United States Patent 10,160,976 (CHROMOBACTERIUM SUBTSUGAE GENOME) - sequence listing, part 4

SEQ ID NO: 1381 - DNA, 2256 bp, Chromobacterium substugae
atgacttggcaatcccgcctcccgctgctggaccgtttcccgcgccacctgagccgagccatcggccgcgagtggtgcgagcgacgcggccggccgctggcgctgctgccctggcaggacgatgtccgccagcgggaggcggaccaatggctacgcgacctcaccgcgttcatgcctcgccacgccttgcccttgggcgcgtgcgaaatggaactggtggagtttgcgaagcagcgcgcgttcgaggcggaccagctgatcggccgcggcgcgaacattgagcagttggagaagtactgcgcccgttacggagtcgccccgccaagcggcaaaaccaaggcaggccgggccgcccgcgtggcgtgcagcctgtggtggcgccgcgcgctgcgccggaccaatgcccgccatagcgaacacctgtctatccagctgggcctggtgcatcgccgccatggcctgtatgccagccatgacgccatcgcccgccgccgcgagcaaaagcgccgcaaccgcggcttgctggaggcgatggccgccatcaacgagctgggccaggaatacacgctgcagcagctgtcggagctgagcgtcagcaatcccaccatccgccgcgccgagctgatggtccgcattgccggtttcgagcatatcgccgtcggcctggagtacgccggcgagttcatcaccattacgtcgccgagcaaataccacccgcgccacgccaagagcggccggcgcaatgccaagtacgccggcaaaacgccaatcgacacccgcgactacctgggcggcgtgtggtcacgcattaccgccgccatggcgcgcgccggcatcgcgccgttcggcttccgcgtggcggagccgcaccacgacggcacgccgcacttgcatgcgctgctgttcatggccaaggacaaggtcaagaaattccgcgccatcgtcgcccgctatgccgtgcgcgaagaccgcgccgagctggggctgaactacctgcaaaccaagggcgaagccatggccgccgcgcgccagttgcgcgccgccggcgccaagggcttgctggccgacatcgccgccaggatcggcaacgaggccgacttctgggccaatcctccccgctgggtgtggaagggcatcaaggcgcgcgtggcattcgaggccatcgactggaagcgcggcaccgccgccggctacatcgccaagtacatcgccaaaaacgtggacggcgccaagcacaacggcgacagcgtgggcatcgactttgaagcccaggaccacgccggccaggccggcaaggacgacggcgcgagcaaggaccaatccgccgccaccgacgccaccgttaccgcgcgccgcgtggatgcctgggccagcacctggggcattcgccagttccagcaagtgggcggcccgccggtgggcgtgtggcgcgagctgcgccgctgggactatcaggccgccgacgccgaagacgtgctgatgcatgccgccatcgccgccgataccggcaactgggggcgcttcgtccacctgatgggcggccacgccatcaagcgcgccgccatgccgctgggcgtggcccgcgacagcgagccggcagagaaccgttacggcgaggatggccagcgccaggtgcgcggcgtggtggagcgcgaaagcggccaattcgcacaaacccgcgtccacgaatggcgcatcggccgcaaggctgacggggttgagggcggcgccgccgccccttggactcgtgtcaataactctacgtttttggaagtgccgccggcagcgccggcccagcccgaatggatgttcggcacggcagaccggattcaggcgaatgtcgaggacgacgacagcgaactgctcaccgccgagcagctggccgcgcgccgcgagtgggacgcccatcagcgctatctgcgggcattccccgaattcgtccacgagtgggccaagcgcggcatcgaggccgccgagctggacgcccagcgccagcgcgaagccagtatcgagcgcgtgcgcttgcagcgtgccaacagccggctggcggccaaccttgggctgacgcaccgcgccggcatcgccgtgatttcccaggtgcgcgcccaggcggaagccgcccgcgccgagcgcgccgcccgccctgcccgcgccagcagcaccgagcgccacgggcctggcatcaccgtttcccagcagctcgcccaggctaccgccagggcgcggcaatggatcaaccaagcaggccgcatctga

SEQ ID NO: 1382 - DNA, 459 bp, Chromobacterium substugae
atggaagcccgtgaaaactacgaatacggcgaggactttgcccgccatgtgatgccagccctgggcgacctgtgccgcgcgccgctggcgccggtagcgccgcgcgacatcgccatgcaggcgctggcccgcatggatgagcgccaggcgcaagcccgccgcccgatgctggagtcggtcgagtcgctgcaagccaaggtgctaaacgcgattcggaaagatgcgctggcgcaaatccaagatgccattcaaacgctggcggaaacggaagcaaaaatcaaccagttgatcgccatgcatgggctggggctgcgcgcgctgttcatgcagcagccgggcaggatgtggtacgacatcgaaacgatgctggacgaaagcaatttggccgaagtccggctcgcgcgcggcggcctgcccttgcatgccgagccgcaggcggtgcgggggcaagcggcatga

SEQ ID NO: 1383 - DNA, 216 bp, Chromobacterium substugae
atgcaacagcccgccgccgccccgcaacagctcgccgcgctgcgcgtccgcaagatgcgctacgtccgcttcagcaatggcgccgcctgctattccgctggctatgccgccggccgcctgcgccagttcagcagccgtcgcgaatggctggagtacctgggcgcggcgctgttcatgctgtcgctgatcctgcttcagctgtatctgccggcgtga

SEQ ID NO: 1384 - DNA, 423 bp, Chromobacterium substugae
atgtgcaaggccatgccgggcggctgggccgccatggcggcggcgctgggcttcagcaaggacggtctggaaaaccgcgtgtacgagcgcaagggccaggcggtttccgtgcatgaggcgatgcagatgcaggcattcagcggttcgtcaatcttcgctgaggcggtggcggcggatagcggcggcgtgttcgtgccgctgccggacatcgacacggtagacgatgcggaaatccagcgcgtctacatggagttggtggatgaagtgggctgcctggcccgtgagtggcgcgaagccacccgcgacggcgaggtggacaagcgggaacgccagcgcctggaggccatccgcgacgccatctgcgccaaggtgacacagatgaatcacctgacgttccaagtcttttgcaataagggggtctag

SEQ ID NO: 1385 - DNA, 123 bp, Chromobacterium substugae
atgctggaaatgacggaaagcaatttgggccgcgaacttgttgatgtggctcttcccatctttctggcccagcacggcctgacagcatgggcagaagataccttgaaagcacttacggcataa

SEQ ID NO: 1386 - DNA, 324 bp, Chromobacterium substugae
atgacgctggaggcgataggcgatccaagcgatctgtcccgatatacgctgatgttcggcgtgccaaacgacgaccaggcggcagtcttggagaatgccgtttacgcggccgggattcttgccaacacctttcctcaatggaatggcaaaaaggacaatgcgatagattggttcaccggtgcgatgcgcaagctgacgcgcaatgttgagaaaaaccgtagcgagcccaagccgataacgctgacgcgggaaggcaagcaagtcaaaatcagcgctatcccgtcgatgggtatggtgttcctgtctgtggaccctcttgaatag

SEQ ID NO: 1387 - DNA, 405 bp, Chromobacterium substugae
atgttatttcctatcgccattgagccaggcgacgccgaccacgcctacggcgtcaccgtgccagacttgcccggctgcttctccgccggcgactccatcgacgaggccatccgcaatgcgcgcgaggctatcgacttccatcttgaagggctggacgaggacggcgccgacatccccaccgccagccaggtggccgaccatgtcggcctgccggaattccagggctatatctgggcggtggtggaggtggatatcgtccgctacctgggcaaggccaccaaggtaaacgtcacgctgccatctaatctgatccgccgcatcgatgcgtttgtggagacgcacaccgagtacgaaagccgctcgggcttcttggcacgggcagcactgaacgagcttagggcttag

SEQ ID NO: 1388 - DNA, 510 bp, Chromobacterium substugae
ttggacgaatacaaaatcttgctagagtcgggcgggcgcgaggaggagttggcgaccgtccgcgacccactcatcgccgccgccgcgttccgcgcgctgctgctgcgcggcgatctgcgcgccagccggccgttggcgattctggagcgcaacggccgcacactgtacgagattccggtcgatggccgagcggatgcagccgctgccgcgctggatctgccgcaggccgcgctggccgacgtgcgccaagccttgcttgccgccggggtggatgccgaggcgctggaattgggccgggcgcagttgaacgacgtgtacaagggattgctgcgcgaggtccgcgacagcgagctggccggtgtgctgcggcgggtgggtctgcccgtcagcaatagccagattctcggctggcgcgtcagtccggaaaaccgcaaattccgccccattgccatgggtgagttgtacgcggtggcggtggcgctgggagagctgcgcaatggtagcgcctga

SEQ ID NO: 1389 - DNA, 705 bp, Chromobacterium substugae
atgcaataccagatccaattcaccgccagccaaaccaaccacgacatgggcgatgacgccgcccaatctttcaccaccctggctaaggctgagcaatacgccgccgagttgaccgaagccctgcgcgagttggttcgagactggtccagcgatgcgggccgggagccgaattacgacgacattcgcgttgaaatagtgcgccaggtgtttgtcgatggcgtggaggtggaagaccaggacgatcaagacatcatcctggcgctgatcgccgccgccgagcgcgcgcacccggcggtgcgctggaatagctgccactctgcggggggcgaaggccgcgcccgcggctggcggttgctgatctgccctcgtggcacgtgggagccggtggcgctggcgcgactggagagcgaggccatgttccagtttttccacgctcaggggttggaatatccttgcaaagtgtcccgccggctggggagcatgcaagagcgccaagcgcgagaggtggctgcgcggaacgcattgttgccggtgcggcaggcggcattccaggcagcccgcgcggtggacgagttgcgccgtcagctggagatagcagaaagccggctgctggatgctcgccggctgcaatcggaaatggaggaccggctggctgcgcgtttggcggctattgccgccagcagctggagtctgccggccatgtga

SEQ ID NO: 1390 - DNA, 1245 bp, Chromobacterium substugae
atgagcctgtttgacgatgctgcggacgtggccggcgccgccggcgacatgctgcaacagggcgcggaccagctggacaacctggccggccagctgggcgatgccgtcggcggcctggccgacagcgccaccaacgccctgggcctgtcgcagcccaagcgtccggcttgccagctgctgctggcagggcgcgacatcaccgccaaactggagccgctgctgatgagcctgacgcttaccgataaccgcggattcgaggccgaccagctggacatcgtgctggacgatagcggcggccagctggacatcccagagcgcggcgtcaccatcagcctggccatcggctggaccggcgcggcgctggtggacaagggcagttacattgtcgatgaggtggagcataccggcgcgccggacaccctcacgctacgcgcccgcgccaccgacctgcgcgccggcatcgccaccaagcgggaaaagagctggcacaagaccaccctgggcgccatcgtcaaggccatcgccaaggcgaacgggctgacgccagccattcccacctggctggcccggcaaaaggtggagcacatcgatcagaccagcgagagcgacgccaacctgttgactcgcctggccaagcaatacgacgcggtggccaccgtcaaatccggccggctagtgttttgcaaggcgggcgatgcggaaaccgtcaccggccaccccttccccgcctgcctgatcctgcgccagtccggcgacaatcaccgcttcagcgtcgccgaccgcaatgcctacaccgcggtaaaagcctactggcacgatacgcgcggcgcgaaaaagggcgaagtcatcgtcaacaaggacaccaagtttgaacgccgcgccaccgtcaccaagctgggccgcaagagcaagcgcaccaagctgaccgccattcaggcgaagggcatcgaacccagcagcgaaaacatcaaggttttgcgccacgtttacgtcagcgaggccaccgccacccagggcgcgaaagccgcctggcagaagctgcaacgcggcgtcgccgaattctccatcaccctggccgaaggccgccccgagctgttcccggagctgcccgcccaggtgcaagggttcaagcccgtcatcgacgccaccggctgggtgctgaagaaagtcacccaccagctgggcgacggcggctataccacggcgctggagctggaggcacggcttgaagatatggcgggatag

SEQ ID NO: 1391 - DNA, 459 bp, Chromobacterium substugae
atgctcaacatcggacccgtcaaaatgccgatgatggcgctgggcctgttcgttttcatgatggacaccctgccctatcaggacttcaagcagaaatacgcctggcgctggccagcgaatggccgcgtcggccgccggccggcgtaccagttcctgggcgcggacgaggaaaccatttccctgtctggccggctgctgccggagttgaccggcggcgatacctcgctggcgctgctgaagctgatggccgatcagggcaaagcttggccgctgatcgagggaaccggcgcgatatatgggttctacgtggtggagtccctggacatcacccgccaggacttcttcagcgatggcaaggcccgcgcgctggatttcacgctggcgttgaagcgcgtggatgacagcctgctggatagcctgggcgcgctggcgcgcggcgtgctggagctggcgctatga

SEQ ID NO: 1392 - DNA, 2871 bp, Chromobacterium substugae
atgaatagccagctgaaactggaagtcatcctggcggccgtggacaagctgacacggccgctcaagcaagccatggctggcaacaaagagctggcgcgcgccgtcaaggaaaaccgcgaccaactcaagcagcttcaagccacgcaaaacagcatcgacgccttccgcaaactcaccaaggaaagcaaggacaccggccaggcgctgcaaggcgccaagcagcggctggaggatgtccgccgccagatggagcaggccggcggcgccagcctcaagctgtcccgcgaatacgccgccgccgagcgcgccgtcgacaaactcaccctcgcccaccgcaagcgcctggatgccgcgcgtgccgcctctggcgcgctgcaaaaggaaggtatcgacacccgccaactgtccgccacggaaaccgccctcgccgcccgtattcaggaaaccaaccgcgcgcttggggcgcgtcaggccaagctggacgccgtggccaagcgacagcgtcagctcaacgatgcgcagcaacgctatggccggcatctcgccatccgcgacaaggtggccggcgctggcgtgaaagccgctgccggtggcgcggcgattggcggcgcgatgtctttgccagtcatggcctatgcggaagcagaagatgcggctacgcagctgaaaggcgcgatgatgcgtgccggtggcgtggttccgccggagtttgagcaaatcaacaacctggctcaaaagctgggcgaccgcctacccggcaccaccgccgatttccagaacatgatgacgatgctgcaacgccagggcatgagcgctcaggccgtcctgggcggcttgggagaagcggcggcctacctgggcgtacagctcaagatgacaccggaggcggctgcggaattcaccgccaagctgcaagatgccacccgcaccagcgaaaaagacatgatgggcctggtggacatgatccaacgcggcttttacgccggcgtggatccggacaacatgctggaagcctacaagggcttgggcgcagccatggacatggtcaaggtcaaagggctggcgggggcgaaagctttcgccccgttcgtcgtgatgatggatcaggcgggcatgcgcggagagtcagccggcaacgccattcgcaaagtcatcgccgccagcctcagcgtggacaagatcaaaaaagttcagaaagaattgcgcaagaaaaagggcattgcgctggacctggactttaccaatggcaagggggagttcggcggcctggacaagatgatggccaagctcagccagttgaaaaaactgaataccgtcaaccgcatagccgtgttgcaggatattttcggaaccgataaggaaaccagcgaagtcctgtccaagatcatcgaaaaaggcaaggacggctatcaggacgtggtgcaaaacctggcggcacaagccagtctgcaagcgcgcgtcaaccagcagcttggcaccctgaaaaacctatgggacgcggcatccggcaccttcacaaatgccatggtccgctttggcgaagccatcggcccggagatgaaagcggcggcggaatggatcggcaccctgtcggaaaagctgggcgcctgggccaaggaaaaccccgagctggctagtgccatcatgaaaaccatcgccatcaccggcctgttgctggccgggctgggcgcgctggcgctggccgccgccgcggtcatggggccgttcgccatgctgggcctggtcatgtccaaggcgtctatcgtcatgggttcgctgggcggcgtgtttgggctgctgcgcggcgcgctgtccttgcttggcggcgggctgggcatgctgggcaaagtgttcatgtgggtgggccgcgtcttcctgatgaaccccattggcctggtagtaacggccatcgccgccgcggcgtacctgatctggaaaaattgggactggatcggccccaagttcgccgcgctgtgggaaggcgtcaaggcggtgttttccaccgtctgcggctggatcaccggctacctgatgaattggacgccggtaggcttcatcgtccgccattgggaagacatctgtaaaatcaccgcagcgctgtgggacaagctgaagggcatcatcgtagccgccgccggcgtgattacggactggttcctcaactggacgccggccggccgcgtcatcaagcattgggacgtgatccagtcggccacacaagtggcctgggactggatcagcgccaaggccaccggcgccggcaaggtgatagcggactggttcctgaattggaccctgcccggcctcgtcatcaagcattgggacaccatcaccggattcctgggcggcatgggcgcgcgcctggcggagctgggccgcatggcgattgatggcctgattggcggcgtgatgagccggctaaccgcgctgcgggataccctgggcggcataggcgataccatggtttcggccctgaagtccgcgctcgacatccattcgccgtcccgcgtcatggcccagctgggcggctacaccatggccggcctggagcagggcatcgacaagggccaggccgggccgctggccagcatgcgcgacaccgccaagcggctgaccgccgccggcgccggcatcgcgctaactgccggcccggcgctggccggctcgctggacaaccggccgcccctgtccgcgcgcgcgccggccatggcggcgccagccccggccatcactatcaacatccacgccgcgccaggcatgaacgagcagcagctcgccgccctggtgcaacgccaggtggcgcaagcgctggcgacgtcagccagccagcaggccgcgcgccgccgctcttacctgggagacatcgactaa

SEQ ID NO: 1393 - DNA, 297 bp, Chromobacterium substugae
atgaacgaaaacaccatcaagctggacgcccccatccaacgcggcgaaaccctgatcgacaccattgagctgcgccgccctggcgccggcgagctgcgcggcctcaagctggccgacgtgctgcagatggacgtggacgccgccatcaagctgctgccgcgcctgtcgatgccggcgctgacggaagaagaggccaagcggctggacccggccgacctgctgcaatgcgccaccgtggtggccggttttttgttgaagaaatcggagctgcaagccagcccctccccggcagcgtag

SEQ ID NO: 1394 - DNA, 513 bp, Chromobacterium substugae
atggccgcactgccgcgcaccctgcgcaagttcaacctgttcaacgacggcatgtccttcattgccgaatgcctgtcggtcaagctgcccgcgctcaagatgaaaaccgaggactactcgggggccggcatgattggcccggtggcgctgctgaggggagtggagaagctggagctggagcacacctacaacggccccattcccgaaatcatcgccaccttcggcgcggataaacacgacgccgccaagctgcgctggatgggcagctatgccaacgaagccaccggggaaagccacgccgtcgaaatcgtcgccgccggccgccataacgatctggaccccggcgacgccaaggccggcgagaacggcgagttcaaagtgaaaaccgacctgacctacctgaaatggatcatggacggcaaagagctgattgaaatcgacatcgtcaacgacgtgttcaaggtggccggccaagaccgcatggcccagcaccgcgccaacgtcggcttataa

SEQ ID NO: 1395 - DNA, 1170 bp, Chromobacterium substugae
atgaaagatttccaccacggcgtgcgggttgtcgaagccaccgccggcacccggaccattcgcaccatctccaccgccgtcatcggcatggtctgcacggcggacgatgccgacgccgacgccttcccgttggacaccgccgtcttgctgaccgacctgaaggccgccatcggcaaggccggcagcaaaggaacgctgcgccgcgcgttgaccgccatcgacgccaacgcccggccgctggttgtggtggtgcgcgtcaaaaccggcaaggacgaggccgagcaatcggcgctgaccatcggcaccacgaccccggccggccaatacaccggcctgcgcgccttgctcaccgctcagcagcgggtagccgttcgcccgcgcattctggtagcgcccggcctggactcgctgcccgtcgccacggaaatggccgccatcgccgccaagctgcgcgccttcgcttatgtctacgcctggggctgcaagaccaaggaagacgtcgctgcctaccgcgccaacttcggccagcgcgagctgatgctgatctggccgcagttcctcgccttcgacagcgccgccgcggccgatgccatcgtcccggtgacggcctgcgccgccggcctgcgcgccgcgctggatgagtccatcggctggcacaagaccttgtccaatgccctggtgcaaggcgtcaccggcatcagccaggacgtgtattgggatttgcaagagcctgccaccgacgccggctacctcaacgaaaaagccatcaccacgctgatccgccgcgacggcttccgcttttggggcaaccgcacgtgcagcgccgacccgctgttcgcgttcgagtcctacacccgcaccgcccaggtgctggccgacaccatcgccgagtcgcatatgtgggcgatggaccagccgatgacgccggtactggtccgcgacatcctggacggcatcaacgccaagggccgggatttggtgacgcgcggctatctgctgggcttcagcgcctggctgccggccgacctcaacagcaaggacaccctcaaggatggccagctgcgcattagctacaaatacaccccggttccgccgctggaaaacctgcaattccagcaggaaatcaccgacgaatacctgatggactttgccgccaaggcggcggcgtaa

SEQ ID NO: 1396 - DNA, 198 bp, Chromobacterium substugae
atgcacagccgcgacgacgcacacatattgaatcccctgattggccaagacccacgcgaaacgctggaaaacctctgcgtctgtctggcgcacctgggccagacgctggccagccaccacgaagacccgtccatccatttcattgccaccagcgccgcggcggcgttgaggtttgaggccgggcaaatcgccgcctga

SEQ ID NO: 1397 - DNA, 618 bp, Chromobacterium substugae
atggctgataaaaaaatcgtgtattgctatagcgccgatactggcgaatatgtcgggcaaacgactgcgcaacgctcgccgctggagctggaggaggaggtctatcttgtccctgcctgggctgctgcggatgcgccgccgccggccgcctcacgtcaggctgcggcgtggcgtaccgacgatggccgcattcccgcccattgcatcctgggcggcggctggcagctgctgccggactggcgcgcggtgccgctgtgggataccgccacggcgcagccgattgccgcgcaactgggcgacacaccgcaggcgctgggcgcgaccgagttggcgccgccgccctttggcgtgtgggatggcgcgagctggcgcgttgaccacgctgccgcgttggctgcacaacgcgccgcggcggaatcggacatcgccgcccggcgcggccaggcggacgccgccatcgtgccgctacaagatgctgctgacctggccatagcaacgccggccgagtccgagcggctggcagcctggcgacgctatcgggtggagttgtcccgagtgccgctgcagcctgactacccggcgacgataacctggccgccggcgccggccgcgcaatga

SEQ ID NO: 1398 - DNA, 1581 bp, Chromobacterium substugae
atggcagacctgaaagaaccggccgagccgaagttcccccccgtttaccaactggaattgaccgaccgcgtcagggccggcgcgggtggcatctcgaaccgccaggctgagcagttggtagagcggacggggtttctcaagaaacgaatcgacgacctggtatccggcgcgctggcagccaaaagcgccgagcgcgccgaccgcctggcctcgccgcgcaacttggccatgacgggcgatggcgcatggtccgtgacgttcgacggcagcggcaatgccagcggcgcgctgacgctggccaataccggcgtcggcgccggcagctatggcatggtgacggtcgatgccaagggccgcgtcatcgccggccggcagatggcggcagccgacgtgccggcgctggactggggcaagatcaccggccggccatcaacaatggagggctatggcattacagatacggcctggcgcgacccggcaaagcgcgtatggggggcggcattccgagccaataagggagaccccgccgatttgggcggcgacactgcgaccgctggttttgcgtttgacgaagatggcgatacggggttgtttgccgcacaaagcagccgaccgggaagcggatcgtccaagctcatgctgaaaatcgacaatatcgaagccctggcggtaggcgccagcggggagatttactccaaaaagtacggatggctacatgagaaatttgcggcggcatcggtggtaagcgatcaggcgggccaagttgcaaacaaagccgacaaggccactacactggcaggctatggcatcaccgacgcgctgccgttgcaggcggatatcgcggcgccggtggatctggacaccttaatcgccagcggcatctaccacaaccccgccaacgacaatgccagcaagggcaagaactggccctgcccgcaggccggccaactgaccgtgagggcggccggcgagatggtctatcacacctatcaggcgtttgccgatgggggattttggcaccgctgccgctatcaggggcgatggaacccctggcggcgcctggcagatgcggccgccattcaggatggcattgccgccgcgacgccgcctggtcaaatcgcctatttcgcccgcgatacgccgccgcctggctggctcatctgcgccggcgctcaggatgtctcgcggactgcctatgccgcgttgtttgctgccattggtgaccggttcggagccggcgacggccggactacgtttggcgtccctgacctgcgaggggagttcgtccgcggttgggatgccgggcgcaacgtcgatgcctcccgtgtgttcgggtccggccaggcgtctcaaaacctctggcacgatcacgccatcccgacacccggctcgacaacgggtggggataccgtgcgcaccgacaacggcggcaccggcttggatgccggcgccaggcacacatccaatgaatttttaaccgaattcggcacgggccggcagcttcgttatgccacgtatggctccggcggcagtgagtcccgcccccgaaatatcgcgctcctggcctgcatcaaaatctga

SEQ ID NO: 1399 - DNA, 561 bp, Chromobacterium substugae
atgagccgccagctgctgccccccaatcgcacgccgctggaagccgcgctggccgacatgctggcgctggacctgaacacgaccgcattgcgcggcctggccgacagcgcgcgctgcccgccggcgctgctgccgtggctggcctgggagcgcagcgtcgaacaattcgatgcggcccggacagaggaggaacgccgcgcgctggtggcgtcgtcggtcgatgtgcaccgccgcaagggaacgctttccgccgtgcgccaggtgttccgcgacctgggcctgggcgaagtgcagattgatgaagggacaggcggctaccgctacgacaacacggtggcctacgacggtttcgccagctacggcgacccggacggctgggcggaataccgcgtccgcatcgacaagctgctgagcgtcgagcaggccgccgccgcccgcgcgctgctggccgacatcgccccggcccgctgcctgttgtgggggctggacttcggcggcgcggaactgatttacaacgacatggccgcctacgatggcggctacacattcggagtggcataa

SEQ ID NO: 1400 - DNA, 891 bp, Chromobacterium substugae
atgacgattgaccttgccgcgctgccgccgccggccgtcatcgagccgctggactatgaaaccctgttcgagcaaaagaaggccaagctgctggcggccgtgccggcagacatgcgcgccgccatcgccgcggcgctgcaactggatagcgaaccggtgacgatgctgagccagctggccgcctacatcgagttgaccgcgcgccagcgcatcaacgacgccgccaaggcgtccatgctcgcctacgcggagaaatccgatctggaccaccgcgccgccgactacggcgtgcggcgcttgctggtgcgcccggcagaccccaccaccacgccgccgacctcggcggaatgggaaacggatgcgcgcctgcgctatcgcgcccagatggcgctggaaggactggccgccggcggcccgcgcggcgcgtaccgctttcacgcgctgagcgcgtcggccgacgtggccgatgtcgatatcgacagcccggcgccgggccaggtgcgggtctggctgctgggccgcgacggcatggccagccaggcgctgctggataccgtggccgccgcgctcaacgcggaaaccatccgcccgctgtgcgacaccgtcaccacggccgccgccacgccgctggcattcgacatccgcgccgacatcacctaccagccaggcggcgaagcgctcagcggcggcgcggccggcgccgcgcagcgcctggccaagatgctggccgcgcgccgccgcattggtggcggcgtgccgcgctctgcgatagacgccgcgctgcatgtggacggcgtggagcgcgtcgccatcgtcagcccggccgccgatgtgctgggccaggtcggccgctatcccgactgcgcatccatcatggtgacgcccgcatga

SEQ ID NO: 1401 - DNA, 357 bp, Chromobacterium substugae
atgagcagctataccggcatgaacccgcaaaccggccacgccatcagcgacgccgaccacatccgccaatccattgcccgcatcctgaccacgccgcgcggctcgcgcatccagcgccgcgaatttggctcgctgctgccggagctgatggaccagccgctcaacggccgaacccgcatgcaggccatggcggccagcgtcatggcggtggccgcctgggagccgcgcatcgagctgtccgccatccgactgatggtgggccagggcgatgccgccggcgcgctgaccatccacatagccggccgccgccgcgacagcggcaagccgctggcttatgacatccctatcaggagctaa

SEQ ID NO: 1402 - DNA, 672 bp, Chromobacterium substugae
atggacgatatcgcagacctcattcgacgcattgaatcgctgattcgctacggcaccatcgccgaagtggaccacgacgcccgccgcgtccgcgtcaaaagcggcgagctggccagcaactggctgccctggagcgtcggccgcgccggcgaaacgcgggagtggaacccgcccaccgtgggcgaacaggttgtgctgctctgccccagcggcgacccggccggcggcttcgcgctgctggccatctattccgaccagttcgacgcgcccagcagcagcccggacgagcatctgcgcgtctacccggacggcgcccgcatcctctacaaccatgccaccggcgccctgtccgtcaccggcgttcaaactgcccaggtgcaggcggcgcagcgcgtcaccgtggattgtcccgagtcgctgtttaccggcaacgtcaccatcaacggccggctgatcgtgctgggcgatgtgctggccaaggcgaaggccaccatagcgggcctgttcagctacctcgccggcatggcgggatcgggcggcgccggcggcgcgtccaccaccatcagcggcaccatcacccatagcggcggcgcgttgtcgtccaacggcgtgacactgcacagccacacccaccccgacccgcacggcggcaatgtaggaaagccccaatga

SEQ ID NO: 1403 - DNA, 495 bp, Chromobacterium substugae
gtggagtggctgaccgaatgtcaccgcgtgctgaaggatggccacctgatcgccgtcttcatcgattggcgacagctgcccaccctgactgatgcaatgcagatggccggcttcatctggcaaggcgtggcggcctgggataaaaccaacggtggcgccagaccgcgccaaggcgggatgaaacagcaggctgaattcatcgtgtgggccagtaagggcaagatgcgcaaggcggatatctacctacccggcgtttttcaaggacgcaagccgaccaagacctaccacatcacagccaagccggtggccgtgatggaggaactatgcaaactggccggcaatggcggccatgtgctagacccgttcgccggcggcggcgccacgctggtggccgcgcgcaatcttggcctatccgccaccggctgcgagctggaaccggatatctaccatcaagcgcaactggcattggaggatggccagccgcttgcggcatag

SEQ ID NO: 1404 - DNA, 447 bp, Chromobacterium substugae
atgagcctggcccgcctggacgccgagctgggcgcgctgatccaccagttggacaccggcgcccgccgcagcctggcccgcgaaatcggccacgcgctgcggcagagccagcaaaagcgcatcgccgcccagcagaacccggacggcagcggcttcgcgccgcgccggccgcaataccgcgagcaaaagggccgtatccgcagccagatgttcaccaagctgcgcggcgcgcgctggctcaagatcgaggccagcgtcggcggcgtggaggtcggctttctgcgccaggtggaacgcatcgcccgcgtccatcaatacggcctacgcgaccgcatcagccgccataccacccgcgaagcgcaatacccggcacgcgaactgctggggctgagccaacctgatttcgagctgatccattccaaggtgttggatcacctcgccaagtaa

SEQ ID NO: 1405 - DNA, 459 bp, Chromobacterium substugae
atgaacaagcccgctgacctgcgccgcgccatcgaggccgctttgcccgagctgcgtgacaaccccgaccgcctcatcatgctggtggaggatggcggcatcgtcaccgcgcctggccggctgaacttcggctatcgctacaagctgaaaatcaccgtcatcgactttgccggccacctggaccagctcatcatcccgctgcgggcctggatcgagcagaacgagccgccgctcatgcaaaacccggaggcgctggagcggggtttccgctttgcggtggaatggatcagcgccaccaccgtggatgtgcagttcaccctgcaactgtccgaaggcgtgcgcgtggaagtcggcgaggatggcaacatcaccgccacccactatggcgagccgcccgcgccgtgggaaggcgacgcaatggccggccggctggtcattgtcgccgaggcgcagccatga

SEQ ID NO: 1406 - DNA, 207 bp, Chromobacterium substugae
atgactgacttttacgaccgcgcccaggcgctggagcaacgccagcgcgatgaagccctcgcccgccaattcgccaacctcgcccacggcgccagcctgagccactgcgaagattgcgccgagccgatacccgaagcgcgccagcgcatcgtcgccggctgcacccgctgcgtgcagtgccaggaagatcatgaacaagcccgctga

SEQ ID NO: 1407 - DNA, 513 bp, Chromobacterium substugae
atgatcgccgacgccctgctgacttttgcccgccgcgtcctggccgtcgtcctgatcgccgccacgctgctggccggcttcgccctctggcagcagcacgccttgcttcagcgccaggcggccgacctcgtggccgcccaacgcgacgccgccacgctggccgaacgcaaccgcgcccagggcgagcagctggccgcccaggatatcgacatcaagctgcagatcgccgccggccgcgagctggccggccagctgtccgccctatcccgtcaacacgccgccgccgcggcgaaactggaggccgccatccatgccacgcctgacgctgtcgcctggggtagcgctgctatccctggccctgttgcccgcctgttcgacaccaccggccgcgccgccgcgcccgctgctgatccagcgctgcccgacggtgacggcttgcgcgctgccggcgctggcgccgacgaccaaccaacagctggccaacagctggcaacaacaccgggcggcgcttga

SEQ ID NO: 1408 - DNA, 792 bp, Chromobacterium substugae
atggatctgatgaagaaaggcgcgcacggcctggaagtgcaagcgctgcagcagcggctggtcgccgtgggcgccaagctggccgtcgatggctggtatggcgacgcaaccgaagccgccgtcgcctcgttccagcgccgcgccggcctggtggtggatggcatcgccggcggcaaaaccctggccgcgctggcgggccaagtcggcccgcgtcgtcagctgggcgaagccgaccttcaggaagccgccgagcggctgggcgtagaggtggcggccgtcaaagccatcaatgcggtggagtcgcgcggctctggttttctgtcggatggccgccccgtcatcctgctggagcgccacgtcgcctatcagcgcgccggcaagcaggccgacagcctggccgcgcaatacccggccgtctgcaacaaggcccgcggcggctacgccggcggcgcggccgaatgggcgcgcttcgccagcttggccatcatgggcggcgaacagctggccatcgagtcttgcagctggggcgcattccagctcatgggctatcactggcagcggctgggctatgccagcgccgccgaatggcgcttggcgatggaatccggcgagccggcccagctcgacgccttcgtgcgcttcatcctggctgagcctgcattgttgaaagccctgcaagccaagcgttgggcggatgtggcccggctctacaacggcccggcctaccgcgaaaacctctatgacgccaagctcgccgccgcctacgcgcgggcggaaaggctggccgcatga

SEQ ID NO: 1409 - DNA, 267 bp, Chromobacterium substugae
gtgctgctggcctttcagcgcggccccagccagcaccggccgtgggccagcctgctggcttacctgctcaccgtcgccgccggcgcggtggcggtgctgcgcctgttcggccgcccggagctggccgagctgccgcagctgttcatcaacctggcgctattgctggcgctgatcgcccagcgcggcaacgtggtggagctgtaccgcaacgccggcccgcgccagtcgcggctggccatcctgctgaggaaagccagatggatctga

SEQ ID NO: 1410 - DNA, 369 bp, Chromobacterium substugae
atggcagaacctgtaagcagtaccgccaccagcgcgacgctggccaccatcgccggcctggccctgacgccaggcattgacgccgctgtcgtgctgggcgctttcgccggcgctgccgtgttcgtgctgagttcggacagcctgagcctggccaaaaaggccggatttttcgtggcgtccttcatcgccggctgcttggctgccgtcagcgtggccggcgtgctggcgcgctggctgatcgccgatatcagccccggcgtctgcgcgatgctggccgccgccctcgccgtcaaattgctgcaatggctgattaaaagcgcggacgaccccgccgcggccctgcgcaacctgaaggggggcggcaaatga

SEQ ID NO: 1411 - DNA, 216 bp, Chromobacterium substugae
atgcgcgccgttcgcgccattcagggcgacaccgtggacgccatcgcttggcgcgtctacggccaaacccgcggcatggtggagcggctgctgcaacacaaccccggcctggccgacctgggcgtcgtcttgcccagcggcacgctggttcagttgccggacctgcccgcggcggctcccgcgacagccaaaaccctcatcaacctatgggactga

SEQ ID NO: 1412 - DNA, 483 bp, Chromobacterium substugae
atgcagatcaacagcgtcaacaccgtcaacgcctcgcccaccaacgccccggcgccgggtgatggcccagccattcagaccagccgcttctggccggacgtcgagcctggccatttccgcgccgcgatgcgctatgacggcaccgtcaccgccgtccgcctgcgccacgcgctggtggaggccgtcgccgccgtcaatggcgagctgttcggctggcgcgtggccagcggcgcgcagcggctggccgacatcgaggcggagcagatcgacggcgagtccatcctggtgcagcgctggcgccgggccatctacgccaccgccgcggccgacctggccgagcgctaccggagttttgacgccaccggcgccggccgccagcgcgccgacgatctggacgacaccgccgaccagctgcgcgccgacgcccgcgccgccatccgcgccatcctgggcgccggccgcgtcacggtggagttgatctga

SEQ ID NO: 1413 - DNA, 675 bp, Chromobacterium substugae
atgagctacgcccgcgcccacttccagcgggccagcgcggccaaggcttcggccttggccgtggaagacggccccatcaactgcaccgcctacgagctgatgctggtcaagctggccgaggacaagcggcgcttgaagcaagtccagtccatggaaggcaaggcggcggtaaagcgcgaagtcctgcccgattacgccccttgggtggacggtgcgctgcaaggcggcaagggccagcccgacgacgtgctgatgacggtcctgatgtggcgcatcgacgccggcgactacaacggggcgctggatatcgccgaatacgcgctcccccacggcctgccgctgccggaccagttcagccgcaccacggccacggccgtggccgaggaaatcgccgacgccgccaagcgcgcccgcgacggcaagcagccgttcgagcttcagacgctgacctacacctccgagctgaccgacaagcacgatatgccggaccccgtgcgcgccaagctgctcaaggaaaccggcctggccatggcagaagcggagccggccgccgcgctggagcatctgcgccgcgcccagcagctgcatggcgccgtcggcgtcaaaaaggacatcgagcgcatcgaacgcaccatcaagaacagcgccccgccgcccaccagcggccaggcgtaa

SEQ ID NO: 1414 - DNA, 1035 bp, Chromobacterium substugae
atgaaaaccgatacccgcaacgtgttcacccagctgctggagcagatcgccaagctaaacggcgtcagcgccgccgccgtcgaaaagtccttcagcgtccagccgaccatccagcagaagctggaaacccggattcaggaatcgagcgaattcctgtcccgcatcaacatcaacggcgtggatgagctggagggcgaaaagctgggcctgggcatcttcggcaccgttgccggccgcaccaaagtgacgccgaccaacccgcgccgcccgcgcaaccttggcgacctgaacagccataaataccgctgcgaattcactgagttcgacaccgccattcccttcgtccagctggacgcctgggccaagttcccggacttccagaccaagctgcgcgacgtcatcgtcaagcagcaggcgctggaccgcatgatgatcggcttcaacggcgtcagtgtggcggaacagaccaaccgcgagaagtttccgctgctgcaagacgtcaacaagggctggctgcagcaataccgcgaacatgcgccggagcgcgtgatggcggaagtgaagaagggttcgggcaaggtcatgatcggggcaaaggaaaagggcggcgactacgccaacctcgacgcgctggtgatggatgccgtagcgggtttgattgacccggccatggcgggcaatcccgacttggtggtggtcctgggccgcgacctgctgcatgacaagtacttccccatcgtcaatcaggacaacaagcccagcgaacagatggcggccgatgtcgtcatcagccagaagcgcgttggcggcctgccgcctgtttccgtgccctacttcccggccggcgcgatgctgattaccccgctgtccaatctgtccatctactaccagagcggcagccgccgccgtcacctgcgcgaagagccggattacaaccaagtggccaactacgagagcaacaacgaagcctacgtggtggagcgctacgaggccggctgcctggtggaaaacatcgagatggtgaacgcggcatga

SEQ ID NO: 1415 - DNA, 813 bp, Chromobacterium substugae
atggcaagcaaggcaaagaaattccgtgtcgccaccgaaggcgccaccaccgacggccgcaacatcgagcgcagctggatcgagcagatggcaaaaaattacgacccgaagaaatacggcgcacgggtcaatatggaacacatcaagggatatacgccggacagtccattcaagcgctatggcgatgtgttggcgctgagcgcggaaaaagtggaagacgacaagctggcgctgttcgctgttatcgatccgactgacgatcttgtcaaaatgacaaacgacgatcgccaaaaagtttactcatccatcgagatcaacccgaagtttgccgacaccggcgaagcctatctggtcggcctggccgtcaccgacgatcccgccagcctgggctgcgacatgctgaagttcagcgcaacagccaagagcaacccgctggcaaagcgaaagtttgacccggacaacctattttccgaagccatcgaattcaccctggagctggaagacgacaacgccggcgcgctggccggcttcagcgacaagatcaagggcttgctgggcaaattctccagccgccaaaccgccgacaccgccgagctgtccgccgccgtgcaaaccatcgccgaaagccaggccggcgtgctggagcaattcagcggcctgccgaccgcggccgagttcaaaaagctgggcgagcagtacggccagctcaaaaccgaccatgacgccctggtggccaaactgagcagcgaatccgccaccgccccccgcagcgccgccaccggcgccgccgccgaagtcgtcaccgactgctga

SEQ ID NO: 1416 - DNA, 1767 bp, Chromobacterium substugae
atggatacccaaacccttatttctgaactcgatctagacccgcgccggctggcccgcgccctctattggcagggctggcgcatcgcgcgcattgccgaacatgtcggcgcgcggccggcgacggtgcatagctggaagcggcgcgacgcctgggacgattccgacccggccgaccgcatcgcgtccaccatcgaaacgcggatgcagcagctgattctgaagaaggacaaggaggggaaggacttcaaggaaatcgacttgctcggccgccaggtggaacgcctggcgcgggtgggcaagtacagccagaccggcaaagagtcggacctgaacccgaacatcgccaaccgcaacgccaagcccaagcgccagccggaacgcaacccgattaccgatgagcacaaggcgcagctggtggcggccttcctcgatggcatgttcgactaccagaagcactggtacagggcagggcagcaagagcgcatccgcgacatcctgaaaagccgccagatcggcgccacctactatttcgcgcatgaggcgctgattaccgcgctggagaccgggcgcaatcagatcttcctgtccgcttccaaggcccaggctttccagttccggtcctacatctgcgatttcgtgaaggatgtcaccggggtggagctgaagggcgaagtcatcaagctgcccaacggcgcggagctgtcattcctggggacgaacagccgcaccgcccagggccgccacggcgacttgtatgtggatgaatacttctggattccgcgctttctggagctgcgcaagctggccagcggtatggccagccagaagatgtaccgccagacctatttctccacgccatccgccatgtcccatgagggttacaaggtgtggaccggcgagcatttcaaccgcggccggcccaaggcggaacacatcaagctcgacgtgtcgcaccaggcattggccggcggcgtgcgcgggccggatggccgctggcgccagatcgtcaccatcatggacgcgctggccggcggctgcgatcggttcgatctggatcagctgcggccggagtacagcccggaagagttcttgcagctgttcatgtgccagttcatcgacgacggcgccagcgtgttttccttcgccgcgttgcagcgggcgatggtggatgcctgggaggtgtgggacgacttcaagccgttcgccgcgcggccgttcggccatcgcccggtttggcttggctatgaccccagccacaccggcgacagtgcggcgctggtggtgctggcgccgccggccgtaccgggcggcaaattccgcatcttggagcgggcgcagttcaaaggcatggattttgccaagcaggccgacttcatccgccagcagacccagcgctacaacgtcgaatacatcggcatcgacacgtccggcctggggacgggcgtctatcagctggtgaagcagttccggccggacgcggtggcaatcagctacagcgtcgaggtgaaaacccgtctggtgcttaaagccttggacgtgatcaatagcggccgccttgagtacgacgccagccacaacgacatcgccgcggccttcctgtcgatcaagaaaaccagcacccccagcgggcgcggcgtcaccttcgccgccggccgctccgaagaaaccagccacgccgacctggcgtgggccaccatgcacgccctggcgcacgagccgctagagggcgcgacttccaccaataccagcttcatggagattttttga

SEQ ID NO: 1417 - DNA, 1065 bp, Chromobacterium substugae
atgggcaaacctcgccgcagccacaaccattcccaaaccccggccgcgccggcggcgccatcggctccggccagcacgccgctggcgttttccttcggcgagccagtgccggtgctggaccggcgcgaaatcatggacctgttgcagtgcgtggacaatggccgctggtatgagccgccggtcagctgggacggcctggcgcgcagcctgcgcgccaacgtccatcacgccagtgccttgatggtgaagcgcaatgtgctggtcagcaccttcaagccgcatcggctgctgagccggtcggcgttttcggcctggctgatggattatctggtcttcggcaatgcctatttgcaggccatcaccaatcggctgggcggcgtgatggagctgaagccggcgcgcgccaagtatgtgcgccgcgccaaagacctggccggcttctggtgggtgccgggtttcgaccaggagcagcaattggccggccaggtgctgcatctgatggacgccgacatcaatcaggaggtgtacggcctgccggaatacctggccgcgctgcaatcggcctggctcaacgagtcggctacgctgttccgccgcaagtactacctgaacggctcgcacgccggcttcatcctgtacatgacggacccggccaacaatgagcaggacatcgacaacctgcgcaaggcgctgcgcgacagcaaggggccaggcaacttcaaaaacctgttcatgtacgcgcccaacggcaagaaggatggcttgcagctgctgccgatcagcgaggtgacggccaaggacgagtttctgaacatcaagaacgtgacgcgcgacgacgtgctggccgcgcaccgggtgccgccgcagctcttgggcgtgatccccggcaacgccggcggcttcggcgacgcgcccaaggcggctggcgtgttctacgaaaacgaaatcaagccgctgatgatgcgcttgcaggaggtcaacgagtgggcgaagctgacgcttggactcggagaggacattatccagtttggcgagtatgcgctggctgccgcggcggcggcctga

SEQ ID NO: 1418 - DNA, 378 bp, Chromobacterium substugae
atgagcctttacgccgaactggtaagaaaagccgccgatcaataccgcagccagctggacgcgatatacgcccagcagaagctcatcaatcgagccgaccatatcgccggcctgcttctcaaagccggcttgcaggccaaggcccaggcggacgactgctaccatcctttcattctgctgcaactatccgaagaactgcagccgctgcaaaagaccgtgctgctatacgtaagcaatgtattggaatgccagatagaagaaaacggcagccgggacggcctggattgcttcctgattccgcccggcggcgacaccggccaggcccgactgcccttgctggtggaatccgcgcaaagcgtgatccttccaacaggataa

SEQ ID NO: 1419 - DNA, 684 bp, Chromobacterium substugae
atgcagccatccttcaccatcgttttcgcgctctatccacgcgtcacccagctcgacttcaccggcccgcacgaagtgctggcccagctgcccggcgcccgctgcgtgctcgcctctgcgcagggaggcaatatccgcaccgacagcggcatcaccttcgccgagcttgcccggctgcaagacatcgccggctgcgacctgctatgcgtgccaggcggcctgggcaccattgccgcgctggaggaccaggactttctcgcgcaattgcgccgcctgtccgcatcggcccgctacaccgcttcggtttgcaccggctcgctgctgctgggagcggcaggcttgctcaaaggcaagcgggcagcatgccattgggcctggcgcgactcgttggccgcgttcggcgcccagcccgatccggcgcgcgtggtggtggacggcgatatcatcagcggcggcggcgtaactgccggcatcgacatggcgctgaccctgatggccgaaatcgccggcgccgactacgcgcagacggtgcaactggcgctggaatacgcgcccgcgccgccgttcgccgccggccgtcccgaggatgccagcccagccatactcgcagcggccaggaccaggctggacgcgctgcgcgaccagcgcgaagccgccatcatccaggccgccgcccggctgtga

SEQ ID NO: 1420 - DNA, 933 bp, Chromobacterium substugae
atggcccatcgcattgcggtattgatcttccccggtttccagctgttggacgctagcgggccgaccgcggttttcgaagcggccgggcgttaccgctgcgatgcttaccgggtgcgggcggtggcgcggcaagccggcctggtgcgcagttcctccgggctgacgctgcaggccgaggcatgcgatgccgtcagcttgccggataccttgctggtggcaggaggagaaggggtggcggcggcatgccgctgcccgcaaacgctagcctggatccagcgttgcgaggcggcgggctgccgagtggccagcgtatgcaccggggcctttttgctggcagaggccggcttgctggccggacggcgcgcgactacccattgggcgcacgcagccgatttcgcccgcctatacccggacacgatgttggaaaccgaccggctgttcatccgcgaaggccagatctggacggcggcgggggtgacggcgggcatagacctggctttggctttagtggccgatgatctgggggcggaggtcgcgcgccagagcgcgcagcgcctggtggtgtattgccagcggcctggcgggcagtcgcaattttcctccttgctggagatgcagcagccgggcgggcgttttgccggattgctagaccatgtgcggcgcaatctcggttccgcctggacggtggcggagttggccgagcgcagctgccttagtccgcgccatttttcgcgcttgtttctggaggaggtgggcgtgccgccggccaaggcggtggagcgcttgcgggtggaggccgcgcgcggcgcgctggaaagcggtgaggcttccttgcagcgcctggcgcggcaatgcggcttcggtgaggtggagcggatgcggcgcagctttctgaggatattgggcgcgccgccatccgcgctgaaacggtag

SEQ ID NO: 1421 - DNA, 82 bp, Chromobacterium substugae
gccccggtggtgaaattggtagacacaagggacttaaaatccctcggcttaggctgtgccggttcgaccccggcccggggca

SEQ ID NO: 1422 - DNA, 363 bp, Chromobacterium substugae
atgatcgcggatcacatctacggcaagttcgacgtgtttcgccagttccggccgctggctctgggcatccacgagagcctgatcgcagccttgtcgcagttcgagccggcgctgatttcccgcgtcgtcgccaatcactgccgcaagccgcgctacctgaaatcgctggcccgcggcggcaagcgcttcgacctgaacggcaagccgcagggcgaagtcagcgccgaagaaaagcgcgccgccgagctgcagatgcaaccgaaaaaccagccggcggccgatgccgccgttgcggagcccgttgcggctcaggtcgagatgtccgccgtagccgcggaacaaccgggccaggccgaatcctga

SEQ ID NO: 1423 - DNA, 1905 bp, Chromobacterium substugae
ttgccgaccatgagtgcacagaaagaaaccctgggttttcagaccgaagtcaaacaactgctcaagttgatgatccactccttgtactccaacaaggaaatcttcctgcgtgaactgatctccaatgcctccgacgccgccgacaagctgcgtttcgagggcctggccaagccggagctgttcgagaacgatgccgagctgaaaatccgcatcggcttcgaccaggatgcccgcaccctcaccatcgccgacaacggcatcggcatgagtcgcgacgaagtggtgtcgcacatcggcaccatcgccaagtcgggcaccaaggccttcttcgaacagctgtccggcgacgagaaaaaagacgcccatctgatcggccagttcggcgtgggcttctattcggccttcatcgtcgccgacaaggtgacgctgaccacccgccgcgccggcgaaaccgaagccgtccgctgggagtcgcaaggcgaaggcgagtacacgctggaaaccgtggaaaaggccgaacgcggcaccgagattgtgctgcacctgaaggaaggcgaagacgagctgctgaacgactggaagctgaagggcatcgtccgcaagtattccgaccacatctccatcccgatcgagatgaagaagggcaatagctacggcgaaaacggcgaagtgatcgtcagcgacgacatggaggcggtcaactccgcttccgcgctgtggacccgcgccaagaacgacatcagcgacgagcagtaccaggaattctacaagcacgtcgcccatgacttcaccgagccgctggcctggagccatgcccgcgtcgaaggccgccaggaatacaccgagctgttgtacatcccgtcgcgcgcgccgttcgacctgtacgaccgcgaacgcaagcagggcgtgaagctgtacgtgcgccgcgtcttcatcatggaagacaccgaaaagctgatgccgcattacctgcgcttcgtgcgcggcgtgatcgacagcaacgacctgccgctgaacgtatcgcgcgaaatcctgcaggaaagcaaggacatcgacgccatccgcaatggctgcgtgaagaaggtgctgggcctgctggaagatctgtcggccaaccagccggaaaaatacgctgcgttctggaaggagttcggccaggtgctgaaggaaggcgtaggcgaagaccacgccaacaaggagcgcatcgccaagctgctgcgtttcacttccaccgcgtcggaaggcagcgagccgacggtatcgctggccgactacatcggccggatgaaagaaggccaggacaagatctactacatcaccgccgacacgctggccgccgccaagaacagtccgcacctggaagtgttcaagaagaagggcgtggaagtgctgctgctggtcgaccgcgtcgacgagtgggtgaccggctcgctgttcgaattcgacggcaaggcgctgcagtcggtggccaagggcgcgctggatttgggcgcgctggaggacgaagccgacaaggaagcgcagaagcaggtggaagaggcgtccaagccggtggtggataaggtgcaaaaggcgctgggcgagcaggtgaaggaagtgcgcgccaccgcccgtctgaccgagagcccggcatgcctggtggcgggcgagcatgacatgagcgcccatctggagcggatgctgaaggccgccggccagaaggtggaaggcagcaagccgacgctggagatcaacccggagcacgtgctggtgaaaaagctggccggcgaaaccgacgaggcccgcgccgccgacttggcccaggtgctgtacgaccaggcgctgctggccgaaggcggcaagctggaagaccctgcctccttcgtcaagcgcatcaacaagctgatgctggagctgtcggcctga

SEQ ID NO: 1424 - DNA, 417 bp, Chromobacterium substugae
atgagcgagatcagagccttgcctggcgcatacccttgcctgtgctacgacgacgcggtggcggcgctggcgtggctggagcgggtgttctgtttccagcgccgtttcgcggcgatcgagaacggccgggttcatcattcggaactgagcctgggcaacgcggtggtcatggtgtccagccccaatcccgaccgcaactggatcggcgccggcagcctgcctggcctcgcccaggcgctatgcgtttacgtggcggatccggccgcgcattacgcgcgcgccagcgcgcaaggcgcggaaatcgtgcaggggctgaaaaaagaggattacggcgcgcacggttatctggcgcgcgatctggaaggccagcaatggtatttcagcgattatctgccgggcgaatactgggaatcctga

SEQ ID NO: 1425 - DNA, 600 bp, Chromobacterium substugae
atgcccgcgctgttgaaattcgccaccgccgagccgctgctgctgctgatagacatgcagcaggcggtggatcaccccagctgggggccgcgcaacaatccgcaggcggagcaggtgtgcgccaagctgctggccgcctggcgcgaacgcggcctgcctatcatccatatccgccacgactccaccgagcccgactccactttccggccggatcggcccggccacgccttcaagacggaaaccttgccgctggcgggcgaaaccgtggtcgccaagcagaccaacagcgccttcatcggcaccggcctggaggccatgctgcgcgagcgcggctggcgggagctggtggtggccggcgtcagcaccagcaactcggtcgaggcgacggtgaggatggccggcaatctcgggtttgcggtcagcctggtcgaggatggctgcttcgccttcgacaagaccgactggcagggaaggccgcgccgcgcggaggaggtgcatgcgatgagcctggccaatctgcacggcgaatactgtcgggtgtgcgccagcgccgacgcgctggccgcgcttggtaataatgccgaggccggcctgtcgtaa

SEQ ID NO: 1426 - DNA, 1404 bp, Chromobacterium substugae
atggatctccatggtttgggcggcgagctgcgccggctgtccgggctggagacggctgaagcggcggccgcgctgctgcgcctgctggcgcgctgggaagaggcggcgcccaataccgccgcgctgcgcgcattgctgctggctggcgtggatttgcagcggcgcagcgaagacgccggcggccatggcgctttgacctgcccgttgtggcggcggctgcatgaggcgtgcaaacgcttggcggcagcggccggcgcgcagccggccggcttgttcgatcatggcaggccgcagcaggaggcgctggcgctggctttttccagcgcctggcaatcgctgcgcgcccacgttctcggctattcgcctttgtgcgccgggttttggcgcgattgccaccgcctgttcgccatggcgggccagcgcggctgggagcggcgcgcgcccggagacggcgccgtcgcgctgggcgattggtaccggcgcttgctgttgctgggcatgagcgccagcaaccggctggatgcccagcgccagcatctgctgctggactgggtggaaacatgcggttccgccttgaaactgacgccttggcgcggcgaagcgccggaacagccctgctggctggtgccggcagaggcagacatgcccggacgcttcgtcgatggcgaaagagaggcgccgggcgacgcgcgctggctggcagatgccggccccgcgctggagcgtctgcgcgggcaagcggaacggcgccggcagcagctgggcatggtcgaatggcagatgcttgcgcggctggaagcggagtggcgcagtccgccgcaacgccggcatccgcggctgaaccagcgcaacggccagcgggtggccttgctggcgggcttcgatgcttgctggcgtctggcgcgggcagggctgccgccggacgccgcagaggcggcggatctgttgctgggcaatctgagcgcgtccggcatgcggctgtgcggcgatttcggcccgcaggaggtgcaggccggcagcatcgcgatggtcaagcgccgcggtttcggctggcagctgggcctggtgcgctggatcagcctgccgggcggcgagcagccggccgagtgcgggatagagttcgtcggcaagcggccgatggcggtggaggcggcggcggtgaccagccacccggacggcggcatggaaaacggcctgctgctgcatggcgaacgcgatttccgccagcgcggcgtgctggcgctggccgggcggcgctatcaggcgatgcggcagttcaaggtgcgcggcgccggcggcgaatggctggtgcgggcgcaacggctgctgcagcagaccggtagctgccagctgatcgaggtgcggctggaggaaacgctggcgcgccgcgacgccgcatcatga

SEQ ID NO: 1427 - DNA, 426 bp, Chromobacterium substugae
gtgccgccacacaaaccgccacttctgccctgcctgtttttcctgctgagcctgctggccggctgccacaccgattccgcgcccggcgtcgccgagcttgccgccgatcagccgcggccggcggagccggaccgccgccacttctggcgcaagcgcgagatcgaagaagtcagccgccgcatcatcgaacgggagctggggcatcgggaagcgttgcgcttcgccgccgaccgcgacggcggcgacggccgctaccgtttccgcctgatcgcaccgccgcgcggccgcctgggctttgccagcgacgaagcggccttcgcggtgcaggcggacctggccaacggcaggatcatcagcatccactgccgccaaaacgacggcagccagcggatgtgttatccctaccgcgatcccgcgcgctcatga

SEQ ID NO: 1428 - DNA, 948 bp, Chromobacterium substugae
gtggcggcacgctggcgttgtctgaagggaaagcctgttggtgcgcgcggcggaaaagttcaaccgccgcgcgcggcgctagctggtatccttgtcgccatgaatgccgtgcccgatacccccgcgtccgccgatggccccgatttccagctgaccgcgcccgaactgccgcccagcgtgccgatcgcccatgtgttcggccagccggtgctggaagtgccgcaagacctgttcatcccccccgacgcgctgcaggtgatcctggaaagcttcgaaggcccgctggatctgctgctctacctgatccgcaagcaaaacctcgatgtgctgaacattccgatggcggccatcaccgtccagtacatgtcctatatcgacgtgatgcagcagggccggctggagctggcggcggaatacctgctgatggcggcgctgctgatcgagatcaaatcgcggctgctgctgccgcgcccgcaactggacgaagacggcgagccggacgacccgcgcgccgaactggtgcgcaggctgctggagtacgagcagatgaagctggcggcgctggagctggacaagatcccgcaggccgaccgcgatttcgcctggctggcggtgctggtggaacagtcggccgagcagcggctgcccgatgtcagcgccggcgatctgcgccaggcctggatggccatcctgtcgcgcgccaaacaccaccgccaccacaaggtggaaaaggacgagttgtcggtgcgcgagcagatgagctggatcctgcgctatctggatggccgcgaatacgtgccgttcgaggagctgttcgacatcgccaagggcgtcgcccacctggtggtcaatttcatcgccgtgctggaactggtgaaggaggggctggtgaaggtgagccaggatgcgccgtaccagcccatctatgtgcggatcgcgctggcgtga

SEQ ID NO: 1429 - DNA, 795 bp, Chromobacterium substugae
ttggtcctggcccagcagcccgcgccggaagacgcctcccgccgcatgccgctgctgcggcagtggtgcggcgaagcggcggcggcgggcggccatctgctgctattgcccgagctgtggtctaccggctacgcgccggagaaaatgcatgaggtccacgcctgggatgacgatgcgccggacttggacggcgtcgcccggctggccgccgattttgggctcgccatcggcttcacgtatctcgcccgccgcggcggcgcgctgcgcaaccgcttgcgcctctatggcgccgacggccggctggcgctgcaatacgacaaggtccacatctgcggcttcaccgacggcgccgaaacggcgctgcaaggcggcgacggcttcgtctgcgccgatatcgcgctgggcggcgaaacggtgcgcgtcggcgcgatgatctgtttcgaccgcgaatttcccgaggccggccgcgcgttgatgcggcaaggggcggaattggtgctggcgcccaatgcctgcccgatgcgggacgatgccgagctgggcgacgcgcgcctgcagcagctgcgcggccgggcgctggaaaaccgcttcgccgtcgcgctgtgcaattacccggcgccgcaatacgatggcggcagcggtttgatcgacgcgcgcggccgcctgctggccttggcgggaagcgagccggccttaacgttggccgagctggacctggcggctttgcgccgctggcgcgccgagcaggacgaagtgtggggagaggccgccttgcggccggactgctaccgctga

SEQ ID NO: 1430 - DNA, 468 bp, Chromobacterium substugae
atggcgcagcatcaagcggaagtgatctggcggcgcggcgagcaggatttcctggaccgccgctacagccgcaagcatgtgttgaagttcgacggcggcgctcaggtggccggatcgtcggcgccgcaagtggtgccgccgccgtattccgacccggccgcggtggacccggaagaggctttcatcgccgccttgtccagctgccacatgctgtggtttctggatatcgccgcccgcgccggtttccgcgtcgacgaataccatgacgtcgccgtcggcgagatgggcaagaacgaggccggaaaggcctgggtggccagggtgacgctgcagcccggcgtctcgttttccggcgacagattgccgacggccgagcagttcgagcagctgcatcacgccgcccatgccgaatgcttcatcgcgcattcggtgaagaccgaagtgctgtgccggccccggctggcctga

SEQ ID NO: 1431 - DNA, 462 bp, Chromobacterium substugae
atgaaaaaactgttgatcctgctgacgctgctgttgggcagcgccgccgcgctggccggcgattggccgtacgacgaaaaggccgacgcccaggcggaattgcggcagactctggcggccgcgcagcaaagccatctgccggtgctgctgatcctgggcgccaactggtgtgaggactgccgcgcgctggacgcggcgctgaaaagcgggaagagcgccgaactgatcgcgcgcgccttcaaggtggtgaaggtggatgtcggcaatttcgaccataacctcgacatcgacgccgcttacggccacccgatcgccaagggcattccggccgcggtggtgctgtcgccggacaacaaggtgctttacgccacccgcgccggcgaactggccgacgcgcgccggatgagcgaaaccggcatttatgaatttttcgaacgggtcagccgtcaggccgcgcagtaa

SEQ ID NO: 1432 - DNA, 405 bp, Chromobacterium substugae
gtggcgtttgacgatacttttcgccttagcgcccacgcggtgatcaccgacgccgccgggcgggtgctgctgctgaaggcgacctacggcgacctggcctggggtctgccgggaggcgcgctggaaccaggcgaaaccattcatgaatgcgtggcgcgcgagtgccgcgaggaactgggttgggaagtgtcgccgcgctatctgagcggcgtctattaccacagcgcctaccattctcaggccttcgtattccgctgcgaggcgccggcgggcacggagcccaggctgagtgccgagcattcggcctggcgctatttcgcgctggacgagctgggcgcggtgcagcgccgccgggtggaagactgcctgaactacgccggcgcggcggtcagcggccgcttctaa

SEQ ID NO: 1433 - DNA, 825 bp, Chromobacterium substugae
atggaccccatcctgctgttgcattccctgatcatgggcctggtggaaggcatcaccgaattcctgcccatctcgtccacaggccacctgatcctcgccggcgacctgctggatttcctcgacaaggacaagcgcgacgtctatgagattttcatccagctgggcgcgatgctggcggtggtgtgggaataccgcgccaaaataggccacaccgtggccggcgcggcacgtccaggcggcgagcgcaacctgctgctcggcatcgtcatcgccttcatcccggccgcaatcgccgggctgctgttttccaagcagatcaaggccgcgctgttcaacccggtgtgcgtggccatcgccttcatcgtcggcggcctgatcattctgtgggcggagaggcgcgagcataagatagcggtggaaacggtggacgatctgagcctgaaagacgcgctgaaagtgggcctgtgccaatgcctggcgctgataccgggcaccagccgctccggcgccaccatcatcggcgggctgttcctcggcctgtcgcgcaaggcggctaccgagttttccttcttcctcggcatcccgacgctgggcgccgcctcgctgtacagcctcttcaagcaccgcgacgcgctcagcgccgacgatatcggcgtgttcgccgtcggcttcgcagcgtccttcgtgttcgccttcctggccatccgcgcgctgctgcgcttcatctccacgcacagcttcgcggtattcgcctggtaccgcatcgccttcggcctgatcgtgctggccagttggcaaaccggctgggtgaactggagcgcctga

SEQ ID NO: 1434 - DNA, 1629 bp, Chromobacterium substugae
atgctgcatcagcttaccgtgcgccaaaaacttctcagcggcttcgccttgctgatcctgctgctctgcgccgtggttctcatcgcctatagcaagctggtcaccatccagaacaatgtcagcgagatcaaggaggaccgctatcccaagatcgtgctgtccaaccgcctgtcgctcaacctgctgcaaatcggccgcgaagtgcgtgacggcgtgttggcccgcgatccccaggccatagagcgccacatccgcaatgtcgacgccatccgcgccgccaaccaggccgatctggacaagatggagccgctgctgggccaacccgaaggccgtgcgctgttcgccaagatccgcgatgcccaaaaccagcaacgcccattgttcgaaccgctgtacgcgctgatgcgcagccaccagagcgacgccgcgcgcgagctgctggacggcaagttcgcgccggccaacaacgccttcatctctgcgctgcaatcgctgcgcgaacggcagcagggccggctggaaaaatcgatggacatcgcgcaggactccagccagcaggcgatcaacatcctgctcaccaccgctctggtttcgctattgcttgccatcgccgtcgcgctgttcatctccgacctgatcacctcgccgctgcgcaagtcggccagcttggtgcatcagatccgcgaaggcgatttgtccggcgtctccgaaccgatccccgacgcgcgcgacgaagccatggtcatcgcccgcgacatccaggaaatgcgcgagggcctgcgcgcggtggtgctgagcatccaggagaacgcccaccaggtgtcggattcggcgcgcgccttgtccggcatggcgcagcaggtggccaccggcgcccagacccaggcggaagccaccacctccgccgccgcctcgatcgaacagctgacggtcagcatcaaccaggtggccgacaattccagcgaagcatccgagcaggcgcagaccgccggccagctggccaaccgcggcggcagcgaagtgctggagtcggtgggcaagatacgcttcgtcactacctcggtagacgacaccgccaagcagatgaacagcctgaccaaggaagtgcagcagataggcaatatcgtcacggtgatccgcgacgtcgccgatcagaccaatctgctggccttgaacgcggcgatagaagcggcgcgcgcaggcgagatgggccgcggcttcgcggtggtggccgacgaagtgcgcaagctggccgagcgcaccaccacctcggcgcaggaaatcaccacgatgataggctcgatccagcaaggcgtcggccaggtggtgcacagcatgggccagagcctggactgcgtggaaggcgtgtccggcaccgccgagcaggcctcgcactcgatgcgcgagatagaaaacagcgccgacaccatcatgcgcaccatccacagcatcaccggcgcgctgaccgaacagcgcagcaccagcctgagcctggcgcaggacatggaaaaagtgtcgcggatggccgaggaaaacaacgccaccgtgcaggaactggccaccacctccagccagctgagcacgctgtccgccaatctgcaaaacgtgaccacccgcttccggctgtaa

SEQ ID NO: 1435 - DNA, 1452 bp, Chromobacterium substugae
atggcggcttcaccgtacgccgccccgcccatgtccaatcacacattcttctggcacgactacgaaaccttcggcgccgtgccgcgccgggataggccgtcccaattcgccggcatccgcaccgacgccgaactgaacgaaatcggcgagccggtgatgctgtactgccggcaggcgcccgactacctgccgacgctgcaggcctgcctgctcaccggcatcaccccgcagctgtgccagcagcgcggcgtcgacgagcacgaattcgccggcgtgatcgaacgggagctggctacccccggcaccatcggcgtcggctacaattcgctgcgtttcgacgacgaagtcacccgtttcctgttctggcgcaatctgatcgacccctacgcgcgcgaatggcagaaccattgcggccgctgggacttgctggatctggtgcgcgccacctatgcgctgcgcccggaaggcatcgtctggcccgaacacgaggatggccggaccagcttcaagctggagcacctgtcggccgccaacggcctggcgcacgaagccgcccacgacgcgctgtcagacgtgcgcgccaccatcgcgctggcgcggctgatccgccagcgccagcccaagctgttcgactactacctgacactgcgcaagaaagacgcggtcaaggtccagctatcgctgcacgccccgaagccggtgctgcacatctccggcatgtacggcgcggaacgcggcaacctggccgtggtctggccgctggcggcccacccgaccaacgccaacgaagtcatcgtctgggacctggcgcacgacccggccgagctgcgcggcctgacggcggaagccatgcgccaacggctatttagccgcggcgaagacctgcccgaaggcgtggcgcggctgccgatcaagaccatacacatcaacaagtcgccgttcgtggtggccaacctcaaagtgctgagcgcggaacgcgccgagcgctggggcgtggacatggccgccatcgcgcgccacgctgaagccgcgcgcgcgctgcccgacctcgcgccgctgtggcgcggggtgttccagcgcgaagccggcgaagcgcgcgacgtcgacgaaaacctgtacggcggcttcgtttccaacaacgaccgcaaggtgttgcagaaaatgcgccggctgtcggcgctgcaactggccggcgaaatggggctgttcgaagatccgcagctcaccgagctgttgttccgctaccgcgcccgcaacttccccgccacgctgtccggcgccgatcaggcgcgctggcggcagtggtgccgggaacgcctccagcgcgccgccccggccttccatgaggagctggcggcgttgcaggcatccgacctttccgccgcccaacggcagctgctgcaacaggtagccgactacgcggccagcctgcaggcttcgctgcaagcctga

SEQ ID NO: 1436 - DNA, 789 bp, Chromobacterium substugae
atgggcaacgaagccgtattgctgagcgtcaacaaacagggcgtggccaccgtcacgctgaaccgcgccgacctgcacaacgcgctggacgacgaaaccatcagcctcttggccgccacgctggaaaccctggccgaggacaacgacgtgcgggcggtggtcctgaccggccagggcatcagcttctccgccggacacgaccccgattggctgcgccggctgtcgcagttttccgccagcgagctcaaccgctacgcgcagcagaccgcccgcctgctgcacaccctggacaccctgcccaagcccacgctggccagagtgcagggctcggccttcggcctgggcatggcgctggtggcctgttgcgacatcgccatcagcgtgtccgaagcgctgttcagcctgtccgatgtccgcttcggccagattccggcgttggccgcgccctacctgatccgcgcgataggcgaacgccccacccgccgctactgcatcagcgccgagcgcttcaacgccggcaaggccaagcggctgggcctgatccaccaggtggtggaaaacgacgagctggacgcggcggtcgaacacatgcagggccagttgctgctcaacagcccggcggcgatgcgcgccgccaagcacctgataggcgagatcggccagcacgacatcacgccgcaggtgatgcagcagtgcatagagcacagcctgacggtgcggatgagcgacgaaggccgcgaaggcatgctcgccctgatcgaaatgcgtaagccggcctggatggaataa

SEQ ID NO: 1437 - DNA, 789 bp, Chromobacterium substugae
atgccgtacgcccagatagacggacgccaggtgtactatgaggaaagcggccatggcggccagacactgctgctgttcaacggcatcaccatgtccacggtgggctggacgctgatgctgccgcagctggagccccacttccgcctgctgcggatggattttctcggccagggccagagcgaccatccgccggccgagtactaccaattgaccgagcaggccgacctcgccgccgccctgctggagctgctggggatagaacaggtctacctggtgggcctgtcctacggcggcatggtggcgcagcacttcgtccatcgccacccggaacgagccagccggctgtttctcgccggcaccctggcctgggccgacagcgtcaacggccatatcggcgacagctggatcgccgccaatcagcaaggcggactggacctgcgctaccaggtcagcattccctggctgttttccagccgctttctggccagcaacgccgcgatgctggacgatctgaaaatgctggccggcatggtggactgggacgcggtgatccgcctgatcgacggcgtgcgccagcacgatgcccgcacctggctgcccgagctgcaactaccggtgcatattctggtcggagacgaagaccggctgacgcccttgtaccaggccaagctgctgcacagtctgattccggacgccgaactggaaatccttcccggcgccggccatgtactgcacatcgaagccgtggaggctttcgcccgcggcatcattcaattcagcccgcgctga

SEQ ID NO: 1438 - DNA, 1827 bp, Chromobacterium substugae
atgcaaagttgcgtcgagccgctcctgtcccccggggcggcgggctggtgtcaggagctggaggaaatcataggcaggcgcaggctgcagccggtattccagcctatcgtcgatctggacgccggcagcatactgggctacgagggcctgatacgcggcccgtccgacagcgcgctgcattcgccgatgatgttgttcgaggcggcggagcgctgccggatgacgctgccgctggacctggcctgcctcagggcctgcgccgagcgcttcgcggaactggcgctgccgggcctgctgttcgtcaacctccacccggagacgttgttgctgcaagggcagcgaccggcttccatcctgggatttctcggccagatcggcctggacagcaagcgcgtgatcctggagttgaccgaaacccggccaaacggcggctatctggcgctgcgcgaagtcaccgccgcctgccggcagggcggcctgcgcatcgccttggacgacctgggcgaaggcttctccaatctcaggctgtggtcggagctgcggccggatttcgtcaagctggacaagcatttcgtgcagaacatccatctggacccgctgaaggagcagttcgtccgctccatcgccgacatcgcccgccagtccggcgcgctgctggtggcggaggggatagagtcggcggcggagctgcgcacgctgtgccggctgggcgtccgctacggccagggctatctgctggcccggccccaggccaatcccgcccacgcgttgcccttgccggcgcacgcgctgccatgggccggcaaccgccgccagggcctgcgcaaccagccgctggcgcgcgacctgctgctggaggtggcgccgctggaggcgcgggtgcccaatgaaaccgcttaccgccgtttcgccgaccaccccgactgtttcgccattccggtggtggaggatggcgtgccggtggggctgctgcgccggcaccacctgctggaaagcttcgccaagccgttcaaccgcgagctgtacggcaagaagccctgccacctgatgatggacaagcagccgttggtggtgagcgccgacttgaatgtgcatgaattgtccagcctggtggtggcggccgagcagcgctatctggtggacggcttcatcatcacggaaaacggtcgctacctgggcatgggcaccggcttcgcgctgatgcgcaagatcaccgagctgcagctgtcggcagcccgctacgccaacccgctgaccggcctgccaggcaatgtgccgatcaacgaggccatcgaccgcctgctgggcatgaagacgccgttcgtcgcagcctacgccgacctggatcatttcaagccgtttaatgatttatacggctatgccgccggcgacagcctgatcgaactggtggcccacctgttgctggagcatgccgacccggaacgcgatttcgtcggccacgtcggcggcgacgatttcgtggtgctgatgcaggcggacgactgggaggcgcgcctgcaatgcgtgctggaagcgttcggccggctggccgcgccgcatttttccgaccgccaccgcgaggccggcggcttcgaggtggcggcgcgcaacggagagacagtgttccagccgctgacgacgctgtccctgggcgtggtgcgggtgaagccggggcagttcggcagccatcacgagatcggcgcggtgaccgccgaggccaagaagcaggcgaagaaaatccccggcaacagtctgttcgtcgaaagacgccagcccgccgcgacggttgccggctgccgttgcggcctggccgagggcggcggctga

SEQ ID NO: 1439 - DNA, 1176 bp, Chromobacterium substugae
atgtcggaagccattgcggccacgaaacacgtagcagccattcccgccgtcggagccgtttccggcgtcagcggcaacgaggaggccccgtatctgaagattgccggggtggtgaagaaattcggcgaacacctggcggtggatcacatcgacctagatatccgcaaaaaggaaatcttcgccctgctgggcagctcgggctgcggcaagtccacgctgctgcgcatgctggcggggatggagacgccaagcgccggccgcatcattcttgacggccaggacatgcatggcctgcagccctaccagcgcccggtcaacatgatgttccagaactacgcgctgtttccgcacatgacggtggaagagaacgtggccttcggcctgaagcaggacaaggtgccgagggacgaaatcgccgagcgggtggcgaaaatgctggacctggtgcagatgcgcaagttcgccggccgcaagccgcatcagctgtccggcggccagcagcagcgggtggcgctggcgcgcagtctggtgaagcggcccaagctgttgctgctggatgagcccctgggcgcgctggacaagaagctcaggcagcagacccagctggagctggtcaacaccatcgaggcggtcggcgtcacctgcatcatggtgacccacgatcaggaagaagcgatgacgatggccagccgcatcggcatcatgagcgagggcaaactgctgcaggtgggcaccccgaccgagatctacgaatacccgaattgccgcttcaccgccgaattcatcggcgagaccaatatgctggagggcgcggtggcggtggacgagccggacttggtggagatccattcgcaggagctgggcggcgtgatccgcatcgagcacggcatcacaggccccaagggcatgcacgtgtgggccagcgtgcggccggaggacgttcggctggacaagcagcccttgccgcccggccccaaccgcgccgccggcacggtgcaggatatcgcctacctgggcagttattccatctatcacgtgaaactggcgggcggcaaggtcgtcaaatccatcgtgccgtcgtcgcgctggtgcgacgccaatgaaacgccgcccacctggggagacccggtgcatgtcagctggcgctccgacgcgccggtggtgctgacccagtaa

SEQ ID NO: 1440 - DNA, 1290 bp, Chromobacterium substugae
atgctgcgcttcgctcatcagccgcatccgccatcctattacgccgccaccgcccacgcctgggatccgcagccgccgctgcgcggcgaggccagctgcgacgtatgcgtggtgggcggcgggctggccggcctgtcggcggcgctgaacctgcgcgagaagggtttctcggtgattctgctggagggctcgcaggtcggcttcggcgcctccggccgcaacggcggccaggtgatcgccggctatgccggcgatatcgacggcatccgccgccagctgggcgacgaggcggcgcgggcgctgtgggacatgtcggtggaggcggtggagatcatcgacgagcgcgtgcggcgccacgccatcgcctgcgactggcagcgcggctacgtcaacgtggcggtgaagccccgccatctgcgggaattggaagactggcagcgcgaggccgagcagcgctacggctatggcggccagcagctgtgggaccgcgccgcgctgcgcggcaaactggccagcgaacgctaccagggagggctgttcgacccgcgctccggccatctgcacccgctcaactatacgctgggcctggcccgcgcggcgctgggggccggcgtggccatccatgagcagacgccggcactgcgcatcgagcagggcgacgcgcccaaggtattcaccgagcacggcgtggtccgctgccgccaactggtgctggcctgtaattcctacatcggcgcgctggcgccgcagctggagcggcgcatcatgccggccggcacctatgtgatcgccaccgagccgctgggcgaggcgagggcgcgcgcgctgatcgccgacaatatggcggtgtgcgacaccaatttcgtgctcgactactaccggctgtcggccgaccaccgcttgctgttcggcggcaaggtcagctattccggccatgagccgcgcgacttggccggcgccatgcgcgccgacatgctgcgcgtgttcccgcagctggcggacgcgcgcatcgattacgcctggggcggcttctgcgacatcaccgccaaccgcgcgccggacttcggccgcttgtcgggcaacgtctattacctgcagggtttctccggccacggcgtcaacatcaccggcctggccggcaaggtggtggcggaggccatcgccggcacctcgtcgcggctggacctgttcggcaagatccgccaccgcgactttcccggcggcaagttgttgcgcaccccggcgctggtgttagggatggcttactaccggatgcgggattatctgtag

SEQ ID NO: 1441 - DNA, 972 bp, Chromobacterium substugae
atgatggatgtttccctgcaggagcccatcatgcgtctactcccttacgccgttctgcttgccgcgctggcgaggcccgccctggccgcgaacgagttgcccatcgcgctggataccgccagtggccgcatcgccggctcgctgctgttgccggagccccccggcaaagcgccggtcgcgctgatcatcgccggctccggcccgaccaaccgcgacggcgacaatcccggcctgccctatggcagcggcggctatctgaaacagctggctcaggccttggccgacgccggcatcgcttcggtacgctacgacaaacgcgccataggcgaaagccgcgccgccggcctggacgaggcggcgctgcatttcgacgactatgtggacgacgcggccggctggatcgccaagctgaaaaccgacccgcgcttctccaaggtcgcggtgatcggccacagcgaaggctcgctgatcggcatgctggccgcgcagaagcagaacgccgccgcgttcgtttcgctggacggcccggcgcgcaacgcggccgatttcctgcgagcccagctggcgccgcggctgccggaagatctggccaagcagagcgagcggattctgcaagcgctgcggcagggccgcgaagccgacaacgttccaggcccgctgctggtggtgtaccgccccagcatccagccctatctgatttcgtggttccgctacactcccaccgaggccatccgcgcgctgaaagcgccgacgctgatcgtgcagggcggcgccgaccatcaggtgccgaaggcggaaggcgaaacgctgcacgcggccaagccggacagcctgctgcaaaacatccccggcatgaatcacctgctgcgcgacgacgatccgcagcatcaagcctcctacggcgcaacgccgcagccgttgtcgccaacgctggcgccatcggtcattcgctttctgaaacaggccctgtag

SEQ ID NO: 1442 - DNA, 1899 bp, Chromobacterium substugae
atgaaacgcatccaacgcctgcccgaccacctcgtcaaccagatcgccgccggcgaagtggtggaacgccccgcctccgcgctgaaggaaatgctggaaaacagcctggacgccggctcgacgcggatcagcgtggatctggcccagggcggcatcaagctgatccgcgtcaccgacaacggcgccggcatcgcggcggatgatctgccgctggcgctggatcgccacgccaccagcaagatcgcctcgctggacgacctggaatcggtgggcacgctgggcttccgcggcgaggggctggccagcgtggcgtcggtgtcccggctgacgctggtgagccggccgcaagacgccgatcacgcgcaccagatcatcgcgatagacggcacgctgcacccggtggagccggccgcacatccgcacggcaccagcgtggaagtggtggacctgtatttcaacaccccggcgcggcgcaaattcctcaaaagcgaaaacaccgagtacgcgcactgcgtggccactttcgagcgcatcgcgctggcgcatccgcatgtcgaattcctgctgcgccacaacggcaaggtagcgtggcggctgccgtcgcaaagcgccgaggaccgcgtggccgcgctgctgggcaaggacttcgtcgccgccgccattccactggacagccaggccggcccgctggcgctgaccggcttcgtcgcctcgcccacttactccaaggccagccgcgacgcccagtacttctacgtcaacggccgcttcgtccgcgacaagaccgcgcagcacgcgctgcgccaagcctaccgcgacgtgctgcaccacgaccgccacccggcctacgcgctgttcttcacgcttgagccgtccggcgtggacgtcaacgtgcacccgaccaagatcgaagtgcgcttccgcgaatcgcaagccgtgcaccaattcctgttccacagcgtgcacaaggcattggccggcaccagcgccggcgccgctccgacggtgcaggtggaaggcgcggaaccggccgcgccgcagctgccgcgcggcgagtcggccccgctgttcgccagccccgcgccccggccggcctcgtccggcgcgccggcgccgcaagctttccagtatcatcaacagcagtccatcccgctgaacgtcgcgcgcgaggccgtaggcgtctacgacaagatgttcggcggcctgcgcgaggaagaacgggcgctgtcgcgcgccgagccggccatgccctcccccgccgcgccgctgccgcacccggcgatgctggcgatgccggcgcacgacgaaaacggcatcccgccgctgggcttcgcgctggcccagctgcacggcgtctacatcctcagccaatgcgccgaagggctgattctggtggacatgcacgccgcccatgagcgcatcgtctacgaacggctgaaaaccgcgctggaatcggacgccatcccgcagcagccgctgctgctgccggtatcgttcgccgccgaccgcatggaagtggccaccgcccacgagcacggcgaagagatgaaacggctgggcgtggagctggcgccgctgtcgccgacgcagatcgccgtgcgcggcgtgccggtgtggctgaaggatggcgatccggtggacttggcgcgagcggtgctgaaggacgtgcgcgagttcggcctgacccaagtgctgaccgaacgccgcaacgagctgttggccaccatggcctgccacggcgcggtgcgcgccaaccgccagctgaccctgccggaaatgaacgcgctgctgcgcgacatggaagccaccgagcgctccggccagtgcaaccacggccgccccacctggagccggctgaccatgcgcgacctggacaagctgttcatgcgcgggcagtaa

SEQ ID NO: 1443 - DNA, 645 bp, Chromobacterium substugae
atggaagttctgacattcctgatcgatttcatcctgcacatcgacacccacctggcgcaactggtggccgactacggcccgtggatctacgccatcctgttcctgatcatcttctgcgaaaccggcctggtggtgacgcccttcctgcccggcgactcgctgctgttcgtcgccggcgccttggccgcgatgggcaagatggacgtgcacgcgctgaccgccacgctgatcgtcgccggcgtgctgggcaacaccgccaactacaccataggccgctacctgggcaaagcgctgctgcagcgctacccgcgcctgatcaagcaggactacctggacaagacccacgccttcttcgcgcgccacggcggcaagaccatcatcttcacccgcttcgcgcccatcctgcgcaccttcgcccccttcgtcgccggcatcggcgcgatgggctaccgccagttcaccatctacaacgtggccggcgcggtgatctgggtggccagcttcgtctacgccggctacttcttcggcaatctgcccttcgtgcgcaagaacctggaactgctggtgctgggcatcatcttcgtctccttcctgccggccatcatcgaattcgcgcgccacaagcgcgcggccgccaggtcgtaa

SEQ ID NO: 1444 - DNA, 936 bp, Chromobacterium substugae
atggagcttttccgcatcaaacgggacatcccgttcatgagctacggcaggctcaccacggcgatctcgctggtgaccttcatcgtggcggtattcttcctggccgcccgcggcctgaatttcagcgtggaattcaccggcggcaccgtgctggaagtgcaataccagcaatcggccgacctggacaagatccgcgacaccgtcgaccagttgaagctgggcgaagccaccgtgcagaacctgggcagcagccgcgacgtgatgatccgcctgccgaacaagccgggcaccagctcggcccaactgtccgacaaggtgatgggccagctcaaggccgccgacagcagcgtgcagctgcgcaaggtggacttcgtcggccccagcgtcggcgccgaactggtgtccagcggcctgaccgccgtcatcctggtgtgcctgggcatcatggcctacctggcgctgcgcttcgaatggcgcttcgcggtggcggccatcatcgccaacatgcacgacgtggtgatcatcctcggctgcttcgccttcttccgctgggaattctcgctgaccgtgctggccggcatcctggcggtactgggctactcggtgaacgagtcggtggtggtgttcgaccggatccgcgaaaacttccgcaagcctggcatgcgcggccaggcggtggcctcagtcatcgacaacgccatcacctcgacgatgagccgcaccatcatcacccacttctccaccgagatgatggtggtgtcgatgctggtcttcggcggcccggcgctgcacggcttcgcgatggcgctgaccatcggcatcctgttcggcatctactcgtcggtgctggtggccagcccgatcgcgctgtggctgggcgtgacgcgcgagcacatgatcaagccggtgaaaccaaaagaggaagcggtagtctga

SEQ ID NO: 1445 - DNA, 1851 bp, Chromobacterium substugae
atgaaccgctaccctctctggaaatacctcgtcatcgtggtggcgctgatcctgtcggcgatctacacgctgcccaacttctacggcgaaacccccgccgtgcaggtctccagttcgcgccagtccgtcccggtggacaccgcagtgatggcgcgggtggaagaggcgctgaaagcgcagaacatcagtcctgacggcgtcttcctcgacgccgccaacagcctgaaagtgcgcttcaaggacaccgacacccagttgaaggcgcgcgacgccatccagcacgcgctgggcgacaactacatcatcgcgctgaacctgctgccggcctcccccgcctggctgaccgcgctgcacgccaacccgatgttcctgggccttgacctgcgcggcggcgtccacttcctgctggaagtcgacatgaaggccgccaccgacaagaccatggaacgctacgcaggcgatctgcgccgcgagctgaagaacaagcaggtgcgctacggcgccatcaagcgcaacggcaatacgctggaagtgcagctgcgcgacggcgacacgctgaaatcggcgcaggacgtggcctaccgcacgctgccgaccctggcggtgcaaaccgacgacgccagcaaccgcctgctgctgacgctgaagccggaagaaatcaccaagatccagagcgacgcggtcaagcagaacatcatgacgctgcataatcgcgtcaacgagctgggcaccaccgaacccatcatccagcaggcgggccccaaccgcatcgtggtgcagctgcccggcatccaggacaccgcccgcgccaaggacatcatcggccgcaccgccacgctgcaggtgcgcatggtggaagacgaccaaggcaagctgagcgacgccgtcaacggcaacgttccctctggctacgaactgctggacgacgtcagctcgcgcggccacagcaagatcctgctgaagaacgacgtggagctgaccggcgacaacatcaacgacgccaaccccagcttcgaccagttcggcgcgcccgccgtcagcatcacgctagacagcgccggtgccgccatcttccgccagctcaccgccgagaacgtcggcaagcgcatggcgatggtgctggtggaaaagggccgcaaggaagtggtgaccgcgccggtgatccgccaggaaatcggcggcggccgcgtggaaatctccggcagcatgaacgccgccgaagccaacgacaccgcgctgctgctgcgcgccggctccctggccgccccgatgaacatcatcgaggaacgcaccatcggcccgagcctgggccaggaaaacatcgagaagggcttccacgccacgctgtggggcttcgccgccatcgtcgccttcatggtgctgtactacggcctgttcggcgtgttctccggcctgtcgctggcgatcaacgtgttcctgctggtggccatcctgtccgcgctgcaggccacgctgaccttgcccggcatcgccgccatcgcgttggcgctgggcatggcgattgacgccaacgtgctgatcaacgagcgcatccgcgaggagctgcgcaacggcgtgccgccgcactcggcgatccaggccggctacggccacgcctgggccaccatcctggactccaacgtcaccacgctgatcgccggcctggcgctgatgatcttcggcaccggtccggtgcgcggcttcgccatcgtgcactgcctcggcatcctgacctcgatgttctcggcggtgctggtttcgcgcggtctggtcaacctgtggtacggccgtcgccgcaaactgacctcgctggccatcggccaggtgtggaaaccggaaaacaagggctaa

SEQ ID NO: 1446 - DNA, 324 bp, Chromobacterium substugae
atgttcatctcccccgccttcgccgccggcagcggcagccccgccggtttcgacctgatgggcttcctgcccatgatcgtgattttcgtgctgttctggttcctgatggtgcgcccgcagcagaagcgcatgaaggaaacccagaagatgctgtcggaaatccagaagggcgatgaagtcgtcacccagggcggcatcgtcggccgcgtggcgaaaaccagcgagcagtacctgaccctggaaatcgccaacggcgtggaaatcaccgtgcagcgcggcgccgtcagcgccaagctggaaaaaggcacgatgaagtccctgtaa

SEQ ID NO: 1447 - DNA, 1116 bp, Chromobacterium substugae
atgctgaagtttaccgtacacaagacctccggcggcgcgcggcgcggtacgctggaactgaaccacggcaccgtggaaaccccggttttccagccggtgggcacttatggctcggtcaaggcgatgagcccggtcgagctcaaggatatcggcgccgagatcatcctgggcaacactttccacctgtggctgcgccccgggcttgagatcgtcgagcaattcggcggcctgcacgaattcataggctgggaccgccccatcctcaccgactccggcggcttccaggtgttcagcctgtccgacatgcgcaagctgaccgaggaaggctgcaccttccagagcccgatcaacggcgacaagctgttcctgagcccggaaatctcgatgaaaatccagaccgtgctcaattcggacatcgtgatgcagctggacgaatgcacgcccggccaggtggaccacgccaccgcgcagaaatcgctgcagatgagcctgcgctgggccgagcgctcgcgccgcgccttcgacgacctgaaaaacccgaacgcgctgttcggcatcgtgcagggcaatctgtacaccgacctgcgccaggagtcgctggaaggcctgctgcaggttggcttcgacggcatcgccattggcggcctgtcggtgggcgagcccaagcctgaaatgtaccgaatgctgactgaactgaaggacatgctgccggccgacaagccgcactacctgatgggcgtgggcacgccggaagacctggtgcacggcgtggccaacggcgtcgacatgttcgactgcgtgatgccgacccgcaacgcgcgcaacggctggatcttcacccaatggggcgacgtcaagatcaagaacgcgcgctacaaggacgacaagcgcccgctggacgaggcttgcgagtgctacacctgcaagaacttcagccgcgcctacctgcaccacctgcaccgcgtcggtgagattttgggcgcgcgcctgaacaccatccacaatctgttctactaccaggaactgatgcgccaggtgcgcaagtccatcgaagacgaccgcttcgaggacttccgcctggagttcgccgccaaccgcgcgcgcggcgtcaattaa

SEQ ID NO: 1448 - DNA, 74 bp, Chromobacterium substugae
aggcacgtagctcagttggttagagcaccaccttgacatggtgggggtcgttggttcgaatccaatcgtgccta

SEQ ID NO: 1449 - DNA, 1902 bp, Chromobacterium substugae
atgccagacattcgcttgccggacggctctatccgttctttcgacaaaccggtaacggtccatgaagtggccgcctccatcggcgccggcctcgcgcgcgccgcgctggcgggccgcgtggacggcaagctggtggataccagcttccagatcgacggcgacgccgatctggccatcatcaccgacaaggacgccgacggcctgtccgtcatccgccactccaccgctcacttgctggcttacgctgtcaaggagctgttcccggaggcgcaggtgaccatcgggccggagatcgaaaacggcttctactacgacttcgcctacaagcgtccgttcacgccggaagacctggtcgccatcgaaaagaagatggccgaactggccaagaaggacattccggtggagcgttacgagctgccgcgcgacgaggccatcgcctacttcaagtcgatcggcgaggcgtacaaggccgagatcatcgaatcgatcccgcagggcgaagtgctgtcgctgtaccgcgagggcgaattcaccgacctgtgccgcggcccgcacgtgccgtccaccggcaagctgaaggtgttcaagctgatgaaggtggccggcgcctactggcgcggcgacagcaagaacgagatgctgcagcgcgtctacggcaccgcctgggccaagaaggaagatctggaagcctacctctatatgctggaagaggcggaaaagcgcgaccaccgcaagctgggcgtgcagctggacctgttccacctgcaggacgaagcgccgggcatggtgttctggcatccgaaaggctggcagctgtggcagagcgtcgagcaatacatgcgcgacaagctgaaccgcgaaggctataaggaaatccgcaccccgatgatgatggacgcccatctgtgggagcgttccggccacgccgccaactaccgcgagaacatgttcatcaccgaatcggaaaagcgcgactatgcggtcaagccgatgaactgcccgggccacgttcaggtattcaacagcggcctgcgctcttatcgcgacctgccgctgcgctacgccgaattcggttcctgccaccgcaacgagccgtctggcgcgctgcatggcatcatgcgcgtgcgcggcttcgtgcaggatgatggccacattttctgtaccgaagaccagatcaaccaggaggccaaggacttccaccgcctggtgatggaagtgtacgaccgcttcggcttcgacaaggtgtcgatcaagctggcgctgcgtccggaaaagcgcatcggcgaagagtccacctgggacaaggccgaggaaggcatgcgcgaggcgctgcgcgcctgcggcgtcgagtgggaagagctgccgggcgagggcgctttctacggtcccaagatcgaataccacatcaaggacgcgctgggccgctcctggcagtgcggcaccctgcagctggacttcatgctgccggagcgcctggatgccgaatatgtggccgacgacaacagtcgcaaacgcccggtgatgctgcaccgcgcggcgctgggctcgctggagcgcttcctcggcattctgatcgaaaaccacgccggcgccttccccttgtggctggctccggtgcagctggtggtgatgaatatcaccgaagcgcaggccgattatgctgttgaagtggccaaatctcttgagaaacaaggcttccgtgttgcgcttgacttgagaaacgagaagatcggctataaaattcgcgaacacagcctgcagaagttgccgtatcagatcgtgatcggcgacaaggaaaaggcaggcggtctggttgccgtgcgcgcccggggcgaagatctgggccagctcacgctggatgcgttcatcgcgcgcctcaaggctgagatgcctgaggcctga

SEQ ID NO: 1450 - DNA, 411 bp, Chromobacterium substugae
atggctctggccgaagagggtgatgtggacctggtggagatttccccgaccgctcagcctccggtgtgcaagctgatggactacggcaagtacaagtacgaaatgtccaagaagcgccacgaagccaagcagaagcagaaacaagttcagatcaaggaaatcaagttccgtccgggcaccgacgatggcgattacaacgtcaagttgcgcaacctggttcgtttcctgactgaaggcgacaaggccaaggtcactctgcgcttccgcggtcgtgagatggcgcaccaggatatcggcctcgcgctgctcaagcgcgtggaagccgatctggcggaagtgggcacggtggagcagttcccgcgcctggaaggccgccagatggtgatgatgattgcaccgaagaagaaataa

SEQ ID NO: 1451 - DNA, 198 bp, Chromobacterium substugae
atgccgaaaatgaagaccaagtcgagcgcgaaaaagcgtctcaaagtactgggtggcggtggtttcaagcgtgcacacgccttcaagcgtcacatcctgaccaagaagaccaccaagaacaaacgccagctgcgcggcacctccatggtggacgcgaccaacgtggcgtctgttcgcgcaatgatgccctacgcttaa

SEQ ID NO: 1452 - DNA, 360 bp, Chromobacterium substugae
atgccacgcgtaaaacgcggtgtaaccgcacgtgctcgtcacaagaaaatcctcgcactggcgaaaggctatcgcggccgccggaagaacgtctatcgcatcgccaaacaggcggtgatgaaggcgggccaatacgcctaccgcgaccgtcgtcagaaaaagcgtcagttccgtcaactgtggatcgctcgtatcaacgcagctgcccgtgaaaacggcctgccgtacagcaagttcatgaacggtctgaagaaagccggcatcgaaatcgaccgcaaggtcctggccgatctggccgtgttcgaaaaggccgcttttgcgcagatcgtcgaaaaggcgaaagcaagcctcgctgcttaa

SEQ ID NO: 1453 - DNA, 987 bp, Chromobacterium substugae
atgaacaacgtcgacgcgattctccaagccggccaggcggcagtcgccgccgcggccgatctgatagagctcgagcaggtcaaggcgcgctaccttggcaagagcggcgagctgaccgaactcctcaagcaactgggcaagctggcgccggaagagcgcaaggccgccggcgccaccatcaatctggccaagcaggcttttgaaaccgcgcacaacgacaagcgcgatcagctcaacgccgccaagctggaagcccagctggccgccgaggtgctggacgtgacgctgccgggccgcggcctggtcggcggcggcctgcacccggtggcgctgacgctggagcgcatcgccggcctgttccgcaccatgggtttcgaagtggccgacggcccggaaatcgaaagcgatttctacaacttccaggcgctgaacattccggaaaaccatccggcgcgcgcgatgcaggacacgttctacgttgaaaacggcgacgtgctgcgcacccataccagcccgatccaggcgcgcttcatggaaagccatcgcccgccgatcaagatcgtcgcgccgggccgcgtctaccgcgtggattccgatgcgacccactcgccgatgttccaccagatggaaggcctgtgggtggatgagggcgtgtccttcgccgacctgaaagcggtggtcaccgacttcctgcgccgtttcttcgagcgcgacgatctgcaagtgcgtttccgtccgtcttttttcccgttcactgaaacttcggccgaaatcgacgtgctcgacgagcagggccgctggctggaagtgggcggttgcggcatggtgcacccgaatgtgttgcgtatcgccaacatcgatccggaaacctacaccggcttcgccttcggcatcggcctggatcgtttcgccatgctgcgctacggcgtcaacgacctgcgcctgttcttcgagaacgatctcaacttcctgaagcaattcaactga

SEQ ID NO: 1454 - DNA, 2358 bp, Chromobacterium substugae
atgcaattttccgaacaatggctgagaagctgggtcaatccggcgctgaccaccgatgaactgtcccacctgctgacgatggcgggtctggaagtggaagaaacgcaagccgccgcgccggcgttctccggcgtggtgatcgccgaggtgaaagagtgcgtcaagcacgaaaacgccgaccgcctgcgcgtgaccaaggttgacgtcggcagcggcgagctggtgcagatcgtctgcggcgcgcccaatgtcgccgtcggcgtgcgcattccctgcgcgctgccgggcgcggtgctgccgggcgacttcaagatcaagccgaccaagatgcgcggcgtggaatcgggcggcatgctgtgctccggcaaggagctgggcgtgccggatgatgtggacggcctgatgctgctgccggacgacgcgccgatcggccagaacatccgcgagtacctgggcctggacgaccagctgttcacgctgaagatcacccccaaccgcgccgacagcttgtcgatccgcggcatcgcccgcgaagtggcggcgctgaccggcgccgagctgcgcccggtggcgatcgaggcggtgaagccgtccatcgatgacgtgcgtccggtgaagatcgaggcgcgcgaggcctgcggccgctacctgggccgcgtggtcaggggcgtcaacgccgccgcggcgacgccggcctggatgcgccagcgcctggagcgttccggcctgcgttcgatctccgccatcgtggacatcaccaactacatcctgctggagcagggccagcccatgcacgctttcgacctggccaaggtcgagggcggcatcgccgtgcgcatggcgcgcgcgggcgaaagcctgctgtgcctgaatgagaagactgtcgagctgaagccgcatcatctggtgatcgccgacgacgccaaggtattggcgatgggcggtttcatgggcggcgagcacagcggcgtcaccgccgcgagccaggacattttcctggagtcggcgttctttgcgccggccgccatcgccggccgcgcgcgcgagctgggcttcggctccgattcgtcctaccgctacgagcgcggcgtggactttcagctgcagcgcgaggcgatcgaatgcgccacccgcctggtgctggacatctgcggcggcgccgccggcccggtggtggaagaggttgccgagctgccgcagcgccaagaggtgaagctgcgtgtcgcccgcgtggccaaagtgctgggcgtggcgctgagcgccgagcagatcgccgacatcctgtcgcgcctgagcctaccgcacacgctggaaaacgacgtgttcaccgtgcaggcgccatcgttccgcttcgacatcgagatcgaggaagacctgattgaggaagtggctcgcgtttacggctacaacagcatcccgtccgacgcgccgcgctccggcatgagcatgctcaagcagccggaagagcagcgcccggtagaccagctgcgccacttgttggcggcgcgcgactaccaggaagtggtcagctacgcctttgtcgacgagcgctgggagcgggatttcgccggcaacgacaaggccattcgtctgcagaatccgatcgccagccagatgagcgtgatgcgctcgacgctgatcggcggcctggtggacaccttggccggcaatatcaatcgcaagcatccgcgcgtgcgcttgtttgaggtggcgcgagtgttcctgcgcggcgagcagggcttcgagcagccggaaaaagtggcgggcctggcctgggggccgcgcctggccgagcagtgggcggccaaggccgagcgcgtcgatttcttcgatgtgaaggccgatgtcgaggcgctgctgcatccgctcaaggcggaataccgcaaggcggcccatccggccttccatcccggccgctgcgccgaggtgctggtggatggcaagctggccggcgtgatcggcgagctgcacccgcaatgggtgcaggcttacgatctgccgagcgcgccggtgctgttcgagctggatctggcttgcgccatcgcccgcgaccgcatcaaggccaagccggtgagcaagttccagccagtgcgccgcgatttggcgctggtggtggacgagcaggtgactgtggcgcagctgatggcagccttcgcgccgaaacgcgcgcaaattgtcaccgatatcgccttgttcgatgtgtatcgtggcaaaggcgtggcggaaggcaagaagagtctggcctttagcgtgctgatgcaggacaatagccgcactctgaccgacgaggatgtggagcctgcgctgcaggcgctgctggatgccgtgtcgggactgggcgcgcagctgcgcgtttga

SEQ ID NO: 1455 - DNA, 303 bp, Chromobacterium substugae
atgactttgacgaaggctgaactggccgatttgctgtttgaccaggtaggtctgaacaaacgcgaagccaaggacatggtcgagtcgtttttcgaagagatccggctggctctggagtcgggagattcggtgaaattgtccggtttcggcaatttccaactgcgcgacaagccgcagcgtccgggacgcaaccccaagactggggaagagattcccatcaccgcgcgtcgtgtggtaacgttccacgcaagccagaaactcaagggaatggttgagcaataccatgctaacaagcaaggctga

SEQ ID NO: 1456 - DNA, 354 bp, Chromobacterium substugae
atgctaacaagcaaggctgatctgccgtcaattccatccaagcgttacttcaccatcagcgaagtcggcgagctgaccggtgtgaagccgcatgtattgagatattgggagcaggaattttcccagctgcgtcaggtgaagcggcgcggcaatcgccgttattaccagcatcatgaggttttgctggtaaggcgcatccgcgccttgctttacgacgacggtttcaccatacagggcgcgcgccagcgcttgggcatgggggaagtttccgagcgtccgatcacggcgcaggaagtgcgcgccgaattggaatccatcctgaattggctggattcgggtattggcaagccataa

SEQ ID NO: 1457 - DNA, 74 bp, Chromobacterium substugae
cggggtgtagcgcagcctggtagcgcacctgcatggggtgcagggggtcggaagttcgaatcttctcaccccga

SEQ ID NO: 1458 - DNA, 174 bp, Chromobacterium substugae
atgctggcgctgtacgtgcaatgcaccaatggccatcaacttggcgatatcacgtcttgtctggtcggcatgctcgtttgtggtttgtgcgtgcagctggggaaaggtatatctctggcgcgaatccatggcgtcaaaaagcatcagctgcctttgagtcattttgacgcgtag

SEQ ID NO: 1459 - DNA, 363 bp, Chromobacterium substugae
atggacgacaccatagacgggctaacggcactactagacagcacgtcagcccctattatcgtttgggaaaacgaacattttggtccggtagaacgaaacggccgcagattccgggactccagcgtctatcacgaaaaccgtgagcgcatcgccggcattgtcacgctgcaccgcccgaatgccgatctggccggccgcgatatcgcagaactgagcatcaaaggccagacctttgccgaagctctaacaagcccggaatggggaatcatgcccaagcaccggctgcaaatgatatgggctgactatctgcagcagattaagccaatcctgacgcaaggactgccggaagaactggccgcatga

SEQ ID NO: 1460 - DNA, 132 bp, Chromobacterium substugae
atgccggaaaaccaattgcgatccgctcacggccaatcgctggaagccatggccgacaatctggattcctcgctctcttggctcaatgaagccattgcagagctatcgcaagcgattgacgaaatggaatga

SEQ ID NO: 1461 - DNA, 114 bp, Chromobacterium substugae
atggcggatcagagttcgcggatgctgttgatcatgctggccaccacggtgcaagccaggaattaccgcgtcgaaatgagagcggtgtctttgcgttttgttaaagagcggtga

SEQ ID NO: 1462 - DNA, 165 bp, Chromobacterium substugae
atgtatatatttattattattctcagatatgtccgcctcaaactgtccgccctcatcctgatcaacagcaatcaaagatggttcagagccttgcgctgcctgactttcagagatatcacgctgcccacctcctgcactcctgctcatgtcctgttcatcacctag

SEQ ID NO: 1463 - DNA, 291 bp, Chromobacterium substugae
atgtcggatgaaaccgtggccaaggtccggcgctggtatcggcaacgcatctggttcgcccggcgcgatgcctgtctgaaagcggcgctctatcgctgcgccacgccgggatgcgtgaaccgcgcgaccgattgcgaccacatccggccgcatcgtggcgactggtcgctgttcatcgagtcgtccaatcatcaggcgctttgccattcctgccactcgcgcaagaccgcgcgggaagacggcgggttcggcaaccggcggcgcgaggtcggccagggggtaggggggtga

SEQ ID NO: 1464 - DNA, 810 bp, Chromobacterium substugae
ttgcgagcgggttccggcgtgatgcccaaaccgcccgcctttttgacttcgaagcgtggccgcgatgtctggaaatacaccatcaacgcactggacagcgctggtctggactggacatccgcgctgctgcagatcgccttgttagcggacaaggtcgatgactggcggacgcatgtcgaggaattggaccgctacggccatcgctacgacgaggacgccaacggcggttcgctggaaaccgatgagtcccgcgccgagcggcgggcgcggggcgaggtgatgaaagacctggatgaaggcggcttgacggtgatggccgccggccaggtgcgcgccctggatcggatgttgacggcggacttattcgcctccgatccgttcgcggtgatggaccagctgggcgagggcggcgccaatttgccgaaaaaaccgccctggtcgatgaccaaggcggaagcgcgtgcctggcgcgagatacagccgctgctgcaggcgtcgggcttcgactattcgtcggcgggcatcgcgctgggcctgatctgcgcggctattgccgactggcaagcctgcaagcagtggattttggacaatcggggcaagattttcgcggcggccaaggagactggccgccggtatgaagtcagcgccagctacaaccgggcaaagatcgccaaacagatgcgcgaattgctcaaacgaaatggaatgacggtggcctcatgcgcaagaaccaaggcgctaagcaaggggcgggtgatcagcgaggacttggccgagctgctggggtacatcaacgacaggccggattga

SEQ ID NO: 1465 - DNA, 1659 bp, Chromobacterium substugae
gtggacgtgctggaaggccgcatcaaggtcggccgctatgtccggctggcggtggagcggcatttccgcgacctgcagcagcaggaagcgcgcggcctggtctggcggccagagatggccgcccatgcgctggcctttttcccgcgctactgccgccatttcgagggcgagtggtcgggccagccggtggagctagcgccatggcaagcgttctggatcgcggtcgagtttggttggtacaaccgggacggccggcgccgcttccgcaccttttatgaggaggtggcgcgcaagaacggcaagtccaccaagctggccggcctgggcctgtatctattcgccgccgacaaggaggccggcgcgcaggtctacacggcggcgacgaagctggagcaggccaaaatcacgcacgcggcggcggaaatgatggtcgccaagtcgcccgccctgcgccagctggtgcagaaccacaaaaacaagctgtggatacctggcacagcgaacaagttcgtgccgctgggcgcggacgccaaaaccctggacggcttgaacgtacatggcgcgattatcgacgaattgcacgcgcatccctcccgcgacctatgggacgtgatcgataccgggcgcggcgcgcggcgccgcagtgtgatgcacgcgattaccacggccggtttcaaccaagagggcagcatctgcctggagcagcgaaattacctgatccggattctggaaaatcagggcaaagacccggcgctggaggacgacagcttcggtggcgtgatctacacgctggacccggaggacgattggtttgacgagtcggtatggtgcaaggccaatccgaatcttggcgtttcgttgttcttggaagagttgcgcacgcaggcgcaaaaggcgcgtgtggtgccgaccgcgctattcaacttcctgaccaagcgcctgaacatctggacgcaagcggttgatagctggatttccctggacgaatgggacaagggaacagccgcggtcgatcctgagttgctgcggcatcggcgttgcttcggcggcctggacctggccagcaagacggatattgccgcttgggtgctgctgttcccgcctgagaagccgggggagccatggcaggttctgccgcgtttttttgtgccggcggacaacatgctggcgcgtgacaaaagcgacagggtttcctattcgacttgggcgcggcaaggctacatcacggccaccgccggcacgcggatcgatcaggaagtgatccgcgcccagatcctggccgatgcccggcaattcgatctgcaggccatcggctttgacgaatggaacgccggcaagttggctaccgaactgacagaagacgggctgcagttggtcgcgctgtcacagaatttccaaaatctgtccgacccgacgaaagagcttgaagccctgatcaagtcgcaagcgctggctcatggcgggcatccggtcctgcgctggatggctggcaatgtggtggtgctgcgggactccaatgacaactatcgcccgaacaagggcaagtcgagggagaagatcgacggcattgtggcattggtaatggcattgaatcgggcgctgtatcacgccccggcgggatcgttcgtttccgcctacgaagacgaggtgtgcttgtga

SEQ ID NO: 1466 - DNA, 141 bp, Chromobacterium substugae
ttgctggtcggcctggccggcgtggcggcggtgacggtcggcatgtcgctgttgcatgcggcggccggttggatggtgggtggcggtttcgcgttagcctggtcgtggatgacggcgcgcagcgcgggaagggcgcgctga

SEQ ID NO: 1467 - DNA, 1251 bp, Chromobacterium substugae
atgttcatgtcacagcagtttggccaatctgcggcatcgcccgatccgggctggttatccagcctgctgggcggcggcgcccggagcgcggccggggtggcggtatcgccggacaaggcgctatcgattaccacgtatcaggcatgtattaccacgctggccgagtcgctggcgcagctgccgtgcgaactgtatcgccgcaacggcgaccagcgcgagcgggtaacggatcatcctgttgcccagctgctgcgccagcccaacggctggcaaacgccgttcgagtataccgaaggcgcgcagatcgctgccgcgcatgatggcaacgcttattcctacatcgagcgcgacgaggccgggcggccggtggcgctgttgccgatggaagccggcaaggtggcggtgctgcgcggtgcggatttgatgccgtattaccgctttgacggccaagagccgatgccggcgcatcaggtccatcatgtgcggtggtttacgcgcaatggctataccggcatcagcccggtgcagctgcattgcgatagcctgggcctggcgctggcgacgcatggccacgccagcgcggtttttgcgaatgggacgcacctggccggcgtattggagcggccggcggtgatcggcggccaggatgtgaagccgctgagtgcggaacgggtgctgcagatcaaagcggcgtggaagagggagtacgccggccggggcaacgcgatgaaagtcgcgttgctgcaggagggtattaccttcaaaccgctttcgatgacgaatgccgatgcccaactgatcgacgcgcgtaagttgtctgccctggaggtggcgcagattttcaaaatgccgccacacaaagtcggtctcttggaccgggcgacaaacaacaacatcgagcatcagggcatcgagtatgtgatctattgcctgatgccctggatcaaacgccacgaacaggcccgcatgcgcgacctgttgttgccgtccgaacgtggcgagctgtacatcgaattcaatgtgtccggcctgctgcgcggcgatacgcaaagccgttatgccgcgtatgcgattgggcggcaatggggctggctgtctgccaacgacatccggcgcttggaaaacctgcagcctatccccggcggggatgtctatatgcagccgctcaatatggtggacacgcgcggggcatcactgcagggcaagcctgatgctcgcgctctggtggagattgatcgcatcctggcgtag

SEQ ID NO: 1468 - DNA, 126 bp, Chromobacterium substugae
atgcagccaattgactcggaactggcgcgggaaaccggcgagcaaatcatcgaggcggtgagggagggccgctgcgacgtgatggattgggaaaacccggtcagcgtctgggggccgaatgaatga

SEQ ID NO: 1469 - DNA, 153 bp, Chromobacterium substugae
atgaacgtttccaactacacgccgccggaggccgtgatcggcggccagggcggcagtctgctggcggccgtgctgatcggcgcattgtcccgccatccggtggcggcctcgttgccacagctggccacgccatcggcaaaggctggccagtga

SEQ ID NO: 1470 - DNA, 957 bp, Chromobacterium substugae
gtgagggggcaattcctgctgtcgcagctgttcaatcagccgcacatggtattgccggacgtactgcatgaggcggtggcctgggccggagagcgggccggcatcgagttgcgccagctgggcgtccacgtcgccgccgcgctgcagcccgcagcctggcgcgatgacggcggccgggcgtcgatggccaacctggcggaacagcggatgcagtccgcccagcaaacgggcctgctggtgatcccggtgcaagggctgttggtggcgcgcgaagcgaacgtcaatctgtgcgccacgcaaaccagctatgaaggcatccgcagccagatacaagccgggctgaatgatccgcgtgttagcgccatggtgctggagctggacagccctggaggcgctgtcgtcggctgtttcgagctggtggccgacatcgaggcggccaaggcggtcaagccgattcacgccctggtgcatttcaatgcgttttccgccgcctacgccatcgcctgcgcctgcagtgatatcacgctgtccgaatcgtcgggggtggggtccatcggggtgatcatgaagcatgccgacttcagccagcagctggccagctctggcgtagctgtcaccacgttttaccggggtgcgcgcaagaacgacatggccagcgattcgccgttgtcagacgacgcccgcgcggcggtcgaaaagcgcatggacgcctattacgacaagttcaccggagtggtggcgagcaaccgcggcctttccgtcgctgcggtcaaggcgaccgatgccgggctgttcttcggcgctgaggcggtgcttgtcggcttggccgatcgggtggaaagccagcaattggcaatcaaccggctggccgccgaggtggccgcgagccggtcgccgccgcttgcgccttcccggcgcgcgaccgccgccgcgatggcgatggccgcccagctgtaa

SEQ ID NO: 1471 - DNA, 1320 bp, Chromobacterium substugae
atgtccgtagtgcttgagttgaaaaaacgccgtgccgatctgtccgccgctgtgaaccagctggccgccctggaggcgaccggcgccgcgctgaacgctgaacaggtggccagcatcgacgcgatgcaaaaagagtttgacgacatcggggccaagatcgcccgcgctgaagccgccgagcgcatgacagccgccacggcgcagccggtggacagctcgcaaggcccgcgcgctggcgcggcgccgatccacgcgacgccggccgcgccgaccgtgaagggcggtggcatggcgcgcatggcggccgcgttgattgaggcgcaaggcaattaccgtcaggccgccaacatcgcggatgagcgcggctatgggcaggaagtggcggcggcactgaataccggttcgccatctgccggcggcgtgctggtgccggccaatatggcgcgcgaagtgattgaactgctgcgcccgaaaaccgtggtgcgcaagttgggtgcgcgctcgctgccgctgaacaacggcaatttgacgattccgcgcctgcgaggcggtgcgacggtcggctatataggttccgacagcgacgcacccgtaaccggcgcgcagttcgatgacttgaagctgtccagcaagaaaatggcggcgctggtgccgatcagcaatgacttgctgagcaatgccggcatcagcccgaacgtggatcagctgattgtcgatgatctgacatcgtcggtgggcgcgcgcgaggacaaggcgtttttgcgcgacgacggcagcggcaatctgcccaagggtctgcgccattgggcgctggctaatagcgtgtttaccgcgccggatttgggggccatcgatgcgaccgcgctgcaggtgctggaaaacttcctgaacaagctgattctggcgctggagggggtagacgccaacatgacaatgcccggctgggtaatgtcgccgcgtaccttccgttttctggaaggcttgaaggacatgaagggtagcaaggtctatccggaactggccggcaaaaccctgaaaggctacccagtgggggtaacgacgcaagtcccgaacaacctgggcaaagacggtgacgagtccgagctgtacttcgcggactttggggattgcttcatcggcgaagaccagtctctggtaatcgacttctcgaaagaggctacctacaaggataccgatggccagatggtaagcgctttccagcgcgaccagacgctgatccgcgtgatcgccaagcacgattttggtccgcgtcaccaagagtcgattgcggtcggcgtcggcatcaagtggggcaagtaa

SEQ ID NO: 1472 - DNA, 204 bp, Chromobacterium substugae
atgattgcagtgaagttcgtgaagccgtatggcatttatacgccgggcgacatcgctggtttcgaagggcaagccagggtcgatgaactgattgcgcgaggcatggccgccttggatgacgaggacggcgaaggcgagccggcgccgggtgaaaccaagccggtggccaagagcaaagccaaggcgcaaccgggcggcgtgtaa

SEQ ID NO: 1473 - DNA, 582 bp, Chromobacterium substugae
atggccgccgaggtgatccggcgcagcccggcggcggtgctgacgctggatgaggtacgggagcagtgccggattgatgccgatttgaccgacgatgacatgctgttgcagatgatcgagcgcgcggccgtggccagcgccgaggcccggatcggtgggccgctgttgctggccgaatgtcgcgaaacgctggatgcctggccgggcctgccctggttgtatctggatatcgcgggcgggcgcgaggtggtcgccatcgaggcggtgcagcaagggcagcgccggccgctgccgctggacgccttccacatcgagcgcggcgagcggcgtttgtgtatcaagccgctgaaaggctggccggcggtggacccgttgccgggagcgattgccattgtctaccgcgccggcttcgcagaggccgggcaagacgtgccggaggatgtgcggcagtggctgcgtttccgtgtggccacgttatacgcctaccgtgaggaagtcagcgccggcagtgtggtggcgttgcctgacagcttggtggacagcctgattgcccattaccggccgacggaaagcccgctatga

SEQ ID NO: 1474 - DNA, 321 bp, Chromobacterium substugae
atgaacgccagcatgctgaataaccgcatccggttaagtcagcccatcaagtcgcgccagccgtccggcgcggtgcgggaagcctggagcgagccgaagccggtacacgccaaagtggactacctggccgcgcgaacctatacggcggtgctggccgagcaaaccggctgcagcgtgcgcgccaccattcggcgccggccggtggcgcaagggtggcgggcttgggtggatggtctgccgttgaaggtcaaaaccatcgagccgcacaaggaccggggctatctggtgctgatgctgaagaccgacgatggcaacggttga

SEQ ID NO: 1475 - DNA, 459 bp, Chromobacterium substugae
gtgcatggcctggatctggtgatgcgccatctggacgcggtgccacgcaacctgcagcgcaagattttacggcgcgggttgaggaagggagccgccctggtgcgcgatgaggcccgccgccgggtgcggcgccgatccggcgtgctggccaagtccatcacggtcgccagttcgcgcggcagcggccagcgcggcgcggtcgcctacaaagtcggcttgcggtcgcgcgcctggtacggccgttatctggaatacggtcacgtcaaacgagggagggggaaaaagatcgcaggcggggaacgaagacgagccgcgacgcgggaagccttgaaaggggcggggcaatttgtcccgccctatccatttatgcggcccgccgccgacaagttgccagctgccttgggcgtggtggcggacgaggtgtgcggcgcgctgatcagcggggagttgtcgagttga

SEQ ID NO: 1476 - DNA, 363 bp, Chromobacterium substugae
gtggaactactggccgcgccggaagtggctgccctggtcggggatcgggtgtacccggtgcatttgccggacgagccggttttgccggcgattgcctatcaggtgttggatgagaagcggcagcagatcgcgcgccggccatctggccgcgtgcgcagcctggtgcaattgtccatcgtcgcgccggattatgatgccgcctactcggtggcatgggtgatccggcggcgcctggagcgctggcgtggtcaggccggcggggtactggtttacgatacattggaagaggcgttgcaagacgttggggatggtacgccgcatgtggtggcgatgacttggcgcattcactggaaagagcaatga

SEQ ID NO: 1477 - DNA, 408 bp, Chromobacterium substugae
atgagcaagattgaagccctgatgcgggcaatggaagaggcattgaagagcgcgacgccggcagcggatcgcgtcagccgcgatgtcgagaagggttacagctttggcgagtttcccgcaatcgtgctgcatcagctgcgcgatgcgccgctgtccggcagcccggttggttacgagtaccggcagttgtcggtggagttggaaattcaggcggatggcgatgagccgcacgctgcttgcgatggcgtgttggaggccgcgcatttggccctgcatgaaatgctaacgggcgtacaagatctgcagcaaggggtaatcgattgggactatgacgaggaaaaccctgccctaggcgtttgccgtgtgcagtacttgctgacttatcggcggagagaggaggagttgtaa

SEQ ID NO: 1478 - DNA, 1524 bp, Chromobacterium substugae
atgattgattcggatagtctgggaaataaaggcgaaaagcggtttggtgaactttgtgccgatgcaggattgttttgtaatgattcttctgatcgtgacagagcgggatgggattttatagttaactttccagaaagcgaggaacgtaaagagtcgttggataatcgaattgcccctctttcttgctatgtgcaagttaaaactatttggagtaaagggggggaggtaaggttgaaattaaatatggctgaaaggcttgcgaaagagcctattccatcatttatattaatattcaaggtggatgtggatttgcagttttcaaatgcatatcttattcacatttatgatgcaagattggcagctattttgaaaaggctgcgccatgagcacgctaagtgcgatggaaagtcattgaataagaaagttattaaattttctcctttggaagaggagactatccctatttctgggagcgggttgcgtgaggcaattattcgatgtgtaggtggggacatcgatcgatatgtggagagtaaaaagcaacagcggctatctgttggttatgatgagcggcctgagtcaataaaagtaactttccagggtttgagtgatgcggaacttcttgatgtgtttcttggcataagaaaagatgtgccagttttgaattttgaatctgcagagactaggtttggcattgcaattaaaaatataccatctgatagcggtcggataacaatagagccgaattcattaggtaaatgtaaggttttagctcgcccgcctaatcgtatgggggggatggcaattctgtttggcgatttctacatgactatgaaagtggggagttgtcagaaagcaattgtaagaagtaatatattcactattgaaataactgacctagatgctagttgtcatgttaaatttgaatattctacttatgggaaaatgtgtgatctatcggagtgggcgaattttctgcagctaatcctgttgctgaatagagatgatgtaatggtcgagatacatccgccaaaatcaaaaaaaccacttgaaattaaatcttcttattttgatttgaagcctagtggggataagcttgatgcagtcatgcatgatatcttcattgtaaggagcttggagagtatattttctttcatcggcttgagttcacgaccattgatcaagctagaagatattattggaagtgcaaattcaattgcaatggtggcggcgctgatggacaatgtaaatccaaatcttaatttggattgtgattattttggtgctgtcaaagatattgataaagaaattattgttgcatcaagattttatgttggtgagattttaatggcgtattatgctgttgttcttggtgtgagtgttgattcggtggagggagaggttggttatgatgtgtttgagttcaagagcgttgtaattttagacaatgtagaggaggcgtttgaagagttcttgaaaagcattcgatgtcaagaaaatattgatcaagtagtgctaatttaa

SEQ ID NO: 1479 - DNA, 930 bp, Chromobacterium substugae
atggcattgaacagtaagcgggtggcgattatcgccaagccggaaagcaaggaaggcgtggacgcggtgccgactggcgcggcgaatgcgattctggtggccagccccaaggtgacgccgttggatagcgaccgtgcggaacgcaatgtggtgcggccctatttcggcaatgcggagtcggttgttaccggcgtgcgcatgaaagcggaattcgaggtcgagttggcaggggccggcgtggcgggcgcggtcccggcctggggcgtgctgctgaggggctgcgggtttgcggaaactgtcgccaaggacgccagcgcgagctatgcgccgatttcgggcggacatgagtcgctgaccctctattacaacctggacggcgtgcagcataagctgttgggcgcccgtgggacggtatcgctggatctgcaaaacaaggcgttcccgaaaatgaaattcgtgtttaccggcgtgcatggcggcattgtcgatgcgcccgcgccggcgctgaagctgacgccgtttcagacgccgatgccgtttgacgcggcgaacgtggccagcttctcgctgtatggctatagcccggcagtgcagagcctgtcgctggacatggccaatgaggtcaagcatcgcagcctgccgggcggtgtggaaagcgtgctgattaccggccgcaagccatctggcagcgtgcagatcgaatcgacgcgggtggcggaaaaagactggtttgcgctggcgcgcaccgcagagcgcggcgcgctcgccctggtgcatggcaagacggccggcaacatcatccagattgacgccacggtcagcatcggcagcgccgactacggcgacagcgacaacatcagcatgaccacgctgccgctcgccctgttgcctaccaacggcgacgacgaaatcaaaatcacggttcgataa

SEQ ID NO: 1480 - DNA, 378 bp, Chromobacterium substugae
atgttcaagatcgccaatagcggcacggtgcgcgtgccggctgaaatcctgacccgcaccgagtccggcgcggaaaacaaagtctccatccagttgacgggccgcctgctgtcacagcctggctgggatgccctgttcgccaaatacgcaggcgaggccggcgcgggcgagctgtccgaggtctaccgccaaaacgcgcgcctttacgccgaggtgttcacggcatgggatggggtagccgatacagacggccaggtgctgccgctgtcgcaggcggcgcttgaggcggccttgctgtcggtggacgggccgcaggtcaatgccgcgctgcaacaggccgtccatgaactgcgcttcggtgccgtccgaaaaaactga

SEQ ID NO: 1481 - DNA, 345 bp, Chromobacterium substugae
gtgcgctggcagtttggcgagcgcgccgccacccggtcggaggatcggcaagcgctgctggcggccggcgtgccgctggaacaagcggacgcgatgttgccggcccggtgcgacgtggaggcgttcgcattgctgcctgacgcgctgccggcctggcgcgtgtggcaggcgatgcagacgcaatggcgggtcggcccggcggggccgtatgggctggactatgcggcgctgcctgtggtggaaaggcgggtcggcctgccggcggcgcagcgggcggaggtgttcgattgcctgcaagagatggaacaagaggcgctgcgcttgatggcgaagaaaggggcgtga

SEQ ID NO: 1482 - DNA, 2667 bp, Chromobacterium substugae
gtggctgcgcaaaatgtaggttcgctggtaatcaatctggaagcgcgagtcgcccagctgcaaggcgacatggcggcgaccaagcgagttgtcagcgatgcaatggataccgtggagcgcgacgccaagcgcggggccaaggcgctggaagacgcggccggcagcgccggcctgctggccagggctggggcggcgattgcgggcggctttgcgctatccgcagtgaaagatggcgtggtgtcggtggcggcggcgctgaaccaagcgcagattgccagcgagcggctgcaaaagtcgctgttctatgccaacggtggtgacgtgcgggcgattgcgtcggatatcgaatggctgaggcggcaggcatccgggctgggcctggacttcgcgcaagcgtccgcgtcctatgcgcagtttgccggcgcggtgaaaggcacgccgcttgcgccgtatgcgcgccaggtgttcgactcgctgtctacggccgccagcgcattcggcttgtcggcggagacggcgcagggcgcgatgctcgccctggtgcaaatgtcggctaagggtgtcgtgtccgccgaagagttccggggccagttggccgagcatctgccggtggcgacgcaggcggcggcgcgcgccctgggcgtgacgacaggtgagttcagcaagatgctggaaagcggccagttgctggccgccgacttcctgcccaagttcgccgccgagctgaagcgcatgagcgcggacgcggcggcgttcggcggcgagacgcaaaaggccagcgccaatttcgtcaactcgtgggaggcgatgaaaaccgaggtggcgcaatcgggcattgcctctttcattgccggccagctggccatcctgacggatgcatttgacgacgtgtccgagtcgatgcggcgggcgcgcaaagagggttcaggattctgggggcagacgatggccggcggcggcgcggtgatgcgctttctgaatccggtgaatgcgctgcactacgacgcgcaaagcgacaacgcccgaatggcccagctgaaagagcgtatcaaggaggggcaggcgggtctgtatgagtattcgttttcgcagacgttggcgcaaaagcaagcgggcctggctgcgatgcggtcggagctggccgagttggagaaacgcgccaaggcggcgacaaccgatgccgccgccggggccaaggctgcggaagccaaggcggcggcgcgcaaggatgccgaggcccgcgcgaagaagtacgcggacgacgattcccgcctgaatgaccgtgaggagttcgacaagaaggtcaggaaggaagaggaggcgttcaaaggggccgtggtcggtttggagaaaggcagcgcggcctatctggcggcggagcgcgcgcatcaaactgcggtgagcaagctgcgcgacgacttcgacaagaagcaagccgccgagcgcaagcgggccggcgcgcagggccggcgcgaggatgccgctatcgacgcgatgcagcgcgaaatcatgggtgtggaaaagctgtcagccgtcgagcgcgcgcgctatgaaattgcggaaggcaagtatgccggctggagcgccgccagccaggcgcgcttgctggcgctggcggccgagctggacgccacccgccaagtgcgcgcggaaaacaagaagttcctggatgagctaaaccgcgatgtcgagcagtacgagacgcatcagcgcgatgtggccaggcgcttgcgcggcggcgagtacgacaacgcggcacagcgcctgcagagcgagcatcgggagcggtcgctagatatccagtacaacgctggtttatcggaccaagaaaagcagcagtatggccaacaggaagaccgccgtaacgaaagagcggtggacgccctgcgcagcagcgagcgccagggcatcggcctgcagtccgaagaacagcaactgcgcgaccagtacgaccgtcgccaccagttgatcatggacgccaccacgctgagcgaaaccgaacgggccgactacatccgccgcaatcaagagcagttgaacctggatttgatgaacatggagcgcaaccgcgcgtccgcgatgctgtcgagttccagccagctgtttgacggactggccggcctggcggccaccttcaagggcaaaaacagcggcatctacaaggccatgttcgccatgagcaaggcattcgccattgccgattccgtcatcaagattcagcaggccgtggcgacggccgccgcatctgcgccctggccggcgaacatcggcgcgatgtcgtcggtggtgtcggcaacggccggcctggtgtccacgatagccagcacgaacttgtcgggcatggcgcatgacggcatcgacaatgtgccgcgtgaagggacgtggttgctggacaagggcgagcgcgtggtggatcgccggacaaacggtgatctgaaagactttctgacccgcgtcaatgccgcacagagcgcgcccgccacgccggcccagccggtcaaggtggtggtcaacaacctggctccgggaacggcggccaggaccgaggagcgtcaaggcgcgggcggcgagcgtgaaattctggtgctggtggagcgggtgatagacaacaagctggcgcggtcgatgcgaccggacggtgacatttacaactttgtgagggggtag

SEQ ID NO: 1483 - DNA, 345 bp, Chromobacterium substugae
atggcggcggaaaccttcggctggacgccgctgtttggcggttcatcgtcgatccgggcgcgagtgcgggaggccaagttcggtgatggctatgtgcagcgcgtgccgggcggcatcaataccatgccgcgcagccgcaagctgtcgtttgcgggggatgcggcgatgtgcgacgccatcgaggcgtttctcatgcgccatgccggcgcgcgctggttctggttcgcttatccgggcgcggcgcgctgcaaagtgcgttgcgaggaatgggaccgttcctatctggccgccggggatgaggtggtgagcgcggcatttgaacaggtatttgatccgggggagtga

SEQ ID NO: 1484 - DNA, 696 bp, Chromobacterium substugae
gtgatgggagagattcacgcagaaaaacagcgcctggtgcctgatgccctggtgcagctgttcgagatacggccgccggccggcgagacaatgcagccgctgcgctttaccaccagcggcaacggccaggcagtgacgtttcaggggctgacctatgagccgtgggccatcgaggccaccggctttgaaagcagcaacaaaggcgcgccacggccgcggctgtcggtcagcaatattggcatgctgccggatggcagaccgatgcgcggcatcttcacggcgctggtgatgcagcatcaagggttggtcggctgggaggtggtccggcggctgacgcacgccaagttctgcgctggcggcgagctggcggccttcccggaaatgcacccggaagaaatctggctgattaaccggcgcgaggccgacaacggcgatgtgctgacatttgagctgcgcagccggctggacctggccggcaagcgcgcgccgggcgtgctggtgacgcgctattgcccggcgcatgtggtctaccgtggtccgcattgcggctatcagggcgaagcgatgttcgatgctaacgacaggccggtgatggacaagcggctggacaagtgcggcaagcggctaagcagctgccgctgtcgggccaatctggccaactacggcggctgccctgggatgagacgatataactaa

SEQ ID NO: 1485 - DNA, 717 bp, Chromobacterium substugae
atgggcaatgcaatgacagcaacaaccgagcaaatcgccgcgatgctggcctacgcggcggcggccggcgacctggaagcctgtggcgtggtgctggactcgggccgggtctatccctgccgcaacctggccgacgagccggcgcggcaattcaggattgacccggtggaccacgccgccgccgagcagctgggccgggtagtcggcatctggcacagccacccgaacgcgccggccgagcctagcccggcggatagggcgatgtgcgagcgcacgcgcctgccctggcacatcgtcagccatcccggcggcgattaccgctatatcgagccgtgcggctatcaggcggactacctgggccggccgtactgctatggcgtgttcgactgctgggaactggtgcgggactggtacgcgcgcgaacgcggcgtgtcgctgccgcgtccgccgggcgcggaacgggacggctggtggagccgggggctggacttgttcactacggcggctgaggccgccggttttgtttgggtcgatgatgagccgcaggccggcgacgtgctgctgatgcagatacagggtgcgttgccgaatcacacggcgttatggctgggcgacggccgcattctgcatcacctgcgggaccggcagtcggaaacgcacatttacggcgggtattggcaacgggcgaccgtcagacgggcgaggtatcgacaatga

SEQ ID NO: 1486 - DNA, 570 bp, Chromobacterium substugae
atgagcaatagcactttgcggatgatccgcctgggcggcgtcctgggcgagcagtacggccaggcgcatgaattggcggtgtcgtcggcggcggaagtggtgccggcgctcaatgcgctgtatccgggcttcaacaacgcgctgcgcgccctggacgaacagggcatggcgtttcgggtgacggtggccgacaggacggtttgcgagcaggaactgacgctggtttccagcggcgacatcctgattatgccggaagtggtcggggccagcggcaaccaagtcttgggcggggtgctgatcgtggtgggcgcgttgacctgggcgtttggcggcacgcagctgatggcggtgggcgtcggcctgatgctgtccggggccatgatgatgctgacgccggttccgcgcctggaccagtcgcagagcgagcagcagcagggcaaaaccagttatctgttcaacggtgcggccaatagcagcgcgcagggcatgcccgcgccctggggctggggccggcatcgcgcgggcggcatcatcatttcggcgggcatcagcgtagaggacatgcggtaa

SEQ ID NO: 1487 - DNA, 3627 bp, Chromobacterium substugae
atggacagggacatcagaggcgcgggcggcggccagaaagagccgcgccggccagtggaggcgtcggacacgctgcagtcgctggcgacggccagggtgctgatgctggtggggctgggagaaatgggcggactggtcgatggcgaccagtccgttttctttggcggggtgccgctgcaggaccgcaacggcgcgcgcaacttcgagcgggtgcgggtggaacatcgggtcggcacggcggcgcaagcgccgatggccggctttgacgagatcgagacggaatacgcggtcggcgtcgaggtgaaggctggcgacggcatcgtgcgcagcatcgacaatctggacgccacggcggtgcgggtgacggtgtcggtgcgggggctgctggcggtcaacgacgacggcgacaccaacccgacggccgtgacgatggcggtagaccttcgcgagccgggcggggtgtggcatcaggcgcggcaaatcgacatcgtcggcaagacgcgcagcaaataccagaggtctgtccgcgtcgatctgccgccgggcgggccgtggcaagtacgggtgcggcgggtgacgccggacagcacgacgcaaaagctcatcaacgcgaccgagtgggacagctacaccatgctgcagtcgatgcggctgagctatcccggctacgcgctcttgggcgtggagttcgacgcccggcagttttcgtcgctgccggaaatcaccagcgagtggcggctgtcggtgctgcaggtgccgagcaactacgacccggcatccggcacgtatgcgggcgcgtggaacggcacgttcaagccggccttcagcagcaaccctgcctggtgtctgtacaccttcgccactgatgcgcgcttcaatctcaatctgccaccggacggcgcgtggaaatgggacttgtaccgcatcggccaatggtgcgaccagctagtcagcgacggcatgggcggcctgcgccgccgctttgaaatgcacggctaccacggcgacggcgcggacgcctggaaggtgctgcaggacatggcgtcggtgttctgcggcaaggtggtgccgagtgccggcggcatccgcgtggtggccgacattccgggcgacccgcccgccaagcacttcacgccggccaatgtgatcgacggccagttttcctatgccagcacggaacaggctgaccgctacacggtggccagcgtgtcgctggtggacccggaagacggctggaagcggggcattgaatacgtcgagcacgccgaaggcctggcgcgctacggctaccagccggccgaggtggtggcggtggcctgcaccagccgcgcgcaggcgcagcagctgggccgctacatcctggagacggcgcagacggaaaccgagctggtgacgttcgccgccggcctgtatggcgtcgatctgcagccgggcgagctgttcacggtgtttgacccggtggtggccggccggcgcgtgggcggccgcctgctggaagtgaaggggaaggccgtgacgctggatgcgcccgtgatgctggacgagggcgtcagctacagcctggaatgcccgatgccggacggctcgctggtgcaacgcggcgtggtggtgacgccgggcgaggcggccagtctgcgcctggtggctcccttcccggcgcaaccggtggacggcgcaacctgggcgctgatcgggaccaatctgcagccgacgctgtggcgctgcgtcgccaagcgcgagcgggagccgggcatctacgaagtgagcggcctgcagcacaacccgaacaagtgggcggcggttgaacagggcatccgcatcgacgcgccgccggcatccagtctgccggacccggcgcagatgccggcggtgtcggcggtcagcatgcgcgaagtgtcctatctgaccggcgacggccgccgcgcggtgcggctggaagtggactggccaggcgtcaatcatccgtatctgcgcggctacgtggttggctaccgccaggacggcggcaactggctggagctgccggagcaggcggccaaccatgccgagttggaagggctgcagccggggcaatggcaagtgcgggtgtccagcgtgtcggccatcggcctgcgcagcatcccggcgctggccagcatcgacgcgcgcggccatgtcgcgccgccgcccgcgccggccctgtcggcgaccggcgcgccgatggccatcaacctggcgtggacctatccgccgggcgtgcctgagctggtgcgcgccgagttgttctattccgctgatccgcatgacggcaacccggccaggctggcggacctggcctatccggcgaacagcttcattcatcagggcatcggcctgggcgtgcattactactactggctgcgggtgacggacagctggggcaatgtgtccgcgccggccatggcagacgcggcgaccatccgcaatcccgaattgctgctgcagcagctgcaaaacagcatcggcggcggccagctggccgaggagttgcgccagccgctggagcgtctgcccgacatcgccgcgcaggccgacgaggccggcaagttggcggtgtcggcggtggaaaccgcgctgcaaaacgtgctggccagcgaccagctgggcgatgtgcaaacccggcaattcgccatcgcccgccgcgacctgaaaacaaccaacgaggctttgaagtcggaagcgacggcgcgggaagtgttggcggccaagctgggcgacacgcaggcggcgctgatcgaggagcggacggcgcgggccgaggcggacagggcgctggccagcgaggtcaagacgctgagcagccagacggcgggcgacctggccacggtgcgccaggaactgcagacggcgaccggtgagaatggcgcgctgtccaagcggctggaccaactgaccgccaagcatgagaccacgcaggccggtttgctgcaggagcagacggcgcgggccgaggcggacaaggcgctggccagcgacgtcaaatccttgaccagcaaaaccgataccggcctggcggcggtgcgcgaggaactgcaggcggcgaccggggcgagtggctcgctggcgcagcggctggaaacgctgtccacccgcatcggcgacagcgaagccaccatccagcagcaatccaagagcgtggacggactgcgggcgcaatggtcgctgcgcatcacccgcacggccaacggcaagaccttcgccagcggcatgggcttgagcaatggcgagcagggcagcgagttggccgtgttggccgacaaatttagcgtcgcccagccggacggcgagaacgcgcgccaggtgtttacggtggggtcgatcaacggccgcccggcggtcggggtgtccggggatttgctgctggatggcacgctgagcgccaacaagatcgcggcgggggagatccgcgccgaggtcgggctgtacgcggcggccattcgcggcggttacatcaatatgggcggcggccaattcgtcgtggacaacaacggcaatgtatccatcagcagcgggcgcaatggcgcgcgcacggaaattaccaaccgggctatccgggtattcgatgaaaacggcgttctacgcgttcagataggagatttggcggcatga

SEQ ID NO: 1488 - DNA, 303 bp, Chromobacterium substugae
atgagtgttcatggtttggtggtgaaggatgccggcgggcgcgtcacgatgcatagcgatgccctgtccggcagcctggtggacgtcatcagcctgaccggcggcgtgggcgagcggcattacccggagttgcgcggcttcgcgctcaacacgctgcagatttacggcgcgacggtcggcgggccaggcaagcgcatgcatgcggtgtcgctggactatgcgccaggctatccgctgctgcgctggtggccgcaaactggcgacgtcgccgcgacaaccctttacgtgttgtcggcgcgatga

SEQ ID NO: 1489 - DNA, 708 bp, Chromobacterium substugae
atggtgtcaaaccgcaatggcggcattgtggtgagcgaccgcacctattccatggtgtatgtcggcctggccgaattttccggcgtgaccggggcggcgctgccggtgtatccggggcgggaggatatcgccaaatgcggcacgacgatgtgctactacgtcaacaattgcccgtttgagccgctgcccttcatccggcgcaatgcgggctgggcgggcattgtcggcgtccagccggcggggctgaatcgctgggaaatcacggtggtggtctacccggccaatccgccgcaaatcctggtgttttgtcggacgccgaataccgggccggcggggcgctggggcatggtgctgcgcggcccggatggctcgctgcgctatgacagcaaccggcaaaatctggtgctggcggacattctcaatcatgcgcctggcggcatttacccgtgggaaagcatgtggaactgcacgaccgtcacgccgctgcgggtgaataacccgaacctggcgttttgttattcggcgaccggcaaggcaacgaccgacaacaactattggagctattactttttgctggtggcgcggctgtcggatgcggggtttgaaaccaagtattcgacgatagccaagggcgcgcaggtcagcgccggctattacgaccacgtcccgcaagcggtgatggtgatcgacgccagcctgtacatttag

SEQ ID NO: 1490 - DNA, 2361 bp, Chromobacterium substugae
gtggtgaagggggcggcgacccactggcgcggccaggtcaatccgggggatatcctgatcggcccggatggccggctgtatgaagtcgccgaggtggacgagggcggcgaggcgctgacgctgcggactccctacctgggcgatatggcggccggcgcgccttacgccatcgtgcgcaacttcactggctcgccgctgggccaggtggcggccgagctggccaagatgcagcggcgctggctgaccacgctggccggcttccgcgatgtgctgctgagcgaggagccgcaggcgacgctttacgacgagctgggcggcgcgcatgcggtgatgtcctggccggcgatagacaaggccgttaaggcggggctggcgtccatggaggcggcgcgggtgatggtggtggacaactcgggcgaactgatcgccagccgcacggcggcgggggccagcgccaaggccagcggcgacagcgcggcggcgtcggcggccagcgccagcgccgccaaggcgagcgaggacgccagccgcaagagcgcggatttcgcggcggcggcgcaggagcaggcgggcggccatcggcaggcggcatcggcggcggccagcgcggcggcgcagtcggaaaaaagcgcggcggccagcgccggcatcctgtcgagcgcggcggcagcggtggaagaggcgcgcaagctggtgaatgggctggacgcgcgttttgcgacgcccgcgcaagttgacgcggcgctggcgcgagtggtggacggcgcgccgggccagctggacacgctgcgcgagctgagcgccgccctgggcaatgacaaggacttcgcggccaatatgaccgcacagttggccaagaagctggaagccggcgacctgtcccgcgtcggcctgggcggcaatgcgcaaaacatcagtgccggcgcgatgaccgacaagcgcccgaatggcttctaccacgtccaaaccgagacggtgacgggcggcccggcgggcgtgggcaatggcatgctgttggtgaacttcctgagcgacaaatggggcgtgctgacctatcgcgcctggggcggcggcgtctatgaggcccggctcgaaaacggcgtgtggtcgagctgggcgcggcactggcacagcggcaacgatgcgccgctgtcgctgttccggggcgagctggacggcaaggccgatctgaacacgctgcagcaaaacggctggtggtggcaacgcgcgaatgccgccgccgccagcggcgcgaactacccgtgcggcgatgccggcgcgctgagcgtgtccaacgccgggaacatgacgttccagcagtatcaaactttcagcacggaacggccgcggctgtttttgcggagccggtacggcgaggcgtgggggaagtggcgcgaggtctggcacagcggcaaccacggcgcagggtccggcctcgatgccgataccctggacggcctgcagggcgcggacctgctgacggtcagcagcgaccagaccgtggccggcgcgaaaacgttcgcccagccgatccgggcgaatgcgccgggcggcagctgggacagctgggcgggcgcggcgcgcggcccggcgctgcagctgaattgcccggacgcggcgcaggcctacgcggtgtggcgggcaggcaagcccggcggcgagcagctggcggcgctggacgtgcgcgcgggcggcgacaagccggcggcggccgtgctgcacctggccggggagggcgtggcggtcaatgcccacgcctggaccggcaacgactacgcggcggccggcaacatccaagccggcggccggctggtgagcggcgaaatcaacgccaacgccacgggcggaaccgatatcggcgtcgaggtgcgcaacaagcccggcagcgagggcgacgacggcatggcggccatgggcttccattgccagggcaagttcggggtcaagctgggcttgcgcgcggatggcgtgttcggcctgggcggctggagcgccagttcctggcgctggtacgtcaacgccgccacgggcgacatgacggccgccggcaacgtgacgtggttttcggataggcggctcaagaccgacatcgagccgattacggatgccctgggcaaagtgttgcggctcaatggctacaccttcacccggacggataccggcgcgcgccaggtggggctgatcgcgcaagaggtccaagcggtccagccggaagccgtgattgaagctgccgacgaaaacaaaaccctgaccgtcgcttacggcaacctggccggcgtgttcgtggaggcgatgaaggaacagcagcgccacatcacgcggctggaggcccgcattgcccagctggaggccgccgcatga

SEQ ID NO: 1491 - DNA, 483 bp, Chromobacterium substugae
atgacgctgccggtaaatgggacgctgtcggcgcgggaagtgaatgtcgaggtcagccggcctggcgcggcgctgggcaacgccggggagccggtgttccgggcgctggcggaggtgggcgacagcggcagttattcggcgatggcgttttacggcaagaacgtcatcaagccgctgacggcggcgctatccacctatctggacgagtcaacattcgtcgtgggcatcggccggccacgggtgtatgtcgaggtgacatgcacgcctggcggcggcgtgccgccgtatgcctacgcctgggagatgctgtccgaagatcgcggccatccgttttattcaggcgaggcgaccaataagattttgttttcgggcgacccgaagggctatggctcaacgtggcgctgccgtgtaacggatagccaaggaaaggtggcgtatagccccgtcctgacgttggtatttaaatacagaaagttgggttag

SEQ ID NO: 1492 - DNA, 279 bp, Chromobacterium substugae
atgcaagagcatgaaaaggcgctagcggcgctggtgggggtgggggccgctatcgggctgggcaagctgctggtgagccaagagcaaatcacggcgcgcttggcggtggggcgcgccatcctgggcggcggcacttcgacggtggccggcgtggcgctgacgcagtttccagaaatgccgctgcctgccctggtggggatcggggccggcatcggcattctgggcgcgcagtacctggaggcgtggttaaaacagcgggccgacaagatcggcagctga

SEQ ID NO: 1493 - DNA, 447 bp, Chromobacterium substugae
atggaattggtgcaagtcgcaatcagccagctgggcgtggaagagcagccgcgaggctccaacgatgggccgaaggtgcgccagtacctgcaggcggtggggatcgggtttccggcgtcctggtgcatggcgttcgtctactggtgcgccgagcgcgcggcggccgagtcgggcgcggccaatccgctattgaagactggcggcgtgctgaaacagtggaatgagcgtccggcgctgcgggtgagcgcgccgcagcctggcgacgtgttcatcatggattacggcaaggggctggggcataccggcatcgtcgaacgggtggacggcgacaagctgctgaccatcgagggcaacaccaacgccagcggcgggcgggaaggctacgccgtctgccggcgcgtgcgcagcgcgaaactgtgcaaggggtttctgcgggtgggggtgtga

SEQ ID NO: 1494 - DNA, 333 bp, Chromobacterium substugae
gtggacgttacgcgccgggaatgggcgctggccgatgcgcagcgcggcgcgacggaagcgcgcgccgatctggccggctaccgggcggaggtcgagcgcctgcaggcgctgtcggtgctgatcgaaaacaagctggaagcgctgcgccaggcgcagccgaaaatcaatgaaaggtataaccgtgttgtcgagaaaagccctttgcccgctgattgccgccctggtcctgagcggctgcgcgaactcaacgccgccatcgaggccgcaaacaccgcccttgccggccaacctggccaggccttgcccgcatctggagccggtgacggtggatag

SEQ ID NO: 1495 - DNA, 114 bp, Chromobacterium substugae
atgaaagtgagctatctgttctttgtctcttgcttcgcggagttcctgttaagcgaattgctggcctttttgatctttctacgcgtgctgttgaaaatagagtggagtcactga

SEQ ID NO: 1496 - DNA, 2142 bp, Chromobacterium substugae
atgagtgtacaaaatgctagctgcccggcacctgaaaaagaaagcaccactcaaaaagctgcacgctttcaaacaaaagctgagcttggcaacaatgtcaataaaaaaaccgagccaagctgcaagactaacatatggtcaaacttctttttcgatggaacaaataacaaccgcgacagagatttagtagacgcagtaaatagtggaaaaccaagatatcgatgcgatcattcaaatattgtttcactatatgaaacagcaattgatgatcaaaaggcaaaccattacacccattacatgcaaggcgtggggactatttttaaagacatcaacgaaaatgaaccatcagatatggggttatccatggctgccggtggccaagccaggctaagttatgcatactatcaattatgcaatgacatatctcttgcatttaatggaaagcgcctattcaccgcggaagattttaaaaaagagctaagagtagctaaagatagaaatcctaatcctagattccctgacctctcctcacttgatgcagttcaaaaaaaactagcactcaacataggaaataataaaaatacgcccaaaatagagatcgtcaacattgccgtgttcggtttctcacgcggagccgcattagctagagtattttgccgctggctggagctatcttgcaaacgtcagggcgatacttggttatttgccggatgcgtcccgattcgtctttatttcttaggaatatttgacactgttgcttccgtcgggatggcacactcaacaccagggatagggagagcaccaggtcgctcagccaatggtgtcgtagatggtcaaaacagctgggctacgccggacatgttaaaagtaaccagcttcaccaaacagtgccgccattatgtggcctcgcatgaagtgcgttactccttcccgttaaccagcattcggcatgaagatggcagcatgcccctaaatgcagttgaagttgtttaccctggctcgcattctgacgtaggcggtggctatggccctggcgaccaagggaaggccgtaggccatagacgaaagcttctaagtcaaatagctttgctcaatatgtataacgacgcaagagctgcaggcgttccccttcgctctctttcagccctaaaaagagatcctgccgcacaagactttgaaattgacccacttctcattaaacgttttaatacctatatggcatgggccaacgcaggcggccgcatggtagaagatgcactctatgcccatttgaaaaaatattggcattggcgcattgcgactagcccgcagtttatgcagcaagattgcatccaacagcttagcaaaggggctacacagcgcagctcgcgctccgacaagcaagacttagaggacatgcgcgccagtgaaaaagattggcaaggtgacctatccagagcgcgcatagtagaaagcgaagttaatgaagctgctgagctattgcggctgcaatcggaagagggtaagcaacccgttccgaaggatgttcatgatttctttgatcaacatcttcatgactcgcatgcctcattttatatgatcggcccgacaactgcatggcagcgacaacaacgtatcgcagatgcaaggcacaagagcaagagcgtcatatacaatcccgcaatcggattaacgccgaagaaactcagcccattcgaacagaagttagccaagtgcgcgccaggcgactcagacgatcccaagaaaattgacagctcaaattatcccgttgtgacggatagcgactattccgatctggtcaaaggagatggcgctggcggtacggtcgcatctgcaatgacaaatacccgccgcgagattggcggacatgcccatcagcgcgcaacgttcgtaggccgctacgaacgctatgcgaaaacgaccagctcaattgatttcctcgcgcgcgacacactaaaagctcgccaggatcagctagctcacgattacaatgagcaagtcaggatacgcaatatggtctttgaaaaccaaaaagccattctgaaagaccaaggactatcgactaatcaactagaaaagactcatcagcaagacatgatgcagcttggcataaagttccgtgaccaacttcagagcctttaa

SEQ ID NO: 1497 - DNA, 846 bp, Chromobacterium substugae
atgttcctgcagaatcgccacgccccggaattgctgccgcagttgcatcaatggatggccataaacgaaaacggccattactgctggctgatggatggcagccagctcgacgccaaggaaaagcgctggctgcaacgccgccagccttggcagcgcgcgctggatgacaccccgatggatgcgctggaagacttcggcccactaatttggacagagccgctgcatctgcaagagtggtggccggaatggctggccatcacgtccggccgcccactactcagcgtggtggaattccgccatgccgtcccggatagcgcgttctggcactggctcagcgacttccgcaccgacgacgggcaaaagctgctgctgcgctttgccgacacccacacactagccaacgtgctgccgctgatgtccgacgagcaattgacgatgctcgcctcccaggtcgcccgctggggctggatcggccgcactggcgaatgggaggcggccaccctgcgcgacacacccacgattccggcgccgtgggaaccgttggagtttacgcaagcgcaattcgatagaatgatggaccgcgcccggccggacatgctcccgccgatcctcgcacactatgaagtggagctgccccaggacgaaacaccggcatcgctccatctgcgtcttagccagctggctgaagcgatgagcagttacggcattcaggatgaaccgagccaagccctttttgcctcacttgcatttgagcagggtgatagcttccatcaagaaacagaatggcaagagttctggaatcgaacccgcaaggggcaactccttacagctgcactatcagaataa

SEQ ID NO: 1498 - DNA, 2646 bp, Chromobacterium substugae
atggacatcaccgcacttctcgccagcttcgcctcagccttttcccaaaataaccgccacatcacccttgccatcgccagcgacgccgccggcccggaacagctgctgccgcagacgctggacggcgaggaaggcgtatcccgcccctaccgcttccagctggattgcctgtcgccggatggccagattgaactcaagtccctgctaggccacccggcccgcatcggcctgatgaatgccgaaggcggcgaggacgtgcgctgcggcgtgatcagccaggcgcgcttgctcggcagcgatggcggctttgcccgctacggcctcacggtggagccaccctttgccttgctgcgccatcgtcggacttcccgcgtgttccaggacatgacggtgcctgacatcatcaaacagatcatcagcgagcatcaggccgccaatccggcctttgcccgcgtgcagacgctggacatcaaggtggatgccgcccagccttcgcgcagctactgcctgcaatatagagagaacgacttcgatttcatcgtgcggctgatgcatgaggagggtttcgcctggcgcttcgaacacgtcgatggtgacagcccccaggtgcggcttgtcgtgtttgatgatgccttcagcctgcccgccggcagcgcgccaagcgtgcgcttccatcgcgccgacgccaccgaggagcaagacggcctgaccgactggcaggccgcgcgccagatcgtcgccggcggcgtggcgctggccagctacgattaccagcccacccgcaccagccacagcggcgacacaagccaggtggaccagggacaggccggccaggcgctgcagagcagccttaaccattacgacgcccccggcctctactacgccagcgacgccgaccagctcagccgctacgcccaactacgccagcaggcgcacgacctgcaggccaagaccttcaccggtttcggtgcggtgcgcggcctgcaggccggcgcgtggttccggctggacgaccacccggcgcaccagggcgacagcgcggaacagcgcgaattcgtcgtcaccggccaacgcatccaggcccgcaacaacctgccgggcgacctatcccagcagctgcaggccattgcccccggcttgggcctgcaggcggcagactcgacgaccgcgccctatcagaccgaattccaggcgcaacggcgcggcatcccgctgacgccggcctatgccgacaccccgcacgccaagccgaccagcctaggcacccaaaccgcgaccgtggtcggcccggccggcgaagaggtccacaccgacgagcacggccgcgtcaaagtgcaattccactggcagcggccggacgaacacccgaccatcggcgcggggatggacgacaagtcatcctgctggctgcgcgtggccatgccttcggccggcgcggcgtgggggcatcagttcattccgcgcatcggccaggaagtgctggtcaactttattgagggcgatatcgaccgccccttgattaccggcatgctgtacaacggcagccaccgcacgccgacattcagcggcgccggcagcctgccagccaacaagacgctttccggcatccagtctaaagagcaccagggcggcggctacaacgagctgctgttcgacgacacgcctggcgaagtccgcgccaagctgtccagcgagccgggcaagacacagctgaatcaaggctttctgacctacccgcgcagcgacggcatggcccagccacgcggcgaaggcttcgaactgcgcaccgacaaccacggagccattcgcgccgggcacggcctattactgtccaccgaggcgcagaacggcgcaggcgggaagcaactggcgcgcgaacatgcgcaaagccagctcgacgccgcgcagagtctcagccaggcgctggcggaaaccgccgccggccagttggccgacgccatggaaaccggcccggacgaaatcaccccggacaacgccaaggacggcataaaagaaaaaggccacctggcgcacctggccagcgcgttgaaggcgtgggaggccggcaccaacaccaacggcggcggcgaggttcccggccagcagcccgttatcatcctgtccgccccggccggcatcgccagcctgaccgaacagagccagaccctggccgccggccaaaatctggatctgattgcccagcgcgacagcaaccacaccaccggccggcgctggctgcacaatgtcggcatgcatatcagtctgttcgtcgcgggcgtcaaggacaaggtggcgttcaagctgatcgcggcgaaaggcaaggtgcagctgcaggcgcaaagcgacgccatggaactgaccgccgaccaggacttgaccatcacatcggccaagcaaaagatccacgccaacgccaagcaagaaatcctgctgaccagcggcggcgcctatgtctggatcaaggatggcaagatcgaactgcacgcgcctggcaacgtcagtatcaaggccggcaaacacgactggagcgggccggatcagatggggccgcccttgccgcagttccccaacaatgtctgcatcccctgcctactgaaagcgatggccgcgcgcagcccggtcgccaccaccacgcccggagcctaa

SEQ ID NO: 1499 - DNA, 309 bp, Chromobacterium substugae
atggatttgtccaagctggaatttaccgcactgattgccctgaaggctgacgtagaaggcgaaatcaaacgccgcgaagttgaagaaaaatccaaggccaagaagcagattctcgaactggctcgctcctttggcctgagcgtagaagatgtgctgagcagcaaaatcgccggcactcgcaagcccgttgaagccaagtaccgccatccagatgatagcagcctgacgtggaccggccgtggtcgaaaacctgcctgggtacaggcttggatcgacagcggcaaagctatggaaacactggctatctaa

SEQ ID NO: 1500 - DNA, 381 bp, Chromobacterium substugae
atgagtacgacccgtcccgattcgccttgcatcgccctgtgttcgaccgcgcttggcgacaatgtctgccgcggctgcgcccgcactttcggcgagatcagccagtggtgcttcatgggcgcggatgagcgcgaagcggtatggagccgcctgccgcagcggcagcggctgttgcagctggcggccgcgtgttcggcgctgctggagctggacagcctggatggcgtcgagtggggcaggttgccggacggctcgcactaccggctggaggaaggcggcggcgcgctgctgcggcgtgatgccgcggggcgggacgaacagctgtgttgcgagggcttgacgctggagcgggcggccagctggctgctggcgcaacgttga

SEQ ID NO: 1501 - DNA, 606 bp, Chromobacterium substugae
atgcaggatagttcgcagccgcagttttgggagcagcgctaccaggagggcgtgatgccttgggagggggcggagctgccagcgccggcccgggacttcttttctggccaggtgccgatgcgggtcttgctgcccggctgcggcagcgcgtcggatatgccgccgctgcacgccatgggccatcaggtgctggcggtggacttcagccagtcggcgctggatctggcgcgcaggcaatggccaggcctggcggacaagctgatgctggccgattttttccaactggatttgcccgctttcgactgtgtgttcgagcgggcttttttgtgcgctttgcccattgccatgagaaagggatatgctgatggcgtggcgaggctggtggcgcctggcggagcgctggccggggtgttcttcctggcgcaaaccgaccgcgggccgccgttcggcattgcggaggcgcaattggaagcgttgctgggtaattggttttcgctggaggaaaagcaattgttgccgactggattgccagtgttccgcggccaggagcactggatggtctggcgcaggcgcaagcttgatctggatcaagctttgacggcgtga

SEQ ID NO: 1502 - DNA, 1800 bp, Chromobacterium substugae
atggagtggttttggcgtctttacacgttttcggaaaaaaacttctggaataccctcagcagaaaattatgcagcttcttcttcatcagcggctttcagcttttgatggtgggatattgctattacgcgctgtctgatatccgcgcgactctgcggacggccggggtggcgccgcaggtgctggccagcgtggagggaaatatcgacagcgcgttgtcctggacgctgggcttatggctggtcagtttcgtcttcatcgctttcatggtgtggtatctgcgttatctgatcgtgcggccgcttaacatgatcatccagatcttcaatgaaatcggcgccggcgccggcgacctgtcgcgcgagattcccacggtgacttacgatgaaatccgcgatctatcgctgtcgtacaaccgtttcctgttgaagatgcgcgagatcatcagcaacgtccgcctgatgacggtgcgcatcgcgatggactcggcggtgacgcggcgcaacgtcaccgaatcgctgggcagcgcgcgccagcaagacgagctggccaggcaggtgagccaggccagcgagcagagcacgcgcggcgtggagcaggtgaccgagcagaccgaggcgatttccgccaccacggcggaaaacttgaaggtggcgcaggagtcttgcgaggaattgcggctggtgaccggcagcatccacgacatcagccgcaaggtgggtcatttcaatctgacggtggaggatctcagccagcgttcggcgagcatcaagaccatcgtcgatctgatcaaggacgtgtcggagcagaccaatctgctggccttgaacgcggcgatcgaggcggcgcgcgccggcgaaagcggccgcggcttcgcggtggtggcggacgaggtgcgcaagctggcggagcgggtgaaaaaggccaccgacgaaatctcgcacaatatcgatggcatgctgggcctggtggcggaaacgcagcaggagacggcggcgatcacccaggatactaatcaggcgcgcgacgtgatttcacgcgcttccgagcacttcagcaagatgatgggcgacttcgaggccacctcgaccagcctgagccagatcgcggcgaccatgcacgatttctccgagtccaatcaccaggtgaacgagcacgtggcggaaatccacgtgttggggcggcaggtgagcggccgcctgggccagaccgagagcgcggcggcggagttgaccgcggcagccgagcaggtgcaggaactggtgtcgaagttcgtgatcggcgacggcgtgttcgatcaggcggtgaatcaagcgcggggagtgcgcgacgaggtgcagcagctgctgcaggccgaattgcagcgcggggtggatctgttcgatcagcgctaccagcccatcgcgggcaccgcgccggtcaaataccgcaccgtttacgacggcaagctggaaaaactgttgcagccgatgctggacaaactggtgggcttgattccgggaggcaagttctgcgtggcggtggatggcaacggttacgcgcccacccataacagctggtacagccggccgctgagcggcgacgcggcgcgggacttggccgaaagccgcgacaagcgcatcttcaacgatccagccggtttgcgcgcggcgcgcaacaatcaaccgttcctgctgcagacttacagccgcgataccggcgaagtgttgtccgaagtggtgctgccgctgcaactgcgcgggcggcattggggggcgctgcgggtgggcttcgaccccaacagcctgctggctcaaggctga

SEQ ID NO: 1503 - DNA, 567 bp, Chromobacterium substugae
atggaagcattcctgatttccaccggcgtggtggccttggccgaaatcggcgacaagacccagttgctggccctgctgctcgcgtcccgcttcaagaaacccatccccatcattctcggcattttcgtctccacgctggtgaaccacttcgccgcggcagccgtcggccaatggctgatgaccaagatcggccccgacttcatgcgctggggcctgggcatctctttcgtgatgatggcggtctggatgctgatcccggacaaactggatgaagacggcggcctgcgcgaacgcttcggcgtattcggcaccacggtcatcgcctttttcctggccgaaatgggcgacaagacccagatcgccaccgtcgcgctggccgcccgcttccacgagctgccgatggtggtggccggcaccacgctgggcatgatgatagccaacgtgcccgccgtgctgctgggcgaagtggccgccaagaagctgccgcaaaaactgatgcacggcatcgccgcggtattgttcgtggtgctgggcgtcatcacgctgatgtcgccgctgactctctaa

SEQ ID NO: 1504 - DNA, 462 bp, Chromobacterium substugae
atgtccgttctgaaagaattcaaggaattcgccgtcaaaggcaatgtcatcgacctggcggtcggcgtggtcatcggcggcgctttcggctccatcgtcaaatcgctggtcgacgacatcatcatgccgccgatcggcttgctgatcggcaatgtcgatttttccaacctgttcttcgtgctgaaagacggcgccaagcaagccggcccctatgtatcggttgccgccgccaagcaggccggcgccaccacgctgaacctgggactgttcatcaacgcgctggtcagcttcaccatcgtcgccttcgccatcttcatgctggtcaaggccatcaaccgcctcaagcgcgaggaagccgctccggcgcccgctgcgcccgccaccaaggaatgccgctactgcctatcgtccatcccggacaaggccacccgctgtccttgctgcacctctcagctcgactaa

SEQ ID NO: 1505 - DNA, 858 bp, Chromobacterium substugae
atgcccagcaaacccaccctgctcgccgccggagccatcgcgctctgggcctcgctcgccaccctgggcgcgctgacccgctcgttgccgcccttcttcgtggtcggcgtcagcctgaccgtaggcagcctactggcgctgccccgcatccgcgagtggcgcgtgccgatccccaccctgctggtcggcgtctacggcctgttcggctaccacttcctgctgttcttcgccttccgcatggcccccgcgctggaggccaacctgctcaattacctgtggccgctgctgatcgtgatgctgacgccgctgttccgccccggctcgcgcctgggcgcccgccacctgatcggcggcgcgctgggcttcgccggcgcggcgctcatcgtcagcggcggctctctgagcttgtcccaacaatacttacccggctacctgctggccatggccgccgcgatcgtatggtcgaccttcagcctggcgctgggcaggctccccgactttcccggcagcgccgtcggcggcttctgcctgatttccggcctattgtcgctgctgtgccatgcgctgttcgagcccgcggcccagcccagcgccctgcaatgggccaccttgctgctgctgggactaggcccgatgggcggcgcctttttcctgtgggagcgcgcgctgaagcatggcgacccgcgccagatcggctcgctttcctacgtcacgccattgctgtccaccctgttgctggccgtcagcggccagggccagttgaacccgctggcgctgctggccatcctgctgatcctgggaggagcgctgctaggcacgttgtccgacaaccgcaagcctgccgatcaagcggcctga

SEQ ID NO: 1506 - DNA, 73 bp, Chromobacterium substugae
tccctgatagctcagtcggtagagcgacggactgttaatccgcaggtcgcaggttcgagccctgctcggggag

SEQ ID NO: 1507 - DNA, 73 bp, Chromobacterium substugae; identical to SEQ ID NO: 1506

SEQ ID NO: 1508 - DNA, 73 bp, Chromobacterium substugae; identical to SEQ ID NO: 1506

SEQ ID NO: 1509 - DNA, 1143 bp, Chromobacterium substugae
ttgttatggaatgaaattttccgctccccggcattggcatggtttgcgctgctggcgacggcgcattgcttggcgttaagatcgcggatggaaataacgattcaaaggatgggaagcatggacgcgttctggaatgaatggctgggacagaagggcctggcgagcgacggcgagttgccgcttggcgagcgattgagccaggtcgaggctttgctgcggcagtcggtgttggcgccgttggcgaatttcgccgtgataaaagcggaaggcgaagacgccgctgcctttttgcaaagccaattgtccagcgatattcgcgagctggtagaaggccgggcgcagtacagcacttactccagcgcgaaaggccgcatgctggcgagttttatgatttggcagcatcaaggcgcctattatctgatggtggcggcggatattgcggctgcgatagtcaaacgcctgaccatgttcgtgctgcgctccaaggtgaagatatcgctggcggacgaatggtctttgctgggaatgtcggggccgcaggcggttgaaactttgcgcaaatatttcccgggcgtggctggattggagagcttgcaaacgctgagcgccgatggcgcagtgctgctggccctgccggaggggggctttatgttggcgttgggcgaaaatgcgtcgctgcggcaggatattgccgcagccgagctgcgcccgcttgcgcctgagatctgggcgctgcgcgatatcaatgcaggcattgcctgggtgtcgcaagccactcaggaacagtttgttccccaaatggccaatatggaattgatcggcgcggtaaatttcaagaagggatgctatccgggccaggaaatcgtcgcgcgcagccagtatctgggcaagatgaagcgcaggatgttcttggtggagttctcgcaagcgctggctgtcggctccaagctatatagcccgcaattgccggatcagagtattggcatgctggctgcgtcgtgccaggtggctgaagaccgttatcgcggcctggcagtggtgcaatcgcagacctggtcgtctggaatattcggcgatgaagcgggaactattgcgctgacggctttggaattgccatatgcgctggaatccgtaacagaataa

SEQ ID NO: 1510 - DNA, 306 bp, Chromobacterium substugae
atggatctgtccaagctggaattcaccgaactggtcacgctgaaagctgacgttgaaaacgaaatcaagcgccgtgaagttgaagaaaaatccaaagccaagaagcagattatcgaactggcccgcgcttacggtttgagcgttgaagacgtattgagcaagaccgtcgccgtgcgcaagccggtggaggccaagtatcgtcacccgtccaacaacgagttgacctggaccggccgcggccgcaagccggcatgggttcaagcctggatcgacagcggcaagtcgctggaacaactggctatctga

SEQ ID NO: 1511 - DNA, 1722 bp, Chromobacterium substugae
atgctggatttcttttcaagggggtccaagggcaagccggatcccttggccaatgcggcggcggccaaggcttatgtcgatgctttgcgcatggagtttggcgcgtccgcgcacgataaggtggccgaactgctgggcggcctgaattcgccttcgctggaactttccgccgacctgctggaggcagtgctgaccctgaatctggagacgcaggcgctgcatgataccttgtgcgtccaatacctgatgaacacccggatgcccaaggtgctggaaagccagttgcgcgggcagatccttaattatggcaagcagtttaccgatttttatcaatatgcattgccggcctcagcagataatcccaatggactgaaaatacgcagccatctgccgttggtgctggctcgcatgctgcattacctgaccgaatatgccagatggcaatatattcgcaactttcagccggatgaagttttctggatgaatgccaatcagctttatcgttttgccgagcagcgcggtttcgactcccagccggtattcctgttcggcgagaaatccgccgccactaccgtccaggacctatacctggcgttgcaaatgttgtcggtgctgtgcaccggcaacctcagcgtccggcaaatcaacttctcttatgagttgctgtcgctgctcagcaaccggatgacgatgaccaaggcctatttcgccgaggccagcttctctgtcaccttgaccgatcccaaacccgccgccagggcgcggggcgcggggggaggggagcagacccgctattggaataccgcggatatggtggagatcctgcacggctgggcgatcgtgatggagggcgggcgcattccgccggagttgaagcgcctggtggagccgggcatagacgccgggctgctgcgggtgctgacgcgggaatgggcggccaagccggtggtgttcgagcgggcggagcgggtggcggtcagcaaccgccatgtcgaggtcgcgcaccggctgaccatattgcacaagctgatccgcaagccggacgaagagtcgatgcagcagcatcgcggcgtcgacagcgacagctacgacgatgcggccaatatccgcatttacggcttcgtcaccagccgcaagcgcgacaaatcgctgtcgccgctgccggccggctcgctgtcgatggccggagagaccgccgaggccggcacgccgcaggaattccagaagtgggcgctggaaaatatcagccagaccggcttgggggtatcgctggatgtgatgggcaacgaatgggtgagcctgggcagcctgataggttttcacgaggcggatggcgagtcctggaatctcggcatcatccggcgcgtcaagcgcaccagccgcgagcgcatctacctgggcatagaaacgctgagcacccggccgctggcggcatcgctgcggccgaccgacgccagattgatcgaccccactctgccgcccgaccaggtgtggctggccggccatatcagcctgttcatgccttaccgccgcagcggcaagctggtgaacgcgctgatcctgcccttgtcgctgtacatgcttggcaagcagttctacatgagcgcgcgcggcaagcatttccagatcgcgctcggcaaggtgctggaaaaaggcagtgactggtgcatggtggaggtggagctggtgaagacgctggacaagttgccggtggtgctgtga

SEQ ID NO: 1512 - DNA, 1134 bp, Chromobacterium substugae
atgaaaatcagcagcaacttcgacgccggcagcatcgaaatcgtctccgccgacaccgccgaggacatccaactgcgcatccgccgcgacaacgccgcggaattcgcgcaatggttctacttccgcgctcagggcgctgcctaccagcactgcaacttccgcttcctcaatgccggggagtgcgcgtacccgcaaggctgggtcgattaccaggcgatggcctcctacgaccgcatcaactggttccgggtgcccacccgctacgaagacggcgtgatgacgatagagcatgtcccgctgtcgggcagcatctattacgcctacttcgaaccctactcctacgagcagcacctgaacctgatcggccaggcgcagggctccggcctgtgccaggtctccgacctaggctccaccgtgcagggacgcgacatcaacctgctgaccataggccacgaagtcgaatccgatctgaagatctggatcaccgcgcgccagcatccgggcgaaaccatggcggaatggctggtcgagggcctgctgaaccgcctgctggacccgcaagacccaaccagccgcgcgctgctggatcgcgccaccttctacgtggtgccgaacatgaaccccgacggctcggtgctgggcaatctgcgcaccaacgccgccggcgccaacctcaaccgcgaatggtcggaacccagcctggagcgcagcccggaagtgctgctggtgcgggaaaagatgctggaaaccggcgtcgacctgttcctggacatccacggcgacgaaaacctcccctacgttttcctggccggcaccgaaggcgtgccgtcctggaacgaaaagctggaggcgctggccgacaacttccgccaccacctgctgctggccagcccggattaccagaccgaacacggctacccgcgcaacgaggccggcaaagccaatatgggcatcgccaccaactgggtgtgcgaacagttcggctgcctggctttcacgctggaaatgccgttcaaggacaacaacaacctgccggacgacgacttcggctggaacggccagcgcagcctgcgcctgggcgaagccctgctgtcgccgatctacgcggttctgaacgatctgaccggcgaataa

SEQ ID NO: 1513 - DNA, 555 bp, Chromobacterium substugae
atgtcctacaacaatgaacagctgaacaaactttccctcgccggcttcgaatccacgctgcgcttcgcgcaaatcgcgctggacagcgccgagcgcctggtcaaactgcagctggacgcgtccaagcaatcgctggaagacaacaccaaggccgccaagcagctgaccgagctgaaggatccgcaagaagcggtcaatcacctgaacaaactggccacccaatccatcgacaaggcggtcagccattcccgcaatctgtacgaagtggtttccggcgcgcaaagcgagctgagcaagctggttgaggaaagcgtcggccatttcaacaaatcgctgatcagctcgatcgaatcggtggccaagaacgccccggccggctccgacgccacgctgaacgcggtgaaaacctcgttcgccgccgccgccgccgccgtcaacaccttcagcaaggccgcccagcaagttgcagaattcaccgacagcagcgtcaaggcagccaccagcgccaccgccgacgcggtgaagaattcggccaagcgcggcgccaccgtttaa

SEQ ID NO: 1514 - DNA, 561 bp, Chromobacterium substugae
atgagtgttgagaaacgggtcatcaagaagtacccgaaccgccgtctgtacgataccgccaccagttcctacattacgctgggagacgtaaagcagctggtattggacaatgtcgacatccaggtgcaggacgccaagacccaggaggacatcacccgcggcgtgctgctgcagatcattctggaagaggaaaacggcggcatgccgatgttcagctacgaagtgctgacccagttcatccgttattacggccaggcgatgcagggcatgatggggcctttcctggagaaaaacctgcagcttttctcgcaactgcagcaaaaaatgcaggaacagacgcgcgcgatgtatggcgacaacgccatgctcaacaccacgctgtggagcgagttcatgaatctgcaggggccggccatccagaacatgatggctaactacatggagcagagcaccggcatgttcctggaaatgcagaaccgtatgcaggagcagaccaagcagctgttcggcggcttcggtttccccggctatccgggcgtggagcccaaggacaagccctga

SEQ ID NO: 1515 - DNA, 1323 bp, Chromobacterium substugae
atgagccaggaaggcggacagcgcttgcggcaggcccagcgccggcatctggccggcgaaaccgctggcgccgaggcggattaccgcgccttgctggcggatgcggcgatcggcgtcgctgcgcggcattggctgggttttctattgctgcagcaaggccgcctggaagaggcgcggcgggagctggcgcaggcggtggcaatggatggcggccatgccgagtggcatttcaacctggggctggcctgcgcccggctgggacgccgcgacgaggccatcgcggcgttgagggcggcggtggccggggatggcggccgttacgcttattggacgaatctggcggcgctgctggacgaggcaggggacgacgcagaggccgaacacgcctgccggcgcgccatcgcgctggaaccaggcagcccggacgcgcatcacctgttgaccgcgctgctgctgcggcagggccgcttcgacgaggccaggcgcagcaatgccgaaggcgtgctggccgagccgccgggcaagatggcgccgatcgcggtgggacaggcgctgtgcgaactgggccggcgcgacgaggcgcaggcgctggcggagagctggctgcggcagcagcccggccatccggtggcgctgcacatgctggccgctttcggcaagggcgagccgcccccggtctgcgacggcgcctatgtgggccgggctttcgacgccgctgcggccgatttcgaagcggcgctggcgcggctgcgctaccgcgggccgcaatggctggccgattgcctggcaggccagggcatcgcgccgcgctcactgtccgcgctggacctgggctgcggcaccggcctagccggcgcggcgctgcggccttacgccagccggctggatggcgtcgacctgagcgccggcatgctggcgcaggcgcgcggcaaggcgctgtacgacgcgctgtcgcaggctgacttattggactttctgcgtgacggcggcgactgccgttatcagctgatcgcctgcatggacaccctgacttacctcggcgagctggcgccgctgtttggcctgctgcgccggcggcaggggccgggcgggctgctgctgttctgcaccgaaaggctggatgatggcgacgacgctgattaccggctgcatcacagcggccgctaccgccatcacgcccgctatctggagcgtctgctggcggacggctggcgggtactggcgcgggagcggctgccggtgcgcgacgagggcggctgtccggtggccggcgaattcatttgcgcgcaacgcgtggacagcgtgggcgagccgggcgcctag

SEQ ID NO: 1516 - DNA, 144 bp, Chromobacterium substugae
ttgacggaaggcctgcgctggcgatggcggctgcctgcgcatggcggcggctatatcaataaccaaactctggcggcgcatcaatcacaattaattacaaatagccgccgcatatatttgtattttttaaaactacaaccctag

SEQ ID NO: 1517 - DNA, 1092 bp, Chromobacterium substugae
atgcgcgccaagaccacgctgcccctgctgttgctgctctccctctccccgctggcccatgcgctgggcaagacgcccggcacttacacccactaccgtttcccggcggccgcgtcggccgggctggacgcggtggacttcaccatcaccgtcaagcgcgatccgggctattccgccaatgtgtactgggccaaccagttcgacctggtcggcacttccggcgcctacaccggcatgcaaagcaatggcggcggggcgcgcaccttcctgttttccgcctgggacaccaccgacgccaagccaggcagcgccggcagctactgcaccaccttctccggcgaaggcaccggccgcagttgccgcatccatgtggactggaagcaaggccatagctaccgcttccgcgccgcctacgagccgggcggctggctgggcgtgaccgtcaccgatcagaccgatggcagctcgttcaagctgggcagcatcaagaccgccgccagcaagatctcgccgcgcaatatggtgaactggaccgagtatttcgagtggaacaacagccgctccacctgcctgggccagccctacagcctggccgccttcgccgcgccggtcggcagcgcgggcggcaagacgatggcggccgccatcagcggcagctcggtcagcgatgcctgcccggcgtattccaaagtcacggtctacagccaatccagcgagcaggaaaacggcatcggcaacagcgcgcgcgcgcccatcgccaacgccggccagtgcctggacgccaagggcggcctgggcgacggcgtcgcggcgatcatctacgcctgcaacggcggcgccaaccagtcctgggtgcatgcggccgaccagtcgctgcagctgcaaaacaattattgcttggaagaaaccggcagcggggtggaggtgcgcagctgcagcggcaagtcgcgctgggagctggcggccggccatgtccgcagcctgcgctccggcttgtgcctgagcgccaatcggccggggcagccggtcagcctgctgcaatgcggcggcccgggacagcagtggtcgctgccggcggctgccgcgcattag

SEQ ID NO: 1518 - DNA, 2430 bp, Chromobacterium substugae
atggtggccgccggctgcagctccatcctggttcgcgatgacgacggcgccatccacggcatctggaccgaggccgacgcgctgcggacggcgctgacgccagcggacgccgacgcgccagtgtcgcgggcggtgggcgagccgccggccacgctgccgcacgacatgccgctgccggacgcggtggcggtcttccgcagccgccagctgcgccacgcgctggtgttggagcatggccggccgctgggcatgctgacgctgaccgatatcgtccgcaaccagggcgtggagtccttcctcatcgtcaagcgcgtcagcgacttgccggggccgccggcggtggtgctggccgggagccaggcgccggccgaggcgctgcgggtgatgcgggagcaggcgctcagcgccctggcggtggccttgccgcagggcggcttcggcatcctcacccagcgcgacgcgctgcgctggctggcgctgggcgggttcccggccacgctggccgagggctgccgccagcccttgataggcgtgccgcgccatgccagcctgctgcaggcgcggcagctgatccagcagcacgacatccgccacttggcggtgttcggcgacgatggcgcgccgttgcggctgctaggcttcgacgacatcgtgcgcggcatcgagcacgaataccagcatgagctgaacgcggcgctgcgccagcgcgacgaggcgctgcagcagtcgcgccacagcctgctgctggccgacaaggtgttcgaatcgacgatggagggcatcgtcatcaccgaccgcaacggcctgatccagtcggtgaatccggctttttcccgcatcaccggctatagccgggaagaagcgctggggcagacgccggcgatgctcaaatccggcaagcagccgccggagttctaccagcagctgtggcgcagcctgctgcgcgacggccgctggcagggcgaggtggtgaaccggcgcaaaggcggcttgctgtacaccgaacacctgagcatcaccgcgatacgggacgccgccggcgaatgcctgcattacgtggcggtgttctccgacatcacccaacgcaagcaggcggaggaaaggctgcactttctggccaaccacgacgcgctgaccagcctgcccaaccgcacgctgttcctggaaaaactgcagggcgcggtggcgcgcgccgccgccgaccgccgcggcctggcgctgctgttcatcgacctggaccgcttcaagctggtcaacgataccctgggccaccacgccggcgaccagttgctgatccgcatcgcgcgccagctgcaggcgcggctgcagccgacggaaaccgtggccagactgtccggcgacgaattcaccgtgctgctggaaggtgttgacggcgtggcgcaggtggccggccgggcgcaggcgctgctggacgccatcaccgaattgtccggcgccgccggccagcaagtgttcgtctccgccagcatgggcatcagcatgttcccggacgacggccgcgaggccgacaccctgctggtgcatgccgataccgcgatgtaccgcgccaaggagagcggcaagaacggtttccagttctacaccgccgacatgaacgcccgcgcgctggagcggctgaagctggaatacagcctgcaccgcgcgctggcgcagcgcgagctggagttgtggtatcaacccaaggtggcgctggacagccggcgcatcatcggcgccgaggcgctgctgcgctggcgccaccccgagctgggcctggtggcgccggaccgcttcattcccattgccgaagagagcgcgctgatcgtgcagatgggcgcctgggtgctggacgccgcctgcgccgacatccgccgctggcgcgacgccgggctggacgccggacggctggcggtcaacgtgtccggccgccagctcaagcatggcgatttcgtgcggcaactggagcaggtgctggcggagtacgggctggacagcgcggcgctggagctggaaatcaccgagagcgtggcgatggaggagggtggcggcatggtggagacgctgcgccggctgcagcggctgggggtgtatctgtcgatagacgacttcggcaccggctattcctcgctggcctatctgaagcggctgccggtgcgcggcctgaagatagaccgctccttcatcgccgatttgcactgcgacagcgatgatgccgccatcacccgcgccatcgtctccatcgcccgcagcctgggcctggatatcgtcgcggagggcgtggagcgcgaatcgcagcgccgtttcctgctggagcagggctgcaactgcgcgcagggctatctgttcagccagccggtgccgcgcgaggcgttcgaggccttgctggcggcgcaggcgcggccgcgcgcgcctgcgttgctgcagaaatga

SEQ ID NO: 1519 - DNA, 1284 bp, Chromobacterium substugae
atgctcgacattactctgcttcgcaacgacatcgacgccgtagccgcccgtctggccgcgcgcggctacgccctggacaccgtggctttcaatcagctggaatccgaccgcaaatcgctgcagtcccgcatgcaggagctgcaggccaagcgcaacgcgtcttccaagcagatcggcgcggccaagagcaagggcgaggatgtctccgcgatcatggcggaggtcgccaccctgggcgacgagctgaaggcggccgaacaggcttttgaaaccgtgcagaagcaactggacggctggctgatgaccatccccaacctgccgcacgaatcggtgccggccggcaaggacgacagccagaacgtggaagtgcgccgcgtcggcgtgccgcgccagtacgacttcgaagtgaaggaccacgtcgatgtcggcgccccgctgggcctggatttcgacaccggcgccaagctgtccggcgcgcgcttcaccgtgctgaagggcgacatcgcccgcctgcaccgcgccatcgcccagttcatgctgaacacccacaccggcagccacggctacgtcgagcactacaccccttacatcgtcaacgacaccgcgctcttgggcaccggccagctgccgaaattcgccgacgacatgttcaaggtgactcgcggcggcgatgaaagcgccgcgccgcaatacctgatctccacttcggaagtgacgctgaccaacaccgtcgccgacaccatcctgaaggaagacgagctgccgctgaagatgaccgcgcactcgccgtgtttccgttccgaggccggcagctacggccgcgacacccgcggcatgatccgccagcaccagttcgacaaggtggagatggtgcgcgtggagaagccggaacactcgtacgccgcgctggaagaaatggtgggccacgccgaaaacatcctgaaggcgctggagctgccctaccgcgtggtgacgctgtgcagcggcgacatgggtttcggcgccgccaaaacctatgatctggaagtctggctgccggcgcagaacacctaccgcgaaatctccagctgctcgaacatgaccgacttccaggcccgccggatgaaggcgcgctacaaggacgaaaacggcaagaaccagctggtgcacacgctgaacggctccggcctggcggtgggccgtaccctggtggcggtgctggaaaactaccagaacgccgacggcagcgtcaccgtgccgaccgtgctgcgccccttcatgggcaaggacaagatcggcggctga

SEQ ID NO: 1520 - DNA, 1320 bp, Chromobacterium substugae
atgcccgacctgttcgccgccgaaccccagaagccgctcgccgaagcgctgcgccccgcgcggctggacgatgtcatcggccagcagcacctgatcgggccgggcaagccgctaagcctggcggtggcggccggcaagccgcattcgatgattctgtgggggccgccaggcgtcggcaaaaccacgctggcgcgcatactcgccgccagcttcgatgccgagttcatcccgctctccgccgttttcgccggcgtcaaggacatccgcgaggcggtggagcgcgcgcacgcggtgctgcagcgcgacggccgccacaccattctgttcgtcgacgaggtgcaccgcttcaacaaaagccagcaggacgcgtttctgccctttgtcgaatcgggcctggtcaccttcatcggcgccaccaccgagaacccgtcgttcgaggtgaactccgcgctgctgtcgcgcgcccaggtgtatgtgctgaacagcctgagcgaggacgagctgaagcagctgctggcgcgcgcccggcacgaacacgcgctggacgggctgaatttcgacgatgccgcggtttccacactgaccggctatgccgacggcgacgcgcgccgcttcctgaacctgctggagcaaacccgcaccgcggcgcaggcgcgcggcgcggccgacatcgacgccgccttcctggaggaagtgctgacgctgaacgcgcgccgcttcgacaagggcggcgacgccttctacgaccagatctcggcgctgcacaaatcggtgcgcggctccaatccggatgcggcgctgtactggctcagccgcatgctggacggcggcgccgacgcgcgctacctggcgcgccgcatcgtgcgcatggcctgggaggacatcggcctggccgatccgcgcgcgatgcagatcgccaacgacgccgccgccacctacgagaggctgggcagcccggaaggcgagcttgcgctgggacaagcggtgatctatctggcggtggccgccaagagcaatgccggatacaacgcgtataatgaggcccgcgccttcgtcaaacaggacaaatcgcgcccggtgccggtacacttgcgcaatgcccccactcgcttgatgaaggagctgggttacgggcacgcctaccgttacgcccatgatgaaccccatgcctacgccgccggcgaaacttacctgcccgaagggatggaggacatccgctggtaccgcccggtgccgcgcggactggaaagcaagattcaggataaactggcctttttgcgccggctggatgccgacgcccagcaagatcccgacaagtaa

SEQ ID NO: 1521 - DNA, 564 bp, Chromobacterium substugae
atgaaaaccgcacaagaactgcgcgctggcaacgtattcatggtaggcagcgacccgatggtcgtgcaaaaggctgaattcagcaaatccggccgcaacgcttccgtcgtcaagatgaagatgaagaacctgctgaccggcgccggcagcgaagccgtataccgcgcggacgacaagttcgacgtggtggttctggaccgcaaggactgcacctactcctacttcgccgacccgatgtacgtgttcatggacaccgagttcaaccagtacgaagtggaagccgacaacctgggcgacaccctgaacttcatcgtcgacggcatggaagacatctgccaggtcaccttctacgatggcaaggccatctccgtagaactgccgaccaccgtagtccgcgaagtggaatacaccgagccggccgtgcgcggcgacacctcgggcaaggtactgaaaccggcccgcctggtaggcaccaccttcgaagtacaggttccggccttcgtcaacaccggcgaaaagatcgaaatcgacacccgcaccaacgaattcaagaagcgcgcctaa

SEQ ID NO: 1522 - DNA, 1146 bp, Chromobacterium substugae
atgacacgccaacactgggacatcttctgcaccgtcatcgacaactacggcgacatcggcgtcgcctggcggctggcgcgccggctggcgcatgatcgcggcctggcggtgcggctgtgggtggacgacctggccagcttcgcgcgcatcgccccggggctggacccggcgctgccgcaacagacgctggccggcatcgacatccgccagtggccgctggccggcttcccccccgatgtcgtccccggcgacgtggtggtagaggccttcgcctgccggctgccggacagctttgaagaagcgatggcggcgaagccggccaaaccggcgtggatcaacctggaatacctgtcggccgaggactggactctcagccatcacaagctgccctcgccccatcccaggctgccgctgaccaagcatttcttcttccccggcttcgacgccgccagcggcgggctgatctgcgaagacggcctcatcgccgcgcgcgaggcctggcaggccgacccggcggcgcaacaagcctactggcggcggcgcggcctgccgccgccgcaagccggcgaactgcgcgtcagcctgttcgcctatgagaacccggcggcgacggcgctgctgcgggcctgggccgatggcgcgcaaccggtctcctgcctggtgccggccggcaaggtgcaggccgatgtggagcgggtgttcggcaaggcgttgcggccgggagaacccgccaacctgggcaatctgacagtccatatcctgccgctgagcggccaggacgactacgaccgcctgctgtggggctgcgatttcaatttcgtgcgcggcgaggacagcctggtgcgcgcgcaatgggcggcgcggccgctggcctggcacatctacccgcaggacgacgacgcccacctcgacaagctgcgggcttttctcgaccattactgccaaggcctgcccgccgaggcggcgcaagccgcgcgcgcgctcaacctggcgtggaaccagggcggcgacatcgccgcggcctggcgccgcgccgcgccctgcctgcccgcctggcggcaacatgcgacaaactggcaacaggcgctgctgcaaccgggcgatctcgtcgtgagactgctgcactttatcgccgatatcggctag

SEQ ID NO: 1523 - DNA, 2244 bp, Chromobacterium substugae
gtgcgcaagaaagcatggacatggctgctggcggcgctgccgctgccagcctgggcgggggtgttgttgcagaatggcttgtggcaggtggagctggagccggccacgctggccatcgcggcgaagccggcgggagcgatggcgcggcaactgtcgcaaggcgcggcgccgcatgcggtgtcggcgttgagccaggatggccaaacggcgcaatggcaatgggacgatggcaaatacagctggcgcgccagcttgcagggccgcgatctgcagctgacgctgacggcccgcgaggccggcaaggtggagctgttgcgccagcccgccgccgcgatggggcatggtttgctgctgccgctggccgagggcagttacatcccggcgggagacaaactgtggcaggactttctgcccggcttcgccggcgacggcctcaatacttcggaaaatctcagcctgccgctgtggggcatggattatggccatcacagcctgagctggctgctgctcaacccgttcaacaatgcgctggccatccgcgccgaaggcaaggggctggccctgtcgcttagccacgagttcaacgcgctcaatcagcagcagccgatgacgctgttgctgcacctgggcgaagccaacctcctgtccggcgcgcaacgctaccggcaatggctggaagacgaagggcgctaccagacgctggcggacaagatccgggcgcagcccgaagctgcgcggctgatcggcgccagccatgtttacctgtggggcaataacctgctggatgccgacgacgtggccgactggcccggctttgtgcagcggctgcgcggcggcggcgcgctggcgcgcaagctgcgcggccgtttcgacgccgaagcgcggcaactgctgcagcaagtcggctcccggcctgaccgttaccagaagaaaacgctgatcgaggccttcaaccaagcgctgaccgccgaggcccgcgccggctggctggggccgcagccggactgggaaggcatggccgagccttaccgccggctgcgcggacaggtggagcgcgacttcggcccggcgctggccgccgactccacgcgctggggcggcgggctgtcgcgcaaaaccgtggacgcgctggcggcggccggcctcaagcggctgtggctgggcgcggacaattgggaaggcggcctgtggcagccacaggcggtggcggccggcatcaaggcgggctacctgatggccgcctacgattcctacgaaaccgcgctgccgcccggtcagcatgtcgactggctcaccgcccagcaaggcgcggcagtctaccgcgactgcggcgtcacgctggccagcggcaagaagaaaaccggcttccagcaagccggctattacaccaatccggactgcgtgcgcgccacgctgcggcggcgcgccgaggccctgcaaaccgccgccggcttcaacagctggttcctggatgcctacgccaccggcatggtgtttgacgactacagcgccggccatcgcggcagccaggcgcaactggccgccggcaacgagcaaagcatgcgttggctggccgaccgcttcaagcagccggtaggctcggaaatgggcaacgccgccaccagcggcggcatcgccttcgctcacggcatgcaggtgccggtgctgggctggggcgacgcggacctgcagaaaaaccggcagtcgccgtatttcctcggccgctggttcccggctgaccagccggaaatcttcttccgccaggcgccgctgaagcaaccgtaccgcgacctctactacgcgccgcagtaccggctgccgctataccaggcggtgttccacggctccatcatcaccaccaaccactggctgtacgacaacctgaagttttccaacgcctacgccgacaatctgctggcgcagtggctgtacaacgtgccgccgctgttccacctgtccgccgccagcctcaaggccaggctgccgcagctacaatgcgccgaccgcgccttccgcccggttcacctgcaactggcgctgcaggcgctgaccggcttcgtctggctgaacgccgagcgcacggcgcagcaaacccgcttcgccgacggcagccgcctgagcgccaacttcggcgcgacggcggtgggcgagggcgatcaggcgctgccgccgcaaagcctgagggtggagctggctggccagccgccgcggctgctgcgggtggcggattgcggcgggggctga

SEQ ID NO: 1524 - DNA, 558 bp, Chromobacterium substugae
  modified_base (335)..(335): a, c, t, g, unknown or other
atgggcgccacgcagtggagccgccagtaccagtacgacgccgccgacaatcgtagcggccagctgagttaccgctatgatccggtcggccgcctgctggaagccgccacccccaagggcgtggaaagcttccgcttcgaccccgccggcaacctgctggacaacgccccggccgccgacggccatcaggacgacagcctgctcggcaacctgctcagccagtacgccggccgccactaccgctacgacagccgcggcaatctggtggagaagcgcgtcaacggcagcctcacccggctggaatgggacagccacaaccgcctgtcccgcctcangcggttcatccccacgcccgtggggaacacgccctcctggttggtgtcgccgaaaagcatggcggttcatccccacgcccgtggggaacacgccctcctggttggtgtcgccgaaaagcatggcggttcatccccacgcccgtggggaacacgccctcctggttggtgtcgccgaaaagcatggcggttcatccccacgcccgtggggaacaccgaagcatag

SEQ ID NO: 1525 - DNA, 861 bp, Chromobacterium substugae
  modified_base (658)..(658): a, c, t, g, unknown or other
gtgctgggcaacgcgctgcaacagcaccagagctacgacaaggccggccgcctgtccagccagcggctgatgggcgcgacgcagtggaaccgacagtaccagtacgatgccgccggccaactgaccggcatcgccgatagccgcagcggcgccctcaactaccgttacgatccagtaggtcgcttgctggaagccgccacccccaaaggcgtggaaagcttccgtttcgacccggccggcaatctgctggacaacgcccctgccgccgatggccatcaggacaacagcctgatgggcaacttgctgagccagtacgccggccgccactaccgctacgacagccgcggcaatctggtggagaaacgcgtcaacggcagcctgaccaagctggaatgggacagccacaaccgcctctcccgcctcatcgccccgggcggccagcgcaccgactaccattacgacccgctgggccgccgcatcgccaagatcagccagggacaggccacgctgtacggctgggacggcgacgtgctggccttcgaaacccgcgacgaagcagcagtgcactacctgttcgagccggacagcttcgtgccgctggcgcaggtgcacaccgacgccatccgcggcgtcaaggtgccggcctggagccagcacngcgccggaacccgaggcccccaaggcggtgtactactaccacaccgaccacctgggcaccccgcaggcgctgaccgacgagcatggcgcgctggcgctggaaatggactaccaggcttggggccaggcgcgcgaagtcatcgccgacgccgcctcaaaagccggcatccgcaacccgttccgcttccaggggcagtatcatga

SEQ ID NO: 1526 - DNA, 246 bp, Chromobacterium substugae
gtggtatttttgtcattatttgaaaatccagaattctcttatacttatcaccgttattatgccgctatttttcttttgtattgggctatttattttttatgttatattgtgcaacccgagctacatcatcatcgttgtcattggttaaaatatttaataattcaattggcgtttttttattggctgcaatggattgacgcactgttggatctggatcttttgcaagcgcgtaaaacaaatctttag

SEQ ID NO: 1527 - DNA, 1545 bp, Chromobacterium substugae
gtggacgtgctcaactacggcagcggccacgtccacggcctgctattcggccaacgcgacatcttcaaccaggagcgcgacaagctgcaccgcgaaacccagcgcgtgctgggcaatgcgctgcaacagaccctggcctacgacaaggccggccgtctgtccagccagcggctgatgggcgtcacgcagtggagccgacagtaccagtacgacgccgccggccaactcgtcggcatcgccgacaatcgcagcggccagctgagttaccgctatgatccggtcggccgcctgctggaagccgccacccccaagggcgtggaaagcttccgcttcgaccccgccggcaacctgctggacaacgccgcggccgccgacggccatcaggacgacagcctgctcggcaacctgctcagccagtacgccggccgccactaccgctacgacagccgcggcaacctggtggagaaacgcgtcaacggcagcctgaccaagctggaatgggacagccacaaccgcctctcccgcctcatcgccccggacggccagcgcaccgactaccactacgacccgctgggccgccgcatcgccaagatcagccagggacaggccacgctgtacggctgggacggcgacgtgctggccttcgaaacccgcgaccaagaagcggtgcactacctgttcgagccggacagcttcgtgccgctggcccaggtgcacaccgacgccatccgcggcgtcaaggtgccggcctggagccagcaccacccctatgacccggacaaggacccgctacgccagcccgcgccggaacccgaggcccccaaggcggtgtactactaccacaccgaccacctgggcaccccgcaagcgctgaccgacgagcaaggcctgctcgcgctggaaatggactacaaagcctggggcgaagcgcgcgaaatcatcgctgacgccgcctcaaaagccggcatccgcaacccgttccgcttccaggggcagtatcatgacgacgagtccgggctgcactacaaccgccatcgctactatgatccagagatcggacggtttatttcacgcgatccgataaagcacaatggcggaataaacatatatgaatatggcacaaatccaattgaatggatcgaccctcacggactcagttcggcgagcatccttaagaagatagcgcaaattaaaacggggcaaagtgtaacagcgtgctcatatcaagaagccaatgccattttgtttggagccttccctgacgctcaaaaatcggcaggtgctgcagataaaagcgaggagaagacagcaaaagacaaggctgcttttaaagccaacagacaaaatggaacaggcagagcttcgtatcacatggactataagacaaacccagcaactggcattttatatggtcatgaaggactacctgacggacatcctcacaaaactattccacatataaatatcgtcaccccagaaggcaagaaaactgacatatttattgaaaaaccgagcagctgcccttcaaggtcaaaaaagaaatga

SEQ ID NO: 1528 - DNA, 4626 bp, Chromobacterium substugae
atgacgaccgcagccctcgcacgccccgtagccgttattcccgccacgcctcaagccgcagcccaggcgctgcagcaaaccggccaagacttcgataaatggctgcgcagcatcagcgacggccatctgtcggtggagagcctgaaaaccatcgcgtccgcagtgccggtggtgggcaacctgatttccatcggcgacgtcatcgtcgacatcgtcgacatgtccaacaaatcccgcgccaatcaggaggtcgatgtcttcgactggctgttcctgggcgtggacctgatcggcgtgatccccgcggccggcggcctgttcaagatgggcgcgcggcccacgcttaagttgtgcgccaccagcctgcgccgcgccggcaaagactgggccaagggcgagatcgaagcgggcctggcggccaagctggtgaccatgctgccggccagttaccgcaactcgccggcggaatgggtaaagtatgtagacggcaagatccagaacgagctgaaagtctgcggcgccaaaggcgccaccatcatcgccggcatgggcgaactgctgaccagcctgggcaccggcaagttcggcgcctatgtgcaaaagaacgtcaagcatgcgcccgtccggtacaacctcaataaaaccaatgaccaaggtttttggggcacggtcagcgcccacctgcattcgctgaaccaggccgctgccgatgccggcaccgaagcggccgccggcatgacggtggccgccgccaagcagatcgactccatcctgaaaggcacagtttccgcgcgcctgatgcagcgcctgggcgcggccatggccaaatgggcgggcatgctggtggacatgctgatgaagatgtacagcagccacctgaagccgttgctggacaaactgctgaaagccttcctcaatcacctgccgaaaaaagcggcggcggtggcgaccaaggcggtgaataccgccaagaaaaaggtcgaacagaccgtgaaggaagttgccgccaagctcaagcagctcgccaaaccagggccaaaatgtgcgtgcgctagcacccaggcctccatcgggtacgcttttggcgacgagtcgctacaacacaccgacttcagccttccgggtgttcttcctattgtttggacacggcaatatcgttccaacttcggcggcaacgatcaaaaaggcgagttcggcgcgcgctggagtcttgcctacgccgcccgcttcgacattgaaggcgggcagctgaaattccacgacgacagcggccgcacgctggactatccgctgctgccggaaggcgagtcgcacaaggacggcatcgagggctttacgctcacccgcctatccgacaccctgctgtcgcagacctttggccatgacttgatccagctgtacgagcgccacggcgacagcttccgactggcgctgatcaaggaccgcgccggcaacagcattgcgatgaacttccgcgatggccgcctcagccagctggtcagcagcgccggctacgcagtggacctgaatcacgacgccattggccgcgtcacccgcgttaccctgcagaatctggaaaccggcctgccgcaacgcacgctggccgaataccgttacagcgatatcccgcagctgggcggcgatgccggcgacctgctggccgccaccgatgaaaacggcgaaagctggagctaccagtaccagcatcacctgatcacccgctacaccgaccgcaccggccgcggcatcacgctggaatgggatggcacgcatctggacgcccgagccattcgcgaatacgccgacgacggcagcctggacgtgcgcctggcctgggatgagaatatcgatctcacctatgtcactgatgcctatggccgcaccaccgaatactatttcgacgacaaaggctacaactaccgcatcgtctatccggaccacaaagaagagtggtttgaattcgatgacgacaagaagctgctcagccatattcgcccggacggcacgcaagacagctatgactacgacgccaacggcaacctgatctggcacgagcgcgccgacggcagcgaagtgcgcttcgcctacgacgaacaggacaatctagtcgaaatcattgacccgatgggcgagaaatggctgcgcgcctacgacgacatgggccagctgatagaggaaaccgacccgctcggccacaagaccaagtacgcgtacaacgagcaaggcctgccggtggccatcaccgacgccaagggcggcgccaagaagatcgcctatcgtccggacggcctgctggaaagctataccgactgttccggcagcgccacccagtggcagtacgacgaacgcggccgcccgctgctgatcgtcgatgcgatgggcaacgccacccgctatcagtacgccgccaacggcacgctacaggccatcgtccagccggacggccaagccacccagctggagcatgacgccgaagcccgcctgctgaaaatcaccgacccgctgggccgcggcacccactacgaatacgacaaggccggccggctgcaaaagcgcaccgacgccaacggccacagcctgggctaccagtacgacaagctgggccgcctcaccgcgctgcgcaacgagaaccaccgctactaccgcttcgactacgacgacggcggccgcctgacagccgaaaccggcttcgacggcagcgccacccgctatgtctacgacaacgccggccgcctggcgcagcaggtggaaggcgacgtcaccaccgattaccgctacgaccgcgccggccgcctgatcgagcgcagcgcgccgaacagcaaggaaagcttcggctacgacccggccggccgcctgttccaggccaagaaccgctatgccagcctgcgctgggtgtacgacccagtcggcaacgtcgtcgaggagcaccacggctaccacgtcgccggggtcaaggaaacctaccgctggcagcatgagtacgacaagctgggcaaccgcatcgccaccatccgcccggacggccaccgcgtggacgtgctcaattacggcagcggccacgtccacggcctgctgttcggccaacgcgacatcttcaacctggagcgtgacaagctgcaccgcgaaacccagcgcgtgctgggcaatgcgctgcagcagaccctggcctacgacaaggccggccgcctgtccagccagcggctgatgggcgccacgcagtggagccgccagtaccagtacgacgccgccggccaactcgtcggcatcgccgacaatcgcagcggccagctgagttaccgctatgatccggtcggccgcttgctggaagccgccacccccaagggcgtggaaagcttccgcttcgaccccgccggcaacctgctggacaacgccccggcctccgacggccatcaggacaacagcctgatgggcaacctgctcagccagtacgccggccgccactaccgctacgacagccgcggcaatctggtggagaaacgcgtcaacggcagcctcaccaaattggaatgggacagccacaaccgcctgtcccgcctcatcgcaccggacggccagcgcaccgactaccactacgacccgctgggccgccgcatcgccaagatcagccagggccaggctacgctgtacggctgggacggcgacgtgctggccttcgaaacccgcgaccaagaagcggtgcactacctgttcgagccggacagcttcgtgccgctggcccaggtacacaccgacgccattcgcggcgtcaaggtgccggcctggagccagcaccacccctacgacccggacaaggacccgctgcgccaggccgcaccggaaccgcaaacgccgaaggcggtgtactactaccacaccgaccacctgggcaccccgcaagcgctgaccgacgagcaaggccagcttgcgctggaaatggactaccaggcctggggccaggcgcgcgaagtgatcgccgatgccgcctcaaaagccggcatccgcaaccccttccgcttccgcttccaggggcagtatcatgatgacgagtccgggctgcactacaaccgccatcgctactatgatcctgagataggacggtttatttcgcgggatccgattgggttgatgggagggataaatacacataactatgcacctaactcaatacaatgggttgatcccctaggtctgtgggcagcaggtgccaagtacaagtataaatacggccccaacggtgaaattagaagtgccactgctaaaattagacccgaggatttgaatacaggcacaaagactagcacctcctctagagcattcgcccgtagtttaggttgcccgcacgatgatgctggccatgccattgcgaatagactaggaggttctggtggtgatgatggagtattcccccaagctctgggcattaaccgtggccaatatagaactcacgaagctcaaattgcagaaaaagttaaagctggtgacaatgtaattgtcagagtcgttccacagtatgacaagggctccactaggcctcattctgttttataccaaacaagaataaatggcaaaaccactacgagagtctttgacaatcctttaaaatgttgttgcggagaaaaaaaatga

SEQ ID NO: 1529 - DNA, 1812 bp, Chromobacterium substugae
gtgcagaccgccaccgtggtcggccccgccggcgaagaagtccacaccgacgcccagggccgcatcaaggtgcaattccactggcagcggccggacgaacaccccaccatcggcgccggtctcgacgacaaatcctcctgctggctgcgcgtcgccatgccctcggccggcgccggctggggccaccagttcatcccgcgcatcggccaggaagtgctggtcgacttcatcgaaggcgacatcgaccgccccgtcatcaccggcgtcttgtacaacggcagccacccgacgcccgacttcagcggcgccggcacgctccccgccaacaagaccctgtccggcatcaagagcaaggaacaccagggcggcggctacaacgaactcttgttcgacgacacccccggcgaagtgcgcgccaagctatccagcgaagcgggcaagacccagctcaaccaaggctacctcgcccacccaagaagcaacggcaaagcccagccgcgcggcgacggcttcgaactcagaaccgaccagcacggcgccatccgcgccgcccacggcctgctgctgtccaccgaagcgcaaaacggcgcatccggcaaacagctggcgcgcgagcacgcccaatgccagctcgacgccgccctcagcctctcccaagcgctggccgaaaccgccgccggccaactggccgacagcatggaaaccgggcccgacgaaatcggcccggacaacgccaaagccggcaagaaatcccaaggccacctgcaacaccacgccgacgcgctgaaggcctgggaagccggcagcaacaccgacaaagacggcaaaaccgcccaggaccaagccggccagcagccgctgctggtgctgtccggcccagccggcatcgccgccctgaccgagcagagccagaccgtctccgctgggcaaaacctgaacctgatcgcccagcgcgacgccaaccacaccaccggccggcgctggatccacaatgtcggccagcacctcagcctgttcgtggcaggggtgaaggacaaggtggcgctgaagctgatcgcggcgaaggggaaggtacaggtacaggcgcaaagcgacgcgatggagctgacggcggataaggagctgaccatcacctcggccaagggcaaggtgcagatcgccgccagccaggaagtgctgctcaccagcggcggcggctacatccgcatcgccggcggcaatatcgaaatacactgccccagcgaagtgagcgtcaagggcgccagccatagcctgagcggcccggccagcctcagcacccccaccccggcattcgccaagcccggcaccggcaatctgcaggtcatccacgagttcgccaacggcgtctcgatgaaccagggcaagttcgtcgtcaccgacgcgctgggcgtcaaacacaagggcgtgctggacgaggccggcaaggcgatggtgcacggcttgccggtgggccccgcccaggtcgacttcctgggccggccgaacaaggacaaggccgacatcttcccctttgtgccacagccggaagaagcggtgaaacagctggtgggcggagaggcggtgaagaagcaggcgatgagccagctctccagcctggtgggcaagaccttgccgcccggcgtcgccgcggccgccggccaactgtcccaagccaagaatacgctggaccaggccaagcaagtggccggccaggcgcaggccatgctgcagcaggcgcgcgatgtgaagcaactggcttcttccgccgccaccgtcccgaacgcagccaatctgctcaagaaaatactgtaa

SEQ ID NO: 1530 - DNA, 948 bp, Chromobacterium substugae
gtgcgccaaggccaggaaatctacaattcagagcaattgaaactaactgatcgaaaaaatagaacaatgatagaagaattgcgcgcattggcggtattcgccaaaaccgttgaaaccggctccttccgcgccgccgcccgggccttgcagctgtcgccgtcggtggtcagccaccatgtgtcgcagctggaaagccggctgggggcggcgctgctgtaccgcagcacccgccggctgtcgctgacggcggacggcgaaacgctgttccaacacgcccaggccatgctgcgggcggcggaaagcgggcttgacgccctggccggccgcgccaccgaaccgaccggacggctcagcctcaccctgcccgcctttttcgcccgttcgccgcttaccgcccggctggccggctttgcccgccgccatcccaaagtggagctggcgttggactacagcgacgagaagcgcgacctggtgcgcgacggcatcgacctggccatccgcatcggcgaattgccggacagcgcgctaaaatcgcgccgcctgttcgacatgccgcgcctgctggtggccgcgcccgccttgctgtcggcgcgccccgcgccccgccacccgcaagagctggccgactggccctggctgggcatacgcatgcggcccgaccgcaaaaccctgctagacgcggccggcgaggcgcacagcttctccatccagccagccatccgcgccaacagcctggatgccgtctgccagctggccatcgccggctgcggcctggccaccccgccggccttcctggcgacggacgacatcgcagccggcaggctgagcgaagtcgagcccgagtggcaggtggaagctctgggggtgtacgcggtatggccagccaacgccgcccgcgccagcctgacgctgcggctgacgcaatatctaagcgagatgcaacagtag

SEQ ID NO: 1531 - DNA, 408 bp, Chromobacterium substugae
atggaagaacgccgctgcgccatcatcgtcgaccccgatctgcccgccggcatcgccgcgaataccgccgccgtgctggcgatgacgctgggccgccgccacccggagctggtgggagacgacctggccgacgccgctggcagcgtgcggttgggcatcgtcacgacgccaattccggtgctgcaaggcggcgcggcgttgctgcgcgccttgcgggcgcaggcgctggaggccggattgacggtggtggagttgacggacgccacccgcagcacccgcagttatcaggagtacgccgccgccttgcgcggcacgcccgagccagacttgcgttaccaaggcctggcgctgtgcggcccggctaagcaggtgcggcggctgaccggcagcctgggcctgttgcgctga

SEQ ID NO: 1532 - DNA, 591 bp, Chromobacterium substugae
atggtctggagctttatcgccgccaccgccttgatcacgctgttgccggggccgtcgatgctggtgatcgtggcctgcgcgctgggccagggctggcgcgccggggcggccgccaccggcggcgtggtgctggccgacgccatcttgatggccatcgcgctgagcggcgtgggcgcgctggcgcaggcttcgcccttggcgctgctggggctgaagtggctgggcgcggcgtatttgacgtatttgggcgcgagcgtgttgcgggctggaaataaaggggcggcggcggaagcgagcggccgatcgggcggcgcttttcgccgcggattggcggcgacgctgcccaatcccaagatcatcgcctttttgattatctactttccgcaattcatccagccggggcgcgatacggccggccagctgctgctgctggggccgctgtttttgctgacggtgggcgcggtgtttctgctgtgcatggcggcggcgctgacggtgggccgcgccatgccgcgcggccgggctggccggctcagtcgggcgtgcggctgctgcctgatcgcctgcggcttgtattcggcgctggcttga

SEQ ID NO: 1533 - DNA, 666 bp, Chromobacterium substugae
gtgaaagccaaagccgatttcagcctgctgttcgacctggacggcaccctgacccataccgacgacctgcatttcgacgccttccgcaccctgatggccgagcacggccgcgcgctggatcacgacaccttcctgcaccacatcgtcggcgccgccaacgaagccatcatggcccggctgtttcccgaccagcccgcccaacacctggccctggccgcgcgcaaggagcagttgttccgcgattccgtcacccggctcgtccccacgccgggcgcgcgggaactgttcgactgggcggaacgccatggcgtcggcatcgccgtggtcaccaacgcgccgcgcgccaatgccgagctgatgctgggcgggctgggcctggcgcagcggatagacgcgctggtgataggcgacgaattggcccacggcaagccgcacccgctgccttaccagaccggcctggcccgcctgggcggccgcgccgagcgcgcctgcgccttcgaggattcgccgtccggcatgcgcgcggcctgcgccgccggcatccacagctatggcatcgccggcgcgctgccgccgcaaaaactgctggacgccggcgcggcagccgtcatcgccgacttcgccgcgcccgaactgtggcgctggctggagcgcgcgctggcctaa

SEQ ID NO: 1534 - DNA, 1392 bp, Chromobacterium substugae
atgagcgacatctacaaaatcggcgtaggcccctccagctcccacaccgtcggcccgatgaaggccggccaccagttcctcggcgcgctcaaggaaaccggcaagttcaaccaagtgaaccgcgtccacgtggactgctacggctccttggccctcaccggcaagggccactgcaccgaccaggccatcatcctcggcctcgccggcaacctgcccgacaccgtcgacccggacaactccgccagcctgctggccgacgtcgagcaaaccggccagttgacgctgggccgcacccaccagcgcgtggccttcggcatggactttcacaccgccaacctgccgctgcacgaaaacggcatgcagatccacgccttcgtcggcgacgaaaaagtcctgaccaaaacctattactcgatcggcggcggcttcatcgtcgacgaggagcacttcaatcaatccagctgcagcgacaccccggtgccataccacttcgtcaccgcccagcagttgatcgacatgtgcgaagaaaccggcctgtccatcgccgcgctggtgatggaaaacgagaaggccttccatgacgtgaaagacacccaggctcacttccgccgcgtgtgggaagtgatgaagggcagcatagagcgcggcatgcgcaccgaaggcaacctgcccggcccgatgcgcattccgcgccgcgcgccggcgctgcaccggatgctgaccagctcgctgaccgtggccaaagacccgatgagcgtgatggactgggtaaacatgtacgcgatggcgatgtcggaagaaaacgccgccggcggccgcgtggtgaccgcgcccaccaacggcgcctgcggcatcgtgccggcggtgctggcctactacaaccacttcatccagccgctggacgacgacagctgtctgcgcttcttcctgtcctccggcgccatcggctgcctgttcaagctgaatgcgtcgatctccggcgccgaagtgggctgccagggcgaggtcggcgtcgcttgttccatggccgccgccggcctgaccgagctgatgggcggcagcccgtcccaggtgtgcatggcggccgaaatcgccatggagcacaacctgggcctgacctgcgacccggtgggcggccaggtgcagattccctgcatcgagcgcaacgccatcgccgcggtcaaggcgatcaacgccgcccgcatggcgatgcaccgcgtcagcagccccaaggtgtcgctggacaaggtgatcgccgccatgtacgaaaccggcaaggacatggacgccaagtaccgcgaaacctcctgcggcggcctggccatccagatcaaggtggagagcaaggtggtgcccagccaggccatccgttgggtggacgacgccgcctga

SEQ ID NO: 1535 - DNA, 1299 bp, Chromobacterium substugae
atgtctcaagccattgcttcaaccgccccgcgatccggctcctccggctggaccaagcacgacaccacctggatgctcggcctgtacggcaccgccatcggcgccggcgtcctgttcctgccgatcaacgccggcatcggcggcctgtggccgctgatgctgatggccatcctggccctgccgctgaccttcttcgcgcaccgcggcctgacccgcttcgtgctgtccggcagcaaggaaggcgcggacatcaccgaagtggtggaagagcacttcggcgccggcgccggcaagatcatcaccctgctgtacttcttcgccatctacccgatcctgctgatgtacagcgtggccatcaccaacacggtgctgtccttcctgaacaaccagctgcacatcgaagtgggcaccggcatcgccacccgcgcggtgttctcgctggcgctgattttgggcctgatgtccatcgtgcgcctgggcggccagatgatcgtcaaggcgatgagcattctggtgtatccgttcgtggtggtgctgatgatgttggcgctgtacctgatcccgcaatggagcgacaccgccatccgccacgccggcagcctgggcgacgccgtgtccagcggcgccttctacaagacgctgtggctggccatcccggtgatggtgttctcgttcaaccactcgcccatcatctcgtccttctccgtcgaccagcgcaagctgcacggcgatgacgccgagcaatcttccagccgcgtgctgatccgcgcccacaccatgatggtgctgaccgtgatgttcttcgtgttcagctgcgtgttcagcctgagcccggccgacctggccgccgccaaggcccagaacatctccatcctgtcctacctggccaaccacttccagaacccagtgatggaatgggtagcgcctatcatcgccatggtcgccatcagcaagtccttcctgggccactacctgggcgcgaaggaaggcttcaacggcctggtgatcaagcagctgcgccaaagcggcaagaccatcgaatcgtcgaagctggaccgctacaccgccatcttcatgatcgtgacctgctggatcatcgccaccatcaacccgtccatcctgggcatgatcgaaaccctgggcggcccggtgatcgcgatgctgctgttcctgatgccgatgtacgcgatccagaaagtgccggcgatgaagaaatactccggcgccgccagcaacatcttcgtgacgctgatcggcctgatcgccatctccgccatcttctacgatctgatcgcctga

SEQ ID NO: 1536 - DNA, 783 bp, Chromobacterium substugae
atgagtcattcctccactctcgcctacgtggccgacgaggccgccagcaagcaacaggcgctgcgcagcgagccgggtcgctacctcctcagcgccgcgatggccggcgcgctgatcgccgtggtgctggcggtcagcctgaagctgggccaggtgttcttcgccgccggcgactccggctattacatcgccaccgccggctttttcggcgtggcgctggtcagcatcatcgtctgcaaggtggagctgttcaccagcaatgtgatgtacttcaccgtcggcgcgctcagcggccgctgccggctgtgctatctgctgcgcagctgggcgatggtctatctgggcaatctggccggcgtgctgttgttcgtcgccgtgctggcgggagcgggcggcatgggcgcgctgccggccgaccacctgctgttcaatgtggtgcagcacaaggtgcatgccccggcgatggagatcttctggaaaggcgtgctgtgcaattggatcatctgcctggcggtatgggtgccgatgcggctggccaacgaggcggcgcgcatcctggtgatcatgctgctggtgttcgtgttcttcttctccggtttcgagcacagcatcgccaatatggcctttttcgcgctggcgaagatgcagggcatggccgggttggcgtggagcgacatcctgcacaatatgctgccggccacgctgggcaatatcgtcggcggcgccatcggcgtcggcctggtggtgttccggctggaacgtcacaccttgcgggcggtctga

SEQ ID NO: 1537 - DNA, 117 bp, Chromobacterium substugae
ttggacgcatccggcatgttgcgccgcgggatcgaaaccgcgccgaaagcgatggctgacttgactaagatcaagcgaaattttcgaattcgaatgtacgatgtgttcaatatctaa

SEQ ID NO: 1538 - DNA, 2328 bp, Chromobacterium substugae
atggacgccatcactcaaaatgctacccaagccaacccgtggcgcgatttcgccgccggcgactggcagagcaaggtcgatgtccgcaacttcatccagctgaactatcagccgtacgaaggcgacgacagcttcctggctggcgcgaccgatcgcaccaagaaactgtgggacgcgctgggcgagctgctgaagcaggaacgcgccaagggcgtgctggacgtgtccgccgaccgcggctcctccatcaccgcgcacgacgccggctacatcgaccaggccaatgaagtgatcgtcggcctgcagaccgacgccccgctgaagcgcgccatcatgccgaacggcggcctgcgcatggtcgagaacggcctggaagctttcggcttcaagctggacccgatgatcaaggaagtgtgggaaaagtatcgcaagagccacaaccagggcgtgttcgatgtctacaccccggaaatcatggcttgccgcaagtccggcgtgatcaccggcctgccggacgcctacggccgcggccgcatcatcggcgactaccgccgcgtggccctgtacggcaccgacttcctgcgcgccgagcgccagcaagtgttccatgaactggacaacgccaccttcaccgacgatgtgatgcgccagcgcgaagagctgtccgagcaattccgcgcgctggacgaattgaagcagatggccgccaagtacggctacgacatcagccgcccggccgccaatgcccgcgaagcggtgcagtgggtgtacttcgcctacctggccgccgtcaaggaacagaacggcgccgccatgtccttcggccgcgtgtccaccttcctggacgtctacatcgagcgcgacatcgccgccggcgcgctgactgaggcgcaagctcaggaaatgatcgacgacctggtgatcaagctgcgcatcgtccgcttcctgcgcacgccggaatacgatcagctgttctccggcgacccgacctgggtgaccgaatccatcggcggcatgggccaagacggccgcaccctggtcaccaagaacagcttccgcttcctgaacaccctgtacaacctgggcccggcgccggaaccgaacctgaccgtgctgtggtcggtgaaattcccgcaaggcttcaagaacttctgcgccaaggtgtccatcgataccagcgccatccagtacgaaaacgacgatctgatgctgccttactggggcgacgactacggcatcgcctgctgcgtgtcggcgatgaagatcggcaagcagatgcagttcttcggcgcccgcgccaacctggccaaggccatgctgtacgcgatcaacggcggccgcgacgagaaatccggcgcgctggtggctcacggtttcgagcctatcaccagcgacgtgctgacctacgacgagctgatgcccaagttcgagaagatgatggactggctggccgccacctatgtcaaggcgctgaactgcatccactacatgcacgacaagtacgcctacgagcgcatcgaaatggcgctgcacgaccgcgacatcgtccgcaccatggcttgcggcatcgccggcctgtcggtggccgccgactcgctgtccgcggtcaagttcgccaaggtccacatcatccgcaatgaagacggcctggccgtcgactacaagatcgagggcgactacccggcttacggcaacaacgacgatcgcgtcgacgacatcgcggtgtggctgacccagtccttcatggacaagatcaaggcccagccgtacttctaccgcgattccaagccgacccagtcggtgctgaccatcacctccaacgtggtgtacggcaagaagaccggcaacaccccggacggccgccgcgccggcgaaccgttctccccgggcgccaacccgatgaacggccgcgacgtgaagggcttcgtcgccgcgggcgcctcggtggccaagctgccgtacgattcggcgctggacggcatcagctggaccgcttcggccacgcctgacgcgctgggccacaccgccgaagagcgcatcctgaacctggccaactgcctggacggcttctgctccgcgcacccgaccgagttcagcagcgccaactgcacgccgttcgactgcgaaggcgagcgccacatcgccggcggcggcttccatgtcaacgtcaacgtgttcaagcgcgaaaccctgctggacgcgatggagcacccggaactgtacccgcagctgaccatccgcgtgtcgggctacgccgtgaacttcatcaagctgacccgcgagcagcagatggacgtgatcaaccgcaccttccacggcaagatgtaa

SEQ ID NO: 1539 - DNA, 780 bp, Chromobacterium substugae
atgatcccacctattgccgcagatcacaccgaagcatgcgttaaggccgaaaccataggctatctgcactccaccgaaagcggcgccggcgtcgacggccccggcatgcgtttcgtgtttttcacctcgggctgtcagttccgctgcctgtactgccacaatccggatacctggaagctgcacaatggccgccaggtgacggtggagcaggcgctgtccgaagtcgcttcctacgcccgtttcctcaagttcgccggcggcgtcaccatctccggcggcgaaccgctgatgcagcacgagttcgtcggcgagttgttccacgcgatcaagcagcgcttcggcctgcacaccgcgctggacacccagggtttcctgcacgagcgggtgccggatgaatggttcgacgatgtcgacctggtgatgctggacatcaagcactccgatccggaaaagtatctggccctcaccggccagcccttgcagccgacgctggacttcgcccagcgtttgcagcggctgggcaagaaaatgtggatacgctacgtgctggtgcctggcctgaccgacggcgacgccgacatcgaacggctggctgatttcgtcgccgcgctgggcgaggtggtggaacgagtggaagtgctgcctttccaccagttgggcaaggacaaatgggcgcagctggggatggagtaccagctgaacgacacgccgattcccaccgccgggcaagtggcgcatgcgcgcgcgctgttcgccagccgcggcatgaaggtaacctga

SEQ ID NO: 1540 - DNA, 744 bp, Chromobacterium substugae
atggatatcgttctggaaatctgcgccggctcgccggcgtcggcgctggcggcgcaggaaggcggcgcgcagcgggtggagttgtgcgacaacctgctggaaggcggcaccacgccgtcctacggcgcgttggcgctggcgcgcgaccggctggcgatcggcctgcacgcgctgatccggccgcgcggcggcgattttctgtattcggaactggaattcgaacagatggcgcgcgacatcgagctgtgccgccggctgggcgtggacggcgtggcgttgggcctgctcaccgccgacggcgatgtcgacgtcgagcggacccggcaactggccggcctggccgggcctctggcggtgacctttcaccgcgctttcgacatggcgcgcgatccggcgcgggcattggaagacgtgatcgcggccggttgccgccggctgctgtcgtccggccaggcgccggcggcgccgcagggcgcggccttgctgcgcgcgctgcgcgaacaggccggcgcgcggctggcggtgatgcccggcgccggcgtgcgggccgacaatatcgccgccttgcggcggcagaccggctgcctggagtttcacgcctcggcgcgggccgcggcggccagcggcatgcgccatcgccagccgggcttgtccatgggcgcgccgggtgccgacgagtacgcgcggcaagagacgtcggcgcagctggtgcgggaactggcgcgccaggcggcgcaggcctag

SEQ ID NO: 1541 - DNA, 1191 bp, Chromobacterium substugae
atgccccgccagatactgatcgccgaagacagtccgggccagctccagctgctggccgagttgtgccgcaagctgccggacaccgaagtgttcgaggcgtcggacggccgctgggcgatgcagatcgcccagcggcatccgcagctggacctggtggtcaccgacctcaacatgcccggcatggacggcatagaactggcgcaggcgctgtcgcaccggatacatttgccggcgctgatgttcctcagcggcgatgtgccggagctgctggccggctgttcccgggcggccgaggcgctgggcttctcccagatcgacagctgcgccaaaccgatagacccggaccggctgctcgcccgcgtccatcgcctgctgcagggctgccgccctccgtcccggcccgacatcgccattgcgctgaccgaaatcatgaccgggctggcgcacaaccagttctgcgcgttctaccaacccatcttcaaccagcaaaaccaccgggcgggccagatggaggcgctggcgcgctggcgccatccgctgcacggcctgttggggccgcagcatttcatcgaccggctggagcacgacggcaccatcatgctgctgacccggcgcatggcgcagaccagcctggacctgctcagcctgaacagctggaccggcggcatgagggtatccatcaatctgtcgcgcagcctgctgcacgaccgggagttcttcgactggctgcagcaagaagtggagctgcggcgcatagcgcctggccaggtggtgctggaaatcaccgaaacgctggccttcaacaatctgggcaacaccctggcctcgctgctgcggatgcgcatgcgcggcttcgagctgtcgctggatgactacggcgccggcaacaccacgctggagcatgtgcgcgatctgccgctgaccgagctgaagctggaccgcagcctgattctggacatacaccgcgaccggcgcagccagggcatcctggccagcaccgtggagatgggacgccggctgggcctgagaatggtggccgaaggcatagacaacccgcaggacttcgcctatctgcgccagcactatcccgatctggagatgcagggcttctacctgagccggccgatgtcggccgccgagctgcctttgcacctcagctggagcccggacggcgattccgcctcggcctga

SEQ ID NO: 1542 - DNA, 1674 bp, Chromobacterium substugae
atgcttgcccgttcccctgtccgctggtttcacatcgcggcgctcggcccctgcctgctgctggccgccgctccggctctcgccgcagaggccgcggtggcggcgccggacgcatacggcgcggcggtggcggcgcaaatcctcaaggacggcggcaacgcggtggatgccgcggtggcgacggccttcgcgctggcggtgacctatcccgaagccggcaatatcggcggcggcggcttcatgacgctgtaccagggcggcaagccgtatttcctcgactaccgcgaaaccgcgcccagggccgccagccgcgacatgtacttggacgacaagggccaggtgacggccaatctcagcctggtgggcgcgcgcgccgccggcgtgccgggcacggtgatgggcatgtggcaggcgcaccagcgcttcggcaagctgcaatggcggcagctgctggcgccggcgatcaactacgccgagaacggcttcaccgtcgcgccgcggcagtaccagtaccgcgacgaggcggcgcagctgttcgccggcaaaaccaatttcaaccgctatttcggcagcctgaaggccggggaaaccttccgccagcccgaattggcggccaccctcaagcgcatcgcccgttacggcgcggccgatttctaccagggcgaaaccgcccggctgctggtggcgcagatgaagcgcgacaagggcctggtcgacgccgacgacctcaacggctaccgcgcgcgctggcgcgagccgatccggatagactggcgcggcaatgtcgtctacaccgcgccgccgcccagctccggcggcatcgcgctggcgcagctattggccatcaagcaggcgcgcgccgccgatttcgccggcgtcgcgcacaactccgcccgctacatccacctgctggccgaaatcgaaaagcgggtgttcgccgaccgcgccgactacctgggcgacccagacttcagcaaggtgccgaccgcgcagctgaccgacgccgcctatctgcagcgccgcgccgccgagatcaacccgcgggcgatctcgccgacgccggacgtcaagccggggttggaatcgcgccagaccacccatttttccatcgtcgacaaatggggcaacgcggtggccaacacctacacgctgaatttcgacttcggcagcggcgtggtggtgcagggcgccggcttcctgctcaatgacgaaatggacgacttcagcgccaagcccggcgtggccaacgctttcggcgtggtgggcaaggacgccaacgccatccagccgggcaagcgcatgctgtcgtcgatggcgcccaccatcgtcacccgcgacggcaaggtgacgctggccatcggcacgcccggcggctcgcgcatcttcacctccatcttccaggtgctgaacaatctgtacgatttcgacatgccgctgaagcaggcggtggcggcgcagcgcgtccatcaccagctgctgcccaaggacaccatcttctacgacgactacgcgccgctgaccggcgcggcggccagcgagctgaaaaccatgggctacacgctgaaggaccagggctggcggatgggcgacatccaggcggtgagaatgaacggcgacgaggcggaaaccgcttccgacccgcgcggccgcggcgtgggcgtggtggtgaagtga

SEQ ID NO: 1543 - DNA, 435 bp, Chromobacterium substugae
atgcggtaccggacggttttgagcgatgtggccgacgaggcggcgcgagcggctatcgtcgcgccattgatcgcctacaatcaggcgcaggcaggggcgggcaacaacaggccgctggtgatcacggtggaggacgaggccggccaagtggcgggcgggctatggggccataccggtttcggctggctgtacgtgcaactgctggcggcgccggcggaagcgcgcggccagggcctgggccggcgtctgatggaggaggccgaagcggaagcccgcgcgcgcggctgcgtcggcgcctgggtggataccttcaccttccaggcaccggcgttctacgaaagcctgggctaccggcgcttcgccgaactggccgattatccgcccggccacagccgggtgttcttccacaagcgtttcgacgcggagccgggctga

SEQ ID NO: 1544 - DNA, 1650 bp, Chromobacterium substugae
gtgactcacctgcttgcccagttcagcatccgcgccaaaatcttcggactgatcctcctcggcatcgccgcggccctcatcatcggcgtcaatggcatcacgggcgcgagcggcatgttccagctgaccatagacatgcacgacaatatgctcaaaccggtgtacttgttggggcaggccggcaagcaggcggcgtatgtcaaccgcgccgactaccgctacatcgcagaaagcgaaaaatcgcagatggaccaggtgcaggtcaaccgcgacaagttcgaggccaatatgaagggctttctcgaccaataccgcaagaccgagctgacgccgccggaagtggacgggctcaagcgctttgacgccgcctgggacgcgatgaacgcgccatgcaagaaagtgcgcgagctcagctacaccgataccggcaacggcgagaacaacaagaaggcgctgtcaatcatggccaaggagtgccgtccgctgttcaccgcggccgacgacatcctgaaggaactgtccgacatcaacatcaagctggccgacaaggcgctggacgacgcccaggcgcaataccagcgggtgcgttcgatggccatcggggtgctggtggtgggcctggtgctggtgaccgggctgggcctggcgatccagaacggcatcgtcggcagcctgaaaagcgccggcgaggcgatggtgcggataggcaatggcgacctgaacggcgaaatccgcccgcagggcaaggatgagatcgccgggatgatgcagtcgctggccgatacccagcagcggctgcgcaagaccgtcggcgacatcatgcgcgccgccaccaatgtcgcggccacgtccgagcaactggcggcgtccaccgagcaggtcagcgccagcatcggccagcaggtcaacgccacctccagcgcggcggcttccatcgaggagctgacggtcagcatagacttgtgctccagcaacgccggccaggccaacgagcaggccagccaggccggccagcaggccaaggccggcaaccgcgacgtgcaggattccaccgtgcaggtgaagaaggtcaacgagagcgtcagccgttcggccgacagcctggagtcgctgtccgatcaggcgcagcagatcggcagcatcgccaccgtgatcaaggacgtggccgaccagaccaatctgttggccttgaacgcggcgatcgaggcggcgcgcgccggcgagcagggccgcggcttcgcggtggtggccgacgaagtgcgcaagctggccgagcgcaccacgacgtcggcgcaggaaatcaccgtcatgataggcaagatccaggacggcgcgcgggtggcggtggacggcatgcgcggcagccgccagatcgtgtccgacgtggtggtggcggcggagaacgcctcggccaccatcagcacggtggagtccagcgcggcggaggtggtgggcgcgataggcgagatcgcctcggcgatgcgcgaacagcgccaggccagcaccgagctggcgagccgggtggaggccatcgcccagatgtccaaggaaaacggcatcgcggtggatgtgttctcgcaggctacccgcgagctggcgatggtggcggagcaactgcagcagaccaccatggccttcaagctggactga

SEQ ID NO: 1545 - DNA, 747 bp, Chromobacterium substugae
atgccccctgtcaccgccctgatcgccgacgacgagcgcctgatgcgcgaacaactgacaatggcgctggcgcgggtatggccggaattgcaggtggtggccgaggcgcgcgacggcgccgaagcggtggagctggcgcgccgccaccgccccgacctggcatttctagacatcaccatgccggtgcaaagcggcctcgccgccgcggtggagctggacggcgcctgcccggtggtgtttgtcaccgcctacgatcagtacgcgatcaaggctttcgaggaaggcgcggtcgactatctgctcaaaccggtggaggacgacaggctggagcgcacccgccagcgctggcagcaaaggcagatcgcgctgccgccgcaatggcaggacacgctgcggctgctgggccggcagctggaaaagcccaactacctgcgctggatacgcgcgtcggtcggcaacagcctcaggatgatcagcataggcgaagtgctgtttttccagtcggacgagaaatacacccgggtgcagaccgtcggctgcgaagcgctgatccgcatgccgatcaaggagctgctgccgcagctggacccggaggaattctggcagatccaccgcgccaccctggtgcgggtggacgccatcgatcaggtgcgccgcgacgagcgcggcctgctgctggagctgcgcggccacgaccagccgctggaggtgagccgcagctacgcccacctgttccagcgcatgtag

SEQ ID NO: 1546 - DNA, 903 bp, Chromobacterium substugae
atgaatgaacgagcacaagccgctccggccgacggcgacagcgcgctgcgcggcatcgaacactactggtggctgttcgtcgaccaggtggcgcgtctggggtgggggaggctgttcatcgcctcgctgctggtgcagaccctgggcggcatcctgaacgtcccgctgctgaccctgacgctggtcctggtctcggtgctggtcaagattctggccagcggcaagcgccaggcggagcagatcgccgaccgcgccatcgcccgcagcgagcgggccgaacagcaagccgagctggaagcgctgcagcgccagctggcggaaacccggatgggcgcgctgcaggcgcaaatcgagccgcacttcctgttcaacaccctgtcctcggtgtgccagctgatggaaaccgcgccggaacgcgcgctgtcgatgcaaaaggcgctgatccgctacctgcgctcctcgctgccggaatggcgcgaatcgccgggcgaaaccagcctgggccagcaactggagctgtcgcgcgcctttctcgacatcatgcagctgcggatggaagagcggctgcaggtgcggctggaagtgcccgaaacgctgctgcaagccaggttcccggtgatgatgctgcaaaccctggtggaaaacgccatcaagcacgggctggagcccaaggccgaaggcggcttcgtcgaagtgcgggccaaggtgctggacggcaagctgcggctgaccgtgtgcgacgacggcgtcggctttcccgacgagcccggccaaggcatgggcctggccaatatccgcgagcggctggcgctgcgctacggcgcggaggcggaacttttgctggaagtgcggcccgaaggcggcacccgcgccaccatcgcgctgccgttcgtgctggcctga

SEQ ID NO: 1547 - DNA, 240 bp, Chromobacterium substugae
atggctaagccgatgctgcacgccgccggcgccgcgctgcgctgcggctgggaacacctcgctggctacgcggcgcgcaccggctggggccgcttgctgctgacggcgctgctggtgcagattctgggcggcatgctgcgggtgcccgcgctgacgctgattttgattctggccaccctgctggccaagcttcaagccggcaagaatgagcaaagcaaacaagaggcccatcatgaatga

SEQ ID NO: 1548 - DNA, 264 bp, Chromobacterium substugae
atgaactaccaaaccatcgccgcgctgttggactcgctgatccagctctgccatcatatgcccctgtacttcacccaaggcctggactggctgtcgcagctggaatggggccgcttcacgctgttcgccctcttggcctctctcgctggcggcgcgctgatcgtgccggtcgtgctggcctggcaggcgctggactactgcgccgccaagccgctggcccgcctgcaccgcctgtcgcaacacaaggaggcgcatcatggctaa

SEQ ID NO: 1549 - DNA, 519 bp, Chromobacterium substugae
atgaccaccaccttccccgcctcccgccacggcctgctggacacccgcttcggcccggcggccgcctggctgaacgccgacggcgcgctgctgcggctgctgttcaacccgacgccgcaacaactggccgagcacgcctgccgccgcgacgacggcgcgctgcgcgaagtggcgcgccaactggccgaataccaggccggcgagcgccaaagcttcgagctggcgctggcccccgccggcacgccgttccagcagcaggtgtgggccgccttgcggcgcattccctacggccgcaccgtcagctacggcgagctggccttgctgctggacctgcccggcggcgcgcgcgcggtgggccgcgccaacgccaccaaccccatcgcgctgatcgtgccctgccaccgcgtgctgggcgccgacggcagcctcaccggctacgccggcggactgccgctgaaggccgcgctgctgcgtttcgagctggagcgcagcgctccgcccggcctgttcgccgactga

SEQ ID NO: 1550 - DNA, 1212 bp, Chromobacterium substugae
atgaacgataccaaaagcgccgctttggccgccgagtcgccgccggccgatgaccccagccgctcccgcgccttgctggccgcctccagcgcccatgcggcgcacgacggattgaccgacctggtgtacgtgctgctgccgctgtggcaggcgcagttcggcatcagctacgcgcaggtcggtctgctgcgcggcgcttactcggggatgatggccggctttcaattgctggccagccgggcggcggcgcgctgggggcgcaaacggctgctggcggcgggaacggcgctggccggcatcgcctacttggtcgccggccaggccggcggcctggcggtgttgctggcggccttgctgctgggcgggctgggtgccagcgtccagcatccgctggcgtcggcgatggtggcggattcccacgaggccggcggcggcgtcaagcaggcgctggcgcagtacaactttgccggcgatatcggcaaaacgctgattccggcgctggccggcctgctgctgacggtggcgagctggcgcgcggtggtcagcctggccggcctgctgggcctggccgcggccgccgcgctgtggcgcttgatcccggcgcggctggatgccgcgcgccgcgaggccaaggcggccgcgcccgcggccggccagggctcggccggtgccatgcgcgcgctgctgttcaccggcgtgctggacagcgcggcgcggatgggttttctcacctttctgcctttcctgctgaagagcaagggcgccggcagcgccggcatcggcctggcgctggcgctgttgttcgtcggcggcgcgttcggcaaactgttttgcggctatctgggcgcgcgcatcggcatggtgaggacggtgtggctgacggagacggccaccgcattgctgatcgcgctggcggtagcgctgccgctgttcggcgcgatggcgatcctgccgctgctgggcctggctttgaacggcacatcgtcggtgctgtacggcgcggtgccggagctggccggcgcggggagccggcgcgaccaggctttcgcgctgttctataccgggacgataggcggcggcgccttgtcgccggtgctgttcggccggctgggcgacgccgtcggcgtgccggtggcctcgctgtggctggcggcgctgctgttgctgaccttgccgctggcgtggcgggcgggcaagggattgcgggcttga

SEQ ID NO: 1551 - DNA, 351 bp, Chromobacterium substugae
atggcggctgatgcggtgatcgcgctggtggcgctgctgcatgggtattttctggtactggagatgtttctgtgggacaaaccgctgggcatgaagacctttcggctgacgccggagcgggcgcgcgacaccaaggttttggccgctaaccaggggctgtacaacggctttctcgccgccggcctggcctggggactgtggctgggcgcgggcggttttcagatcaagctgtttttcctggcctgcgtgctggcggccggcgcgttcggcgccgccaccgtcaaccggcgcattttgttggtgcaggggctgccggcggcgctgggcatcgcgctgttgtggctggcttga

SEQ ID NO: 1552 - DNA, 186 bp, Chromobacterium substugae
gtgccgctggaggagatcgcgtcggttagcctgaggcgggggcggcgtctgttcggcctgttttcgttcggccggtggctggtggcggagtctcgcggcggcaagttctatctcgaacccaccctggagtataagacggaggacctggagcgcttggtcgcgcgaatctgccagttcatcgcttga

SEQ ID NO: 1553 - DNA, 909 bp, Chromobacterium substugae
atgaaacccgcgctgggacaagtcagcgatttcgatatccgcctgctgcggctgttccgcgcggtggccgaatgcggcggcttctccgccgccgagggcgtgctgggcatcagccgctccgccatcagcctgcagatgggcgatctggaaaaacggttgggcatccggctgtgccagcgcggccgagccggtttcgcgctgacggacgaaggccgcgaagtgctgcgcgccagccacacgctgctggcggcgctggaggatttccgcggcgaagtgaacctgctgcaccgccaactgcgcggcgagttgaacatcggcatcgtcaacaacctggtgacgctgcccaggatgcgcgtcaccggcgcgctcaaagcgctgagcgagcaaggtccggaagtgaagatctccatcggcatgatgacgcccagcgacatcgaaaccggcctgctggacggccagctgcacgccggcgtggtgccgctgatccagcccttgtccgggctggactacctgccgctgtacgacgagcgctcgcagctgtactgcagccgcgaacatccgctgttcagccggcccgacaatgacttgagcgaggtggacctggccgccgccaacgccgtcgcgcccggctaccgcttgccgccgcaagcgcaggcgctgcaacaacggctacgcgccgccgccaccgcgtccgaccgcgaaggcatcgcctttttgatcctcagcggccgctacatcggctacctgccggatcacttcgccgccggctgggtggcgcaaggacagatgcggccgctgctgccggacatctgccattacgacgcgccgctggcgctggcggtgcgcaaggggcgccgcgccaatttggtgttggagcggtttttgcaggagctggaacacacaagctga

SEQ ID NO: 1554 - DNA, 120 bp, Chromobacterium substugae
atgggaaaattcggaacgggtggtgagcgggttcatgtcaggcacctgtggcgggagtatggacacagcatgccgcggacattgcgtgagttaaatgctatctttcttatgttcagataa

SEQ ID NO: 1555 - DNA, 1338 bp, Chromobacterium substugae
atgaacccgctcaccacccgttccgaattttcccatctcgatctgcgcgcgcactggatgccgttcagcgccaaccgcaacttccagcgcgatccgcggttgatcgtcgccggcgaaggcaattatctggtcgatgaccaaggccgccgcatcttcgacagcctgtccggcctgtggtgctgcggcgccgggcacagccgcaaggagatcgccgaggctgtgtatcgccagctgtcgacgctggattactcgcccggcttccagtttggccatccgctgtcgttccggctggccgagcgggtggcggcgatggcgccgggcgcgctgaaccacgtattcttcaccaactctggctccgagtgcgccgacaccgcggtgaagatggcgcgcgcctactggcggctgaagggccaggcgtccaaaaccaaattgatcggccgcgctcgcggctaccatggcgtcaacatcgccggcaccagcctgggcggcatgaatggcaaccgcaaattgttcggcccgctgatggacgcggaccatctgccgcacaccttgctgccggccaacgctttcagccgcggcttgccggcgcagggcgcggagctggcggacgacttgctgcggctgatcgagctgcacgacgcgtccaatatcgccgcggtgatcgtggagccgatggcgggctcggccggcgtgatcgtgccgccgcagggctatctgcaacgcctgcgcgagatctgcacgcagcacggcatcctgttgatcttcgacgaggtgatcaccggcttcggccgcaccggcaagctgttcggcgccgactatttcggcgtgacgccggacatcatgaatgtcgccaagcagctgaccaatggcgcggtgccgatgggcgcggtggtggcgaccagcgaaatctacgaggccttcatggcgcaggcgacgccggagtacgcggtggagttcgcccatggctacacctattccgcccatccggtggcttgcgcggcggcgctggcggcgctggacgtgctggagaacgaaaacctggtggccagggccgccgagctggcgccgcatttcgagcgcggcattcacggcctgaaaggcttgccgcatgtgatcgacatccgcaactgcgggctggccggcgcggtgcagatcgcgccgcgcggcggcgacgccatcgtgcggccgtacgaggcggcgatggcgttgtggcgcaagggcttctatgtccgctacggcggcgacgcgctgcagttcggcccgccgttcaccaccacgccgcaggagctggacagcctgttcgacgccgtcggcgagacgctgaccaagctggcctga

SEQ ID NO: 1556 - DNA, 1521 bp, Chromobacterium substugae
ttgtcaccaataaaacgagatcctgaaatgacgactttgcaacacctgatccacggcgaggcttgcgacggcggcagccgccgcgcgccgatcttcaatccatccaccggtcaagccatcgccgacgtccaactggcggacgccgccaccgtggcgcaggcggtggctgccgcccaggcggcgtttccggcctggcgcgacatgccgccggccaagcgcgcgcaagtgctgttccgcttcaagcagctgctggagcagcatgaggccgagatcgtgccgttgatcagccgcgagcacggcaagacattggaggacgccgccggcgagctgaagcgcggcatcgagaatgtggaatacgcctgcgccgcgccggcgctgctgaagggcgagtacagccgcaacgccggccccaatgtcgacgcctggagcgatttccagccgctgggcgtggtggccggcatcacgccgttcaacttcccggccatggtgccgctgtggatgtatccgctggccatcgcttgcggcaacacctttatcctgaaaccgtcggagcgcgatcccagctcgacgctgctgatcgcccgcctgctgcatgaagccggcctgccgcgtggcgtgctcaacgtggtgcacggcgacaaggaggcggtggacgcgctgctggcggcgccggaagtcaaggcagtcagctttgtcggctccacgcccatcgccgaatacatctacgccgagggcagccgccgcggcaagcgggtgcaggctttgggcggcgccaagaaccacgcggtggtgctgccggacgccgatctcgacaataccgccaacgccttgatgggcgcggcctacggctcctgcggcgagcgctgcatggccatctcggtcgccgtctgcgtcggcgatcaggcggccgacgcgctgatcgccaagctgacgccgcagatccaggctttgaaagtggggccgggcacctcgccgggcctggacatgggcccgctggtgacgcacgcgcatctggacaaggtcagcggctatatcgccgacggcgtggcggccggcgcggagctggtggtcgatggccgcggcatcgcggtgcccggccatgagggcggcttcttcctcggcggctgcctgttcgaccgagtgacgccgcagatgcgcatctaccaggaagaaatcttcggcccggtgctgtgcgtggtgcgggtgaacagcctggaagaggcgatcgcgctgatcaacgcccacgaatacggcaacggcacctgcatcttcacccgcgacggcgaggcggcgcgcctgttcgccgatacggtggaagtgggcatggtgggcatcaacgtgccgctgccggtgccggtggcctaccacagcttcggtggctggaagcggtccttgtttggcgacttgcacgcctacggcccggacggcgtgcgcttctacacccggcgcaaggcaatcacccagcgctggccgcagcgcgccagccacgaggcctcgcagttcgcctttcccagcctgtaa

SEQ ID NO: 1557 - DNA, 573 bp, Chromobacterium substugae
atgaaactgtctgcttccgcaaccatcgtttcttccccttggtccatccgccgcctgagcgcggccgatatcggcgcggattggctggacgatttccagcgccggcaggaggtgacgctggtgtatcgcggcgcgcccggcgagcggcgcatcgtggccgagccgttcatcgacgactggtcggcggacgagcggcgggcgctgtgtcgcgagctggcggcgatggcggatgccgggcgggtgtggtcggcgatggaaggggaacgcctggccggcttcgccgccattgcgccggcgccgctggggccggatggcgaataccggcaattgacggaattgcaggtcgatgcccgctggcgggggcgcggcttggggcgcgaactgatggccgcctgcgtcgccggcggcagggagatgggcgcgggccggctgtacatttcctcgcactccgccattgaaacggtgtcgttctacgagcgctgcggctgcgtgccggcgcgctggctgcatgttccgcagatcgaacgggaaccgttcgattggcagttggagtacgacctggcgcgccagtga

SEQ ID NO: 1558 - DNA, 444 bp, Chromobacterium substugae
atgcccaacaccatacgtctgcaccgcgtgctgaacgcgccgccggagcgcgtctaccgcgccttcatcgatccgctggcactggccaagtggctgccgccagacggcttcgtctgccaggtgctggagcaggacgccaccgtgggcggcggctaccggatggccttcgtcaatttctccggcggccagcagcacgagttcggcggccgctatctggagctgattcccggcgagcgggttcgctacagcgataggttcgacgatccgaatcttgccggcgagatgaccaccaccatcacgctggcgccattgtcctgcggcgccgatctcaccatcgtgcagcaaggcatcccggacgcgattccgcccgagaactgctatctgggctggcagcagtcgctgcggcagctggcggccttggtggagccggacattccgggctag

SEQ ID NO: 1559 - DNA, 1122 bp, Chromobacterium substugae
atgaaagcactgggcaagaaagcggccggcgcgcggctggaaaggatgcgcgcctccccgatgtgggcggacgacggcttccgcaacatctatccgatcgctcccggcctgcgcgacccggcggtgaagatgccgtcgctgaaagactttctgtgcggcggcgaaaggcggacgccgaatggcccgctgcccgtagcggacccgcggcatgcctggcgcaagccgccggagtccggcctgcgcgccacctggcttgggcactcgacggtgctgctggaaatagacggcctgcgcgtgctgaccgatccggtatgggggccgcgcgcctcgccgacgcggctggccggccccaaacgcttccagccggcgccagtgcggctgaaggagctgccgccgctggacctggtgctggtttcccacgatcactacgaccatctggactaccccacgatacgcgaactcgccaaaacgccggtgcccttcgtcacctcgctgggcgtcggcgcgcatctggaagcgttcggcgtggcgccgcagcgcatcaccgagctggactggtgggaaagctaccgccaccccagcgccgacctgaccgtcaccgccaccccgtcgcagcacttttccggccgcggcctgaaagaccgcaacgccacgctatggtcgtcgctggccatccgcacgccgcggcactcggtgtttttcagcggcgacaccggcctcaccggccagtttgaggaaatccgcgaacggatcggcgcattcgacctggtgatgctggaagtgggggcctaccaccccgcctggggcgatatccacctggggccggacaacgcgctcaaagccctggagctgctgggcggcggcgctttcctgccggtgcattggggcaccttcaacctggcgatgcacgcctgggacgaaccggcggacaccctgctggccctgtccgagcaaagcaatgtccaactgctgatgccgcgccagggccaggcgctggagcccgcccacgccgatcggacggagccgtggtggcgcgcggtggataccgtcgccgcgcctgccgtgccggcatccgatgccgccgccgatcaggccaaaaccattccctggccgctggattga

SEQ ID NO: 1560 - DNA, 552 bp, Chromobacterium substugae
ttggatgaagtgctgctgcagttatgccggcaagaaggcctgccggatcatgccgtgctggatatgcgggtggtgcaacgccagcgctatcctcgcgccagcctgctgtattgggccgtggtggacttcagcctgccgtccacggaggccaggctgttcgttttcgatacgctggagggttcggtgcagcgttttctggtggcgcatggccggggagaagacccggccggccatgcgcattacgcccagcacttttccgatgcgcccggctccctggcttcctgcctgggcgtgtgccgggccgccgacacctgcttcggcccgcacggcctggcgttgtggctggacggcatggggccggacaatgccaatatgcgcgcgcgccggctgaccctgcatggcgcgcagtacgtggcgccggactacatccgccaacacggcgcgccgggatgctcggacggcagcctggcgatagacccgcaatacagcgtgggcctgatcaatatgctgcagggcgggtcgtacatcaattgcatccgctcgcgcatttga

SEQ ID NO: 1561 - DNA, 984 bp, Chromobacterium substugae
atgcgcgcaatcgtcagacaacaatatggcggcccggagcagctgagaatccaggacatccccgcgccgcaagccggcgccgacgaagtgctggtgcgcgtccgcgccttcggcttgaatcgggccgagcagtatttccgccaaggcctgtggggagaagtggcggcggtatccggcatagagtgcgccggcgaggtggcccatgaccccggcggcgttttgccgcccgggcaaaccgtcatcgccctaatgggcggcatgggccgcagccgcaatggcagctatgcggagttcgtcagcgtgccggccgccaatgtggtgccggtgcgcaccacgctggactggagcgcgctcgcggctctgccggaatcctacgccaccgcctggacctgcttgcacggcaacctggcgctacaaaacggcgacaccttgctgatccgcggcgcgctgtccgccctgggtcaagccgcgatggcgctggccaagctgcatggcgcgcgcgtcatcgccaccgtcagccaggcatcccggctgcaagcggcgcgccagctgggcgcggacatcgcgcgcgtggagtccgccgaacttggcgcggaattggcggaaatcgccggttgcagcatggataaagtgctggatctggtcggcacctcgaccctgctcgattcgctgcgcctggccaaacgcgacggccgcgtctgcgtggccggctttctgggcgggcacgaaccgctggccggcttcgatcccatggcccacctgcccagcgggcggcagctcagcttcttcgccagcgccctggtatttggcagccgcgactatccattgggcgacatcccgttccaaaacatcattgaatgggcggaaagcggcgccattcccgccaggccggcgcgggtattcgccttcgagcagatccaggaggcccatagcgtgctggacgcgcaatcggccggcggcaagatcgtcgtcacgctggactga

SEQ ID NO: 1562 - DNA, 909 bp, Chromobacterium substugae
atggacttcacactgcatgagttggtctgcctggatgccgtgctgagagaaggcagcttccaggcggcggcgctgaaactgcaccgcagccatcccgccgtccacgcggcgatcaagaatctggaggcgcgtctgggcttgagcttgctggaccgcgcgtcttatcgcgtccggctgacgccgcaaggcgaggcgttccatcgccaggcccaggccttgctggcgcaggcggctagcctgggcacgatgtgcggccagctgcggagtggcgaagaaacggacttgcgcgtagtagtgggcgatctcacgcccaatgcggaggcgctggatttgctgcggcgctttttccggaactggccgcatacccggctgcacctccacttcgaggcgataagcggtccgtgggagaggctgcttgccgaggacgcggacttgatcctgcatcacgtcgataagtcggacacgcgtttcgaatggacggatgtctgccgggtggagctggtgccggtggcggcgccgggttttctggatggccccatttcccgcgatgtgagcccggagcagatggcgcgtcatgttcaggtggtgatacgggattccgcgcaggcgccggggcgcgattactttgtggtgaaggaggcgccgagttggacggtggcggatcaatacaccaagaaagacttgatcgtgcgcggcatgggctggggccatatgcccttgcatctggtggcggaggagctgcgcagcggcgcgctgctttcgctggaggggcggcatttccggcgcagcgcgctggacatcgtcgccgcgcgcttgcgcggccgtcccgccggccccgtggcgtccgcgctctggtccttcctggcggcggagggcgaagggcggccaggcggcgctcagctccgctga

SEQ ID NO: 1563 - DNA, 936 bp, Chromobacterium substugae
gtggcctgcccctattttctcttccatccgctgtcctattctttgttcatgaacgcaaaaacctgccgcctcctcgccctcattctgcaagcctgctgcggactgcgggccatggcggaaaccgagatcgtctatccggcgccggaatcgccacgcgatgtcagacatgccgacattctggaattgttgaacggcgcgctggcccatacggataagcgctatggtccggcgctcgccaggccatcgctcgagccgatgaacaagaaccgccaattgctgtcgctgacacaaggccagggcctcacgctgatgtggggctcaatcagccgcgaactgcagcaaaagactttgccggtatacattccgctacgcaaaggcctgctgggctaccgcatcgcgctgattcgacgagaccgtcaagacgagttcaaccggacagcctcgctcgccgatctgaaaaagttcagccttggccaggggcgcggctgggcggatgtcgatattctgcgaggggccggattccatgtgatcaccaacgaatatccacagctgttcggcatgatagaagctcgtcggatcgatctatttcctcgcggcatcaacgaagtgtatgcagaatacgcagcgcatcgcgaccagacgccgtctttggcggtggaagcgcatttagcgctgcattacgccaacccctactatttctacgtagccaaggacaacgccgcgttggcgcagcggctggaacagggcttgcgcctgatgatgcgcgatggcagcttcgacgaaatcttctggcgctataacggccaggcgatacgccaagcggacctggcgcaccgcggcatcatagaaatcccatccgacgatacgctgacgccgcgcaaggttctcaaggattcccagctttggttcgacccgcgcggcgcggcgtaccgataa

SEQ ID NO: 1564 - DNA, 999 bp, Chromobacterium substugae
atgcctcagctccgccaattgaaagccatcgccgccgccgtcgccatcagcgcggcaaccctgctctccgcaacctccagcctggccgccgcgccgcaaatccatgcccaggcgccgggctattaccggatgatgctaggccggttcgaaatcaccgcgctgtccgacggcaccgtcaaagtgccgctggacaagctgttgcatggcgagtccccggagcagatccggcagcagttggaaaacggcttccagacgccgggccatgcggaaacctcgatcaacgccttcctgatcaacacgggctccaagctgctgctggtggacagcggcgccggcgacctgttcggccccagcgccggcaagctgcccgccaatatccgcgccgccggttaccggctggaagacatcgacgccgtgctgctcacccatgtgcacctggaccactccggcggcctcaccgtggccggcaaggcagtcttcccgaacgccgacgtctatctgaatcaaaaggaggaagacttctggctgaacccggccaaccgcgccaaggtggcgccggcgcagccatccggcttcgatcaaagcaaaggtttcgcccaggcccaggcttcgctggcgccctatctcgccgcccatcgcgtgaaggctttcgccgccggcgccgagctgttccccggcatacgcgccatcgccgcgcctgggcacacgccggggcacaccttctatgaggcgcagagccagggccagcgcatgcagttctggggcgataccgtgcatgcccaagtggtgcagttctctcagccgcaggtgaatatagacttcgatgtcgactcctccggcgcggtcaaactgcggcgccatgcctttgccgacgccgcggcccatggctattgggtagccgccgcgcacatctccttccccggcatcggccatgtccgccgcgacgccaaggcctacgcctggattccggccaattacagcgaggacatgggaaactga

SEQ ID NO: 1565 - DNA, 927 bp, Chromobacterium substugae
atgactatcagcgaaagagattttcgcgcggttgatctcaacctgctggtgactttcctggtgttgatgcgcgaacgcagcgtatcgcgcgcggccgagcggttgttcatcggccagcctgcggtgagcggcgcgctggcgcggctgcgcagcctgttcgacgacgagctgctggtgcgcggcgccggcggcatggagccgactgcgcgcgccttgcggctggaggccgagctgttgccggcattgcaggatgtgcaggcggccttgtttcattccgagcgtttcgatccggccggcgccgaacgagctttcacgctggcgatgccggactgggtggaggtttggctgatgccgcgggttttcgccgaactgcgccgccaggcgccgcgcgtccgcgtcgccgtcaaggccaccgaccccttccagggcgcggccatgctggagaggcatgaaatggagctgggcgtggcgacgctgccggacaagccggcttggctgcgcagcgttccgctggccaggatggggttcagctgcgttcatcacggaaagcggctgccgctggccggcccgctcaccctgcgggattatgtggcccatccccatgtgctggtcacttatcgcggcgcgttccgcagcggcatagaccaattgctggaagcgcgcggcctgcggcggcaggtgcaatacaccacccagcagttcagcaccctgcccagcctgctgcgcgaagtggcggcgctgtccagcgtgccggcggcgctagccgatcattgggcgtattgccaggatctgcatgcgcatcccttgccgctgccgtcgccggaaatcgagttgtcgatgttctggcatgcggccaaggacaaggacccagcattggaatggctgcgcggcgtggtggcggaggcggcgcggacgccgctggtttga

SEQ ID NO: 1566 - DNA, 279 bp, Chromobacterium substugae
atgaacgcctggatggtcatcgcggttttgccgatcggcgccgcgtcattctattttctggcctaccagccggccgcgcagaagtactggctgcgattccccacgctggagaaataccggcaagaccatccagccagccatagccatggcgtcccgcattgccacgtttgcggcggcagcgacattctctccgtcggactattgcggccggtggaataccgccgcatctaccaatgcgcgcagtgccagaccaagctgtggcgcgccatggaaccctga

SEQ ID NO: 1567 - DNA, 2856 bp, Chromobacterium substugae
atgcagcaggaaaacatcgccgccatggcggaacaggacatctcgcgcgaggtgttgctggaaaagtacgccaagaatggcgaacaaagcgtcagcgaagtgcgccgccgcgtcgcgcgcgcgctggccggactggaacatgacccggcccgtttcgagccgctgtttttcgaggcgctggaccacggcttcatccccggcggccgcatcaattccgccgccggcaccgagctgtccgccacgctgatcaactgcttcgtgcagccggtcggcgattcggtgtcagaaaccgaacacggcaaggccggcatctaccaggcgctgctgcaggcggcggaaaccatgcgccgcggcggcggcgtcggctacaacttcagccgcatccgccccaggggcgcgcatgtgaaaggcaccaacagccgcgcttccggcccggtgtcctatatgcgcgtgttcgaccgcagctgcgagacggtggaatcggccggcgcgcggcgcggcgcgcaaatgggcgtgctggacgtcagccatccggacgtggaagccttcatccacgccaaggatcagggcgatctgcgcaacttcaatatctcggtcggcgtctccgacgccttcatgcaggcggtggaagccgacgccgactggcagctgacccacgcggtggagccggcgtccgacgccttccccgacagcttccgccgcgaagacggcctgtgggtgtaccgcaccgtgcgcgcccgcgcgctgtggcggcagatcatggaatccacctacgaccacgccgagcccggcgtgctgttcatgacccgcatcaaccaggacaacaacctgtcctactgcgaggtgatcgaatccaccaatccctgcggcgagcagccgttgcccgactacggctgctgcgacctcggatcggtcaacctgacccgccacgtgcgcgcgccgttcggcgacaaggcccacttcgacttcaagtcgttcgagaaggtggtgcggatgtccatccgcatgctggacaatgtgctggacctgaccgtgtggccgctgccggaacaggagcgcgaggcgcagaacaagcgccgcgtcggcctgggattcaccggcctgggcgacgcgctgatcatgctgaagatacgctacgacagcgaggaaggccgccgcttcgccgcccgcatcgcccagagcatgcgcgacgccgcctacgacgcctcggtggatctcgccatcgaaaaaggcgccttcccgctgttcgacgccgacgcctacctggccgcgccgcactgcgccagccggctgccggacaagatccaggcgcgcatccgcaagcacggcatccgcaattcgcacctgctgtcgatcgcccccaccggcaccatctcgctggccttcgccgacaacgcctccaacggcatcgagccgccgttctcctggttctacacccgcaaaaagcggatggccgacgacacgcagcaggaatacctggtggaagaccacgcctaccgcgtgtggcggatgcagggcggcgacaccgcgcgcctgcccgactacttcgtctccgcgctggaaatgagcgcgctggaccacatgcggatggtggccgccgtcgcgcccttcgtcgacaccgccatctccaagaccgtcaacgtgccggccgactacccgttcgccgacttcgaaagcctgtacctggaagcctggcgcaacgggctgaaaggcatcaccacctaccgccccaacaatgtgctgggttcggtgttgtcgctggagccggcgcaagccgccgccgccgcgccggaagacctgtccggcgccgccaacgacccggaccgccgcgtagtgctcaacaccgcgcccaccccggcgctatccagcttgaaatggccgaaccgccccaaactgaaggaaggcaacccgtcgtggaccttcatggtggaaggcgacgccggcgatttcgccgtggtggtcggccacatggaaaacggccgcgtccagccgtttgaatgctgggtcaacgccaccgaagtgcagcgcggcctgtccgccatcgccaaaacgctgtcgatggacatgcgctgccgcgaccgcgcctggctggccgccaagctggacgcgctgtcgcgaaccaacggcgacaagcgctaccagttcacgctgggcgacaaggccatccacgccacctcggccgccgccgcgctgggccaggtggtgcgccaccgcgtcgagcaactgggcgcgctgcggctggacgccggcgaagccacgccggtgatggacgcgctgttcgcccgcaaggagccgaaatccggcagcgacggcaccatgagctggtcggtggacgtggtgaatccgcaaaccggcgatgacttcgtgctgttcatcaaagagctgatcctgcccaacggcaagcgccggccgtactcggtatggctggccggcgcctacccgcgcgaactggacggcctgtgcaagatgctctccctcgacatgcgggtgatagacccggcctggataggcctgaagctgcgcaagctgctcaactacgccgagccgcagggcgacttcttcgcccgcattcccggactggaaaaatcgcaaagctggccatccaccgtcgcgtatctggcgcggctgatcatccaccgctacgcgatgctgggcgtgctgaccgaggaaggcgtgccgctggaggaaatgggcgtgatggcgccggagcagagcgacctgttcgcgctagaagcgccggcccagctcaagccgctggccggcaaggcctgcccggaatgcggcaaccacgcgctgataaaaaaagacggctgcgagttctgcaccgcctgcggccatgtgggggcatgcggctga

SEQ ID NO: 1568 - DNA, 3213 bp, Chromobacterium substugae
ttggcgttttgggcctttctcggcctggccgggccgcgcctgctgcaaaaggccgccgccgactgggccggcaagcatggccgccagctcagcatccagcaggtgcgcatcacgccctggagcatggagctggcgctcgacggcgtggcgctgcgcgaaggcgacggccgcccgctgttcctcgcccgccgcctatacctgaacgccgacctctacgcgctgctgctggggcgctggcaagccagcgaattcacgctggacagcccgcagctgtggctggagcgcggcgccgacggcatgtggaactgggaaaagctggcggccgacctatccggcccgcccaaactggaagacggcaccgcgccggaaaagttgccgcggctgaagatcgccgcgctgaatctgcgcagcggccagatccgcctgagcgaccataacgacggccagcacgagcgcttccggctgatgccgatcaacctcaacctggccgacctgtccacgctggccgaaaacggccgctacgcgctgcacgccgaactgcaaggcggcggccgcttcgactggaaaggcagcatgcggctgcagccgctgcaatccagcggcgaggccagcatgcaggacctgccgctggcgacggtctgggactacgtccatccctatttcgcgacggccaagccgcagggcgcgctgtcggtcaacgcccgctaccagtttgaaatgaacggcagccggcccgacctcaccgtgtcgccgatccgcgccagcctgaaagacctgaagctggcggcgccgggcggcgccagcgagctgtcgctgccggaattgacagtggaaggcggcgcgctggacctgtcgcgctcgctgctgaccatcgccaaggtggagttgaaccatggccgcgtcagcgccggccgcggcgccgacggcatggtggactggctgcgcgcgctccccgccgcgcccgccgccgccaaaccggtccaagccgccaaaccgtcgccctggctggtcaaggtggatagcctgcgtctgaaccaatggcatgcgcagtggcgcgatgacgtcttcgtcaagccgatggcgctgcaagccgacatgccgcgcatgcaagccaggatttcgctcagcccggaacacggcctgcagttgggcgatctaggcctcagcctggccggcgtcaagctgggctcggctggcgcgcctgactggctgacgctggacggcgccgagctcgcgccgtcgcagatcgacctcaagcaacagcagctgaaacccggcgacctgaccctgcgcggcctgcaagtggcgctgcagcgcgagcgcaacggccagctgcaactgcagcagctgttggcgcagcggccgccaaaagcggccaaggcaaaggccgacggcgacgccaagacgccggcctggaaattcagctatccggccatccggctggaagacagccggatgaactggcgcgacctgaccctggccaagccgctggcgctgagcatggaccagctgtccggccagcttgccacccgcgacggccagcagctggcgctggacatcgccggccggatgggcggcggcaagctggccgccaagctggacctgaacccggacaagctggccgcccgcggcagcgtcaagcttgacgcgctgcccatcgccccgctggcgccgtacgcgctggccggcaccccgctcaagctctccggcggcgcactgtccgccgacctgcagctggacgccgcctccgccagccagtggaagctggccggccagttgaaactggcgaaaatggcgctgcaggagccgggcgaagcgctgccgctgctgggctggaacagcctcagcctcagcaggctgcaagtgcagggcatgccgctgaaggccagcatcaacgacgtgcggctggaccagccgcgcgcgcggctgatcctggatccgcagcgccggctcaactggcagaagatcttcgccggcgcgccggcggccaaacccgcgcagcctgccggcaagagcgcgccgctgccgcaggtggacgtgcacagcatccacgtgcagaacggcgcggtggagttcgccgaccacggcatgactccagacttcgccacccgcatgcaccatctgcgcggcagcatccagaacctgtcgacccgcgccggcggccgcggccgcatcacgctggacggcgcggtggaccagtacggcgaggtgaaggtgcgcggcgcgctgtcgccgacgtcgccgaccgacagcaccgacatccatctcgacttccacaacctggcgctgaacaacctgaatccgtattcgatgaacttcgccggctggcaggtgaaggacggccgcctgtcgctggagctgcgctatctgctagagcaccgccagctgaagggcgagaaccgcatcgtgatcgattccatccagctgggcgaggaactgcagggcgacaagtcgccgcacctgccgctgcgcctcgccgtggcgctgctggaagacagcaacggccgcatcgacctcgatctgccggtggccggcagcctggacgacccgcagttcagctacggacaagtggtgtggaaggcgctcgtcaacatcgtcaccaaggtggtcaccgcgccgttccgcgcgttgggggcgctgctgggcggcgatggcttcgacgacatccgcttcgtcgccggcgaagcccacgtcagcccgccggagcgcgaaaagctggacaaggtggcggcgctgatggccaagcggccgaagatgcagctggccatttccggcggctacgcgccggacgaggacagcaagcagctggcgcgcgcgcgcgtcgacgccgcggtgctggccgccgccggccacgcgccgatggatgacgagccgctggcttcgctggacctgaaagacgcgcagatccagtcggcgatcaaaaccgtctacggccagcgcatcggccggctgaagctgctgggccacacgctgaagcccggcggcccgtccggcgccgaactggccaaactgctgcgcgacgagatgctggcggcggaaaaagtcagccaggccgatctcgtcaagctggcggaactgcgtggcgccaacgcccgcaaggtgatgctgcgccatgcgcccgacctcgccgaacgcgtgacgctggacgcgccgcaaaaaacctcggccaaccgcgacggcgtggagctggcggtgaaaatcaccgcgaaatag

SEQ ID NO: 1569 - DNA, 162 bp, Chromobacterium substugae
ttgcaacaaagctaccggccacgccggtcattcatcttattttcaacagacgcggccacgccgctgctggcggaccgctgcctgttcctgctgcaggccgggcggcgccacaccctggccaatccggccaggctgctgggtagctccggtacccatacataa

SEQ ID NO: 1570 - DNA, 1341 bp, Chromobacterium substugae
atggatagtgccaatgcaatcaatcaatggctggacgaacaccatatcaccgaggtggagtgtctgatcccggacatgaccggcctcgcccgcggcaagatcgtgccgcgccacaaatacaaccccgccgaggggttgcgtctgccggaggctgtgttgtcgatgacggtgaccggcgattaccccgaccgcgacttcacctcggtggccgaccccgacatgaagctgatccccgacgccagcacgctgcgcccggtgccgtggaacaaggaacccaccgcgcagatcatccacgactgttactccttcgccggcgacgcggtggacctggcgccgcgcaatgtgctcaagcgcatcctcaaactatacgaagacaagggctggaaggcggtgatcgcgccggagatggagttctacctggtggaaatccagccggacgaggacctgccgctcaggccgccggtgggccgcacccgccgcaccgaagcgggcatgcaaagcttcagcatcgatgcggtcaatgaatacgacgacatcttcgacgtgatgtatgactggtgcgaggcgcaaggcctggcgctggacacgctgatccacgagatgggcaccgcgcagatggagatcaacctggatcacggcgaccccttgcagctggccgaccaggtgttcctgttcaagcgcaccgtgcgcgaagtggccatccgcaacaatatgtacgccaccttcatggccaagccgatgcagggccagcccggcagcgccatgcacatgcaccagagcgtggtggacatcgccagcggccgcaacatcttcagcctgcaggacggcggcccgtcgccggatttcctgcatttcatcggcggcctgcagcgctacctgccggcggcgatgccgtttttcgccccctatgtgaactcctaccgccgtctcagccgctacacctcggcgccgatcaacctgtcctggggctacgacaaccgcacctgcggcctgcgggtgccgcattccgggccggaggcgcggcgggtggaaaaccggctggccggggtggacgtcaatccttacctggcgatggcggccagcctggcctgcggctacctgggcatgcgggaaggcatccagccgtccgagccattgaccggcagcgcctacgagcagccgcaccagctgccgcgccatctggatgacgccatcgacatgctgttgcgctgcaagccgctggccgagttgttcggcgagcatttcgtcgaaacctacgccgcgatcaaggaggtggagtaccgcgagtatttcgacgtgatcagcccctgggagcggcggtttctgctgttgcacgtctaa

SEQ ID NO: 1571 - DNA, 201 bp, Chromobacterium substugae
ttggccttcatgcagggatttgaaaccatcagcacgaatttcagaaaaatgagcgaacagatcatcaccaccattgtccggcgtgataaaaccaaaaccttttgcgtcgttgaaaaacttaacggtacccgtttccataatgcactccttgtgtttgtaaagggcaataaaatcgccaaaagcatgataatcaaggaatag

SEQ ID NO: 1572 - DNA, 1098 bp, Chromobacterium substugae
atgaatcgacgccgttttttgcgacacgcctccctgctgtccggcagcgccctgctgctgggcggcgccctcgccgccccgccgcgccccgcacagtccggctggcgcataccggatgagggcgaaccgcacgcagccacctggatggccttcggcgcgcgcgcggacatctggggcgagcgcctgctgggcccggtccggcaaaacctggccggcatcgcccgcgccatctcggcgttcgaaccggtggcgatgctggcgccgaaagacagcctggaattggcgcgtcaattgtgcggcgacggcgtgcgcctgatcgagcagccgctggacgacctgtggatgcgcgacaccggacccgttttcgtcaaggacgcccagggccgcgccgccggcgtcggcttccatttcaacggctggggcggcaagcaggcgcatgggcgcgacgccagggtggcagccgcggtctgcgcgcaatcgggccggccgctgctctccagccgcctggtgctggaaggcggcggcatcgaagtggacggccagggcaccgccatcatcaccgaaagctgcgtgctcaaccccaaccgcaaccctggcctgggcaaggccgcctgcgaggccgaactgaagcggctgctgggcgtggacaaggtgatctggctgcccggcgtcgccggccgcgacatcaccgacggccacaccgacttctacgcccgcttcgcggcgcccggcgtggtggtggccggcctggacagcgacccgtcgtcctacgactacgcggtgacgcggcgccatctggccatcctgcgcaccgcccgcgacgcccggggccgcccgctggaagtggtggagctggaaggcccgtccagcgtgcgtccgcgcttcgaaaaccgcgaattcgcagccggctacgtcaacttctatatctgcaacggcgcggtgatcgccccgcaattcggcgactcccgcgccgacgccaactgccgcgccatcctgcgcgaactattccccggccgcgaagtggtgcagctggacatcgacgcggtagcggcaggcggcggcggcatccactgcacgacgcagcagcagccggcgtag

SEQ ID NO: 1573 - DNA, 891 bp, Chromobacterium substugae
atgcgcactccttccctgaaactgctgctgggcttcgaggccgccgcccggcacggcaatttttcccgcgcggcggacgagctgtgcctgtcgcaatcggcgatcagccaccaggtgcagcaactggaggcgcaattgggccagcccttgttccgccgggtggggcgcggcgtggagctgacggtggccggggaagtgctgcagcaaagcgtgcggcgggcgctggacaatctgcagggcggcctggggcggatcgccggctatatggatccgggtctggtggtgctggtgtgtccggcggggctggcgcatggttggctgcagccccggctggcggatttgcagcggcggctgccgcaattgagcctgttgctgtccaccgacgagagcgcgcgcttcatcgatgaaatcgacgtcgacatcgtgatcgccgaccggcccttgcagcaggccggcgtcgcggagcggccctggctgcgcgacgagtgggtggtggcggccgcgccggagctggcgcggcggctggaggcggcgcccatcgagcggcatcccgagctggccggcttgctctgcctggaggacggcttcaccgacgcgcgcgccggcggcttgtttcgcggccacctggccggctttcgccgcgccggcgtttacgacgatgcccggctgctgctggacgcggcgctgcgcggacagggggcggcctgtctgccggcgctgctggcggatgaagcgctggcggatgggcggttgcgccgcctggcgggctatcctgccgccgccggcgcgcagtactggctggcacgcgccgacggcgagccgcgcgccgccatcgtggcggcggtggcggattggctgctggccaaggcagggctggcggcttcagtctag

SEQ ID NO: 1574 - DNA, 1386 bp, Chromobacterium substugae
atgaacaagaccgggcaattgagccaacgtttccgccacgcgatagaacagggccacctgcgcgccggcgaccgcatgccctcgctgcgcaaggtatgccaggaccacaagatcagcatcaccaccgcgcagcgcgcctacgccgaactggagaaactggggctgatcgaatcgctgccgcgctccggcttccgggtgctggcgcgcagcgccgtcctgcccagcaacctgccgctgcaaagcgacggcagcggcatccgcatcgaacacctgaccagcgcgctgcccatgccctggggctgtccgtacatgaacccggcgctgatcaacaccaccccgctcaaccgcgccctcacccgcgcgctgcgcgactaccgctacgcgctgtccggcaacggcagcaccggctacgaaggcctgcggcgcgagctgaccctgcgttatctggcgcagggcgtggagctggacggcgacgagctcttggtgacctgcggcggcatggaagcgctgaacctggcgatacgggcggtgaccaaattgtccggcagcgcggcgatgctggtgctgaccccggccttcccggcgctgttcgaccaactggagcaactgggcatcgcggcgcacacgctggccacgccgcccggccaggcgctggacctggaacggctggagcaactgatcgtccagcaccagccggccggcatcctggcgatggccaacttccagcaccccaccggcctgacgatgagcgaccatgacaaggcggcgctgctggcgctggcggaccggcaccgcctgcccatcatcgaagacgacacctaccgcgagctgtacttcggcgaaagcgcgccgctgcctttgaaggcctacgaccagaaaggcagcgtgctgtactgctcgtcattcagcaaatcgctggcgccgggctaccgcgtcggctggatcgccgccgggcgctaccgcgacagcatcctgggcctcaagctgtgcagctcgctgtccacgccgctgcccagccagatggcgctgtcgcggctgctggccggcggccaccacgaggacatgctcagcctgctgcgcagccggctgcaggccaactggctggcgatgcgccagcagctggacagccacatgccggccggcagccgccagatcgcgccgcaaggcggctatttcctgtggctggagctgccggaaggcacggactgccgccgccggctggcccaggcgatgcagcaaggcatccatttcgcgccggcgccgctgttcttccaggacaatcagccgcgcttgaacgcgatgcggctcaacttcagcttctacgacccgctgcagcagcacaacggcgtggcgatgctggccgaagcgctggccgcgctagactga

SEQ ID NO: 1575 - DNA, 1350 bp, Chromobacterium substugae
atggcagccatgtccaagctcgaaaccaaaccgatcaagatctatccccgcctgaccagcgggcgcttcaacacgctgcgcgtctcgatggtggcgttgacccagctggtattcttcggcctgccctggctgcaatggaacggccgccaggcggtgcatttcaacctggccgagcaccacttcctgatcttcggcatcagcctgtggccgcaagacttcatctacctggccgcgctgctggtggtgtgcgcgctgggcctgttcctgtggaccacgctggccggccggctgtggtgcggctacagctgcccgcaaaccgtgtacacgcagatcatgatctggatagaaagactggtgcagggcgaccacaacgcccgccgcaagctggacgcggcgccgatgagcgccggcaagttcgccaagaaggggctgacccagctgctgatgggcgcgttttcgctgtggaccggcctgaccttcgtcggctacttcaccccgatgcgcgagctggcgacgctgaacatggggccgtgggacctgttctggaccttgttctacgccggcttcacctggctgctggccggggtgctgcgcgaaaaggtctgcctgcacatgtgcccgtacgcccgcttccagggcgcgatgttcgacgaccacacgctggtcatttcctacgacgcccgccgcggcgagccgcgcggcaagcagcaggcgcgcagcgaggccaagaccaagggctgcatagactgcggcatctgcgtgcaggtctgccccaccggcatcgacatccgcaacggcctgcaatacgaatgcataggctgcgccgcctgtatcgacgcctgcgaccaggtgatggacaagatccaggcgccgcgcgggctgatcagctacaccagcgcccaggcgcagcagggccagcccgcgccggccaagtcgctgcaccggccgcgcatcgtcgtctactcctgcctgctggccggcatcatcaccttgtccaccaccgcgctggcgctgaagaagccgttcaaggtggacgtgctgcgcgaccgcgccagcctggtggaacaaaccgacgacggcctgctgcagaaccgctacaacctgcgcctgatcaacaccacggaacaaacccagcgctacagcctggcggtggaaggcctgcccggcatccggctggaccagccggaccagatcatcgcggtgaagccggcgcaaaccgaaaccgtggcagtgcgggtgcaggccgatccggagcacgccggccgcggcgcccaccccatccacttcgtgatacgctcgttgggcgatgacgtcaccatcaaggaaaagtccagcttcatcggagaatga

SEQ ID NO: 1576 - DNA, 129 bp, Chromobacterium substugae
atgaaatttccacttcgttcaaaaccctatgcggcgcaaatataccatgcccgccatcccggccgccgcgccggcaagcggccgcagccggccaaacccttgcaggaagcggttccgcgccaagcctag

SEQ ID NO: 1577 - DNA, 540 bp, Chromobacterium substugae
atgatttatatcaatgatcagcccgcgcccgggcaagacggcgtggaagacgcggatcagcagccggcgtttttcgccgtttcgccgcagaagcttttcgtcatgtcgctgagcacgctggggatgtaccaggtctactggatgtatcgccactggcagcgggtgaagcagcgggaaggcagcgatatctggcctttctggcgcgcgctgttcggctatttcttttgctacgcgctgttccgccgcattcacgacgactgcgagcgcgctagcgtggaagggctggcggccgggccgctggcggcgggttgggttgtcatctgcctgctgtggaagctgcccgagccttactggctggtcagccacgccgcgatcctgctgctgttgccggtgcaggcggcggcgtgccgggccaacgaggcgctggctcccggccatgcgcgcaacgacggctacagcggctggaacatcgccgcgattgtgttgggcggcatactctggctgctggccatctacggcatgtttttcatcaagaactga

SEQ ID NO: 1578 - DNA, 219 bp, Chromobacterium substugae
gtgctgtacttcatgctgccgacagccatgtttttggcattgtttccctcttgtctggccgggtggctttttacccgcgtgatccgcaaagtgatcgcgggcagcggctacgagcgggcgcgagctgtggcgcccagaaccggcggtttgtgcagcttgctggcggtatggggggcggcggatttttgctctgcatcggtggaggccgcagtgacatga

SEQ ID NO: 1579 - DNA, 666 bp, Chromobacterium substugae
atgaaaaagatgattctcgcctgtagtctgctgttggccttcggcgtggcccaggcccagccttacggccatttcgacatgcgccagatgctgatgccgcatgccgagggcgatgcgtcgtaccggctgaacctggagtatctggaccgcgtgctggacgatctggccggacacgcgcgcaactatccgcccgcgttcgacagccaaggcgacaagcgccaggccctcaatgacgccaagaaactgtccgacatgctggaaatcgtcgccggcggcggccaggccgacaccgaactgctgatgcgggccggtttcctgaacagcatggcttacaacctggacgtgccgaagtccggcgggcgagcccaggccgccttcgccgccgtactgcaaagagagccggacaacgccaacgcccactatctgtacggcagcttcctggccggcatgggacatgccaaagaagcgctgccgcatctggaccgggcagtggagctgggccagcaggaggcgctctactcgctgggcatggcctatctggcgctgggcgacaaggccgccgcgttgcgcgagctggaagcctatcaagccggccatccgaacgaccgcagcgtaggcggcctcatcgaagccgtgcgcagcggcgccggttcggtgcagcgctag

SEQ ID NO: 1580 - DNA, 1341 bp, Chromobacterium substugae
atgttcaatcaaaagctgaagtccgacctgagtcacgctctgtcgcaactggaagggcagaaaagcgtgctggatgcgctggaccggtcgactgccatcatcgaattcagccccgacggcatcatcctggccgccaacgccaatttcgaacagaccatgggctatgccgccgccgagatcatcggcaagcatcaccgcatgttctgcccgccgcagctcgccgccagccaggaatacctggctttctggcaaatgctgcgcgaggggcgcttcgtcaaggatcagttcaggcgcatcgccaaggatggccgcaccgtctggctggaggccagctacaaccccatccgcgaccacaacaaccaggtggtcaaggtggtcaagttcgcgctggacatcacgcatgaagtcaagatcgcccacgaggcgagcaacaccatgaaagcggtggggcgctcgatggcggtgatcgagttcacgccggacggcgtgattctcgccgccaacgccaatttcctggccgccactggctacagcgccgatgagatcgtcgacaagcaccaccgcatcctctgccccgccgacttcgtcaacagcccggcctacgaggaactgtggcgcacgctgaaacagggtgtgttcgtcaccgggcgcttcgagcgccgccacaaatcgggccggccggtctggctggaagccagctacaacccgatcttcgacgacgatggcgcggtatgcaaggtgatcaaattcgccaccgacatttccgaccaggaaaccgcccgccaggaagacctgcgcctggtgcaggaggctcaccggctgtcggcggcgtcggacagcgcctccaacgacggccagcaggtgatccgcgacaccatccgggcaatgaacgtgatcgccgacagcgccggcaagtcggcccggctgatcgaagacctggaacagaaaaccggccgcatcaccaccatcgtcaacaccatccatgagatcgccgaccagaccaatctgctggcgctgaacgcggcgatcgaagcggcgcgcgccggcgagcaaggccgcggcttcgcggtggtggccgacgaggtgcgcaagctggccgaacgcaccagcgcctccaccaaggaggtgaccgagatgatagacgacatcaagaccggcaccggcagcgccaccgacagcatccacgaaatgctggtcaaggcccagctgggcgaggaacacgccagcgtggccagcacctcgatagacgagatccgcgccagcacttcgcagctggccgacgtggtcaaccatttctccgcggtgcaggccaactcgacccacccgccgcggggcagctag

SEQ ID NO: 1581 - DNA, 630 bp, Chromobacterium substugae
atggaaatcgaaatcgccaaaatcttcatcgccctgctggtgctggtcaatccgctcggcgccatccccattttcatcagcctgacgcccaatgccagccaggaagaacgccagaagatagccaagaccaccgccatcgccgtggccgtggtgctgtgcctgttcgcgctggtcggccagaccctgctgcgctttctcggcatcagcataggctcgtttcaggtgggcggcggcatcctgctgatgctgatcgccatcgcgctgatgaacgccaagcctggccccaccaaaaccaccaagcaagaaagagaagaagccggccacaagaccaatatcgcggtggtgccgatggccatcccgctgatgaccggccccggcaccatctccaccgtgatcatctacgccaccaccgcccattcctgggtgcaggtggtctatctgctcatcagcggcctgctggtcgccatcacctgctacggcgcgctggtgctggcttcgccgctcacccgcctgctgggccagaccggcatcaacatcgtcaaccgggtgatgggcatgctgctggcggcggtatcggtggaaatcatcgtcgacggcgtctaccggctgtttccgcagctgacgcgctga

SEQ ID NO: 1582 - DNA, 1134 bp, Chromobacterium substugae
atgagcgcgacgctggatctggcccgcgaattgatccgccgcgattccgtcaccccgcgcgacgaaggctgccaggcgctgatgatagaccgcctggaggccatcggcttcaaggtggagaagatgcgccacggcgacgtcgacaacttctgggcgcgcaggggcggcgccggcccgctgttctgcttcgccggccataccgacgtggtgcccaccggcccgctggaaaaatgggacagcccgccgttcgagcccaccgtgcgcaacggcctgctgtacggccgcggcgcggcggacatgaaggcgtcgctggccgccttcgtcaccgcctgcgagcgtttcgtcgccgcccatccggaccacgagggctcgctggcgctgctgatcacctccgacgaggaaggcgtggcggtggacggcacggtgaaggtggtggacgcgctggaggcgcgcggcgagacgatagactactgcatcgtcggcgagccgacctccgagcagcggctgggcgacaccatcaagaacggccgccgcggctcgctgtccggccgcctggtagtgcacggcatccagggccacatcgcctacccgcagctggcgaagaaccccatccacctgatggcgccggcgctggccgaattggccgccacccgctgggacgaaggcaacgacttcttcccgcccaccagctggcaggtgtccaacattcaggctggcaccggcgccaccaatgtcatccccggccactgcgagctgctgttcaacttccgcttctcgccggaaagcccggcagacagcctgaaggaacgggtgtgccagatcctggacaagcacggcctaggctacgagctgcactggcagctgtccggccagcccttcatcacgccgccgggcgcgctgacggaagccttgagcgccgccattgccgaagtggccggctccaaggccgagctgtccaccaccggcggcacctcggacggccgcttcatcaagcgcatcgcccgcgagctggtggagttcggcccgatcaacgccaccatccacaagctgaacgagtgcgtggaagtggcagacgtggagccgctgtccgatatctaccggcgcacgctggagttgctgctggccaaggcgtga

SEQ ID NO: 1583 - DNA, 351 bp, Chromobacterium substugae
atgattaccctgtacggcattcccaactgcagcaccgtgaagaaggcccgccaatggctggccgacaacggcatcgactacaccttccacgacttcaagaaacagggcatagacgccgagcgcctgtcggcctgggccgagcaagtcccgctggccaagctggtgaaccgccagggcaccacctggcgcgcgctgccggacgcggccaaaaccgccgccgacacccgcgacggcgccatcgcgctgatgcgggagcaaacctcggtgatcaagcgcccggtgctggagtgggacggcaaggtcggcgtcggcttctccgaggccgactgggcggagcgcttcggcaaatga

SEQ ID NO: 1584 - DNA, 1131 bp, Chromobacterium substugae
atgctgatgctgcccttcttcaagctgatggccgagcgcaaggccagcgacctgttcatgaccagcttctcgccgccgatgctgaagctggacggcgacctgcaaccggtcaacgacaagccgctgaccgccgacatggtcaaacagctggcctacagcctgatgagcgaagaagaaatcgcggttttcgaacgcgagcgcgagatgaacctgggccacccagtgccaggcctcggcagcttccgcgtcaacatcttctggcagcgcggctcggtcggcatggtggtgcgctacatcctgcccagcattccctcgctggagcagctgcagctgccgcccatgctggcgagcctgatccagcaaaagcgcggactgatcctggtggtcggctccaccggctccggcaagagctccaccgtggcggcgatgctgcaaacgcgcaaccagaccatgaagggccacatcctcaccgtcgaggatcccatcgaattcctgtaccggcacgacaaatccatcgtcaaccagcgcgaagtcggcttcgacacgctgtcctacgcccgcgcgctgaaaaacgcgatgcgcgaggcgccggacgtgctgatgataggcgagatccgcgacgcggaaaccctgggccacgccatcacctacgcccagtcaggccacctgtgcatctccacgctgcacggcaacaacagctatcacatgctgaaccgcgtcatcaatttcttcccgccggaaagccgcaataccttgctgatggacctgtcggcctcgctgcgggcggtggtgtcgcaacggctgatcgccacgctggacggcggccgggtgccggcgatcgagctgatgatcaacacgccgcacatttcggagttgattcgaaccggagagatagacaaaatcaaggaggccatcgagagcagcatgagcgatggctcgcaaaccttcgagcaggcgctgttccagctgtacaaggccggacgcgtcagcctggacgaggcgttgaaaaacgccgattcgccgaccaatctgtactggctggtcaatcagtccaaggaaggcgccgcggacaagaacaaatctggccccgacagcgcggccagcttcgacagcatcaaactggacctgtaa

SEQ ID NO: 1585 - DNA, 1680 bp, Chromobacterium substugae
atggacaaggtgtggcttaaaaactaccaggctggggttgcccacgaaatcgacatcaatcagttccagtcggtgaccgaggtgttcgaccgcagcgtcaagaaattcagcgatcggcccgccctcgcctgcatgggcaaggtgctcagctacgcggagctggacgcgctcagcggccagttcgcgtccttcttgcagcacaagctgggcctggcgaagggcgaccgcgtggcggtgatgatgcccaatctgctgcaatacccgctggcggtgttcggcacgctgcgcgccggcggcatcgtggtcaacgtcaacccgctgtacaccccgcgcgaactggagcaccagctgaaggactccggcgcggaaaccatcgtcattctggagaacttcgccggcgtgctggagcaggtgctgccgcgcacccgggtgaagaacgtggtgatcgcctccatcggcgacatgctgggcttcgccaagggcgcgctggtcaacttcgtggtgcgcaaggtgaagaagatggtgccgccgtggcacattcccggccacatccgcttcaacgacgccctctccgccggcgcggccaagccttacgtcaagccggcgctgacccacgacgacatcgccttcctgcaatacaccggcggcaccaccggcgtggccaagggcgcggagctgctgcacaagaacatcgtcgccaacatgctgcaggccaacgcctgggtcaaaccgctgatccgcgaaggccaggaagtgatcgtcaccgcgctgcctctgtaccatatattctcgctgaccgccaatctgatggtgttcaccaatatgggcgcgctcaacctgctgatcaccaatccgcgcgatatcccgggcttcatcaaggagatgaagaaatacccggtgacctgcatcaccggcgtcaacaccctgttcaacgcgctgctgaaccacccggaattctccaagctggacttctccacctggcgcctgacgctgggcggcggcatggcggtgcaaaaagcggtggcggacaagtggaaggccgtgaccggcgtgaccctggccgaagcctacggcctgaccgaaaccagcccggccgcctgcatcaatccgatggacctgaaggaatacaacggcaccatcggcctgccgatttcgtccaccgacatcgagatccgcgacgccgaaggcaagccggtggcccagggcgagcaaggcgaattgtgcatccgcggcccgcaggtgatgcgcggctactggcagcgcccggatgaaaccgccaaggtgctgggggccgacggcttcctcgccaccggcgacatggccatggtcacgccggaaggcttcgtcaagctggtggaccgcaagaaggacatgattctggtatccggcttcaacgtctatccgaacgagatcgaagacgtggtggccagccacccggacgtgctggaagtggcctgcatcggcgtgcccgacgacaaatcgggcgaggtggtcaaggtgttcgtggtgaagaagaaccccgccctcaccgacaaggacatcatccgtcactgccgcgaaaacctcaccggctacaaagtgcccaagctggtggagttccgcagcgagctgcccaagaccaacgtcggcaagatcctgcgccgcgcgctgcgcgaccaggaaaccgccaaaccggcctga

SEQ ID NO: 1586 - DNA, 426 bp, Chromobacterium substugae
atggatgttcgtttgctgctggaaagcacactgcaggggttcggctacgagttggtcgattttgaaatcaccccgggtggcggttttcgcgtatttatcgacaagcccggtggcatcaccgtggaagactgcgtgctggtgagcaatcacctcactcgactcttcatggtcgagaacgtggactacgagcggctggaagtgtcttcgccgggcctggatcgtcctctgaagaaggaagccgattttgtccgtttcgcaggtcagctcgccaagatcaagacgcgcatgccgatcgagcagcagaagaaatttaccggtcgtcttgccggggtcgaagacggctccgtgaagcttgaggtggatggccgcatcgtggcgataccgtttgccaatatcgacaaggccaggattgagcctgagttttga

SEQ ID NO: 1587 - DNA, 1479 bp, Chromobacterium substugae
atgagtcgcgagattttgttgctggtggatgccctggcgagcgaaaagaatgtcagcaaggatgtggtgttttccgcccttgagatggcgcttgcttcggcaaccaaaaagaagtttaccgatgacgagatggatgtgcgcgtcgagatcgaccgccacaccggtcagcatcagaccttccgccgctggacggtggtggaggacgacctgcttgagtccgagagcaaggaaatcggtctgaccgacgcccgcgagcgcgatccgcgggtggaggtcggtgccgtcatcgaagacgcgatggaagcggtcgagttcggccgcatcggcgcgcagaccgccaagcaggtgatcctgcagcgcatccgcgacgccgagcgcgagcagctcctgaacgagttcctgcagcgccgcgagcacctggtgatcggcaccatcaagcgcatcgagcgcggcaacgccatcgtcgagtgcggcaagctggaagccgttctgccgcgcgaccagatgattccgaaggaaaacctgcgcgtgggcgaccgcgtgaagtcctacctgctgcgcatcgatcgccagggccgcggcccgcagctgatcctgtcgcgcaccgcgccggaattcctgaccaagctgttcgagctggaagtgccggagatcgacgaaggcatgctggaaatccgcgctgccgtgcgcgacccgggcatgcgcgccaagatcgccgtcaaggccaacgacgcgcgcatcgatccgcaaggcacctgcatcggcatgcgcggctcccgcgtacaggccgtcacgcaggaactggcgggcgagcgggtcgacatcgtgctgtgggcgccggaaccggcccagttcgtgatcaacgcgctgtcgccggctgaggtgagccgcatcatggtggacgaagacaatcacagcatggacgtgatcgtcgaggaagagcagctggcgctggccatcggccgcagcggccagaacgtcaagctggctgcagagctgaccggctggtacctgaacatcatgaccgtcgccgaggcggaagagaagaaccaggcggaagacgctgcgttgcgtcagctgttcgtcaccgcgttgagcgtggacgaagagaccgccgcgaagctggtcggcgaaggtttcgccgcgttggaagaagtggcctatgtgccgctggaagaaatgctggaaatcgaaggcttcaacgaggagctggtgggcgagctgcgtagccgcgcccgtgatgcgctcctgacgcaggccatcgcgtccgaagagcaggttgaaaatgtatccgacgacctgaaggacgttgaaggcctggatgccgagctggttcgcaagctggccgcaggcggcgtgtccacccgcgacgatctggccgacctggccgttgacgatctggtggacatgaccggcatggaagcggaagctgcacgcgccatcatcatgaaggcgcgcgaacactggttcaaccagtaa

SEQ ID NO: 1588 - DNA, 2781 bp, Chromobacterium substugae
atggttttgacgaatgtaaaacaatttgccggtgagatgaatctcacgccggaacgcctgctggaacagctgaaggctgccggtgtgagcaagcgctcgccggaagacacactgtcggcgcaagacaagtcccagctcctggactacctgaagcgctctcatggcgcccgcgaggattccaacatcacgctgacccgcaagtccacttccgaagtgaagaaggcggacggcggcaccgtgaccgtggaaacccgcaagaagcgcgtggtcgttcgcccggaagaggcgccgaaggcggctgctccggtggaggcgaagatcgagcagcccaaggttgagcccaaggtggaagccaaaccggaaccgaaaccggagccgaaaccggagccgaaggtggaggccaagcctgagccgaagccggaacccaaggtcgagcccaagccggaaccgaagccggctccggcggcccgcaccgtggcctccatcctgtcgccggaagaaatcgccgcgcgtgaagccgaggaaaagcgccaggcggcattccgcgcccgtcagcaagagctgatgcgcgaaaagatcgaacgcgaagagcgccgtcaggcagccaagctggccgcatcgcagccggctccggtggtggaggccccgcgcgcgccggaaccgcaacgagagcagcgcgatgagcgcggcccgcgtccggcggctggagacaaccgcggcccgcgtccggctggcgacaaccgcggcccgcgcccggctggcgataaccgcggcccgcgtccggctacggctggcgcgcccggcgctccggcgattccggctaccgtcgccggccgtccggatgctaagaaaggcggcaacaagaagggcggcgaccgctgggatgacaacaagaagggcggccgcggcggtctgaagaccaagggcggcgacgccggcaacgattggaagtcgcgcggcggcaagggcaagcacaagcaaagcaacaatcagcacgctttccaggccccgaccgaaccgatcgtccatgaagtgctggtgccggaaaccatcacggtggccgaactggcccaccgcatggccgtcaaggccgtggaagtgatcaaggccctgatgaagatgggcatgatggtgaccatcaaccaggtgctggaccaggaaaccgcgatgatcgtcgtggaagaaatgggccacaagccgaaggccgcccaggcggacgatccggaagcctacctggaagtgaccgatggcgaagctgtcgaagtggtggaactgccacgttccccggtggtgaccgtaatgggccacgtcgaccacggcaagacctcgctgctggactacatccgccgcgccaaggtcgccgcgggcgaagccggcggcattacccagcacatcggcgcctaccacgtggaaaccccgcgcggcatgatcaccttcctggataccccgggccacgaagcgtttaccgcgatgcgtgcccgcggcgccaaggccaccgacatcgtcgtgctggtggtggctgccgacgacggcgtgatgccgcaaacgatcgaagcgatccaccacgccaaggccgccaaggtgccgatggtggtggcggtcaacaagatcgacaaggtgggcgccaacgtcgagcgcatccgccaggagctggtgtcgcacgaagtggtcccggaagattggggcggcgatacccagttcatcgaagtgtccgccaagatgggcaccaatatcgatgcgctgctggaagccatcctgctgcaagccgaagtgctggaattgaaggctccggtcgacgcgatggccaagggcatcatcgtcgaggcccgcctcgacaagggccgcggtccggtcgccacgctgctggttcagtccggcaccctgaagaagggcgacgtggtgctggctggcaccgccttcggccgcgtccgcgcgatgatggacgaaaacggcaagccgatcgaatcggccggcccggctatcccggtggaaatcctgggtctgtccgacgtgccgcaagcgggcgaggacaccatggtgctggccgacgagaagaaggcgcgtgaaatcgcgctgttccgcgccggcaagttccgcgacgtgcgtctggccaagcagcaggcttccaagctggagaacatgttcgcccagatgaccgaaggcgaagtgcagaccctgtcgttgatcatcaaggccgacgttcagggttcgtacgaagcgctggcgggcagcctgcaaaaactgtccaccgacgaagtgcgcgtctccatcctgcactccggcgtgggcggcatttcggaatcggacatcaacctggcgatcgcctccaaggccatcgtgatcggcttcaacacccgctccgacgccgccgcgcgcaagctggccgaaaacgaaggcgtggacatccgctactacagcatcatctacgatgccgtggacgaggtgaaggctgcgttgtccggcatgctggctccggagaagaaggagcagattctgggtaccgtcgagatccgtcaggtgatctcggtgtccaaggtcggcaacatcgctggttgcatggtcaccgacggcatgatcaagcgcaccgcttcggtccgcctgatccgcaaccacgtggtggtgcataccggcgaactggaatcgctgaagcgcttcaaggacgacgtgaaggaagtgcgtcaaggctacgaatgcggcctgatgctgaagaacttcaacgacatccaagaaggcgaccagttggaagcgttcgagatcgtggaagtggcgcgctccctgtaa

SEQ ID NO: 1589 - DNA, 417 bp, Chromobacterium substugae
atggcaaaagccaaaaaaggtttctcccgcgccgaccgcgtgtccgagcagatccagcgcgagctggcagaactgacccgcaccggcctgaaagacccgcgcgcgggctggatcaccatcacccaggtggaagtgacccgcgattactcgcacgccaaggtgtattacaccgtaatggtggaatccacccgcgcggccacccaggaggcgctggaaagctccgccggctacctgcgcaacgaactgggccgcagcatcaagatgttcagcatgccgcagctgcatttcgtctacgacgagtcggtggagcgcggcatgcacctgaccagcctgatcaatcaggtggcgcgcgaagacgcggaaaaattcggcaccgccgcgcctggcgaagaagcgggcgaaggcgacaaggaatga

SEQ ID NO: 1590 - DNA, 924 bp, Chromobacterium substugae
atgagcaagccgcgcagcaccaagcgccagatcgacggcgtgctgctgatagacaagccttacgacatctccagcaacaacgcgctgcaaaaggcgcgctggctgctgaacgccgccaaggccggccataccggcgtgctggacccgctggccaccgggctgctgccggtgtgcctgggcgaggccaccaagttttcctcgtatctgttggacgccgacaagggctaccgcgccacggtgaaattcggcgcggtgacgacgacgggcgatgtcgagggcgaagtggtgtccgagcggccggtcagcttcagccgcgaacagctggaagccgcgctggcgtcgttccgcggcgaaatcagccaggtgccgccgatgtattcggcgctgaaacaccagggcaagccgctgtacgaatacgcgcgcgccggcatcgaagtgccgcgcgaggcgcgccgggtgaccatccgcaagctggagctgctggccttcgacggcgtgtctgccgaaatcgacgtgctgtgcactaagggcacctatatccgcaccctggcttgcgacatcggcgaagccttgggcagcggcgcgcatttgaccgcgctgcgccgcaccgccaccggcggcttcggcctggacgaagcgcacacgctggcggcgctggaggcgctggagatggccgggcgcgaagccttgctgctgccggccgacgtgctggtgcaacattttccggaaaccgaactggccgacggcgaaatcggcaagttcatgaacggacaagccgtgctttttgctgaaaagtgtgagaaaatgcagcgcttccgggtataccaaaagtctacccggcgcttcatggggctgggcgaggcgcgcgacgatggtcgcctgcatccgatccggctcctggccaaccaggcggcaacgtcctga

SEQ ID NO: 1591 - DNA, 270 bp, Chromobacterium substugae
atggcaatgaccgccgaacaaaaagctgaaatcgtcaagagcttccaacgcgctgaaggcgacaccggttcgtccgaagtgcaggttgccctgctgaccgcgcgcatcaacgacctgaccccccacttcaaggccaacaccaaggaccaccacagccgtcgtggtctgctgaagatggttagccgtcgccgccgtctgctggactacctgaagaccaccgacgctgacgcttaccgcgcgctgatcgcccgcctgggcctgcgcaagtaa

SEQ ID NO: 1592 - DNA, 2145 bp, Chromobacterium substugae
gtgttcaacaagatcaccaaatcgttccagtacggccgccacaccgtcaccctggagaccggcgaagtcgcccgccaggcatccggctccgtcatcgtatccgtagacgacaccgtagtgctggtgaccgtggttggcggcaagtcagtcaagccgggccaggacttcttcccgctgaccgtagactacctggagcgcacctacgccgccggcaaaatcccgggcggcttcttcaagcgcgaaggcaaacagtcggaaaaagaagtgctgaccagccgcctgatcgaccgtccgatccgcccgctgttcccggaaggcttctaccatgacgtgcagatcgtcgccaccgtgatgtcgctgaatccggaagtggattccgacattccggcgatgatcggcgcttccgccgcgctggccatttccggcctgccgttcgccggcccgatcggcgccgcccgcgtcggctacgccgatggcgaatacatcctgaacccgaccaagaccgaactgcaatcgtcgcagatggacctggttgtcgccggcacccagcgcgccgtgctgatggtggaatccgaagccaaggaactgtccgaagccgtgatgctgggcgccgtggtgttcggccacgagcagatgcaagccgcgatcaaggccatcaacgaactggccgacgaagtgaacccggtgatgttcgactgggccgctccggtagccaacgaagagctgatcgcccaagtgcgcggcatcgccggcgccaagctggccgacgctttccgcctgcgccagaagcaagcgcgcaccgtggtcatcaacgaagcctgggccgaagtcaaggctgcgctgatcaacgaaaccaccgacaccttggtggccaacgagatcaagggcatcttcaagggcctggaggctgaaatcgtccgcggccagatcctggcaggcgaagcgcgcatcgacggccgcgacacccgcaccgtgcgtccgatccgcatcagcaacaatgtgctgccgcgcacccacggctccgcgctgttcacccgcggcgaaacccaggcgatggtcgtgaccacgctgggcaccaagcaggacgaacaaatcatcgacgcgctggccggcgaatacaccgagcgcttcatgctgcattacaacttcccgccgtactccaccggcgaagccggccgcatgggtccgccgaagcgccgtgaaatcggccacggccgcctggccaagcgcgcgctggtagcggtgctgccgccggaagacgaattcggctactcgatgcgcgtggtgtcggaaatcaccgaatccaacggctcctcgtcgatggcttccgtgtgcggcggctgcctgtcgctgctgtccgccggcgtgccgctgaaggcgcacgtggccggcatcgccatgggcctgatcctggaaggcaaccgcttcgcggtgctgaccgacatcctgggcgacgaagaccacctgggcgacatggacttcaaggtagccggttccgcttcgggcatcaccgcgctgcagatggacatcaagatccagggcatcaccaaggaaatcatgcaggttgcgctggaccaggccaaggaaggccgtctgcacatcctgggcctgatgaaggaagccgtggacggcccgcaagaactgtccgcccacgctccgcgcctgtacgtgatgaagatcaacccggaaaagatccgcgaagtgatcggcaagggcggcgaaaccatccgctccatcaccaaggacaccggctgcgagatcaacatcgaggaagacggcaccatcaccatcgcttcgatcagcaacgagggcgcggaagcggccaagaagcgcatcgaagagatcaccgttgaagtggaagtgggcaaggtgtacgaaggcaccgtggtcaagatcctcgacaacaacgtcggcgccatcgtttccatcctgccgggcaaggatggtctggtccacatttctcagatcgccaacgagcgtatcaagaacgtggccgactacctgaaggaaggccaagtggtgaaggtcaaggccatcgaaatggacgaccgcggccgcatccgcctgtccatcaaggccctgctggaagaagaagcgaaaaccgcccaggcgaccgctgattccttcggcctgaagacccagtaa

SEQ ID NO: 1593 - DNA, 183 bp, Chromobacterium substugae
atggatgtggcggagcctgaaaaatacttgcgcgagctcggattgttcaagcaaatgctggcgcgcatcagctggaaaacgcgcggtagcccgatctacatttcagccagcatgggttttgacgagctgaccactgttttcgaacagtactatgcggcatacggcgcgccatctcggcgctag

SEQ ID NO: 1594 - DNA, 327 bp, Chromobacterium substugae
atgcgcatcattgtatttgtgcctggcgtggttttcgcttggtgtttttacggttttgtcctgttcgtgatcggcatcggctatatgaatccgcgtttgccccagtattatggggcgatctcgctgttcacccagttcctgcccttgctggtcagcatcggcagttggctggtctggatattgacgctgcggctgcgctggctgaaacgatgcgtcgccgcattggctttgctggcggcgggaacggttttcctgcagcagatccagcattatctgccgcctgggccggatagggagcaggctcagcttcagcaaatggagccttag

SEQ ID NO: 1595 - DNA, 1119 bp, Chromobacterium substugae
gtggagaacatcatgactacgcttgccaggccggaacacggcctactcgcgcccgaacacggccacgcgtcgccgccgtccagccaggccgactaccgctcgatggccagccccgccgaattattgcgcagcctgccggccagcgcgcgcgccagcgcctcggtccatgccggccgcgacgcggtgaagaaagtgctgaacggcagcgacccgcgctggctggtggtggtgggcccctgctccatccacgacccgcgcgccggcctggactacgccgcccggctggcggagctggccgccgaactggacgacacgctgctgatcgtgatgcgcgcctacttcgaaaagccgcgcaccagcgtgggctggaagggcctgatcaacgacccctatatggacgacagctactgcgtcgatgagggcatgcacatcgcccggcgcttcctcttggccgccgccgaactgggcctgccgctggccggcgaggcgctggacccgctatcgccgctgtacttggccgacctctacagctggacggcgatcggcgcgcgcaccaccgaatcgcaaatccaccgcgaactggcctcggcgctggacagcgcggtgggcttcaagaacagcaccgacggcacgctggacgcggcgctgaacgccatcgtctccgccagcgcgccgcacgcctacctgggcatgggcaaggacggccgggtggcggtggtgaacagccgcggcaacccgcactgccacctggtgctgcgcggcggcggcggccggcccaactatgattcggtgagcattgcgctggccgaacaggcgatgaagaagcacgacatcccgccggccatcatggtggactgcgcgcacgccaactcgtggaagcagcacacgctgcagccgcgcgtgctggccgacgcggtatcccagatccgccacggcaaccgcagcatccgcgccttcatgctggaaagcttcatcgagccgggcaatcaacccatcccggccaacctggccgagctgcgctatggctgctcggtgaccgatccctgcgtggactggaacaccaccgccgacatcctgcgcgacgcccgcgccaaactgcggccgctgctaaaacattga

SEQ ID NO: 1596 - DNA, 765 bp, Chromobacterium substugae
atggtcggactggatttcaccggccaatgcgtgtgggtgaccggcgcggcccagggcataggccaggaggtggcgcgccgcttcgtcgaggccggcgcgcgcgtcgtggcgctggacctgcagttcgaacaagcggccgcgcattgcggcgtgatgcgcgagctgccgctggacatccgcgacgccgacgccgtggccgcgctgtgccgccgcctggccgaagaggacgcgctgccggacgtgctggtcaacgccgccggcgtgctgcgcctgggcgcgttcgacgcgctgtcggtcgacgactggcagcagtgcctggccgtcaacgtcagcggaccgttctacctgctgcgcgcgctgatgccgcacttcaaggcgcgccgcgccggggccatcgtcaacgtcgcctccaacgccgcccacgtgccgcgcatagccatggccgcctacggcgcgtcaaaggcggcgatggccagcctcagccacaacgccgcgctggagctggcgccgtacggcgtgcgctgcaacgtggtgtcgcccggctccaccgacacgccgatgctgcgcggcatgtggcaggacgagcacggcgccgccagcaccatcgccggcaagccggaagcgttccgcctgggcatcccgctgggcaagctggccaccccggccgacatcgccggcgcggtgctgtacctggcttccgacctggccggccacgtcacgatgcaggacatcgtggtggacggcggcgccaccctggccgcctag

SEQ ID NO: 1597 - DNA, 879 bp, Chromobacterium substugae
atgagcattcccaagctgaacgcctacccgctgccgcaggcggccgacttccccgccaacaagaccgactggcgcgtggagcccaagcgcgccgcgctgctgatccacgacatgcagcgctacttcctggccttctacggcgaggacagcgcgctggtcaatgaactggtatccaaagtggacgcgctgcgccgctgggccgacagccacggcgtgccggtgatctacaccgcgcagcccaccgaacaaaagccggaagaccgcgcgctgctgaacgatatgtggggcccgggcctgaccaccgccgatccggcggtgcaagtggtgaccccgcggctggccccgcgcgagcaggacaccgtgctggtcaaatggcgctacagcgccttccagcgcagcgacctgcaggaaagaatgcaagcctggggccgcgaccagttggtgatctgcggcgtctacgcccacatcggctgcatgatgaccgcctgcgacgccttcatgcgcgacatccaggccttcatggtcggcgacgcggtggcggacttcagcgaggaagagcacaagatggcgctgcgctacgtggccacccgctgcggcgcggtgatctcgcagtccgacctagcggttgccggcggcgacgccgcgctgacccgcgaatggctgaaggcccaggtgctgaccgtgctggaagacggcgacgacagcctggccggcggcgacaacctgctggactacggcctggactccatccgcgtgatggagctggtggcgcaatggcagaagctgggcctggaaatcggcttcgaagatttggcccaggacctgacgctggacggctggtgggccgccatcgaggccaagctgccgcaggaggcctga

SEQ ID NO: 1598 - DNA, 1608 bp, Chromobacterium substugae
atgagcgtagccttcacccgctggcccgacgacctggcggcgcgctatcgcgccgccggctactggaacgaccagccgatgaccgagatgctggcccggcaatgccgcgagcgtcccgacgcgccggccgtgctgtgcggcgagcgcgagatcagctacgccgagctggaccgccgcgcgggcaacctggccgcctggctgctggcgcgcggcgtggcccgccacgacaccgcgctggtgcagctgcccaatgtcgccgagttctacatcgcgctgttcgcgctgttcaagatcggcgccgccccggtcaacgcgctgttcagccaccagaagctggagctgtcggcctacgcccgccagatccagcccaagctgctgatcgccgaccgccgccacccgctgttcggcgacgacgcgatggcggacgaactggcggccatctccccggcgctgagcgtgcgcctgttcgccaacgacgagctggaagccgtgctggagcgggactgcggcggcctgccggagcaagccggccccagcgccgccgacgaagtggcgttcttccaactgtccggcggcagcaccggcacgcccaagctgattccgcgcacccacaacgattacttctacagcgtgcgccgcagcgccgaaatctgcgagctcggcccgcatacccgcttcctgtgcgcgctgcctgcgccgcacaacttcccgctcagctcgccgggcgcgctcggcgtgttccacgccggcggcgcggtggtgttggcgcctaatccggaagcgctggcctgcttcgcgctggtgcagcgccaccaggtggacatcgccgcgctggtgccgccggccgtcgcgctgtggctgcaagccgcgcccggccgcgaatcccagttgaagagcctgaagctgctgcaggtcggcggcgccagcttcgccgaagccaccgcccgccaggtgccggaagtgctgggctgcaagctgcaacaggtgttcggcatggccgagggcctggtcaactacacccgcctggacgacggcgacgacatcgtctatggctgccagggccggccgatgagcgacgccgacgaagtgaaggtggtggacgaagccggccacccggtgccaatcggcgcgccgggcatgctggccacccgcggcccctacaccttccgcggctactacctggccccggaacacaatgcccgcgtattcgacaacgaaggcttctattactcgggcgacgtggtggtggccgacgagcgcggctacctgcgcgtggtcggccgggtcaaggaccagatcaaccgcggcggcgagaagatcgccgccgaggagatcgagcacctgctgctgcaacacccgcaggtggcccaggccgcgctggtggcgatgcccgacgcgatgctgggcgagaagagctgcgcctacgtggtggcgcatgaggacggactgaaatcggtggcgctgcgccgcttcctgcgcgagcagggcgtggccgactacaagctgcccgaccgtttcgaactggtaaacaccctgccgctgacccatgtcggcaaaatagacaaacaagcgctgcgcggcatgctggccgccgcggccggagcctga

SEQ ID NO: 1599 - DNA, 1179 bp, Chromobacterium substugae
atgcacacccagtcggccgcgaccggcaacgccgaagacggcgagttttatttcctgtcgtcccaccgcagcctgaaggccggcggcatacactcccgaatcgatacccccgcgcgcggcgcgctcgacgccggcagcgccttttcccgcgaagtggccgaagccttcgcccgcgcccgcgccgacggcatcgcctccccggtgctgatgggtgccatccccttcgacatcgatcagccgtccgaactcttcatccccgcccgccacgccttcttcgaccgccaagaacgcttgcaggctgccacccagcgcgccggcgacggcggcaaggtggtcggctcgcgcagcatcccggacgagcaaggcttcaaggcagccgtcagccaggccatagagcgcttcggccgcggcgagatccgcaaggcggtgctgtcgcgcgtgctggaagtggacttcgaccgcccggtgtcggcggagcgcgtgttcgacgccgtctgcgcgcaaaaccccaacggctaccagttccagctgccgctggcaggcggcggccgcctggtgggcgtcagccccgagctgctgctgcagaaggaaggcgcgcgcgtgcgcaccttcccgctggccggctccgccaagcgccagagcgacccggcggccgacgccgccgccagcgccaagctgctggattcgtccaaagaccattacgagcacagcctggtcatcgacgacatccagaacgtgctgggcccctattgcgccgagctatccatcccgtccgcgccgtcgctgctgggcacccgcgcgatgtggcacctgggctcgccaatagacggcgtgctcgccgacgcctcgctgccgattttgcagctggcctgccgcctgcacccgacgccggccatctgcggcttccccacccaggcttcccgccagctgatccgcgagatcgagccgttcgagcgcggcgtgttcagcggcatcgtcggctggtgcgacgagcatggcaacggcgaatgggcggtgaccatacgctgcgccaccgtggccgatacccgcgtgcggctgttcgccggcgccggcatcgtcgccgcgtccaccccggagtcggaatgggcggaaacccaggccaagctgggcaccatgctgggcgccttcggcctgtccggccaggaggcggcggcatga

SEQ ID NO: 1600 - DNA, 3903 bp, Chromobacterium substugae
atgaccgagactcccacgcgccttcccgtcagccatgcccaatacggcatctggatggggcagcggctggcgcccgacaatccgggctactggaccgccgaagccaccgagcttgacggcccgctggacatcgacgccttccgcgccgccgccgccgccgcgctggcgcactgcccggcgctgcgcatgcgcttcgaattcgacggcgaacagctgtggcaatgcccgcaagccgcccccgcgcaagcgctgccctggcacgacctgagcggcgcggccgatcccgaagccgcggcggatgcctggatgcgcgaagcgctgtcccgcccctgcgacccggcggcggacccgctgcaccgcagcgcgctgctgcaactgggacctcatcgttttctgtggtatgtgcaaacccaccatatcgcgctggacggcttcgcctacggcctgctggccaaggccgtatccgcgcgctacaacgccgcccaacgcggccaggacgcgccgccgctgcccgactggcggctggagccggtgctggccgaagaccaggcttaccaagcgtccgaacagcgcgagcgggaccgcgcgttctggaccgcgcggcaacaagccttccctcccgccgccacattggcgccgccgcaaccgctggccgacagcgtgcgcaaagccggccgcgcgctgaccgcaagccagatcgacgcctggcagcgcgccgccaaggcctgcggcgtcaactgggccgcctggctgatggcggcgaccgctgcctggctggcacgccgcagcggccggcgcgccatcaccctgggcctgccggtgatgaaccgcatgggctcggccgcgctggccgtgccgtgcatggcgatgaacatcgcgccgttcagcctgcggctggacccggccgccagcctgggagagctggcccgccaggccgccgccggcctgcgcgacatccgcccccaccagcgctaccgctacgaatggctgcgcggcgatctgggccggctggacggccgccagcggctgttcggcccggtgctcaacctgatgcccttcgaccgccacgcgccgttcgacggcctgaaaacccgcatccggccgatcagctccggcccggtggaagatctgtcgatcaacatcagcctgctcaacaccgaatggcggctcagcctggaagcccatccggacgcctatccggccgagcggctggacgcgctgtggcatgagctgccgcaatggctggaccaactggcccatgccgagcccggcacgccgctggcgagcttgctgccggacttgccgccgctgtccattctgcaaggcccggcgctggaacggcccgctgtcccggtgatggagcggctggccgcgcaggccgtcgcgcagcccgacgcggtcgcgctggaaggcgaaggccaggccctcagctaccgccagttgctggaccgcgcgcgcgcgctggccggccgcttgaaggcccagggcctggaagacggcgatcgcgtcgccatcctgctgccgcgctcggtggacgccatcgtcgccatcctcggcacgctgtgggccggcggctgctatgtcccgctcgatccgctcggcccatcggcccggctggccatggtgctggacgacgcccgccccaggctggcgctgacccatcgccgctgggccgcgctatgcggcgacgcgccggcgctgtgcctggacgaagcgccgggcgaagacgcgccgcgtctggacgcttgcgccgccggcgtcgacagcccggcttacctgctctacacctccggctccaccggcaagcccaacggcgtgctggtcggccaccgcgcgctggcccacttcgtctccagcgccgggcagttctaccgcgtccatgccggcgagcgcatcctgcagttcgcgccgctgcatttcgacgccagcatcgaggaaatcttcctggcgctgtgccacggcggcacgctggcattgcgcgacgacgcgatgctggaatcgatgccggccttcgccgacgccgtcgcgcggctgaagatagacgtgctggacctgcccaccgccttctggcacgagctggcttacgcgctgacgccggaattggccggccggctgtcccgcgtccgcctcgccatcatcggcggcgaggccgcgctgaccgagcgcgcgcgccgctggcgcgagctgctgccggatgccacgctgctcaacagctacggccccaccgaggcctccatcatcgccaccggcgccgcgctgtccggcccggacgcggtgtgggacggcggcgacgacattcccatcggcctgccgcgccccggcgtggccgccgccatcgtcgacgccggcctgcaaccggtggcgcagggcgaggaaggcgagctgtgcctgctgggtgacgcgctggccatcggctacctgggccgcgacgagctgaccgcccgccgcttcgtggcgctggacgcgctgcccggcgcgccgcgcgcctaccgcaccggcgaccgcgccgtctggcagggcggccagctgcgcttcctcggccggctggaccacgagctgaagatcagcggcctgcgcatcgacccggccgaagtggaaaacgcgctgctggcctgccccggcgtgcgcgaggccgcggtgatcggcttgccgcaggccggcggcggctacacgctggccgccttcctcgccgccgacgcggagccggatgccggcgcgctgcggcgccagttggccgaacggctgcccgccgccgccattcccgaccgctggcaatggctggaacagctgccgcgcaacgtcaacggcaagatagaccgcaagcaactggccgcgctgagcgatgccccggcccgcgacgcgtccccggccgccgaggccacgccgctggagcggcagatcatggaagtgtggagccaggtgctgggccgcatgccggaaggcccgcacgccaacttcttcgcgctgggcggcaagtcgctgcaggcgatccaggccgccaaccggctggcccagctgctgcagcgcgaagtcgccgtatcggcgctattcagctacaacaccgtcgccgcgctggcgcaggcgctgagcgcgccggccgcccaccgtccgccatcagcgagccagggcggcgagttcgcgccgctgctgaccatccagcccggcaagctgcccgcgctgttctgcctgcatccggcggaaggattgtcctggtgctatctgggactggcgcgccacctgccggacaccgccatctacggcctgcaggccaccggcatccagggcgaggcgcccgccagcttcgacgccatggtggccgattacgtcgcccgcatgcgcgccgtccaaccgtgcggcccgtaccggctgctgggctggtcgctgggcggcgcgctggcgcaggcgatggccgccgcgctcgccgccgccggcgaaaccgtggagctgctggcgctgatggacagctaccccgccgcctgctgggaaacgcggccgcaaccccaattgcacgacgccttggtgacggtgcttagcgtcaacggcgaggtggacgccgacgccgacggactgccgctggacaacgaggccatctaccagcgcctgctgcgtcccggcagcccgctggcgccgctgggccgcgccgcgctggaaaaactgggccaggcctcgttgcacggcatgcgcctgttccgcgacagccgcacgccggcctacgccggcgacgtgctgttgttccgcgccggccgccaccccggcgacgcgccgacgccggccgactggcagccctatctgcaaggccggttggactgcgtggagctggactgcgaccacttcggcatgagcgatccggaaccgatgcgccgcataggagaagagctggcccgccgcttgcaatctatttaa

SEQ ID NO: 1601 - DNA, 771 bp, Chromobacterium substugae
atgagcgagcagctgtccatcgagaacctgtcggtcagctacggcaagcgccgcgtcatcgacaagctgtccgtcccctgtatgcgggcgggcgaggtcaccgccctgctcggccccaacggcagcggcaagtccaccctgctgcgcgcgctggccggcctgcagggcggcgacggcctggtccgcctgcgcggccgcccgctcagccgccaacgcggcgaggtggcctacctgccgcagacgctgccgcccagcgtgcacctgacagtgttcgaatcgctgatggtggccggccaggccaccgccgccggcctgttccgccgccacgacgaccagcaggtgttcgcgctgctgcaatcgctgggcatcgaccacctggcgctgcacttcctcgaccagctctccggcggccagcgccagctggtgggcatcgcccaggcgctgatccgcgagccggcggtgctgctgctggacgagccgctgtcggcgctggacctgaattaccagttccacgtgatggacctgctgcggcgcgaaacccgccgccgcggcatggtgacggtgatcgtgctgcacgacctgaacgcggcgctgcgccacgccgaccgggcgctgatgctgaaagccggccagctgctggccaacggcgatccggaccaggtgatagacgccgccacgctgcaagcggtctacggcgtcaacggccgggtggagcgctgctcgcaaggcgtgccgcacgtgctggtggacggcctggccgccatccgctga

SEQ ID NO: 1602 - DNA, 1068 bp, Chromobacterium substugae
atgaacgattccaccctgcccccgctcaccgccgccgcggtgagcggcgactaccgccgcgcgctgctgcgccggctgctgctggtggccggcctgttggcgctgctggcgctgtcgctgtcgctggatgtcaccaccggcgccagcggcatgccgctggccgaattctggcgcacgctgctggaaccgtccgcagccgatccggccaccgccgtcatcgtctgggacatccgcctgccctacgcgctgatcgccgtcggcgccggcctggcgctgggcctggccggcgcggagatgcagaccgtgctgcacaaccctctggccgacccattcacgctgggcctgcagccggccgctgccttcggcgcggcgctggcgctgctgctgggcatcagcctgcccggcattcccgcgtcgtggatgctgccggtcaatgccttcgtgttcgcgctgggctcggcgctgctgctgaacctggtggcgcgctggacgcggatggctgccagcggcgtggtgctgttcggcatcgcgctgttcttcagcttcaacgccctggtgtcgctgctgcaattcgtctccaccgccgacgcgctgcaagacctggtgttctggctgatgggcagcctgtcccgcgccgactggcccaagatcggcctgatcttcgccgccttcgcgctgatcctgccgtggtcgctggccaacgcctggcggctgaccgcgctgcgcctcggcgaggaccgcgccgccagcttcggcatcgacgtgcgccggctgcggctgaccgcgctactgcgcgccagcctgctcaccgcgctggcggtggccttcgtcggcaccataggcttcatcggcctgatcgcgccccacatcgcccgcaggctggtgggcgaggatcaccgcttctatctgccggtgagcgcgctgaccggcgccgccatcctgtccatggcctcggtggtcaccaagaacctgattcccggcgtcatcgtgccggtgggcatcgtcaccgcgctggtgggcatccccttcttcatcgtcatcgtcttgcgcaacggaggccggacatga

SEQ ID NO: 1603 - DNA, 1110 bp, Chromobacterium substugae
atgaagaccgtattctcccgtttgctggccgccacgctgatcgccgccaccgcgctgtcggcccaggccgccaccatcaccgacatcgccggccgcaaggtggaagtgccggccaaggtgaaccgcatcctgctgggcgaaggccggctgttctactcgctggcgctgctggaaggcaagcagcctctggcccgcgtcgccggctggcagggcgatttccgccagctggacccgcaaacctacgcccaatacaagaaacgcttcccggagatcgaccgcatcccgctgatcggcaagaccagcgaaaactcggtcagcgccgagaaggtgctgacgctgaagccggacatcgccatcttcagcatttccggccacggtccgggcctgaacaatcccatcgtccagcagctgcaggcggccaaagtgccggtggtgttcgtcgatttccgcaacgcgccgctggagcacaccgtgcccagcctgcgcatcatgggcaaggcgctgcagcgcgaggccgaggccgagcgcttcatccgcttttaccaaagccggatagacgccatccgcaagacggtggccgccatcccggcgcagcagaagcccaatgtcttccttgatctgcgcgccgccgccttccccaacgtcaccagcgccggcaaaggcagcctgggcgagctggtggatgccgctggcggcgtcaatatcggcgacaagctgattcccggcgcggtgggcgaggtgaacatggaacacgtgctggcctccaaacccgactggtacatcggcaccggcaccgccgacgcggccgacaagatcggcatccagttcggcgccgacatctcgccggcccaggcccgcgaatcgctggcccgcgccgccgcgcgcaaaccggtgggcgcgctcgccgccgtgcgcgacggccgcaccttcggcgcctggcaccacttctacaacacgccctaccacatcgtgctgctggaagccttcgccaagacgctgcagccggcgcgcttcgccaaactggacccggacgccagctggcagcagctgcaccgcgacttcctggcgattccgccgcagggcacctactgggtcaagggaggcaaatga

SEQ ID NO: 1604 - DNA, 282 bp, Chromobacterium substugae
atgctgagcagccgcgcttccctcaccaccgccaacgccgacaaggtgctgtacaaactgtgcaagcactacgcgctgaaggtgccggtggatttcgacaccgagcgcgcccatgtgcagttccccatcggcacctgcgacatccagcgcgcgggcgacacgctggacatggtgtgcgcggcggacgcggccgacaagctggccaagatcgaattcatcatggacgagcacctgggcttgatggccaagcaaccggaactcaagctcgactggcaaaagtaa

SEQ ID NO: 1605 - DNA, 2130 bp, Chromobacterium substugae
atgaaaaaaaatcgcctcccgcctcgcgccgtcgccaggcatggtttccgtctcgccctgctgtccgccgcggcaggcagcctgcacattcccgcggccttcgccgccgaatccgaagcggtgctgccgtcggtggtggtgaccgcctccggctacgagcagaagatcaaggaagccccggccagcatctcggtgatcacccgcgaagacctggaaaagaagccgttcaccaatctgaccgatgcgatccgcgacctggaaggcgtcaacatcaacggttccggtccgggggacaaggacatttccattcgcggcatgcccggcgaatacacgctgctcctagtggatggccgccgccagaacacccgcgaatcccgcagccgcggcaccggcggcttccagcagtaccagattccgccaatggaggcgattgagcgcatcgaagtggtgcgcggcccgatgtcgtccttgtacggctccgacgcgatgggcggcgtggtcaacatcatcacccgcaaggcgccgaaggaatggcacggttcgatgacgctgggcggcaccatcacccagcattcagatgaaggcaataccggccagagcagcttctgggtcggcggcccgctggtgaaagacctgctgtcgctgcaaatctacggcgcgctgaacaaccaggccgaagacaacatctactactccaacagcggcgatggaggcaaagttgcgactcacgcctcagacatcaacgccaaactgacctttaccccgaacaaggacaatgagatcacgttcgaggcagggcacaacgagctgcgcaagaccaccacgccgggcaagagcgtggcctccctaataaaagtcaagggaggctttggaccgaatacaaaagacgactatttcgacaccagggatcactggagcctgagccacaacggcaaatacggcatcatccgctccaatgtcgcgctgtatcaggaaatcgagaagcccagccacagcgccaacaatatcgacgatggcaaaggcctgaagctgaccaacaccacgttggatggccagctatccttcctgttcgacaggcacacactgaaactcggcacccaagtcggccagcaggttggcgacaacatgcgcgcccaggaagccattgccggcttcaccgggccggccaatccgaacaagatcaccgtcaatacctgggcactgttcgccgaagatacctacgacatcaccgacagcctgaagctcaccggcggcggccgtctcgaccaccacagcgtgtttggcagccatttcacgccgcgtctgtacctggttgagcaactgaattcgcagtggactctgaaaggcggcgccggcaaaggcttcaaggccccgaccatccgccagagcaccggcggctactgcatgcgcaccggggcaggcaacgaagcaggcgttctgtgcggcaactccaatctgaagccggaggaaagcacttcctacgaggccagcctgcatttcgataacaacaaggatctgagcgccaacgccacgctgttctacaacgacttcaagaacaaggtggtcagctacggaacggataaattctccaatcaatacgatcctggtatctcacccgctcgcatctacgtctacgacaacgtcgactccgtgaacatccgcggcctggagctctccggcagctgggcgttcgcgccgcgctggaccgtatccggcaactacacctacaccaagtccaagcgccacggcggcaaggaaaccagtttcggcggccagtctctggatggcatgccgctggacaaaacgcctgagcatgcgggcaacgccaagctggcctggaacccgatggaaaagctggatctgtacactcgcctgaacttcgaaggcaagcagtactacaccggcttccgcaacggcgccaacgtcgcccgcactcgtggcggctccagcacctgggacctgggcggcacttaccgcatcaacaagaccttcgacgtcaatttcgccgtgttcaacgtcggcgaccgcaaggtggccatcgatgatcgaggccgctacaacggcctggacggcaactggatggtcgacgagggccgccgctattggctgaccctgagcggcaagttctaa

SEQ ID NO: 1606 - DNA, 117 bp, Chromobacterium substugae
gtgaaaaccgccgccatccaggacaccggcggcggctgtccgccgcgcgccgcaaatctggatgcgcttgccttgcatcaagcaggcgtgtcgataccgcttgcataccacctctaa

SEQ ID NO: 1607 - DNA, 2637 bp, Chromobacterium substugae
atgagcgtgaagcgattgctgggcgcggccgcgctggccgcggcgacaacggcggcgtgggcggcgccggacgcggcggctttggggcaaagcctgtcgatgcgggtggcggtggacagcaacagaggcgcggcggccggcgcgccgtgttccgacctgggcgcggactgggcgtcctgcctgaaagggcggctgattctggaaaaccagggcggccaggcggtgccggccggcggcggctggagcctgtacctgcacagcatccgccgcatcctgaagctggatacgccgcagttcgccatccgccacatcaccggcgacctgtaccaggtgacgcccaccgccgctttccagggcctggccgccggccagcggctggagctgccgctgatagacgaatactggatcctgcaggaaagcgatgtgctgccgcgcccctacgtggtggtggacggccaggcgcctgccttgttggcgcacgatggcagcgacgaggccagctacttgctgccgctgcgcggcgacaactggaagaacccggccggcgagctgcggccgctggccacgccgcagcaacgctatctgacattcacccagcgcggtcagcagctgtcggccgcccaggtggccaaccgcgtcatcccggccgcgctgcggcagcagttgggcggcggccagctggaggtgaaagggctgagcctgagtctgtccggcctgagcccggcgcaaagccaggcgctgtcccagcgcgcggcgcaattgggattgcggccggccgggggccgggtggcgggcggcgtggtcggtacgcggctgccggccgatatcgccgtctccggcggctaccggctgcagatcggccggcagggcgtgaaggtggaaggctacgacgccgccggcgtgttctacggcgtgcagacgctgctgggcctgctgccgcaaaacggcggcaaggcgcaatggatgacggtggaggacgcgccgcgctatgcccaccgcggcatgatggccgacctggctcgcaacttcaaacagccggccaccgtgcgccggctgatagatcagatggccgcctacaagctcaacaagctgcacctgcacctgtccgacgacgaaggttggcggctgcagattcccggcctgccggagctgaccgaggtcggcgcgcgccgctgccacgacctgagcgaaacccagtgcctggtgccgcagctgggctccggtccggccaaccagtccggcggcggctacctgacccgcgccgcctacatcgacctggtgcgctacgcccaggcccgcttcatcgaggtgattccggagttcgacatgccggcgcacgcccgcgccgccgtggtctccatggaggcgcgctatcgcaagctggcggcgcagggccggccgcaggcggcggccgaataccggctgctggatccgcaggaccaatccaatacgctgtcggtgcagttttacgaccgccgcacttatttcaatccctgcgtgccgggcagcgcgcgcttcgtcgccaagctggtgtccgaagtggcacagatgcaccgcgaggccggccagccgctgcagatctggcatttcggcggcgacgaggccaagaacatcctgttgggcgccggcttccaggacgccagcggcggcgacccgtccaagggcaaggtgaacatggcgcagcaggacaagccatggggccgctcgccggcttgcctcgcgcagatcgcccaggggcaactgagcagcgtggaccagctgccgctgaagtttgcgcagacggccagccgcatcgtcgccgagcaaggcatcccgacgatggcggcgtggcaggacggcgtggccggcgccagcggcgcgtcggacttcgccacccgcaacaccatggtcaccgaatgggacacgctgtactggggcgcggcgcaggcggtgaacggctatgccgccaagggcttccagaccgtgctggccatgccggactacctgtatttcgacttcccctatgagctgaacccgcgcgagcacggctactactgggcctcgcgcgataccgacagctacaaggtgttcagtttcgcgccggacaacctgccgcaaaacgccgaagtgatgccggaccgccagggccagccgttcgcggtgaccagcgccgccgcgccggcgcgctacgccggcatccagggccaggcctggaccgaggtgatgcgcaccgacgccgagttcgaaaccatggtctatccgcgcctgctggcgctggccgagcgcgcctggcacaaggcggcgtgggagcggccctacacggtgggcgaaacctaccagctgggcgtgacgcacctggtggacaaggcggcgctgaacgccgactggcagcagttcgccgcggtgctgggctggcgcgaagcgccgaaactggaacatgccggcgtcggctaccgggtgtcgatgccggcggtgcggaccggcagccagggccagacggcgacgacggaatggccgggcgcgcgcctgcaatattcgtacgacggccatggctggcaaacctaccagcccggccagcaggtgcaggcgaattactggcgcggcgtctcgcaggacggccgccgcgccggccgggcggagagcctgtccggacagtga

SEQ ID NO: 1608 - DNA, 447 bp, Chromobacterium substugae
atgtcagagcgcgatagcaggcttcacggcagttggcggctgctttcttttgagctggagctgcaggaatcgaaagcgcgtacccagccatggggagccgacccaaatggccgcctgattttcggcgccgacggccggatgatggtgctggtgaccgccaaggcgcgcgaaccgggaggcaccgacgcgcaacaggccgcgctctatcgcactgtgatggcctataccggacgatatagggtggatgcggacagcttcatcgtccaggtggacagctgctggaacgaagcctggaacggcaccgagcagcagcgtttctaccagttggatggcgatgcgctggtcgtcttcaccgcctggatgccgaacccgttggcggcggacaatgcaatgggacgaggagtgcttgggttggtgcgggagtcgtccgggctgtgttcgcaatga

SEQ ID NO: 1609 - DNA, 753 bp, Chromobacterium substugae
atggtgacggcgcttctttgcacggcattcattggcagcgccgctgccgattcctttgtcgtaggtgtggaagaaattgactattacccgctgcatagttacgccaatggaaaattctccggctatggcagagacttgcttgacgcatttgcaaaacaatccggccattcatttacttacatgccgcttccagtttcaaggctgttccatacatttctgaatgacaattcgattgatttcaaatatccggacaacccgcattggcaagcggacatgaaaaaagggaaatccgtcctctatagcgatcccgtagtcaatgtcagcgaaggattgctggtgaagccggagaagatagatcaattgtccgaggattcgcttcaggctatcgtgaccatgcgagggtttacgccttggccttttgatcagaccatgcggcaaaagatcaataatggaagcattcgggtttatcaggaggattcgttcggcaaggtgatcgctttggggatgacggggcactacgacgcggtctatgccagcccgatagtcatcaactactaccttgatgtggtgattcacaagccgggcgcgctagtttttgataaaaagcttccctttgaaagcaatgatttttccctttccagcatccgccaaggagaggtgatcaagcaattcaatgaattccttgctaaaaaccagcctttggttatggagctcaagaaaaaatacaggctgactgacaaggcggttcaatga

SEQ ID NO: 1610 - DNA, 1116 bp, Chromobacterium substugae
atgtcggaactgaaaatagagaagctgggcaagcgcttcggcgagcaccgggtgctggacgacatcaccctgaccgtcgaacaaggctcgctgctggccttgctggggccgtccggcagcggcaagaccacgctgctgcggctgctgtgcggcttcgagcgctgcgacgagggcagcatccacatcggcggccggctagtgagcagcccgcagctgtacctgccgccggagaagcgccagatcggctacgtgccgcaggaaggcgcgctgttcccgcacctgtcggtctcggacaacatcgtcttcggcctgccgcgcgccgagcgccgcgaacgccgccgggtggcggagctcttggacatggtgggcctgccggccgacttcgccgcccgcgcgccgcagcaattgtccggcggccagcaacagcgcgtcgccttggcgcgcgcgctggcgcccaagccggcgctggtgctgctggacgagccgttctcggcgctggacgccgcgctgcgcgccgaaacccgccaggcggtggccgacgcgctctccgccagcggcaccaccgcgctgatggtgacgcacgaccaggccgaagcgctgaccatgggccgccaggtggcggtgctgtggcagggcaagctgctgcaagtggccgcgccgcaaacgctgtaccagcgcccggccagcccggaactggccgacttcgtcggcgacgcggtgctgctgcccggccgcgcccagggcggcgaggcccactgcgcgctgggacggctgccgctgctggacggcatgccgcaaggcgaagtcaatgtgctgctgcggccggagcaaatccgcctgctgccggcatcgcccgaccacgcgcgtcaggcgaaagtgctggacgtcagcttcagcggccacgacgccagcgtgcggctgatgctggacgacggcagcctgctggccgcccgcgtccccggccaccgctgcccgcagcccggccagacgatggcgctgcaagtggaaggcgctgtcgcctgtttcgccgcgcccggcagcgccagcagcggcggcggcaatatcgccaccacccgcctacagcacagcccggcgctgtttagacaggagaagtga

SEQ ID NO: 1611 - DNA, 1617 bp, Chromobacterium substugae
atgaacatcgccatgcgcctggctggcggcagcagccggcggcccgccggcctcatcgtcagcgccgccctggtggcgctgctggccttgctgccgctaggctttaccctgtggcaggcggccagcgtcggctccggcgacgccgccgaactgctgctgcgccccatcgtcgcccggctggccggcaacaccgccttgatcgtgctggccagcaccttcagctgcgccgtggccggcaccgcctccgcctggctggtggagcgcacccgcttgcccggccaccggctgtgggcattgctgtgcgtggccccgctggccattccgcccttcatcaccagcttcgcctgggtgtccatcagcccggatctgcagggcttctggggcgcctggctggtgctgaccaccgcctacacgccgctggtctacctgccggtgtcggcggtgctgcgcaatatggacccggcgctggaggaaaccgcgcgctcgctgggcctgtccgcctggtcctgtttccggcgcgtgacgctgccgcagctgaagccggcgctgctgggcggcatgctgctggtggcgctgtcgagcttgtcggaattcggcgccttcatgctgctgcatttccacaccttcaccaccgaaatctacgccgaataccgcgccagcttcgacagcgccggcgcgtcgctgctggccagcgtgctgatggccgccggcgtgctgatcctgctggccgaactgcgcgtgcgcggcgaaagccgctaccagcggctggaccgcggcgcgcgccgcgccgccggccggctggaactgggctggaaacgctggccggcgctgctgtggctggtgctgcaaggctcggtcacgctgctggcccccatcgccaccattctgtactggacgctgcaaccaggcgcggacgcggtgacgccggccgaggtgtcgccgcagctcttgctgtcggccaccgccacctcgctgggcctgggcctggccgccgccgcgctgaccacggtgctggcgctgccgctgggctatctgctggcgcgccatcccggccggctggcgcatttgctggagcgggtggtctatctggctcagggcgtgccgggcatcgtcatcgcgctggcgctggtcaacctagccatccagtggctgaagccgctgtaccagagcgcgctgatgttggcgctggcctacgccatcatgttcctgccgctggcgctggtcagcgtgaggagcgccttgatgcaggcggaaaacaagctggaagagctggcgcgttcgctggggctcaactggtggcaggcgctgtggcgggtggtgctgccgctggcggcccccgggctaggcgccgccgccagcctggtattcgtctccgtcatcaccgaactgaccgccacgctgctgctcgcgcccatcggcaccgagacgctggccacccaggtatgggccgacaccgccgcgctggccttcgccgccgccgcgccgtacgccgccatcctgatcgcgctgtcgcttctcgccacctggctgctgatgtcctgcctgggacgcggcgcggtgctgggcggccagccgcaaccatggaatcaacaggaagatccgccatgtcggaactga

SEQ ID NO: 1612 - DNA, 1002 bp, Chromobacterium substugae
atgaaacgcaaactgatctccgccctgctcgccggctcgctgctggccgccagccagctatccacggccgccagcctagtgctgtacaacgcccagcatccgcaaaccatcaagctcctgaccgccgacttcgaaaagatgagcggcatcagcgtcaaggtccgctccggcgaaggcccggagttgtccgcccaattgctggccgaaggcaaggcctcgccggccgacgtctacttcgcctccaactcgcccgagctgatgctgctggaaggcaagcagatgctggccaagctgccggccgccaccttctccgccatcccggcgcgctacagctcgccgcagggcgaatgggtgggcgtgatggcgcgtgaaaacgtgctggtgttcaacaacaagctggccgccggcgcccagatgccggcctcgctgctggacctggccaagccgcaatggaagggcaagctggccatcgccccgtccgacggcgacttcctgccgctggtcagcgcggtgcgcgcgctgaagggcgagccggcgacgctggcctggctgaagggcctgcgcgacaacgcccagaccttcgacgacaacgaaggcgtggtggcggcggtgaaccgcggcggcgtggccgtcggcatcatcaacaactactactggacccgcctgcaggtggagctgggcagcaagggcatgcacagccagttgtaccacttcggcaacgccgacgtcggcgcgctgatcaacgtctccggcgccggcatcctcaaaaccgcgcgcaacgccgacgcggcgcagaagttcctcgcctacctggtgagcccgcgcgcgcagcagctgatcgccaagagcaacatcaccttcgaatacccgctgctgccaagcgtggcgccggccccgcagctgaagcccttcaaccagctgaacccgccgccgctggacatgcagaagctgggcgacgacagccagtcggccaagctattgcgccaggcgggcctgctgtaa

SEQ ID NO: 1613 - DNA, 1281 bp, Chromobacterium substugae
atgacagaccgcgacaagccgaaacagccgtcccggcgcggcttcctcaaaggcggcggcgcgctggcgctggcaggctggctgggcggcggcaaggcgctggccgcagccgccggccacaccaaagcggcggcgcagcctggccgcgagcccttcgacggcgtccaccagggcggcatcctcaccccgcagcagcagaacagctacttcgccgccttcgacctgcaaaccgccaagcgcgaagaggtgatcgccctgctcaaggcctggaccgaggccgcgcggcggctgagccagggcctgccggcgcgcgcgctgtcgggccagagcgacaaggcgccgctggactccggcgaagccgtcggcctcgccaccgcccgcctgaccctcaccttcggcttcggccccggcctgttcagcaagaacggcgtcgaccgctacggcctggccaagcacaggccggaagcgctggtggacctgcccaagttcaatggcgaccagctggtgccggaaaagagcggcggcgacttgtccatccaggcctgcgccgacgacccgcaagtggccttccacgcggtgcgccagttggccgccatcgccgacggcatcgccagcgtgcgctgggtgcagaccggcttcgccagcggcgcgcccggcggcggcaccccgcgcaacctgatgggcttcaaggacggcaccaacaacccgtccaccaaggacccggcgctgatgaaccagttcatctgggtcggcgacgagggcggctggatgaagaacggcagctacctggtggtgcgccgcatccgcatcgcgctggagcactgggacaagaccgagctgggcttccagcaggaagtggtgggccgctacaaggacagcggcgcgccgctgggccaaaagcatgaattcgagccgatgaacctggccgcggcggacaaagacggcaacccgctgattccggacaccgcccattcgcgcgtggcttcgccgcaggaaaacgacggcgcccgcatcctgcgccgcgcgtattcgtacaacgacggcgccaacttctacgccgagcgctggccgccctggcgccagggcgtcgaatacgacgccggcctgttcttcatcgcctaccagcgcgacccgcgcaccggcttcatccgcatcaacaagaagctggcggcgatggatatgatgaatcagtacatcacccatgtcggcagcgccgttttcgcctgcccgcccggcgcgcgcccgggcggctacatcggcgaagccctgttccagctctga

SEQ ID NO: 1614 - DNA, 1119 bp, Chromobacterium substugae
atgaagcggaacttctcgcgccgcggcctggccgccgccgccaccctgctggccctggccggcgcggcccatgccgacggcgccttcctcgccggcatcaagcgccacaccatcctggccaacaccgtgcccgacaacggcgaccagaacccgtacgcgatcgcggtgtcgccggtgagcgccggcaaactcaagcagggcgacgtgctggtggacaacttcaacaacgccgccaacctgcagggcctgggcagcaccatcgtcaactaccacccggacagcaagagcctgaccctgttcgcgcaaatcccgcgcacgctgccgcagtgcccgggcggcgtcggcctgtccaccgcgatgacggtgctgaaaagcggctgggtgatagtgggcagcacgcccagcaacgacggcaccaccgataccaagggcgccggctgcctgatggtgctggattcgtccggcaagctggtcgacacctgggccggcgccgacatcaacaacccctggggcaatatggcggtgatagacaacggcgacaaggcgaccctgttcgtcagcaacgccggcttcggcgtcggcagcgccaagggcacgccgccggtggtgaacctcgccaccgtgctgcggctggagctggacatccccgccggccagccgcccaggatcgtcagccgcaccgtggtggccagcggcttcggcgagcaggccgacaagggcgtgttcctgatcggccccaccggcctcgcctacggcaaggacgacaagctctacgtatccgacgcgctgggcaaccgcatcagcgagatctgggacgccaccacccgcaccaccagcgccggcatcggccgcaccctgacccacgacggcctgctgctgcgtccgctggcgctggccaccacgccgcaaggccacctgctggtcaccaacggctccaacggcaaggtggtggaaatcgacccggccaacggcgagcagctgggcgcgcgctggatagacgccaacaaggcgcaaaccccgcccggcaacggcgacctgttcggcatcgccatgacgccggaaggcgacggcttctatttcgtcgccgacgacaacaacaacctggtattggcgaaatga

SEQ ID NO: 1615 - DNA, 1509 bp, Chromobacterium substugae
gtgaaacgccccttcctgccgaacgcggccgccaagccgctccggatctcctcgctggcgctggccgtgctgctgggctgcggcctgcaggccgcccacgccgaggaaaccgacgccgcagccaatccggccgacctgcccgaggccgaccaggcgatcaaagccaaacccgacaaccagtggaccggctggtggaaccgctccaccctgctgggcgacatgggcggcctgcgctcggcgctgggccgccagggcgtcaccctgggcctgaccgaggccagcgaatacctgcgcaacgtcagcggcggcgtcaagtacggcggcgactaccagggcctggccaccctgaccctgggcctggatacccagcgcgccggctggtggaacggcggcagcttcaatgtcagcgcgctggacatccacggcaaggccttcaccgccgatcacgtcggcagcatccagagcgccagcggcatcgaggccgaccgcgccacccggctgtgggaggcctggttccagcagcagctgaacggcgagcggctggacgtgaagatcggccagcagagcctggaccaggaattcatggtcacccagtacggcggcgctttcatcggcaccatgttcggctggccggcggtgccgtcggccgacctgccggccggcggcccggcctacccgctgtccggcctgggggtgcgcctgcgcggcaagctgggcgacaacatcacgctgctgggcggcgccttcgccggcgaccccacccgcgacgtcagccagaacccgaacgacccgcagcagctgaacaagcacggcaccaccttcagccgccacggcggcacgctgttcatcggcgagatgcaatacggccgcaacctgccgtccaacggcgcggtggaagcgccgcgcggcgcgaccggcatcgccggcctgcccggcacctacaagctgggcttctggtacctgaaccagaaaaccgccgacacccggatggacgtcaacggccagcccatcgccctcaccggcgccaacccgcagctgcacagcggcaactacagcatctacgcggtagccgaccagacggtgtggcgtccggccgaagacagcacccagacgctgaacgtgttcacccgactgatgggcgcgccgggcgaccgcaacctggtcagcttctccgccaacgccggcgtcacgctgaccgcgccgttcgccggccgcgacaacgacaccgtcggcctggcggtcggctatgtcaaggtaggcaaccacgccgccggcaacgacgccgacaccggcatcgccaacggcaacttggcctatccggtgcgcagcgatgaaacccaggtcgaagccacctacatttatcaattgacgccatggtggcaatggcaggccgacctgcagtacgtgcgcaacgtcggcgccggcgcggtgtcgcccaacgacccgacccagacccagcgcattcccaacaactgggtggtgggcctgaagaccaccatcaccttctga

SEQ ID NO: 1616 - DNA, 1215 bp, Chromobacterium substugae
atgagcaataccgtatcccgcgctgatttcgaccaggtcatggtgcccaactacggcccggctggcttcatcccggtcaagggcctgggttcccgcgtgtgggaccaggacggccgcgaattcgtcgacctggccggcggcatcgccgtcaactcgctgggccactgccacccggagctggtggcggcgctgaccgaacaggcgaacaagctgtggcacgtgtccaatgtgttcaccaacgagccggcgctgaagctggccagcttgctggtggaaaaaaccttcgccgagcgcgtgttcttctgcaactccggcggcgaggccaacgaggccgcgttcaagctggcgcgcaagtacgctcatgatcatttcggcgcggacaagaaccagatcctgtcctgcgtcaattccttccacggccgcacgctgttcaccgtcagcgtcggcggccagcccaagtacaccgaaggcttcggcccggtgccgggcggcatcgcccacttcgaattcaacaatatcgaatcgctgaaggcggccatctccgacaagacctgtgcggtggtgatcgaaccgatccagggcgagagcggcgtgctgccggccgatccggccttcctcaaggccgcgcgcgaattgtgcgaccagcacaacgcgctgctgatcttcgacgaagtgcaaagcggcatgggccgcaccggcgcgctgtacgcctaccagcaatacggcgtgacgcctgacatcctgtcctccgccaagggcataggcggcggcttcccgatcggcgcgatgctgaccaccgagaaggtggccaagagcttcgtcatcggcacccacggctcgacctacggcggcaacccgctggcttgcgcggtggcgcacaaggtggtgtccatcgtcagctcgcccgaagtgctggcaggcgtcgaggcgcgccaccagcgcctggtggccggcctggaagccatcaacgccaagcacaaggtgttcaagctggtgcgcggcaagggcttgttgatcggctgcgtgctgaccgacgaatacaacggccgcgcccgcgaattcctgaaggccgccgaaaagcagcagctgatgatcctggtggctggcctgagcgtgttgcgtctggcgccgtcgctggtgatcagcgacgccgacatcgacgaaggcctgaagcgcctggaggccgccgtcgccgaaatggcggccgccaagtaa

SEQ ID NO: 1617 - DNA, 1020 bp, Chromobacterium substugae
atgtttaccgtgcgtcccatccggacttcggacctgccggcgatagagaggctggcccaggccagcggcatcggcgtcaccagcctgcccagcaaccgcgagaaactgttcgagcgcatccagcaatcgatccgcgctttcgagcatgaagccatcggcgatgccggcagcgaatactatatgttcgtgctggagcatggcggcgcggtggtgggcaccgcctccatctgcgcgtcggcgggcttcgacgagcccttctacagctaccgcagcgaaacggcggtgcatgcgtcgcgcgcgctcaaggtcaacaaccgcatccacgtgctcaacatctgccacgacctgaccggcaccgtgcagctttgcggcttctacgtggagggcgggctggatcaactggccgccgagctgatgtcgcgcgcccggctgctgttcatcgccggcgagcgcgagcgcttcggccgccgcatcatcgccgaaatgcagggcatccacgacgaggccggccagtcgccgttctggaacgccatcggccgccgcttcttcaatctggactttctgcaggtagagcaggccttcgtcagccacagcaagaccttcatcgccgagctgatgcccagctacccgatctatgtgccgctgctgccggacgaggcgcagcaggcgataggccagatccatcccgatttcgagcgggtgtgccggctgttgtgcaacgaaggcttcgaggccgacaactacctggacatcttcgacggcggcgcggtgctgaccgccgagctcgaccgcctgaaaacggtggagcaaagccgcagccatccggtggaaatccaggccagcctgccggcgcaggccagcctgcagctggtgagcaaccagcgcctgtcggctttcgccgccaccgccgcccgcgtcgccgtagtcgacggcgtggccttcatcaatcccgacgccgccagggcgctgggcgtggccagcggcgaccgggtgcgcgtcgccggtctgcaggcagagtga

SEQ ID NO: 1618 - DNA, 1038 bp, Chromobacterium substugae
atgatgtttattcgtcccgttgaacacaaggacctggacggcttgatgaacctggcgcgcagcgccggcatcggcctgaccacgctgccggtgaacgaggagcggctgtcgcgccgcatcgcgcgctcggtgctgtctttttccggcgagctggacaaggcggaccactgctatgtgttcgtgctggaagattccgacaccggcgcggtggccggcatctgcgcgatcgaggccgcggtggggctgaaggagccctggtacaactaccgcgtcggcaccatcgtccacgcctcggaagagctgggcgtgtacagccgccacgagacgctgttcctgtctaacgaccataccggctattccgagctgtgcacgctgttcctgcacccggactaccgcgtcaagcgcaacggcggcctgttgtccaagtgccgcttcctgttcctggcgcagtttccgcagctgttcggcaagatggtggtggccgaaatgcgcggcgtgtccgacgaagccggcaactcgccgttctgggaggcgctgggccgccacttcttctccatcgatttcgccaaggccgactacctgaccggcgtcggccagaaggccttcgtcgccgagctgatgcccaagcacccggtgtatgtcgacttcctgccgccggaggcgcaggcggtgatcggccagacccacgagggcacccgcccggcggtggcgctgctggagtcggaaggcttccgctatgaaggctatgtcgacatcttcgacgccggccccaccatccaggcctatgtcagcgatatccgcgcggtgaaggaaagccagcggctgccggccaaggtgtgcgacccgctgccgcagggcgagcgcgaatggtacttggtatgcaacgacgcgctggcgggtttccgcagcgtgctggtggaagcggtgcgcccgcaaggcgaattctgcctgacgcctgagctggcgcgggcgctggatgtgcaggacggcggccatgtccgctgcgtgaccttgacgccgaaggaggcagtgcaatga

SEQ ID NO: 1619 - DNA, 1461 bp, Chromobacterium substugae
atgagcagtctgttcatcgatggcaagtggctggccggcgacggcgtagccatggccaaaaccaatccggccgacaatgcgccattgtggagcggccgcgccgccagcggcgcccaggtggacgccgcggtgcaggctgcgcgcgccgctttcccggcctgggcgcgcgccggtctcgacgcgcgcgccaaagtggtgcgccgcttcggcgaattgctgaccgagcgcaaggccgagctggcccgcgtcatcgcccaggaaaccggcaagccgctgtgggaggcgacgactgaagtcgccaccatggtcggcaagatagacatctcgctgaaggcgctggccgagcgcaccggcgagcgcgccgcggcgatgggcgacgcccaggcggtgttgcgccacaagccgcacggcgtggtggcggtgttcggtccgtacaacttccccggccacctgcccaacggccacatcgtgccggcgctgttggccggcaacgcggtgatcttcaagccatcggaactgacgccgtggaccgccgagatcaccgtcaagctgtgggccgaggcgggcttgccggccggcgtgatcggcctggcgcaaggcgccaaggacaccggcgtggccttggccggccatgagggcttggacggcctgttcttcaccggcagctccgccaccggcgcgctgttgcacaagcagttctccggccgcccggacaagatactggcgctggagatgggcggcaacaacccgctgatcgtcggccccgtggccgatgtggacggcgcggtgcatcacgtgatccagtcggccttcgtctccgccggccagcgctgcacctgcgcgcgccgcctattggtgccgcaaggcgagtggggcgacgccttcgtcgcccgcctggtcgaggtggccggcaagctgcgcgttggcaagttcgatgccgagccggcgccgttcctgggcgcagtgatttccaatgccgccgccgacgcgctgctgaaggcgcaggacgcgctgctcgccgccggcggcaagccgttgctggcgatgcgccggctggaagcgggcgcggcgatgctgacgccgggcatcatcgacaccaccgccgtggtccgcccggacgaggaattcttcggcccgctgctgcaggtgatccgctacggcgatttcgaccaggccatcgccatcgccaacgacacccgcttcggcctggccggcggcgtgctgtccgacagccgcgagctgtacgaccgttactggctggaatcgcgcgccggggtggtcaactggaacaaacctttgaccggggcctccagcgccgcgccgttcggcggcatcggcgcgtccggcaaccatcgccccagcgcctactacgcggcggactactgcgcctacccggtggcgtccttggagtgcgacactctggcgctgccggcccagctgtcgccgggcatcgtgttgtaa

SEQ ID NO: 1620 - DNA, 1347 bp, Chromobacterium substugae
atgaacgcctatgaagtgaatttcgacggcctggtcggcccgacccacaattacagcggcctgtccttcggcaatgtcgcgtccaccagcaacgtcagcgcggcatccaatcccaagctggcggccaagcagggcctgcaaaagatgaaggcgctgcacgacctgggcttcaagcagggcgtgctggcgccgcaggagcggccggacgtggcgtccttgcgcaagctgggcttcggcggcagcgacgccgaggtgatcgcccgcgccgccaaggaagcgcccgccatcctggcggcggcgacctcggcgtcgagcatgtggaccgccaacgccgccacggtcagcccgtcggccgacaccgccgacggccgcgtgcatttcacgccggccaatctgaacaacaagttccaccgctcgatcgagcatccgaccaccggccgcgtgctgcgggcgatgttcgccgacgaggcgcgcttcgccgtgcacgcggcgttgccggcgcagatgcacttcggcgacgaaggcgcggccaaccatacccgcttctgcgccggctatggccagccgggggtggagttcttcgtgttcggcgcggcggctttcgacatgcgctacccgaagccggccaagttcccggcgcggcagacgctggaggccagccaggcggtggccaggctgcatggcctggacgaggccggcgtggtgtacgcgcagcaagaccctgacaccatcgacgccggcgtgttccacaacgacgtgatctcggtcggcaacggcgaggtgctattccatcaccagcaggccttcctcaatcaggccgacgtgctggaggagctggcccgcaagctggccgcccgcggcggccgcttcgtgcccatcgaggtgccgcgcgccgaggtgacggtggaggaggcggtgaagagctatctgttcaacagccagctgctgtccaagccggacggcaagatgctgatcgtggtgccggaagagtgccgcaacatcgaacgggtatggcgttatctgcagaagctggcagccagcggcgggccgatcgatgaaatccgcgtgttcgatctgaagcagagcatgcagaacggcggcggcccggcctgcctgcggctgcgggtggcgttgaacgaggccgagctggcggcagtgaatcccaaggtgttgatgagcgacgccttgttcgccgagctgaacggctgggtggaccgccattatcgcgaccgcctggcgccggccgacctggccgacccgcagctgctgtccgaatgccgcggcgcgctggatgagctgacccgcattctgggcctgggcagcgtctatcccttccagctggcttga

SEQ ID NO: 1621 - DNA, 930 bp, Chromobacterium substugae
gtggacatttttctgcaacaaatcctgaacggactcgttctgggcagcatctacgcgctgatcgcgctgggttacaccatggtgtacggcatcatgggcctgatcaacttcgcccacggcgaagtggtgatgttcggcgccatggtcaccatcaccgtcatcaccaccctgatgggcatgggcgtcaaccttccgggtccggcgctggtgctgatcggcctgctggtggccatccccgcctgcatgctgctgggcttcgccatcgagcgcatcgcctaccggccgctgcgcggcaaacagcgcctggcgccgctgatcaccgccatcggcgtgtcgatcgtgctgcagcaggtcgccatcctgatctggggccgcaactacatccccttcccgcaaatcctcgaccatgacgtggtgaccatcttcggcgccagcatcaccaagctgcagatcgtcatcgtcgtgctgtgcctggccatcatggccggcctcttgctgatggtggaaaagaccaagctgggccgcgcgatgcgcgccaccagccagaacccggcggtggcgggcctgatgggcgtcaacgtcaacaccatcatctccaccaccttcgtcatcggctccggcctcggcgccatcgccggcgtgatggtggccaccaactatgagcaggcccactattacatgggcttcatgatcggcctgaaggcgttcaccgccgcggtgctgggcggcatcggcaacctgggcggcgcggtggccggcggcattctgctcggcatcatcgaaagcctgggcgcaggctacatcggcacgctgaccggcggcttcctcggctccaactaccaggacatcatcgccttcatggtgctgatcgcggtgctgatcttccgtccgtccggcctgctgggcgaaaaaatggccgatcgcgcctga

SEQ ID NO: 1622 - DNA, 1092 bp, Chromobacterium substugae
atgaatctgaatactctggacaccaacaagaagatgggcctgttcgccctcagcgccatcgcgctgctggtgctgcccttcgtggtgggcggcgcgctgggcaattcctgggtgcgcatcatcgacttcgcgctgctgtacgtgatgctggcgctgggactgaacatcgtggtgggcttcgccggcctgctggacttgggcttcatcgctttctacgcgatcggcgcctattcctacgcgctgctcagttcgccgcatttcgacatccactggctgttcttcctgaccatccctctgggcgcggcgctggcctcgctgggcggggtgttgctgggcacgccggtgctgaggctgaagggcgactacctggccatcgtgacgctgggtttcggcgagatcgtgcgcatcttcatgaacaacctgaacgcgccgatcaacatcaccaacggtccgcagggcgtcaacctgatcgatcccatccatgtcggcagcgtcagcctgggccagaccatcgagctgttcggcctcagctttcacagcgtgtacctgtattactacctgtttctggcgctgaccgtggcggtggtgatcatggtgtggcggctgcagcactcccgcatcggccgcgcctgggtggcgctgcgcgaggacgacatcgccgccgcggcgatgggcatcaacatccgcaacatcaagctgctggccttcggcctgggcgccttgtccggcggcgtggccggcggcctgttcgcctcgttccagggctttgtttcccctgagtcgttcagcctgctggagtccatcatgattctggcgatgatcgtgctgggcggcatgggccatatcccgggcgtgatcctgggcgcggtggtgctgaccatcgccccggaaatcctgcgcgacgtgatcggcccgctgcagatgaaaaccttcggccggatgctgatcgatccggaaaacgcccgcatgctgctgttcggccttgccatggttgtgatgatgctggtccgcccggaagggatgtggccgtccaagcgccgcaaggctgaattccagcacgccaaagaagaagcggctgcgcagaaaggttaa

SEQ ID NO: 1623 - DNA, 771 bp, Chromobacterium substugae
atggctgaagttttgctgaaaatcgaaggcattcataagcgttttggtggcctgcacgcgttgagcgacgtcggcctgaccatcaacaagggcgaaatctacggtttgatcgggccgaacggcgccggcaagaccacgctgttcaacgtgctgaccggcctatacgtgccggacgagggcaagttcgagttcgacggccacaatctgttccagcagaagccgcacgtggtggtggccgccggcatcgcccgcaccttccagaacatccgcctgttcgccgaaatgacggcgctggaaaacgtgatggtgggccgccacatccgctccaaggccggcgccctgggcgcggtgctgcgcgaccccggcaccatggcggaagagcgcgccatcgaggccaaggcctgggagctgctggagtatgtcggcatcgccgacgtggccgaagagcgcgcccgcaacctgtcctacggccaccagcgccggctggagatcgcccgcgcgctggccactgagcccaagctgctggcgctggacgagccggccgccggcatgaacccgcgcgaaaccgaagagctgaaacagctgatgagcaagatccgcgacggcggcgtgaccgtgttgctgatcgagcacgacgtcaaactgatgatgggcctgtgcgaccgcatcgctgtgctggactacggcaagaagattgccgaaggcgtgccggaagaagtgcgccgaaacccgaaagtgattgaagcctacctgggagcggcccacgcatga

SEQ ID NO: 1624 - DNA, 711 bp, Chromobacterium substugae
atgagcattctggaagtcaaaaacctgcaagtggcctatggcggcattcaggcggtcaaggggatagattttcacatcgaccagggcgagctggtgacgctgatcggcgccaacggcgccggcaagaccaccacgctgaagacgctggtgggcatggtgaagaagtcgggcggcagcatcgtctacgacggcaaggacgtggcgtcgattccttcctacgacttcgtccgccacggtctggccatggtgccggaaggccgcggcgtgttcgccaagctgacggtggaagaaaacctgcagatgggcgcctactaccgcaacgacaaagaggcgatccagagcgaaatcgagcatgtctacgagctgttcccgcggctgaaggaacgccgactgcagctggccggcaccttgtccggcggcgagcagcagatggtggcgatggggcgcgcgatgctgtccaaacccaagctgctgctgctggacgagccgtcgatgggcctcgcgcccatcatcgtcgagaagatcttcgagatcatccagatggtggccaagcagggcgtgaccatgctgctggtggagcagaacgccaaactggcgctggaagtgtcgcagcgcggctacgtgatggaaagcggccgcatcaccatgagcggcgacgccaaggagctgctcaacgacgagcgcgtgcgcaacgcctatctgggcgaataa

SEQ ID NO: 1625 - DNA, 741 bp, Chromobacterium substugae
atggccagctggaaatacgcgctcatgcttgtggtttccctgtccctccgcgccggcgcggcttgcgccggcgaaacgctgacgctggcggcttccgaatacccgccctatatgtcgtcgcagatggcgaacggcggcgtcgccgtcgccatcgtccgcgaagccctgcgccgcgccggctattcggccaaagcggtctacatgccgtgggcgcgcgccgtcaacgaagctcgcgacggccatctggacggcatcgtcggcctgtggaccacgcccgaacgcctgcagcgcttcctgttttcccaagccttcctcgacaaccacatcggctttttcaagcgcagcggcgaccccatccgctaccgcgcgctggccgacctcaagccctacaccatagggatcgtgcgcggctacgccaactccgaggccttcgacgccgcccgcctgcaaaccgacgaaaccttgagcgacgccagcaatctgtccaagctggccgcccatcacatcgacctcgccttgatagaccgcggcgtcgccaattacctgctgggcggcagcctggtcgccctcgcgcccaagctggaatggctgccgccgcccgtcgtcgtctacccgatgcacctgggcatctccaaacggctgccgcaggcggaaaaacgcatccaggacttcaatcgcggcctggagacgatgcggcaggacggcacgctggacaagatgctgaaagaggccaaaatctga

SEQ ID NO: 1626 - DNA, 771 bp, Chromobacterium substugae
atgagccgttatttcccgctgtccgccgcactgttcgtcctgctgttgtcgcagtccgccgcggcgcagctgccggcgctgcatatcctgaccgaggacgatccgccgctcaccttcagccagaacggccagccggcggggctggtggtggaggtggtgcgggagatccagcgccgggtcggcagccacgacccgatcaccgtgatgccctgggcgcgcggctatctgctggcgcaaacccaggctaacacagctttgttcaacaccaatcggatcgccgagcgcgagcatctgttcaaatgggtgggaccggtcaccgccacgctgggcagcttcttcgtccgccgcgacagcaagctcaagctggtgtcgctggacgatgcgaggaagctggaccagattctggtggtgcgcgactggtatctgcaactgacgctgtcggcgcagggtttttccaatctcagcgccatcgccacgcccaaccagatggtgtcgatgctgatgcgggggcgcgccgacgtcatcgccagcgagaacaccacgctgccgacacaattggcgcagctggggtatcagccggcggatgtgcgcaaggcctacaccttcatccgcacttggggctatatcgccttttcgccgcaaacttccgacgcggtggtggcggcgtggcagcgggcgctggacgacatgaagcgggatggcagcttcgccgccatctaccgccgctggctgcctggcgagccattgccggcggcggccgcagaaaaatga

SEQ ID NO: 1627 - DNA, 801 bp, Chromobacterium substugae
atggacggcggggccgccgcgtcttcttgcaagggggaaaccatgtatagcgtcaccgttttggcgcatcggctgcttggggcgctgctgctgccgccgattctcaatctgctgcccatcattgccggcggcatgctgatacggcgttgtccgcatgccggccggctgctgctggcgtccggcgtggcgctgacctattttctttcgataccgcagaccgccatctggctggcgcatggactggagcgctatccggtgatcgacgccgcgcaactggcggacgtggacgccatcgtggtgctgggcggcggcaagcgtccggcggaagagttcggcggcaacgctccgggcggcgacacgctgacgcggctgcgttacggcgcttacctcgcccgcgccagcggcaagccgattttggtgaccggcggcgcgccgagcggcggcgaggccgaaggcgcggtgatggcgcgggcgctgcgcgaggattacggcctcaagccgcgctgggtggagctgcgctccaacaccacgctggaaaacgcgcagctgtcggcaccgatgctgcaggccgccggggtgaagcgcatcgcgctggtcagccagggctggcacctggcgcgggcggtgccgtttttccggcgccagggcctgcaagtgctgccggcgcccaccgggctgattcgctacgacggcgccgccgctttcctctacattcccagcggcaacgcgatggcggagtgccgcaccttgttgagcgaacgcctgggcctgctgttttaccgcatccggccgacgggctga

SEQ ID NO: 1628 - DNA, 1149 bp, Chromobacterium substugae
atgaaaacgacgacccgtccggcgctgtggctgctgacggcgctgatcacattcccgcagctggtggaaaccatttacagcccggcgctgaccgacatcgccttcgccttcggcgtcagccaggcgcaggcatcgcaaacgctgtcggtctacttcctggccttcgccgccggcgtggcgctgtggggctggctgagcgaccgcataggccgccgcccggcgatgctgctgggtttggcctgctatggcgccggctccgcgctggcgctggccgcgaacgatttcaacatgctgttgctggcgcggatgatttccgcgctgggcgcggcggccggctcggtagtggtgcagaccatgctgcgcgacagctacgattccacccggctggcccgcgtgttctcgctgctgggcgcgacgctggccttgagcccagtgctgggcctgctcagcggcggctggctggccggccgcttcggccaccacggcgtgttcgccgccttgctgctgcttgccgtcgcgctgctggcgctgactgccctgcagctgccggaaacccgcccgataggcacggcgcgccccgatatggcccggctggccggccagatgctgcgcgacgccgaactatggcgcgacgcgatgctggtggcgctgttcaacaccatgctgttcagctactacagcctggcgcccttcctgtttcagcggctgggctggagcccggagcagttcggcggctcaggcgcggcgctggccgcggcgtcattggcgggcagcttgctgaatcgcagattgttgggacgtggcctccagtcagaacagctggtgcgggccgcctgccggctggccttgctgtccggcctggcggcctggctgctgcaggcgtcggcctggatcttgttgccggccgccggcgcggtgatagccttcagcatcgccattcccaatgtgctgagccgggcgctgcgccattaccgcgatcaggccggcgccgccggcgcgctgttcggcctgtcctattacctgttgctgagcctgggactggcgctggccggattggcgcagcagttggggatgacgctgacgctggccgccctgctggcgctggcctgccagcggcgccaggctcagcccgtcggccggatgcggtaa

SEQ ID NO: 1629 - DNA, 777 bp, Chromobacterium substugae
atggcttggattcccgctgatcaggcattcgacgccgacggcttcgacgcgccgatgataggcatcgccgccgacatgggcgtgcatgactccggccgccactgccaccgccgccatcagctgctgttcgccgccgccggctgcatcaccatcgagttggcggatacgctgtgcctgctgccgcccagccgcgccgcctggattccggccggcaccgcgcaccgggtgcggatgcgcggcgtggtcgcttaccgttcgctgtatttcgccgtcgacttgcctttccccgcgccgcctttgcaggtagtggaggtcaatccgctgctgcgcgaggtgatagagcggatggcttggtggccatgggatttgcccgcggagcggcaacgcagcctgttggcggtgttcggcgaggagttgcaggcggcgcggggagaaaactggcggctgccgtttccggcggatgcccggctggcctcatggctggatggcgtgcgcggcggggcgcagccgccgcggctgaatcaactggcggacgcggtgggggccagcgagcgcaccatcagccgcatcttcatccgcgacaccggcatgagctaccaggcctggcgccagcagtggcgcctgctgcgggcgatggaaatgctggccgacgggatggggacgagcgagacggcgcagcggctggcgttcgccagcgacagcgccttcatcgcctttttccgccagcacaccggcgcgacgccggcgcggcgcgctcagtccagcgtgtccaggtag

SEQ ID NO: 1630 - DNA, 654 bp, Chromobacterium substugae
atgaaaatgctgttgctctccctgctgctggcgctggcagctcccgcccgcgccgcggcccccgacctgcaggccgtggtgcattacgaaaccgtcagcctgggcgccgacggcgtcgagaaaaccatccgctaccgcgaaaagctggtgcgccagaatggacatgtctggcgcgagcgcctgaacgccggcgcgccgcaccgccacgacgacgacggccaccagcacctggacttcgccgccgcgccacgccatgtctggctggacgcccaggggcggccgcaactggagttcatccacgccggcaaaaaagagaggatccagaccgcgccgcgcgaatggagcgatgtcggcttcaacggctcctgggcgcaggccagccagttggtggacatcagccagctgcgcggcttctcgctgcggcaggaggaaaaagacgtcgcgcgctacagcaaaaccagcgcccagggcagcaagacgctgcgctggagccagcgctggcagctgccgctggaagtggaagtgcgctcggccgacggccgccagcgcgaaaccatacgagtcagcccgcaggctctggccgccggcaccgttccgccttggcggcaatacgcgcgctggcccgtccgcgactacctggacacgctggactga

SEQ ID NO: 1631 - DNA, 1359 bp, Chromobacterium substugae
atgcaaaccgtgatgaaaaccctgctggccgccgctgcgctggcggcgctgtcctccgcccccgcccgcgccgccggcgaagccaagaacgtgatcttctttctcggcgacggcatgggcccggccaccgtcaccgcagcccgcatctaccagtacggcgagggcggcaaactcaatatggagaagcttgaccgcaccgctcgcatcaagaccttctccaatgacgcgcagaccaccgacagcgcgccgtcgatgtcggcctatatgaccggcgtgaagatgaacaacgaggtgatctcgatgtcgtccgacacccgcgccatcgaacccaacagcgacggcaccggcaactgcggcgcgaacaacggcgcgccggccgccacgctgctggagctggccaaggccaagggcaaggccataggcgcggtcaccaccacccgcgtcacccacgccaccccggccgccacctacgcccacgtctgccaccgcgacgccgaatccgacatcatcgcccaggcggtgcccggcggcgccggctacaacgccaggctgggcggcggcctggatgtgctgatgggcggcggcggcaagttcctgctgcccaaggccagcggcggcaagcgcgccgacggccgcaacctgctgcaggaattcgccgccaccggctacccggtgctgcagaccggcagcgacctggccgccttcgacgccaagtccgccagccgcgtagtgggcatcttcggcaaggaccacctggaatacgagctggaccgcgtcaagaacaaggtggaccagcccagtctggcgcagatgaccgcggcggcgatagacgtgctgtccaaaaacagcaacggctacgtgctgatggtggaaggcggccgcatcgaccacgccttgcacggcaccaacgccaagcgcgcgctgaccgacgccatcgccttcgacgacgcgatcaagaccgcgctggccaaggccaacctgagcaacacgctgatcgtcgtcaccgccgaccacgaccacaccatgaccatcaacggctattccaagcgcggcaaccccattcacgacatctcgcgcagctatgtcgacggccagccggcgaaggacgccgacggcgccgtctacaccactctggtgttcggcaacggccccaaccgcaaaccgacccgggtgtcggtggattcggccgccgccaccgccgacgactaccagcaggagaccggcatccgcctgtccagcgaaacccatggcggcggcgacgtgatgctgatgtccggcggcgccggcagcaagggcttcaagggcgtgatggacaacaccagggtgttcggcctggtgaaaaccgcgctgggcctgtaa

SEQ ID NO: 1632 - DNA, 1425 bp, Chromobacterium substugae
atggccatcagcctggccgcctgcaacagcggcggcggcagcgccgccaaccggccgcaggacaacgcggaaagccgtccgccggcggccagcgccaagaacgtcattttcttcctcggcgacggcatgggcatcgccaccaccaccgccgcccgcatctactccgtcggcgaagacggccagctgacaatggacacgctgccggaatccggcttcgtcaagaccttctccaacgacgcccaggtcaccgacagcgcgccgtcgatgtcggcctacatgaccggcgtcaagatgaacaacgaagtcatctcgatgtccaccgacaccgtggccaaatcacccaaagccgacctgacatccaactgcggcgccggcaacggcaaagcggtgtccacgctcttggagctggccaaggccggcaaccgcgccaccggcgtggtcaccaccacccgcgtcacccacgccaccccggccgccacttattcacacgtctgccaccgcgacgccgaagccgacatcgccgcccagctggtgcccggcggcgcgctgtacaacgccgcgctgaaagacggcgtggacgtggtgttcggcggcggccgccagttcttcctgcccaaggccgccggcggcaagcgcgccgacggccgcgacctggtggcggagctgaaaacccgcggctacggctacgccgccgacaaggccggcttcgacgccatcgatccggtccggacccgccgcgccgtcggcctgttcaccgccagccacatgagctacgacctggaccgcgacgccgccaaggagcccagcctggccgagatgaccagcaaggccatcgccatgctggccggccgcagcgacaagcagggcatgttcctgatggtggaaggcggccgcatcgaccacgccctgcacgaaaccaccgccaagaaggcgctgcaggacaccgtggccttcgaccaggcgatccaggccgcgatcaacgcgatgcagcagaaagaccccggcctgaaaaacacgctgatcgtcgtcaccgccgaccatgaccacaccctggtgctgaacggctacgccaagcgcaccggcaagaccgcgccgggcaaccccggcgtgctgggcctggccaaggattacgtcagcggcaagaacctggtcgacgccgacggcatgccctactccatcatcggcttcggcaacggcgaaaaccgcgtcgccggcgaccgcagcgcggccaccgcgctgaccgacgacgcggcttccgccaacgactaccaccaggaagcggcgatacggatgccggccggcggcgaaacccatggcggcaccgacgtctacatcgccgccatcggccagggcgctgacagcgtccacggcttcctggaaaacatcgaagtgttcggcctggtcaagaaggccgccggcctgtaa

SEQ ID NO: 1633 - DNA, 1095 bp, Chromobacterium substugae
atggtcgacatcggcaaggaattgtcgatggacgtctattccaaaaacggctttttgctgctcaagcgcggccattacgtgctgacgccggaattgaagcaaaaactggtcaatatgggcttcgccgaaggcaagtccgaggccaggccggtggacaagcccattctgaacgacagcaggaaacattcgctgttcgaggacatcgccttcttgcagcagcgcgtgcgcagcatgctgtattacgcgctggccaccccgggtttcgaggccagggcgatggagatcgcgctgacgctgatccggctggccgaaacccacccggacgcgctgatcgcctccatcttcctggtgccgttcgccgaatacagcgtcgcccattcgctgcacaccgcggcgctgctggccatcctgtcccgcagcatcgccctgccgccgcgccaccgcgaaacgctgatctgcgcggcgctgacgatgaacatctcccagatcgagctgcagaacgagctgttcggccagccgggcagcctcagcgccgaacagaggcaggcgatcagcgaccacccgctgatgagctcggccatcctgcgcgaagccggcgtcgacgaccagctgtggcacacgctggtgcaaacccaccacgaatcctggcacggcaacggctacccccacggcctgtcccgcgaacagatcctgccgccggcgcacatgctgcgcctggccgacatcacctgcgccaagctgctgccgcgccgctaccgctccgcgctgctgccggccaccgcgctggggcagatcttccagcgcaaggacagcgagttcgaccagtccttcaccacgctgctgatccgcgagctgggcatatacccgcccggcagcttcgtgcgcatcgccagcgaggaaatctgcgtggtgatctcggccggcgccaagcccagcgcgcccatcgtcgccgccatccgccgcgccgacggcccgccctacggcgaaccgctgctgcgcgacaccaacaagccggggctgaaagtcctcgcgccctgccccgccggcgacgccaaggtgagagtgtccttcctcgcccacctgtggaaatgctga

SEQ ID NO: 1634 - DNA, 3936 bp, Chromobacterium substugae
atgacacctgccgccagcctcgccgacctgaaatccgccctgtcctgctgcctgatccgcgaccgccacatcctgcgccgcaagctggccgacgccgccgaccggctgaagaaaaaccagtccgccgacaagctgctggcggacatcgccaaccaggtggagcgctcgcgcggccgcgccgacgcccgccgcgcgcacctgcccaagccggagttcgacgacgcgctgccggtcaaccagaagctcgccgacatcaagagcgcgatagacaagaaccaggtggtgatcatctgcggcgaaaccggctccggcaaaaccacgcagattcccaagatctgcctggaattgggccgcggcgtgttcggcctgatcggccacacccagccgcgccggctggccgcgcgctcggtggcgacgcgcatcgcgcaggaactgggctcgcaactgggcgagcacgtcggcttcaagatccgtttcaccgacaaactgtcggaaaagtcggtgatcaagttgatgaccgacggcatcatgctggcggagacacagaccgaccgccacctggaagcgtacgacaccatcatcatcgacgaggcgcacgagcgcagcctgaacatcgacttcctgctgggctatctgaagcagctgctgccgcgccggccggacctgaaagtcatcatcacctcggccaccatcgacgccgaccgcttcgcccgccatttcgacggcgcgccggtgatcgaggtttccggccgcactttcccggtggaagtgcgctaccggccgctgaagcagcgcgatgaagacgagcgcgagatggagatggaggacgccatcgtcgacgcggtggacgagctgtcgcgccaaggccccggcgacatgctggtcttcctgcccggcgaacgcgaaatccgcgagacagcggaaaagctacgcaagtccggcatccgcggctacgagatcctgcccttgttcgcgcggctgtccaacgaagaccagcagaagatcttcaagccgtccggcggccgccgcatcgtgctggccaccaacgtggcggaaacctcgctgacggtgcccggcatcaagtacgtgatcgacaccggcctcgcccggctcaaccgctacagcccgcgcgccaaggtggagcagttgcaagtggaaaagatttcgcaggccgccgcgcgccagcgctccggccgctgcggccgggtggccgccggcatctgcgtgcgcctgtacgccgaggacgacttcaacgcccgctcgccgttcaccgacccggaaatcgtccgctccaacctggcggcggtgatcctgcgcatggccgcgctgcgcctgggcaaggtggatgccttccccttcctggaagcgccgtccagccgcctgatcgccgacggctaccaggtgctgaccgagctgggcgcagtggacgacaagggcgagctgacgccggtcggcaaggagttgtcgcgcattccggtggacccgaaagtgggccgcctgctattggccggccgcgacttccactgcatgcgcgaggtgctgatcatcgccgcggcgctgtcgatccaagacccgcgcgagcggccgttcgaagcgcgcgacgcggcggagaaggcccaggcccgcttcaacgacgagaagtccgatttcctgtctttcctgcacctgtgggacttcttctccgacgcgctcaagcacaagaagtccaaccgcctgctggtcaacacctgccacgaccacttcctgtcctacctgcggctgcgcgaatggcgcgagctgcacgcgcagctggccgagatcgccagcgagctgggcctgatcaagcgcgacgaagcccacgccgacgccgagcagccggacgcgcagatgacgctgaaaaagcgccagcagctggacgccgtcgcctatgaaaacctgcacaaggcgctggtgaccggcctgatcggcaacatcggcatgaaaaaccaggaaggcgacgactaccagggcgcgcgcggcgtcgccttccacgtcttccctggctccggcctgaagaaagccaagccgaaatggctggtggcggccgaactggtggaaaccacccgcctctacgcccgctgcgtggccaagatcgagccggaatgggtggagaagctggcgccgcacctggtcaaataccactacttcgagccgcactgggaaaagagccgcggcgaagtggtggccagcgagcgcgtgacgctgtacggcctgacgctgattccgcgccgcgccgtcagctacggccgcatcgcgccggaagaagcgcgcgaactgttcatccgcggcgcgctggtgaatatggactacgtcagcaacgcgccattcttccagcgcaaccagcagctgatccgcgaagtggagcaactcgagcacaaggcgcgccgccaggacgtgctggtggacgaggaggcgctgtacgcgttctacagcgagcgcatcccagccgaagtggtggacgccgccagcttcgaagcctggcgcaaggaagccgagaaggccgagcccaagctcttgcacctgacccgcgacgagctgatgcgccacgccgcccagcacgtgaccgaaaaccagttcccggaatggctggagctggacgacggcaaactgaagctgcgctaccgcttcgaacccaagcatccgctggacggcgtcaccatcgacgtgccgctggccatcctgaaccgcctgacgcctgcggcgttcgaatggctggtgccgggcatgatccgcgacaagctgcagcaattgatcaagggcctgcccaagcagatccgccgctgctgcgtgccggtgccggacttcgtcacccgcttcctgctgagcaatccggacttgcagcaacccatcgcgccgcagctggcgcgcttcatcctgcgcgagacaggcggcgtcaaggtggacatcgacgaattcaacgcgcaagagctgccggaacacatgctgttcaacttccgggtgatagacgacggcaagcaggaaatcggcctgggccgcgacctggcggcgctgcagaagcagttcggccaggcggcgcagctgaccttccgcgacaccagcgccgacttcgagcgcgacgacgtcaagacctgggacttcggcgaactgccggaaagcatacagttcgcccgcggccgccagcagctcaccggctacccggcgctgacgctggaggacgacaaggtggcgatccgcctgttcgacacccagctggccgccgagcgccaccaccgccagggcgtggtgcgcctgctgcagctgcagttgaaggaacagatgaagcagttgtccaagggcctgcccggcatcacccagatcggcctgcagctgcgcgcggtggccaatgtcgacgagctgatggccgacgccatcgcctgcatctgcgaccgcgccttcatcggcgaggacgcgctgccgcgcaatgagaaagccttcaacgaccaaaagaaccgcgcccgcacccgcctgccggcggtgatccaggcggtttcgcaatacctgcagcaaatcgccgccgaatacacgccgctgggcaacaaaatgcagaagcacaagctgggctacgacctgaagccgcagctggacagcctggtctacaagggctttctcgccgccacgccgtggagccagctgccgcagctgccgcgctacatgaaggcgatgagcctgcgcatggacaagcagccggccaacccgcagcgcgacggccagcgcgcggcggaaatccgcgacctatggcagaaatggcaacagcgggtggcggagcagagcgagcagggagaagcggcgccggcgctgctggaatttcgctggatgatagaagagctgcgggtcggcctgttcgcccaggaactgaagaccccctatccggtttcggtgaagcgcttgctgaaagcatgggcagacctgccgcgctag

SEQ ID NO: 1635 - DNA, 1212 bp, Chromobacterium substugae
atgaacaagctgccggtaacggtgctgtccggctttctaggcgccggcaagaccacgctgctgaaccacatcctggccaaccgcgaaggcaagcgggtggcggtgatcgtcaacgacatgtccgaagtcaacatcgacgcccgcctggtgcgcgaaggcggcgcccagttgtcgcgcgccgaggaaaagctggtggagatgagcaatggctgcatctgctgtacgttgcgcgaggatttgctgctggaaatccgccgcctggcggcggaaggccgcttcgactacctgctgatcgaatccaccggcatctccgagccgctgccggtggccgaaaccttcactttccgcgacgacgatggccgcagcctggctgatctggcgcggctggacaccatggtgacggtggtggatgcctgcaatttcctgcgcgactacgcctcgcgcgacagcctcaccgatcgccaggccagcctgggcgaggaggacgagcgcaccgtggtggatctgctgatcgaacaagtggagttctgcgacgtcatcgtgctgaacaagaccgatctgatcagcgccgaagcgctggtggagctggagggcatcctgcgctcgctgaatccgcgcgccgacatcgtgcgcagcgagttcggctgcgtgccgctggacaaagtgctcgataccggccgcttcgacttcgacgccgcggccgaagcgccgggctggctggccgaactgcgcggcgagcatgtgccggaaaccgaggcctacggcataagcagcttcgtctaccgcgcgcgccgtcccttccatccgcagcggctgtggcaatggatgcggcaggaatggccgggcgtggtgcgctccaagggctatttctggctggccagccggccgcagttcgccgccttgtggtcgcaagccggatcggtggcccgccattcctgcgccgggctgtggtgggcggcgctggaccgcgcggaatggccccaggacgaagacagcctggcgctgatccgcgcgcgctggcaagagccgttcggcgaccgccagcaggagctggtgttgatcggcatggatatggacaagcaggcgctgaaggccggcttcgacgcctgcctgctgaacgatgccgaactggccggcggcatggagacctggcaaacgttggaggacccgttcccacgctgggaaatccgcgaggaggaagccgaggcctga

SEQ ID NO: 1636 - DNA, 639 bp, Chromobacterium substugae
atgaccgccgacgccaccgccgaaaccatccacctttccgataacttggccagccttgcggccatcttcgacgccgacgccgagctgtgcctgtaccgccgcccgcccaacgccgccatcgccggctatctgcgccgcgcggagcaaaacggcctactgggcctgggctggcggcggatagtgacgcctggggaaagcgccgacttgccgctggccgacctgcccggccgcgacgcgctgcaagccgacatcgactggctgtgcgagctgtacgccacgctgaccggctgtccgcaagtgggcgcccggctggaggtgctgagccgcccgatgtgcccgcgcttccacgtggaccgcgtcggcctgcgcctgctgtgctgctaccaggggccgggcaccgaatggctgccttcccccgcggcaaaccgctctcggctgggttcggccgcgcagggcctgcccgatgcggaatccggcctgatcctcgacgccgccgccatcggcagcgcgccgccgttcgccgtgctgctgctcaagggcgcggaatggccggaatccaagggcggcgtcatccaccgctcgcccgccccgcatcccggagaagcccgcgtgctgctggcgctggacgcggtgtggtag

SEQ ID NO: 1637 - DNA, 819 bp, Chromobacterium substugae
ttgctggctcatgccgcggtcaatgtcgtcgccggcgaaaacttctacggcgatgtggcgcagcagatcggcggcagccatgtccgcgtcaccagcatcctgagcaatccggaccaggacccgcacctgttcgaggccagcgcatccacagccaaggcgctgagcgatgcccggctggtggtgtacaacggcatagactacgacccgtggatggacaagctgctgtccgccgccaaggctccgcagcgcaagaccgtggtggccggcgagctgctgaagcgcaagactggcgataacccgcatctgtggtacgacccggccaccatgccggcagtggccaaggcgatcgccagcgggctggaaagcgccgatccggcgcacaaggccgattacgatcacaatctgcagcatttcctggcctcgctgcagccgctgaacgccaaagtgcaagccttgcgcggcaaatacgccggcaagccggtgaccgccaccgagccggtgttcggctatatggcggaggcgctgggcctgaaaatgcgcaatgaaaaattccagctggcggtgatgaacaacaccgagccggcggccagcgatatcgccgcctttgaaaacgatctgaaaacccatgcggtgaacgtgctgttctacaacagccaggcatccgaccagtccgccaagcgggtgcagaaagtggcgcgcgccgccaaggtgccggtggtgggcgtgacggagaccgcgccggccggcaagcattaccaggagtggatgctgtcgcagctgaacgcgctggacaaggcgctgggcgggtccggcaagtga

SEQ ID NO: 1638 - DNA, 795 bp, Chromobacterium substugae
gtgagcgcggtgtcgctggccggcgtcagcgtcggctatggccagcgccaggtgctggccgatgtcagcctggagatcgggcaggggctgttcatcggcgtgctcggccccaacggggccggcaaaaccacgctgatgcggaccatgctcggcctgcaggcggtggaccgcggcagcgtgcgggtgctgggccagccggcccggcgcggcaatccggctgtgggctacatcccgcagctgcgcagccacgccgcccatctgcggctgtgcggctgggacttcgtcgccagcgcctgccgcggccaccgctggggtttgccgctgctggatgccgcggcgcggcgcgaggtggggtgggcgctggacaccgtgggcgccggctcgttggcgcggcgtccgctctccgagctgtctggcggcgagcgccagcggctgttgctggcgcaggcgctgctggggcggccgcggctgttgttgctggacgagccgttgatcagcctggacccgcaccaccagcgcggggtggtggagctggtgtcgcgcatccagcgcgatttcggcatcaccgtgctgttcagcgcgcatgagcttaacccgctgctgccggccatcgaccaggtcttgtacctgggccgcggccaggcggcgctgggcacggtggacgaggtgatcacccggccggtgttgtcgcggctgtacggctcgccgatagacgtggtgagaatgagggaccgcatcttcgtgatgtcgggggaggtggaagtggagcgggaggcgcactgtcacgatgtttga

SEQ ID NO: 1639 - DNA, 801 bp, Chromobacterium substugae
atgtttgaatacgatttcatgatcaacgccttcatcgccggcggcctggtggcgctggtggccggggtgaccggctatttcctggtgctgcgcggccaaaccttcgccggccacgcgctgtcgcacgtcggtttcgccggcgccaccggcgcggcgctgctggggctgccgccgctatggggcatgacgctggtcacgctgtgcgggggcgtggcgatgggcgcattgggcgagaggctgcagggcagcgacatcgccattggcgccatcctgtcattggcgctgggcctgggcatgctgttcctgcattttttcaccgcctatgccacgcaagccacggcgctgctgttcggcaacgtgctgggcgtggacaccgccacgctgtggacgctggccggtctgggcctgctgtgcctggcggcgctggctttcatctcgcggccgctggtgttctgcagcctgcagccggagctggccgaggccaagggcgtgtcgctgcgccggctgtccatgctgtttctcgctatcgtggcgctggccaccgccggctgcatccagatcgtcggcgtgctgctggtgttcacgctgatggtggggccggcagccaccgcgcagaagctgacggcgcggctgggcgtcggcgtgggcctggcggcgctgctggcgctgggggaggcctggggcggcatcgcgctggcttactacaccgactggccgtccagcttctggatcaccaccctcagcggcgctgcctatctggcagcgggcggcgcgcgaggcctgcgcgtgatgcgcggatag

SEQ ID NO: 1640 - DNA, 663 bp, Chromobacterium substugae
atgaaagctaaattcgcgatgacggcctgcggcgcgctggccatgctgtacctggcagccgcgcatgccgacgacaccttcggctacgccaagctaggcaccggcgtggagctcggcgtcggccgcgccctggacaacggcctggcgctgcgcctaggcatcgccgacaccttccgctacaagcacgacaaggcgctggacggcacgccctatcagttgaagtccaaacccaatcccgcgctggcggccagcctggattggcgcccgctcagcgacagcggcttcaggttgagcggcggcctgaccttgtccggcaaacccagggaggatctgaacttcgcggccaatggcgcgggcaactacacgctgggcggcaaccgttatgccgcgtccgccgtcgggccgctgaccggcaagatggaataccagccactcgggtcttatctgggtatcggctgggatttcgccgtgccgggcgcatccgcctggcgcatcacctccgacctgggcgcgcagcttcagtttggcggcaaagctacgctgagtccggcggccggcgtcagcgcccaggacctggcggcggcacaacagaagctggaccacgacctgggcggcacccgcttccggctgagcgccggggtgggcctgtcttacgcgttctga

SEQ ID NO: 1641 - DNA, 1443 bp, Chromobacterium substugae
atgctggaaggattgaggtgggcggcgtggccgttggcgcatggttgggccaggccgggattttccatgaagagcgcaggctgcatgacatatggcttgtgttacgctggcgcatattgcgcggcatgggccgcgcttttcatattgacgcgggaaaaagccttctccatgcgaccttatctccatgccatcggctccggttccgcctggttccggcgcgcgctgctgctggcttgcgcgctgatgctggcgtctggcggcgttgacttatggcccctgccggaagcggcgctgcgcgagcaggccgctgcctggttgtggcctgcctggctggcgcatggcttgcgcggttggctgagcttgcgtgacgcggctttgctggtgttcgccgcgctgatgctgctgttcatgattgcgctgcggcgcggcttgtcgagcgaggcgccgccacggcgatggtggccatggctggcggggcagatgatcatcgcagccgtgctggaaccatggaccgagccgggacttgggtatctggtggcggccgaactggcctttctgttgccctggcgcggcgcggcggccggggcgctgttgcaggcggccttgatcgatgcggcgctgttgccttatctggcgcgcgtgggaaacggccatccggcctgcaatatcgccggtgcgctgccgccgccgttctggacggtggccgcgctggactggctgcaaggactggttttccaggctttcgccttctgtgtgggctatggctgggcggaagcgttgcgggggcggcatcggcaggcgcaggccaatgcggagctgcaggcgacgcaattgctgctgaccgaggcggtgcgcgaagccgagcgcgcgcgcatcgccgagggagtggcgcggctggcggcggatcaactggcggccttgcagctgcagctgagattggctgaggctaagttgggcgctgaggctgacacgcagatcgccgcggcgcgcgagggcgcgagccggctggcggaggagctgcgcggcgtcgcgcgcggcgatgccctggcatccttggacttgcgcgaggcgctgaataccttgtgccgcggcatcccgatgccgctggtcagattggatatggaggatgcgttgacgttgagcgagcccacgctggcgcatgcgatatttcgcacggtgcaggaggccttgagcaatgccttgcggcattccggcgccgccggcgcggtggtgaggctggagcgatcgggcgccggcgtggcggtgaccgtcagcgataacggcaaggggctggctgcgccagaggcgaagcgggcaggtcatgggttgatcggcatgcgcgagcgggtggaagcgcgcggcggcacgctggacatcctgtcgccggcatccggcggctgctgcctgcgcatctggctgccgttgtccggagaggcgtcatga

SEQ ID NO: 1642 - DNA, 1014 bp, Chromobacterium substugae
ttggcgcatatgcgcgaacgactgccgctgttgacgggaccggccatcggcctgcccggcgcgatggcggcctacggtttgggttttgcggcgtttggctgggccttgtggcgggccagcgcggttggcgcgcgcgcgccgggggcgacggcgaaagccggcctggtcgttttgcagatcgcgctggccttgctgacaaacgacaagttgctattgctgaccgctgccgagcttgcgttattgttcccgccgcgcgcggcctggctcggcttgggcgggcaagtgctggcgctgctgctggcgtgcgcctggcagctgcagcgtctgccggcgaaggagctgatgtgcaatgtcagcggctccaatgtccatgccccgccgttggagcagcggtcttggttgttgtggcaggacgctgtcgtcggcggtggcttccagctgctgaccttcggcattggttgcctgggcgcggcggaacgccgccgccgcgcgcaactggaagcgacccgcgccagcctgcttgccgcccggcaactgttggccggcgcggccggaaatcgcgagcgggtgcgggtagcccgcgaattgcacgacggcatcggccatcatttgtcggccttgaatctgcaactggagctgttgttgcggcgcggagcaggcgaggcggatgcgccgctgcgcgcggcgcagcaggctgcgcggcagatgctggccgaggtgcggaccctggtgggaatggagcggcggcaacagcaagccccattggcggaggcgctgcgtttgttgtgcgccggcgtccggccgcaagcggagttggtgttggagccgatgccggcgctggcggacgatgcggcgtggcgggcgttttccgcggcccgccaggcgctggagcgcgccggcggccggtcttgccgcctgtggctgcgggggcagggcgaaggcggcgcggagctgcgcctgtcgatgagcggcgaaggcgaatggacgaccgtgtggcaggaggcggcgcgatga

SEQ ID NO: 1643 - DNA, 672 bp, Chromobacterium substugae
atggacgaccgtgtggcaggaggcggcgcgatgatacgcgtgggattgattgacgatcagatactggtgcgcagcggcattcgcggtttgctggagttgaccggcgacatccgggtggcgctcgaggccgcggacggggccgaggcgctggcgctgttgcagggggagaggcccgatgtgctgttgctggatgtgcgcatgccggtcatgtctgggatagcgctattgcaagccctgcagactcgcggcggcatgcccccgaccttgctgctgaccacgttcgatgacgacgaggcgctgttggccggcatgcgtttgggcgcgcgcggatttctgctgaaggacatctcgctggagcggctggcgcaggcgatccgcaacgtggcggcgggggcgaccttgtttcgtccggggctgaccgaacgcgtgctggacggcgtgcgcggcggcggggcaagctttccctccctcgatttgccggaaaggctgactggccgcgaggtggaagtgctggcgctgatggccggcggtttcaataaccgcgagatcgcggaagcgctggggccaagcgagggcacgatcaagaatcacgtctccagcatcttgtccaaactgggcgtgcgcgatcgggtgcgcgcggtgttgcgcgccttggagctgggctacatctga

SEQ ID NO: 1644 - DNA, 1509 bp, Chromobacterium substugae
atgtctatacaggccatcacagaatggttcatcccggacgcggtccggcagattccggagcaggcgatacgcgcccgcaccgtggtcggcgtcggcctgctcgccggcctgatggcgccgctgttcgccgtcgaatacctggagctgggccactatccgatggccgaaggcatcgcgctgggcggcctgggcctgctgtgcggccctctgctgctcaagctttgcggcgcggtgcgcttcaccgccgaattcatcaccagctgcatgtacgcaatggtgtgctggatggtatatgtcaacggcggcatcctctccaccagcctgatgtggttcgccgccatcccctttaccgcggtgttcatcggcacccgccgctccggcatgttctggctggcgatgtcgctggccgccgtcggcgtcgtgatgtggctgtcggcgacgcccggcggcattccgaccagcccgctgccgcgcgaggccttgcccaagctgcaggccaagtcgctggccggcctgtcgctggtggtgctggtgctggcgctggccttcgacaaggccaagagcaagagctttgaaaaactggaaagcgcgcgccaggacgccgaacgcgccagcctggcgctgtcgcagatgatggagcagatcagccgctccatccgcgacgcctccagcgccagccgacagatagccgacagcaccggcagcatggcccgcaccatggccgatcagcaccagcgttcggaaaacatggtggtggtggcgcagcagatggcggtggtcaccagccagaacgccgagcagtcgagcaccgccacccagctggcgcaaaccgccggcagcgccgcgctggccggcggcgaggcgatggaccaggcggtggcgcagctgggccgcgccggcgaagtgataggccacgcggccggccggctggaagagctgggccagcgcagcgccgaagtcagcggcatcgtccagctgatccgcgacatcgccgaccagaccaatctgttggcgctgaacgcggcgatcgaggccgcccgcgccggcgagctgggccgcggcttcgcggtggtggccgacgaagtgcgcaagctggccgagcgcacccagaacgccacccaggacatcgaaagcaaaatccgggtgatcgtcgacggcaccaaccaggccatggtggcgatgcgcgacggcaaccgccagatgcaggccggccgcgacaacgcgcaggacgcgcagcagaagctgtccggcatcatccgcgaaaccggcgagctggccggcctgctgagccaggtgtcgcaggcggaaacctgccagaaccaaggtttcgcgcagttcgccggcgatatcgtcgccgtcggcgaatccacccgcagcctgtccggcgaaacccacaacatcgccgaagccatccgccggctggacgcgcagatggaaaccctgcaccaggcggtgagccagccggcacacgcgccggcatcgactagacgcgaaccgagccgggcctga

SEQ ID NO: 1645 - DNA, 2076 bp, Chromobacterium substugae
atgcagacattctttcttgccccaaccggtttcaacgccggtctgacttcggtgtcgctgggcgcgatccgctcgctggaacaagccggcctgcgcgtaggcttcgtcaagcccatcgcccaggacaccaaggatggcgaagtcgagcgctccacccacttcgcccaggccatctgccgcctgaacccgccgcagccgatcagcatggagcgcgtcgagcacctgctgtcgcaaggccaggtcgaccagctgatggaagaggtggtcagcctctaccagcaagccgcgcaaaacgtcgacgtggtgatcgtggaaggcctggtgccggaccagaagcaggtgttctccaccttcctcaacaccaagatcgcccgcaacctgcaagcgcagaccatcctggtcagctcggtgaaggatctgggcgcggcggaaatcgccgaacagctggaaatgaacatccaggccttcggcggccaatccatcgccggctacatcctcaaccatgtgctgcccggcgccgaccgcgccgaactggcgcgcgaggtgcagcagtccggcaatctgaaaaaaaccggcctcgcgctgctgggcgtgatcccgtaccagccggagctgctggcgccgcgcacccaggacgtggcccgctacctgaacgccagcgtggtgcacgccggccagcaggccagccgccgcgtgcgcaatatggtggtggcggcccgcaccgcgcctaacatcgtcaacctgctgaagccgggcgcgctgatcatcaccccgggcgagcgcgaagacgtggtgatggccacctcgatggccgcgatgaacggcgtgccgctggccggcctgctgctgacctgcgactccgagccggatccgcgcatccagcagctgtgccagcaagccttcaccggcggcctgccggtgctggccacctcgctgaactcgatggaaaccgccagcgcgctgaacgcgatgagccaccaggtgccgtccgacgacctggagcgcatgggcaaggtgatcgatcatgtcgccgagttcctcgacgtgtcgacgctgaagcaaagcgtcggcgagccgcgcgaaatccgcctgccgccgccggccttccgcttccagctaatggaaaaggcgcgcaaggccaacaagcgcatcgtgctgccggaaggcaacgagccgcgcaccatccaggccgccgccatctgccaggagaaaggcatcgcccgctgcgtgctgctgggcaagcgcgccgaaatcctgcaagtggccgaagcccagggcgtgacgctgccggcatcggtcgagattctggatccgaacgaaatccgcggccagtatgtcgcgccgatggtcgagctgcgcaagggcaagggcctgaacgagccgatggccttggcgcaactggaagacaccgtggtgctgggcaccatgatgctggcgatgaacgaagtggatggcctagtttccggcgccgtgcacaccaccgccaacaccatccgccccgcgctgcagctgatcaagaccgcgccgggctccagcatcgtgtcgtccgtcttcttcatgctgatgccggagcaggtgtacgtgtacggcgactgcgcggtgaatccggacccgaccgcggaacagctggccgacatcgccatccagtccgccgactcggccgtggccttcggcatcaacccgcgcgtggcgatgatctcctactccaccggctcgtccggcagcggcagcgacgtggaaaaggtgcgcgaagccactcgcatcgcccaggaaaagcgcccggacctgctgatcgacggcccgatgcagtacgacgccgcctcggtggaatccgtcggccgccagaaggcgccggacagccaggtggccggccgcgccaccgtgttcgtgttcccggacctgaacaccggcaacaccacctacaaggcggtgcagcgctccgccaacgtggtgtcggtgggcccgatgctgcaaggcctcaggaagccggtcaacgacctgtcgcgcggcgcgctggtggacgacatcgtctacaccatcgcgctgaccgcgctgcaggccgaacagcaaggctga

SEQ ID NO: 1646 - DNA, 1206 bp, Chromobacterium substugae
atgttcaagcctatgaattccagcatcctcgtcatcaattgcggcagctcttccctgaaattcgcgctgatcgacagcgccagccacgaagcggtcatgaccggcctggctgagaaactgggcctggccgacgcctgcatcaccttcaaacacaatggcgacaagcaaaccgccctgctgtccgctccggaccacgccgcggccatgcacgccatcatcgagaaactgcaacaagtgtcgctgctggacagcgtgaaggccatcggccaccgcgtggtgcatggcggcgaacacttcaagcaatcggcgctgctggacgaaaacgccatcaacgaaatcgaacgctgcatcaagctggccccgctgcacaatccggcccacatcctgggcatccgcaccgcgatccaggaattcccgagcctgccgcaagtggccgtgttcgatacctccttccatcagaccatgccggaaaaggcttatctgtacgccgtgccgatgaagctgtaccgcgagaacagcctgcgccgctacggcatgcacggcaccagctaccgcttcgtcgccgaagaagccgccaagatgctgggcaagccggccgatgaaaccagcctggtgatcgcccacctgggcaacggcgcctccatctccgccatccgcaacggcaaatgcgccgacacctcgatgggcctgaccccgctggaaggcctggtgatgggcacccgctccggcgacatcgaccccagcgtattcggctacctggctaccgagcgcggcatggacgtgcaggccgtcaccaatatgctgaacaaggaatcgggcctgctgggcctgtccgagctgtccaacgactgccgcgagctggaagacgccgccgccaagggccacgaaggcgccaagcgcgcgctggaagtgttcgcctaccgcctggccaagtacgtggcctcgatgagcgtgggcgcgggccgtctggacgccgtggtgttcaccggcggcatcggcgagaattcgtccttcctgcgcgccgaagtcatcaaccagctgggcttcttgggcctgaagctggacgccgccgccaacgaagcgtgcatccgcggcaacgccggccgcatcaccgccgccgactccgtgccggcgctggtgatcaacaccaatgaagaactgatgatcgccatggacaccgccgaactggccggtctggccaagtaa

SEQ ID NO: 1647 - DNA, 189 bp, Chromobacterium substugae
ttggagcagctgcgcggaagccagatcagacattattcccacacctccgtggaagaagatataagaccagccgaatctcgctcgggacgagtttgcgggactatcaaaaacaatcaatcaaaacaaggccgaaccttgcattacgagggcggaattatgccctcgcccctcccccggggcaagcgttaa

SEQ ID NO: 1648 - DNA, 1110 bp, Chromobacterium substugae
atgtctgatctggcttccgcgcagctgctccaagcatctgcagcccagctgcccattcatacctatttcgatcccgggttctacgccagggagcaggagcttctgttcgccgacgctccccagtactacggccacgaattgatggcgcccaatgccggcgactatcacacgctggaatggctggggcacggcaagatgctcaagaacgtcgacggcgagatcaagctgatctccaacgtctgccgccatcgacaggcgatcatctataaaggccgcggcaacggcaaccatatcgtctgcaatctgcacggctggacctacgatgccgctggcacgctggtgggcgcgccgcattttccggaaacgccgtgcctgaacctgggccagaccgagctgacgcgctggaacggcctgctgttcgacgcgcgccgcaacgtggcggcggacctggccaagctgggcgtggccaagcacatggcttttgacggctacgccttccattcgacgcagtccgccgagtacgacttcaactggaaaaccttcattgaggtgtattccgaggactaccacgtcgatcccttccatcccggcctcggcaatttcgtcgactgcggcgatctgaagtgggaatggggcgacagctaccacgtgcagaccgtgggcgtgaaaaaccgcctggcgcgcgccggctccaaggtgtacggcaaatggcacgaggaagtgcgccgccgctacgccgagcagcagccggagttcggtgccatctggctgacctactaccccaatatcatggtggagtggtatccgcacgtgctggtggtgagcgtggtgattccgcgcggcccggagaagtgcacggtgatcaccgagttctactacccggaagacgtggtgtggttcgagccggaattcatcgaggccgagcaggccgcctacttcgaaaccgccaaggaagacgacgaaatctgcatccgcatgcacgagggccgcaaggcgctgtggatggccggcgtcagcgaggtggggccgtaccagtcgccgaccgaggagggcatgcagcacttccacgaatactatcgccgccagatggggttggcattggctggttaa

SEQ ID NO: 1649 - DNA, 510 bp, Chromobacterium substugae
atggttgttttcggcgcgctgctgctgggcagcacgatggcccaggctgccagctatgccgatccggtcagcaaagtccgcttcacgctgccgccgggctggaaggtgcgccccagcatcaccgacggcgtgcgcgtgctgcgggtggtgccgccgaaggccgatcagcgcgagcgcgccgccatcgaggtgcagatcggcgtgcgcaagccgcggcgcggcgacacgctgccgcggctggcggcggcgttccgcaatgaggacggcgaccgcgaggccgccaacttcgtccgcgtcaatccaaaagccggccggctggtgaccgaataccgcgacggccgcttcgtctccaaccggctgtggattgtgcgccataatctgcatgtgattcagctggtggaccgcaatcggctgctggaggcgcgctgcaccgccaacgcgtcggaattcaagacctatcgccggcagatggaggccatctgtctgagcgtggcgctggccaggaagtga

SEQ ID NO: 1650 - DNA, 813 bp, Chromobacterium substugae
atggtggtggcggcggcgttgttcgccttgatggggttgttcgtcaagctgggcgcgcagcaattctcgtccaccgaactggtgttctggcgcacgctgatcggcgtggtcgcgctgggcggcgcggcgctgtggcggcgcgagcgtttcgccacgcctttgctgcgctaccatctgcagcgcggggtgataggctacagttcgctgctgatgtcgttctacgccatcgcccatctgccgctggcgacggcgtccacgctgacctacacctcgccgatgtttctggcgctgctgtcagtggtcttgctgcgggagcgcttgccggcgcaggcgatggccgggctggcgctgggcttcgccggcgtggcgctgctgctgcggcccacgctgtccggcgacgcctggtttgccggcttgatgggcctggcgtcgggctttctggccggctggtcctacctgcatgtgcgcgaactggggcggcagggcgaggccgagtggcgggtggtgttctatttcgcgctgatctccacggtcggcggcgtgctgctgatgtgcctggagcgctggcacccggtgacgctggacaatgtcggcctgttgctgggccttggcgtcagcgctacgctggcgcaattggcgatgacccgcgcctacaaggtggggcgcaagctggccgcggccaacctgtcttatctgaccgtggtgttttccagcctgatcggcgcgctggtgtggggcgacgcgctgtcgccggcgtcgctgctggcgatgggcttgatcgtggtcagcggcatgttggctagtcggcgctag

SEQ ID NO: 1651 - DNA, 357 bp, Chromobacterium substugae
atgatctcgattcgcgagcaggattatggcctggacgtggccttgttcaatgaattcacgctggccgatttccagctgctggagcaggcgctgctcaagcggctggaagagcgcgacaagccggacatgctgctggacctgtcggagttgaaggacttcacgctggacatggcgctggaagaggtgaagttcatgcgcgcccacgaggagaagctgggccgcgtcgccatcgtggtgggcgacgtgtggatccggctggccacccatatcgccggcctgctgtcgcatacccatgtccagtatttcgatctgaccgaagaggctcaggcctggctggcgcggccggtcgccgcttga

SEQ ID NO: 1652 - DNA, 1475 bp, Chromobacterium substugae
gaactgaagagtttgatcctggctcagattgaacgctggcggcatgctttacacatgcaagtcgaacggtaacagggtgcttgtgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgtcatcaccggaaccgtttcgtttccgccgtttcgttcgctgcgtcagctgaggaggcgaactatacgcccgggacccgcacccgtcaacaccttgcttgcgaaaaatcagaaaaattcatcgcaaaccgccccgcgcgccgccaagcccatgatctggctgaagatatgaacacagggtatttgcaaaagccatcgacaaaacggatggcgcgccgccagccccgcccccaaaccccgaaaacaaacaggccggcgcacccgccggcctgttccaatagctctatatagtcaaactcagctcttgcgcagtttggcgaaggccgccgccatcgcggtatcgccctgcggcgcggcagactggccacgctgctggcgcggacggctgtcggcgcgggcgtcgcttcggccgctgcggctattacccgcgccgacctcgtcgtccagccgcatcgtcagtgcgatgcgcttgcgcaccacatccacttccagcaccttgaccttgaccacatcgccagccttgaccaccttgcgcggatcgtcgatgaatttattggacagcgccgagatatgcaccagcccatcctggtgcacgccgatatcgacgaaggcgccgaagttggcgacgttggtgaccacgccctccagcaccatgcccggctgcaaatgcttgatgtcctcgatgccgtcctggaaggcggcggtcttgaactccggacgcggatcgcggcccggtttgtccagttctttaagaatatccatcacggtcggcaggccgaaacgctcgtcggtgtagtcggtcgcgcgcaccgacttcaggaaggcggagtcgccgatcagcgatttcacctcgcggccggccttggccacgatcttctccaccaccggatacgcttccgggtgcaccgacgacgcgtccagcgggttgtcgccgccggcgatgcgcaggaagccggccgcctgctcgaaggttttgtcgcccagacgcggcactttcagcaactccttgcgagtgcggaaagcgccgttctggtcgcggtaggacacaatattggacgccagcgtcgcattcaggccggagatgcgcgtcagcaacggcgccgaagcggtattgacgtcgacgcccaccgcgttgacgcaatcctccaccacgccgtccagcgcgcgcgccag

SEQ ID NO: 1653 - DNA, 1475 bp, Chromobacterium substugae
  modified_base (332)..(332): a, c, t, g, unknown or other
gaactgaagagtttgatcctggctcagattgaacgctggcggcatgctttacacatgcaagtcgaacggtaacacaagcaccctgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgtcatcaccggaaccgtttcgtttccgcntcttgggccgagctcacctatccaaagctgggccagcgcgccttcgagccgtgctgtacatggcagcagtggtcgccatacgatacaacccacatgttaaggcgctgtatcaacgattattagcgcggggcaagacgaaaatgtccgccctgggagcagctatgcgcaagctggtccatctgtgctttggcgtgctgaaaacacgccagccttaccgggccgactacgcacgagccgcttgacgtgaaagacggtatctacggtcctgaataatttgcttgaaaccgtagattaggatgaatgaaatgaagcccaatctatggcctgccgctttaggaaacccgagtcaccagtgcaaaacagaggcactcgagagtgagggcctgcccgatgaaaaccgtgacctgccctcccccccgaaccattaacttaacttattaaatgcaaaccattcagtttggcgagttttattgtcctatcaaacaaatcaccatccatcgaaaaaacattatgtgtttgatcatatccaaatcttacaactagccttccatccgaaaattcaagctcacttaacttcctttcacgtaatccaagaattattaatcgccttaactcattctttccaatttttctccctgcaaaaaaaaccacttcattggaaataccaatcaaatcaccaaaccagccacaaaatttcttctcaccaacataatagtcatctaagcaattattatcattcgcatgatcaaaacacataaatggcaacgcatcacactcctcctcattaagcacatggtcatacacggaaatatcagctcgaaatggatattcatcaatcttcacaatactcctcactttctcaaaaccttcccagattcatccaaagttgctactcgccgtcctttcgcatcaaatagcttccaagcactaccaccgtgcggatttccactgcgttcgggagaaatactccatccagttttgggatcaacatagtttgcacctcctcccgactgcttttgacgctggccaaaatccgacaaatcaacaatatctcccttactcaaatctttcccataagagcgcgagtagctacttggatcaattgggtctacgattcccataccttcaagaataaactgacca

SEQ ID NO: 1654 - DNA, 1695 bp, Chromobacterium substugae
atgaaactccgttctctggccgccgcgcatggcggctttttgctgtccaccatctgccaggccgccgcgccgcctgccttgatccagcaaaccgatcagctgctgcgcctgcagcagcaacaacttgagcagcaacgccagtcgctgcagcaacgtccggatgtctttctgccttcgtccgcgggcgcaaagccagcgcccgccattccgggcgccgcgccggcggcggcttgctttgccatcggccagacgcaactggacggcgcgccggccagctggcagcgttggctgcagccgctgctggatgccgggctgggtaagtgcatgggcctggacgcgctgaatcgcctggtggcggcgctgaccaacgagatggtggcgcgcggcttcgtcaccagccgggtttatctgccggagcagaatctgcgcggcggcacgctgcggctggcggtggtggcgggcaggatacacgccatccgcttgaaggaaggcggcagcgatctggccctgcgttcggcgttttcatccggccccggcgacattctcaatgtgcgcgacctggagcaagggctggagcaactgggccggttgccgggccagcaggcaaccatggagatggtgccggcggaggcgccgggcgagagcgatgtggtggtggcgcggcaaggcggccggccgctgtccggcgcgctgacgctggacgactccggccagcgcgccaccggccggctgcaaagcgccgccagcctcaatatcggcggcgccgctggcctgaacgatgtgctggcgctgtcgtggactcaggatgccgagcatctgcgccatcccttgagccagtcgaccgccgcctcctggctgctgccgctgggcgattggaccgccatggccagttacagcggcttcgcctaccgccagacggtgcagggcgtgaaccaggatttcatttccagcggccacagccgcaatacccagttgtcgctgtcgcggctgttgcggcgcgaccagagcggcaagaccgaactcaagctgagcctgacgcgcaaggcgtcgcgcagcttcatcgaggacgccgaagtggcgcagcagcgccgcgacctgaccatcgccgggctggagctcagccaccgccagtattggggcgaggcggtgctggacggttccatcggctatcagcgcggcatcggcgcctggggcgcgcagtctgacgcccaggcggcgcaaggcggccccaatccgcgccatcagctttaccaggggcggctggcgctgcaactgccgctacatgcctgcggccagaccttgcgctggagcagcgaactgcgcggccagtacagtccggacctgctgatgtccagcgagcaattcgccatcggcggccgcggcaccgtgcgcggcttcaatgccagttcgctggtggggcagagcggctactacctgcgcaatgaactgagctggccgctgccgccggccggcgcgctggcgttggaaccctacctgggcctggacgccggccagatctcgcgcccggtcggggagaccggccccgagcgcagcctgtccggctgggccgccggcttgcgcctgagcctgggcggccatctgtccgccgaactgacccacgagcgcgcgctgcaccagccgcaaggctgggaccgcccggccatcacccacttttcgatcaccgcgcagtggtaa

SEQ ID NO: 1655 - DNA, 1113 bp, Chromobacterium substugae
atgaagaaagctatcctcgccgccgccatcgccgcggccgttcctgcgctcgcgcaagccgatgtcaccctgtacggctcgctgcgcgccggtgtgtccagcaccaagaacagcaccaacaactacaccagcaccttcggcgtggacgacttcggcagccgcatcggcttcaaaggcaaggaagatctgggcaacggcctgaaaaccatctggcaggttgagaccggcctgtcgctggacggcacttccggcttttccagcaccgactccggcaagctggccaaccgcgaatcctatgtcggcgtggaaggcggcttcggcaaggtgcgcctgggctacctgaccgacgtactcggcgacacagaatccaccgacaacctgtacggccccttccgcgacaatatgggtaccggcttcccgctgtacgaagccaccgacgtgttcggcgcctacggcgactcccgcttcaagaacggcatccgctacgactccccggaactatacggcttcagcggcaccgcccagtacggcgccggcgaaagccaggccgccggccagatgaaacagggcgacaaggtcggcctgcgcctcgcttaccagaacagtggcttcttcggcgcctgggcctacgccggcgcgctgaataccaagggcggcagcaatagcgccaccaaccgtctggaaggcggctacaacgccaacaatctgtacctggctgccaactaccagtgggtcaccctgtatggcaatgcccacgcccagaagagcgataactccggcccagtcctcgccggcatcggcaacttcccgaccatcgccactggcaccaacaagctggaaaacaccacttgggccatcaacgccgcctacgctttcggcaacttcaagccgtcggtggtctactccaagcgcggcgacgccaaggtggacggcgtgcgctacagcctgggcgccactcagtgggccgccgcgctggactacaccgtcagcaagcgcaccctgctgcaggccggctacggccaagtgaaggagaaccgcgacgcgcaaaccatcaatggccacgcgcagtccacctcctccacggtatgggcgatgatgaagcacaacttctaa

SEQ ID NO: 1656 - DNA, 1125 bp, Chromobacterium substugae
atgtcgaaaaaagatttctacgatgtgctgggcgtgaatcgcgatgcgtccgacgacgacatcaagaaggcctaccgcaaactggcgatgaagtaccacccggaccgcaatccggacagcaaggaagccgaagacaagttcaaggaggtgaaggaagcctacgagatcctgtccgatagccagaaacgcagcgcctacgaccagttcggccatgccggggtggatccgcaggccggcgccggcggcggccagggcttcggcggcttcggcgatttcgccgacatcttcagcgacatcttcggcggcggccagcgcggcggcggcggcggacgttccaacgtctaccgcggcgccgatctgcgctacaacatggaaatcacgctggaagaggcggcgcgcggctgcgagaagcagatccgcattccgtcgcacgagtcctgctccacctgcaacggcagcggcgccaagccgggcacccagcccaagacctgctccacctgcggcggccacggccaggtgcggatgagccagggcttcttctcgatccagcagacctgcccgacctgccacggcagcggcaagcagatctccgatccatgcaccagctgccacggcgccggccagaagaagaccaccaagacgctgaacgtgaagattccggccggcgtggacgagggcgaccgcatccgcctgggcggcgagggcgagcccggccagaacggcggcccggcgggcgacctgtacgtggtcacccacatcaagcagcacgcggtgttccagcgcgatggcatggacctgcactgcgagatgccgatctccttctccaccgcggccttgggcggcgaagtggaaatcccgacgctggacggcatggccaaggtgaagatcgccgcggaaacgcagagcggccgcgtctaccgcctgcgcggcaagggcgtgaaggccgtgcgcggcagcgaattcggcgacctgcattgccatgtgatcgtggaaacgccggtgaagctgaccgagcgccagaaggagctgctgcgcgagttcgaagccatcagccagggcgatgtggccacccacaatccgcgctccaaatcgttcatggacaagctgcgcgacttcttcgagtaa

SEQ ID NO: 1657 - DNA, 1923 bp, Chromobacterium substugae
atgggtaaaatcatcggtatcgacctgggcaccaccaactcctgcgtggcagtggtagaaggcggcaacccgaaagtcatcgaaaacgccgaaggcaaccgcaccaccccgtccatcatcgcctacgtagaagacggcgaaatcctggtgggcgcgccggccaagcgccaggcggtgaccaacccgaagaacaccatctacgccgccaagcgcctgatcggccgccgcttcgaagacaaggaagtgcagaaggacatcgacctgatgcctttcgaaatcctgaaggcgaagaacggcgacgcctgggtgaaggtgcgcgaccaggatctggctccgccgcaaatctccgcggaagtgctgcgcaagatgaagaaggccgccgaagactacctgggcgaagaagtgaccgaagccgtgatcaccgtgccggcctacttcaacgacagccagcgccaggccaccaaggacgcgggccgcatcgccggcctggaagtgaagcgcatcatcaacgagccgaccgcggccgcgctggccttcggcctggccaagcaggaaggcgatcgcaagatcgcggtatacgacctgggcggcggcaccttcgacgtgtccatcattgaaatcgccgacgtggacggcgagcaccagttcgaagtgctgtcgaccaacggcgacaccttcctgggcggcgaagacttcgaccaacgcctgatcgactacatcgtcaccgagttcaagaaagaacaaggcgtcgacctgaagcaggacgtgatggcgctgcaacgcctgaaggaagcggctgagaaggccaagatcgagctgtccagcgccacccagaccgaggtgaacctgccgtacatcaccatggacgccaccggtccgaagcacctggcgatgaagatcacccgcgccaagttcgaaagcctggtcgacgacctgatcacccgctccatcgaaccgtgccgcgtggccctgaaggacgccggcgtgtcgctgtccgacatcaccgacgtgatcctggtcggcggccagacccgcatgccgaaagtgcaggacgcggttaaggaattcttcggcaaggaaccgcgcaaggacgtgaacccggacgaagccgtggccgtcggcgccgcgatccagggctcggtattgtccggcgatcgcaaggacgtgctgctgctggacgtgaccccgctgtcgctgggcatcgaaaccctgggcggcgtgatgaccaagctgatccagaagaacaccacgatcccgaccaaggcgtcgcaaaccttctccaccgccgacgacaaccagaccgcggtgaccatccacgtgctgcagggcgagcgcgagaaggccgcggccaacaagtcgctgggccagttcaatctgggcgacatcccgccggcgccgcgcggcattccgcagatcgaagtggaattcaacatcgacgccaacggcatcctgcacgtgtccgccaaggacaaggcttccggcaagcaagccaacatcaccatccaggcgtcgagcggtctgtccgaagccgagatcgagcgcatggtgaaggatgccgaagccaacgccgaggaagacaagaagctgcacgagctggtgaccgcgcgcaaccacgccgaaggcctgatccacagcatcaagaaatcgctgtccgagcatggcgagaagatcggcgtcgacgaaaaggccaagatcgaagacgccgtcaaggcggctgaggaagtggtcaagggcgacgacaaggaagccatcgaagccaaggccgaagaattggccaaggccagccagaagctgggcgagatcatgtacgcccaggccgctcaggctgaaggcggcgccgaaggcgcgcaagccgccggcgacaagaaagacgacggcaacgtggtggacgccgagttcgaagaagtgaaagacaagaagtaa

SEQ ID NO: 1658 - DNA, 546 bp, Chromobacterium substugae
atgcaagaaaatcagaacccggcggccgaagccgtggaaaacgaagcgaccgaaaccgccagcgacgcgcataccgagctggagcagaccccggagcagcacatcgccgggctggaagccgagatcgccgaactgaacgacaccctgctgcgcgcccgcgccgaactggacaaccagcgccgccgcgcgcaggaagaagtggccgccgcgcataaatatgcgatcggcaaattcgccgccgagctggtgacggtcaaggattacctggaaatggcgctgctcgaccagagcggccagatcgacaccttgaagatgggcgtggacctgacgctgaaacagctggtgtccgccttcgacaaggcgcagatcaaggacatcgcgcccaaggccggcgacaagctggacccgcaccagcaccaggcgatgagcgcggaagagtccgacgccgaaccgaacaccgtggtgcgcgtgatgcagaagggctacctgctggccgaccgcgtgctgcgaccggccatggtggtggtttcgaaagccaaggcataa

SEQ ID NO: 1659 - DNA, 135 bp, Chromobacterium substugae
ttgttcgcgagtcgtcatgttagaacccttctcgatgcgtttctctgctcgccaggcgggcccggcgtcctcaatagcgtgtcggcgtatccggtgttccggatttttttgtcaaaccgggccgtgtgggcctga

SEQ ID NO: 1660 - DNA, 1299 bp, Chromobacterium substugae
atgacgactcgcgaacaacgcattgcagccatccagaaagactgggacgaaaatccgcgctggaagggcatcaaacgcggctacaccgccgccgacgtcgaacgcctgcgcggctccctgcaggttgagcacagcctggcccgccacggcgcggaaaagctgtggaagctggtgaacaccgagccctacatcaactgtctgggcgccctcaccggcggccaggcgatgcagcaggtgaaggccggcgtcaaggccatctacctgtcgggctggcaggtggcggcggacaacaacgaatactcggcgatgtatccggaccaatcgctgtacccggtggactcggtgcccaaggtagtggagcgcatcaacaacaccttcacccgcgccgatgaaatccagcatgccaagggcctggacaagggcgacaagggctatgtcgactacttcgcgcccatcgtcgccgacgccgaagccggcttcggcggcgtgctgaacgcctatgagctgatgaagtcgatgatccgcgccggcgccgccggcgtgcacttcgaagaccagctggcctcggtgaagaaatgcggccacatgggcggcaaggtgctggtgccgactcaggaggcggtccaaaagctgatcgccgcccgcctggccgccgacgtctacggcgtgccgacgctggtgatcgcccgcaccgacgccgaagcggccgacctgctgaccagcgacgtcgaccccaacgacgagcccttcctcaccggcgagcgcaccgccgaaggcttctacaagaccaagaaaggcctggagcaagccatcagccgcgcggtagcctatgccgactacgccgacctggtatggtgcgaaaccggcacgccggacctggagttcgcgcgcaagttcgccgaagccgtgcacgccaagcacccgggcaagatgttggcctacaactgctcgccgtcgttcaactggaaaaagaacctggacgacgccaccatcgccaaattccagcgcgagctgggcgcgatgggctacaagtaccagttcatcacgctggccggcatccacagcatgtggttcaacatgtacgacctggcgcaggactacgtggcgcgcggcatgtccgcttacgtcgaaaaggtgcaagagcccgaattcgcggcccgcgaccgcggctacagcttcgtgtcccaccaacaggaagtgggcaccggctatttcgacgacgtcaccaccgtgatccagggcggcacctccagcgtcaccgcgctgaccggctccaccgaggaagaacaattccactaa

SEQ ID NO: 1661 - DNA, 384 bp, Chromobacterium substugae
atgaaaaaaatactggctggcagcctaatcatcgccagcagcctgtgcttcaccggctgcacgtccatgcgcgtcatcgccgacaatcagcaagccctgtccagcctggcctcgccgcaacaaagccagctgaaaccgggcgacaagatcagcctcaagaccaccgacggcaaagagtacacgctggtgctgagcgccatcgaccagcaaggcctggaaggcaagctcactgatagcgagcaactcacccggctcgcctggcaaaatatcagcgcggtacaaaaaaacgagattgacggtgtcaagaccgctggccttatcttgctgctgtccggcgccaccttcgcgatcggcaaggctttcctgagcatgttccccggctag

SEQ ID NO: 1662 - DNA, 480 bp, Chromobacterium substugae
atgatcccgactacccctgatctttgcgattcctttgcagacgccgtccgcgtcctggagcccattttccagtcatacggcggccatgcccgcttccatggccagatcgtcacgctgaagctgttcgaggacaacagcctggtgcggcaaacgctgggagaaaacggccagggcaaggtgctggtggtggatggcggcggctcgcgccgctgcgcgctgctgggggatcaattgggcgagctggcggtgcgaaacggctgggccgggctggtgatagacggctgcgtgcgcgacagcgcggcgcttgggcaactgccgctgggggtcaaggcgctggccgcgcatccgcgcaaatcggtgaagctgggcggcggccagagggatttgccggtgcgcatcgccggctgtgaactcgcgccgggccaatggctgtacgccgacgaggacggcgtgatcgtggcggagcgccaactggcctag

SEQ ID NO: 1663 - DNA, 408 bp, Chromobacterium substugae
atgaccattggcctgaccggcggttgcctgtgcggagcggtgcgctaccggctgcgcggcacgcctttccacatcacccactgccattgccgcagctgccggcgcgccagcggggcggctttcgtcacctggttcaccatgcgggtgcatgaattggaatggcgcggcgaaaagccggtgcagtatcactcctccgccgcggtgtcgcgcggcttctgcccgcactgcggctccacgctgacctacttccacgaatccgatcccgaggaaatcgacatcaccgccgcttcgctggacaaccccgaagtgctggtgccggagcaccacacctggtgggagcagaggctggagtggggcaccgccaacgcccagggcgcgctgccggtgcatcagcgcggcggcggctag

SEQ ID NO: 1664 - DNA, 792 bp, Chromobacterium substugae
atgcgcgctctttggctttttcccgcctggctatgcctgtccgcgccatgccaggcgcaagcgctcgaccgctcgccgctgcgcatttgcgacgatgccgacgaatggccgccctacacctactatgtccgcaaaaaccagcagcagacccgcgaactgaccggctattcggtggatgtcatcacccgcatcctggacaagcagcgcatcccgttccggatagacctgttgccatggaagcgctgtttgtccgcgatcgacaacgacgagcaatacctgatggccttgagcgccagcaagaatccggaacgggagaagcagttcctgttctcccttccctattaccagacgcactactatgtgttttattcgagagccaagtatccggacggggtaaacgtcgccggccaggccgaccttggccgctaccggctgggcggcgtcaagggctacgcctattccgcgctgaccgcggtcgacaaaaacgccatgctgcgcgccgccgactatccgacgctcgccaggatgctgcaggccgaccgtttcgacctgttcgccgaagactatgaagtgctggccggcctggaccggctgagcgtcacccacatcgtcgacaacccggccatcggccggatgccgctgcccggcatgccgggcaacgccttccacatgatcttcagccgcaagaatcccaggggcgcccagctgcaacagctggtcgaccgggaattgcggcagatgcaggcttccggcgagctggagcagttgctgcggcgctacgtgccgcgctga

SEQ ID NO: 1665 - DNA, 708 bp, Chromobacterium substugae
atgtcatggatcgccgccatcgcggcggtgtccattctcgccggctgcgccgccaagcccagccaggcccagctggacgacgcccgccagcacgcgcagttcgccaacgacgcggcggcctggcggcaactggaggattgggccaggaacgacgacgccgacgcccagcgcgcgttggccgaggcgctggccagcgacggcggcatggcgggctggcgcaaggcgcggccctggtaccaggcggcggccgagcgcggcgacgcgctgtcggcgttccgcctggcgcggatctacgccaagggcttgggcgtggccgccgacgccggccagtccgaccgctggctggcgctggcggcgcgacgccggcaagccgacgccgcctgcatgctgggcctgcgcgccaaggatggcggcgacgcggcggcggccaggcgctggttcgaactggcggcggagcggggcagcgccgaagcgatgttccagctgggcatcgcctatcaggaagggctgggcgtggcggtggacttgccgcgcgcgcgcggctggtacgaacaagcggccaggctggagatgcccgccgctttgcagacgctggcgatggcttacgagggcggcgatctgggtttgaagaaggacccggccaaggcatccgagctgttcaacctggcggcccacgccatccacgatttcgaatcggctttgttttga

SEQ ID NO: 1666 - DNA, 2064 bp, Chromobacterium substugae
atgccgacgcttaagccaatagaatgccggctgggcgattcagacccggtaagacaagaaaggcatgtgatgagcaagcataatatcgcggcggcaggatgggcagtcctgctgctggcgggctgttccagcggcagcgcgccgtcgggcaggccggcagaggggaccacggtcagcgtggcgctgctggaaaccaccgatatccaccaaaacgtcctcagctacgactattacaaactggcggccaatccgtcgtttggtttggagcgggcagccacgctgattcagcaggcgcgcagccagtatccgaacaatctgctgctggatgacggcgatttgatccagggcaccgcgctgggcgattaccaggcggcggtgaatccggtgaaatgcgcggatacgctcgccgtgcacaaggtgatgaattacctgaaatacgatgccggcaccataggcaatcacgaattcaatttcggcctgcctttcctgtcgcaggtcaccaataccgatttccgcctggccaatatcgcgcggccatccgcctgcggcgcgccggcttatccgcaggtattggccaatgtggccaatctggcggataaaaagcccattttccagccttatgccctgctcaagcgcactttcgccggcaccgcgccggacggcagcagcgtgcaggtgccggtgaatatcggcgtgatcggcttcacgccgcccaccatcatggattgggacaagaaaaacctgaacggccaggtctacaccaacggcgtggtggaaaccgccaacacctatgtgccgcagatgcgccaggccggcgccgacctggtggtggcgctgtcgcacggcgggctggatccgtccagctacagcccggcgatggaaaacggcagctggcacctgaccaagaccggcatagacgcgctgatgataggccactcgcacgatatcttccccaacccgggcgcggccggctcgcagttcaacgctatgcagggcgtggacaacaacaagggcttcgtcaacggcgtgccgacggtgatggccggcaattggggcaaccgcctgggcgtgatccggctgacgctgaaatacagcggcggcaagtgggtggtgcaaaccggccagtcggcggtggagacgcgttcgatcaagaacgccgacggcagctatgtggcggccgacccgcgcgttgcgcaactggtggcgggcgagcatcaggccacgatcaattacgtgaagacgccgataggcagcaccgattttcgcatgaacacctacttcgccttgctgggagatgtcagcgcgatccagatcgtcaatatggcgcagcaggactacgtgaagaaatacgtgcaggccaacctgccgcagtacgcgtcgctgccggtgctgtcggtatcggcgccgttcaaggccggccgaaatggcgccagcgactacaccgacgtggcgcaggggccgatcgccatcaacaacgccgccgacctctacctctatcccaacacggtgcaggcggtgaaggtgagcggcgcggatgtcaagaactggctggagcgcgccgcgcagatgttcaacagcgtggacccgacgtcgtcggcgccgcaggagctgatcaactccgccttccaggtgttcaatttcgacgtgatgtacggagtgcagtaccagatcgacgtcagccagccggtgggcagccgcatcgtcaacctgacgtatgacggccagcccatcgatccgtcccagcagttcatcgtggccaccaacaattaccgcgccagcggcggcggcaacttccccggcatagatggcaccaaaaccatcatccaggcccccgacgccaaccgcgacgtgttgatcgcctacatcaaggccaatggcgacctgggccgggcccagtacggcagcagtcggccgtggagcttcgtcaagatcaacgccaaggtcaatttcaagagcatcgccaaccagttggcggcggccagcctcgccggcatcaatggcgtgagccagggggcggacaacggcgatggcacctggacctacctggtcgatctgagcaagtga

SEQ ID NO: 1667 - DNA, 117 bp, Chromobacterium substugae
atgcatccgaattttctgttcttggccgatttttcttgttttgctttgcctattgttcggcaatccggcgcttggatcattctggcgatgtttttcaaccgtttttcttcgcattga

SEQ ID NO: 1668 - DNA, 381 bp, Chromobacterium substugae
atgcaacgcaatatgctcaagtccaagctccaccgcgtgaccaccacgcacgccgagctgcattacattggatcctgcgccatcgacgagaacctgctggaagcggcggacattctcgaatacgaagaagtgcagatctggaacgtcaccaacggcgagcgcttcgccacttacgcgatcaaggccgagcgcggctccggcgtgatttcggtcaacggctcggccgcgcgccgcgccgcgccgggcgatttgctgatcatcgcctcgttcgcccaatacgaagacgcggagctgaagaaccactcgcccaagctggtgtttgtcgacggcgacaaccgcctgaccgaagtcaagggcgccacgccgacccagccggcctga

SEQ ID NO: 1669 - DNA, 894 bp, Chromobacterium substugae
atggaaatcatccgtaccgtggcggacatgcgcgcctggcggaaacaggccggcaagctggccttcgtgcccaccatgggcaatctgcacgaaggccacctggcgctggtgcaagccgcccgcggccaggcggacaaagtggtggtcagcatcttcgtcaaccggttgcagttcggccagggcgaagacttcgacgcctacccgcgcaccttcgaggcggactgcgacaagctgcgcgcagccggcgtcgacgcgctgttcttcccgaccgaaggcgagctgtatccgcgcgtcaagcaggacttcaacgtggagccgccgcgcatccaggacgagctgtgcggcgccttccgccccggccacttccgcggcgtggccacggtggtgaccaagctgttcaacatcgtgcagccggacctggcctgcttcggcaagaaggacttccagcagctgcatgtgatcaaggcgatggtcgaagacctcaactcgccgattgaaatcctgccggtggacaccggccgcgccgccgacggcctggcgctgtcctcgcgcaatggctacctgagcgcggaggagcgcgccgaggcgccgcgcctgtaccgcaacctgaccgcgatccgcgacggcctgctggccggcagccaggattacgcggcgctggaacagtccgcgcgcgacgacctgtccgccgccggctgggtggtggactacgtggaagtgcgccaggcggacacgctggaaatcgctcacgccggcgaaaagcgcctggtggtgctggctgccgcgcgcctcggccgcacccgcctgatcgacaatatcgaagtgttccgcgccggaacgacaaggaagctgtcatgcaacgcaatatgctcaagtccaagctccaccgcgtga

SEQ ID NO: 1670 - DNA, 789 bp, Chromobacterium substugae
atgaaaataaccgtcaataccctgcacaagttggccgcggaaggccagaagatcaccatgctgacctgttacgacgccagtttcgccagtctgctggacgaggcgggggtcgagattctgctggtcggcgactcgctgggcccggtgatgcagggggtggattccacgctgccggtcagcgaggcggacatgctctaccacatccgctgcgtggcgcgcggcagcaagaacgcgctgatcctgggcgacatgactttcggcgcctaccaggaaagcccgcagcaagccttcgcccacgccgcccgcctgctgcaggccggcgcgcacatggtgaagctggaaggcggcgcctacatggccgagaccacccgcttcctggtggagcgcggcattccggtgtgctcgcacatcggcctgaccccgcagttcgtcaacgctttcggcggctaccgcgtgcaaggccgcggcgatgacgcgcagcgcatcgtcaacgacgccaaggcgctgtccgacgccggcgccagcctgattgtgatggaatgcgtgccggcggcgctggccaaggaaatcaccgcagccatttccgcgccgaccataggcataggcgccggcgtcgatacttccggccaggtgttggtgctgcatgacatgctgggcgtgtacccgggcaagaaggcgaagttcgtcaagaacttcatggaagaggccgacagcatccagggcgctgtcgaagcctatgtcaaggcggtgaaggaacagaccttcccgaccgcggaacacacctactaa

SEQ ID NO: 1671 - DNA, 636 bp, Chromobacterium substugae
atgagccaattgcgctacgtggtggtggaggggccgataggctcggggaaatcctcgctggcggcccggctggcgcagtactggggcgtgcagctgaaggcggaagacccggcggccaatcccttcctgccgcgcttctatcgcaatatgccggcccatgccttgtccacccagctgagcttcctgatgcagcgcgccgacatggcgcgcgagatgctgcagggcgatctgatggcggcgccgctggtgtcggacttcctgttcgaaaaggacgcgctgttcgcgcggctgaacctggacgagcacgagctggcgctgtaccagcgcctggcgcgccaggccttgccggaatacccggtgccggacctggtgatttatctgcaggcgtccgaagacactttgctgcaaagggtggccgcgcgggcggtggagtacgaggtaaacttccccgaaggctatctgaagcgcgtgcaagccggttatagcgagtttttccaccagtacgagtcgtcgccgctgttgatcgtcaacaccgatcatctgaacctggtggacggcgacgaagatttcgatctactgatccgctgcattgccgaaatgcgcggccagcgcagttatttcaacaagagcgtctga

SEQ ID NO: 1672 - DNA, 510 bp, Chromobacterium substugae
gtgacgctggcctacgtggctctgggcagcaacctggagcagccggcgcaacaggtcggggccgcgctcgcggcccttggccatttggccggcgccacgctactgcgccattcctcgctgtaccgcaccgcgccggtcggttacgccgaccagcccgatttcatcaacgcggtggccctgctcgacaccgatttgccgccgctggcgctgctggataggcttttcgagatcgaacagcgcttcggccgcgagcgcagcttccgcaacgcgcctcgggtcttggatcttgaccttctgcattacgatggcgtcataatgagcgagccgcggctgaccctgccgcacccgcgcatgcgcgaacgcgccttcgtgatggtgcctctggccgaaatcgccccggccggcatgctgccgggcgtcggcgacgtggccgcgctggcggccgcgctggacgcgtccggcgtggagcggctggacgaaagccgtggaacccgacaacaacaggaataa

SEQ ID NO: 1673 - DNA, 1368 bp, Chromobacterium substugae
atgatccgcaagctaatccgaaaagtactggacctgccggccggcatgagcaaacgccgcaacaagccccgcgtcttcccgttgccgcaacacggcgtgcgccgcgaccagctgagccaggcggcgctgcgcgtcacctcccggctgcaggaagccggctatgccgcctacgtggtgggcggcgcggtgcgcgacctgatgctgggcgtgtcgcccaaggatttcgacgtggccaccaacgccacgccggagcaggtgcaccatctgttccgccgctcccgcatcatcggccgccgcttccgcatcgtccacgtgatgatgggtccggaaaccatagaggtgaccaccttccgcggcggcaatgtggacgacaccaatgaaaccggccgcatcatggccgacaacagtttcggcagccaggaagaggacgcgcaccgccgcgacttcaccgtcaacgcgttgttctacgacccgtccgacgaaaccgtcatcgactaccacaacggcgtcaaggacctgcacgccaagaaactggtgatgataggccagccggcgcgccgctatcaggaagacccggtgcgcatgctgcgcgcggtgcgcctggccgccaagctgggcttcgagatcgacgaggacaccaagaagccgatccgcgcccacgcccatctgctgaagaaagagccggcggcgcgcctgttcgacgaaatgctgaagctgctgatgtccggccaggcctacgcctgcctgaagaagctgcgcgacgagggcctggcccgcggcgtgttcccgctgctggacgcggtgatggacgacaagggcaacgacgacgccttcctgcgcctcagcctggaaagcaccgacgcccgcctgcgcgccgacaagccgatttcggtcggtttcttgctggccaccctgctgtggcgccaggtgaaccagggctggcagcagcgcctcgccgctggcgagaagagcctgccggcgctgttgtccgccatttccgacgtggagtccgaacaggacaacgatttcgccatcccgcgccgtttcagcgtgaccatgcgcgaaatctggacgctgcaggcgcgcttcgacagccgcagcggcggccggccgtaccgcttcctggagcagccgcgcttccgcgccgcctacgatttcctggcgctgcgcagcgaagccggcgaagtgccggcgcaactggtgagctggtgggagcgcttccagcgcgccgacgccgacgagtgcgagcgcctgatcgccgaggccaaggagcagggcggcgacgccgagccggccaagaaacgccgccgccgccgcagcaacagccgccgccgcgacgagtccggaggcggggagagcgccgagtga

SEQ ID NO: 1674 - DNA, 1026 bp, Chromobacterium substugae
atggcggctccaagtgatggtttgcatggtattcctgttttatttccattaaatccagctagaattcgaatcagtttcaaaaaaatattgataaaaatggtcaggaccgatgatttgcaggttttcatccgcgccgcggacaacggcagcctgtcggcggcggcgcggcagctggatctgagtccggcggtggccagcgcggcgctgaagcggctggagcaggcggtgggcgcgcaattgctggcgcgctccacccgcagcctgaggctgacgctggcgggggagcgctatctcgaacacgcgcgcgcggcgctggacgcgctgcgggcggggagcgtggcgctggcgcaggataggcaggcgctgtccggcagcctgtcgctatcgatgccgtctgacctggggcgcaatctgctgcggccctggctggacgattttctgctgcggcatccgggcctggggctgcagctgcagatcagcgaccgggtggccgatctctaccgccagccggtggacgtggcgttgcgctacggcgtgccggaggattcggcgctggtggccttgccgctggcgccggacaaccgccgggtgctgtgcgcgtcgccggactacctggcgcggcacggcgcgcccgccgcgccgcaggagctgcgcggccgcgaatgcctgcgcttcatcctgggcgcggcggtgcacgagcgctggagcttcgcgcagggcggcgagcggcagacggtgacggtggccgggcgctggcagagcgacgacggcgaaatcgtgcgccgctgggcgctggccggacgcggcatcgcctacaagtcgcggctggacgtgctggccgatctgcgcgccggccgtctgttgccgctgctggacggctatgatacggagcagaccccgctgttcctggtgacgccgcaccggctgatgctgtcgccggcggtggtggcgctgcgcgcgcatctgcggcaatgcctggatggctatctgcttggcccggacgcggcgggcgacagtcttgattga

SEQ ID NO: 1675 - DNA, 1014 bp, Chromobacterium substugae
atgaaagccgtcgcctactatcagaatctgcccatttcccatccggaagcgctgcaagacgtgcaattgcccgagcccgtcgtcggcgagcacgacctgctggtcgaagtgaaggccatttcggtcaacccggtggatgtcaaagtccgcgccaatatggcgccggaagccggcgaggcccgcgtgctgggctgggacgccgccggcgtggtgaaggccgtcggcagccaggtcagcctgttccggccgggcgaccgcgtctggtacgccggcgcgctgcagcggcccggcgccaacagcgaactgcacgcggtggacgaacgcatcgtcggccgcatgccggacagcctggatttcgaaaccgccgccgcgttgcccctgaccgccatcaccgcctgggagctgctgttcgaccgtctgcaagtgctggccaaccaacagccgtccggcaagaagctgctggtggtcggcgccgccggcggcgtcggctccatcctggtccagttggcgcgccggctcaccggcctcaccgtgatcggcaccgcctcgcgcccggaaacccaggcctgggtggcggagctgggcgcgcatcatgtgatagaccaccgccagccgctgagccgggagctcaaacgcatcggcatcgatcaggtcgattacgtggccagcctgaaccagaccgaccagcacttcggcgaaatcgtcgaagcgctggcgccgcagggcaagctcgcgctgatcgacgacccggctgcgctggacatctcccagctcaaacgcaagagcctgtcgctgcactgggagttcatgtacacccgctcgatgttcaccaccgacgaccagatcgagcagcacaagctgctgaccgagctggcgcggctggtggacgccggcatcgtcaagagcaccgtcgccgagcgcttcggcgccatcaacgccgacaacctgaagcgcgcccacgcgctgctggaaagccataccgccaagggcaagatcgtgctgtccggcttctga

SEQ ID NO: 1676 - DNA, 297 bp, Chromobacterium substugae
atgatcgttgaaatcgtccgtctgcgcgtcaagccgggcctatcgcaagccttcgaaaccgcctgggccgaggcatccgcccgctacctgcgccgccagcccggctaccaggcgcacaagctgggccgccagttggaaaccgagcgcgactacctgctggcagtgcagtgggacagcctggacgcgcaccgcgccttcatggaccatgccgacttccagcccttcgcccaaagcttctggcacttcttcgacggcgagccggacctgatccacttccagccgaaccccgcgctatga

SEQ ID NO: 1677 - DNA, 231 bp, Chromobacterium substugae
atgagcccggccgccgccccgcaaatgaccgccctcctggcgcgcgtccgcgccgccggcacgctggacatcgccaccgaaacgctggcgcaagctcgagcggcggcggagggcctgcgccgctggcaagcgccgccgggctggatccgctgcgcgacgacggcctggattacgccgcggcgctgcgcgcggccggcgtcgataccagctgcatcctgttgtccggcctga

SEQ ID NO: 1678 - DNA, 138 bp, Chromobacterium substugae
ttgtccggcctgacccacgccggcctgcacctgagcggcgtcgtcgcgcaggcgcgccgcctgaccgatctgggcggcgaagccctgcgccgggcgctggcggccgcccctccccccaacgccacggagacgacatga

SEQ ID NO: 1679 - DNA, 804 bp, Chromobacterium substugae
atgaaccgcccccacctcaccctgatcacgatagacctgtccttccaccacgccagcgccgcggtggtggccgccctgctggaagagcatggcgtggccgtcagcgaatggcgcgtcccgcacgaacgcgcgttcgagctgctgcgcaacggcgaaggcgatctgctgtgcagcgcctggctgccaggcagccatggcgcctatctcgcgccgctggaagacgaagtggaaaagctggctgtgctctacaccccgtacgcgttgtggggcgtgcccgactacgtgcctcaggagcaggttcccagcctggccgacctgaaaaagccggaagtggccgcccgcatgcaaaaaacgatacagggcatcaaccccggcgccggcatcagccgcttttcgctggaaatcatcgagcgctaccggctggacgaagccggctatcacttccgccacggcagcctggacgactgcgccaccgccttcgagcgggcggtggcgaaccaggactgggcggtggtgccgctttggcagccgcagttcctgcactggcggcacagcatccgggaattggccgaccccgaaaagctgctgcgcggcaaggacgaggcgacgctgctgatccgcaagtccgcgctggcgcgcctgccgccggccgcagtcgaggcgctgcgcgcgctgacgctgggcaacccgtcggtggtttgcctagaccaccagatttcgcgccagggcatggatccgctccaggcggcgcggcactggctgcaaaccgcccgcgcggccgcctccgccatcaaagcaacatag

SEQ ID NO: 1680 - DNA, 1551 bp, Chromobacterium substugae
gtgtattccaaatcgagtccaagcggcggcggacagcctggcggcattgcgcgccggctgccgccacatcatctgaaacatggcgccgcggcgctggccgtcgccatcgcgctggccggctgcgcggtcggtcccgacttcaagccgcccgtcctgccatcggcagccaacggcccttataccgaagccccgctgccagccagcaccgtctccgctcgcggcgagcatgtcggccccgccggcgccagccagcggctggccaatggccaggatctgccggagcaatggtggacgctgttccgctccgactcgctcgatcaactgatccgcgccgcgctggagcacaacccgacgctggacgcggcccaggcctcgctggcgctggcgcgcgaaaactacaacgccgccgccggcaccgcctattacccggcagtcaacgcccagctgggcggcggccgccagcgcgccatcctgaccggcaccagccccagcgagttcaacgtctacaacgccaccgtcaacgtgtcctacacgctagacctgttcggcggcgagcgccgccagctggaaagcctgatggcggccacggactaccagcgcttccagaccgaagccgcctaccagaccctgatcgccaacgtggtgaccaccgcggtgcaggaagcctcgctgcgcggccagctggaagccacgcgcgagctgctgaaggcgcaggaagagcagctgcgcatcgtcgacaagcaggtcgcgctgggcgcgcagccgcgcgcggccgcgctgacccagggcacgctggtggcgcagacccgcgccctgctgccgccgttggacaaggcgctggcgcaaacccgccaccagctggcggtgttcgtcggccgcttccccggcgaaggcggcctgccggaattccacctcgactccttgcggctgccggccgagctgccggtatcgctgccgtccgacctggcgaagcaaaggccggacatccgcgccagcgaggcgctgctgcaccaggccagcgccaatgtcggcgtggccaccgccaaccagtatccgcaaatcaccctcagcggcaattacggcacccagcacaccgttctgccaggcatggacttgggcaacacgctgtggggcctctccgccggcctgacccagccgctgttcaacggcggcgcactcagcgccaagcgccgcggcgcagaagccgcctaccgccaggcggaggcccagtaccgctccaccgtgctgaaggccttccagaacgtggccgacagcctgcgcgcggtggatgccgacgcgctggcgctgaaagcccaggccgacgccgaaacccaggcgcgcgaatcgctgcaggtgcacacccgccagtaccagctgggcggcatcagctacctgtcgctgctggacgcgcagcgcagctatcagcaggcgcggatcggcctgatccaggcccaggccgcccgctacaacgacaccgcggcgctgttcctggcgctgggcggcggctggtggcgccaccccgccgccgacggccagggggccgggggctga

SEQ ID NO: 1681 - DNA, 1107 bp, Chromobacterium substugae
atgaccaagcgaatgttgatcatgctgggctgcgtagtgctgctggtagcggcgctgggcgtgggctttttcctccacatccagaaactgatcgccagctcgcccaagcccgggccgcagacggtgtccaccaccatcgccaaaactcaggaatggcagccgcaactgggctcggtgggcaccctcaccgccgtccacggcgtggacatcagcagcgaagtggccggccaggtgcgcgagatcgccttcaagtccggccaggacgtcagggccggcgaggtgctggtgcagctgaacgccgacgctgacgtcgcgcagctgcgctcgctgcaggcggcggccgagctgtccgccaccacgctgaagcgcgaccgcgcccagttggcggtgcagggcgtcagccaggcccaggtggacgccgacgaggccgatttgaagagcaagaaggccctggtggcgcaacaggcggcgctggtggcgaaaaagaccatccgcgcgccgttcgccggccggctgggcatcaccaccgtcaacccgggccagttcctcaaccccggcgacaagatcgtcaccctgcagaccatagacccggtctatgtcgacttcaacctgccgcagcgccagatcggccaagtgcggatcggccagagcgtgtcgctgaagagcgatgccttcggcaacgagctgttccacggcaagatcaacgccatcagccccaagatcgacccggccacccgcaacgtgcaggtggaggccaccatcgccaaccccaagcgcaagctgctgccgggcatgttcgccaacaccaccatagacgtgggcagcaagcagaagcacctgacgctgccgcagaccgcgatcacctacaacccgtacggttcgacggtgttcatcgtcaaggccggcaagaacggccccgaggcgcagcaggccttcgtcaccaccggcgacacccgcggcgaccaggtggccatcctctccggcctgaaggaaggccaggaagtggtgaccagcggccagctgaaactgaagaccggcacgccgatcgccgtcaacaattcggtgcagccggccgatagcccgaacccgacgccgcaagaacactga

SEQ ID NO: 1682 - DNA, 3066 bp, Chromobacterium substugae
atgaactttaccgatatcttcatccgacggccggtgctggccaccacggtgagcctgctcatcgtggtgctgggcctgcgctcgttgttcggcctgccggtcaaccagtatccgcgcacgcaaaacgcggtggtgaccatctccaccgcctattacggcgccgacgccaagaccgtggccggcttcatcacccagccgctggaatccgccatcgcccaggcgcagggcatagactacctgtcgtccaccagcaccagcggcgtgtccaccatcaccgccacgctgcggctgaactatgacgcaaaccgcgcgctgaccgagatcaacacccaggtcaactcggtgaagaaccagctgccggcccaagcgcagcagccggtgctgacggtgcagaccggccagaccaccgacgcgatgtacatgggcttctacagcgacacgcttccgaccaacaacgtcaccgactacctggtgcgggtggtcaagcccaagctggactcggtgccgggggttcagacggcggaaatcctgggcgcgcgccagttcgcgctgcgcgcctggctggattcggccaagatggcggcgcacggcgtcaccgcggccgacgtcagcgccgccctggccaacaacaacacgctgaccgcgctgggcgccagcaagggccagatggtgaccatcccgctgaccgccgccaccgacctgcactcggtcgacgaattcaagcagctggcggtcaagcgcaacggcgacgccatcgtgcggctggaagacgtggccaccgtgacgctgggttcggaaaactatgacttcaacgtcgcgttcagcggcgtgcgctcggtgttcatcggcatcaaggtggcgccggaggccaacatcctggatgtggccgaacgcgtgcgcacggtgttcccgtccatccagcagcagctgcccaccggcctgaccggccagatcgtctacgactccaccgacttcatcaacacctccatccacgaggtggtgaagacgctgctggaggcgctggtgatcgtgaccgtggtgatcttcctgttcctcggcagcttccgcgcggtggtggtgccggtgatcgcgatgccgctgtcgctgatcggcaccttcttcatcatgctgatgctgggctactcgatcaacctgctgacgctgctggcgctggtgctggccatcggcctggtggtggacgacgccatcatcgtggtggaaaacgtcgaccgccacatgcgcgagggcaagacgccgctcgaagccgccatcatcgccgcgcgcgagctgggcggcccgattctggcgatgacggtggtgctggtggcggtgtacgtgccgatcggcttccagggcggcctgaccggcgcgctgttcaccgaattcgccttcacgctggccgcctcggtcaccgtgtccggcgtggtggcgctgacgctgtcgccgatgatgtgttcgcgcttcttcaagtcggacatggacaacagccccttcgtccacgccatcgaccgcaccttcgaacgcgtgcgccaccgctaccagcgcatcctgcgcagcctgctgcagacctggccggtgctgatcgtgatgggcgtgatcctgatcgcgctcttgggcctgatgttcaagatgtcgaagtcggagctggcgccggaagaggaccagggcatcgtgctgtcgcaggtggtgggcgcgcccaccgccaccgccgaccagatgcaggcctacgccgaccaagtgttccaggtgggcaagagcatgccggaatacaagcagatgttccagatcaccggcgtgcccaccaccaacgccggcatcggcggcgtgctgttcaaggaatgggaccagcgcaagcgcagcgcgcatgaaatccagctggacctgcaggcgcgctggaacaagatcgccggcgcgcgcgtggcggccttccagttccccgccctgcccggcgcgtccggcctgccggtgcagttcgtcatcaccaccaccgagccgttcgagaacctgaaccaggtggcgcagcaggtgatggacaaggcgcgcgcctccggcaagttctacttcgtcgacgccgacctgaaaatcgacaagccgcaggcgacggtggtagtggaccgcgacaagatcaccgcgctgggcctgacccaacaggacgtcggcaactcgctgtctgcggcgctgggcggcggctacgtcaactacttctcgatcgacggccgctcctacaaggtgattccgcaggtgctgcaaaccgaccggctgaatccatcccagctgctggattactacatcaagacgccgaacagcggcgtgatcccggtgggcaccgtggccaagctgaaatacgacgtggtgccggagtcgatcacccgcttccagcagctcaattcggtgaccatctccggcgtggccggcgtgtcgcagggcgaagtgctgcagttcatgcgcgataccgtgcagcaggtcgcgcccagcggttacaccgtcgactactccggccagtcgcgccagttcatgcaggagtccggcggcttcctggtgacgatgatgttcgcggtgatcatcgtgttcctggcgctggcggcgctgttcgaaagcttccgcgacccggtggtgatcctggtgtcggtgccgctggcgctgttcggcgcgatgatcttcatcttcctcggtttctcctcgctcaacatctacaccgaggtggggctggtgacgctgatgggcctgatcagcaagcacggcatcctgatcgtggaagtggccaacgagctgcgcaagaccggcttgtccaagcaggacgccatcgagcaggctgccgccatccggctgcgcccgatcctgatgaccaccgccgcgatggtgttcggcgtgattccgctggtgatcgcctccggtgccggcgccgccggccgctacgcgatgggcctggtgatcttcaccggcctgtccatcggcacgctgttcacgctgttcgtggtgccggcgatgtatatgttcctggcctccaaacgcgaaaccgccgtggaaaccgccggcgacgccgcgctggaaaaccagccgcgctaa

SEQ ID NO: 1683 - DNA, 780 bp, Chromobacterium substugae
atgagcatcaccattcaggcggccggcgcttcggtcaattatacctgcagcggcgttggccggcctttggttctgttgcacggcaccagcgtcgatgcgcagggcaatttcggccaagtggcggaacgtttcgccgaccactgccaggtggtcatgcccaattacggcggttgcggcggctccactctgccggacggcgaactgacgttggacattttggtagagcaggtcgcggcggtgatccgccatgctgcggacgagccggtcgatctgttgggcgattcgctgggcgcggtggtggcggccgccgtcgcggcgcggcacccggaccgggtgcggcgcctgatcctggtggccggctgggcggacagcggcgatgcccgccaccagatggtgtttgaaggctggcggcggcttctggcggcggacgccgagctttgcaaccgctatgccttcgcgctcgcggtcagcccggccgcgctgacccggtttggcggcgacagcatcgacgccttgctgcgccagcccatgccgcccgacacggcgcgccgtgtcgaactgggcctgcgcatcgatatccgccaagcggcgcggacgatcgcggcgccgacgctggtggtggcgtgccgccaggattacctggtgccgccttaccagacgcgtgggctgcatcagctgatcccgggcagccgctgcgtcgaaatcgacagcggccacgccgcttttctggagcggccggatgaactggtggcgttggtgcgcgaattctgtctggcctag

SEQ ID NO: 1684 - DNA, 744 bp, Chromobacterium substugae
atgctccgccaaaatcgcattcccggacggggcagtcatgacgctggcccgcgctgctgcatcgcccggccggcggcgcagcccgaaatctgccgcaggcgcggcaagcaaagcgaaaaaatgaaacagaccatggaagcgcgccgcgtcagcggcctgattctggccggcggccagggcatgcggatgggcgggcaggacaagggctggctggaactggtcggcgcgccgctggtcgagctgacgctggcgcggctgcggccgcaattggcaaacggagagttgctgatcagcgccaaccgcaacctggaacgctatgccgcgctggcccgcgcgctgccggacgcgccggagttcgccggctgcgggccgttggccggcctggaagccggcttggcggcttgcgcggccccctggctggtggcggttccctgcgacctgcctttcctgcccgccgacctggcctcgcggctgctggcgccgctgctgcgcggggaggccagtctgagcgcggccagctgcgccggccggcagcacccggcctgcatggctttgtcggtggagctgctggaggatctgcgcgcctatctgcgcgccgacggccgcaaggtcagggaatggcaggcccgcgtcggcgcgctgcagatagatttcgacgacgcgcccgaggcctttcgcaatctcaataccccggacgatctggccgcggcggaagcctacgccagccagtggcgccagtcgtaa

SEQ ID NO: 1685 - DNA, 1197 bp, Chromobacterium substugae
atgttggcattcgaggatgcccagcgctacctggccgattacgcgccgccgttgacggggaccgaaaccgtgcgattggacgaagcggcgggccgggtgctggcacggacgctgacggcggcgctggacatgccgccggccgacaacagcgcgatggacggctacgcattgcgttgcgccgacgccgcgccgggcgtggcgctgccggtgcagcagcgttgctatgccggccaggcgccagaggccttgctgcccggccaggctatccgcttgttcaccggcagcctgctgccggacggcgccgacgcggtggcgatgcaggaggacgcggaagaggccgacggcatggtgacgatcagccgcccgccgctgccgggccagcatatccgccgccgcggcgaggatgtggcggcgggcgcgatcctgctggaggccggctgcgtgctggggcccggccatatcgccttgctggcgtcgcaagggatggccgaagtcccggtgttcccgcgcctgaaggtgggcatcctgacttcaggcgacgagctggtcgcgccgggcgaggcgcgcgcgccgcagcagatctacaacagcaacggcgcgatgctggcggcgctggcggccggcatgggcgcgcgggtggcggcgcggcggcatgcccgcgacgtcgaggacgagctgcgccaggccttcgtcgagctggcgcgcgaatgcgacctggtgctgagcgtcggcggggtgtcggtgggcgagcgcgacctggtcaagccggtgctggccggattgggggcggagctggatttatggaaggtgaggatgaagcccggcaagccggtggcgctggcccggctgggcgcgacgccggtggtgtgcctgcccggcaacccggtttcggcctacgtggtgttcgccttgctggtgacgccgttgatgcggcggatgcaggggcgcggcgaatgcttcccgccggtgggccaattgcccctggccagcggcgcgcagcgcaaggactgcggccgagaggacttcctgcgggtgcggctggaaagcgacgcgcggctgcatccgcatggccgccaggccgccggcattatcagcgcgctgccgggatcgtcgggcttggccaggctgccggcggaccggcaactggccgatggcgacagggtcgcctattacgactggcgccactggctggcgtag

SEQ ID NO: 1686 - DNA, 519 bp, Chromobacterium substugae
atgcatgacgaacaagcggtttcgctgcgctgcgcggtgctgaccatcagcgaccgccgcaccctggacaacgacggcgccggcgacctgctggcggaaaaactgagccaggacggccatgtctgcgcccggcgcggcatcgtcgccgacaatatctaccagatccgccgcgtgctcagcgaatggatagccgaggacgaggtgcaggtgatcctcaccagcggcggcaccggcttctcgccgcgcaactcggcgccggaggcggtgctgccgctgctggacaaggagatagacggcttcggcgagctgtaccgccatttctcgctggcgcaggtcggcagttcggcgctgcagtcgcgcgcgctggccggtttcgccaaccgcacgctgatcttctgcctgccgggggcggagcgggcgtgcgagctggcctgggacaagatactgcgcgagcagctggacagccgccaccagccctgcaatttcgccagcgccttccgcgtcaaggaggagagctga

SEQ ID NO: 1687 - DNA, 798 bp, Chromobacterium substugae
atgggcgagggcgacggtttcattcaatgcgcggtgacgcgccatcaggaagacggcgggcagcgcgccgacgcggaccgggtggcggaggaaacgccggtggcgctggtgttcaacggcatttcccacgcggtgatgatggccacgccatgcgacctggaggcgctggcggtgggcttcgcgctgaccgagggcatcgtggcgcggcgcggcgagatcttcgacgtcgaggccgagtttttcgccagcggcgccgaggtgaggctggagatcgcccagccggcttttttgggtttgaaggagaggcggcgctcgctggaaggccgcagcggctgcggcgtctgcggcatcgagagcctggccttgctcgacctggcgccgacgccgatcgccgcggcgcggcggataatcgcccgcgccgacatcatcgcccgcgccgcgcgcgagttgcccgagcatcagcggctgatgcgcgccaccggcggcgtgcacgcggcggcctggtgcgggccggacggcgcggtgctgcgggcgttcgaggatgtgggccgccataatgcgatggacaagctgatcggccatctggcgctgcagggcgcggcgctggatgagggcttcgtgttcatgtccagccgcgccagctacgagttggcgcgcaaggcggccaggatgggcattccgctgttggccaccatttccgcgcccacctcgctggcggtggacatcgcgcgccaggccggaatgtcgctggccagcttctgccgcaagaacggctttgtcgaatacaccgcgggctga

SEQ ID NO: 1688 - DNA, 279 bp, Chromobacterium substugae
atgacccagccctcgtccgatcagctcgaccccgccatcgccgccctgctggcgcagctatggcgcgccgcccaatccggcgggccggcctggtcgctgccgcggctgtgcaaacagtccggcctgcgcatgagcacgctgcggcgcagcctgaccttgctcgccgaactggagctggccgccatcgagctgtacgccgacggccgcggccgcgcctggctcagcgacgacggcctggccttgtgccgccagctgttcgagcccggcgacgaaggctga

SEQ ID NO: 1689 - DNA, 2304 bp, Chromobacterium substugae
atggaccattccaagaccaagggacgaatcgaaccctacgcgccgccggccggcggcctcggttcgctgaaaagcaccaccgtcgccctggtcaaggaaaaggtgccgggcagccgctacaagacgctgttccatcagaaccagcccgacggcttcgactgcccgggctgcgcctggcccgaccgcgaacacacctccaccttcgaattctgcgaaaacggcgtcaaggcggtggcggcggaagccaccggcaagaggataggcgccgacttcttcgcccgccacacggtgacggcgctgctggaacagtcggactacgaactggagcagcatggccggctgaccgaaccactggcctacgacgccgccagcgaccgctacctgcccatctcctgggacgacgccttcgcgctgacggcgcgccacctgcgggcgctgccggaccccaaccaggcctcgttctacacctccggccgcaccagcaacgaaaccgcctacctgttccagctgttcgtgcgcatgttcggcaccaataattttccggactgctccaacctgtgccatgaatccaccagccgcgccttgccggccacggtgggtgtgggcaaggccacggtgatcctcgacgatttcgagcacgccgacaccatcctggtattcggccagaacccggccaccaaccatcctcgcatgctgaacgagctgcgcgaatgcgcgaagcgcggcgcggccatcgtctccatcaacccgctgaaggaacgcggcctggagcgcttcgccagcccgcagcatccgctggacatggtgggcggcggcgtcgccatcagctcgatgttcatccgcccgaccctgggcggcgacttcgcgctgatcaagggcgtggccaagcgggtgctggagctggacgacgaggccgtggccgccggcggcgagcgggtgctggatgccggcttcctcgccgagcattgcagcggcttcgacgccttcgccgccgacttgcgcgccgaaagctggccggcgctggcggccgattccggcgtgccctggagcgacatcgacgcgctggcccggctgtacgcgcgcggcaaggcggtgatcgccacttggggcatggggctgacccagcacaagaattcggtggcggcgatacagatgctgtccaacctgatgatgatgcgcggcaatatcggcaagcgcggcgccggcctatgcccggtgcgcggccactccaacgtgcagggcgaccgcaccgtcggcatcgaggacaagccaaccccggccttcctcgaccggctgcgcgacgtctacggctttgagccgccgcgccatcacggcctggacgccgtcgacaccatcgccgcgatgcgcgacggacgggtgaaggtattcgtcggcctgggcggcaatttcgcgatggccacgccggacaccccgctcaccttcgccgcgctgcgcaactgcgcgctgacggtgcagatctccaccaagctcaaccgcagccacctgatccacggcaaggacgcgctgatcctgccgacgctgggccgcaccgagatagacctgcagaaaagcggcccgcagggcgtgacggtggaggactcgatgtgcatggtgcatctgtcctacggcatcaacccgccggcctcgcgcgaactgcgctccgaaaccgccatcgtcgccggcatcgcgcaggcgacgctgggcggcggcaaagtggactggctgagcttcgtcgacgactacgccaaaatccgcgacgagatcgccaaggtgctggacgccttccgcgacttcaacgcccgcgtggcgaagccgggcggcttccacctcacgcccgcctcgcgcgagcggcgctggctgaccccggccggcaaggcgcagttcatcgtccacgcgctggagcgcgacacccccatccagcgcgcccgcgcccgccacggcgaccaactgatggtgctgatgaccgcgcgttcgcacgaccagtacaacaccaccatctacgcgatggacgaccgctaccgcggcgtctacggccagcgccgggtgctgttcatccaccgcgacgacctggcgcggctgggtttttccgccggcgagcgggtggacctgttcacagtctgggacgacgacgtggagcgccgcgccgacggtttcctgctggtggaatacgatattccgcgcggctgcctgggcgcctacttcccggaaaccaatccgctgatcccgctagacagcgtggccgacgtctccaacacccccacctccaaatcggtgccggtgctcctgcgccgcgccgccggctga

SEQ ID NO: 1690 - DNA, 5205 bp, Chromobacterium substugae
ttgctggccttgctggcagggctgggattgagcgccctggtatcctggcaattggcgcgccagaacgacgccgatgtccaactggcggtgcggagcgcgacgcagcggatggccaggcaggtggcgtaccgggtgctgcgctatcagttcggcctgaaggcgatgcgcggggtggccatggcggcgggcgagcgcggcctcagccgcgaacgtttccgcgattacagcgaggggcgcgacatcgcggccgaattccctggggcgcagggctttggttacatcctcagggtgcctctgcggcaaagcgcggcgttcgagcgccggatgcggcgcgagggcatgtccgatttccgcatctggcagttgcagccgcatcagggcgagcgcgatgtcgtggcctacatccagccggagctgggcaatctgcgcgcggtcggtctggacattgcctcggagcccaatcgccgcgccaccgcggagcaggcgctgcgcagcggccagatgacgatgactgcgccgatcaagctggtgcagcgttcgctggcccaggatccggcttttgtggttctgcttgcggtctatcgcggcggcgtggtgcccgccaccggcgccgccagaatggagcaaggctacggctgggtgagcgttcccctgcacatgaaaaccgtgatgggaggactggagcaggagcaaggcggcgtgcgggtggaactgaacgatgtcaccgacccggcccggccgatcgcggtgtacgccagcgcggcgccggccgggcaagcgctggcgagctattccgaataccagttggtgctggggcggcgctggcagctgacgctgcgcgcatatcctggcttcgccgcccggctgcagcagccgcggccggcggcggccggcctggccggcgcgtttctgagcctgctcggcgcgctgttggctttcatctggcagcgcagccaccagcggcggatgcagctggcggccacccaggcgcggctggccaccatcgtcgagaactcggccgacgccatcatcggcaagacgctggcgggcgtgatcaccgactggaaccgcagcgcggagcggatgctgggtttttccgccgcggaagccataggccggccgctggcggggctggtggtgcctcaggagcggcagtcccaggtggaggacatcctggcgcgggtcggcaggggcgagccggtcgagcatttcgcaacccgctggcggcgcaaggacggcagcctggtggacgtgtcggtttccatctcgccggtgcgcgacgccgccggcgaggtggccggagcgtccacctcggtgcgggacatcagccggcaaaagcaggtggaggcgcagctgcacagcctgaacagccacctggaggagctggtggccgaacgcggcgccgagctgggcaaggccaggcataccctgcggacggtggtggacgcggtgccgtcgctgatcggctattgggaccgcggccagatcaaccgggtggcgaaccgggcttacctggattggttcggggtggccgccgacagcctgccgggcctgtcattgcgcgagttgctgggagcggagctttaccgcgctaaccagccttacatcgaggcggcgctgcgcggcgaaccgcaaaccttcgagcggcggattcccgggccggacggccgggtgcgcgacgcgctgacccactatctgccggatatcgtcgacggcgaagtgcaaggtttctacgcggtggtgcacgacgtgtccgaactggtggaaagccgcgaccgccaggcgcgcgcgcgccaggaggtggacttgctgctgagcaccatcaatcgccaactcctgtactcggtgaccggcgccgacggccggctgctggaggtcaacgatctgttctgccgcagccacggctacgcgcgcgaggcgctgctgggccgggatctgcaatggctggacggcggcgggcagacgccggcgttctggtcggcgttatcggatgcgctgcgccgcggcgaggcctggcgcggcgaaatgtgcaaccgcgccagcgacggcggcctgcgctggctggacaccgtgatcgcgccgcagctgggcgccgatggcagcctgggccgctgcgtggcgttgagcatagacaccaccgagcggcggcgcgccgacgccgagctgggccgggtcaatcgcctgctgagcgatgtgctgggcgcggcgtcggagatttccatcatcgccaccgacgtcgacggcgtcatcaccctgttcaaccgcggcgccgagcgcatgctgggctatcgcgcggaggagctggtcggcgtcagcacgccgggacgcttccatccggcggaggagatcgccgcccgcggacgggagttgagcgagcgttacggccagcctatcgaaggcttccgcattttcgtccatgaatcggaaatcctgggcgctgatcatagccaatggacctatctgcgcaaggatggctcgcaactgaagatatcgctggtggtgaccaccatgcgcgacgacgaggggcggatcaacggctatctgggcatcgccgtcgacattaccgcccagctgcagcagcagcaggaactgacagtggcgcgcgaccagctgcaaatggcggcggatgtcgcgcagctgggcgtgtggagctgggtgccggcggacggcatgctcaactggaaccacaggatgttcgaaatccacggcctggcgccgcaaccggagccggcgcggcaggaactggagtaccggagctggctggagcggctccatcccgacgacgcgcggcggatggaggcaggcatgatggcggcggcggcggaaggcggggcctatgacgccgccttccgcgtggtgcgtcctaacggcgaggtgcgccagttgcaggccggcgcgcggatcgagcgcgacggcgacgggcgcgcgctgcgcttcaccggcatttgcgaggacgtcaccgagcgccaggcctacgaagccaccttgctggaggccaagcggcaggcggagcaggccagcatcgccaaaggccagttcctggccaatatgagccatgagatccgcacgccgatgaacgcggtgctgggtctgctgcagctgctgcagcgcacggggctggacgggcgccagcgcgactacgtcgaaaaaacccaggcggcggcccgctctttgctgggcctgctcaacgacatcctcgatttctccaagatcgacgccggcaagctgcagctggacccgcaccccttcgacctggaaagcctgatgcgcgatctggcggtggtgctgtcgggcaatcacggcgaccgcaatgtggaagtgctgttccggatggatccgaccctgccttccatgctgtatggcgaccggctgcgcctgcagcagatcctgatcaacctggccggcaacgcgctgaagttcaccgtggcgggacaggtggtggtcagcctgtcggcgacgcggcgcggcgagcgcgacgtcgtgctgcggttcgagattctggacagcggcatcggcatcagcgccgagcaattgaaccgcattttcgaaggcttctcccaggcggaagcctccacctcccgacggttcggcggcaccgggctgggcttggtgatcagcaaggggctgatcgagctgatgggcggccgcctgcaggtggagagccggcccggcgagggcagccgcttctggttcgagctggccttcggcttgagcgggggcgcggcgctggcggccagttggccgggggatggcctgcgggtgctggtggtggacgacaatgcgctggccggggagatcctgctcgacaccttgtccttggtgggctggcatgccgattacgccaatggcggcgaagaggcgatagcgttggcgcgcgcggccatcgccggcggctggcgctacgacgtggtgttgatggactggcgcatgccggggctggacggcgtggaaacggccaggcgcatgcggcagcaggccgcgcccaaccattcgccggtgatcgtgatggtcacagccttcggccgcgaggtgctggcgggcatcgcccagcagccgcaggcaccgttctgcgacgtgctgaccaagccggtgacgccgcagcagctggtggacgccattcgccgcgcggtggcgggcgcggataacgatttgtgcgaggcgatgccgccggccgcgccgaggcggctggccgggttgcgcctgctgctggtggaggacaacgccttgaatcggcaggtcgcgatggaattgctgcgcgacgaaggcgccgaggtcgcgctggcggagggaggcctgcagggggtggcgctggccagcgccgccgatccgctttacgacgtggtgatcatggacgtgcagatgcccgatatcgacggcctggaggcgacgcgccgcctgcgcgccgatccgcgctgccaggcgctgccgatactggcgatgacggccaacgcctcccgggccgaccgcgacgaatgcctggccgccggcatggacgaccatgtcggcaagccgatagacatagacgaactggtggccaagctgcaggcgctggccggctggcaggcgcgtaatacgcagatgaccggcggggaaggcgaagacggcgggagcgacgatgggccggcgatagaggcgctgccttcgcggctgcgccgcttcggcaacaagctcaaggtataccgcgcggcgctggcgactttccgtccggagtgcgaaaggctgctggctgatatggagcggcaggtggacaaaggcgcctggcccggcttgctggtcagcctgcatgcgctcaagggcgtggcggcgaccatgggagcgacggcgctgaatcggcaggcgcaggagctgtcgcggctggtgaaggccggcaatccggggcggctggcggcaacggcgctggccgaccggctgcgcgaactggagcggctggccgacagcagcgccggccagctggcggcgtcgctgccggccgaagcgcggagcgcgccggcgtccggcgcgctcgcgctggagcgggaccggctgcgggatgtgctggcgctgctggaagaccacaatctggcggtgatagacctgatcgaagaattgctggcgttggagctgggcgacagcgaggcgcgggtgcgccaggcggccgcctgcgtgcagcgcctgcagttcggcgacgcgatagcgatcgtccgcggcctggtggcggccggctga

SEQ ID NO: 1691 - DNA, 2481 bp, Chromobacterium substugae
atgttcaacgatctaaggcatgagagggcgcggatactgatcgtcgacgatatggcgagcaatatccatgtcatccgcgaggcggtgcgggatctgggcgaggtgcgcttcgccaccagcggccgcgaggccttggaaatggcgcagcgggcggttccggacgtgatcctgctcgatatcgaaatgcccggcatggatggctacgcggtatgccgggagatcaaggccacgccgcggctgagcgacatcccggtgattttcgtcacctcgcatgacgaagacggccacgagctgcaggcgctgaacatcggcggcgtcgatttcctgcacaagccgctgaacgtgccggtggcgcgcgcgcgggtgcagacccagctggcgctgcgtttgcgaacccgccaactggcggccgcgcagcgggatctggccgaggtgctgcggcggttgccggccttcgtcgcctactggaacgccgatctgtgcaacgagttcgccaacgacgagagcggcgcctggttcggcatcgccgccgccgacatgcgcggtctgccggcacgggcggtgctgggggaggccaacttcctggcgatggagctgcggctgcgggcggcgctgaacggcgacgcggcgactttcgacctcagcctggccaagccggacggcggcacgctgcatggccaggtggcgctggcgcaccggccgcaggagggcggcaggcccggctgcctgatgctgatcgccgacgtcaccgagcgcaagcgcgcggagctggcgctgcgggatgaaaaggagcgcatccgcatcacgctcaattcgataggcgacgcggtgatcgccaccgacgccgccggccgggtcacgtttttgaacccgatcgcggaggagatgaccggctggctggcgaaagaggcgctgggccagccgatcgaaagcgtgatgccgctgcaggccagcgatgccggccgcggcgtcgacaacccggtgcggctggtgctggccgaacgccgcgccgtcggcatgacgctggaccgggcgctgctgcgccgcgatggccggctgttggaggtggaggattccgccgcgcccatcctcgaccatgccggcgagctgaccggcgccatcatcgtgttccacaatgtcggcgaagcgcgcgcgctggcggtcaagatgatgcatctggcgcagcatgacgcgctgaccaatctgcccaaccgcatgctgctgcaggaccgcacccagcaggcgctgcgccaggcagaaagcagcggcgagcggctggggctgttcattctcgatctcgaccatttcaaggtgatcaacgactcggtcgggcattcggtcggcgaccgcttgctgcagctggtcgccaagcgcctgcaggcgatagtgcggcccggcgacaccatcagccggcagggcggcgacgagttcatcatcctgatgccggatccggtcagcatcgaacaactgggcgccgtcgccgcccgcttgcagaaggcggtgtccgaaccttgcctgctggacgaggaacgatttgacctgtcggtcagcataggcgtcagtctgtacccggacgatagccgcgaccaggaagaactgtaccgccacgccgacgccgcgatgtaccaggccaaggaggacgggcgcaaccgctaccgttttttctcggccgagatcgaggaggcgctgctgtcgcggcaggcgctggagcgccatatccgcatgggcgcggagtcgggagggtttcgcgcttactaccaggccaaagtggatgtgacggaggggcggatcgtcggggtggaggcgttgatgcgctggcgcgatgagagcggcgaaatcatttctcccggacatttcatcccgctggccgaggaaaccgggctgattttgccgctgggccgcttcatcctgcgccaggcctgcctggacggcaagcgttggcacgacgccggcttgcccttgcgcatcgccgtcaatgtctcggccgcgcagatcgccgacggctgcttcagcgatacggtgcgcgcggtgctggccgaaaccggcatcgctccccaactgctggagctggaaatcaccgaaggggtgctggcggccaatatcgcccaaaccatgagcgtgctggccgagctgaagcgcttgggcgtcgccatcgccgtcgacgatttcggcaccggttattccaatctggcctatctcaggcagtttcccatcgacgtgctgaagatagaccagagcttcgtccgcgacatgataggggacaagagcaatctcgccatcatctccgccatcgtcagcatggcccagggcctggatctgcaactggtggccgaaggcgtggagtcggccgagcaggagagggcgctgctcgcgctgggctgccgcgtgatgcagggctttctgtacggcaggccggtgccggtggaagagatggatcgccagttgggcaatggcgcccgcctggccggcagccaggcctga

SEQ ID NO: 1692 - DNA, 1527 bp, Chromobacterium substugae
atgaacgccgccgtcggcgcgccgcaccgcggcatgatcaccgtggccatcatgctggccaccatcatgcaggcgctggacaccaccatcgccaatgtggcgctgccgcacatgcagggcagcctgcaaagctcgcaggaccagatcagctgggtgctgacttcctacatcgtcgccgccgccatcgccaccttgctgaccggctggctgtgcgcgcgcttcggccggcgccgggtgctgctggcgtcggtggccggcttcaccgtcgcctcggccttgtgcggcctggccgattcgctgtggcagatcgtcgccgcgcgcttgctgcagggggtgttcggcgcggcgctggtgcccttgtcgcaggcggtgctgctcgacatcaacagcaaggaaaaagtggggcaggcgatggcgatctggggcgccggcatcatggtgggccccatcctcgggccgctcttgggcggctggctgaccgacaacgccagctggcgctgggtgttctacatcaaccttccggtgggcgtgctggccttttacggcatcgcccgctatctgccggagagccgcgccggcaacgacaagctggaccgtttcggcttggccacgctgtgcgtggccatcggcgcgctgcagctgtttctggaccgcggcgagcagctggactggttcagctccgccgaaatctgtctggaggccatcgtctgcgcggcggccttcgtctatttcatcatccacacctggtccgcgccggaagggcagtccttccttagccgcggcctgctgcgcgaccgcaatttcgtcaccggcagcctgttcattttcgtggtggggatgatcctttacgccaccatggcgctgctgcccagcctgctgcaaagcctgctggactacccggtggtgttcaccggcgaggtgatggcgccgcgcggggtgggcaccatgctggcgatgatgctggtggggcggctggtgcacaaggccgacccgcggctgatcatggccggcggctttctgctgacggcgctgtcgctgtaccagatggccggcatcgcgccgaacatgggcagcggcatcatcgtgttgtcaggcttcatccagggcgccgggctgggcttcaccttcgtgcccttgagcatggtgaccttcgccacgctggagccgcagctgcgcaacgagggcacgccgatctacagcctgctgcgcaatgtgggcagcagcgtcggcatctcgctggtgcagaccatgctgaccgaggacgccgcgcgagcgcatgcggtgctgggcgagcatgtggcgctgggcagcccgctgctgcgggagttgccggcggcgctcagcccgttcaccgacgccggccgcgccttgctcaacctggaggtgaccaggcaggcggagatggtggcctatatcgacgacttcaccgtgatgatgtggctgtcgctggcggtgctgccgctgttgctgctcatccggcgtccggcgccaagcgcgccggcggcgggagcggacagcgcgcactga

SEQ ID NO: 1693 - DNA, 453 bp, Chromobacterium substugae
atgaagatacgcatcgcggaacgcttcggctttctggtcagcgacaccgggcggttgtacggccgggttttcgaccaaagggcgcggcagcagctcggcttgtcgctggcgcagtgccgcttgctgggcgcgctggcggcgcacgagggcgaaaagcccttgtcgcaggccgaactggcagacaagctggacctgacgccgatgggcgtggcgacgctgtgcgaccggatgcaggcggccggctggctgcggcgggtgcccagcgcgaccgaccgccgggtcaatgaaatcgaactgctggagccggccttcgcggcgttgaaatcggcgatggcgctgggcgacgagctgcagcaacaggcgcagcaaggcctgagtccggaggaggacgcgcagctgcgcgcgctgctgggcaaggtgcacggcaatctggcgagcctgctgtcccgatga

SEQ ID NO: 1694 - DNA, 1389 bp, Chromobacterium substugae
atgcaaacagaagtcaaagagaagccccgctacgccattgtggcctcggtgcagctgccggaagtcagcgatgtcgagttcgaggcctcgctcaccgaattgagcgaattggccaagaccctgggtttccaggtggtgcagacctttgtgcaaaagcgcaacagcttcgaccgcaccgcctatatgggcgtgggcaagctggaagaaatcagcatgttcgtcaaacgcggcatccgcgccgacgagctggaagacgagccgcagcagatggacgccagcgccgtcgagatagacgcgttgctggtggaccatgaaatctcgccgtcgcagatgcgcaacctggagctggccgtcggctgcgaggtgatggaccgcaccatggtcattctggagattttccaccgcaacgcccgctcgcgcgcggcgcgggcgcaggtggaaatcgcccgtctcggctatatggcgccgcgcctgcgcgaggcggccaagctggccggcccgcaaggccggcagcgcagcggcatgggcggccgcggttccggcgaatcgcacaccgagctggaccgccgcaaggtgcgcgaccgcatcgccgagctgcagcgcgaaatcaccgcgatggagctggagcgcaagacccagcgcgcgcgccggctggagcgtcagggccaggggctgggcggggtgtcgctggtcggctacaccaacgccggcaagtccacgctgatgcgggcgctgaccggcagcgaggtgctggtggccaacaagctgttcgccaccctggacaccacggtgcgggtgctgtacccggaaagcgtgccgcgcgtcttggtcagcgacactgtcggcttcatcaaaaacctgccccacggcctggtggcctcgttcaagtccacgctggaggaggcgctggacgcctcgctgctgctgcatgcgatcgacgccagcgaccccggcttcgagcgccagctggaagtgaccgacgtggtgctgaaggagatcggcgccgacgaggtgccgcgcatccgcgtgttcaacaagatagaccacgtcggcgacgccgcggcgcaggccgcctggaccgccgaactgcggcagcgctacccgggctgcgtggtgatgagcgcgctgcgcccggacgacgtggccggcctgcatgcggccatcgtctccttcttccagcaagacctggtggaggaagaactgctgttgccgtggtcggcgcagcagctgcgcggcgagatctacagccactgccaggtgctggaagagcatgccgaggacgagggcagccgcttccgcgtgcgcggcgagccggaaaagctgcgccgcctgcgcgagcagctgaatccgggctcgcagggccgggaaaaggaatattgggaactgtga

SEQ ID NO: 1695 - DNA, 1263 bp, Chromobacterium substugae
atgtcattcgcttccctgggcctgcagcccgacctggtccagtccgctctcgagcaaggctatatccagcccaccgccatccagaacgccgccattccggccatcttgcaaggcggcgatgtgctggccaccgcgcaaaccggctccggcaaaaccgcggccttctgcctgccgttgttgcagcaatggctggccagcccgcgcgccgtgctgcgccagccgcgctcgctgatcctgctgcccacccgcgaactggcggcccaggtcggcgaaatcctgcgcgacctggcccaggccctgccccgcaagctgaaagtggcggtggtgtacggcggcgtgtcgatcaatccgcagatgatggcgctgcgcggcggcgccgacatcgtggtggccactccgggccgcctgctggatttgcatcaacataacgcgctgcggctgtcgtcggtcaaaaccctggtgctggacgaggccgaccgcctgctggaccaaggcttcgccgaagaattgaaccgcgtgctggccctgctgccggcgggccggcaaaacctgatgctgtccgccaccttcccgccggcggtatgctcgctggcgcaaacgctgctgaaccagcccttgcggatagacatcgaacaaaacgccgccaccgcgccggacatccgccagcgcgccatcgaagtggacgccgacaagcgcaccctgctgctgcgccatctgctggcgacgcatgactgggatcgggtcttggtattcgtcgccagccgccaggccgccgaccgggtggccggcaagctggcgcgcaacggcgtggccgccgccgcgctgcacggcgactgcagccagagccagcggggccaggcgctggccgacctgaaatccgggcgcttgcgggtgctggtggccacggacgtggcggcgcgcggcatcgacatcgcccggctgccgctggtggtgaactacgacctgccgcgctcgccggccgactacatccaccgcatcggccgcaccggccgcgccggcgccagcggcgaggccatcagcttcgtcagcgccgattgcgccgcccacttcaagctgatcgaaaaacgccagcaactgcggctgccgcgcgaacggatagacggcttcgaaccgagcgaggccgccgcgccagccgcctctctgacggacccggacggcaacggcggcatcaagggcaagcgcaaaagcaagaaggacaaattgcgcgaagccgccgcgcagcaaaccgcagccgaccgatga

SEQ ID NO: 1696 - DNA, 867 bp, Chromobacterium substugae
atgatgaaacgattgcattgtgttttgggcatcgccatggcggcgttgctgagcgcctgcggcagtttgcagagtatcccggcggcgaaagtgccggccgctgtcgcggcgaatggggtggcgctgagccaagcccgtccgaccaaggatgaagtcgattcccgctcctatgaaattcccgaacattccgcttttgtgcggcaaacttcgggaggcagcgtggcggtgggggtattgctgggaccgctgggggtgttggccaattcgatgaatatcgaccgcctgacccaggatatgggcgaatccggcaagtcttccgctttgtaccagctggatgcgcgggcggaagccatcgctgcgatcggcgacgagctgggcaagctcaacgccggcagcattagggacaaggcggcgttgaagccttacctgatgtacttcgtcgccgacgagaaggttggcattcaggttcaactgcatttgcgcgccgagtccaccgtggaggaagacggcaagagcaagccctgggtcggcgaatacgtggtcttgctgcgcgatgccctgccgttttccgcgttgacgagccaggatccggccgctttgcaggcgctgcgcggcgatatcaaggcgggatatcgcgaattgctggacgaaatggccaaggatttcagcgccggggcgctgccgcgccgcgatatcgcctgggttatcgcgccggttctcggtctgggcatgcctggcgatatcgaatacaacgcccagggccacatggtgctgcgctcgcaatggggcaagtacaatctggtgattttccaggacaagaaaagctatgccttcagcaatggcccggtgccgcgcgagcaaggctga

SEQ ID NO: 1697 - DNA, 88 bp, Chromobacterium substugae
ggagaggtggatgagtggtttaagtcgcacgcctggaaagcgtgtttagggtaataccctaacgggggttcgaatccccccctctccg

SEQ ID NO: 1698 - DNA, 88 bp, Chromobacterium substugae; identical to SEQ ID NO: 1697

SEQ ID NO: 1699 - DNA, 1179 bp, Chromobacterium substugae
ttgatcgtccgattttacctgaagatggcgtcggttcagaaaggaaaagcattgcagctgcaactgtatgacggcgtggccgccataaagcggccggcgtggccgcagggagagggcgcgggcgtgttcgtcggccaagcatggctgacggcgctggaggagaccggctgtgtcggcggcgccaccggctggcaaccgatgccgctggcgctggagcgcgacggccaagcggtggcgctggcgccggcttatttgaaacggcacaaccgcggcgaatacgtgttcgattggtcgtgggccgaggcttacgcccgttccgggctggattattacccgaagctggtggtggcctcgccattcacgccggtgactggcggccggctgctgggcggcgcggacgagcaggcgcatctgatcgccggcctgcggcaactggtggacgacaacggcctgtcgtcggcccacgtgctgtttccgactgcggacgaggccagccggctgcggcaggccggttggctgctgcgcgacggcgtgcagttccattggcgcaatcgcggctacgccgatttcgacgatttcctcgccacgctcagccgcgacaagcgcaagaaaatccgccaggagcggcgcaaggtggcggaggccggcgtcgaagtgagggccttggccggcgcggagatctccgacgccgattggcggctgttctaccgctgctaccggcagacctatctggagcatggctcggcgccctatctgaacctggatttcttccgtctgataggcgagcggctggccggccattgcgtgatgttcgtcgccagccgcggcggccggccgatagccgccagcctgtgcatgcgccagaacgatgtgctgtacggccgctactggggtgcgctggacgacgtgccctgcctgcatttcgaactgtgctactaccagggcttggaatatgcgatcgcccagggggtggaggccttcgaaggcggcgcccagggcgagcataagctggcgcgcggtttcgagccggtggccacctgttccgcccactatatcgccgatggccgtttccgcgccgcgatcgccgcctggctggagcgcgaaaggcaaggcatgggcgattatgtggacgagcttttttcacattccgcttataaaacgcttgcgccagacgaatag

SEQ ID NO: 1700 - DNA, 1593 bp, Chromobacterium substugae
atgcgtatcgcactcgcccagttcaaccccgtcgtcggcgacatcgccggcaatgccgaaaaaatcctgtccctggcccacgccgccatcgcccaaggcgccgacgtgctggtcacgccggaactggcgctgaccggctacagcccggaagacctgctgctgcgcgaaagcttctaccgcgaggtggccaagggcctggacgccatcgagcaactggacggcatcaccgtgatcgtcggccatccggcgcggataggcaatgagcgcttcaacgccgccaccgtgctgcgcgacggcaatcgcctgggccagtaccacaagatgcagctgcccaataacgaagtgttcgacgagtgccgctacttcaccccgggcgccgcgccgctggtgttcgagcagaacggcgtcaaggtgggcgtgctgatctgcgaggacatctggcatctggagcccgccgcggaaaccgccgacgccggcgccgagttgatcgtggcgctcaacgcctcgcccttccaccgcgacaagatcgaaacccgccagcaaatggcgcgcttccgcgtcgaggaaaccggcctgccgctggcctacgtgcagatggtgggcggccaggacgaactggtgttcgacggcgcctccttcgccgtcaacaaggatggcgaagtcgtcgcccaggccgcagcctacgacgaggagctgctgctggtcgactatgccgacggcgacttccagcccggcaagcaagccgcgctgccggacgcgctggaaagcgtgtaccgcacgctggtggtcggcgtgcgcgactacatagtcaaaaacggcttccccggcgcgctgctcggcctgtccggcggcatcgactcggcgctgacgctggcggtggcggtggatgcgctgggcgcggacaaggtgcacgcggtgatgatgccgtcgcgctacaccgccgacatttccgtggccgacagccgcgacatgatcgcccgcctgggcgtcaagtacgacgaaatcgagatctggccgatgtacgaaagcttcatggccgcgctggcgccgtcgttcgatggcctggcgatggacaccaccgaggagaacctgcaggcgcgcatccgcggcaccctgctgatggcgctgtccaacaagagcggcaagctggtgctgaccaccggcaacaagtcagaaatgaccaccggctactgcacgctgtacggcgacatggccggcggcttcgcggtgctgaaggacgtggccaagaccctggtgttcgagctctgccgctggcgcaacaacgtgtccgacgtgatcccggaacgcatcatcacccgcccgccgtcggccgagctgcgcccggaccagaaggaccaggacagcctgccgccgtacgagattctcgacgccatcatggcgcgctatgtagaaggcaaccagtcggccgccgacatcatcgccgccggcttcgccgaagcggacgtcaaccgcgtggtgcggctgttgaagatcaacgaatacaagcgccgccaggcgccggtgggcccgcgcgtcacccagcgcggcttcggcaaggactggcgctacccgatcaccaaccgcttcagctga

SEQ ID NO: 1701 - DNA, 1116 bp, Chromobacterium substugae
atgactcgcatcaaactggccgccgccgcggcgctttcctccctcgccctgctgaccggctgcgccacgccgctggccggcaagccggccgacgaggcaacccgcaaggtaatcgctcagaactggcaaaacgccagctacaatttcgacggacagctcggcttcacccagctgcgttttatcgacagcgaaggcaaactgagccagcccgacatcgccgacaccgtcgatcaggtcggccgctccatcaagatgaacatcagcggcgccatcgacgcgccgaccggccgactggagctgacaccggaactgcgcttcgagcgccgcaacctgctggccagcgtcaaggtgccgctgcagttccacgcccaggacatgtcgctgctggtggacccgtccgccatcgacctggccctgccctcgctgcgcaaaaaccccggcaaattcatccgcgccaaactgccggcagacatcgccgccaagatcccgctgaaggaaatgtaccaggcgatgccgcagattctcgaccaggcctacgcccaagtggacaagaaagccttcagcttcgagccgctggacgcctatgccgacgaggtcggcgccaagtacaagctgcgcctgaccctcagcaaggaacaggagcagaaaatgacgctgcagatcctggacggcctggccaaggccgcccatcagcaggctgcccaaccggatgacaagttcaacgccgaatccatgctcacgctggtgcgcgacctggtcaagctcagccccgccggcgaaatgaacggccagaccgtcagcgacatctatgtcagccgcggcggcgagcttgaagccatccgccagaccatccacatgaccagcgccgaattcagcgccgatgcctacttcaacctgcgctacagccatcatggcaagccgcagttcgtctaccagccggccgaaagcgacatcatcgactacgacaagctggagctgccggactggctgaagagcaaggccggcgccgacgaagcgcccgccgccgatgccgccctgcccgccccggcctacccgcagccggccgcgcccgccgccaaggccaagaagagaaaggccaaaccgcgcgcgcagtaa

SEQ ID NO: 1702 - DNA, 618 bp, Chromobacterium substugae
atgaaaccgctcaagctcgccctgaccgccgccgccctggcctgcctggccgtgccggcgcacgcctccgccatcgcccagctgaaggcttttgtcgccggcagcaagaccctcagcgccgacttcacccagctggtgaccaacaagggcaagcgcgaggaagccagcggccggctggaaatcgcccgtcccggcaaattccgctgggaatacagcaagccctactcgcagctgatcgtcggcgacggcaagacgctgtggatctacgaccaggacctggcccaggtgacgcgcaaggcccagggcgcggcgctgggctccagcccggcggcgctcttggccggcagcaacgccatcgagcgcgactaccggctgaacgaggccggcaagcagggcgatgtggagtggctgaccgccagccccaagaagcaggacaacaccttcagcagcgtgcgcatgggcttcaagggcaatatgctggtggaaatgcagctgaccgacagcttcggcaacgacacccgcgtcagcttcgtcaagccgcagcaaaacgtggtgcttccggccaaccgcttcgccttcgtcccgcccaagggcgtggatgtggtcagcggcgactga

SEQ ID NO: 1703 - DNA, 801 bp, Chromobacterium substugae
atgcctgatgccgttcaacaacacgatgtttttcattacaaccaggccgcctgggaccgccaggcgcgcgccgattgcgagtggtcgcggccggtggatgccgccgccatcgccgaagcccggcggggccgtgtgctggcgcggctgacgcccagccccttgcccgccggctggctggacgacgcgcgcggcctggacgtcttgtgcctggccggaggcggcggccagcaggcgccgctgctcgccgccgccggcgcgcgggtgacggtattggacgcgtccgttgagcagctggcgcgcgaccgcgaggtggccgagcgcgagagcctggcgttccggctggagcagggcgatatgcgcgatctgtcgcgcttcgccgacgcgagcttcgactgcgtgttccatccgatctccaatctgtatgtgccggatgtagcgccggtgtggcgggagtgccatcgagtgctgagaccgggcggacgcttgctggcgagcttctacaacccggcggtgttcgtcgccgaccgcgatcctgcgctgatggagcagggcctgatccggccgcgattcgccattccatacgccgatcccgagcatttgtccgaggccgagctggaggcgaagcgaacgaggggcgaggcgctggtgttcggccacagcctggacgagctgatcggcgggcagacggcggcgggctttctgatcgccggttttcacgaggactggcagccgcggccgcgcttcctgatcgaccgctatctgccgaccttcatcgccacctgggcgctcaagccggcgtga

SEQ ID NO: 1704 - DNA, 597 bp, Chromobacterium substugae
atgaagaatccccccgcgctggagcatttgattgccgcgctgaaagtcctgcccggcgtcggtcccaaaaccgcccagcggatggctttccacctgctgcaacgcgacaagaagggcgccgacaagctggcgcgcgcgctggaccgggcgctgacccagctgacccactgccagcgctgcaataccttcagcgaggccgagctgtgttccatctgcgccgacgaaggccgccgccaggaccagctgtgcatcgtggaaatgccggccgacctgatgatgctggagcaggccaagtgtttcgagggcctgtatttcgtgctgatggggcggatatcgccgctggacaatatcgggccgaaagacctgaatctggacaagctgctgacccgggcgctggacggccaggtcagcgagatcgtgatcgccaccaacttcaccgccgagggcgaggtgacgtcccacatgctcagcgagctgttcaaggagcgcggcctggccgtcacccgcatcgcgcgcggcatgccggtgggcggcgagctggagtatgtcgatctgggcacgctggcgcaggcggtgtacgagcgccgcggcgtgtaa

SEQ ID NO: 1705 - DNA, 444 bp, Chromobacterium substugae
atgttcggccatttcaccatgcgcagccggctgccgcgcccgccggaaacggtatggcgcgatgtcgtcagccgcggtggcatcgccgacgaattcttcccctggcttggcatgcggctcccggcgggcgagctgcccgcgcggctggaagcgccgctccgcgtcggctcttgctggctgctgctgttcggctgcctgccggtggagtgcgacgatctgacgctgatgcggctggagccgggcgctttcgacgagcgctcccgcatgctggggcagcgcgtctggtggcaccgccgccgggtggccgccacggcagatggctgcgagctggtggaccgggtggcgttcctgccgcgctggcccgccacgctgccgctgtgccggcttctgtttcggctggtgttcgcttggcgccatcgccggctgcgccggcgctatcgctga

SEQ ID NO: 1706 - DNA, 297 bp, Chromobacterium substugae
atgaagcaggcccagcaaatgcaggaaaacatgaagaaggcccaggacgagctggccacggtggaagtcgagggccagtccggcgccggcatggtgaaggtcgtcatgacctgcgcccatggcgtcaagcgcgtcgccatcgacgacagcgtgctggatgacaaggaaatgctggaagacctgatcgccgccgcgttcaacgacgccgcgcgcaaggtggaaagcaccacccaggagcggatgtccggcttcaccaacggcctgaacctgccggccggcatgaagctgccgttctga

SEQ ID NO: 1707 - DNA, 1929 bp, Chromobacterium substugae
atgagctatcaagtccttgccagaaaatggcgccccaagcgtttcgccgacctggtcggccaggaacacgtggtgcgcgccctcagcaacgccctcaaggaagcgcggctgcatcacgcctacctgctgaccggcacccggggcgtaggcaagaccaccatcgcccgcattctggcgaaaagcctgaactgcgaaaccggcagcaccgccgacccttgcggcgaatgctcggcctgccgccagatcgacagcggccgcttcgtcgacctgctggagatcgacgccgcgtccaacaccggcatcgacaacatccgcgaagtgctggaaaacgcccagtacgcgccgaccatgggccgttacaaggtctacatcatcgacgaagtgcacatgctgtcgaaaagcgccttcaacgcgatgctgaagacgctggaagagccgccggcccacgtcaagttcatcctggccaccaccgacccgcagaaggtgccggtgacggtgctgtcgcgctgcctgcagttttcgctgcgcaatatgacgccgcagcaggtgtccacgcatctggcgcacatgctggacgtggaaggcatcgcctatgagacggcggcgctggcgctgctgggccgcgccgcggccggctcgatgcgcgacgcgcagtcgctgctggaccaggccatcgcctacggcctgggcgaagtcaaggaagacggcgtgcgcgccatgctgggcgcggtggaccgccgctatctgtacaccctgttgcaggcgctgtccgccggcgacggcgcggcgctgatggcggaggcggacaatctggccgagcgcggcgtcagcttcgacgcggcgctagccgaactggcggtgctgttgcagcagttggcgctggcgcagacggtgccggcggcgctggccgacgacgagccggagcgcgaggccttgttcgcgctggccgacgccatcgcgccgcaggacgtgcagctgtattatcagatcgccatccatggccgcaaggatctggcgctggcgccggacgagcatgccggcttcaatatgacgctgctgcgcatgctggctttccatccggtcaacgcgccggccgaagccgcggcgccggctcgtgcggctgtcgcgccccaggccaggcccgcggccgcatccgccgcagtagcctccgtctcggtgccggcggagcggggcatgtcgccggcggcgcgcgccctgcaggcggctggcttggcggcgccaacgccggccaagtccgcgccgcgcgcggccagcgaagaaagcgtcccggccgccgagccggaacccgagcccgcgccccggccgcagcctgcgccggccgccgcgcccgcgcctgaagcgcttgtcgccgcgccggctccggcgccgcaaccgcagctggtcgcaacggcaagcgaggcggacgatgatggccgcgacgaggacgaaatcgacgacacgccgtggcaggccgatgacggcgacgcgatgcccgactacgcgcaggcgccgccgccggacgacgagccggtcgactaccagttcgacggcgactggcaggcgctggtggtggatctgggcggcaagctgggcgcggcgcgaatgctggcgcacaatgcggtattgaaaggctggaaccagcagcggctggagctggcggtgccggaaagcttccgccacatgagcggacgcgattaccaggacaagctgaaggccgcgttgagcgagcgcttcggccgggcggtggagctgacggtgacggtggaggaactggggatggaaaccccggccatggtcgacgcccgccagcgccaggagcaattggccattgcccgagaatgcatgaaaaacgatccggtggtgcagcaactggtgcgcgaaatgggcgccgcgctgctcatcgagaccatccaacccgtacaggagtga

SEQ ID NO: 1708 - DNA, 1044 bp, Chromobacterium substugae
atgaaatcgatgttgaaactggctattgccgccgccctggccggcgcggccttctccgcgccgcaggcccaagccgacgccgcctttctggggcgcccggacgtgcagcgctatatcgacgaacaggtggccagcggccaattcaaccgccccgagctggaggcggtgttcgccaatgtcgaattgaagcccaatatcatccgcattctggacaaaccgtccacttcgcgtccctggtaccagttccgcgcctccaccgtcagcgacaaagtcatcgccgacggcgcggcgttctggcaggacaatgccgacgcgctggcgcgcgccgagcgccagtacggcgtgccgcctgaggtgatcgtggccatcctcggcgtggaaacccactacggccgcaacaccggcagcttccggctggtggattcgctgtccaccatcggtttcgattatccgcgccgcgccgcctacttccgcggcgagctgacccagttcctgctgctggccaaggaagagggcaaagacccgctgacgctgaggggatcgtacgccggcgcgatggggctgccgcagttcatgccgtccagctaccgcaagtgggcggtggatttcgacggcagcggccatcgcgacatctggaacaacccgcacgacgccatcggcagcgtggcccattacttcagccgcttcggctggaagcgcggcgacgacgtggtggcgccggccagcgtggtgccggggccgcaggtggacaaattgctggccgacaaattcaatctgcactacacggtgggcgatttgcgcaagatgggcgtcgcgccgcagacgccgctggcggacaacgtgccggcggtgctgttcgcgttggaaagctcgcccggcgtcaccgaatactggctgggactgaacaacttctacgcgatcacccgctacaaccgcagcacgctgtacgccaaggcggtgcaggaaatcgccgaccaggtgcgccaacgctattacgccgcgctggcgcggaaactgccggagccggcatccgccgcccagtaa

SEQ ID NO: 1709 - DNA, 1020 bp, Chromobacterium substugae
atgaacgaacgcgcccaacgcctgctcaaggtcctgatcgaacgctacatcgccgacggccagcctgtcgcgtccaaggccttgtcgctgctgccggggatggagctgtcttcggcgtccatccgcaacgtgctggccgaactggagggcatggggctgatcgcctcgccgcacacctcggccggacgggtgcccaccgcgcgcggctaccgcctgttcgtcgaccgcttgctgacgatacggccgctggacgagctggcgcgccacgagctggaggccagcctgcagccggacagcccgcagcgcatcgtccaggcggcgtcgtcgctgctgtcggaattgaccagcttcgccggcgtggtgatgacgccgcagcgcagcgacgtcgccttccgccagatcgaattcctgcgcctgtccgagcgccgcatcctgatgatactggtgacgctggacggcgacgtgcagaaccacctgctgctgaccgagcgcgactacacgccgtcggaactggtggaggcgggcaatttcatcaaccagcattacagcggccaggcgctggacgcggtcacctcccgggtggagggggaattgcgccagctgcagggcgacatcgccgagctgatgtcggccgcggtgcggctgggacagaaaacgctggccagcagcggcgaggacgtggtggtcagcggcggctcgcgcctgctgcaggtgaacgacctgtccgacgacctgtcgcggctgcgcgagttgttcggcgtgttcgaacgtaagaccgaactgctgaagctgttgtcgcaaagccgcgaggcgcagggcgtgaacattttcatcggcgaggagtctggcctggtgacgctggacgaatgctcggtggtcaccgccccttaccgcgtcaacggccaggtggtcggcacgctgggggtggtcgggcccacccgcatggcttacgaaagggtgatccccatcgtcgacatcaccgcgcggttggtgggcagcgccttgtccttccgcgaatga

SEQ ID NO: 1710 - DNA, 1053 bp, Chromobacterium substugae
atggcttccgaagacaagagcaaggcgctcgccgccgccctctcccagattgaaaagcagttcggcaagggttcgatcatgcgcatgagcgacaaccagatcaacgaaaacctgcaggtggtctccaccggctcgctgagtctggacttggcgcttggcgtcggcggcctgccgcgcggccgcgtggtggaaatctacggcccggagtcgtccggtaaaaccaccctgtgtctgcaagccgtggccgagatgcaaaaattgggcggcacctgcgcctacatcgacgccgaaaacgcgctggacccgcaatacgcgcaaaagctgggcgtcaaggtcgacgacctgctgatctcgcagccggacaccggcgaacaggcgctggaaatctgcgacatgctggtgcgctccagcggcgtcgatctgatcgtgatcgactcggtggccgccttggtgccgaaggctgaaatcgaaggcgaaatgggcgacagccacgtcggcctgcaagcccgcctgatgagccaggcgctgcgcaagctgaccggcaacatcaagcgcaccaacaccctggtgatcttcatcaaccagatccgcatgaagatcggcgtgatgttcggcaacccggaaaccaccaccggcggcaacgcgctgaagttctacgcctcggtgcgcctggacatccgccgcaccggcggcatcaagaagggcgaggaagtgatcggcaacgacacccgcgtcaaagtggtgaagaacaaggtgtccccgccgttccgccaggccgatttcgaaatcctgtacggcgaaggcatctcccgccagggcgaaatcatcgagctgggcgtcaagcacggcttcatcgacaagtccggcgcctggtacgcgtacaatggccagaagatcggccagggcaaggacaacacccgcgaatggctgaagtccaacccggcgatcgctgaggaaatcgaacgcaagatccgcgaagcggtgggcgtgaagatcgaaatcaacgaaaaccagggcgacgaagagttcgccgacgacgccctcgacgcctga

SEQ ID NO: 1711 - DNA, 459 bp, Chromobacterium substugae
atggcggcgacaggcaaaagcctgaaggcgcgggccgtcgaactgcttgcccgccgggaatattcccggcgcgagctggttcggcggctcgcgccttttgccgacagcgaagacgaattgaacgcggcgctggacgagctggccgccgccaactggcaatccgacgaccgcttcgcccgccagttcgccaacagcaagggcggcaagttcggcagccgtcggctgcagcaggaaatgcgccagcgcggcgtcgacgacgacaccatacgcgaggcgctgtccggccaggacgacctggccagcgcgcgcgagcaatggcgcaagaaattcggccgcccgcccgccgacgcggcggaaaaggccaggcagtaccgcttcctcgcccagcgcggttttcccggcgacgtgatccgccaggtgctggccggcggcgcggacgacgacggctacgaggactga

SEQ ID NO: 1712 - DNA, 459 bp, Chromobacterium substugae
atgagggcgcgcgccatcgccaccgagatcgacatcaccgccgcccacgaaacggtgtggcaggtgctgtgcgactggccgcgctacccggaatggaatcctttcatcgtcggcctgcacggccgccatcggctgggcgcccgcctggtggccaccctgcgctatcccggcggcgcgcgcgccaccctgcgccccgtcgtcatcgaactctccgcgccgcaagcgctggcctggcgcagcgccgcgctgatgcccggcctgctggaccgcgaacaccgctggcggctggaagcgctggccggcggcgccacccgcctgcatcacgacggcgcgctcagcggagtgctgctgccgctgtgcggcgccggaatccaggaaagcgcgcgccggggattcctgctgatgaacgaggcgttgaaacagcgctgcgaaacccttgccagcgccgccacggcttga

SEQ ID NO: 1713 - DNA, 2634 bp, Chromobacterium substugae
atgaaaacctccgaaatccgcaagaagttcctggacttcttcgccgccaaaggccaccaggtcgtcccctccagcagcctgatccccggcaacgacccgacgctgatgttcaccgtcgccggcatggtgcagttcaaggacaccttcctcggcttcgagaaacgcgactacacccgcgccactaccagccagaaatgcctgcgcgcgggcggcaagcacaacgacctggaaaacgtcggctacaccgcgcgccaccacaccttcttcgaaatgctgggcaacttcagcttcggcgactacttcaagcgcgacgccatcaccttcgcctgggagttcctgaccggcgaacaatggctgaacctgcccaaagacaagctgatggtcaccgtctacgcctccgacgacgaggcctacgacatctggcacaagaccgtcggcgtgccggccgacaagatcgtccgcatcggcgacaacaagggcgcgccgtacgcttccgacaacttctggaccatgggcgacaccggcccctgtggcccgtgcaccgaaatcttctacgaccacggcccgtcggtcgccggcggccctccgggcagcccggacgaggacggcgaccgcttcatggagatctggaacaacgtcttcatgcagttcaaccgcgacgaagccggcacgctgcacccgctgccgaagccgtcggtcgacaccggcatgggcctggagcgcctgtccaccgtgctgcagcacgtgaagtccaactatgaaaccgacgcgctggcctgtctggtgcgcgccgccgcccgcgaaaccggcgtcgcctacagccaggacgtgccgtcgctgaaagtgatcgccgatcacatccgcgcctgctcgttcatgatcgccgacggcatcctgccgtccaacgaaggccgcggctacgtgttgcgccgcatcgcccgccgcgcgatccgccacggctacaagctgggccagaaaggcctgttcttccacaagatcgtcgccgacctggtggccgagatgggcgaagcctatccggaactgcgcgaaaagcaggcgcatatcgaagacgcgctgcgcgccgaggaaatcaagttcgccgaaacgctggaaatcggcatgggcctggtggactccgcgctggaaggcggcaagaaagcgctggacggcgacaccatcttcaagctgtacgacaccttcggcttcccggtggacctgaccgccgacatctgccgcgaacgcggcatccacgccgacctggaaggcttcgagcgcgcgatggaggcccagcgcgagcgcggccgcgccggctccaacttcaagatgaccggcaaaatcgcctacagcggcgccggcaccgccttccacggctacgacaagagcagcgtggaagcaaaaatcctggcgctgtacaagggcaccgaagcggtggacagcctgtccgccggcgacgaaggcatcgtggtgctggacggcaccgccttctatgccgaaggcggcggccaggtgggcgacgtgggcaagatttccgccaccgccggcctggacgcgctgttcgacgtggccgacacccagaagatccagtccgcggccttcggccacaagggccggctgctcagcggcgcgctgaaggtgggcgacgccgtcaccgccaccatcgacctgcatgcccgcctcgccagcgcgcgcaaccactcggccacccacctgctgcacgcggcgctgcgccatgtgctaggcagccacgttgcgcagaagggctcgctggtcaacccggagcgcacccgcttcgacttcgcccacggcgaagccgtgacggccgaacagatcgccgagctggaacgcgtggtcaaccgcgtgatctgccacaacgtggaagtgaaggccgagctgatgagcatggaagacgcgcagaaatccggcgcgatgatgctgttcggcgagaaatacggcgatgaagtgcgcgtgctgaccatgggcgatttctccgccgaactgtgcggcggcacccacgtcaagcgcaccggcgacatcggcctgttcaagatcgtcgccgaaagcggcgtggccgccggcgtgcgccgcatcgaagccgtcaccggcgaaggcgcggtagcccacgtgcaggcgcaggacgccctgctgaaggatgccgccggcgcgctgaaggcgcagaccagcgacgaagtggtggccaagatcgccgcgctgcaggatggcgccaaggcgctggagaaggagctggccaagctgaagggccaactggccgcctccgccggcgacagcctggccgacagcgccgccgtggtgagcggcgtcaaggtgctggccgcagagctggaaggcgcagacaacaccgcgctgcgcgaaacgctggacaagctgaaggacaagctgggctccgccgccatcgtgctggccgccaagggcgacggcaaggtggcgctggtggccggcgtcaccgccgacctgaccggcaaactcaaggccggggagctggtcaacttcgtcgcccagcaagtgggcggcaagggcggcggccgcccggacatggcccaggccggcggcacgcagccggaaaacctggccgccgcgctgaagggcgtggaagcctgggtagccggcaagctgtaa

SEQ ID NO: 1714 - DNA, 492 bp, Chromobacterium substugae
atgtccgccatagaactccgccaggccagctgggatgacctgcccgcggtatgccagctgatccagcaggccttcgcgccgctgctgacgcagctgccaagcccgccgaccgcgctggatgaaaccgtcgccagcctcaccggccacctcagcagcggcagccagatcttcgtcgccgtcaggcaatcgcgcatcgtcgcctgcctgctggtgctgccgccggaaaacggctgcgccgaaatcaagcgcgtctgcacccatcccgacctgcaaggccagggcctgggcgcggcgctgctcgattacgccgagcaagagctgcaacgccagggcgtgcagcagctcaagctatccacccgcagacgcctgcccagcaatctgcagttctaccagcggctgggctacgaggtcagcgcgcagcaaccgtatccgcagggcatagacgacgaacgcgtcacgctgagcaagccgctggcggagctggtgtgctga

SEQ ID NO: 1715 - DNA, 306 bp, Chromobacterium substugae
atgcgcctgctccgcgccgccttcctcgcttgctgcctgcaagcgctgcccgcctgcgccgacctgccccagccagacatctacgcgctgaccgaaatcctgccgccgctcagctacggcgagggcggcgagcacaagggcttctccaacgaattgctggcgatgatgctgcgcgacagcggcctgcgcgccgtcatccaagtcaagccctggagccgcgcgctgcgcgaggcgcagcaagcgcccaacaccatgctgtatctggccgtgcgcacgccggagcgggaagagatgttaaatggatag

SEQ ID NO: 1716 - DNA, 357 bp, Chromobacterium substugae
atggtggcggtggcgcgcgacacgccgggacagaaaatgatggagaagctgggcttcgtcgacaatgtcaatctggtgctgaccaatgacgaggcccagtcggccaggctgctgtacgcccgtcgcgtgcaatacagcgtcggggtcggcttgttccagcgttacgccgccaagcagcagaaccagcagccggacaggctggattcggtgcaggtgctggacgacagcacccagttctatttcgcgatgcagagggacagcaatcccgactacatcgcccggctgcaggccgcgctggacaggatcaagcaggatgggcgctacgcggctttgctaaggcgctacacccacccctga

SEQ ID NO: 1717 - DNA, 768 bp, Chromobacterium substugae
atggatttgggatatacggttgcgggcctggcggtgggcttcatcgtcgggctgaccggagtgggcggaggctcgctgatgacgcccattctgctttggttcggcatctcgcctgccaccgccgtcggcacagatctcttgtacgccgcgctgaccaaggctggcggcgtggctgcgcatcaccggcagcgccacatcgactggcgcatcacgctgcacctggcgctgggcagcgtgccggcggcgatgctgacgttgggcctgttgagctggctgcacgtgccgtcgcaggtgatggacgcgctgttccgtttcgtgctgggcatcgccttgctgctgactgccgccgccatcctatgcaagccgtggctggtccgcctggggcagcgccatttcggcagcctgggcgtaggcgagcggctgtggccgaccgcgctggtcggcgcggtgctgggtgtgctggtcacgctcagctccatcggcgccggggcgctgggcacgctggccttgtttctgctgtacccggctttgccgacttcgcggctgatcggcaccgaaatcgcccacgcggtgccgctgacgctggtggcgggcctgggccatgccggcatgggccacctggactgggtgctgctgctcaagctgctcagcggctcgttgcccggcatctggctgggcagccgcttgaccggcaggctggccgaccattggctgcggccgacgctggcggtgatgctggcgctggccggcggcaagctggtgttgtga

SEQ ID NO: 1718 - DNA, 117 bp, Chromobacterium substugae
gtggcgaaaccgcaactgagcgatgaggagagatcccgccagcaaaaagtgcggcaacgcgcgcatgaccgcgacgacgcccgcttcctggctgatcgctgcgacgacctgttctga

SEQ ID NO: 1719 - DNA, 1809 bp, Chromobacterium substugae
atgacaacacccgccatgctccaactggggctgttcctggccgtgcttctggcgctggcctggcctcttggcgcgtacatgacgcgcatcatgcagggggagaacgttggtccggtactctggttcgcgccgctggaacgcggcttctaccggctggccggcattcagaaggatgaggagatgggctggcgcggctataccgtggccctgatcctattcaacgtgctgggcgcgctggccgtctacgcgctgcaacgtctgcaaggctctctgccgttcaacccgcaggcgatggccgcggtcagcccggactcctcgttcaacaccgccgtttccttcgtcaccaacaccaactggcaaggctacggcggcgaaaccacgatgagctacctgacccagatgctgggtctgaccgtgcagaacttcctgtccgccgccaccggcgccgcggtggtgatcgcgctgatccgcggcttcgtccgccacagcagcgccaagatcggcaacttctgggtggatatcacccgcctgacgctgtacatcctgctgccgctgtcgctggtgttcgcgctggtgttcacccagcaaggcgccatccagaacctggccgcctacaaggacgtgcacacgctggaagtcaccaagtaccagcaacccaaggtcgacgccaagggcaacccggtgaccggcaaggacggcaagccggtgatggaggacaagactgcgcagacgcaaactctgccgatgggtccggtggcctctcaggaagccatcaagatgctgggcaccaacggcggcggcttcttcaacgccaactccgcccacccgtttgaaaacccgacgccgctggccaacttcctgcaggacatcgccatcttcctgatcccggccgcgctgtgcttcctgttcggccgcatggtgggcgaccgtcgccagggctgggccatcatcgccgcgatgaccatcctgttcgccaccgcggtggtcgtggaaaccagcgccgagcaggccggcgtgccgcaatacaaggcgctgcacatcgaccagcaagccagccacctgcagtccggcggcaatatggaaggcaaggaagcgcgcttcggcatcatcgacacctcactgttcatcgccgtgaccacctccgcctcctgcggcgcggtcaactcgatgcacgactcgctgaccccgatcggcggtctggtgccgatgttcctgatgcagttgggagaagtggtgttcggcggcgtgggttccggcctgtacggcatgctgatcttcgccatcctggcggtgttcatcgccggcctgatggtgggccgcaccccggaatacctgggcaagaagattgaaacctacgagatgaagatgaccgcgatcaccattctggtgaccccgaccctggtgctggcgctgaccgccatcgccgtgagcgtggccgcgggcaaggccggcatcgccaatccgggcgcgcacggcttcagcgaaatcctgtacgcgttcacttccgccgccaacaacaacggcagcgccttcgccggcctgtccgccaacacgccgttctacaacatcgccaccggcgtcgccatgttcttcggccgcttcttcatgatcgtgcccatcctggccatcgccggctcgctggccgccaagaagcgtctggccgtcaccgccggcaccctgcccacccacggcccgctgttcgtggtgctgctgatcggcaccgtgctgctggtgggcgccctcaactatgttccggctctggcgctgggcccggtggtcgagcagctgcaaatgctcgccgtccactaa

SEQ ID NO: 1720 - DNA, 2121 bp, Chromobacterium substugae
atgaacgacaagaatcatttgaaatccgtggtggcggaacctatcgccaccggcaacaagaacgccggcaagtcgatgttcgacccggcgctggtgaaacccgccatcgtcgattcgttcaagaagctgtcgccgcgcacccagtggcgcaacccggtgatgttcgtggtgtacgtgggcagcattctgaccaccgcgctgtggatacagtcgctgggcggccacggcgaagcctcgtccggcttcatcctgggcgtggcgctgtggctgtggttcaccgtgctgttcgccaacttcgccgaagcgctggccgagggccgcagcaaagcccaggcggcgagcctcaggtcggccaagaaaaacgtggtggccaagaagctggcaggcggcaaccatggcgcggccaagaccatcgtcgacggcaccagcctgcgcaagggcgatttcgtattggtggaagccggcgacgtgatcccggtggacggcgaggtgatcgaaggcgtggcctcggtcgacgaatccgccatcaccggcgaatcagcgccggtgatccgcgaatcgggcggcgatttctcctcggtcaccggcggcacccgcgtgctgtccgactggatcgtggtgaagatcaccgtcaatccgggcgaaaccttcctcgaccgcatgatcgcgatggtggaaggcgccaagcgccagaagaccccgaacgagatcgcgctgaccatcttgctggtggcgctgaccatcgtgttcctgatcgtgaccgtcaccctgctgccgttctctctgttcagcgtggacgcggtcaaggccggcaccccgatcagcatcaccaccctggtggcgctgctggtgtgcctgattccgaccaccatcggcggcctgctgtcggccatcggcgtggccggcatgagccggatgatgggcgccaacgtgatcgccacctccggccgcgcggtggaagccgccggcgacgtcgacgtgctgctgctggacaagaccggcaccatcaccctgggcaaccgccaggcctccgccttcatcccggcgccgggcgtgtcggaaaaagacctggccgacgcagcccaactggcctccctggccgacgaaacgccggaaggccgctccatcgtggtgctggccaagcagaagttcaatctgcgcgagcgccagctggccagccatgaagccagcttcatcgccttcagcgcgcaaacgcggatgtcgggcatcgactacgacggccgccagatccgcaagggcgccatcgacgcgatccgccgccacatcgccgaactgggcggccagttcccggacgcgctggcgaaaagcgccgacgaagtggcccgccgcggctccaccccgctcttggtggccgaaggcaaccgcgcgctgggcgtgatcgaactgaaggacatcgtcaagggcggcatcaaggagcgattcgccgaactgcgccagatgggcatcaagacggtgatgatcaccggcgacaacccgctgaccgcggccgccatcgccgccgaagccggcgtcgacgacttcctggcggaagccacgccggaagccaagctgaagctgatccgcagccatcaggccgaaggcaagctggtggcgatgaccggcgacggcaccaacgacgcccccgcgctggcccaggccgacgtggcggtggcgatgaacaccggcacccaggcggccaaggaagccggcaatatggtggacctggactccaatccgaccaagctgatcgagatcgtcgaaatcggcaagcagatgctgatgacgcggggttcgctgaccaccttctccatcgccaacgacgtggccaagtatttcgccatcatcccggcggcgttcgccagcacctacccgcagctgaacgcgctgaacgtgatgggcctgaacagcccggcctccgccatcatgtcggcggtgatcttcaacgcggtcatcatcgtgttcctgatcccgctggcgctgaagggcgtgaagtaccacgccaagagcgccgccgagctgctgcgcggcaacctgctggtctacggcctgggcggcctgctggtgcccttcgccggcatcaagctgatcgacatggcgctgggcgcgctgggtctggtgtaa

SEQ ID NO: 1721 - DNA, 579 bp, Chromobacterium substugae
gtgaaagtcattcgtcccctgctggtgatcttcggcggcctgtcgctgctcaccggcctcgcctacccgctggccaccaccggcatcgcccaggcgctgttcccggcgcaagccaacggcagcctgatcgagaaagacggcaaagtggtgggttcgcgcctgatcggccagaacttcaccggcgacaagtatttctggggccgcccgtcggccaccagcccgatgccgtacaacgccggcaactccggcggctccaacctgggccccaccaacaaggcccagctggacgcggtgaaaggcaatgtcgacgccatccgcaaggcgcacccgacccagaccggcccggtgccggtggacctggtgaccgcctccgccagcggcctcgacccggaaatctcggtcgcctccgcctattaccaggttgaccgcgtcgccgcggcgcgtaaactgccggcaaccgaagtgcgcaagctggtggaaggccgcatcatcggcgaaaccttcggcctgctgggcgaaccgcgcatcaacgtgctggagctgaacctggcgctggacgaactttccaagaaagcctaa

SEQ ID NO: 1722 - DNA, 2688 bp, Chromobacterium substugae
atgaccgatctgcgccccgacccggatgccctgctggacgaattgaaacgcgaagagctggacgcccagcgcggccggctgaaaatcttcttcggcgcctgcgccggcgtaggcaagacctacgcgatgctggcggcggcgaaaaccaagcagcaggaaggggtcggcgtgctggtcggcgtggtggaaacccacggccgcaaggaaaccgaggcgcagctggccgggctggaggtgcttccgcccagccagatcgagtacaagggccgcgcgctgtcggaattcgacatcgacacggccctctcgcgccgcccgcagttgatcctgatcgacgagttcgcccactccaacgtccccggctcgcgccatcccaagcgctggcaggacgtggaggagctgctcgccgccggcatcgacgtctacaccactctcaatgtgcagcatctggagagccttaacgatgttgtcggccagatcaccggcatcatcgtcagggaaacgctgcccgaccatgtgttcgacagggccgacgaagtctcgctggtggacctgccgccggacgagctgctgtcccgcctcgccgccggcaaggtctacctgccgcaccaggccgagcgcgcggtcaagaatttcttccgcaagggcaatctgctggcgctgcgcgaactggcgctcaggcgcaccgccgaccgcgtcgacgcgcagatgcgcgcctaccgcgccgaccagtcgatcaacccagtctggcacgcgcgcgaacggctgctggtctgcgtcggccccggcccgggcaccgacaagctgatccgcagcaccaagcggctggccgccaatctggacgccgactggatcgctgtctatgtcgaaacccccagcctgcagcggctgccggaggaaaagcgcgcgcgcatcctcaagggcctgaagctggcgcaagagctgggcgcggaaaccacggtgctgggcggcagctcgctggccgccaccctgctggcctacgcccgcacccgcaacgtctccaagctggtggtcggcaagtcggccagcagcccgctggcgcggctgtggcgcggctcgctggtggaggagcttacccgtcagtccggcgacgtcgacgtctacgtggtggcccacgacctggacccgtccgacgaaaagagcggcaagcgcgtgcccagcctgctgttcagcgacggcgaatccggcaagccgcagcgcggctacctggccgccgccgcggtctgcgccgccaccaccgcgctcaaccacttgctggtgccctacttcgcgctgtccaacgtcatcatggtgcacctgctggcggtggtgctgatcgccacccgctacggccgcggccccggcgtgctggcgtccttcctgtcggtggcggccttcgatttcttcttcgtgccgccgcagctgtcgttcgcggtgtccgacacccagtacctgctcaccttcatcgtgatgctggtggtggcgctggtgatcagccagctgaccgcccgcttccgcttcgaggccaccatcgccacctaccgcgagcgccgcacccgcgcgctgtacgacctgggccgcgagctggccggcgcgctgaccgcgtcgcagatcatcgacaccgcggtcggccggctggagccgctgttccgcgccaaggtgatgctgttcatccccaatagcgaagaccagctgcgcgccgccaccgaggccggcaacggcgccgacaccggcgtcgcgcaatgggtgttcgacaacctgcagccggccggcctgggcaccaacacgctgccgtccaacgccgcgctctacgtgccgctgaaggcgccgatgcgcacccgcggcgtgatcgcgctgctgccggaggaaacgatcccggccttcctgccggagcagcagcggctcttggaaacctgcgccgcgcagatcgcgctggcgctggagcgggtgcattatgtggaagtggcgcaagacgccatcgtggcgatggagtcggaacggctgcgcaacagcgtgctgtcggtggtgtcgcacgatctgcgcacgccgctgaccaccatgctgggcctggccaatatgctgaattcgcccagcctgccgccggagcagcaggccgacatctcgcagtcgatccaggatgaggcgatgcggatgaacaagctggtgaccaatctgctggacatggccaggctgcaatccggcgtcaagttgaacaaggaatggcaactgctggacgaggtggtgggcagcgcggtacgcgcctgcgagcacagcctgcgccgccatcatttggcgctaaaactgaaccgcgacctgccggtgctggaatacgacgcggtgctgatcgagcgggtgctggtcaacctgctggaaaacgccgccaaatacacgccggccggctcgcgcatcgagctggcggcccagcacgacggcgcccgggtgcgcatcagcgtcagcgacgacggccccggcctgccggccaatatggaacagaaagcctttgagaaattctcgcgcggcgcgccggaatccaccacgcccggcgtcgggctggggctggccatctgccgcgccatcatcgaaaaccacggcggcagcatagaagccggcaacctcagcccgcacggcgcccgcttctccttcaccctgcccgccggcgcgccgcccgagctgccgccggaagacgcctga

SEQ ID NO: 1723 - DNA, 720 bp, Chromobacterium substugae
atgaacgacgcaccgatttccgtagtgatcatcgaagatgaaaaaccgatccgccgcttcctgtcgtcggcgctggatgaggaaaggctcaccgtctacgaggccgaaaccggcaagcagggccagatagaagtggccacccgcaaacccgacatggtgatactggacctgggcctgccggacatgaacggcatcgacgtgatcaagagcctgcgcgagtggaccgacattcccatcctggtgctgtcggcccgcacccaggaaacggaaaaggtggcggcgctggacgccggcgccgacgactacctgaccaagcccttcggcgtggccgaatgcctggcgcgcatccgcgtgctgctgcggcgccgcatccagggcagcgccgcgccgcagcagaacttccacttcggcgacatcaagatcgacctggtcaaccgcctggtgcacaagggcgatgcgccggtgcacctgacgccgatcgaataccggctgttgtccacgctgatccgcaacgccggcaaagtcatcacccaccgcgagctgctgctggcggtatgggggccgtcgttctccgagcacaaccagtacctgcgcgtctacatgggccacctgcggcaaaagctggaagacaacccggcgatgccgcgccacatcgtcaccgaaaccggcgtcggctaccggctggtggaaagcgaccccagccgcaaccagaccgcctga

SEQ ID NO: 1724 - DNA, 300 bp, Chromobacterium substugae
atgtacgattgccagcaagacagctatgccgatttttcttttgcgatttacgacgccgtgggaagacctcgccccctctgtggcagcctgagcgccacaccgctgccgtccagcgacgacagcgccctttacgatctcgccgccttcgcccgcgaacagggctacagcctcgatcaccatgaacagcatctcaccgtgcacgacatcagccttgccgacgcgctggcgatcaacacccgcttcggagaaacgctgatcatcagctgcgatctgcgccgcgatccgccggtgcgcttctag

SEQ ID NO: 1725 - DNA, 1398 bp, Chromobacterium substugae
atgctgtttgaactcaaccacgcctcgcgctcggagattctgcgcgaagggcgccagatcgcccgcctggctctgccgatgatggtggcccagatcgcccaggtggccaccggcttcgtcgacaccgtaatggccggccgcgtcggcaccgacgatctggccgcggtttcgctcggcgccagcgtgttcatcaccgtctacgtgacgctgatgggcgtggtggccgcgctcaatcccatcctgtcgcaccatctgggttccggcgacgcgcgcggcttcggccgcgacgccggccagggcctgtggttcggcctgctgctgggcacgctgggcggcgcgctgatgatcgcgctggaacccgcgctgcgccagtggctgcacctgccgcaggaagtgatagccaaggtgatgctgttcatcaccggcgccgccgtcggcatgccggcggcgatggcccaccgcgcgctgcacgcctacgcgtccagcctgggccaccccaaggccatcatggtggtcagcctgatcgcgctggccctgaacattccgctcaactacatcctgatccacggcttgttcggcttcccccgcatgggcggcgccggctgcggctgggccaccggcgcggtgttctggttcaactgcctggccttgctaggctacgtgagctggcataagaaattcgccggcaaccgcatcctcgccggcatcgcccgccccgactggcgccgcttcgccgcctttttgaaactgggcctgcccatcggcctgtccttcttcgtcgaagtcagcctgttttccttcatcgcgctgctgatcgccgagctaggcaccgtcgtcgtcgccacccaccagtcggtgctgaatttctccagcctgatctacatgctgccgcagagcgtggccaccgcgctgtcggtgcgggtcggccaccacgccggcgccggcgattaccaggccgcgcgcttcatttccggcgtcggcctgctgatggggctggcgatggcgggcatggccatggtgctggtgctgctgctgcgcgcgcccatcatgtggatgtacagcgccgacccgcgcgtgatatcgatgggcaccacgctgctcttgttcgccgccgtctaccagctgaccgacgccgcgcagaccatcgcctccggcgcgctgcgcggctacaaagtgaccgccgtgccgatgctgatccacatcacctcgttctgggtggtgggcctgggactgggcatcctgctgggattgaccgaccatatcgtgccgcggatgggcatttacggcttctggaccgcgctggtgatcagcctcaccgtggccggcctgctgctaacctattatctggcccgcgccagccgccgccggctgcgccgcgaccaaggaatcctgctatga

SEQ ID NO: 1726 - DNA, 1026 bp, Chromobacterium substugae
atgagcctgcagtttagcgccgactacgatctgcgcccgcacaacaccttcggcctggccgcccgcgccgcgcacttctgccggctggacgacctggccgacctgtccgcgctgctggcgcatccgctttaccgccagggcccggtgctgtggctgggcggcggcagcaacctgctgctgacccgcgactaccccggcctggtggtgaaagtggcgctgaccggcattcgcctgctggaacagaacggcgacgatgtgctggtcgaggccgccgccggcgaaaactggcacgacttcgtgctgcacacgctggcgcaaggctggtacggcctggaaaacctcagcctgattcccggcaccgtaggcgcctgtccggtgcagaacatcggtgcctacggcgtcgaggtgaaggaccatctgcaagaagtggcgtgcgcgcagctggagcgcggcggcgaagcgctgacgctgtccaacgccgactgccgcttcggctaccgcgacagcgtgttcaagcatgaagccgccggcaagctgctggtgaccgcggcgcgcttccgcctctcccgcgcggcgcggccgcgcaccggctacggcgacatcctgcagcagctggagcggcaaggcatcagcgcgccgacgccgctggacgtcagccgcgccgtcatcgccatccgccagagcaagctgcccgacccggcggcgctgggcaacgccggcagcttcttcaagaacccggtggtatcgctgacccgcgccgaggcgttgttggccgaacacccgcagctgccgcactaccccgcgccggacggccaggtgaagctggccgccggctggctgatagaccaatgcgggctgaagggctatcgcgatggcgacgccggcgtgcatgagaaacaggcgctggtgctggtcaactacggccaggcgcgaggcagcgaaatcgaggccttggcccgcaaggtgcaggacaccgtggcgcagcgcttcggcgtcaggctggagccggagcccttgatactctga

SEQ ID NO: 1727 - DNA, 609 bp, Chromobacterium substugae
atgagcaagaaaccgactgtgctggtgttcgatctgggcggcgtgctggtcgactggaacggcatcgatccgctgatccgcctgtccggcggccgcctcagccgcgaagaggccaggctgttctggatgcatttccactggacggaaaagctggatctgggcgcatgcacgccgctggaattcagcgccgccatggcggacgagctgcggctcgacctgtcggccgaggcgatgcaggcccagttgcgcagctggaaccgcggcgccttccccggcgcgcgggcgctgctggaaaagctgtccgccgactggcagctggcggcgctcagcaatatcaacagcctgcactggcagcaggtgagcgaggaattccagctgctggacctgttcggccacaccttcgcctcgttccagctgcgcctgcgcaagccgcagccggaaatctaccgccacgtgcagcagacgctggggctggcgccggcggacatcgccttcttcgacgacaacatcgaatgcgtggcggccgcccgcgccgaaggctggcaggcattccacaccataggcttcgacagcctgcagcgcacgctgcgcgagcaaggctggctgtaa

SEQ ID NO: 1728 - DNA, 384 bp, Chromobacterium substugae
atgccgttcgtattgtggagtctgttgttggcggcgctgctgccgctgatctgggccggcgtcgccaaggccggggtgaagtacgacaatcaccggccgcgcgaggaggcggcgcgggccagcggctaccggcagcgcgccggctgggcgcagcaaaatgcctgggaggcgctgccgacctggaccgccgcggtggtcgcggcctggctgatgaaggtgccggaggcggcgatgaacgccgccgccgccgtgttcatcctggcgcgggcgacgcatggcttgctgtatctggcggacaaggcctcgctgcgttcgttgtcctggctgataggcttgctggcggcgctgtacctgttcctgcgcgccagcggcgtgctgggctga

SEQ ID NO: 1729 - DNA, 675 bp, Chromobacterium substugae
atggatctatcggctttgcagtttggcgcgtggccgctcgggctggccaatgcgctggcgctggcggccctggcctgggccggcgccggggtgcgctggcgcgagctggagcacggcgcgctcaacgcctggatgggcgcctgcgtgctggacctggcgctgtggctgttgcgcgccggcctgctgcccggcctgtccttccatctgctgggcggcgccctgttcgccttgctgatggggccgcggctggcgctgctggccctggccgcggtgcaggcggcgctagcggccggcggccacgccgactggcgggcgctgggcttgaactggctgctgaccgcgttgccggcggtgggcgtggcggcgtcggctctggccctggcgcgccgtttcctgccgccgcatttctttgtctatgtgttcgtcaacggcttcctggccgccggcgccagcctgttcgctgccgccctgtgcggcatggcggccttggcggcggcgggggcgtatccgtgggagacgctgctggacgacgccgtgccttactattttctgctgtcgtggtcggaggccttcacgaccgggctgctgctggcggtgctgattgtttacaaaccgcagtgggtggcgacgttcgatgacggccgttatctcggcgacaagccgggcaatcgttga

SEQ ID NO: 1730 - DNA, 843 bp, Chromobacterium substugae
atgcccgccctacccgctcagcacctgattgcccagcaagttggccaagccctggccgaagacatcggccaatgcgattggaccgcccgcctgatagacgcggacaagaccggcgcggcgcgggtgatcgcgcgcgaggacgcggtgatctgcggccaggcctggttcgatgaatgcttccgccaggtggacagccgctgcgctgtgcaatggcgggtggccgaaggcgagtcggtcgccgccggcagcgaactgtgccgtatctccggcccggcgcgcgcgctgctcaccgccgagcgcagcgcgctcaacttcctgcagctgctgtccgccgtcgccaccgagacccgccgctacgtcgaggccgcggccggccaccgcgcccgcatcctggacacccgcaaaaccgttcccggcctgcgtctggcgcagaaatacgcggtgaccgccggcggcggccacaatcagcgcgtcggcctgttcgacggcatcctgatcaaggaaaaccacatcatggcggccggcggcgtggccgaagcgatgcggcaggcgctgcaagacctgccgcccggcgtgacgctgcaaatcgaagtcgagacgctggcgcaactggaggacgcgttggagaacggcgccaagctggtgctgctggacaatatgtcgctggagcagatgcgcgccgccgtcgccctgagcgccggccgcgcccagctggaagcctcgggcggcatcgacctggacagcgtgcgcgccatcgcggccaccggcgtcgaccgcatctcggtcggcaagctgaccaaggacatccgcgccgtcgacctgtccatgcgcttcaccctgtaa

SEQ ID NO: 1731 - DNA, 1878 bp, Chromobacterium substugae
atggacctgaccccgcgcaaacacggctcacgctccgcccgccatgccaagtggggggcggcgctgtttctgctggtcaccctcgggctggtgctgctcgatctcgccgtcagctaccgccaggtggaaaacgaggccgggcaccaggccagcggcctgagccagctgctggcggaacgactcagctccggcatccacgaagccgggctgatcctgcaaagcagcaaccagattccggaagtccaacacctgctgcgcagcggcggccaaagccccgaggcgcagcagaagctgcaacagaagctgcagcagcaattgcagctggcgccttacctcagccaaatcgagatcgtcgacaccgcctgccagaccatcttcagcagcagccgcagcagcctgccgcgctcgcgccacaacgaattctgccgctggctgcaccgcatcgacccgcaggaaagcaattacaccgccgtcacgcacagccccaccgagggcggcatcgtgctggccaacaagctgcacgacggcgacggcaacctgataggcatggccaccggcctgatcaaccacaacttcttccaggacgaggtcagccggctgacggtgggcgagcatggcgaaatcctggtgctggaccagcgccagctcaccgtggcgcgctggccgcaggtagccgggcacgacccgcaaagctaccgcccgctgcaggcgcacatgatcctgtcgcacgacgccaaccagaccctgttcagcgcgccgtccagcttcgatggctcgatgcggctgtacagcatgcgccagaccggcaattatccgttccaggtggcggtgggcatctcgcggcaggacttcacccgctacgtctgggacaaggcctggctggccctgcccggctggctgttcgtcgccgcgctgaccttgctggcgctgcgcaagcacctgtccaatctgcgccagcaccagcagctgctgcgcggcagcgagagaatccgcgacagcgaggagcaggcccggctggtgctggacaccgcgccgctggcgctcttgctggtcaacccgcgcacctgccgcatccagcacgccaacgcgccggcgcgcgagctgctgcggctgccgccgcgcgcgccggacgaaagcgccagccacgaactgaacctgccgctgaagctgcagccggtcgagcaatggctggcggaaaacgaagacgtgatgcagcgcgaggtggagctggagctggaagaccaaagccggctgtgggcaatcgtctcgctgcagaaactgggccgcggcaaccacccgtcgtcgctgatcgcgctgtatgacatctcgggccgcaagctgctggagcagcaactgcacgagagcaatctgcagctggccgagatggcggtgaccgacccgctgacccgcctctacaatcgccgccacgccgacacggtgctgcgcgacgaaatcagccgctgcgaacgctatggccagaccatggcgatagcggtgttcgatatcgaccacttcaagaaattcaacgaccagcatggccatcaggccggcgacaacgtgttggtggcggtggccaacgccttgcgcgacaccacccgcaacaccgacatcaacgcccgcatcggcggagaggaattcatggtgatcttcccctacacccgcctgcgcgacgcccagaaagtgatgagccgcatgcagatggcgctgacccgctccaccgtgtcggtggtcgagcaaccgatcaccttcagcggcggcatcaccgactggcgacccggcgacacgccgtcgcagatggcgtcgcgcgccgacaagctgctgtacgaggccaagctggcgggccgcaacatcatcctgtgcgaccaggaaacgccctga

SEQ ID NO: 1732 - DNA, 612 bp, Chromobacterium substugae
atgtggtcgatggaggcagacgctgccgccgcgctgattgcccggcggcttgagtcctatgatttcaccggcaaggtggcggatctgccttgccggccggcggggccggaattgcggccggcggcggtgctgctgccgctggtgtggcacgacgatggcgcgacggtgctgttcacccgccgcaccgaacatctgtccagccatccgggccaggtgagctttcccggcggcaaggtggagagcggcgaccgctcgacgctggacgccgccttgcgcgaggcgagcgaggaaaccgggctggacccggccggcgtgcgggtgttggggcggctgcccgactacgtcaccatcaccggctacgtggtgacgccggtggtggggatgctgacgccgccgctggcattggcaccggcgccggacgaggtggccgaggtgttcgaggtgccgctgcgcctgttgctggatcgcgccgcttacagccggcacgactatgtccgcgacggcatcgccgggcgctacctgtccttcgagtggcagcgctacaccatttggggcgccaccgcggcgatgatgtggatgctggccgacgcgctggcggccggcggcgcctag

SEQ ID NO: 1733 - DNA, 639 bp, Chromobacterium substugae
atggaatggagcggccggtttttccagatggagtggttttcggcgatcggcaccgcggctttcgccttttccggctacctggtggggatacgcaagcggctggacctgctcggcgtttccatcgtggcgctggtgacggctatcggcggcggcgtgatccgcgacctgctggtcggacgggtgccgctggtgttctacgattacaccaacctgttcatcatcgccggcgcggtatggatcgcctggctggccggcctgcaccggcgcaagagccgcacgctggagcggctgttcatcgtcgccgattcgctggggctggtggccttcagcctggccggcgcccaggtggggctgctgttcggcctgaacgccttcggcgtggtgtcgttgggtttcgtcaccgcggtgggcggcggcgtggtgcgggacatgatggtcaatgaagtgcccttcattctgcatcgggatttctatggcacggtgtcgatactggcggccgccggattgtttctggccgaccggctgggctgggtcagcgtcgcgtcgttgcaggcgctgttctggtccggactggcgctgcgcctgttggcgcaccgaaatgaaatgaccttgccgacgctgggcgggcgcgggcggtaa

SEQ ID NO: 1734 - DNA, 1209 bp, Chromobacterium substugae
atggccatttccaacgagattgacggggccagccggctgcgcaagcaggatctgattttcgcgcttttgaaaaaccaggccaagaaaggcgagagcattttcggcgagggtacgctggaggtgttgccggacggtttcggtttcctgcgcagtccggatacttcgtatctggcggggccggacgacatctacgtcagcccgtcgcagatccgccgcttcaatctgcataccggcgactccatcgagggcgagatccgcaccccgaaggacggcgagcgctatttcgcgctggtgaaggtggacaaggtaaacggcgaggcgccggagaattccaaacacaagatcctgtttgagaacctcactccgctattccccaccgaacaattcaaactcgagcgcgacatccgtgccgaggaaaacatcaccggccgcatcatcgacctgatcgcgccgatcggccgcggccagcgcgcgctgttggtggcgccgccgaagtccggcaagacggtgatgctgcagcatatcgcccacgccatcaccgccaaccatccggacgcggtgctgatcgtgctgctgatcgacgagcgtccggaagaagtgacggaaatgcaacgctcggtgcgcggcgaagtggtgtcctccaccttcgacgagccggccacccgccacgtgcaagtggcggaaatggtgatcgagaaggccaagcgcctggtcgagcacaagaaggacgtggtgatcctgctggactccgtcacccgcctggcccgcgcctacaacaccgtggtgccggcttccggcaaggtgctgaccggcggcgtggacgccaacgcgctgcaacgcccgaagcgcttcttcggcgccgcgcgcaatgtggaagagggcggcagcctgaccatcatcgccaccgcgctgatcgacaccggcagccgcatggatgatgtgatctacgaagaattcaagggcaccggcaactgcgaaatccacctggaccgcaagatggcggaaaagcgcatcttcccggcgatgaacatcaaccgctccggcacccgccgcgaagagctgctgatcccgcaggaccagctgcaacgcatctgggtgctgcgcaagctgctgtacccgatggacgacctggaggcgatggagttcctgcaggacaagatcaaggccaccaagtccaaccaggccttcttcgactcgatgcgccgctga

SEQ ID NO: 1735 - DNA, 327 bp, Chromobacterium substugae
atgagcgatctcatccaccatgtaagcgataactcttttgaacaggaagtgctgcagtccgatctgccggtgctggttgactactgggcggaatggtgcggtccgtgcaagatgatcgccccgatcctggacgaagtctccaaggagtacgaaggccgcctgaaagtcgccaagctcgacatcgaccaaaaccaggccacgccgccgaaattcggcatccgcggcatccccaccctgatgatcttcaagggcggccaagtggtgtccaccaaggtcggcgcgctcaccaagagccagctgacggccttcgttgacagcaacatctaa

SEQ ID NO: 1736 - DNA, 786 bp, Chromobacterium substugae
atgggctttctgcaaggcaagaaaatcctgatcaccggcatgatctccaaccgctcgatcgcctacggcattgcccaagcctgtcaccggcaaggagccgagctggcgttcacctacgtggtggacaaactggaggaccgcgtccgcgaaatggcggccgacttcggctccaagctggtgttccgctgcgacgtgcagaatgacgacgaaatcaaccagctcttcgtcgagctggccaaggagtgggacggcctggacggcctggtgcactcgatcggcttcgccccgcgcgaggcgctggaaggcgatttcctggattcgctcagccgcgaagcgttccagatcgcccacgacgtatcgtcctacagcttcccggcgctggccaaggccgcgcgcccgatgatgcagggccgcaaggcttcgctgctgaccctgtcctacctgggcgcggtgcgcgcgatcccgaactacaacgtgatgggcctggccaaggccagcctggaggcgtcggtgcgcttcatggccgccagcctgggcaaggaaggcatccgcgtcaacggcatctccgccggcccgatcaaaacgctggccgcttccggcatctccggcttctccaagctgctgaacatggcctccagtcaggcctgtctgcgccgcaacgtgaccactgaggaagtcggcaacgccgccgccttcatgctgtcggacctgtcgtccggcatcaccggcgaaatcacctacgtggacgccggctacagcatcaacgcactgaacgtgccggaataa

SEQ ID NO: 1737 - DNA, 849 bp, Chromobacterium substugae
atgaatgtggccgacgcatgcaccgataggctggaggctttgttgaatcactttccggtgcgcgcgcggatgttccattccggagccttgtgcggcgtcaccgatttcgccgcgccgggcgagggcggccagttgcacctgatccgctccggcgcgctggagatcatgcgcgccggccagcctgcgctgcgggtggacgtgcccagcctgctgctctacccccggccggtggccaggcgtttcgtcgcggacgccgggcgcggcgccgatctggcttgcgcggagctgagtttcgacggcggcgctgacaaccccatcctcggggcgctgccggaaatggtgtgcctgccgctggcggccatcgccggcgccgacagcgtgctggcgctgctgttcgaagaggcgttcggcgccaactgcggccgccacgcgttggtggacaggctgttcgaggcggtgctgatcctggtgctgcggcagttgatggaaagccggcaggtacagggcggcatgctggccgggctatcccatccccggctgcgcaaggcgctggcggcgatgcacgcgcagccggggcgggcgtggccgttggaggcgctggcggagcttgccggaatgtcgcgcagcgttttcgccggcgcgttccgcgacgtggtgggcagcacgcccggcgcttatctgcaggcctggcgcgtccggctggcgcagcaggcgctgctgcggggccggcagttgaagatgatcgcgagcgaggtggggtatggcagcgaggccgcgctgtcgcgggcgttcaaggcgcaatgcggtttgacgccgcgggagtggcggcaggggcggctggcggattga

SEQ ID NO: 1738 - DNA, 426 bp, Chromobacterium substugae
atgtcgatcgacaccatcctgtaccgcgcccacgccaccgtcgccggcggccgcgaaggccatgccgcctcttccgacggtgccctggacgtccagctgtccatgccgcgcgaactgggcggcgccggcggccccggcaccaatcccgaacagctgttcgccgccggctacgccgcctgcttcctcggctcgctgaaattcgtcgccaccagggagaaagtcgcgctgccagccgccgccagcatcgccgcctctgtcggcatcggcaccgtgcccaccggcttcgccatcgaggcggagttgctgatctcgctgcccggcctgccgccggaaaccgcgcaggcgctggtggaaaaggcccatgtggtctgcccctattcgcacgctacccgcaacaacctcgacgtgcgcctgcgcctcgcctga

SEQ ID NO: 1739 - DNA, 1014 bp, Chromobacterium substugae
atgaaaaccaagctccatatcgtcgcggcgtcgctcgccgcgctttgcgccggctccgcgctggccgccggcagccccggagtggaacgccatacccaggcttttctcgaaaccctggcccaaggcggcggccagccgctggaaaccttgtcgccggccgaggcgcgcgatgcgctggcccgcgcgcaaaaaggcgccaaactggcgccggcggacgtcagcgagaaaatcatctccgtcgacggccagccgctgaagctcaccgtggtgcgcccggcaggcgtccgcggcgcgctgcccgccttcatgttcttccacggcggcggctggattctgggcgactaccccacccacgagcgcttcgtccgcgacctggtggccgactccggcgccgccgcggtcttcgtcaactacacgccgtcgccggaggcccgctacccggtggccatccgccaagcctacgccgccacccgatgggtggcggaacacggcgcggcaatccaggtggacggcaagcggctggcgctggccggcaacagcgtgggcggcaatatggcggcggcggtcgccctgatggccaaagccggcggcggcccggcattgcgcgcccaggtgctgttctggccggtggccgatgccgacttcgaagacgcctcgtatcgcgaattcgccgatggccacttcctgacccggaacatgatgaaatggttctgggacgcctacacgcccgacccgcggcagcgaagcgacatctatgcctccccgctgcgggcggcgccggcgcaactgcgcggattgccgccggcgctgatccagaccgcggaaaaggacgtgctgcgcgatgagggcgaggcctacgcccgccaactggacgccgccggcgtagacgtggtcgccacccgctacaacggcatgatccacgacttcggcctgctcaacgcgctgtccggcctgccggccacccgcgcggcgctgcaccaggccagcgaggagttgaaaatgcgcctgcgctga

SEQ ID NO: 1740 - DNA, 759 bp, Chromobacterium substugae
atgcccgacaacgaccatcagctggccgccgatatcgcggcccaggctgccgagctgctgaaccagctgcggcaaggcaacaccgccggcgacaaggcgctgggcgcgctgggcgacgccaaatccgacgcgttgatcgcgcatctgctgcgccaggccaggcccgatgacggcctgctgtcggaagagtcggcgcccgacgacgcccggctgcgcttgcgccgggtctgggtcatcgacccgctggacggcacccgtgaatacagcgagcgcgagcgcgatcgctccgactgggcggtgcatgtggcgctgaccgaagacggcctgcccaccgcctgcgcggtggccctgccggcgctgggccagctgttctccaccgccgcgccggcgctggccggcgcgccgccgggtccgatccggatcttggtcagccgcagccggccgccggccatcgccgagcgcgtggccgggatgctgggcgccgaactggcgccgatgggctcggccggcgccaaggcgatggcggtgctgcgcggcgaagcccacgcctatctgcacagcggcgggcaatacgagtgggactcctgcgcgccggtcggcgtggcgctggccgccggcctgcacgcgtcgcggctggacggcagcccctgccgctacaaccagcccgatcccttcatgcccgacctgctgatctgccggcgcgagctggcgccggcgctgctggacgccatcgcccgcgcccaggccgaatccgcctga

SEQ ID NO: 1741 - DNA, 2469 bp, Chromobacterium substugae
atgagcaagcggtttgccatcctggtggtggacgacaacgagagcaaccgggtgacgctgcgggcgctgctgtcccgcctgtccggctgcgaggtgctggaggcggggtcgggcgaggacgcgctgctgcgcacgctggagcgcgatgtcgacctgattttgctggacgttcagatgcccggcatggacggcttcgagaccgccagccatctgcagatgacggaacgcacgcggggcattcccatcgtcttcgtcaccgccatcttcaaggccgaggagttcatcggccgcggctatggcctgggcgcggtggactacctgatgaagccgctggacgacaacctgctgctgaaccgggtgcggatgtaccaaaccctgcacgaccgcgaggcggcgctggaaaaacgccgcctggcgctggaagaggccaatggccagctgcagcaggcgctgggcgaactgcagcgccagtcggtggcgctgtccgaggcgcgcgacgcctccgaggcggccaatcgcgccaagagcgaatttctggcggtgatgagccatgagatccgcacgccgctcaacggcgtgatcggcatggccgacctgctattgaaaacccggctggacgagcgccagcggcattacgtcaacgtggtccaccgctccggcgaaaacctgctcagcatcatcagcgacatcctagacttttccaagatcgaggccggcaagttcgaactggaccgccagcctttctgcctgagcctgttggtggaggagatcgtggagcggctggccccggtggcttacggcaaggggctggagcttttgtgcgcgcagccggcgtcggcggtggaggtgataggcgacagcaagcggctgggacaggtgctgaccaatctgatcggcaacgccatcaagttcacccaggccggccaagtggtggtgcgggtggcgctggaggggcgcggcgagcgggaaaccagctgccaggtcagcgtggaggataccggcatcggcatcacgccggagcagcagagccggctgttccagcccttcgctcaggccgacagctccactacgcgccgcttcggcggcaccggcctggggctggtgatctcgcagcggctgatggccatgatgggcagccgcatcgagctggccagccagccgggcgtgggcacccgcttccatttccggctgaccctgcccaatggcccgcaaacccagccgccgccgccggtcgagcggctgagccggctgcgggtgctggtggtcgacgacaacgccaccaatctggaaatcctggagcagcagctgacggcctggcattgccgggtatgcgcgctgcaaagcccgctggcggcgctggaccggctggcagaagcgaagggagagcagcagttcgacctggtcttgtccgacatgatgatgccggagctggacgggttgatgttcctgtctcaggcgcggcagcggctgggcgaggcgatgccgcccgccatcatcctcagctcggcggccgatgacttccagcaactgaaggacgccgccagcctggcgcgccaagtactgaccaagccgctgcggcgctcggagctgtacaacgcgctgatccaggcgcgcgagcccgacgcccagccggccggccgcgggccggcgcgccaggagcgccaggagcgcgcgttcggcaagctgagcggccatgtgctgctggtggaggacaatctggtcaaccaggaaatggcgcaggcgatgctgcagaacatgggctgcagcgtcagggtggccagcaacgggcaggaggcgctggctctgctgggcgaggaaaagttcgacctggcgctgatggactgcgagatgccggtgatggacggctggcagaccacccgggcgatacgcgacaaggagcggggcgccgacgcgcgcctggccatcgtggcgctgaccgccaacgccggcctgggcgacaaggagcgttgcctgcaggcgggcatggacgattacctagccaagccgttcacgcagcgggaattggctgccacgctggcgcgctggctgcgcgcggcgggcaaagaggccgcgccggagagcgaggcgccggccgaagcctcggtggcgggcggcgagtggatagagccgcaggtgttgcaggcgatacgcgacatccgcgccggactgctgcccaggatgctggaggcctggatgcaggagtgcccgggcattcatatggcggtgcacgaggcggtgaagaaagcggacggcggcgagctgttccgcaccgcccattcgctgaagaacagcgccagcagcgtcggcgcgctgcagctggcggcgctgtgcgcgacgctggagcaactgggccgcgcaggcgatctgccggcggccgcctgcctgatcgaccagctcgaccaggctttctattactcgatggaggcgttgaagaagctgctggcggctgatccgccgccgcccgcctga

SEQ ID NO: 1742 - DNA, 1701 bp, Chromobacterium substugae
gtgagcgtcaatctccagcatcaaggcgaactgtgccgggcggcgatcctgggccggctggacgccgccgacgagcgcgcggccttgcaggagctgctgcgcggcccggccgacgacatgctggagctgtgcttctacgacgccgacctgctgcccgcggaattgatcgcggcgttggcggccaggctggactcgggcggcaagctgaagatcgtcgcctaccacgcgctgctggcgcacagcctgatgcggctggggctgccggtgcggcaggtgtccgcccagccgcccgcggccggggagcggccgccgctgcgggcgctggcgctggcgggatcggcgctcagcctggagcgcatcctgcacatcgtcgaacatctgcccttgtccgatatggtggtgttcgtcgcccagcatgtgcaggaaaaccagatcaatctgctggatcagctgctgaaatcgcgcaccgaataccgggtgctgatgccgcagcatctgacgccggcgcaagccggcacgctgtatgtggcgccgcccggccaccacatgcgggtggcgcacggcctggtctacctcacccgcgaccggcagatccagttcgctcggccgtcgatagacgcgttgttcgaatcgctggccggcgaatacggcgacggcgtgctggcggtgctgctgtgcggctacggcagcgacggcgtggacggctgcgccgccttgcgcgccgccggttcctgcgtcatcgtcgaggacggcgacgaatgcgcgccggcgcgagtgatgccggacaacgcccgcaacgccggccattacgatttcctcatgaagctgccggccatcgccagcgtggcggccgcggcggcgatgggcgacgccgccaggcccgacggcgcgctgctggaattgttcctgcaggcgctggtcagccattacggctacgatttccgccattaccagcgcgaaagcctgaagcggcgcatcgtcaatctgatggggcagttcaatctgcgcggcttcgccgaattccagcgcgcggtcttgtgcgacgccgccctgttcgagcggttgtgcgccgagctgccggtgggcgtcaccagttttttccgccacccggcgcagttgaagcaactgcgcgaggagatcctgccctatctggccagctttccgatgatcaagctgtggtcggccggctgctccaccggcgaggaggcgtattcgctggccatcgtgctggacgagctgggcctgctcgaccgcagccatctgttcgccaccgacctgaatccctatctgctggagctgggagcgagcgggctgtttcccagcgcgccgctggcgctcaaccgccagcactacctcgccagcggcgggcccaggctgttcgacgcctatctggccggcaacgggcgctacctggccatggacgacaggctgcgccagcgcattctgttccaccgccattcgctgaccgacgaaggcatcttcaatgaattccagctgatactgtgccgcaatgtgctgatctatttcgacgccgaactgcagcgccaggtgctgcgccgcttcgcccgctcgctgcacgcggagggttttctggcgctggggccgcaggacggcttgcaccggctggcgctggaggagggcttcgagccctgccgcggcggcagccatatctatcgcatcggcaggagcgcggaagcatga

SEQ ID NO: 1743 - DNA, 3702 bp, Chromobacterium substugae
atgaaactcactgtcggcaagaatatggccttgctggtggccaccgctttgctgggattggccatgctcaccgcgctggagcagtatttgctggagaaagtctacgacggcgccaatttcggcaatatcaacgcggtgcccagcttgaaagtattgggcgagctgcggcgcgcttttctggaagtcaatatccaggtcggccgcctcgattacgacgaggaccgggctttgcggctgaagatagagcagcggctgcaaaccgcccgcgaacaagtcagcgacgccatccgcagttatgaaaccaatggctgcgatgggggcagctgctttgccgacgcgaccgacaaggattggctggagcgggaaaaaccggtgtggcagaaattccagtccgttctggagcccattctcgccattcgcggcaacgacgcgcaaagcgtcgccaacgttcatcagatgctgctggcgctggacccgctgtccatccagctgcaaaaaatgatagacggccatatcgactacaacatggtgatcgcccgcaagttttccgatgaggcggcgcagaccaagcgcggcgccattcagctgacgctggtcatcagcgcggcgatgttgctggcgattggtttgttgggctggctgaccagccgttccattctcagccggctgggcggcgagccgaccgaagcggccgatatcgcctcccgcttggctgaaggcgacctgagcatggacatccggctgcgggagggcgacggcaacagcctgatggccagattgcaggaactggtcgacgcgctggacaggctggccagccgggcttacgcgatcggccagggcgacctgagccaggaggtgcagctggcgtcgaaccaggacaagctcggcatcgccatcaacgagatgatacggatgctgcgcggcgcccgcagcgaggacgagcgccgcaactggctgaaggacggctatggccagatatccgcggcgctgactggggacctgaccaccgagcagctagccgactcggccatcggcatgataggccgctacctggacgccggccgcggcgtgttctacctgtaccaggagtctgaacaggtgctgctgctgatcggcagttatatgtataccgaacgcaaccacatcggcgccagcttccagctgggcgagggcgcggtggggcaggtggcgcgcgagagaaagcccatcatcctcgaggtgtcgaatgaagacgtggcgcccatcgtcaccggcaccctgctggagacgccgcgctttacctacacctacccgctgctgcacgaaaaagagctggtcggcgtgatagaactgtccagcttcgagcgtttcgacgacaaaaagcaggagttcctggccaatgtcggcggcatgctggcgtctttcctgttcgtcgccgagcagcgcgcgcacatccgcaagctgctggcggccagcgaagcgtcggaaaaggaaatgcggcagcagagcgagcagctgcgcgagagcaacgccaggatggaggagcagcagcagttgctgcagcagcaggccgaggagatgcagcagaccaatgctcagatggaagaagcgcagcagctgctgcgccagcagaccgaggagctgcagcagaccaacgcgcagatggaggagtcgcagcagcagctggagcagcaaaacctggagctggacgaggcgcggcggcagcaggaggccaaggccaggcagctggaccaggccagccagtacaaatcggaattcctggccaatatgtcgcacgagctgcgcacgccgctcaactccatcatcctgctgtccaagatgatggtcagcgacgaggacggcaaggtggagggcgaggcgctgaagtgggcgcaggtgatccaccgctccggcgaagacctgctgcggctgatcaacgacgtgctggacctgtccaaggtggaggccggccgcatggacgtgcacctgtcgccggtgagcagccgcgatctgtgctcggaattgcaaggcatgttcgaacacgtggcgcgggacaagggcctgagcttcacagtggaggacgagctgcggcggcacttcgtgtccgaccccgacaagctgtcgcaaatcctgcgcaatctgctgaccaacgccatcaagttcacccgccagggcggcgtcaccttccgcctcagccatcatcccgaccagccgctgccgatccggctgagcgtccgcgacaccggcatcggcatccccgaggaaaagcgcaatgtgatcttcgaagccttccagcaggccgacggctccacctcgcgcgagttcggcggcaccggcctcggcctgaccatcagcctgcgcttcgcccagatgctgggcggcaccatcgagctgctgagcgcgccgggcgagggcagcgagttcatcgtgctgttgccggaggccggcgcggcggccgagccgcagccgggccacgcggccagccatccggcagccgcgccgcgcccgcggctggacgcgccgggcgacgaccgcggcgcggtgagccccggcgaccgcatcatcctgctgatagacgacgacccggtgttcggccagatgctggtcggcatgaaccgccggctgggctacaagacgctgctggcgcagaacggggccgatgggctggctctggccggacagtaccggccgcacggcattctgctggacctcggcctgcccgacatggacggcgcgcaggtgctgcatgaaatcaagacccggccggcgctgtccagcctgccggtctacatcgtttccgcgcgcgaccgcgacgaagccttgctgcagcagggcgccatcggcttcttgagcaagcccgccgccgaccacctgctggcagccgccgaggcgacgctgatcagcgcggtgggcagcaagggcggcgagcgcatcctggtggtggaaaacggcggcatccgcggcgacgaggtgcagtcgctgctgggccgcgacggcggcgccatcgtggcggccgcgccggacgccgactggccggcgctgttgcggcaaaagccctgccagctggccatcatcgacttgggcgccgggccggcggccgacgcgctggtgacggcggcggcgctgcgcgaagccgacgccgcgatctcgctggtgttttacgccgacagccatcccggcgacgaggaggaggcggcgctgcgcgcctattccgattgcgtgatcgtcaaggcgccgcaggccggccagcggctgatggaaaacgtggagcgctttttgcaggacgtgcccagacagcacgcggcgcgcaagacgccggcggcgggcggcgacagcaagctgctgtccggcaggcagatcctggtggtggacgacgacccgcgcaatctgttcgtgatcaccgccgcgctggagcggcacggcgccaagctgttttccgcggtcaacggccggcgcgcgctggagtttctgccgcagcagccggtggacctggtgctgatggacatcatgatgccggaaatggacggctaccaggcgatcgcggccatccgcgccgacccggccctggccgccatcccggtggtggcgatcaccgccaaggcgttgccggccgagcgcgagaagattctggctaccggcgccgacgactacctgtccaagccggtggattacgacgtgctggtggccaaggcggcgcagtggtgcgcggggcgcaagacgtga

SEQ ID NO: 1744 - DNA, 2145 bp, Chromobacterium substugae
atgccggcgccaggcgacattctggtggttgacgacaccatgacaaccctgatgatgctcttggcgctattgtccaccgagggttatcaggcaagctccgcgcagagcggcgccgaggcgctggaactggtgcgcaagcatcctccggatttgatcctgctggatttcagcatgccggacatggatgggctgcaggtatgccgccagctcaaggccagctcccgcacccgcgacatccccatcctgttcctcagctccatcgccgacacccaggccaaggtggacggcttcgccgccggcgcggtggacttcatcggcaagccgttcgagcgcagcgagctgttggcgcgcgtcaacacccacctggacctcgcccggctgaaaaagcgcctgagcaagctggtggacgaaaaaaccgagtcgctgcggctgagcgagcagcgctttcgcgcgatgatcgaacaagcgccggaagccatcatggtgtacgacctggacagcagccgctacgtcgacgccaaccagcaggccgaggcgctgactggccggcagcagaaggacttgatcggcatgacgccggtgcagctgtattcgccggaacaaccggacggactgcctactgccgaaagcgtgcgcctgcacgccgccagggcgatgaaaggcgaggtgcaggttttcgagcgcgtcatcgcccggcccgatggcagcaacatgccctgcgaagtgcggctgagcaagctgcccagcgaaaccggccgcctgctgcgcgtcagctacatcgacatctcgccccgcgtcgccgcccaggagaagatcaaccgcctggcctatttcgacgcgctgaccggcctgctgagccagagcggcctgctggagaagctggacaatctgttcaacatccgccaggaagccaatctgcagggtttcgccatgctgttgatcgatctgggcgacttcaagtccatcaacgacgtctacggcaacagcgtcggcgacctgctgctgtgcgaagtggcggaacggctgcgccggctggccggcgccggcaatctgatctcgcggctggccggcatcgaattcgtggcggtgctcagcgggatccacagccgcgaaaaagcggaacaggcggccgacgaggcgctggaggccctgtcccgcccgttcatcatcgacgagatgacgctgaacatcaccgtcagcataggcgtcagcctgggtccggaacacggcgccagcggccaggaactgctgcgcaacgccgacatggcgctgtacaaggccaagcagcaaagcaagcgccgcgtccaggtgttcgaggcggccctcagccagcagatgcgggaacgggtggagctggaaaaggagctgcgccacgccatcgaggaaaaccagctggtgctgcactaccagccgcagatcgagctggccagcggccgggtggtgggcgtggaggcgctggtgcgctggcaacacccgcggaagggtatgatcccgccggcccagttcatcccgatcgccgaacagtccggcctgatcctgccgctgggacgctgggttctgcaggaagcctgccggcagctcagccgctggcaggccaaggagccaacccgcatccgcatggcggtgaacctgagcgtggcgcaattcaccgaccacgagctgccggaattcgtcgccggcatcctgaagcaaaccggcatcccgcccagcagcctggagctggaaatcaccgagtcctgcgcgatgttgtcgccgcagcagtcgatagacatgatgcggcaattccaccagatgggcgtgctcagttcgatagacgatttcggcaccggccattcgtcgctggcctacctcacccgcttcccgctggacacgcttaaaatagaccaatcgttcatccgcaatatttccagcgacgaacgcgacaccgccctgtgcgacaccatcgcctatctggcgcaccggatgggcctgcaggtggtggccgaaggcgtggaaaccgatgagcagctgaccttcctcaccagcatccacgtcgacgtggtgcaaggctatctgctgtgcaagccgctgccggcggcgcaggtggaagccttcatcctgcaaaggccggaccagtcgccgcggcccggcgtcgaatacttctag

SEQ ID NO: 1745 - DNA, 1467 bp, Chromobacterium substugae
atgaccgccaaaaccatcatgatccagggcgccacgtccgatgccggcaagagcgcgctggccaccggcctgtgccgtttgctggcccggcgcggcgtgcgggtggcgccgttcaagccgcagaacatggcgctgaacagcgcggtgacggcggacggcggcgagatcggccgctcgcaggcggtgcaggcgctggcctgccgcgtggagccgcacaccgacatgaacccggtgctgctcaagcccaacagccacaccggctcgcaggtgatcatccagggccgcgccatcggcaatatggaggcgcgcggctatcacggctacaagcccatcgcgatgcaggcggtgctggagtcgcacgcgcggctggccgagcagtatcaatgcatcgtcgccgaaggcgccggcagcccggccgagatcaatctgcgcgacggcgacatcgccaatatgggcttcgccgaggctgtggactgcccggtgatcctggtggccgacatcgagcgcggcggcgtgttcgcccacctggccggcacgctggcgctgctgtccgaatcggagcgcgcccgggtggtcggcctggtgatcaaccgtttccgcggcgatccgtcgttgctgaagaccggcgtcgactggctggagcagcacaccggcaagccggtgctgggcgtgctgccctatctgtacgacctgcacctggaggccgaggacagcatgggtctggacaagctcggcggcgcatcgggcggcggcgacaagctgcgcgtggccgcgcccgccgcgccgcgcgtcagcaatcacaccgatttcgatccgctgcgcctgcatccgcaagtggagttcaccctggtgcgcgcaggcgaaaccattccgccggccgacctgatcgtgctgcccggcagcaagagcgtgctggcggacctcgcctggctgcgcgcccaaggctgggaggaggcgatacgccgccatctgcgctacggcggcaaggtgctgggcatttgcggcggcctgcagatgctgggcaagaagctgcacgatccggatggattggaaggcgagccgggcagcggcgacggcctgggctggctggacatggaaaccacgctggcgccggagaagcggctgacgcggatgcgcggccggctgacattgggcgacgccgaggccgccggctacgaaatccacatgggggtgagccaggggccggccctggcgcatcccgccgttcggtttgacgatggctcggtggatggcgcgcgctcggaagacggccagatcttcgccacctatctgcacggcgtgctggacgaaccggccgcctgccaggccatcctgcgctgggcggggctgaaagagccggaagcgttggactatccggcgctgcgcgaggccaatatcgacaagctggccgacatgctggagaagcatctggatctggcgctcatccgcgactgtctgccgcgctga

SEQ ID NO: 1746 - DNA, 939 bp, Chromobacterium substugae
ttgaattccgcactgtttctgccgatcgcgctgctgctggaccgtctgctgggcgagccgccgcgctggcatccgctggtcggcttcggccggctggtcaaagccatggagcggctggcctacccggccgcgccacaggctgagccggtctggcggatgcgcttgcgcggcgctgcagccatcgcgctgctgctgaccccgcccacgctgatcgcctgggggctggcgaggctgccgtggctgggcgccatcgttcccatcgccctgctgtatctggccgtcggcgctcggagcctggcccagcacgccgaagtggtgcgaaaagccttggccgacggcgacttggccctggcccgtgaacgggtgggctggatagtcagccgcgacaccagcgagctggatgaagccggcgtggcgcgcgcaaccatcgaatcggtgcttgagaacggcagcgacgccgtcttcgccgcgctgttctggtttctggttctgggcgcgcccggcgcggtgttgtatcggctgtccaacacgctggacgcgatgtggggctacaagaacgatcgctacctgcacttcggctgggccgccgcccgcttcgacgacgcgctgaactatctcccggcgcggctggccgccctaacctatctgctgctgggccatgccgccgacggctggcgctgctggcgcgcccaggcgcctacctggtacagccccaacgccggcccggtgatggcggccggcgccggcgcgctgggcgtcagcctgggcggcggcgcgcgctatcacggccaatggaaggaacgtccgccgctcggttgcggtcccacccccacgcatgaagacatcggccgcgcggtgcggctggtcaaccggggcatgtggctgtgggccgggctgtcgctggcggccgccatcttgatcggagcgatccatgcttga

SEQ ID NO: 1747 - DNA, 987 bp, Chromobacterium substugae
atgcttgaacacggaggcggcctgctgcgcgccgcggccgaatacggcattccggccggcgactggctggacctgtccaccggcgtcaatcccaacggctggccggtgccgccgctgtcggccgacagctggctgcggctgccgcagaacggcgacggattggaagcggcggccgccgactattacggcagcgacaagctgctggccgtggccggctcccagccggccatccagttattgcccaggctgcgcgcgccctgccgcgtcggcatgctggcgctgtgctacgccgagcacccccaccactggcagaagcgcgggcaccagctgttccgcctgtcgccggatgagctggccgccggcatagaccaactggacgtggtgttgctgtgcaatcccaacaaccccaccggcgaccgcttcgatgcggcgctgctggaaagctggcggcagcggctggccgcgcgcggcggctggctggtggtggacgaggcgtttctggacgcggccccggaggacagcatgctgccgcacatcggcaagccgggactgatcgtgctgcgctcgatcggcaagttcttcggcctggccggcgcgcgcgccggattcgtcttcggctggccggagctgctccaggcgctggccgaggagctggggccatggacggtggccggcccagcgcgcgaggcggtgaagctggcgctgcgagatgtggaatggcagcgggacatggccagcaagctgcagcgcgacagctcaagactgcaacgctgcctggagcggcacggcctgccgccggccggcggctccgagctgtttcaatgggtgccggatgcgcacagcctggcgacgcaccgctacctggccggccgcggcatcctgacccgctacttcgaatccatccccagcctgcgcttcggcctgcccaaaaccgatcaggactgggtgcggctggaacaggcgctagcggactggaatcggttttaa

SEQ ID NO: 1748 - DNA, 192 bp, Chromobacterium substugae
atgcatggtgccctcgtagacgatactcgtcgcgcaagcgagggcacatccttccgtcttcttatccatgagcggagcttgtgcgtatcccccggtacaccccgcccggtttctgcttgcgtcgacacgtatgacggccggtctcctggctcgcgcgtcgccgtccgggcgccgccttcccgaccttgctaa

SEQ ID NO: 1749 - DNA, 1047 bp, Chromobacterium substugae
atgcatccatccaccacgctgtccacgggccgccgtctggcgcgccacgctcccatactcgccgggctgatcctggccaatctgttggcctgggcctgggccttcgccgctttcgccgaccacccggcccagctcgccaccgccctgctcgcctatttgttcggcctgcgccacgcggtggacgccgaccatatcgccgccatcgacaacaccgtgcgcaagttgatgcaggaaggccgccacccgtcggcggtgggcctgttcttctctgtcggccactccgcggtggtggtcatcgccgtggcgctgatcgtgttcgccgccagcgccttgcaaagccgcgtcaccggcttcaaggagataggcggcgtcatcggcaccagcgtgtcggccttcttcctgctggcgctggcgctgatcaatctgtcgtccttgcgcgcggtctgggcggctttccgccgcgcccgcgccggcgagcccatctgcgacgagcaactgaacctgctgctgaacaaccgcggcctgatcgcgcgcatgctgcgcccgctgttcaagatggtgaccaaaagctggcatatgttgcccatcggtttcctgttcggcctgggcttcgacaccgccaccgagatcggcctgttcgccatcgccacctcgcaaagcgccaacggcgtggcactgtggcacatcatggtgttcccggtgctgttcgccgccggcatggcgctggtggacacgctggacagcatgatgatggtggaagtgtacggctgggccttcatcaacccggtgcgcaagctctggtacaacctgaccatcaccttcgtctcggtcgtggtggcagtcggcatcggcgggctggaaggcctgggcctgctggtggacaagctgcagctcagcggcggcctgtgggatgtgattgccgccctcaacgacgacctggcccatttcggctatttcgtggtcggcgtgttcctgttcacctggctcgcttccgccgccatctacaaatggaagcgcttcgaccaaatggccccggaggcgcaatga

SEQ ID NO: 1750 - DNA, 330 bp, Chromobacterium substugae
atgagaacgcacgacaaacacgtgctgatgtgcaccggcccgcgctgcacccctgacggcgagggctcggaggcgatgttcctgcacctgggccgcacgatagacgcctgcgacggtctgcgcgccaagcgtacccgcagccactgcttcgccgtgtgcaaggaggggccggtgatggtggtgtacccggacggcgtctggtatcgcaaagtcagcgaagccgacgtcgagcgcatcgtctgccagcatctgaagggcggcgtcccggttgaagagctggtgttccataaaaccggcagcggcgacatcgaaacggaaccccaggcatga

SEQ ID NO: 1751 - DNA, 4125 bp, Chromobacterium substugae
atgagcgccgaaatcgcactattgagccacgccggcaccgacctcgccgcgctgtcgcgcgcgcgctggcctgaggatttccccgcggtcaccggcatcgcgctgcaaggcataaccgacgaggccgcgatgcgggcgctgctggacggccagcttgccagcgcccgcgccatcgtgctgcgcgtgctgggccgcgccgacgcgatacccggcctggagcggctgctggcccacgcccgccggctgcaggccgcggtcatcgtggtcagcggcaccggcgagccggacccggagctgcaggcgctgtgcagcgcgccggtatcgctgcagcaggacgtccacgcctatctgcaggccggcggcagcgtcaacctgggcgagatgatgcgctgcctggccgacaggctgctgctgaccggctttggctaccagagcccgcagccgctgcccgagcacggcgtctaccacccggagctggccgcgccctgctcgctggaagattggctcgaaatccgccatccggactggcccaccgtcggcctgtgcttctaccgcgcccactggctgtccggcaacacccgcttcatcgatctgctggtggactgcttggccgagcgcggcgtcaacgcgctgccggtgttcacctcgtccttgcggaccatagaccagggcggcctgccggcggcgctgacgctgctagccgatccgcgcgcgaatgtttcgctgctgatcaacaccacctcgttcgcgatgggcgacatcaacaacgacggccccacccagcccggctgggcggtggaggcttcggaccaactggatctgccggtgctgcaagccatcaccagcagcatgacccgcgagcaatgggaagcgtccgaccgcggcttcaacccgctggacacagcgatgaacgtcgcgctgcctgaattcgacggccgcatcatcggcgtgccgctgagcttcaagcagccggccgaggccggccaggccgagcaatacgcgccgctgccggaccgcgcccgccgcctggccggcatcgccgcgcgcttggcgcggctgcgccatctggaaaatgccggcaagcgcatcgccttcatcttcaccaactccaacagcaaggcctcgcagataggcaacgcagtgggcctggattcgcccgcgtctctatacgctatgctgcgcggcatgcaaggccgcggctaccggatggatccgctgccgccggacagcgacgcgctgatgcacgagctgatagaccgcggcgcttacgaccaggactatctaagcgccgagcagatgaaaaacgccgccgcccgcgtgccggcccagcgctaccaggcctggttcgacgagctgcctgaggcgctgcgcgacaagatgctgcagcgctggggccagccgccgggcggcgcctacgtcgacggcgacgaactggtattctctggcctggattacggcaatgtcttcgtcgcgctgcagccgccgcgcggctacggcatggacccggacgccatctaccacacgccggacctgccgcccactcaccactactacgcgctgtaccgctggctgcgcgacgactggcgggccgacgccatcgtccacgtcggcaagcacggcacgctggaatggctgccgggcaagggcgtgggcctgtcgcagaattgcttcccggacgcgctgttgggcgacatgccgctgttctaccccttcatcgtcaacgatccgggcgaaggctcacaggccaagcgccgcggccacgcggtgatcatcgaccacctgacgccgacgatgaccaccgccgacagctacggcccgctggcgcagctgacccagctggtggatgagtactaccaggtggaactgctggacccgaacaagctgccgctgctgcagcagcagatctgggacctgatcaaggaggccaagctcgacaccgacctggccgcgatgctgaagcacgaccatgatcacgatcacgatcacgagcatcaccacgatcatgaccatagccacgaccacccgcatggcggacaccagcacgcgcccgccgccgtccacggcaagtaccgggcgcaggcggccaagccggcggccgcgatgaagccggcggcggccgcggcggcgaaataccgcccagccaaggccgcgcacagccacgatcatggacaccatcatcaccatcatggcgaccacgaccatcaccacggccaccatgaccaccatcatcatgatcatcacagccacgaccaccacgaccatgaccacgattgggacgacacgctgaacgaggacggcgtgcccttgagcctggccaagatggatggcgtggacgtcgcccacctgatcgaggacatagacggctatctgtgcgaactgggcgcggcgcagatccgcgacggcctgcacgtgctcggcaacgcgccgcagggcgaggcgctggtcgacatgctgctggcgctgacccggctgcccaatctgggcatccccggcctgcccgccagcgtggcggcggcctgcggcggcgactggccgctgtggcagcaggaccagggcaagcggctggccgaagcccccgcgtccttgcaagcgttggccggccaggcgctggtcacccgcgccgacgcccatgacgcggtgatgaagctggcgcgcgcgctgatcgccgatttggccgcgcgcggctaccacgccgccgccatcccggccgccgtcgaaaacatcctgcccggcatcgagccgcatgccgatctggagcgggtgctgaacttcgtctgcgccgaactgtgcctgaagctcgcccgcaccgccgaggagatagacaatctcttgcgcggcctggaaggcggctacgtgccggccggccccagcggcgcgccgacgcgcggcatggcccacattctgcccaccggccgcaatttctattcggtggacccacgcagcctgccctcgcaagccgcctggcgcataggcgacggcttggcgcgcgagatgctggcccgccatctgaaggaaaccggccagtatccggaatcggtcgccatcagcgtgtggggcaccagcgcgatgcgcacccatggcgacgacatcgccgaaatcctgtcgctgctcggcgtcaagccgcgctggcagcaggaaagccgccgcgtgcaggggctggaagtgatccccttggccgagctgggccggccgcgcatcgacgtcaccgtgcgcatcagcggcttcttccgcgacgccttcccccacctgattgcgctggtggacgaggcggtgcacaccgtggcgcggctggacgagccggcggagcagaacttcctgcgcaagcactacctggccgacctgaagaacgaactcttaggcaagctgcccgactccgacgcgcagtcgctgtaccgcgtgttcggcgccaaaccgggcagctacggcgccggcatcctgccgctgatcaacgagcagaactggcagaacgacgccgatttcgccaccgcctatgtcaactggggcggctacgcctacggccgcgcggccaacggcgccgacgcccgcgacgcgctgcgccatcggctggcgggcgtggaagtcgccctgcacaaccaggacaaccgcgaacacgacatcttcgacagcgacgactacctgcaataccacggcgggatgatcgcgacgatacgcagcctcagcggccgccagccgcgcgccttcttcggcgacagccacaatccggaagcgccagccgtgcgcggtctgaaagaggaagtgctgcgggtgttccgctcgcgggtggccaacccgaagtggatagccggcatccagaagcacggctacaagggcgcgctggagctgaccgccaccgtcgattacctgttcggctacgacgccaccgcccaggtggtggacgactgggtctatgaacaactggcgcaaagctacgcgctggacccggcgatgcagcagttcttcgccgacagcaacccgtgggcgctgaacgccatcaccgaccgcctgctggaagccgcgcagcgccaactgtgggcggagccggacccggacacgctggccgccctgcgccagctgcacctggatagcgaagcgctgctggaagcgcgcggagaaaacaaagcatga

SEQ ID NO: 1752 - DNA, 1917 bp, Chromobacterium substugae
atgagcccgatttaccccttcgccgccatcgtcggccaggaacaactgaagcaggcgctgctgatctgcgccgtcgacccgacggtcggcggcgtgctggtgcgcggcgacaagggcagcgccaagagcaccgccgcgcgcggcctggccgccgtgctgccggcgatacgccgggcgaccggctgcggctacaactgcgagcccgaccatccgctgccgctgtgcccggtgtgctccggcgacgcgcgcgcgctgcatgacggcccggtgcccttcatcaacctgccgctgggcgccaccgaggaccgcgtgctgggcagcctggacttcgaaaaggcgctgcagggcggcaagcaggcgttcaagcccggcctgttggcggcggcccaccgcggcatgctctacatcgacgaagtgaacctgctggccgaccacctggtcgacgtgctgctggacgccgccgcgatgggcgtcaacaccgtcgagcgcgagggcctggcggtcagccacccggcgcgggtgacgttgcttggcaccatgaaccaggaagaaggcgatttgcggccgcagttgctggaccgcttcggcctgatggtggacgtggccgcgccgcgcgagcccgccctgcgcgccgaggtggtgcgccgccgcctggccttcgaggccgacccagccggcttcgccgcccaatggcaaaccgacagcgaagcgctgcgcgccaacatcgccgccgcgcgcgcgctgctgccgcaaacccggctcagcgatagcctgttccacttcgtcagcgagctgtgctgcgaattcgacgtcagcagcctgcgcgccgacatcgtgctgaacaaggccgcccgcgcgctggccgcgctggacggccgcgccgacgccagcgccgaagacatccgcgacgccgcccggctggtgctgccgcaccgccgccgccgcaaaccgttcgagcaaagcgggctggaccaggacaagctggagcagatgacgcggcaggcgtccaacccgccccctccgccgcctccttctccgcaggaacagaatcacacccagccgccgccggacgcagacggcgagcaggagccgaatcctgccagccatggttcggaacaaatcttcgccgccgcgccggccggcgacatcgcccgcatccgcgtccaggcgccctcgtccggcgacgcggccggccgccgcagcgacggcgccagccgccagcgcggccattacgtgcgcgcagaggccaacccacagccggcccagctggcgctggatgccacgctgcgccacgcgctgctgcgcgatccggacaacttcgccgtcacccgcgccgacctgcacgacaaggtgcgcgtcgccaagcagggcaatctgattctgctggtggtggacgcctcgggatcgatggccgcgcgccagcggatggagcaggtcaagggcacggtactaagcctgctggaagacgcctaccgccgccgcgaccaagtggcgctgatcgccttccgcggccagcaggccgaactgctgctgccgccgtgcaaccgcgtcgaacaggccgagctggcattgcgcgagctgcccaccggcggccgcacgccgctggcgcacgcgctggcgctggccgccgacacgctgtcccgccaactgggcggcccggccccactgctggtgatcctgagcgacggccgcgccaatgtggcgctggatggcgacggcgacccgtggcggcaggcgctggacctggccggccagctggccggcgcgccggcgctggtgctggacaccgaacaggacttcgtccgcctgggccgcgcccgcgagctggccgaggcgctgggcgcggaatacctggcttgcgacgccctcaccggcgagcagctgacattgacgattcaacaaagactgggccgctga

SEQ ID NO: 1753 - DNA, 762 bp, Chromobacterium substugae
atgacgggcaaggtttacctgataggcgccggccccggcgacctggacatgctgacgctgaaggccgcgcgttgcctgaaactggccgacgtggcgctggtggacgatctggtgcatccggacattcgttccatgctgcggccggacgccgaaatcgtgccggtaggcaagcgcggcggctgcccgtcgacaccgcaggcggccatcgagcagcggatgatagacgaggcccgcgccggcaagacggtggcgcgcctcaagggcggcgaccccttcgtcttcggccgcggcggcgaggaaatgctgacgctgcaagcggccggcgtcgaggtggagatcgtcaacggcctcagcgccggcctggcggtgccggccacgctgggcattccgttgacccatcgccatttcgtccacggcgtgaccttcgtctccggccatccgcaccaggacggcgacgagccgaactggcaggcgctggcgcaaagcggcatgacgctggtgatctatatgggcgtcaagcggctgccctggatccgcgcggagctgctgcgccacggcctgaaacccgacaccccggcggcggcgatagaaaacggcacgctgccgcagcagcgccaagtgctgagcacgctggacgcgctggaacaagacatgcgcgcggccggcatccacagcccggcgctgatcgtcatcggaccgacggtggcgctggcgtcctgtagtccgtccgccgccaatgaaacaaccaaggaatacgcatga

SEQ ID NO: 1754 - DNA, 702 bp, Chromobacterium substugae
atgatcatctgcataggcgccggccccggcgacatcggctacctgccgcagcgctcggcccaactgatacgcgaggccgacgtggtggctggcttcaacgcggtggtggacgtggtccgcccgctgatccccgacagcgccgaagtgatccagatgggctaccgcgaccaggtggcccagctggacatcgtcgccgagcgccaccatgccggcaaaaagtgcgtggtggtgttcatgggcgacatccacttcagcggcttccagtacctggagcgggtggagcgcgcctgcggccacccggtggaaacgatacccggcatctcgtcggcgcagatcctggcctcgcgcggcaaggtgtgcttcgacgaaaccagcttcatcaccttccaccgccgcggcgacctgacgccgttcaagcgccacctggtgcacgtgctgcaggacggccgcaacgccatcgtcatcccctgcccgtgggatgaggcgcgctccttcatgccctggcacatcgccgcctatctgctggaaaacggcatcccggccggccagccggtggaagtgtgggaaaacctgacccgcaacgaggcggcatggcgcggcacgctggccgaatgcgccgagcagcgcttctccgacatgagcatcatgctgatccgcacgctcgcgccgatggacagccagatcgagccgacccacaaatga

SEQ ID NO: 1755 - DNA, 1566 bp, Chromobacterium substugae
atgagccaatcagactacgccatcgtattggccggccacggcagccgcgacccggacggggtgaacgagttcatgcagctggtggacgcgctgaaggcgcgcgccggcgtgcgccccgtcgcccacggttttctggagttcgcccgtccgacgatagacgaggcggtggaacaggtaatcgccgccggcgccaaaaccgtggtgatggtgcccggcgtgctcttggccgccacccacgccaagaacgacatgcccagcgagctattggcgctgcaacagacgcatccgggcgtcgatttccacttcggcgcggcgctggacctgcatccgcggctgctggcgctgtgccgccagcgcatcgtcgaggccgaagccgcgtcgccgcacaccatctcgcgcaacgacgcctgtctggtcgtggtcggccgcggcacctcggacccggacgccaactccgaaatctccaagctggcgcggatgctggaggaaggcctgggcttcgccgcgtctttcgtctgctactccggcaccgccaagccgctggtggccgacggcctgcgcgccgccgccatgctgggctaccgccgcatcgtggtgctgccctacttcctgttcgacggcgtgctggtcaagcgcatctacggcgcggcggcggacctggcggcgcgccacccggaaatcgaggtgctgagcgccggctacctaggcccggacccgcaagtggccgaggtattcctggagcgcgcgcaggaaggcgtggaaggacgcgcggcgatgaactgcgcgctgtgcaagtaccgggtgcagatcgtcggcttcgagcagcaggtgggcgagccgcagcgcggccaccacggcaaggtgcgcggcctgctggaacgcgagccaaccgccaatcagccgccggcctggaaacgctacaccccgcatccgatcgaagccgaaagcatgcgcatcatagacgaaggccgcgactggtcggccttcccggccgaacagcgcaccgcgctgatgcggctggtgcacaccaccggcgacttcaacagcgtggacgacctgttcttctcggccggcgcttgcgaaaccggcatgcgcgcgctgctgcgctgccgccgcgtggtcaccgacgtcaccatggtggaaaccggcctcaagcgcgaggtgctgcgccagctggaagtggaaacctggtgcggcgtgcacgacgaggaaacccggctcttggccgaagccagcggcctcacccgctccgccgccggcatccgccgggcgtggcagaaattcggcaacgactgcgtggtggcgataggcgacgcgccgaccgccatccgcgaggtagtgcggctggtgcgcgatcacggctggcggccgcagttggtcgtcggcctgccggtgggcttcgtcggcacccgcgaatgcaaggaagagctgcgcgcgctgctgcaagtgccgcgcatcaccaaccgcggcacccgcggcggctcgccgtgggcggccaccgtggtcaacgcgctgatgatagacgcgatcgaacacgttcatcagcagcagcaacgggaagaatga

SEQ ID NO: 1756 - DNA, 1125 bp, Chromobacterium substugae
gtgcgccagccctacgacctcgccgcccccgcgcccaacggcatgcgccgcggccgcaccaccggcagctgcgccaccgccgccgtcaaggcggcgctgatgctgctgctggacggcatcgacgccgacgaggtcttcatcagcctgccggacccggacttctacctggcggtgccggtagagaacgtggcctggctggacgaaaacaccgtgcgcgccgaagtgctgaagtacgccggcgacgaccccgacaacaccgacggcgcgacgatcttcgccgaggtaaggataaacggcagcggcgcgctgcgtttcctggccgcgcccggcgtcggcatggtcacccagcccggcctgcgcatcccgcccggcgagccggcgatcaacccggtgccgcggcagatgatgcggatggcggtggatgaagcgctggccggccggcccgaccccggcatcgacctggcgataggctgcgtcgacggcgacaagatcgccaagcgcaccttcaacccgatgctgggcatcgtcggcggcatctcgatcctgggcaccagcggcatcgtcgagccgatgtcgcaggcggcgtggatcgcgtcgatcgaggtttatgtgcgggtggcgctgggcgagctgccgactgccatcgccttcacccccggcaagataggccgcggctacgccgccgacaggctggggctagccaagaaacaggttgtccagatcgccaacttcgtcggcgactcgctggacttcgccgaatcggtgctgatcgagcagggccgcatcctggacacgctgtgggtgctgggccacccgggcaagatcgccaagctgttggacggcgtatgggacacccattccggcaagagcggcatggcgatggacgccgtcgccgacgtagcagccgacctgggccatgcgcccgaactggtggcgcaaatcaaacaagcgaataccgtggagaacgtagtgcagatcatgagcagccagccggacgcgcgcggctactggatggaaatagaacgccgcaccgcggcgcggatggcggccaaggtgcccagcgtgcggcaagtggcggtgcgcctctttagcatggacggcaccccgctgggagaagccgcatga

SEQ ID NO: 1757 - DNA, 729 bp, Chromobacterium substugae
atgaagctgggcacgctcataggcataggcgtgggccccggcccggccgggctgattccggtggcggcgctggccgcgctgcgcgaggccgacatcgtctacctgccgcgcgcgacgtccagcgacacgtctgtcgcccgactatgcctggccgggctggaattggacgagagccgcttccgcgaaatcgagttcgaaatgaatccggaccgcggcgcgctgtcgcgccattacggcgcgctggccgagcgactggccgccgaactgaaaaccggccggaacgtcgcctacctgaccataggcgactcgatgacttactccacctatggctacctgctggcggcgctgcgcgaaatgctgccgcagctggagacgcagaccttccccggtgtcaccagcttcgccgccaccgcgtcggccttgtcctggccgctgggcgaaggcaaggaacgcatcctgatcctgccctgccccgacgacatggccgagctgcaagccgatatcgacagccacgacatcgtggtgctgatgaagataggcaaacggctgccggacgtgctggcgctattgaacgatatgggcatcgcccagctgtgcgccttcgcccgccgcatcggcctgcccggcgaagtgctgtgcgccgacgcctcgcaattgacggccgacgccagcggctacctcgccaccatgctgatccgcaagacagccagagaaagacgccattcatga

SEQ ID NO: 1758 - DNA, 804 bp, Chromobacterium substugae
atgaaagtgtatttcatcggcgccggccccggcgccgccgacctgatcacgctgcgcggcagccgcctgctgggcgcggtgcccatggtgctgtacgccggctcgctggtgccggccgagatgctgagccactgccgcccggacgccgaaatccacgacaccgccgagctgaacctggaccagcaggaagcgctgtaccgccgcgcccaagccgaggacaaagacgtggcgcggctgcactccggcgacccggccatctacggtgccaccaacgaacagatgtgccggctggaagcgctgggcatcaaatatgaggtcgtccccggcgtgtcctcgttcaccgccgccgccgccgcattgggcagcgaattgacccggcccgaggtgtcgcaatccatcatcctcacccgcaccagcggccgcgccagcgcggtgccggagaccgagtccatcgccagcttcgccgcccaccgcgcgacgatgtgcatcttcctatccggccagcggctgaaacagaccgtcgccgacctgtcgctgcactacccgcccagcaccccggtggcgctggtgcgccgcgccagctggccggaccaatccgtccaccgctccacgctgggcaagatgctgtccgaggtgaagcagaaagactggctgctgaccacgctgctgttggtgggcgaggcgctgtcgcgcgaaggcggcgtcgaatccagcctgtacgcggccggcttcacccacatcttccgcgacggcgacgaacgcaagaccaagcgggccagcctgcggaaagaaaaccaggcatga

SEQ ID NO: 1759 - DNA, 747 bp, Chromobacterium substugae
atgagccgcgccgtgtggctggtgcgtgccgaggcgctgcccttgggccaaaagctggcatcggcgctagacgccaagctataccagccgtggctggatgcggatgccagcggccgcgagcaatttcgcgccgccttccacctgcacagccactgggtgctggtgatggccagcggcatcgccgtccgctatctggatggcctgccgcaaagcaaatacagcgacccggcagtggtggtgatggacgaagccgcccgcttcgccatcccgctattgtccggccacgaaggcggagcgaatgaccttgcctacgaagcggcgcggctgaccggcgccatcccggccgtcaccaccgcgacagaagcgatcaagccgctgacgctgggcatcggctgccgccgcggcaaaagcgccgaagccatcgaacaagcggtatcgcaagccttggccggccggccgctgtccgacgtgcgcgaagtggcgaccatagacctgaaggccgacgaagccggcttgttggcattctgcgcccaccacgcgctgccgctgcgcgtcatcgcccgcgaagacgtcgccgcccgcggctggaccggcgcgccgtcggactgggttcggcggaacgtcggcgtcgacggcgtgtgcgagccgtgcgcgctgatcgccagcccgcgggggaggttgatcgtgcccaagatggcattggatggggtgacggtggcggtagtggaggatgggccaattgtttga

SEQ ID NO: 1760 - DNA, 183 bp, Chromobacterium substugae
atgtgtggttccgcccggtgggcgggtaagggggctgcgcggccagcgcccttacaaccccaggccgcccctgcgtcgcgcgaatttccggcaaacatcaggctggcaaggcgctgccgaactcgccgcgcgctagcgtcgcacggctcaaacaagcggcagcttaaaaccttgccagcctga

SEQ ID NO: 1761 - DNA, 1545 bp, Chromobacterium substugae
atgaccggcaaactctacctcgtctcggtcggccccggccgcgccgaactgatccccgaccttgcccgccaggcgctggccgcgagcgacgtgatcgtctcctacgacctctacctgacctgggtgcaaccatggatcgccggcaaggacatccgcacgctgccgctgacccaggagcgcgaacgcgcgcagctggccctggacgaagcccgcgccggcaagaccgtggccttgctgtccagcggcgacatcggcgtctacgcgatggccacgctggcctacgaagacatgcgcgaggacgatagcttcgacgtgcagctgatccccggcatcacctcggccaactcctgcgcgtcgctgctcggcgcgccgctgtcgcacgacttcgccacgctgagcctgtccgacctgctgtgcccgtgggagtggatcgaaacccgcgcccgccacatcgcccaggcagacctggcggtggtgttctacaacgtgcaaagccgccagcgccaggagggcgtctaccgcatcctggacatcatgctggagcacaaaaagcctgagacattgtgcggcatcgtccgcaacgcctaccgcgaagaccaggcggtggaaatcgtcaccctggccgagctgcgcacccgccgcttcgacatgctgaccagcatcgtcatcggcaaccgcttcacccgccgcaagcgcaactggatgttcaccccgcgcggctacttcaactgggacaacaccagcgacacggtgaaggccgacgcgctgcccgccggcgccgcctgggtgttttccggcaccagcgacggcaacgcgctgtcgcgcgccatcgccgaaaccggccgcgcggtggtggtcagcagcgccagcgattacggcaacgagcaagcgcagcaggccgtgcccggcgtcgccaccgtcagcggccggctgggcgtggagcgccgccgcgagctgctgtccggcagcagggcttcggccatcgtcgacgccacccacccctacgccagcgagatgtcgcagcagctgatggcgctggccgaggaactggccctgccctatctgcgctacgaacggccggccagcggcagcgcgcatccggtgatccgctgcgccgacagcgatgcagccgccagaatggcgatggcgaaaggacaccgcatatttctcgccaccggcagcaaggagctgcaccgcttcctctccgccgacgcggagcacaaacatcaatggttcgtgcggctggcgccggacccgcagcacctgcagcgggcgctggacttaggactcccgcgttcgcgcatctgcgcgatgcaaggcccgttctcgcaggccgccaacgaggcgctgtggcgcgactggggaatcgactgcgtgatcagcaaggacggcggcgaggccggcggtttcgacgccaaggccgcggccgcggcggcgctgggcatcccgttcatcgtcatcgaccggccgcaactggactacccgcaatctttcgacgatttcgagtccgtgctggcggtcctgccgcagggaggccaggcatga

SEQ ID NO: 1762 - DNA, 1107 bp, Chromobacterium substugae
atgagcgcgccgcgccttcccgtcaccgtgctgaccggtttcctcggcgccggcaagaccacgctgctgtccaagctgctggaaaacaacaagcaacgccggctggcgatactcgtcaacgagttcggcgaggtgtcgatagacggcgggctgctgcgcgacgccgacgccggcggcgtggaaatccacgacctcgccaatggcctggtcgcctacgacgacgacgccgacttcctgcccaccatgctggcgctgtggcagcgccgccagcagatcgaccacgtgctgatcgaaacctccggcctcgcgctgcccagcgcggtgatggcgcagctgcaaagcgaggcgctggcgccctatttcgtgctggacgcgacgctggcggtggtcgacaccccgctgctgctggccggccacttctccccggccggcaacggcggcgaggccgacgcggtggcggaactgttcgaccagcagctgggccacgccgacatcgtggtgctgaacaagatagacgcgctgtccgcagatgaactgctggcggcggaggaaaccgtgcgccggcaggcgccgtcgatccgcttcatcgaactggcctatcaagccaggctggacacccggctgacgctgggcctgcatctgcacgaggccgcgccggccgcgcaccgccattacggcccggtggccagcatgccggggctggcgatgcggccgctggccaaccaaactttgctcgatggccacagccacggcggccaggccgcgcacagccacggcctgtccacccacaagcatttccacgagcaggacccaggctggcaatcgttcatgatacgcagcaaggagccgcagcatgccgacaagctggccgcggcgctggaggccatcgcccgcgaggagccgctgctgcgcatcaagggcttcgccgcctgcgccgacggccccggccggctgctggcccaaggcgtgcgcaagcgcatcgaactgagccgcgacgaggcgctggccgcgccacgccaggcgcagctggtgttcatcggctaccaccccagccgcccgcgcgtggtggccttgctgcgcgacatcaccggcgcgcactggagctag

SEQ ID NO: 1763 - DNA, 801 bp, Chromobacterium substugae
gtgagcgcattggaactatgcggcctggactggtcgcccgatccgcgctgcgcgccggaagagcggctgctgcgcggcatcgcgctcaccgtccggcccggcgagttcgtcggcgtcatcggccccaacggcagcggcaagaccagcacgctgcgctgcgccttccgcttcaaccagccgctggccggcgaggccaggctggacggcgccgacatctggcgccagtccgccgccgccttcgcccgccgcgtggcggtggtgctgcaggagttcccggaggacttcggcctgaccgtgcgcgaggccgcggagatgggccgcatcccgcaccagtcgctgctgcgcggcgcgccagcggacgatgccgacatcgtcgacgacgccttgcgccaggtggggctgctggagcggcaacaccagtccttcgccacgctgtccggcggcgagaagcagcgcgcgctgctggcgcgggcgctggcgcaacagccggaactgctgatcctggacgagccgaccaatcacctcgacctgcgccaccagctgtcgctgctgcgcctggtgcgccggctgggcatcgccgccgtcgccaccctgcacgacctcaacctggcggccgccttctgcgaccgcctgtacgcgctgcaagagggccgcatcgtcgccagcggcagtccggccgaagtcctgactgccgacctgctgcgcgaggtattcggcgtgcgggcgctgatagacgcgcacccgctggccggccacccccgcatcaccctgatcaccgaagagcatagccatgagatttga

SEQ ID NO: 1764 - DNA, 969 bp, Chromobacterium substugae
atgagatttgactttcccctgctgctggccgccggcctcgccgccctgtccgccgtccaggcgcacgccggccattacccgctgaccgtccagagctgcaaccgccaggtgactttccagcgcgcgcccgaacgcgcggtcagccacgacatcaacatgaccgagatgatggtggcgctgggcctgcaaaaacgcatggccggctatagcggcatcagcgcctggaacaaattgaatgccccattgaagcaggcgctgggcgcgttgccggagctggccggcgactacccgtcggccgaggccttgctggcgcgccgcgccgacttcttcttcgccggctgggattacggcatgcgtgtcggcggcccggtgacgccggcttcgctggcgcccttgggcatcaatgtctatgaattgagcgaatcctgcgcccacgtgatgaagcgcccggcggccagccttgccgacgtctaccgcgacatcggcaacctcggccgcatcttcgacgtggagccgcgcgcgcaaaaagtcatcgccgagatgcgcgccaaagtggacagcgcgtccgcccgcgtcgccaagcgccaggccacgccgtcggtcttcgtctacgacagcggcgaagaccgccccttcagcgccggccgtctggcgatgcccaacgcgctgatccaggccgccggcggccgcaacatcctggacgacgtcgacgccagctggacccgggtgaattgggaaacggtgatcgcccgcaacccgcaggccatcgtcatcatcgactacggcaaggtgaccgcgcagcagaagatcgccttcctgcgcaaccacccggcgctgggcaagctggacggcgtgaagaaccagcgcttcatcgtgctgccctatgacagcgcgacgcctggcatcgccaatgccgacgcggtggtggcgctggcgcgcggcctgcatccgcaggccttcgcccggtga

SEQ ID NO: 1765 - DNA, 1032 bp, Chromobacterium substugae
gtgagcgcgcccgccttcgcgcgcggcccggcgccgctgccgcccattcttctggcgctgctggcggcgctggccgcctcggtgctgctgaccgtgggcctgggccccgcgccggtcggcctggccgatagctggtccatcctgctgcatcagctgggcgcgccggtcgcccccgcctggcagcccggccaagacctgatcgtctggcagctgcggctgccgcgggtgctgctgggcggcctggtcggcgccggcctcgcgctggtgggcgcggtgctgcaggcggccacccgcaacaagctggccgacccgcacctgctgggcgtcagctccggcgccacgctgggcgcggtgtcggtgctgctgttcaccggcaacctggccggcagcctcaccttgccgctggcggctttcgccggcgcgctgctcagcaccgcgctggtgatggcggtcgcgctgcgccagcgccggctgcaggccgaacgactgctgctggccggcgtggcggtgtccttcttcatgatggcgctggccaatctgctgatctacctgggcgaccaccgctccacctcgtcggtgttgttctggatgctgggcggcctgggccaggcgcgctgggaactgctgccggtgccggcgctggcgctgggttccggcctgttggcgctggccgcgctgggccgcccgctcaatgcgctgatggcgggcgaacagaccgccgtcacgctgggcatacaggtgtcgcggctgcgcctggcggtgttcgccgtctcctcgctgatgaccggcgtgatggtggcggtcagcggcgcgataggcttcgtcggcctgatgattccgcacatcgcccgccgcttcgtcggcgccgaccaccgccggctgctgccggtgtgcgcgctgtccggcgccattttcctgatctgggtggacgccgccgcgcgcacgctgatcgcgccggaggacatcccggtaggcgtcggcaccgcggcgataggcggcgccttcttcatctggctgatgcgcgcgcgctga

SEQ ID NO: 1766 - DNA, 603 bp, Chromobacterium substugae
atgaaaaccgatccggcatcccaccaacgcatggccgagaagcgcaaggcgggctttgaaaagaaaaaagccgccgccaccaaggaaaaaggcctgctcatcgtccacaccggcaccggcaagggcaaaagcagcgccgccttcggcatggggctgcgcaccgtcggccacggcatgcagctgggcgtggtgcagttcatcaagggcgcgctgcacaccgccgagcgcgacctgctgggcggctttcccaactgcgacttccacaccatgggcgaaggctatacctggaacacccagaaccgcgacgccgacatcgccaccgcacgcaagggctgggacgaagcctgccgcatgctggccagcggcgaatacgatatggtgatcctggacgaactgaacgtggtgctgaaatacgaatacctgccgctggacgaagtgctggccgccttcgccgcccgcccggccgacctgcacgtggtggtcaccggccgccacgcgccggaagcgctgatcgaagcggcggacctggtgaccgaaatgcggctggtcaaacacccctaccgcgaacagggcatcaaggcgcaacagggcgtggaattctga

SEQ ID NO: 1767 - DNA, 1293 bp, Chromobacterium substugae
atggaaacccgccactgcccggcgctgtttctcaccgctcccgcctcgcaccagggcaagaccacgctgacggcggcgctggcgcggcatcaccgcaagcagggccgccgggtgcgggtgttcaagaccggcccggactttctcgacccctacatcctggagcaggccagcggccacaccgtctacggcctggacctgtggatgaacggcgaggacgactgccgcgcccggctgcatcaggccgcggcggaagcggacctgatcctgatcgagggcagcatgggcctgttcgacggcacccccagcagcgccgacctggccgagttgctgggcgtgccgctggtcgcggtgatagacgccgccggcatggcgcagaccttcgccgccgtcgcccacggcttggccagcttccgtcccggcctggtcttgcacggtttggtcgccaaccacgtcgccagcgagcgccatgccgaaatgctggcccagcagttgcccgtccatctgccgctgctggccgcgctgcgccgcgacgaggcggcgcggctgccggaacgccacctgggcctggtgcaggcgcaggagatcgccgatctggacgccaggctggagcgttcggcggcgcagatcgcgggcaccgccttggccgcgctgccgccgccagccgcctttcccgccatcgcgcagcctgccgtgcccaggcagctggcgggcaagcgcatcgccatcgcccgcgacgccgccttcgccttcgtctatccagccaatctggaaacgctgcgccagctgggcgccgaactggccttcttctcgccgctggccgacgccgcgctgccggactgcgacgccgtctacctgcccggcggctacccggagctgcatcttgaaacgctgtccgccaacacggcgctgaaagcggatctgcatggacacgtcgaagccggcaagccgctgtacgctgagtgcggcggcatgctctacctgctggacaggctgaccaaccgcgataacgacaacgcggcgatgctggggctgctgcccggccacgccacgctgcaagcgcggctgtgcgggttgggcctgcagcaaatggacttccccggcggcgcgctgcgcggccataccttccactacacccggctggaaacggctctggagccaatcgcccgcgccgagcgcgccagcggcgccggccagggcgaggcgctgtatcgccgcggcagcctgctggccagctatttccacgcctactttccgtccaatccccttgccaccgcgagcctgttcctgtcatga

SEQ ID NO: 1768 - DNA, 645 bp, Chromobacterium substugae
atgaaccgttatccgcaagccgacatcgacgccatctaccgcgctatccgcgaacgccgcgacatgcgccacttcctgccggacccgatcgattccgaaaccatgcggcggctgttggccgccgcccacttcgcgcccagcgtcggcttcatgcagccgtggcgcttcatccgcatccgcagcgccgaactgcgcggccagctgcacgcgctggtggagcaagagcgcatccagaccgcccgcgcgctgggcgagcgcgaagacgagttcatgaaactgaaggtggaaggcctgctggattgcggcgaagtgctggtggcggcgctgatggacggccgcgagcggcacgtgttcggccgccgcacgctgcctgagatggacctggcctcggtggcctgcgcgatccagaacatgtggctggccgcccgcgccgaaggcctgggcctgggctgggtatccatcttcgatccggccaagctggccgcgctgctggccatacccgccggcgcgcggccggtggcgatactgtgcatcggccatgtcgaggcgttttacgagaagccgatgctggagcaggaaaactgggcccgccggcaaaacctggccgacctggtctacgacgaccgctggcccggccaggcctga

SEQ ID NO: 1769 - DNA, 1092 bp, Chromobacterium substugae
atgaaaactgcaaaaacaatggcggcgctatggctgctggccatcggccatctggcgcatgccgatgcgacggtgccgcgctgggcggtgcaagccgaagggcggcaagtccgccacgccgacggctggcaggccacctggcccggcgtcaactggcaggtccgcgtcgccgcccaggcggtgggcgtcacgctggacgacgcggtcaactactatgcgctggaagtggatggcaaggcggtgcaaaaaatcggcccggccgccggcgagcgcacgctctggcaagacctgccggaccgccgcccgcacatcgtgcgcctgttcaagctgacccagtctccggacaatcccggctggttcaaaggattttcgctgcgccagggccaagtgctggagcagccgcccaagccgcgccgccagattgaattcatcggcgattcctggaccgtggcctacggcaacctgtccaccacccgcgactgcaccgatcagcaaatcgtcgagcgcagcgacgccagccagagcttcgccgcttatctcggcaaacgccacggcgcgcaaattcagaacgacggcatgtccggcatgggcatggtgcgcaactggggcggcaatatgccggaagtcgactaccgcagctatcatccgcggctgttgcagaacctgccggccagcgcgccaggcaacaacgccgagcatcgcgacaactggcggccgcagctggtggtgatcgcgctcggcgtcaatgatttcggcaccgatgtcggccctggagaaaagcgcagccagcagcagttggccgacgactacgtccaggcctatcacggcctgatcgcccgcctgaagcagcgctacgacaaccccgccttcctgctggccgccacttatctctggccagccgaccggatgcggccgctggtcagccgcatcgccgacgaggaaagacagcaagggacgacggtggcctacgtggactggcaaaacatagagctgaccggctgcaactggcaccccaacttatccgaccacgccaaaatggccgaccagatggacgccgccatccgcacgctgggcaatatctgggacaagtaa

SEQ ID NO: 1770 - DNA, 423 bp, Chromobacterium substugae
atgaagccgcgcatcactttgctgacgctgggggtggacgatctgcagcgcgcgctgcgtttttaccgcgacggtttggggctggcaagcgagggcatagtcggcgccgagttcgagcacggcgccgtcgcctttttcgaactggaaggcggtttgaagctggcgttgtacccgcgcgccagcctggcgcatgacgcgggcctgcctgagccgcgggccgccgccgccggcgtgtcgatcggccacaatgtttcctcccgggggcaggtagatgaaacgatggcgcaggcggcgcgcgccggcggcaccatcgtcaagccggccatggacacgttctggggcggctatgccggctatttccaggatccggacggctatctgtgggaggtggcctggaatccgcagtgggaggttcgggattga

SEQ ID NO: 1771 - DNA, 783 bp, Chromobacterium substugae
atgttcgagcaggatgtggtgcgttaccaggtggaagatggcattggccggatcacgctgaaccggcccgactgcctgaacgcgatgaaccgcccgctgctgcgccagctgctggcggcgctggagctggccgcggtggatgaatcggcgcgggcactgatcctttgcggcagcggccgggtgttttccgccggcgcggacatccgctttctcagccaggcttcggcggccgaggtgagggagctggcgcggctggcggtggctgtgacaagcaggatagaggcgcttggcaagccggtgctggccgcgatcaacggcgacgcgctgggcggcggcctggaaatcgccgaagcctgcatgttgcgtctggccgcgccgcatgcccgtttcggccacccggaagtgaggataggcgcggtggccggtttcggcggcaccacgcggctgcccaggctgataggcaagggcagagcggcggagctgctgctgaccggcaggctgatcgatgccgaggaggcgtgccggctgggcctgatcaatcgggtggtggccgccgcagatttgctggcggaatcggaggctttgctgcgcgaggtgatggcgcagtcaccggtggcggtgcggctcacctgggaggcgttgcaccgcggccttagcctgacggaagacgaggcggcgcggctgggggccgattatttcggcctggcggcgcagagcgaggatttccgcatcggcacccgcgcttttctcgacaagcaggcgccgcatttcaaaggacgctga

SEQ ID NO: 1772 - DNA, 468 bp, Chromobacterium substugae
atgcccgccatcatccgccaagcccttccttccgatctggaaaccatagtcctgctgcgcatgcggctgttcgacgacgcggccgcgctcaacggcgtcggccccgacgaaaccatccgcgccgccaccatcgcgtatttccgccaggcgctgcaaggcggcgattgcgtcacctgggtggcggaggaggccggccaggtggtcgccatcggttcgctggcggtgttcgctcggccgccttatccgggcaatgccgccgggcgggacgcgtatttgctgaatatgtacacgctgccggatcatcgcggccagggccatgcgcgggcgatcgtgcgcagcgcgctggcgctggcgcagcggcggggttacggcaaggtctggctgcatgcgacggaggcggggcggccgctgtatcggcaggaaggctttctcgcgtccgccgattacatggagtgggcggcgggctaa

SEQ ID NO: 1773 - DNA, 339 bp, Chromobacterium substugae
atggaaacgccgccgccatcgccctgtatcggcatctgccgcctggacgagagcgggcaggtgtgcgtcggctgccgccgcacgctggacgagatcgccggctggtccagctatggcaaggaagagaaggagcgggtctggcagcgcctgttggccttgcctgtgccggtgcaggccaagacctgcgcccgttgcggcggtggcttcacctgcggggcgggcggcgaggcgggcggctgctggtgcgcggatctgccgcggcgcttgtcgccaagcgcggcggacagcgactgcctgtgcccggcgtgtctgcagcggcaactgcgcgtcgagaattga

SEQ ID NO: 1774 - DNA, 1224 bp, Chromobacterium substugae
atgcaagtatccaagctgtctaccctgactctggcggttgccgccgctgtcgccctgtccgcctgcggcaagaaggaagaagccgctccggcaggcgccgcttcggctccggcccaggcgagcgctggcggcgacgtggtcaagatcggcttcgccgcccccttgaccggtccgcaatcgcactacggcgaggaatacaagaacggcgtgaccctggcgatcgaagacgccaacgccgagaagccgaccatcgccggcaagccggtcaccttcgaactggacgcccaggacgatcaggccgatccgaaaaccgccacccagctggcgcagaagttcgtcgacgagaaagtcgccggcatcgtcggccacttcaactccggcacttcgatcccggcctccaagatctactccgacgccggcatcccgatgatcgcgatggcgacttcgccggtattcaccgcgcaaggcttcaagaacaccttccgttcgatgacctccgacacccagcagggcggcgtgatgggcaagttcgtggtgcagaacctgaaggcgaagaagatcgtcatcgtcgacgaccgcaccgcctacggccagggcctggctgacgaattcgagaagtccgcccgcgcggccggcggcgaagtggtgaagcgcgagttcaccaatgacaaggccaccgacttcaccgccatcctgaccagcatcaagggcgcgaacccggatgcggtgttctacggcggcgccgacgcgcagtccgccccgatgaccaagcagatgaagcgcctgggcatcaaggcgccgctgatctccggcgaaatgaccaagaccccgactttcctgcaactggcaggcaaggaagccgacggcaccatcgcctcgctggccggcctgccgctggagcagatgccgggcggcaaggactacgaatcgcgctacaaggcccgtttcaagtccgatgtggccacctactcgccgtacggctacgacgccgcgcgcacgctgatccaggcgatgaaggacgccaattcggccgatcccaaggtctacatgccggtgctggccaagatcacccacaagggcgtgacttccagcaactggacctatgacgacaagggcgacctgaaagacggcggcatcaccgtttacaaggtggaaaacggccagtggaaagtgctggaaaccgtcggcggcggcgtggccaaggacgcatccgcagccaagtaa

SEQ ID NO: 1775 - DNA, 3594 bp, Chromobacterium substugae
atgcaatttgaagcttttgctcatcatcaaaccgctttgcgcgatgcgatcaccgccgcctaccggcgcgacgaacgcgaatgcgtgcaggccttgctggcgcaggcggcgatgagtccggaacaggtgaagtcggtgcagcagctagccagccgcttggtgaccgaggtgcgccgcgagcgcacccgctccagcggcgtcgatgcgctgatgcatgagttctctctggacagcagcgaaggcatcgccctgatgtgtctggcggaggcgctgctgcgcatccccgaccgcgtaaccgcggacaagctgattcgcgacaagatttcccgcggcgactggaaggcccacctgggtaacagctcgtcgctgttcgtcaacgccgccgcctggggcctgctggtgaccggcaagctggtttcctcgcacagcgcctccggcctgtcggccgcgatgacccggctgatcgccaagggcggcgagccgctgatccgcaagggcgtcgacatggcgatgcggatgctgggcaagcagttcgtcaccggtgaaaccattgaggaggcgctggccaacggccgcgagcgcgaggcgcgcggctatcgtttcagctacgacatgctgggcgaagcggcgatgaccgaagccgacgcgcagcgctatctgaaagactacgtcaccgccatccacgcgatcggcaaggagtcgaacggccgcggcatctatgagggcccgggcatttcggtgaagctgtctgccatccacccgcgctacgcccgtctgaagcatgagcggatgatgagcgaactgctgccgcgcctgaaggatttgttcctgctggccaagcagtacaatatcggcctgaatatcgacgccgaagaagccgatcgcctggaaatttcgatggacctggtggaggcgctggccaacgatccggatctgaacggcttcgaaggcataggcatcgtggtgcaggcctatcagaagcgctgtccttatgtcatcgacttcctgatcgacctggcgcgccgcaccagccaccgcttcatggtgcggctggtgaaaggcgcctattgggacgccgagatcaagcgcgcccaggtggatggcctgccaggctacccggtgtatacccgcaaggtgtacaccgatgtgtcctacctcgcctgcgccaaaaaactgctggccgcgcaggacgccatctacccgcaattcgccacccacaacgcctacagcctggcggcgatctatgacctggccaccgggctggattatgaattccagtgcctgcacggcatgggggaaacgctgtatgaccaagtggtgggcaaggacaagctgggcaaggcctgccgcatctacgcgccggtgggttcgcatgaaaccctgctggcctacctggtgcgccgcctgctggaaaacggcgccaactcctccttcgtcaaccgcatcgtcgacgaagcggtgtccatcgccgaactggtgaccgacccggtggccgaagcggcccgccatgccggcgcgccgcacggcaagatcgcgctgccggccgagctgtacggcaatggccgccgcaactccaagggcctggacctgtccagcgagcacgtgctggctaccctgcagctgggcctgcaggcgtccgagcagcaacgctgggcggctttcccgatgctgggcgacggcgatgtcagcgacggccagttgctggaggtgcgcaatccggccaatcacgccgacatcgtcggcaaggtgatagaggccagccccgccgatgtggagcgcgcgctgacgcaatcggccggctacgccgccgcctgggccgccacgccggtggcggagcgcgccgcctgcctgaaccgcatggccgacctgatggaagccaatatgccggcgctgatgggcctggcggtgcgcgaagccggcaagacgctgaacaacgccatcgccgaagtgcgcgaggcggtggacttctgccgctactacgccgcgcagatcgccgccgaattcgacaacgccagccatcagccgctgggcccggtggtgtgcatcagcccgtggaatttcccgctggccatcttcatcggcgaagtggccgcgtcgctggccgccggcaacaccgtgctggccaaaccggccgagcagaccagcctgatcgctgcttacgccgtgcgcctgctgcacgaagccggcgtgccgcgcgccgcgctgcagttcctgccgggccgcggcgaggtggtgggcgcggcgctgaccggcgacgcgcgcatccagggcgtgatcttcaccggctccaccgaagtggcgcagatcatcaaccgcacgcttgccaagcgcagcgacgacaccgtgctggtggcggaaaccggcggcatgaacgcgatgatagtcgacagctcggcgctgccggaacaggtggtgaccgacgtgttgagctcggccttcgactccgccggccagcgttgctcggcgctgcgcgtgctctacctgcagcacgacatcgccgacaaggtggtcaagatgatcaagggcgcgatggacgagttgacggtgggcaacccggccaagctcaccaccgatgtcggaccggtgatcgacgcggaggcgcaggccggcttgctggcccatatcgaaaagatgaagaagtccgcgagggcggtgcatcagaccaggctgtccagcgagtgcgagcagggcacttatgtcgcgccgacgctgttcgagatcgacaatctgtccgaactgaagcgcgaggtgttcggcccggtgctgcacgtgctgcgcttcgccgccagcgatctggaccaggtggtggccgagatcaacgccaccggctacggcctgacccacggcattcatagccgcatcgacgaaaccatcgccgacatctgcggcaagatcaaggccggcaacgtctacgtcaaccgcaatatcgtcggcgcggtggtcggcgtgcagccgttcggtggcgagggcaagtccggcaccggccccaaggcgggcggtccgtattacttgtatcgcttgagccgcgccgcctggcagccgaagctggccgccgttaacgctgccgtcgagctgccggcgctggaggcgttggccgccgccgccaaggcgcaggggctggcgttggatggcgctatcgccgcggcgcgcaaggaaagcccattggcgcacagcgtggcgctgccggggccgaccggcgagaacaacacgctgggcttcgccggccgcggccgcatcggctgcgtggcggacgacgcgcaagcactggctgaacagctggccgcggtgttcgccgccggcaaccgcgcggtattggccaaggacggcgccggcgccaagctggctgcgcaattgggtagccatgtcgaactggcggcggacgtgctggccgccgacgtggacgcggtgctgttcgccggctctggcgcggaggaggcgcgccgccgcctagccgcccgcgacggcgcgctggcgcaactgatcctgcgcgacgcgcatggctataatattcaccggctggtggtggagcgcgcgctcagcgtcaacaccacggcggcgggcggcaacgccagcctgatgagcatgagcgaataa

SEQ ID NO: 1776 - DNA, 118 bp, Chromobacterium substugae
tatctggtgacaatagcgaggtggtcccacgccttcccataccgaacaggaccgtgaaacgccttagcgccgatgatagtgtggcattcgccatgtgaaagtaggacatcgccagatt

SEQ ID NO: 1777 - DNA, 118 bp, Chromobacterium substugae
tatctggtgacaatagcgaggtggtcccacgccttcccataccgaacaggaccgtgaaacgccttagcgccgatgatagtgtggcattcgccatgtgaaagtaggacaccgccagacg

SEQ ID NO: 1778 - DNA, 118 bp, Chromobacterium substugae; identical to SEQ ID NO: 426

SEQ ID NO: 1779 - DNA, 1590 bp, Chromobacterium substugae
atgaaaaaaaacctgcccgtggacagcattgaattatttctgctgccccaccgtcccatcgtcaccaaaaccgatctgaaaggccagatcacctacgccaaccgggccttcatcgacatcagcggcttcagcgaagaagagctgatcggccagtcccacaatgtcgtccgccatccggacatgcccgaagaggcgttcgccgacctctggaccaccatcaagtccggccgcccgtggaaaggcctggtcaagaaccgcagcaagcaggggcatttctactgggtggaagcctacgtcacgccgatctgcgaaaacggccgcccggtgggctatatgtcggtgcgcagcgcgccctccaagacgcaaaccgccgaagccgagcagctctacgcccgcgtccgggaaaagcgccaggccttcccgcaaacccgccacaccacgccgctgccgctgagcctggccatgctgctggcgcagctgccttccgcggcgctggccttggccgccgccgccctgcccggcggcgcggcgcgggtcagcctactcgccctgctggccctttgggcgccgctggccggctacctggccgcccgctggcagacgccccccatcgatgccgcccgcaaagccttgatgcgcctggccgaaggcgacttcagcagccagatcgccccggccggcctgcgcgagccgcgcgcggtgctggaagaaatggaaaccctgcgcatccacctgcgcgccatcctggccgacgtggtggccggagccgaagacatcagcgaagccgccagcgccacccacgctgaggccgaatcgctgaactcgcgcggcgaacacacgcaggaaggcatcatccgggtggcggcggcgctggagcagctgtcggtggcggtcaacgaaatctcccaggccacccgcaccggcgccgacttcgccggccaggccaccgaactggccacccagggcgaaacgcagatgaacggcacccgccaggccgcgctggaggtggtcaacgaggtgtccagcacccgcaacaccatcatcaagctggaacagtcggtggaatcgatcaacaccgtcaccggcgtgatcaaggaaatcgccaatcagaccaatctgctggcgctcaacgccgccatcgaggcggcgcgggccggcgagcaaggccgcggcttcgcggtggtggccgacgaagtgcgcaagctggccgaacgcaccgccggcaacacgctggagatagaacagtcggtggccttcctgcgcgaacgctcaagcgaagcgctggccgacgtcaaggcggcggtggacaaggtgcacatcgccgaagcgacgatacaggtggcggcccaggggctggaggccatccgcggcgccaacgagaaagtggcggaatcctccgccagcgtggccaatatgctgcggcaacagtcgtcggcctccaccgaagtcgcccagaacatggaaaccatgagccgcctgaccgagcaaaacggccacagcatcagcaccacgctgcaagtggcccagaaactgcacctcaccgccggcgacctgcgccggctggtcagccagtttgaaaaacacatgtga

SEQ ID NO: 1780 - DNA, 1005 bp, Chromobacterium substugae
atgatttttgccaatcgctatttccctgccacccgcatgcgccggatgcgcaaggatgcgttcagccgccgcctgatgcgtgagaatgcgctcaccgtcgacgatctgatttacccggtgttcgtgatggagggcagcaaccagcagattgacgtgccgtcgatgccgggcgcgccgcggctgacgctggacaagctgctttacgtggcggaagaggcgctggagctgggcattccgatgctgtcgctgttcccggtgatcaccggcgacaaggataacgaaggcagcgaggcgtacaacccggaaggcctggtgccgcgcgtggtgcgcgaactgaaaaagcgcttcccggagctgggcgtgatgaccgacggcgcgctggacccgtacaccatccatggccaggacggcgtgatagacgccaacggctacgtgctgaacgacgaaaccaccgagatcctggtcaagcagggcctgtgccatgccgaagccggggtggacgtgttcggcccgtcggacatgatggacggccgcatcggcgccatccgccaggcgttcgaggaagaaggcttcatccacaccaagatcctggcttattccgccaagtattcgtccggcttctacggcccgttccgcgacgcgctgggttcgtcggccaatctgggcaaggccgacaagaacagctatcagatggatccgggcaatatcgaggaagccatccaggaagtggcgcaagacctggaagagggcgccgacatggtgatgatcaagcccggcatgccttatctggacgtgatccgccgcgtcaaggacaccttccacgtgcccaccttcgcctaccaggtgtccggcgagtacgcgatgctgaaggcggcgttccagaacggctggctgaacgaagaaaagtgcatgatggaaagcctgctggcgttcaagcgcgccggcgccgacggcattctgacttatttcgcgatggacgccgcgcgtttgctgcgccagcgttga

SEQ ID NO: 1781 - DNA, 222 bp, Chromobacterium substugae
atggatgtactgcatgccacatggttttgggtggcggtgatcgccgcgccggccatcgcgctgatcggcacgctggccaggctggcgcgcaaggagccgccgatcaagctgccgtccggcgtggcgccgctgcgttgggatgacgacgaggaagacgcgccgtccggcgaggccaagccgcccgtcgccggcaacggtgacagagtgccgccaaaacactga

SEQ ID NO: 1782 - DNA, 1206 bp, Chromobacterium substugae
atgaaccacacttaccttgcccacctgcaagccacgctggcgcagatccgggccgacggcttcgaaaaaccggaacgcgtgatcgccacgccgcaaagcgccggcatcgcgctggccggcggcgagaaggtgctgaacttctgcgccaacaactacctgggcctggccgacgacaagcggctggtgctggccgcgaaggccggcatggacgagtacggctacggctgcgcgtcggtgcgcttcatctgcggcacccagtccatccacaagcagctggaaaaatccatttccgaatttctgggcaccgacgacaccattctttactccagctgtttcgacgccaacggcggcgtgttcgaaaccctgctgagcgaagaggacgcggtgatctcggacgagctgaaccacgcctccatcatcgacggcgtgcgtctgtccaaggccaagcgcttccgctacaagaacaacgacatggccgatctggaagcgcagctgatcgccgccgaagcggccggcgcgcgcttcaagctgatcgtcaccgacggcgtgttctctatggacggcatcatcgccaacctcaaaggcctgtgcgaagtggccgaccgccacggcgccatcgtgatggtggatgactcccacgcggtgggcttcatcggcgaatccggcgccggcacgccggagctgtgcggcgtggccgaccgcgtcgacatctacaccggcacgctgggcaaggcgctgggcggcgcgtccggcggctacgtggccgcgcgccagcccatcgtcgacctgctgcgccagcgctcgcgcccctatctgttctccaacacgctggccccggccatcgccgccgccagcgtggaagtgctgagcatcctgaagagcggcgaaggcgccgaactgcgcgccaaggtgcgccgcaacgccgaattgttccgcaaggaaatggccgccgccggcttcacgctggtgccgggcgaacaccctatcgtgccggtgatgctgggcgacgcccgcctggctggcgagatggccgccaggctgctgaaggagggcgtttacgtgatcggcttctcctacccggtggtgcccaagggcaaggcgcgcatccgcacccagatgtccgcggcgcacagcgaagagcaggtgctgcgcgcggtggccgccttcatcaaggtgggccgcgagctgggcgtcatccccgattaa

SEQ ID NO: 1783 - DNA, 1026 bp, Chromobacterium substugae
atgaaggcgttagccaaactgaaggccgctcccggcctggaaatgaccgatgtgccgatgccggaagtcggccacaacgatctgttgatcaagatcgtcaaaaccgcgatctgcggcaccgacatccacatctggaactgggacgaatggtcgcagaagaccatcccggtgccgatgcacgtcggccacgagtacgtcggcgtcgtcgccggcatgggttcggaagtgcagggcttcaagatcggccagcgcgtgtccggcgaaggccacatcacttgcggttactgccgcaactgccgcgccggccgccgccacctgtgccgcaacaccaccggcgtgggcgtgaaccgcgaaggcgcgttcgccgaatacctggtgatcccggccttcaacgccttcccgatcccggatgacatctccgacgatctggcctccatcttcgaccccttcggcaacgccgtgcacaccgcgctgagcttcaacctggtgggcgaggacgtgctgatcaccggcgccggcccgatcggcatcatggcggtggccatcgccaaacacgtcggcgcgcgccatgtcgtcatcaccgacgtcaacgactaccggctggaactggcgcagaagatgggcgccacccgcgccgtcaacgtcgccaagcaggacctgaaggaagtgatgcaggaactgggtatgaccgaaggcttcgatgtcggcctggaaatgtcaggcaacccgcaagccttccgccagatgctggaaaccatgaaccacggcggcaaggtggccttgctcggcatcccgccgtccaacaccgccatcgactggaaccaggtgattttcaagggcctggaaatcaagggcatctacggccgcgaaatgttcgagacctggtacaagatggtggccctgatccagtccggcctcgacatcagccccatcatcacccaccactacaaggtggacgatttcgaagccggcttcgcctccatgctgtccggccaaagcggcaaggtgatcctggactggagctga

SEQ ID NO: 1784 - DNA, 1560 bp, Chromobacterium substugae
atggcgcatgaaatccgcatgaaaacccggctcgtcgcgctgggcgtgatcaacctgtctaccctgttgctgctggtcgtcgccggcatctatcagctttccgcgatgaaccgcgacatggagcggcaattgaaccatgtcgcccagcaaagccggatcaaccgcagcgtgcaattggccaatttgcatttcaagatccaggtgcaggaatggaaggacatcctgctgcgcggcaacgcgccggccgactaccagcgccacttcaacgccttccaggccgaaggccgaacggtggaccagacgctggaacaggcggcccagctgcaaaaagacagcggccaggaccgctcagccctcaacgccatcctgcagcagcacagccagctggatagccgctaccgcgccgcgctggcgtccttccggcagagcgaccgcctgtccggccaaaccgtggaccggctggtgcaggggcaggaccgcgacatgaccgagcagctgcttaacgccagcgccgccatccaggatggcttcgagcgactgctgcgggaccagatcgccgaatcgcgcagccattaccgcgacgagcgcggctggttcatcgccgccgcgctgctgagcctggcggcgctggccgccgccatcatctatatcggccgcagcctgttccgccaggtgggcggcgagccggccgaggtggccgccatcgccaagcgggtggctgccggcgacctgacggtgcgggtcgcgccgcgccccggcgacgacatcagcgtgctggcggcgatggcgcagatggtgcgccagctgaccggcgtgatcgaggagctggggagcaacgccgaatcgctgaacctgacctcggaagaagtctcggcctcggcccaggcgcttagccagagcgcgtcgcagcaggccgccagcctggaggaaaccagcgcgtcggtggaggagatcgccgccaccgtggcgcaaaactccgacaacgccggcatcaccaacgagatggcgggcaaagccgccgaggacgccgaccagggcagccaggcggtgggccagaccgtgtcggcgatacgggagatcgcccggcagatcgacatcatcgacgacatcgcctaccagaccaatctgttggcgctgaacgccgccatcgaagccgcccacgccggcaagcagggcaagggcttcaccgtggtggcggccgaggtgagaaaactggccgagcactgccgcaccgccgcgcgcgacatcggcaagctggcggtggacagcgtggcactggccgaacaggccggcggactgctggggcagatgctgccctccatccgcaagaccgccgacctggtgcaggaaatcaccatggcgtcgaaagagcaaagcgaggggctgatgcagatcaacaccgcggtgtgccaactgtcgatgaccacgcagctgagcgcctccacctcggaagagctgtcgtccaccgccgatcagctcaacagccaggcgctgcgcctgaagcagatgatggccttcttcaagacccgccgcgccgccgacgcgccgccgcatgactga

SEQ ID NO: 1785 - DNA, 1326 bp, Chromobacterium substugae
atgatcgcggtgataggcgccggcgtgtccggtttgtcatgcgcctggtggctgcgggcgcgtggcgcgccggtacgggtgtacgaggcagcgggccgggtgggcggcaaggtctggacccggaccgagggtgctttgtgcgaggccgggcccaatacgctgctggcggacgaggcgctgctgcgctggtttgaggagctaggcctgtcgccggtatggccggccggcggcggcaggccgcgccatgtgctgaaggatgggcgctaccacccgttgccgcagagcgtctcgcaatggctggcgggcggttttcccggttggtccgccaaactgggggtggcggcggggctgctgaaatccggcgatccgcgggcaggggaggaaagcctggcggcgttttgccgccgccagttcggccgcgcggcgctggataacttgctggacccgctggcgggcggcgtcttcgccggcgatccggatgagctgctgctggcggaaaccctgccagagctggcggtggcggcccaatcgccggggccgctgtggcgcgctttgctgcggctgcgcggccagcgtgcggcgcggcgggtctgcacgctggccggcggcctggaaagcttgccgcgtcgtctggcgcgcgatctggacatccggctgaacgcgccggcgacggcgctggcgcgcgacggctcgggctggcggctgcgcgccggggcggattgggagcgcttcgatcaagtggtgctggcgctgccggccggcgccgccgccgatttgctggaagggtcggaaccggcggcggcgacgctgtgccggcaggtgcgctacgcgccgctggcggtggcgttcacgctggcgcgcgccgaggcgctgacgcggccgctgccgggcttcggcggcctgcatccgcacagcgagggggcgttggcgctagggcatttgatgtccagcaatctctacccgcatgtctgccgtcccggcgagcggctgctgaccagcttcatcggcggccggcgccaggccgcgctgctggaactggacgacgatgcgctgctggcgcggctgaattgggaactggagcggctgttcggactaaagggggcaccgacgctgcagcgcgtcgcgcgctggccgcaggccttgccgcagggcacggcgatacagcgcgcgctgcgcgcggcgacggcgccgtgggccgagcggggcttgcatctgtgcgccaactggctggacggcgcgtcgctgccggattgcctggacaaggggcggcggctggcggcccgcatcgccggcgcggacggcacggctttgctccggcggcgctag

SEQ ID NO: 1786 - DNA, 891 bp, Chromobacterium substugae
atgcttaccttccaggaaatcatcctcacgctccagcactactggaaccgccaaggctgcgcgctcttgcagccgtacgataccgaagtgggcgcgggcacctcgcataccgccaccttcctgcgcgcgctgggcccggagccttggaacgccgcttacgtgcagcccagccgccgccccaaggacggccgctacggcgaaaacccgaaccggctgttccagcatcaccagttccaggtggtgttgaagccggcgccggcgaatatccaggaactgtacctgggctcgctgaaggagttgggcctggaccccacccagcaggacatccgcttcgtcgaggacgactgggaaaacccgacgctgggcgcctggggcctgggctgggaagtgtggctgaacggcatggaagtgacgcagttcacctacttccagcaagtgggcggcctggattgcaagccggtgctgggcgagatcacttacggcctggaacgcctggcgatgtacttgcagggggtggaaaacgtctacgacctgatctggacccatctgccggacggccagcctgtcacctacggcaacgtgttctaccagaacgaagtggagcagtcccgctacgccttcgagcacagcaatgtcgaactgctgttccgccagttcagcgattacgaagccgaggccaaggcgctgctggaagccagcttgccgctgccggcctatgaaatgatcctgaaggcgggccacaccttcaacctgctggatgcccgcggctccatctcggtgaccgagcgcgccacctacatcggccgcatccgcacgctgtcgcgcggcgtggcgcaagcctattacgacgcccgcgaggcgctgggcttcccgatgtgccgcaaggactga

SEQ ID NO: 1787 - DNA, 429 bp, Chromobacterium substugae
atgaaagcctgtattgcgatattgctgtgctgcagcctgccggcctgggccgagcagcctgccgactgggtggtgtaccaggacggcaagtcgctgcagctggcgatagacggcaactccctgtggctgggcaaggatggcctggtgcatttcatccaccaggaacgctttgccaggcaacgctacgaaaaatcgtaccggctgcacttttacatccgccgcaccaccggctacgccgattgcaagcagtaccaatacgtgtttgtcgggtcggaatatttcgatcagaacaacaagcacctgttttccacgatgttcccggtgccgcgctacgcctggaagtggcagccggtgaacgaggattcggtcgcccacgccatgatgaaggtgatttgcgaggcggccggcgccgcttcccaaaataattga

SEQ ID NO: 1788 - DNA, 2061 bp, Chromobacterium substugae
atgaacgcaaccctgctgatagaactcctgaccgaggagctgccgcccaaggccctgccgcgcctggccgccagcttcgcccagaccatcaccgaagagctgaaaaagctgcagttcatcgccgccgacgccgaagcggtggcctacgcgtcgccgcgccgcctggcggtgcagctgccgcaagtgctggccatgcagcccgagcagcgcgtcacccgccaggggccggcggtggccgccggcatgaaggacggtcagccgactccggcgctggccggcttcgcccgctcctgcggcgtggaagtgtccgagctggccgtggtcagcaacggcaagcaggatgtctacgcttattccagcaccaaggccggcgaggcgctgtccgcgctgctgtccgacgtggtggcgctggcgttgaaaaagctgccggcccccaagctgatgcgctggggcaatctggacgtgcagttcgtgcgcccggtgcacggcctggtgatgctgcacggcgacgccgtggtcgatggcgaagtgctgggcctgaagagcggccgcgttacccgcggccatcgtttcctgtcgcagggcgaggtcagcatcgccgacgccgatggctacgcccgcgccatgcatgaagaaggcaaggtgatcgccagcttcgccgcccgccgcgaattgatcggccacaagctggccgaggccgccgccaaactgggcgccaccatcgccgcgccggatgcgctgttcgacgaagtgaccggcctggtggaatggccggtggtgatggaagccggcttcgaggccgaattcctgcaagtgccgcaggaatgcctgatcctcaccatgcagcagaaccagaaatacttcccgctgctggaccagaacggcaagctgatgaaccgcttcttgctggtgtccaacatcgcgccgcaggatccgtccttcgtcatcggcggcaacgagcgcgtgctgcgcgcccgcctgtccgacgccaagttcttcttcgagcaagaccagaaggtccgcctggacagccgcctgccgcgcctggccaatgtggtgtaccacaacaagataggctcgcaactggagcgcgtggagcgcctgcagagcatcgccggcgccatcgcccatgaactgggggccgacgccgcgctggccgcccgcgccgcttacctggccaaggccgacctggtgtccgacatggtgggcgaattccccgagctgcagggcatcatgggcatgtactacgcccgccatgacggcgagcacgcggaagtggccgccgccatcgaaggccactaccacccgcgcttcgccggcgacacgctgccggaaggcaagatcgccaccgcggtggcgctggccgacaagctggaaaccatcatcggcatctggggcataggcctgatcccgaccggcgacaaggacccgttcgcgctgcgccgcgccgcgctgggcgtggtgcggatggcgctggaggcagacctggacctgaagcgcctgctggatatcgtggccaacgccttcccgaccggcaagctgtccgccggcgtggccgacgaagtgttcggcttcatgatggaccgcctgaagaacttcctggccgccgactgcaaggccgacgagatcgacgctgtgctggcgttgtcgcccagccgcctgtccgaggtgcgcgcggtgctggccgccgtggcccagttcaaggcgctgccggaggccgccgcgctggccgccgccaacaagcgggtgaagaacatcctgaagaaggccgagggcgacatcgccgcggtgaacccggcgctgttcgccgaagacgccgagcgcgcgctgttcgacgcggtggagaccctggcgccggcggtggacgccaagttcgccgcccacgacttcgccgccgcgctggcgcagctgtccagcctgaaggcgccggtcgacgccttcttcgacggcgtgatggtgatggcggaggacgccgcggtgcgcgccaaccgcatcgcgctgctggcgcgcctggccgcgctgttcaaccgcgtggcggacatctcgctgctggcggagtaa

SEQ ID NO: 1789 - DNA, 540 bp, Chromobacterium substugae
gtgaaactagtcattctcgaccgcgacggcgtgatcaacgaagaccgcgacgatttcgtgaagaacagcgtggaatgggtgccgatcgagcacagcctggaagccatcgccaacctgacccagtcgggctggcgcgtggtggtggccaccaaccagtccggcatcgcccgcggcctgttcgacgtgcacgcgctcaacgcgatgcacgagaagatgcaccggctggtgaaccaggccggcggccgcatcgacgcggtggtgttctgtccgcacgggccggaccacggctgcgaatgccgcaagccgctgccgggcatggtgctggagatcgccgagcgcttcaatgtcaagctggaaggcttgccgctggtgggcgacagcctgcgcgacctggaggccgtcgcagcggtgggcggccagcccatcctggtgaagaccggcaagggcgccaagacgatggcgtccggcaagctgccggaaagcaccctggtgttcaacgacctgtacgatgccgccgagcatctgatcaaccatcactga

SEQ ID NO: 1790 - DNA, 777 bp, Chromobacterium substugae
atgatcagtctatggatacgcaatctgctgtactggctggtgctgtgcgtcatcacgccgctgtttttctgcctgctgctattggcggcgccgctgccgcgccgcggccgccatgtgttcggcgtcagctgggcgttgaccctgctgtggatgcttgagcacgtcatcggcctgaagtacacggtggtcggccgcgaaaacatcccggacgagccgtcggtgatctgctccaagcaccagtccggctgggagacgctggcgctgcagaagatctttccgtggcaggtgtacgtggccaaacgcgagctggcctggattccgctcttcggctgggggctggtgctgatgaatcccatcatgatcaaccgctccgaccgttcccgctccaaccagcgcttgctggagcaggggctggagcgcaagcgccacaagttctggatcacggtgttccccgagggcacccgcaccaagccgggcgtgccgggcaaatacaagctgggcgcggcgcggatggccaagcagttcgacatgccgctggtgccggtggcccacaatgccggcgaattctggccgcgcaacgccttcctcaagtatccgggcgaagtcaccgtggtgatcggcccggcggtgcgtccggccgatgacgccggtccggaggcgatgatggccgaggcggaagcctggatagaatcgcagcagcgcctgatcggcggcgtcggccccttcgcccatcccgatgaaaaacgccagcgtctggcaccgcctgcctctgcctga

SEQ ID NO: 1791 - DNA, 342 bp, Chromobacterium substugae
ttgtcgttctatcaggaagtgctgggcatgaaactgctgcgccgttccgattttccggaagggcgcttcacgctggccttcgtcggctacggcgacgaggccgaccataccgtgctggaactgacgcacaactgggacaccgcatcctacgagctgggcaatgcctacggccatatcgccatcgaagtggacgacgcctacgccgcctgtgacatggcgcgcgccaagggcggcaaggtgacgcgcgaagccggcccgatgaagcacggcagcaccgtgatcgccttcatcgaggacccggacggctacaagatcgagttcatccagaagggcagccgctaa

SEQ ID NO: 1792 - DNA, 1410 bp, Chromobacterium substugae
atgaatcataaattacttggcatggcggccttgtccatgacgcccgcgctcgcgcaggccgccgatatggacggggccgcgatgggcttggcctggggcgtgccgtttgccggcatcctgttgtcgatcgccctgtttccgatgctggcgcccggcatctggcatcatcatttcggcaagatcaccgccgcctggaccgcgctgttcctggcgccgttcgccgtgtccttcggcctggggcacgccgccacgctggtgctgcacgcgctgctaaccgaatacattcccttcatcgtgctgctgttcgcgctgtacaccgtgtccggcggcatcctggtgtggggatcgctgcacggctcgccgcggctgaacaccgcgctgctggcgataggcacctgtctggcctccatcatgggcaccaccggcgcggcgatgctgctgatccgccccttgctcaaggccaacgagggccgcaagcgcaatgtgcacgtggtggtgttcttcattttcctggtggccaatgtcggcggcggcctgactccgctgggcgacccgccgctgttcctcggctttctcaagggcgtgaccttcggctggaccttccagcacatgctggcgccggtggcgaccctggccgcgctgttgctggcgatattctatttcctcgaccgccatctgtacgccaaggaagcgcaggagggcacgctcaagccggtggacgccagccacgacaagccgctgaagctgtacggcaagcgcaatttctggctgctggccggcgtggtgggcgcggtgctgatgtccggcctgtggcagcccggcatcgtcttcgagctgcccggcgcccacctggagctgcagaatctgctgcgcgacgccgccttgctgctgctggcgctggcctcgctgtggatcacgcccaagcaggtgcgggccggcaacgagttcaactggctgcccatcctggaagtgggcaagctgttcgccggcatcttcatcaccatcgtgccggtgatcgccatcctgcgcgccggcgcgcacggcgacctggccggcctggtgcagatggtgtcggcgccggacggcaagccgctggacggcatgtacttctggatgaccggcatcctgtccagcttcctggacaacgcgccgacctacctggtgttcttcaacctggcctccggcgacgccgccacgctgatggggccgttgggcagcacgctgctggccatttcgatgggcgcggtgttcatgggcgccaacacctatatcggcaacgcgcccaacttcatggtgaaggccatcgccgagcaccgccatgtcaagatgccgggcttcttcggctacatgctgtggtcgggcgccatcctgatgccttgcttcgtgctgatgacctggctgttcttctga

SEQ ID NO: 1793 - DNA, 804 bp, Chromobacterium substugae
atgccaaaaatcttattgaaaagcctggccgcggccctcctcgtgctgccgacgctggccggcgccgccgccctcaaaatcaccgtcgccaatctcgcctacgaagaaaaagtggaagaatacttccacctgaccgccgcctccagcgacgacagcttcaacgccaaccgcaactacgccgccgcctccagcagcaaccgctatctggaagtggaaggcaccaaggtccgcatcgaccgcggcgaaatgcgccgcttcaacgccgacatcaagggcgagctgctgaagctgcgcaccgtgcagctggtggaagcccagggctatcggccctccaagaacaacgaaacgctgttcgacgtgatcgcccgcatcaagcgcggcgagttccgcggcgccgattacgtgctgttcggcaccgtctccaacatcgacgtgcaggacgacgccaaccccatcgccggcacctccacggtgtccttgtcgcgcaatatgcagctggtggcggacttcagcctggtaaacaccaagacctacgcggtgaaggcggcgttcagcgcgatgggagccggctccgacgtcaagctggtcggcgagcaaggcgccgtcctcaaccccaacaacggcaagatcgtgtccgaagtgtccaagtcgctgggccataacgtggtcgaacagatcaccgagcaattcggcgcgctgggaaccatgcgcgacaacggcggctacgccgacgcccgccagccgacgtacgccgcgccgcaggaagaagtgatggtgctcaccccagccgcgccggccaaataa

SEQ ID NO: 1794 - DNA, 600 bp, Chromobacterium substugae
atgaatgcccgcaatctgacccgctccgccctgtgcgccctcgccatcgccgccctgtccggctgcgcccagaccaactcgccgacgctgggcgacggctccgtcagctacggcgacagcaaggcggtggaactggtcagcaatgaattcggctccaccgacctgcagcgcctggcggaaagcatgacccgctcgctggtgcaggtgccggtcatccgcggcaagcgcctgaccctggccgacgtgcagaacaagaccagcgaatacatcgacaccgccgaaatcaccaaatcgatccgcgtgcagctgatgaaggccggcaccgtgcgcttcgtcgccgacgtggcccacatggaaggccagacccaggaattgatgcgccagaaccagtccggcctgtacgacaagagcaagagcaagaagataggcaagatggtcggcgccgactaccgcctgaccggcggcatctcctccatcgtcaagaagaacagcgacgtcaaggacgtgtactacaagctcagcctggagctggtggacaacgaaaccggcgagctggtatgggccgacgagcaggaaatccgcaagacctcccgccgctga

SEQ ID NO: 1795 - DNA, 390 bp, Chromobacterium substugae
atgaacatgcgtcacatccgtcgttgtctgctcctggccgcgctggccgcggccccgctctgccatgccgacgggctggaaagcaaactggaaacgctggggaaaatggacaacatcaaggtggagtccgcacgcgtcgtcaagcgcaacgacttcctcaacgtccaggccgagctgtccaacagcgccaccaagcagcagatgctgttctaccgcttcaaatggctggatggcagcggcatgcaaaccggcgccgaggaaacctggaagcagctgcagctccagggcctggagcgcaaatccatccagaccgtcgcccccacgccgcaggccgccgacttccgcctggaactgcagagccccgacaactccgtcaatcttttccgttaa

SEQ ID NO: 1796 - DNA, 1395 bp, Chromobacterium substugae
atgaaacgcaaatccaaactggccaattccgtgctcatcatcggcctggccgcctcgctcagcgcctgcggctcgatgcgcagctatcaaggcgaaatgaaaaccgctctggccgccgccaacgaaggccgcatcgacgatgcgctggccagcgtcgaggccaacaacagcagcgaagacaaagacctgctctatcacctggagaaggggcagttgctgcggctgaagggcgatctgcaaggcagcgtggacgcctggctgaaggcggatgaaaagatccgcgtctgggaagaggaatccaagctcaccacatccaaggcggcggaaaccgccggcagcctgctgatcaacgacaaggtccggcgctacgacggcgaagactatgagaaagtgatgctcagcaccatgctgacgctggatcacgcgctgtccggcaactacgccggcgcccgcaccgaaatcaagaaaacctacgagcgcgaagcgctgatcgccagcctgcacgaaaaagagtacgacaaggtggaagaggaggcgaaagagaacaacgtccagaccaccttcaaggatctgcaaggctatccggtcgaaaccctggacgacccggaagtcctgaacctgaagaacggttatcagagcgccttcagccactacctcgccggctacatcttcgagtcgctgcgcgagccctccctcgcctccgccggctaccgcaaagccatcgagctgcgccccaacatgccgctgctggagcaaggcctgaaaggcctgaacagccgcatcgcccagaaagccgctggcaccgacgtcttgttcgtggtggaaagcgggctgatccccacccgcacctcgctggccattccgatgccgttcagcctggacggcaagcccatcatcacccagatcgccttcccggtgatcatgcccggccacagctaccagccgctggccttgcaggtgggagacaagccggtcgcgctgacgccgatcagcaatttcgacgccatggcccgccgcgcgctgcgcgacgagatgcccggcatcatcatgcgcagcaccgtgcgcgccgtcgccaaagggctggcgcagaaagagctgggcgaccagttcggcgcgctgggttcgctcgctggcatcaccgccaccgtgctgaccgagcaatccgacgagcgcgcctggagcaccctgcccgcccgcatcgccatcggccgcgtcaacctcaagccgggccgctacagcgtcagcgtgcccaccccgagcggcgaacgccaggtcgagctggatatctccggcagccacgccatcgtgccgctgcgcctgttcgaacaaaccgtcatcccgccccaaggcggcaagcaaccgccggcagccgcagtgaaaaccgccggcatttaa

SEQ ID NO: 1797 - DNA, 1371 bp, Chromobacterium substugae
atgcacatccacatcctgggtatctgcggtaccttcatgggcggcatcgccgccatcgccaaacaggccggccacaaggtgaccggctgcgacgccaacgtctacccgccgatgagcacccagctggaggagatgggcatagccctgacccaaggcttcggcgcggagcagatcgaactgaacccggacgtgtacgtgatcggcaacgtggtgacgcgcggcaagcccttgatggaggaaatcctcaatcgcggcttgccttacatctccggcccgcaatggctggcggagaacgtgctgcaggacaaatgggtgctggcggtggccggcactcacggcaagaccaccaccagctccatgctggcgtggatactggaagacgccggcctggctccgggctttttgatcggcggcatcccggagaatttcggcgtgtcggcgcgcttgccgggcaagccggcgctggatccggccagcgtcagcccctttttcgtgatcgaggccgacgagtacgacaccgccttcttcgacaagcgctccaagttcgtccattaccggccgcgcaccgccatcctgaacaatctggaattcgaccacgccgacattttcgccgacctggccgcgatcgaaacccaattccaccacctggtgcgcaccattcccggcaacggccgcatcgtcagcaacggccgcgaggccaatctggagcgcgtgctggagcgcggctgctggacgccggtggagcgcttcggcgcggacgccggttggcagctgggcgagctgcatgaggacggcggtttcgatgtgctgcttaacggccagatgcagggcacggtgcgttggggactaatgggcgagcacaaccgcctgaacgccgtcgccgccatcgccgccgcccgccatgccggcgtggcggtgaaagatgcgatagacgccttgtcgcgtttcgccaacgtcaagcgccggatggaagtgaagggcgtggcgggcggtgtaaccgtttacgacgacttcgcccaccatccgaccgccatcgccaccacgctggaaggcctgcgccgcaaggtgggccaggcgcgcatcctggcggtgctggagccgcgctccaacaccatgaagctgggcacgatgaaagacgcgctgccgggttcgctggcgctggccgaccaggtgttctgctcggctgcgggcctcaactggaatccgggcgaggcgctggaggcgatgggcgccaaggcgcaaaccttcaccgacttcgatgcgctgatcgacgccatcgtcgccgcggcccggccgggcgaccatgtgctggtgatgagcaacggcggtttcggcggcatccaccagaagctgctggaccggctggcctaa

SEQ ID NO: 1798 - DNA, 936 bp, Chromobacterium substugae
atggttacgttccaggcgctccagcctttcatcgacaccgtccagggttgcctgatcgtggcgtctccggacgatggccgcatcgcatccgccaaccagttggcctgcatcctgctcgcctgtccccacgacgaactgctggaccgctccatcttcgacttcatccaggatccggaactggcagccggcatccgcgccgagctgggcagcgacaacatgatctacaaccgcggcatgcagctgcgcaccgccagcggccgcgatttcgaagcgcagctgtcggtgcgcaaggtgagcctcaacgaccgcccgatgctggtattcagcttttccgaccgcaccgaggccaaggtgatggggcagctgctggactttgaacgccagctggtggagcgctcgctgagcattgtcaagacactgaaggaagaaggcggccaaaccgacgacgaggacaagctgaccggcgtcgccggcatgcaccggctgctggccgtcgccaacgccgaaaccagccgcgcccgccgctatggcggcccgctgtcgggcttgacgctggaactggtcaacgcgccggaaatggtgcccgaccaggacgacggttcggcctacgcccatctgatccgactggccggcagcctgtgcctgcaaaacgcccgcgacagcgacctggtggcgcgccgcagcgccaacgccttcatcatcctgctgcccaacacgccgatgagcggcgccaatgaaatgggccggcggctgatcaagtcgttgcgccagctcaccttcgtctatcagggcgcggaacaccaggccgcggcctgcgtcggcctgagcgcgctgcgcccgaccgaaaccagccccgccccgatgctggagcggctgcagcaggcgcagggaaaagcgcgcgaaggcggcgccaactacatcatcaagctgccctga

SEQ ID NO: 1799 - DNA, 1359 bp, Chromobacterium substugae
atgcgctttcaaaaaaccaatacgacaaagaagcaggacatggctagatctcaatggggctcgcgcctcggtttcattctcgcggcggccggctccgccatcgggctgggcgccatctggaagtttccctacgtggccgccaccaacggcggcggcgcgtttttgttcatctacctcggcatctgcctgacgctggggctggtgctgatgctggcggaaatggcgctgggacgcgccaccggcgccggcgcggtcggcgctttccgcaaggtggccggcggcttctggccggtgatcggctatatgggcgtgctggtgtgctttttgattttgtcgttctacagcgtggtaggcggttggaccatcgcctacatcgtcaagtcgctgcagggcggcatcatgacatccgaccccaaggcgctaggcgccattttcaacggcttcatcagcgatccggcgcagccgctgctgtatcacggcggcttcgcgctgctgacgctggcggtggtggccggcggcgtgcagaagggcatcgaggcgctgtccaagctgctgatgccggcgctgttcgcgctgatgctggtgctgatcgcgcgcgggctgacgctgccgggcgcgctggagggcgtcggctacttcgtcgcgccggacttctccaaggcgagcgccgccatgctggtggacgcgctggggctggccttcttctcgctgtcgctgggcctgggcatcatgatcacctacggctcctatgtcggccgcgaatccaagctgctgggttcggcgctgtgggtgatcctgctgacggtggcgacctgcttcctggccggcctgatggtgctgccggcggtgttcgccttcggcttcgacccgtccgccggtcccggcctcactttcatcaccatgccggcggtgttcgcccacctgccgctggggcaattgttcgcggtgctgttcttctgcctgctgctgctggcggcgctgacgtcctccgtttcgctgctggaggtggtgaccagcttcgccatcgacgaatggggcatgtcgcgccgcgccgccgcctggctgatggccgccggcatcttcctgctgggcattccggcttcgctgtcgctgggcgtgtggggcgattaccagctgggcgggatgaatttcttcgatctgctggatttcgtcacctccaagctgctgatgccggccggagaattgttgctggcgctgttcgtcggctggaaggcctggccggtggtgaaggccgagctgtcgtccggccgctcgccgcgggcgatgcagtgcatgcgcggcttctgcatggcgctggcgccgctgctgataggctggatcatggcggctggcatctaa

SEQ ID NO: 1800 - DNA, 702 bp, Chromobacterium substugae
atgcggtggatggggctgttgctgttcggcctgctggccggcgcgcctcgcgcggaaacattgcaggtgctgaccacccagattcccggggtgatcgcgctggcggccgacggcgtcaccatggagggcaccggcatcgacctgatgcgcgaggtggggcgccgcgccggcgtcgatttccgcttcgccgcctatccgcaggcgcgggcccggctgctggtggagcagcaggtcgacgcctgctcgccgatggcgcggctgccggaactgggcgagcgttacaagtggaccgccacgctgctgccgatgcggctggtgctgctggcgcgcgatggtgacgcccgccggctgcgcagcctggatgaggcgcgcggtttgcggataggcgcgatgcgcggcaccatggcggcggcgcggctgagggcgcgcgggctggcgccggaggagagcgccgattatttcggcgggctggagaagctgcaattgggccggctggacctgtgggcgatgctggacgtcggcgtggcgtcgctggcgcggcggctgggcatgccgcagccgcgggtggcgctggtgctggacacgctggatgtggccttggcctgcaaccgcaagctggatgacgcggtgctggcgcgcttggaccgcgccatcgcctccatgcatcaggacggcagcatcaatcatttcgacctgcgttga

SEQ ID NO: 1801 - DNA, 1239 bp, Chromobacterium substugae
ttgaaagtccgtctgacactgttatccggctgcctgctgctggccgcttgcgccacgccgccgaatcccgcctccgctcccgctcccatcgtcgcgccggttccggaagagccggcctccgcgccggcggtggaaacactgccgcaaacgccgccgccggcctcggcgccagtgcaggtgccgtcgctgcccatcgcccggccggtgcagccgcccgccgtcatttccgacagccagggccgcgctttgctggaccggctgctgccgccgggcatccccgaccgcaagggctggagcaatgacgtgatgggcgcgttcagccatctgaagattccgtacacgccgcagttcttctgcgcggtgctggcggtggcggagcaggagtccggcttcagctccgatccggtggtgccgaatctgtccaagatcgtttggggcgagattgaccagcgccggcagaaatacctgataccgtctttcgtggtggacgcggcgatgagcaagaaatcgcccgacggccgtacctacaagcagcgggtggacgcgctgcgcaccaagcgcgaaatgaacgcgctgtatgaagacatggtgcgcgagctgccgttcggccagaccatcttcgagcacaagaacccgatccgcgacggcgggccgatgcaggtcagcgtcgccttcgccgaaacccacgtccgcgcctggccgtatccgtacaactattccagcctgcgcgacgaagtgttcacccgccgcggcagcgtctacttcggcaccgccatcctgctgcaatacccggcgccgtatcatgaaatggtgtaccgtttcgccgactacaacgccggccgctacgccagccgcaacgccgccttccagcaggcggtggcccgcctgtccggccgcaagctggcgctggacggcgacatcatgctgtattccgacaagatgaaccgcgtgctgtccggcgcggtcagcgacacccagcgcgcgctgcagtccatcgccggccggctggggatgagcaatgcggaaatgcagcgcgatctgcagcaggagaagctgtccggcttcggccagagccagctgtaccagaaggtgttcgcgctggccggccccaaggccccgcgcgagatcattccgcagatcgtgctggtcagccccaagttcacccacaagctcaccaccgagtggttcgcgcgccgcgtcgacggccgctaccagcgctgcctgcagcggggaggctga

SEQ ID NO: 1802 - DNA, 453 bp, Chromobacterium substugae
atgaaggtttccatcaacggcaaggaggtggagctgggctcctctccggacacgcccatcctgtgggcattgcgcgacgaactgggcctgaccggcaccaagttcggctgcggcgcggcgctgtgcggcgcctgtacggtgctgaagaatggcctggcgatacgcgcctgcgtgacgcccatctccacgctggccgccgatgacagcatcaccaccatagaaggcaacgccggcaaggtggcgcaggcggtgaagcaggcctggcacgatctggacgtggtgcaatgcggcttctgccagagcggccaggtgctggccgccaccgccttgctcagcgccaacccccatcccagcgaccgcgacatcgacctggccctcagcggcaatctgtgccgctgcggcacctatccccgcatccgcgcggcgatccacgccgccgccaaactgttatag

SEQ ID NO: 1803 - DNA, 2169 bp, Chromobacterium substugae
atgagcgtaagcggaatctcccgccgcgcctttctcaaggccggcggcatggtgggcggcgccttgtgcctgggtttcgtgctgccgaacggcgggctggcgcgggcggccggcgcgggcggcgccatcccgacgccgaatgccttcgtccgcatcgagaaggacggcggcgtcaccatcgtcagcaacaagtcggaaatggggcagggcatctacacctcgctggcgatgctgatcgccgaggagctggagtgcgactggagccggatccaggtggtgtcggcgccggcggcgcccatctacgtccataccgccttccatatccagatcaccggcggcagcaccagcacgctgtccagctacgaccagtaccgcaagataggcgccgccgcgcgcgacatgctgatagccgccgccgcccagcgctggcgcgtgcctgccgcgcaatgccgcgccgaaaacagccgggtgttcaataacgccaacggcgccagcctgggctacggcgagctgaccgaggccgccggcaagctgccggtgccggacacggtggcgctgaagccgcgccatcgctggaagctgctgggcacccgcgtgcatcgggtggacggcggcgagaagctggacggccgcgcgcagttcgcgatggatgtccgcctgcccggcatgctgacggcgctggtcaagcgctgccccagctacggcggcaagcccaagggcttcaatgccgacgcggccagggcggtgcccggcgtcaaggccgtgttcgcgatcagcaacggcgtcgcggtgctggccgatggcttctggccggccaagaaggcgcgcgacctgctggaagttgagtgggaccgcggcgccaacgccagcctggattcggcccggctgcgcgcccactaccgcgaactggcgtcgcggcccggccagcattaccgcggcgtcggcgacgccgattccgcattggccggcgcggccaagcaactggaggcctggtacgaggcgccgtatctgtcgcattcgccgatggagccgctcaattgcgtggtctggctgaagccgggcagctgcgaaatctggagcggcacccagtcgcagaccatagacgccggcatggcggcggcgatgaccgggctgaagccggagcaggtttcgctgcataccacctttcttggcggcggtttcggccggcgcgcggtgccggtgggatccgattggctgagagaggcgctggaagtggccaagcaacatggtcaggatctgccggtgcggctgatgtggacccgcgacgacgatctggccggcgcctattaccggccgatgtggctggaccgcgtgcgcggcggcatagccgcggacggcaagccggccgcctggctgcagaccggcgtcggccagtccattctggccggcacgccgttcgcgccgatgatggtgaagaacggcatcgacgcggtatcggtggagggcaccgacgacatgccctacgcgctgccggcgctggcgctggacctgcatacgccggagattccgctgccggtgctgtggtggcgctcggtcggccattcgcacagcgccttcgccaaggaaagcttcatcgacgagctggcgcggctggcgcgccgcgacccggtggcctaccggctggcgctgatggacaaggcgccgcgcgagcaggcggtgctgcgcgaggcggcgcggatggccggctggggccgcaagctgcccaagggccacggcctgggggcggcggtgcatgcctccttcggcagccatgttgcccaggtggtggaggtggcggtgaagggcaaggaattgaaagtgctgcatgtctggtgcgcggtggattgcggggttgtggtcaatcccgaccaggtggccgcgcagatggagggcggcatcatgttcggcctgtcggcggcgctgttcggcgcaatcaccttcaaggacggcgaagtcgagcagaaaaacttcgacggctaccagatcgtcaggatgttccaggcgccgaaggtggatgtctccatcgtcgccagcgacgaagcgccgggcggcaccggcgagccggcggtgccgctggtggcgccggcgctggccaacgccgtccacgcggcgtcgggcaagcggcggcgcgagctgccgctgatccgccacggctatcagatggtatga

SEQ ID NO: 1804 - DNA, 546 bp, Chromobacterium substugae
atgagaaaaaccatgatcctgggctgggcgctggcggccgctttgccggcagcctgggcgggcggcgacccgtcggcgtcgctgcgggcctatggcgaagtggccaaggtgctgcagtcgccgcgctgcatgaactgccacaccgtcaccgactttccgcgccagggcgacgaccgccatccgcacgcgcagctgatccggcgcgggccggacaatatgggcgcgccgtcgctgatgtgcatggcctgccaccaggcggccaactccgccgacggcctggtgccgggcgcgcccaactggcatctggcgccgctggcgatgggctgggaaggcctgagcggcgggcagatctgccggcggctgctggacaagacgcgcaacggcaaccgcgacgttccggcgctggtggcgcacatgaccgccgatccgctggtgcaatgggcatggaagcccggcgccggccgcgcgacgccgcccctgtcgcagcaggacttccatgcggcggtgcggcgttgggcggacagcggcgcttattgcccgcgctga

SEQ ID NO: 1805 - DNA, 993 bp, Chromobacterium substugae
atgcaaggcaatgtcgaggaagtgctgagccaggcgctgtcctggctggagtccggccggcgcgccgctttggtgacggtgctgtccaccttcggcggcagccccaggccgccgggggcgatggcgctgatccgcgacgacggcgcggtgttcggctcggtgtccggcggctgcgtcgaggatgacctggggcgggagatcgtcgccggcggctttttcggccgggagacggcggtgcgggtgcgcagcttcggcgtcagcgtcgaggagcgccagcgctaccggctgccctgcggcaacagcctgcgggtggcggtggagccggcgccggacgcgggccagctgcgcctgttgctggacgcggtgcgcgcgcagcgctgcctgtggcggacggtgcgctaccgcgacggcgcggcagcgttgtccgacgccggcccgccgggcgagttcgccgaggacgaacaaggcttcggcgtgttgcacggaccgcgctggcggctgctgatcatcggcgcgtcggagctgggcgcctatctggcgcagatcgcggtgacgctggattacgcggtgacggtgtgcgatccgcgcagcgaatacagccaaggctggagcctgtccggcgcgcgtctgtccggcgagatgccggacgacctggtgctggctttcggctgcgacagccgcaccgcggtggtggcggtcacgcatgatcccaagctggatgacctggcgttgatggaggcgctcaggctgccctgccattacgtcggcgcgctgggttctgccgccaccaccctgaagcgcaaggcgcggctggccgagcacttcggcctgtcgccggcgcagctggagcggctgcacggcccggtggggctggctataggctcgcgcacgccggccgagatcgccgtctccatcgccgccgacctgatcgccagccgcagcgagcgcgcgcggccgggcgtcgccggcgcggcgcggacttgccgcgcatga

SEQ ID NO: 1806 - DNA, 555 bp, Chromobacterium substugae
atgctggcggccggagcggggcggcgcttcggcggcgacaagcggcaggccgcgctgccggatggccgcacgctgctggaagccagcctgcaggctttcgtcggccaggtggacgtattggcggtggcgctgccggaggacgacgccttcggcgccgcgctgtgccgccagttgggcgcgacgccgctggcctgccggctcaatcgcgccggccttggccattcgctggcctgcgccgccgcctgggcgctggcgctgccgcaatgccgcggcctggtgctgggcctggcggacatgccgctggtgcggccgcacaccgtcagccaggtggcggcggcgctgtggcacggccggccggtgctgccctgctacctgggccaggccggccatccgcgcggcctgcccggcgcgtgcctgccggctttgctcgatctgtccggagacatcggcgcgcgcgacgcgctggactggagccaggcgttgcggctggagctggacgacgccggcgtgctgctggatatcgatacgccggaggatctgctccggctgggctga

SEQ ID NO: 1807 - DNA, 1848 bp, Chromobacterium substugae
gtgcgctttacggttgcccacaagctggtgttgctgatcgcgccgctggtgctggccttgtttttcgtggcgatcggctatgcctggaaccagcgccagctgctgcaggcgctgaatcgcgaccagacgctgacggaaaacatcgcgatggtcggcgagctgatccagtcgctgcaggacgagcgcggcttgagctacggctacctgaaccggcaccaggccttgccggcgcagctgggacgggcgcgcgacggggcctccgccgccttgcagaagctgctgcgccagccgcaggcagagctgtctgatgcgctgcgccattacctggaaaccagcgcgccgcggccggaacaactggcgcagctgcggcgcgatgtcgacaaccgccatatttcgcccgaccccgccttcaaccgctattccgacatgatcgagcagctgtcccgcatcatcaccctgttcaacgcccagacccaggacgtacaggcgctgatcttgcagtggtcggcggtgaattgccagaaggagtacaccggccgcacccgcgggctgatcaccggcgtgctgacggtgggcagcttcaccatcaccaatttccgccaggtgagcggggtggtgtcgcaggaagaactgtgccggacgcaatatcggcagtacggcggcgacgacgcgctgctgcgcaacgccatgatgcgcagccgccagttcgagtcggcgcgcgacgcggtgctggcgcgcggcgccggcgcgatgcagagcgcgacgccggaggagtggttcgccgcggccagccagcgggtggcgtcgctgtaccaggtgcagcaggacctgctgcagcagatccggcagcgggtggagggccaggcgcatagcgcgcgcctgcatggctatctggtgctgctgggtctgctgttcctgttgctgcccatcgcgctggcagtgctggtggggcgcaacatcatccgcacgctgggcgccgagcccgacgaggtggcgcagggcatgcgcgaattgtcggccgggcggctggatttctttctgccgctggcggccggcgacgaccacagcctggccgcgcacatccgccagatgggcgaccggctgtcgggggtgatcctgcaggtgaagcaggacgcggatgcggtggccaacgcgtccaccgagctgaattcggcttcgcagggcttgtcgcagggcgcggcgcgcgcgtcggtcgacgtggagggcgccagcagcgcggtggacgagatcgcgcgcagcatggccgagatggccggcgacgccaaccgggccggcggcatggccgataccgcgaccgggcaggcggcggacggcaaccaggtggtgcagcagaccatcgcggcgatgcgggagatcgcgcgccgcaccaccatcatcgacgacattgcctaccagaccaatctattggcgctgaacgcggcgatagaggcggcgcgggccggcgagcacggcaggggcttcgcggtggtggccgacgaggtgcgcaagctggcgaagcgcagccaggcggcggccaaggagatcgaccaggtggcgaaccgcagcgtgcagctggcggagagcgccggccggcagctgagcgacatcgtcgactccagccagcggacgctggaattggtgcgcggcatctcgcaggaagccacggtgcagtcgcagcgggtgggcggcatcaacgaggcgatgcaaaggctgaaccagctgtcgcagggcaacgccgcggccagcgaggaattgtcggcggcggcgcaggaagtggcgatgcgcgcggacagcctgcgccggcagatgcagtatttccagcagggcgacgacgacaagccggcctag

SEQ ID NO: 1808 - DNA, 1005 bp, Chromobacterium substugae
atggcatttctgcaaatcgaccatctgaacaagcgcttcggccagcaggccgtggtccacgacttcaacatgaaggtggaggccggcgagttcgtcaccttcctcgggccgtccggctgcggcaagaccacggtgctgcgcatgatcgccggcttcgaaacacccagcggcggcgccatccgcctggccggcgacgacatcacccaccagtcgccgcagaagcgcggcatcggcatggtgttccagagctacgcgctgtttcccaatatgaacgtggccgacaacatcgccttcggcctgaagatgcagaagcgcggcgccgacgagatccgccgcaaagtcggcgaggtgatcgcgctggtggagctgaacggccgcgagaaacactttccgcaccaactgtccggcggccagcgccagcgcgtggccctggctcgcgcgctggtggtggagccgcgcgtgctgctgctggacgagcccttgtcggcgctggatgcccgcatccgcaaaaacctgcgcgagcagatccgcgacatccagcgccgcctgggcctgaccaccgtcttcgtcacccatgaccaggaagaagcgctgacgatgtcggaccgcatcttcgtgatgaaccagggcaaggtggagcaagaaggcgcggcggaaaccatctacacccagccggccaccgagttcgtcgcccgcttcatgggcaactacaacctgctgtccgcgcagcaaagccaggcgctgctgggcctggacatccagggccatctggcgatacgtccggaatccatccagctggccgatgccggcgaggccggcgccgacacgctgccggcggtgatccgccaacaccagctattgggcaacatcatccgctaccaggtggagtcccgcggcgccacgctgcaggtggaccgtctcaaccgcaacgccggcgacctgctggccagcggcaccgaggtgcggctgcgcatctcgcgcgaagacatccgcgaagtgcgttga

SEQ ID NO: 1809 - DNA, 801 bp, Chromobacterium substugae
atgaaaaccgccgccacttcgcgcctgggcgcctggatcgccattttgctcggcagcggctacttcctgctgcccttgatcgccaccttcgaattcagcctgaagatgaaacgcgaaggctatagcttcgaagcctacaaggtggtgctgagcgaccccggcttccaggccagcttcggctattccgcgctgctggcgttgctgaccatcctggccggcatcctgctggtggtgcccaccgccttctgggtgcagctgaagctgccgcggctgcggccgctgatcgagtttctcaccctgctgccgctggtgatcccggccatcgtgctggtattcggctacctgcgcctgtacggcagcggcggctggctgccgctgaccggcaacgagcgcggcaccgacctgctgttggtgttcggctacgtgacgctggccctgccctatctgtaccgctcggtcgacaccggcttgtcggcgatagacgtgcgctcgctgaccgaggcggcgcagagcctcggcagtggctggttcgacatcctcaggctggtgatcttccccaacctgaaaaccgccatcctgtccggcgccttcctgaccttcgccatcgtcatcggcgagttcacgctggccagcctgctggcgcgcccggccttcggcccctatctgcaattgatcggcgccaaccgcgcctacgagccggccgcgctggccatcatcgccttcctggtcacctgggcggcgatgggcctgatgcaggtggtcagccgcaaccgcgccgccctcggcgccgatgaacactga

SEQ ID NO: 1810 - DNA, 909 bp, Chromobacterium substugae
atgtccgcatcatccgacaccatgtcccctcccggcagcagactctccagcggcaaaccgcaacgcggatccatcctgtcctggctgggcgtcgcccccttcctgctgttcgcgctgctgttcctgatcctgcccaccgccttgctgatggtgggcgctttccaggacgcgcagggcgacttcacgctgggcaatatcatccgcctgttcgaaccgaatatcctcagcgcctaccagatcagcctggaaatcagcgcggcctcggccatactgggcaccctgctcggcctcgcgctggcgctggcggcgatacgcggcggcctgcccgcctggatccgcccgacgctgaccaccttctcaggcgtggcgtccaacttcgccggcattccgctcgccttcgccttcctgtccacgctgggccggatggggctgatgaccatgctgttgcgcaaatacctggacttcgacctgtacggcagcggcttttccattctcagcttcgccggcctcaccctcacttacctgtatttccaggtgcccttgatggtgctgatcatcgctccggcggtggagggcctgaaggatgaatggcgcgaagcctgcgaaagcctgggcggctccggcttcgcctactggcgccacatcgcgctgccggtgctgtggcccagcctggccggcgccgcgctgctgctgttcgccaacgccttcggcgcggtggccaccgcctacgcgctgaccggcagctcattgaatatcgtgaccattctgctgtacgcgcaaatccacggcgacgtgctgcacgaccagaacctgggctacgcgctggcgttgggcatggttctgatcaccggcagcgccaacgccggctacatctggctgcgcaagcgcagccaccgggaggccgcatga

SEQ ID NO: 1811 - DNA, 1098 bp, Chromobacterium substugae
atgaagaacaaactgggttacgccgccgtagtcggcgcgctgagcatgatcgccaactccgctctggcggacaatctggccgcactggcgcaagccgctaaaaaggaaggcgagctgaccgtgatcggcctgccgcatgactggtgcggctacggcaacgtcatcgccggcttcaaggccaagtacggcatcaaggtgaacgaactgaatccggacgccggctccgccgacgagctggaggccatcaaggccaacaagaacaacaagggtccgcaaacgcccgacgtgatcgacgtcggcctctccttcggcccgcaagccaaggcccagggcctgctgcagccgtacaaggtgtccacctggaaatccattccggacaacgccaaggacaaggacggctactggtacggcgactactacggcgtgctgaccttccaggtcaacaaggacctgatcagcaaggcgccggccgactgggccgacctgttgaagccggaatacaagaacgccgtggcgctggccggcgacccgcgcgccgccaaccaggccatccagggcgtgttcgccgccggcctgtcgcaagcccgcggcgacgtgaacaaatccgccgacgccggcctgaaattcttctcgcagctgaacaagaacggcaacttcgtgccggtgatcggcaaggccgcctcgctggcccagggcaccactcccatcatcgtgcgctgggactacaacgcgctggccgaccgcgacaccctgaagggcaaccccaaggtggaagtggtggtgccgaagagcggcgtggtggccggcgtgtacgcgcagggcatcaacgcctacgcgccgcacccgaacgccgccaagctgtggatggaatacctttactccgacgaaggccaggtggcctggctgaagggctactgccacccgatccgcttcaacgacctgaccgcccggaagaagattccggccgatctgatcggcaagctgccggacgccgccgcctacaagaaggccgtgttcccgaccatcgagcagcaggaaagctacaaggccggcatcaccaagcagtgggacagcgtggtgggcagcagcgtcaagtaa

SEQ ID NO: 1812 - DNA, 1260 bp, Chromobacterium substugae
atgagcaagcagtacgacatcgtgatcgccggcggcggcgtcatcggcgcctcctgcgcctaccagctgtccaagcgcggcaatctgaaaatcgccctgatagacgccaagcggccgggcaacgcctcgcgcgcctccgccggcggcctgtgggcgataggcgaatcggtgggactgggctgcggcgtgatcttcttccgcatgacctcggccaagcgcaagcgcgaagcggccggcgccgcggtgaacgtcagcgccggcgcgccgcacatcctgcccaaaagctttttcgacttcgcgctggcgtccaacgcgctgtacccggccttgcaccaggagctgcgggacaagcacggcgtggatttcaagtttgaggaaaccgggctgaaattcgtcatctacgacgaagaagaccggctgtacgccgaacacatcgccgcgcagattccccacctggccagccaggtgcgctggctggaccaggcgcaattgcgcgccgacgagccctatgtcagccatagcgcccagggcgcgctggaattcctctgcgaccaccaggtcagccccttccgcctggccgacgcctataccgaggcggcgcggcaaaacggcgtcgacgtgttcttcaacgtcaacgtcaccggcgtggcgcgccagggcagccgcgtcaccggcgttagcaccgccgaagccggcgacttttcctgcggcacgctgatcaacgccggcggctcctgggccgatgagctatgccaatgggcgaccggcctctccatcccggtgaagccggtgaaaggccagatcgtgctgtcggagaaaatgcccaagctcttgcgcggctgcatcaccaccagcgattgctacatcgcgcaaaaggacaacggcgaaatcctgatcggcagcaccaccgaggacaagggctacgacgtcagcaccacctaccccgaaatccaaggactggtgcagggcgccgtgcgctgcctgccggagcttgcgcgcatcaacatcaagcgttgctgggccggcttgcgcccgggcaccccggacgaattgcccatcctggggccggtcgacggcgtggacggatacctgaacgcctgcggccacttccgcaccggcatcctcacctcggccatcaccggcgtgctgctggacaagctggcgcaccgcgaggccctgccgctggacatcacgcccttcctggccagccgcttcgccgaacagccgcgagactggcgtctggaagccctgcacgcctga

SEQ ID NO: 1813 - DNA, 1407 bp, Chromobacterium substugae
atgaacggcaaaccgctaatcgtcggcggcggtcccgccggcattgccgccgcgatggaactggcccgccatggcgtgcacagcatcctgctggacgaggcctcgcggctgggcggcgtggtctaccgcggcccgctgcgccagggcgtggtgctggactacctgggggagcgctaccgcgaaaacatgcaggcgctgcatcgcgaattcgaaccattccgcccgcaaatcgacatccgcctggagactcgcgtcgtcggcggcgacggcggccagctgttcgccctgtccccggatgagcaggtgcagccgatagcctactcgcagctgctgcttgccgccggctgccacgaacgcagcgtgccctttcccggctggaccctgcccggcgtcatcatgctgggcggcctgcaactgcagctcaagagcggcgtggtcaagccgctgggccgcaccgtgctggccggcaccggtccgctgctgcctctggtggcttgccagctgcaccgcgctggcgccgacgtggcgggcatctacgaagcctgcgccttcggccggctggccaaggaggccatcgccctgctcaaccagccgcaactgttcctggacgggctgagcatggtcgcctatctgaaacgccacggcattcccctgcattacggctggggcatcgtcgaaggccatggccaggacgagctgcgcgacatcaccgtcgcgccctacgacgccgactggaccgccgacctgtcccggcagcgccgcctgccggcgcagaccctggcggtgggctacggcttcatcccgcgcacccagctgacccagcagctggggctggcgcaccagtaccacgacgatggcttcctcaaaccggacagcgacgactggcagcgcagcagcctgccgcatatccacctggccggcgacatcggcggcctgcgcggcggcgaggccgcgatgctgaccggccgcatcgccgccatctccatgctctggcagcgccacattctcagcgagcagcaagcgctgcggcagcgccaggcctgcctggaccaactggcggccatcctgcgcttccgcgtcggcatcgaccgcttcacccgccgcggcgccggccagctggcgctgccgcggccggacacggtgatctgccgctgcgagcacgccacccgccaggacatcgacgccgcgctggaacagggcgtcaacgacctgatcagcctgaagatgcgcacccggatcagcatgggcgactgccagggcaagatgtgcgtcggctattgcagcgaccgcctgcgcgaacacaccggcaagcaggacgtcggctggatccggccgcgcttcccgctggacccgctgccgttctcggcatttccgaccaccgccccccaaccgacggaagaggtttga

SEQ ID NO: 1814 - DNA, 312 bp, Chromobacterium substugae
atgtccttacaccgcgaccatgacatccaggccctgcaaggccagactctgaccatccatatcgacaaccaggccgtggccgccgcggccggcgaaaccgtgctgagcgtgctgaacgccgtcggcctgcgccggctcagccgcaacgaccagcaacagatcgccggctcctattgcggcatgggcgtttgccactgctgccaggtgcgcatagacggccgccacaaacggcgcgcctgccagacggtggtgcaagccggcatgcgggtggagaccgccggcaaccgcctggatacggagggcttgaaatga

SEQ ID NO: 1815 - DNA, 519 bp, Chromobacterium substugae
atgaaattgaagaacattggcattcagtggctggcgccgctgatcgccgccgccagcctgagcgcttgcgtggtgacgccgccgcgcgcccagatggtgtatcagccggcgacggtgcggctggaaatgccgcgcgactggcgcccggccgagcatccgtactatctgcacgcgatgagcgatctgcgcgcggcgcgcgcctatctggcgcacggcgactatccgcagatcatggatgacgagcgccgcgcggtgtccgagatcgacgccgcgctgggcgagatgcagcgcgccgccatcgaagacggcaaacaaccctggcgctacgagcagcccgatgcgcggctgagcccgaccgaccgcttccacaaggcgctggagctgctcgaatcggcccgccgcgatgccagccaccaggaagacgacccgtgggtgcgcgacctgcagcatcgcatcctccaccatgtagacgcggcgcaccatgcggtgcagcaagccatcaacgatgccctgcgctaa

SEQ ID NO: 1816 - DNA, 504 bp, Chromobacterium substugae
atgaaattttccggaatactgatgatgttgacgatggcggccgccggcaacgcggtgctgagcagccaagccatggccgacggctggcgcgacggcgacgcctggacctggcagcagcaccagtggcatcccgaggagcatccctattatctgcacgcgatgaccgatctgcgcgccgcgcgcgatctgctggcccggccggattatccgcgggtgatggatgacgagcgccgcgcggtggacgagatcaaccgcgcgctgcacaagatgcgcgacgccgccatcgacgacggcaagaacgtcgacgaccgcatgccgccggatgcgcgctggcggccggaagaccgtttccatcaggccaagctgttgctggacaaggcccgccaggacgccacccaccgcgaggatgatccttacctgcgctcgctgcagcgcgacatcgtccatcatatagacgaggcgcgccgcgccatcgactacgcggtgtccgacgccctgcgctga

SEQ ID NO: 1817 - DNA, 1008 bp, Chromobacterium substugae
atggagtattcaatgagccgaatcctggtgctctacaccggtggtaccataggcatggaccacaccccggatggcctggcgcccgtgccgggcttgctgccgcgcctgctgcagcgtttcgtccgcccaggcctggaattcgatgtcgtcgaattcgaacagctgatcgactcctccgttctcgtcccttcgcagtggaaccagatcatagacgcgctggcgccgcgctacgacgcctatgatggcttcgtggtgatccacggcaccgataccatggcctataccgccagcgtgctggcgttcgcgctgcagggctggaaaaagccggtggtgctgaccggcgcgcaattgccgctggtgcacccgcgctccgatggctgggccaatttggccgacgcgctggaagccgcctgccagcccgacctgcacgaagtggcggtggctttcgaccgcttgctgctgcgcggctgccgggcgcgcaagctggatgtggagtgctttgccggcttcaacagccccaacgacctgccgctggccgaattcgccatccatgcgcattggcacaagccgcgctggctgccgggcgaaggcgagcggcgggcgcagcgggtggacgaaaatctgaaactggcggcgctgatgctgaccccgggccatggcagcgcgctggccggccaggtgctgcagcgcgaagggctggatggcgccattctgctctgttacggcagcggcaatgcgccggcggacccggccttgctggccggcgtggcggcgatgacggcgcgcggctgtccggtgctgacattgacccaggtggcgcgcggcggcgtggaggtgggggcttatgccgccagccagccgctggcgcgggcgggcgccttgccgggggccgatctgacgcccgaggcggcgctggccaagctgcaggtgttgctgtcggccgggctggcgtggccggagctggcggccggtctggtgaggccgctgcgcggagagctgagcgcctga

SEQ ID NO: 1818 - DNA, 555 bp, Chromobacterium substugae
atgatgcggcacaagcaagcccaagcgcctgtcagggtggcgatagtcggcccggagtccagcggcaagagcacgctggcgcgggaatgggccgaacagctgcgccgcgagggccggcgcgcggcgtgggtggcggaatactcgcgtgcctattatgccgatcggccttatatttccagcatggcggacatcgaggcgatcgccgccggccaactcgcggccgaggagcaagcggccgcggccgccgacatcttgttgtgcgacaccacggtgctcacctgcaagatctgggcggaggtggcgttcggccaggcgtcggccgagttgctgcggctgtatcggccgcaggattacgcgctgactttgctgacccgccccgacatgccctggcagcccgaccccttgcgcagccatccgacgcagcgcgattggctgctggagctgcaccgcgccgaactggcccgcgccggcatcgccgccgtcgagctggcgggcggccgggaagcgcggctggagcaagcggcacgggcactttggccgcttttgcctgcctaa

SEQ ID NO: 1819 - DNA, 231 bp, Chromobacterium substugae
atggatgtgcagaaaatgaaagaaacgttccgtctcaatagcgaatacatcgccttgtgcgacctgctcaaggcctgcaatgtctgccagtccggcggcgaagccaagcatttcatcgccgaaggcaatgtgcaggtcgatggcgcgcaggagctgcgcaagacctgcaagatccgggcgggccagaaggtcagcggcgacggtttcctgatcacggtcgaggccgcctga

SEQ ID NO: 1820 - DNA, 195 bp, Chromobacterium substugae
atggacgacgcgacggacgccatgccgcagcctccgttcgaggtggatgacgacatgtgctgcggcagcggctgcgagccgtgcatcctggatatccatcagcaggagctgcgcgcctaccgcgcgaggctggcggcttgggaggcgcgccaggccgaagggctggccgcgggagacgccgatggccggcattga

SEQ ID NO: 1821 - DNA, 858 bp, Chromobacterium substugae
atggccggcattgatctgcatttccactcgcgcgtttccgacggcgcgctgacgccgaccgaagtggttgaccgcgccgcgctgcgcgcgccgtcgctgttggcgctgaccgaccacgactgcaccggcggcctggccgaggcggccgcggccgcggcgcgcaacggcatcgatttcctcaacggcgtcgaggtttcggtcagctggggccggcataccgtgcacatcgtcggcctgggcatagaccccggccacgcgccgctggccgccggcctgcagcgcatccgcgatggccgggtggagcgggcgcggcagatgggcgaatcgctggccgcggccggcatcgccggcgccttcgacggcgcgatgcgctggtgcgacaacccggaaatgataggccgcacccatttcgcccgccacctggtggcgtccggcgcggtgaaggacgtgcgcacggtgttccgcaaattcctgacgccgggcaagcccggttatgtcgcccatgactgggccagtctggaggacgcggtcggctggatcgccggcgccggcggcatggcggtgatcgcccacccggggcgctacgacatgggcaagacgctgatcgagcggctgatcctggacttcaaggcggcgggcggcgaggggatagaagtcgcctgcggcagccacagcctcgacgacatgcacaaattcgcgctgcacgccgaacggcaccagctgtacgccagcagcggcagcgatttccacgccccgggagagggcgggcgcgacgtcggctacaccgagccgctgccgccgctgtgccgccccgcctggctggcgctgagcgggcgcgtgatccgcgccgcggcctga

SEQ ID NO: 1822 - DNA, 624 bp, Chromobacterium substugae
atggcccagtttttcatgatccaccccgacaacccgcaggcgcggctgatccgcgaggcggtgaagatcctgcgcgacggcggggtgatcgcctatccgaccgactcctgttacgcactgggctgcgcgctgggcgacaaggcggcgatggagcgcatcctggacatccgcggcctggacctgaagcagcggatgatgaccctggtctgccacgacttgtccgagctggccaactacgcccgggtggacaacagccagttccgcctgctcaagagcgccacgccgggcagctacaccttcatcctgcaggccagccgcgaggtgccgcgccgcaccctgcacccgaagcgcgccaccataggcctgagggtgccggaccacaaagtggcgctggccttgctggaagagctgggcgaacccatattgtcctgtaccctgatgctgccgggcgacgccgagccgctgtccgacccttatgaaatccgcgaacgcctggagcacctggtggacgcggtgatagacggcggctggtgcggcaccgagcccaccaccgtcatcgacatgaccgacggcgtcgagctggtgcgctcgggcaagggcccgctctcgcccttcggtttttga

SEQ ID NO: 1823 - DNA, 1197 bp, Chromobacterium substugae
atgttcgccaaccgcattctttccggcatgcgccccaccggcagcctgcacctgggccactatcatggcgtgatcaagaactgggtggaactgcagcacagtcacgaatgctttttcatggtggccgactggcacgcgctgaccaccaacttcgacgatgtctcgatcatcggcaggtccatcgatgaaatggtgatcgactggctggcgtccggcgtcgacccggaaaagtcgacggtgttcgtgcagtcgcgggtgccgcagcacgccgagctgcacctggcgctgtcgatggtgacgccgctgggctggctggagcgggtgccgacctacaaggaccagatggagaagctcagccacaaggacctgaccacctacggcttcctcggctatccgctgctgcaggcggcggacatcctggtgtacaaggccggcctggtgccggtgggcgaagaccaggtgccgcacatcgagctgacgcgcgaagtggcgcgccgcttcaaccacatgttcggccgcgagcccaatttcgaggagctggcgcgcgccgcggtgaaaaagataggcaaggccggcaagcaattcgatcagctgcgcaccgcttacctgcaggacggcagcgccgaggcgctggagcaggcgcgcgaaatcctggctggcagccagaacctgggcgcggccgaccgcgagcggctgatgggctggctggagaacaagggcaagaccatcctgcccgagtgcgaggccaagctgaccgccgcctccaagatgccgggcctggacggccagaagatgtccaagtcctacggcaacaccatcaccatgcgcgaagcgccggaaacggtgagcaagaagatccgcggcatgccgaccgacccggcccgcgtgcgccgcaccgacccgggctcgccggccaagtgcccggtgtggcagctgcacgaggtgtacagcgacggcgcaaccaaggaatgggtgaaggcgggctgtaccagcgccggcatcggctgcctggactgcaagcaaccggtgatcgacgccgtggtgcgcgagcagcagccgatgttcgagcgcgccgagaaatacctggccaaccctaagctggtcgccgaaatcctggccgacggcaacgcccgcgccgagaaggtggcgcgcgaaaccatgtgcgacgtgcgccaggcgctgggcctgggacgctga

SEQ ID NO: 1824 - DNA, 1326 bp, Chromobacterium substugae
atggcttttttcaaccgcaaactcatcagccggctggagcagaccaccgcccagcgggacaaggcccgcgacatgctggccgccatcgaacgctcgatggcggtgatcgaattcagccccgccggcgaaatcgtccacgccaacgacaatttcctgcgcgccatgggctaccgcggcgatgaactgatcggccagcaccaccgcatcttctgtccggccggctacgccaacagcccggcctacgccgccttctggcaaaaactggcgcgcggcgaatgccaatccggacattttctgcgcctgcgcaaggacggcggcgaagtctggctggaagccaactacacgccgatcctggacgccgacggcaaggtgagcggcgtgatcaaggtggctaccgacatcaccgcccaggtggcggcggagcaggacaacaaggccctgcgccaggcgatagaccattcgatggcgcggatcgagttcgacctgcaaggccatatcctcgacgccaacgacaatttcctgcagaccttcggctacgcgctggccgaagtgaaaggcaagccgcacagcatgctgtgcgaaagcggctacgcccacagccaggcctaccaggatttctgggcgcagctgcggcagggccgcttcatgcaggggcagtatcaccgcgtcgacaagcaaggccgtccggtctggctgcaagccacctacaacccggtgctggacccggacggacggccgctgcgggtggtgaaattcgccaccgacatcaccgagcaggtggagcggctgcaacagcaggcggaaaacgcccagtccgcggtgcaggcgtcggaaaacaccgcccaactgtcggtgcaaggcagcgcggtgctggagcaggccaccaccgagatcagccgggtggcggacagcgtggagagctcgtccaccatcctgtccaagctgggcgacagctccagccggatcggctccatcgtcaacaccatcagcgacatcgccgaccagaccaatctgttggcgctgaacgcggcgatcgaagccgcccgcgccggcgagagcggccgcggcttcgcggtggtggccgacgaggtgcgcaagctggccgaacgcaccagccagtcgaccggcgaaatctccggcatcgtcaagagcatccaggacgactcgcgctcggccatcgacgcgatgggcgaaatgcaggcgctgaccgacagcagcttgcaactggccgaccaggcccgcggcgcgatttcggaaatccgcgacggcgcccgcgacgtggtgcaggtggtgcgcgaggtatcggagctgctgcagcagaaatag

SEQ ID NO: 1825 - DNA, 2589 bp, Chromobacterium substugae
atgatgaaacacaccctgctgctggccgggctgggcgccgctttgcccatcgccgccctcgccgccgattccgccccccaggacaacgcgctggaacgcgtcaccgtcaccggctccaacctgcgcgccagctccaaggcaaaggccaacccggtgcaggtgatcagcgccgccgacatcgcttccagcggcaagaccagcctgcccgacgtgctgcgctcgctggcggtgaacagcggcaacagcttcaacgagcaatacaccggcagcttctccgccggcaccgccggcatttcgctgcgcggcctgggccagcgcaacacgctgattctggtcaacggcaagcgcgtcgccaactacgccaccgctcaggagctgcaggaaactttcgtcgacctgaactcgctgccgctgaaggcggtgaagcggattgaaatcctcaaggacggcgcgtcggccatttacggttccgacgccatcgccggcgtggtcaacatcatcctctaccccgactaccagggcgcggagctgggcgccagcgccagccgcgacgccagcaccggccagaacgagcgccagttcaacctgctggccggcaagggcgacctcgagcgcgacggctacaacgtctggttctccttcgacgcgcaaaagcgcgaccggctggaccagaccgacgtttcctggctgaaagataacgattttcgcaaccagcaaggcggctcgctggtgcgcaacgtcaccaactactacaacggcgcccccgcccagcgcttccccaacgccgcggggccgctgcaggacatcgactacggcgcggtcaacccaggcaagagcggccgggtctgggcctacaatccggcgctctacaccacgctgatgcccggcatcgagcgctaccacgcggcgctgcgcggcagctaccgcctgaacgccggcgccgaggcctatgccgaattcctgtacggcgccagccacagcaaccagattttcggcccgccgctcaccatcagcagctcgctgcgcgcctggaacagcgccacccagtcgctggtgccgatcagcaatgtgctgcccgtcggcaaccccggcaatcccaacgcgacgccgacgccgatcaacgccaccttgttcgacctgggccagcgcaacaaaaccgacagcgtgtcgttccgccgcctgctggcgggcgtgaagggcagcggcgacgcctgggactgggacgtgtccggcctgtattccgacagccggctgcgcgagtacgcgtacaacttcgtcaaccgctatgcctacgaagccttgctggccaacggcggctacaacttcgccgacccgtcgcagaacaacgatcaagcgagaaacagcctgcgcatcagcaccctgcgcccggcctggtaccgcaccgccagcttcgacgccaccgccagcaccgagctcggccaattgccggctggcccgctgggcttcgccgccggctatcagctgcggcgcgaaatgatgaatgccggcacctcgcccgaggtggccagcggcgccgaattgcggccggcgctggacctgatcaacggcgcccgcaccgtgcaggccgcctatggcgaattgaacgcgcccatcgtgaagaacctgtcgctgagcgccgccgcccgcgccgaccactacagcgacttcggcagcgccttctcgcccaagctgggcctgcgctaccagccgctgcaaagcctgaccctgcgcggcaccttgtccaagggctttcgcgcgccatcgctgccggaaatcacccatagcaccgcggtcagctacggcagcgtgcaagacccgtacgaccccatcacgcccaaccagagcataggcttcacccacctggtggtggccaacccggccatcaagcccgagcactccaccaacgccaacctgggcctggtgctgtcgcccactgcggacagcagcatcgccatcgattactaccgcatccgccagaaggacgtgatcggcctggaggacatcgacaatctggtgcgcaaccccggcgcctaccccggccagatcgtccgcgacagccagggccggttgcaaaccatcacccagcagttcaccaatctgggcaaccgcgaaaccaccggcttcgacctggacctgcggcaaagctggaaactgggcggcggccgggtgacgctggccgcgcaatggagccgcctgctgtcgttccgccagccgttgcagcaaggcggcgcgctgcgggaaggcgccggcagcaatctgctgggcgcgctgccgcgctggaagggccaaacctcggccagctgggacagccacgactggtcgagcacgctgacctggttccacaccgacggctacacccaggccttcagcagcggcgctggcgaccagacccgggtgggcagcgccaataccttcaacctcagcgccagctacaaaggcatcaagcgcgccacgctgaccgccgcgctgcaaaacctgagcaatcgccggccgccctgggattcgcacgccggcatctactacgattccagccagtacgaccccaccggccgcaccctgaccctaggcgtgcaatacaagctggactga

SEQ ID NO: 1826 - DNA, 129 bp, Chromobacterium substugae
ttgtttatgcgggtaaggcggggctgctcggacggcgcgcaggcgtcagccgggcaggcgcggacagcggatggctggaaggacgaggctggggagcatggctttcatttctggatacaaaatacataa

SEQ ID NO: 1827 - DNA, 249 bp, Chromobacterium substugae
atgaacatcctgcccgccatcctgctgctgattcccgcgctggcctgcgccgcgcccggcgcctccgccccgcgcggccaagcccgctttggggaaatgaaggccaagctgctgcaagagcacgcccagcgcatccagatcctgcaagccagccaaagctgcatccaggcggcgcagacgccgccggcgctgaaagcctgcgtggagacgcagcgccaacagatggaagcgctgcgtccgccgcgttga

SEQ ID NO: 1828 - DNA, 702 bp, Chromobacterium substugae
atggcaaaattcacgaactcacactacgcaaccatcctcacgctgttcgccctgctggcggcgccgccagcccaggccggccattccgccgaacaggcggtccgccagcaggccacccagctgatccagcaacggctggccgacgccggcctggaccagcccggcatcacgctgcagctgattcccccgcgcgacctgcccgcctgcgcccgcccctggcaggtggaggcgaccgacagccgcgccttcagccgcatgcgcttcagcgtcgcttgcccggatggcgactggcgcggcgactacatcgcgcgcgccagcgtcagcgccagggtggccagcgccgcccgcgacctgccggccggcgcgccgctgcagaaagaagacatcagctggagccggcgcccggtcagcgagccggccgacctgttcggccaggccagcacgcccttgggcctggcgccgcgcgcggcgctgagccagggccagctgctgcggcgcaagcagctgcaagcgccgcaattggtgaagcgcggcgacgaggtgcgcatcgtcgcccgccaagacggcatcgaggtcagcaacgccggcgaggcgctggccaacggccgcatgggcgaagtgatccgggtgcgcaatgtcggcagcggcaaggtgatcagcgcccgcgtcagcgccggcggcgaggtggaagcgcaggactga

SEQ ID NO: 1829 - DNA, 357 bp, Chromobacterium substugae
atgggcatgcatctggacaaggccctgagcatccaccccgaagccttgcggctgcgggcggagcggacccgggtgctggcgtctaacctcgccaacgagaacaccccgggttatcaggcgcgtgacatcgatttcaaggcggcgctggcatcggccagcgccgattcgccgttggcgctcgacgacggcggcggcgatctgctgtatcggctgcccaaccatccctcgcgcgacggcaataccgtcgagctgggcgtcgagcaggccgagttctcgcaaaacgtttccgaattccagaccagcctcaccttcatcaatatgaagctgcatgggctggccaaagtcatcgcggggtaa

SEQ ID NO: 1830 - DNA, 405 bp, Chromobacterium substugae
atgtcattccgggacatctcgcgcatcgccggctcggcgatgaccgcgcagaccgtgcgtctcaataccgtggccagcaacctggccaacgccgacaccgccgccggcaccgagcaggcggcctatcgcggccgcaagccggtgttcagcagccagatgcagggcgaaggcatgggcgtgcaggtgctggacgtggtgcagaaccaggagccggtgcgcaaggcgcacgagccgggcaatccgttggccgacgccggcggcaacgtcttctacagcaatgtcaacgcggtggaagagatgaccgacatgctctcggccagccgggcgttccagaccaatgtcgaggtgctgtccaaggccaagagcatgcagcaggatctgctgaaactgggagacaacgcatga

SEQ ID NO: 1831 - DNA, 693 bp, Chromobacterium substugae
atgagcgtggatcaagcgcaggccaaaccgttcgccgcgggcggcaacggccagcaagcgggcgggcagggcgtcgccccggccgccggccagggttccggcggcaacgatatgttcatgacgctgctgctggcgcagatccgcaaccagagcccgctggaccctgccgacccgtcgcagttcgtcagccagctggcgcagatgagccagatgcagtccacccagggcatgctgagccagttgcaaagccagggcgcgatgctgcgcgagctgcaaggcgtggcgctgggcgcacaggtgggcaagaacgtgctggtgcagaccgaccgcatccgcagcgacggccagggcaatctgtccggccgagtcacgctgtccggcgccgaggaaagcgccacgctgaccctggtggacgccgccggcaaacgcaccaatatcgcgctgggcaagcgcccggccggcgccagcgatttcagcgtcaagctgtccgattacggcctggccgcaggcgactaccaggtggagttcgccaccgaatcgaaaaaagccggcctgctggagctgcaggccgctgtcagcggcgtgcgcctgccggtgaacggcggcgagccgaccatcacgctggccggcctgggcgatttcccgtcctcttccatatccgccttgctgggcaagcccggcagttccgcttaa

SEQ ID NO: 1832 - DNA, 1182 bp, Chromobacterium substugae
atgagttttgaaattgcgctgtccggcatcaacgccgtcaacaaccaactgggcagcatcagcgacaacatctccaactccggcacctacggcttcaagtccggccgggtgactttcgcttcggcctacgccggcagccaggcgatgggcgtgaacgccaaccccaacaaccagaacatcggccgcagcggcggcgtggtgaccaccggccgcgcgctggacgccgccatcgacggccgcggcttcttcgtctccaagagcgtggccggcgcgatggcctatagccgggtcggcatcttcaacaccgacaaggacggctacctggtggacaactacggcggccgcgtgcagggctacgccaagtccgataccggcgcgctgggcgcgatgggcgacattcagatcccgaccggcaacattccggccaagcccagcgattcgctgcagtacaccggcaatatgtcggccggctgggcggtgcagaccgtgccgttcgacaagaccgtcagccaaagtttcaaccattccaacgtatccaccgtctacgattcgctgggcaacaagcacaatctgacgcagtacttctgcaagagcgccgacagcaccgtcaccgtgcattacgcgctggacggcaatctgctgggcaccaccaccgacctcaagttcgacaccaacggcaagctgaccgcgccgaccgcggcggtcaacctggggctgggcagtcccgctggcgcttcggcgctgaacgtggcggtggactacaccggcaccacccagttcgccggcgagcccagcaccagccgcaacgccaccaacggctacgcgccgggcgcgcgcaccggcgtcagcctgggcgagaacggcgaagtgatcgtcagctacagcaacgaccagaaaatgacggtggcgcagctggcgatcgccaacttcgccaacgaaaacgcgctgaccgccggctcgcagaccagctggcaggaatcggccggctccggcgcggcgctgtattccgtcgccggcagcagcatggccggcaagctggccaccggttcgctggaacagtccaacgtcgacgtcaccgccgaactggtcagcctgatgaccgcccagcgcaactaccaggccaacaccaaggtgatttcggcggaaaaccaggcgatgcaagcgctgatgcaggcggtgtaa

SEQ ID NO: 1833 - DNA, 732 bp, Chromobacterium substugae
atggacgcgctgatctacaccgcgatgagcggcgccgaccgcatgttgaaggcgcagcagatccacgccaacaacctggccaacgccgaaaccggcggcttccgcgccgacattgacgccgccaccagccaggcggtgcctggctacggctacgacgcgcgcctgctgagccagaacgcgcccaccgtgctggacagccgcaacggcgcggtggtggaaaccggccgcgatctggacatcgccttgcagggcgatggtttcctggccatcgccgcccccgacggcagcgaagcctacacccgcgccggcagcatgacggtgggcgccgacggcgtcctcagcgtcaacaaccggccggtgctgggcgacggcggcgccatcacgctgccggagggcttcaccaaggtcagcgtcgccgccgacggcaccgtgtcggtgctgaatcccggcgacaccgaaatgcagccggtggacaagatcaagctggtaaagccggagccgaacgcggtgaccaagagcgccgacggcctgatcgtcagccgccagggcctgcccttgccggccgacgccagcgtcagcgtgcaaagcggccatctggagcgcagcaatgtgtccgcggtggaggaaatggtggccaccatgacgctcaaccgcaacttcgagatgcagatgaagctgttcaacgccgccagcgacatgaacgaggcgggcaaccgcctggtgcgcgcgtaa

SEQ ID NO: 1834 - DNA, 789 bp, Chromobacterium substugae
atgaatccggcattgtggatcagcaaaaccggcatccaggcgcaggacgcgcgcctgaccgccatcgccaacaacctggccaacgtcaacaccaccggcttcaagcgcgaccgcatggtgttcgaagacttgttctaccaggtcgacaagcagccgggcagcaaggtggacgacaacaacatctcgccgtccggcgtgcagttgggcaacggcacccggctggtgggcagccagaaggtgttcaccgaaggcaacctcaccaccaccggccagtcgctggacgtggccatcgtcggccagggctttttgcaggtgaagatgagcaacggcgaaaccggctacacccgcgccggccagttgcagctgaacgccaacggccagctggtgaacgcgcagggcctgccgctggagccggaaatcaccattccgcccaccgccaccaaaatttcgatcagcgagaccggcgcggtgtcggtgaccgagggcggcagcggcacgccgaccaatgtcggccagatcaccctggccaacttcatcaaccccaccggcctgttggcgctgggcgacaacctgttccaggaaaccgccgccagcggcaaccccaccaccggcaatccgggcgccgacgcgctgggcaagctcaagcagggcagcctggagggttccaacgtccaggtggtggaagaaatggtggacatgatcgccgcgcagcgcacttatgaaatgaacaccaaggtgctgtccgccgccgacaacatgctgcagcaactgggccaggcggtgcgatga

SEQ ID NO: 1835 - DNA, 654 bp, Chromobacterium substugae
atgaggctgatccgccttgcgccgctggcggccttgctgctggcggcttgcgcccagttccagcctgcgccgccggaggcggatccattgcccgatctgttgcagcagcaggcgcagaccagccgcggcggcggcgtgttcaccccggcgggcgcgctgtcgctgacgtcggacaatcacgccttccgcgccggcgacgtgctgaccgtggtgctggaggaaaccacccaggccagcaagcaggccggcaccagcttcggcaagaagtccggcgccaaggtgggcccgacgctgctgggcaataccaccttcaacgcccaggtgggcatagacgccagccgcgatttcaacggctcgtccacctccacccagcagaacgcgctggccggctcgctgaccgtggtggtgcacaaggtgctggccaacggcctattgcaggtgaagggcgagaagcagctggcgctgaaccagggcgaggaaacgctgcgcctgtccggctatgtgcgagtggaggacatcgacaccgacaaccgcgtctcctcgctgcgcatcgccaacgcccgcatcggttattccggcaccggcgcgctggccgacgccaacaatgccggctggctgatgaagttcttcgccagcccgctgatgccgttttaa

SEQ ID NO: 1836 - DNA, 1107 bp, Chromobacterium substugae
atgaaactagggtttttccgccgcctgctggcggttgtggtgctggcggcgtgcgcgccgctggtttgcggccagccgctgcggcagatggtcaacgtcgagggcatccgcgacaaccagctgataggctacggcatcgtcgtcggcctggacggcaccggcgacaactcgcaggtgaagttctccggccagtcggtcgccaacatgctcaagcagttcggcctgaaaatgccggagaagaccgacacccgcgtcaagaacgtggcggcggtgatggtcagcgccagcctgccgcccggctacagccgcggccagaccatagacgtgaccgtatcgtcgctgggcgacgccaagagcctgcgcggcggcacgctgctgctcacccagctgaaggcggccaacggcgaggtgtacgcgctggcccagggcagcgtggtgataggcggcttgtcggctcagggcaagagcggctccagcgtcaccgtcaacacccccactgccggccgcattcccaacggcgcgtcgatagagcgcgagattcccagcgacttcgagcaaggcgacagcatacggctgagcctgcgccgccccagctttgaaaccgccagcaatgtggtcaaggccatcaaccagagctacggcaagatcgccagcacccgcaacgccaccaccatagaagtgaaggcgcccgccgatcccacagagcgcgtggccttcgtcgcgcggctggaaaggctcaatgtcaatgtcggcgccgaactgccgcgggtggtgttcaattcgcgcaccggcaccgtggtgatcagcgagggcgtcaccgtgcggccggcggcggtatcgcacggcagcctgcgggtggtgatctccgaatcctcccaggtcagccagccggggccgttcagcaacggcgacaccaaggtggtgcccaattccaacgtcaacgtcgagcaaggctcggggcgtatgttcaagtggcccgccggcgccagcctgcgcgccatcatcgatgcggtcaaccgcaccggcgccacgccggacgacatcatggccatcctgcaggcgctggaccaggccggcgccatcgacggcgaactgattgtgatttga

SEQ ID NO: 1837 - DNA, 423 bp, Chromobacterium substugae
atgctgaacaacgatctgcaaaaccagaacctgccggccggcggcgacgcgccggtggcgccggccagcgccgaataccgcaagaaagcggaaaaggccgccgaacagttcgaggcgcagttcgtgcgcgaaatgttcaagcagatgcgcaagaccacccgcgaggtggcgggcgaggacagcgtgttcgccaactccatcaacggcgacatgatggacctggccgacggcgcgctggccgaccagctggcgcaccagcgcattttcggcgtggccaacgccattctggcgcagctgctgccggcggatgggaatattgccattaagccgccggcggatgccgtcgccagtcaacagcaaggccatgacaatggccaggggctggcggctttcgccacgccgatgtttcccctgaacaagtga

SEQ ID NO: 1838 - DNA, 1368 bp, Chromobacterium substugae
atgcgcatgatcaacaacgcgctgtccggcgcgcaggccgcccaggtcgcgctgaatacggccagccagaacatcgccaaccagcagacgcccggctactcgcgccagggcgtggtgctgaccacccaggcgccgggcatgggcgaccccaccagcgcaggctacggcgtggcggtcggcagcgtgcgccgcttcagcgacgactaccgcaatctgctgcaatggcaggcggcctccagcctgggcgagcagtcgtccgcccagccttacttcactcagctggagaaggtgatgggcagcgacggcagcagcctgtccagcggtttcgacaaattcttcgccgcgctcaacgccgccagcctggattccaacaccatgcgcgaccaggtggtgcgcgaggccggctcgctggcgcagcgcttcaacaatctggacggcgtgctgacgtcgcagctggcggccatcgccgagcagcgccgcgccacgctcacccagatcaacagcgtcaccgccaacctggccacgctcaacgacaagctgatgtcggcgcgcgcgcaggggatcaacacttccgggctggaggacgagcgcgaccgccagatcgacgcgctgtcgtcgttggtggaggtgagggtggtggcgcagcctgacggcagcaagagcgtcaacctgaagaacggcctgccgctggtggccggcgacagcgccgcggtgctggacagcgaaggccagccggatggaacccagcagctgaagctggttttcggcaccgagaagtatgcgattccgggcggcgatctgggcggccaactgggcgggctcaaccagtttgaaagcgacaatctgcggccgatccagacccaggtgcgcactttggccggcgagctggccaaccgcgtcaacagccagctggccaagggcttcgatctgaacggccagccgggcaagccgctgttccagtacgatgccggcgccgcccatggcctgctgcagaccaccggcatcgccgccgccgatttgggtttctccgccgacgcggccaaacccggcaataacgacaatctgcgcgcggtgctgaccatcaagcagcaaaccttccccttggccggcatcggccaggtgacgctgggcgacgcttattcgcagatgatcggccacctcgccatctccagccagcagaaccagtcggcgctcgacactgccaatgtgatccgcgccgaggccgagaagaactggcagtccaccagcggcgtcaaccgcgacgaagaagcggtcaacctgatcgaataccagaagatgtaccaggccaatatgaaagtgatttcggtagccaaccagctgttcgaaagcacgctggccatcctgtaa

SEQ ID NO: 1839 - DNA, 909 bp, Chromobacterium substugae
atgcgtatctccagcaaccagtaccgctccaccctgcagctggccatgcagaacaccagttccggcatggccgacctgctgcagaaaatgtccagcggcaagagcatgctggccgcctcggaaaacccgatcgccagcgtgcggctgctgcgtctgcagcgggaggaggcttcgctcaagcagtatcgcgacaatatcggcgcgctcaagtcgcagttgtcgaagaacgaggccctgctcgacggcatcagcgccaatctgcgcgacgcgcgcgacatcctggtggcggcggccaaccagccgccggcagaggacctgaaggcgatggccgcgccgctgaccagcctgcgcgacagcattctgttcgccgccaacaccaaggacagcgaaggccgctacatgttttccggcagcgccatcaacaccgccaccatcgcggtggatcccagccagccggccggcagccgctacagcttcgccggcaacaccgacagccagctggtgacggtgggcgagggcgtgacccagtcttccaacgtcacgctgcagccgatggcgggtttgctcaaccagctggacaaggtgatcgccacattgcaaagcccgacgctggacaacaaggacccggcgttgggcgcttccatccgcggcgtgatggacggggtggacggcgcgctgagcgaagtcagcggccgcatctccgaactgggcggctcccagaacgtgctgcagacgctggacgacaatcacaatagcctcagcctggccaaccagcagagcattctggagcttggcagcctggattacggcaccgcctatatggacatgaacaatctgtcgatggccttgcaaaccagccagaaggcttacggcaaggtcagccagctgaccctgttcgacgtgatctga

SEQ ID NO: 1840 - DNA, 1038 bp, Chromobacterium substugae
atgtccagcacgctcagctcgatcaagcatgccggcgcggacaagcgctggggcaaggacggcgcggccatcgcgccggccgccagccgcgccgtcgccggcggcggccgccccgcgctggccagcgcccagccgtcggcctccgcggcggcgggctggcgctacagcacccagctcaacgaacagctcaccgccgcccagtgcgcgcagggcttcgtcgacgacatgctgcgccagctggaggatttcaagggcaatctcagcctgcagctcacccagcggcgggtggacgatgacggcctggccgcgcagcgcgatcaactgcagcaaagctggttgcagcggcaggacgatagcgccggcagcttggacggccaactgcggctcagcttgggcgcgccgtcgcgccagctgttctccgcgcgcggcctggacctggacagcctgagccagggccagccggaaaccctggtgttttccggcggcggcggcgcgccggccggcgcggtgagggtgggcgacggcgtcggccgcgaagaagtgctgcggcggctgaaccaggctttggggccggctagcgtgcgctgcgagctggacaaccatggccggctgggcttcagctgcagcgaggccgactggagccggctgcgcgacagcctggcggtgcgcggcggcggcgtgcgttttcccggcggggtgccgcagccgctggcgctggatgccgagccgccggctctggccccggcgcagtggcaggtgggcgaccacgcccaagtgcggcaaacgctgcagggcgtgctgcgcgccatcgcccagctgcagcagacgcgggccaccataggcaacgccatcgccgaggcgcgccagtccatcagccagctggcgcggcaggatgagcccagctgggcggacggcttcgtcagcgatttcaacgcccgcctcaatcagggaggggacttcggccagctgcaacagctgttgccggccttgatgggcatcagccgctaccgcgtgttgtcgctgttgtcgctgcgctga

SEQ ID NO: 1841 - DNA, 1215 bp, Chromobacterium substugae
atgcgcagccgctgttggccgctggccctgattttgtcgtccacgctggcccgcgccgatttcaccattcccggattcgagctggtgcataccgcgccgcagcatgcggggctggacacaccggatttgcgcgacccggccgtagtatggagcgagttgttcgactccgcccgcacgcagatcgtgctggagcagttttacgcggcggatcaggcgggcagcaagctgacccaggtgatggatcggctggaagccgcgggacggcgtggggtgaagatacgctttctgatggaaaagaagggcatgttcgccagcgaggccgccaccatcgcccgcctgcagcgcattcccaatctggaataccgccagctcgactacagccagctcaccggcaacggcatcatccacgccaagttcatcgtggccgacggcaaaaccgcttacgtcggcagccagaatttcgactggcgctcgctccagcacatccatgaaaccggcctcaaggtggacgacgcggcgatggccggccgcatgcaggccatcttcgaacaggattgggccgcgcaagagacgctggccaccggcggcaaggtcgcgccgctgcgcgcggccgagcaggcggcggacttgtcgcagccggcgacgctgctggccagccccaacgcctacaacccggacggcgtcggcgattccgaggaggcgctgcccaggctgatggccgaggcgaaacgcgaggtgcgcatccagctgttggactacgcgccgctcagcttcggcaagccgcggcaatactacccgctgttcgacaacgccattcgcggcgcgctggcgcgcggcgtcaaagtgaagctgatggtgtcggactggaacctggaaaagccgggcgtcgactacctgaggagcctggcggccttgccaggcatggaagtgcgctatgtgaccattccgcgcgacggcgcctgcattccgttcgcccgcgtcatccacagcaagaccatggcgatagacggccagatcgcctgggtgggcaccagcaactggagcggcggctatatggacaagtcgcgcaatctggaagtagtgttgcgcaatccggcgatggcgcagcgcatcgccactttgcacgagcagacctggtcgtcgccgctggcgcggagcatcgagcccggcaaggcatacaccccgccggacaaggcctgccgccaggcgtcttga

SEQ ID NO: 1842 - DNA, 1851 bp, Chromobacterium substugae
atgtgcggcatcgcaggttggatcagctttgagcggaatgtgagggattaccgcgaagtcatcgacaatatgacgcgcaccatgcggctgcgcgggccggacgccggcggcgtatggctggatcgccacgcggcgctgggccaccgccgcctgtccatcatcgatctggaaggcggcagccagccgatgctggcggaggaggacggcaagacgctggcctgtctggtatataccggcgaggtgtacaacttccaggagctgcgccgcgaattgatcgcgctgggccacggtttccgcacccgcagcgacaccgaggtggtgctgcgcgcctatctgcaatggggcgaggcgctgaccgagcgcctgaacggcatgtacgctttcgccatctgggacgcgcgcgccgagcggctgctgctggtgcgcgaccgcatgggcgtcaagccgctctactattatccgctgcccgacggcgtgctgttcggctccgaacccaaggccatcctcgcccatccggaggcgaagcgcgtggtgaaggcggaagggctgcgcgagatgctggatctggtgaagacgccggaggcggcggtgttcgatggcatgcgcgaagtgcggccgggacagacagtcaccgtggaccgcgccggcctgcgcaagcaccgctactggaaactggaggcgcgcgagcacggcgacgacctgcccgccaccatccgcaccgtgcgcgagttgctggacgacatcgtcgaacgccagatcgtcgccgacgtgcccctgtgcaccttgctgtccggcggactggactcttccatcatcaccgcgctggcggcgtgcagcaccgcccggcaaggcaagggcaaggtgcgttcgttctcggtggatttcatcaagcatggggtggagttcgcctccgactacctgcgcagctcgccggatgcccccttcgtgcgcgacttggccgcccatgccggcaccgatcaccaggaaattctgctggaaagccgtgatctggccgatccggcgttgcgcgcggcggtgctgggcgcgcaggatttgccgccggcctactggggcgacatgctgccgtcgctgtacaagctgttcgaggcgatccgcgcccagtccacggtggcgctgtccggcgagtcggccgacgaggtgttcggcggctaccgctggttccacgacgccgccgcggtggcggccgacacctttccctggctgtccggcgccaccgcctccttcttcgacggccagtcgctggtatcgccggatttgctgcggcagctggacatggcgggcttccgccgcgacagctacgcgcaggcgctggccgaggtgccgaccctggcctcggacgacgccaaggaaaagcgcatgcgcgaaatcagccacatgcatctgacccgcttcgtgcaggggctgttggaccgcaaggaccggatgagcatggcggtagggctggaggtgagggtgccgttttgcgaccaccggctggtggaatatgtgttcaacgcgccgtggcggatgaagaatttcgacggccgcgaaaagagcctgctgcgcgccgccggcaaggatgtactgccggactccatcgttcagcgcgtcaagagcccgtatccggccacccaggatccggcatatgagcaggcgctgcgccagggcctggcgcgggtgctggacgacgccgccgcgccggcgctgccgctgctggaccgggccgcggcgtggaagctgctggaccggccgttcggcaagaccagctccgcgccggagcgcgccggactggaaatggcgctggggctgaacgagtggctgcggcaccatcgggtggtgctggatttataa

SEQ ID NO: 1843 - DNA, 894 bp, Chromobacterium substugae
gtgactatttatgggcagcaagaaattatcaaggacctgattgccgcgcgcttgaagacggaatttccactgctgtttgacgctgcagatgttcagattcatgatactgacggattttcgccatatgtttcattttcgcatggcggtgagcagcagacgctagagtgtgattttatcgtcggttgcgatggcttccacggtatttgtcgaccgcatatctcagactctctcacccagttttcgtacaactacccgtttacttggcttgctgttctggctgaaatgtcgccgatttcgccggacgtcattttttccagtcacgagacagggcttgcattatttacgatgcgatcgccgaatgtgtcaagaatctacttgcagtgctcgccagacgaagaccccaatgagtggtctggttcgagaatctgggatcttttgcaattacggttggaaggcaggcctgagaaggtgaatggcggggcaatcattgagaaaagcattgtgcaacttagaagctttgttgctgagaaaatgcaaaaaggcaggctgtttctggctggagatgccgcgcatatcgttcctccttctgctgcgaaagggctgaatctcgcggtttccgatgcgaatattttggcccgcgcttttgagcagcactatggcaaaggcaaggaagatcttttgttgtcttactctgatatcgcattgaagcagatatggcgggatgtacagttttcccattggatggccatgttgttgcatcgtttcgatgacaactctcattttcatagacgtctgcagatagcagagctggatagggtgcttggctctgggccagccgcgcagagtttcgctgaactatgggttggcaatccgccattcgccgcgtcgatttaa

SEQ ID NO: 1844 - DNA, 1917 bp, Chromobacterium substugae
atgaccaccacctttccgtttcaagaagatgaatgcttttttttgatgcgtcgcaaaaatgaaccaacagtacttgcatgcacaggaaaggtagagaggtttcgccatttggcggatattcccatgaagtctgggctagccgatagccatactttcgattcagtcaacctgattccatttgctcaagcccgagaacgtggctttcctgtgcatgatgatggggagcctatcgtttctctgcaaatcgagaattcgcaatatttcccgctcagccagtttgtcgagatgctacccaatgaacaggtggacatttcaaatatatcgttcactaccgatcaggctgaatacgaagccatcatcagaaatatcatcaactgtgaaatcgggacggggcaaggcgcaaatttcgtcatcgcacgggaatgcgtcgctcacatcggcaatgctgagctgagtggcattctcagtattttccgttcactgcttctgaatgagttcggcgcttactggactttcgctttctatgatggagagcattattatcttggcgcatctcccgaacgacatatttcggcttcgtgcggcgaggtcatgatgaatcccatcagtggcacctatcgtaaaaatagcgcatatgaggtggcggaaagcgagaaggattttctggaattccttcaggacgagaaagaaattttcgagctcttcatggtttgcgacgaagaactcaagataatgagcgagatttgcgatcaaggcggctcggtgatcggccccatgctcaaggaaatgtcccgcctgattcataccgaatatctgttggtaggcaagacggacaagtcgatcatcgatctgctgcgtcgctccatgtttgcgccgacggtcaccggcagtccggtgctgagcgcatttcgcgtcatccaccgatacgagaagcaatccagaggttattacggcgccacgatcgccctggtcggccgcaataaggatggcagcgcgacgctggatgcgccgattctcatccgcacgcttcaaatagaccgggcaggcaaggcggtagcccgggtgggcgccaccttggttcgcggctccaatccgatgcatgaggtgtgggaaacggaaaccaagattgcaggtttgttcaacgcggtccgcaatgcaggcaagagtccggcacctcccgagcgcttgttggacaagatggatcatgagcagattcaaagactgctgcagtccaggaacgcgtatctatcccgcttctggttcgaatcgcaagacgcggacttcggaacggagccatcgttgcgcggaaaatccgtcaccatcgtggatgcggaggatgatttttcggtgatgctcaagcgtctgctggagcagcttgagatgcaggtgagcttggtttccttcgccgactacaaccctcagcttcatcagagcgatctgttggtggcgggacccggcccaggcaaccctctggatagccaggatggcaagatgatgcgcttgcgcaatataatcgccgcccgcttggagagtgggcaagcgatgctttgtgtttgcctgtctcatcagattctgtgcgacatccttggctttcccgtgatcaccaaggcggttcccttgcaaggcacgcagcaagtgattgatttgttcgggactcagcagcgagtgggtttctacaatacttacgtcggattggctacgcaaacgctcgagcaagtcagggtggcgagcgatgaggaatcgcgcgagatacatgcgttgcaaggcgagcggttcttcagcgtgcaattccatcccgaatcgattcttacacctcacggtttcgagctgacgcggaagatattgagccggctcttgctgacgcgtcagtttgaagacagggaaaggccggttttgatcggcgatgccgttctgtga

SEQ ID NO: 1845 - DNA, 558 bp, Chromobacterium substugae
ttgcgcttgatgggtttagagcatgagcaccggcaaatctcggtatttcgcaatgtggatgagttccgcgccatcaatccggcggtcaaggcgccgacgctgatctgcgatgacggcgaaatgatcatggattcgtcgatgatcattgactatctggaatcacgggtcgacccctcccgcagtttgatgccaaaagactcgaaacaacacagaaaggtgctgtcgctgatcggacttggcctcacggtttgcgaaaaagccgttcaactcgaatatgagcacaacaagcccggcgaatatcaatatgctccttggctaagccgcataaccgaacaattgcatgccgcgctggcgcttctggaagaagccgcggcccaagcaaacccttggcttgccaccgcgcagctgtctcaggccgatgtcaccgtggccgcggcttggcgtttcacccaattcagggtatcccacttggtggatgtccaaacctataccgcgcttgcagcctatgccgaccaagtcgaactgttgcctgagtttgtcgataccccgctaaagtga

SEQ ID NO: 1846 - DNA, 444 bp, Chromobacterium substugae
atggaagtagacgcaaaatcctgggctatcctggccgcgctgcaggacaacgcccgccagtcgctgaccgaactggcgcaggcggtgggcctgtcggtgcccgcggtatcggaaagagtgaagcggctggaagaagccggggtgataggcggctaccacgcccgtgtggcgccgttacgcgccggctacgcgctatcggcatgggtgggcatcaccgtgccgcaaccagacaagaagacgctgctggctcggctggaagcgatgccggaagtgatggaatgccaccacgtcaccggcgtcgactcctacgtgttccgcctgctggcgcgcgacgtcggccacctggagcaactggtgtcccagctcaacgacctgggcgaaacccgcacctccatcatcctgtccacgccgctgcagggccgtccggtgcggccgccgcgctag

SEQ ID NO: 1847 - DNA, 609 bp, Chromobacterium substugae
atgttctggcaggcggctttgataggcttggcgattgcggcgccgatggggccgataggtttgttgtgcgtcagccgcactctgcgcggcgggccgcggctgggcctggccaccggcctgggggcggccagcgccgatggcctgttcgcaatggccggcgtcgccggcagcggcgcggcgctgcatctggccggagcgctggcgcggccgctggcttggggcggctgcctgctgttggcgtggctgggcgtggccacgctcaggcggccggaaagccagccggcggtgcgggaagaaggccgcgtcgggctgcggcgcgcttacgccggcgcgctattgctgacgctgagcaatccgatgaccatcctgtccttcgccgcggtggcggccggcttgtcaggcggcctggccgccagcggcgcgcagcagctggccattgtcgccggggtgttttgcggctccgccgcgtggtggctgatattggcctatggcggcggcgccttgctggcgcggctgggcgcgcgcggccgccgcttgctggacgcaggctgcggtctgctcttgctcggtttcgccgtcttgctggcctggcgcgcggcgggcggctga

SEQ ID NO: 1848 - DNA, 2082 bp, Chromobacterium substugae
atgagtcacgcgcagcaacaatggggacgcctcagtacccgcatcatcctggtggcggccggcgccataacggtcgccttcgccgccatgatcgccctgatcgcccatctcaactacaagtccgccatcgacaccggctaccagctggcctcggagcaggccggcagctacgccaaggacgcggaaaacaccctcagccaaggctttctgctgccgcgccacctggccgacgccgtcgtcggcatcaagcgcggcggcaaggccgaccgcaagcagaccgacaacatcatcctgcagatgctggaccacgcgccgcagtcgataggactgtggatgctgtgggaacccaacgccttcgacggcgacgacaacccctaccggctggattggccgcgccacgaccccaccggccgctaccagccctacatcacccgcaacgcgcaaggcaaggcgcagatggacgtgatgatgtctgctgaccgcatcaaggacttccccaagttcaaggaccatccgcaaacctatcagcccgactatgaaaagccgggctggggcgatttctactacgtgcccaaacagcgcggccgcgacaccatcaccgagccctacccctatgaagtgcagggcaagaaggtgctggaaagctcgctggcggtggtgatgaaggacgatgccggcaagatgctgggcgtttccgccaccgacgtggcgctggaccagctgcagaagtccttcggccagatccgcctgtaccagaccggctacatccgcatcctgtccgaaggcggcgtctacgtggtccacccgcaggcggatcagctgggcaaaaacgtaggcaaggacgacgcgctggccggccatctggccgacatcaagaaaggcgaggatttcgtctacgaagacggcggcttcactcacttcttccaccccatcgcgatcggcgacaccggccagttctggacgctgggcatcagcgtccccaccgccgccctcaccgacggcgcccgccgcgaaatgctcaccgccatcgccatcggcgcggtggcgctggcgctgatcctgctgctgctggccatcgtcatccgcacccagacccgcccgctgcagcacctggccgaaaccatggagcagctggccagcggcggcggcgacctcaccagccgcatcgccatcgccaaccgcgacgaaatcggccgcaccgccagcgccttcaaccgcctgctggacagcctgcgcgacatgttcgtcaatgtgcgcgagcaaagccgccaggtttccgacgccgccgcgcggctcagccactcggccggccaggtgcacgacgcctccgcccagcagtccgacgccgccaccgccagcgccgccagcgtcgaacaggtgacggtgggcgcgcagcacatcgccagcaccgcgcagcaagccggcgacatcgcgcgcgaaaccggcgcgatgaccgagcagagcgtggccaaggtcaaccgcgtcaccagcgagattcagcgcatgaccgacagcatgcacgagctggcggaacggatgagcggcctgggagagcgctccaacgaagtcaccaccattgtcggcgtgatcaaggacatcgccgaccagaccaatctgctggcgctgaacgccgcgatagaagcggcgcgcgccggcgaactgggccgcggcttcgcggtggtggccgacgaggtgcgcaacctggctggccgcaccgccgaggccaccgtccagatcacccgcatcgtcgaggccatcagcagcgaaacccgccaggcggtcggcgacgtgcagcgcagcagccagcaggtggatctgagcgtcggcatcgcagaagaagccaaccaggcgatgcgcgaagtgcagggctacaaccagcagctggtgaccagcatcgtcgacatcgccgccgccacccgcgagcaatccagcgccagcctggaaatcgcgcagaacgtcgagcgcatcagcagcatggcgcagaacaacaaccaggtggtgagcgaggtcagccaggcggtgaagcagctgcgcgagctgtccggcggactggagcaactggtcagccacttcaagctataa

SEQ ID NO: 1849 - DNA, 159 bp, Chromobacterium substugae
ttgttgctgcgcgtgactcatggcgattacctgcgaggctgctggttgattcgagtgctgcacgaaaccggactaatacgtataaattcgtatttaaaacgaatataccggcatcccgcccgcgcaggcaatgacctgcggcagtggcggagcgggtag

SEQ ID NO: 1850 - DNA, 1017 bp, Chromobacterium substugae
atgacgcagcgacaagatccccccgactcccaggaacccgccgccggcgacgcgcccgccgctgcggccaagccgcgccgccagtcggcgcgcagccgcaacgtggcgcgcgcgcacgacgaatcggtgcacatcatccaggaaaccagccagcagccggtggcgctgcaggtggcgctggcgccgcacggcagcgacgaggacagcggcagcgccgagctgccggccagctacccttacagcagccgcatgcgccgcgccgaatacgaaaggctgaaacaggagctgcagatcgagctgttgaaagtgcaaagctgggtcaaggaaagcggacaaaagatcgtgatcctgttcgaaggccgcgacgccgccggcaagggcggcaccatcaagcgctatatggagcacctgaatccgcgcggcgcgcgggtggtggcgctggaaaagcccagcgaccaggaacgcggccaatggtacttccagcgctacatcgcccacctgcccagcgccggcgagatcgtgttcttcgaccgctcctggtacaaccgtgccggggtggagcgggtgatgggcttctgcaacgcccaccagtacctggaattcatgcgccagacgccgcaactggagcggatgctggtcaacagcggcatcaaactgttcaagttctggttttcggtcagccgcgaggagcagctgcgccgcttcatctcgcgccgcgacgacccgctcaagcactggaagctgtcgccgatcgacatccagtcgctggacaagtgggacgactacaccgccgccaagcaggcgatgttcttccacacccacaccggcgacgcgccgtggacggtggtgaagtccgacgacaagaagcgcgcccggctgggctgcatccgccactttctgtcgcggctggactatcccggcaaagacccgcgcgtggcgcgcgcgcccgatccgctgatcgtcggcgagcctggcgacatgtcctatcaggaggaacaggacgtcttgaccttctga

SEQ ID NO: 1851 - DNA, 702 bp, Chromobacterium substugae
atgtggtcagtgcagatgcgccaggtgcgcaagcattaccggctggaccaggtgacggtgccggcgctgcaggatgtcgagctggcggtgagaccggcctgcttcaccgtgctgtccgggccgtcgggcagcggcaagaccacgttgctgaatctgatcggcggggtggaccagcccgacagcggcgaaatcctggtggcggggcaggacatcgcccggctgggcgacgatgcgctcagcgatttccgcgcccgccatatcggcttcattttccagaatttcaatctgctgccggtgctgtcggcgtatgaaaacgtcgagtatccgctgctgctggccaaggtgccggccgccgagcgcaaggcgcgcgcgctggccatgctggacgcggtgggcctggccgacaaagccggcaaccgccccggccagttgtccggcggccagcgccagcgggtggcgatagcgcgcgcgctggcgcaccggccgtcgctggtgctggcggacgagccgaccgccaacctcgacagccagaccggcgccagcatcctggcgctgctgcgcggactgcagcagcaatatcagttgacggtggtgttttcctcgcatgatcctcaggtgatcgccgccgccgacgaccattaccaggtgcgcgacggccgcgtcagccacgcgcccgccatctcccgcaaggagccggcatga

SEQ ID NO: 1852 - DNA, 1377 bp, Chromobacterium substugae
atgaataccctgaaactggcctggcgcaatctgctgcgcaaccgccgccgcacgctggccacgctgggcaccatggtggtgggcgtggtggcgctgctgctgttcggcggctacaaccgcaccgtgcaatacggcctgcaaaccagcttcgtccgcggcggcggccatttgcagatccagcaccgcgactacttcctctacggcaacggcaatccggcggcctacggcatccgcgactaccgccgcgtgatgcgggtggtggagaacgacccggtgctgaagcctatgctgatcgcggcgacgccgacgttatcgttgggcggcatcgccggccattacgccgccggggcctcgcgcaccgtcatcgcccagggcagcgaagtgacggggcagaacctgatgcggcgctgggacgactaccatttcggcgacaagcccaaaaccgtcgccctcaccggcagcgcgccggacgccgcggtgataggcgtgggcgtggcgcgggtgttgcaattgtgcgacgcgctgaaagtgaagggctgcgccgcgccggccaaggctgaaagcggcggcacggcgatgccggcggacctgcaggcgctgtccgacgccgcgccgcaggcggcggccgacaatcgcatcgaactgttggcggctaccgccgccggcgcgcccaatgtggcgcggctgaccgtggtgaaggcgcagagcatgggcgtgaaggagctggatgacatgttcgtcagcatgcatctgtccgccgcgcagcggctggtttacggcggcggcgagccgcgcgtcaccgccatcgcgctgcagctgcaacacacccgccagattccggcggcgcaggcgcggctgcggcagctgttcgccaccagcttgaaggaccagccgctggccgcttacgacttcgccacgctgcagccgcaatacggccagatcaccggcatgttcggcaccatcttcggttttctgtccattttgatcggctgcgtggcgctgttcaccatcgccaacaccatgaatatggtggtgctggagcgcacggtggaaatcggcacgctgcgggcgatgggcctgcgccgcggcgggatccagcggctgttcctgtgcgaaggggtgatgctgggcatgttgggcagcgcggccggcatcgcgctggcattgctgctggcccagctgatcaaccacgccggcttgacttggctgccgccggggcaggtggacccgtctcccattctagtgaggctgtggggcgaaaccggcatgatgctggccaccgcgctgggcctgatgctgatggcgacgatatcggcctggtggccggcgcgtcgcgccgcgcgcgcggtgatcgtggacgccctgcgccacgcctga

SEQ ID NO: 1853 - DNA, 765 bp, Chromobacterium substugae
atgaaaaacatgtggatggcggcgctggccctgctggccgggctggcccaggccgcgccggacgcgcagaccatactggccaacagcgacgcggtgcgcaatccagacaaatccttcggcctgatcgtgtccctggtcagctacaaggacggcaaggagaacgaacgcagcgcgctggcggtgtattcgcgcgccgacccgcgcagcggccagttccgcagcctgctgcgcttcgtcaacccggcgcgcgacgccggcaagttgatgctgaaaaacggcaacgacctgtggttctacgacccggccagcaaggccagcgtgccgatctcgccgcagcagcgcctgttgggccaggcgtccaacggcgatgtggtgacggtgaacctggcgctggactaccaggccgcgctggccggggaggaggacatccaggacggcgaccgccagacgcgccattgctacaagctgcggctgagcgcgcgcaaccccggcgtcacctaccacgcgatagagctgtgggtggacaccgccggctaccgcagccgcaaggcccgttttttcgccgaaagcggcggcctgctgaaaaccgcctattaccgcgcctatcagccggtgctggggcagcagcgccccactgagacggtgatcatagacggcctcaatcccaagtgggtgacggtgctgcgcaacagcgacttcgcctggcgcgaggtgcccgaagcctggctgcagcgcgactacctgccgcgcttccgggcggagtga

SEQ ID NO: 1854 - DNA, 1215 bp, Chromobacterium substugae
atgcggctgagcatgttggcgctggcgggcttgctgtgcggcccggcctgggcggacgacgacgcggcggcgctgcaactggccgatcaggccagcctgccggcggaaaagccgcgcgacctgaagctgctgctggaggcggccgccatcgccagccccggcgggcagcggttgtcggtcgacctgcgctgggacgggcggctgggtccgcagtggcgggcggtgttcgccgaccggctggaccaggatttcgccgactcgccgcagcgcggccacggcgtcaataccttgaaggaggcgtatctcagccatgagttcgacgccgccactatgctggacgccggccggatcaacacccgctacggcgtcggcgtcggctacaacccaaccgactttctgggcgtgggcacggtgcgttcggtggtgtcggccgatcaggccagcctgcgggaaaaccggctgggcaacgccatgctgcgctggcagcggctgtgggacaacgcctcgctgaccgcgatctggtcgcccaaactggccgacggccccagcggccacggcatgagcctggatttcggcgccagcaatccgcgcgagcgggccttgctggcgtacagctaccgcttcagcgaggcgctgaatccgcagtggctgctgctgcaggagcagggccgctcgccgcaactgggcttcaatctgtccagggtgttgggcgatgccaccgtcgcttatgtcgaatgggccggcggccggcaggcgccggactggcggcgatggcagggggaggcggacgacagctggaacaaccggctggccagtggcctgacctggaccggcagcaacaagctgagcctgacgctggagggcgagtacgacggcggcgcgcctgggttggacgattggcggcggctggcgcgcagcccgttttaccgactgtaccggatgcagatggcgacaggcggcgtgttgccggcccggtgcgccgcgctggcgcgcgccagctggcaggacgcgttgctcgataatctcgacctgacggcgatgcgcgccgccagtctggacgaccatagcggcatgaactgggccgaggcgcgctatcatctgggcccggtcgatctggcgctgcagtggcagcgcttcgacggcggcgccttgagccaatacggcgccgggctggccaagccgtcctggcagctggtgttcgattatttccattga

SEQ ID NO: 1855 - DNA, 1023 bp, Chromobacterium substugae
atgaatgcaagccggcgctggtccgacgaagcgcgcgaactggctgtctgcagcgcgatcaacctggccatcggcctgtttttcgccgcgctgggcggctggaagatggtgtatgacaacctgctgatctcgttctgcatcggttactgctgttggctgaccggcaccttgctgggcggctggcttcagctgaaccgcatcgcggtctgcctggcggtgttgctgttcagtgtgccgttcggcttcaagctggcgacgtggctgggcgctttcgatgtgctggcgcgcgctttccgggtgccggagcgcgcctacctgttcttgctgcccaccttcctggtggcgaccggcgcgatgacggtcagcatgctgtactaccgttcgcgggcgctggccggcgaactggaggccacgcggcggcgcgaggcggaaagccgcgccgcgcagaccgcggcccaactggcgatgctgcaggcgcagatcgagccgcatttcctgttcaacacgctggccaatgtgcaaagcctgatcgagctggacccgccgcgcgcgtccgagatgctgcggcacctgaacacctatctgcgcgccagcctggagcgcagccgcaatgccgacggcaccctggggcaggaactggagctggtgtcggctttgctggacatcgccgctatccgcatgggcgcgcggctgcgggtgcggatggaggtggacgacgcgctgaaagccttgccgttgccgccgctcttgttgcagccgctggtggaaaacgcgctgcgccacggcctggagcccagcgtggccggcggcgagctggcggtgttcgcccggcgcgaaagcggcgtgctgcgcctgggcgtcagcgacagcggggtgggcattgccgaattcgcgcccgccggcgtcggcttggccaatatccgcgagcggctggcggcgctgtacggcccggcggcgcaattgcggctgacgccgcgccagcctagcggcgtgctggccgaactgctgttgccgatcgcataa

SEQ ID NO: 1856 - DNA, 723 bp, Chromobacterium substugae
atgcccaccgcgctgatcgccgacgacgaaccgctgctggccgccgcgctgcaaagcgcgctgaaccgcttgtggccgcagttggacattgtcgccatcgcgcaggacggcgcggcggcgctggccgccatcagccggctgcggcccgacttcgccttcctcgacatccgcatgcccggggtggacggcatggcggtggccaggagcgtgtccggctgcaaggtggtgtttgtcaccgcctacgagcagttcgcgctgcaggccttcgaggccgaggcggccggctacctgctcaaaccgctggacgacgccaggctgctgcgctgcatcgcccgcctgcaggccggccatcaggcgccggcccctgctttgccggctgccagggccgaggccgagggctggctcaactggatcaccgccggcctgggcaacagcaagcggctggtctcggtggacgaggtgctgtatttcaaggccagcgacaaatacaccgaactggcgctggccggcgaaagcctgctgatccgcacgccgctgaaggaactggccgcgcggctggacccggagcgcttcgcccagatccaccgcggtctgatcgtgcggctggctgcggtgcggggcatagagcaggacctgctggggcgcagcacggtcttgttgaagcacggcggcggcagcctgccgctcagccgcagcttcgccgccaggttcaaggcgatgtag

SEQ ID NO: 1857 - DNA, 189 bp, Chromobacterium substugae
gtgaaggaactggccgcgcggctggacccggagcgcttcgcccagatccaccgcggtctgatcgtgcggctggctgcggtgcggggcatagagcaggacctgctggggcgcagcacggtcttgttgaagcacggcggcggcagcctgccgctcagccgcagcttcgccgccaggttcaaggcgatgtag

SEQ ID NO: 1858 - DNA, 288 bp, Chromobacterium substugae
ttgtcctgccgcggcgtgttccgctatggcgaccaggtttgcgaagtcggccccggcgactgcctgtgctgtccggccggcaccggcgtagcccaccaattggccaatcccttcgacgaagatctggtctacctcggcgtcggcgccaaccatccgcacgaggtctgcttctacccggacagcggcaagacgctggtgcgcagcctgcatcgggtcggctatctgcatgaggcgccgcatatggacggcgagccggagcggccgaaaatcttcgaactgctgaaatag

SEQ ID NO: 1859 - DNA, 1668 bp, Chromobacterium substugae
atggccagtcccgcgttccgtccccgcctgctcgacagtctgaagcactacaacagccagttgctgcgcgccgacctgatggccggcgtcacggtgggcatcgtggcgctgcccttggcgatggccttcgccatcgccagcggagtgacgccgcaggccggcatctgcaccgccgtcatcgccggcttgctggcggccgcgctgggaggcacccggctgtgcgtgaccgggcccaccggcgccttcatcgtcatcctgtacggcatcgtcagcaaatacggcgtggccaatctgctggtgtgcactttcatggccggggcgatgctggtgctgatgggcgtattccgcctggggcaggtgatacggtttttcccgatgccgctgatcaccggcttcaccaacggcatcgcggtgctgatcttcctcacccagatgaaggatttcttcggcttgcccatcgccaggatgccgtcgggtttcttcaacgtggtgctggcgctgcgcgggcatttctccgcgctgcactggcccaccaccttgctgtccgccgcgctgctggccttgatcctggcgtggccgaagcggttgaaccgcatattgccgtcgcccttcgccgcgctggtgctggcgaccgcggcgactgcggctttcggactgccggtggccacgctgggcagccgcttcggcggcattccgcaaggactgccggcctttgccggactcgatctcagccccgcccacctgtccgacttgatggcgccggccttcaccatcgccttgctgggggcgatagagtcgctattgtgcgcggtggtggtggacagcctcaccgccgaccgccacgacgcaaaccaggagctgatagggcagggcatcgccaatatggtggtgccgtttttcggcggcatcccggccaccggggcggtggtgcgctcggtgaccaatatcggcaacggcgcgcgcacgccgctggccgccatctttcacgccttgctgttgctggcggtgctgctgctggccgcgccgctggccgcccacgtgccgctggcggcgctggcggcgattctggtggcggtggcgctgaaaatgggcgactgggacatccgcaaggcctggcggtttccgcgccacgataccgcggtgctgatcctcaccttcgtcctgaccgtgattttcgatctgacggtggcggtggaaatcggtctgctgctggcggcggtgtttttcattcgcagcatggccagccatacctcgatcaagcagttgaagccggagtacgcgcagctgttcgagcgccataccatcgccggcaaggtcgtgccggacggctgcgccgctttccgtgtggagggcgcgttgttcttcggcgcggccgacgcggtggatgtggtgctgaagcaggcgccgcacgagcgggtggtcatcctgcagctgcatcggctggtgttgctggacgccagcggcctgctggcgctggacgcgctgcgggagcggctggcggagcaaggcaaaaccttgatcctgtgcggcgcggcggacgaagtgatggacatgctggtggggtcgaggctggcggagcggctgggcgcggacaatctgcagcccgacctggtgtgcgcgctggcgcgggcggagcggcaattgacggatggcgtggtgtggggctga

SEQ ID NO: 1860 - DNA, 756 bp, Chromobacterium substugae
atggccgccatcatccgctccacccgagtcatgcccgccaaactggacgccgcgcagaaagagcagctggccgcggaactgttccaggtgcacgacgccatcttctccggcaccgactaccccaccttcaagggactggtgttttcgccgccggccgagcacagctgcctgctgctgcaccgcgacgagaaccagcgcctggttggctactgcgcgatgcaccgcttccgccgccagataggccgccgcgcctgcagcgtgctgcgcgtccaatccggcctgttcaaggaataccgcggcaagaacagcaatttcgccttcatggtgcgccaggtgctgctccattggctgagccacccgctgcggccgatgtatttcttcggcgtgatgctgcacccgtccagctatgccgtgctgcacaaattcgcccacaagctgtggccggcgcccggccaggacgagcgccacccgctggcggccaaggcctacgagctgttctccagcttccaactgacgccggtgtcgccggaccgccccttcatcgccaacctgggcatcctcacccgcgacagcaaggacgaccaccagttctggcaaagctccagcaagccgtccacccgcttcttcctcagcatgaaccccggctacagccagggcgatggcctgatggcgctggtgccgctgtcgccggtttcggtggcgcatgcgctgtaccgctggctgcgcctgcgccgggaaaaaagcgccgggaagtga

SEQ ID NO: 1861 - DNA, 927 bp, Chromobacterium substugae
atgatcctggtccacacgcccaacccgaaggaagtcgccgcctatctggagctgttccgcgccgccatgccggaacagcgcttcggcagcctggccgacatccagcccgacaccgtccgctacctgatcgcctggggcatcccggacggcctgatcgccagcctgcccaagctggaggccctcttcgcgctgggcgccggggtcgacaagctgctgagccggcccgacctgccggaaagcctgccggtgtaccggctgctggacggcggcatggcggcccagatgatcgaatacatccgctacggcgtgctgggctatcagcgcaatatggacatctaccgccgccagcaggccgccggacaatggcggatgctggcgcccaagccgccggaagacgtgcatgtcgggattttgggcctgggcgagatcggcgccgccgtcgccaaggcgctggcgcacgacggctatatggtgagcggctggagccgcaatcccaagcacatccatggcgtgcacagcctgcatggcgaaagcgggctggagaaactgctggaaaccagccaggtggtcgcctgcgtgctgccatccacgccgcagacccagggcctgctgaacggcgagcggctgtcgttgatgccggccggctcgatgctgatcaacgccggccgcggcgacctattggaccaggacgcgttgctggcgctgctcgacaacggccatctgcgctgcgcgcagctggatgtgttcgccgaggagccgttgccggccggccatccgctctggcgccatccggccgtcgcgatcacgccgcacatcgccgccatcacgctgcgccaggaagcggtggagcagatagtcggcaagctgcagcaactggcgcgcggcgtcgaagccgacggcctcgtgcagcgccagcaaggttattga

SEQ ID NO: 1862 - DNA, 771 bp, Chromobacterium substugae
atgcatttcatcttcgacatagacggcaccctctgcttcgacggcgccaacatcagccccgccatccaggacgccttgtccgaactggaagggcaaggccattcgataggcttcgcctccgcccgcccttaccgcgacatgctccatttgctggacgagcgcttccaccacggcttgttcgtcggctccaacggcgcgatgacctggcatggcggcgcgctggccgacatcgccccgctggccgcagacaccctgcaacaactgttagacctggcggagcgccactcggcctcctacctggttgacctggcctggcattaccattaccagggcgagcccggccatcccttcatgacgctggtggacccgcagcggcgcgcccgccaggtggcgcgcgacgaaatccaccagccagtgaagctgctggtgaccgaatgcgccgacagcgacgccttgcagcaggcgctgcgcggccgcgacgatatccacatccatcaccattccgaccagcagatcgtcgacatcaccgccgccggcgtcgacaagatgagcgcgctgagccggcatggcatcgccgccgaacagctggtctgcttcggcaacgatagcaacgacctgccgatgttccgcgccgcccggcattcggtgttgatcggcgcccacccgcagctgctgccgcatgccagcgagcggctggcgcgcggcgacgatgtcgaaaccctgctgatcggcaccatgcgccggctgggcgaacgctacgcggcgcgctag

SEQ ID NO: 1863 - DNA, 1581 bp, Chromobacterium substugae
atggcggtaaacggcgggtttcccatcgctttgcggccgcagtcggctttcgccgcggtaagggtggcggcgcctgcgggtgcgccatccaatcccagcggcgcggcgccgctgctggacatcaaggggctggaggtggggacgccagaatcgcgttatggcttcagcatgcaaaccctgcagctgctgaagcagtacgacgtgcgcgatatgtcgggcaaggatctggacgcgctgagcgaactgatgctggcgcgtggcgagatggatggcgatgtcagcggcaccatccgcagcgacatccagggccatggctggaaaaccgccggcagcagcaatgcgctggaaatcttctcggcgcgccgcgacgagaccatggccagcgtcaaggcgggagaagtctcgctgaagcttgccgatttcgacctgaaaggcaatgcgcgggtgacggaggcgctgaacaagctggcgggcatccacgatgccttgcaacacgacgacagcgtgacggcggccgccgagggaggcatgagccaggcggcggacatccagcgcttcgacagctggctgcggcaaaccacgcgctggcgggagttgggcgaggccgagccgcagcccgatgcggagaccatcgacgcggtggggcgcgttttgcagcggctgggcatcagcttggcgggcgagggcaatagtgccgagcggatggcccaagcctggcaagcctatcagggctggcaggcgcagcacccgggcgagcagccgcggatggatttgcagccgccggcggaaacgcccgccgagccgcctcgtgccgcaccggcggctgccgcggtggcttcgacgccggcggcggctgcgaagcccgccagggaagcggcgccgcgcttcctgctggaggcgcagtacgggatgagtttgccgatgctgcaggtgctgaagagtttcgatgtcgccaatgcctcggtggagcaggtcaagcaactgggccggttgttgcaggacaatggcgaactgtcgcaggacgacgccgattcgctgctgccgcttacccagcgcgggacggcggattcgatgaattattaccggcgcgacctgcgctggctggccgattcgcaacagcatggcgagacgcctcagtaccgcactccacaaggcttggtcgacttggcgagcccggccggccgcgcccgcaacgatcagcaggcgcaggcggtgctggaccgcttggccgctttgcaccaggccttgcagggagacgacagggtgcaggaggctgtggacggcggcttgcagcagggcagcgacctggcggcgttcaacgcctgggcgcaggcggagggcaagggcgcgcgcagcggcgacgacgcgcagccggcgttccgcaaccggcaggacgtggacggcatcttccgcacgctgcagcgcttgggcgtggagctgacgccgcaagatggcgccgtttcgcccggccagcggctggaacaggcgtggaaggactaccagggctggcgcgccagccacccggacgcgcagccggggctgaggctggcgccggccagacgcatcaacgattacgcctga

SEQ ID NO: 1864 - DNA, 1200 bp, Chromobacterium substugae
atgataggcgcggacatgcggtatctattgggcgagcgcagtttgcgctcgctgagcgcgctgccgggccgccgcgccgccgccggcatcctggccagcgatgtcgaaggcccgctgttcttgggcgatttcatcgccgaagcgctgtcggcccgggttcggccgcgccactatgcggtggatgccacgccatcctacggccatctcctgtaccaggaaggctacgcggccttcagcgaagccaccgcgggactgcgtcggccccattgccgcaacggctgcgcccaggaggggaccgacaccattttcgccctgcctatgctgctggcctgcggcgcggacgccggctatctcgacttgctggcccgccgcagcgcgccgacgccgggggccgcccggatgctggctgagctggacaggatgggcatgatggcggtgggcatcaccaccgcgccgcaacaaccctaccgcaatctggtcgccgcgagcggcctgctgccgcgggagcgcatcctgggctcgccgtttccgctgaacgaggccgcggagctgctgcgcggccaccggcgctgggatgaggaaatcggcgcggtgaaccgctatctggacgacgctttcgccatcatcgacggctattcggagatttaccgcggcgtggatggccagatacgccgtctgtcggactgcggccggcagctgctgcaagcgcgcttcatccggcattgtcgcgatgagctgggcatcagccatgacccggcgacgcggcgccgccggacggcgcccaccctgctgggcgagatcatcgaggcctgcgcgatgatgggcgaccgctcgaaagcggcgacggcccttaacctggggcgctcgctgcgcggcggccagccgctggtggcgatgggagatggcggcaacgatgccgagatgctgcggcgggttccgttgtcgataggcgtgaacggcccggaagccgccagcgcggccaagataggcgtggtgaccgccgacatggcctgcgtgctgcccatcctgcggcagatgttgctgggcgagcgggatatcgacgccatcatcgtccgggcgcaggccgaggtcggcgacgccgctttgatccaccgcggcggcggccgcctggcgccggcgctgttggcgcggcaccgggagatgaaacggcagctgcgcggagccttcgtcactttctga

SEQ ID NO: 1865 - DNA, 822 bp, Chromobacterium substugae
ttgctgctgggcgtgttgtcgggcttgttgtccatggtctgcgtgcagttgggatcggcctggtcggtgccggcgatgcgggagcaaggcccgtacgcgctgacctggctgcggctgtgctgcgcggccttggcgctgctggcttgggcgcgcccgccgctatggcgtttgctgcgcgctcatggcggccaactggcggccttgggcgcggcgatggccggcatgatgctgtgttttttcgccgccatccgcagcatgccgctgggcctgacggtggcgatcaactttctcggccccttgctggtggctttggccggcgcgggccgccggttggcgctggcatggccgccgctggctttcttgggcgtgggattgctggcctggcatggcgggcagtggcagggcgatgccgccgggttggcgttcgcctgcggcgcggcggtctgctggggggcttacatcttgctgatgaagcgggtggggcggctgggcggcgggctggatgggctggcggcctccatgctgatggccgccttatggtgcgcgcctttcggcttggccggcctgcatggccgcccactgccggatttgccgcaaacggcggttttggcattgttgacgcccctgctgccttatgtgttggaaatgctggcgttgcgacggatgccggcggcgtcgttcggcatcttggccagcctggagccggccatcgccgtgctggcgggctggttgctgttggcgcagccggtcgcgccggcgcagctgctgggcgtggctatggtggtcggcgccagcctgggctcgctgctgacggcgcgatga

SEQ ID NO: 1866 - DNA, 1347 bp, Chromobacterium substugae
atggccgccaccctgaaactgtcgcaactgatcagcgcgctgagctacgcgctggacatcaccgaaggccagccggaagggcattgcctgcgcagttgctggataggcatgcacataggccgcgccatcggcctggaagaacaagcgctgtgggaactgtactacaccatcctgctgaaagacctgggctgcagcagcaatgccgcccgcatcagcgagctgtacctggccgacgaccgccgcttcaaacaggctttcaaacaggtgggcgccagcctgccgcaaatgctgaacttcgtcttcagccagaccggcacccatgccgacggctggcgccggcgcgccgcctccatcttcaatgtgctgctgcgcggcaaggaaatggccgacgaactgatcaacacccgctgtcaccgcggcgccgacatcgcgcggcaattgcgcttcaacgagggggtggcgatgggcatccagtgcctggacgagcactgggacggctccggccggccgcgcggcctgcagggagacggcattccgttgaacgcgcgcatcgcgctgctgtcgcaggtgaccgacgtgctgcacgccacccatggccgcgccgcggcgctggacgaggccacaggccgcgccggcggctggttcgaccccgaactggcgcgggcgctggccggcatcggccgggacgaagccttctggcgccagttggaggcggacgacgtcgagcaggcggtgctggcgttggagccctcgcaatgtgaagtgccgctggacgaagactacctagatgaaatcgccgaaggcttcggcctggtggtggactccaaaagcccgttcaccgccggccacagcctgcgcgtcggccattacgccgaccgcatcgccgaacggatgggcgtggcgccggaacgccggcgctggctgaaacgcggcgcgctgctgcacgacgtcggcaagctgggcgtgagcaacaccattctggacaagcccggcaagctgacgccggaggaatgggaggccgtgaaacgccacgccggctacaccgaagccattctcagccggatagactctttcggggagttggccttgatggcgggcgcccatcacgagcggctggacggtggcggctatccgcgcgggctgaaggccgacgccatcgcgctggaaacccgcgtcatcaccaccgcggacatcttcgacgccatcaacgccgaacgcccctaccaccccgccacgccgatagcggaaaccctggacatcatgcgccgcagcctgggcagcgccatcgatcccgcctgtttttcggcgctggagcaggtgctgcgcctcgaaggcgtcgcggcgtaa

SEQ ID NO: 1867 - DNA, 507 bp, Chromobacterium substugae
atgtctgccgccatcaccctggattttctcaccgatcacgatttcgacaccgtcgcggcgctgggcgccgaaatctggcgcaagcatttcatcatgatgatcacgcgggaacagatcgattacatggtttccagccgctacacgccggaaaagctgagccgctacctggacgcgcccgaccgctggttccgcctgctgcgggtgggtggccgtccatccggctattgcagctacgcgctgagcggccggcccggcgaaatgaagctggagcagctgtatctattggaagagatgcggggaagagggttgggcggcaggatgatggacgaagcggaagccgcggccggcactcagggctgcgccacgctgatgctgactgtcaaccggcacaatgccgacgccatcgccgtgtatgaaaagcgcggtttcactgtgcgggaagaggtggtggccgatatcggtaatggatttgtgatggatgactatgtgatggttaaaaatttataa

SEQ ID NO: 1868 - DNA, 1626 bp, Chromobacterium substugae
atgggcggctttttgccgcgcccggccctggccatgacggcggacgcggcatcgcaaagaaaaattcaagagcccggcggcgcgaaattaagatatcgtcatgccatgcgcagccgccgccagccgacagcacaccacaaggattccgccatgatccgcatcgccttcgaccacagctacgcccgcgacctgcccggcgcttacgagcccgcgctgcccgacgcgccgcccgcgccggcgctgctgtactggaacgcgccactggcggccgagctggggctggacgccgccgacgccagcgcggcggagctggccgcggccttctccggcgcggcgctgcccgccggcgcgcaagccatcgcccaggcttacgccggccaccagttcggcggcctgtcgccgtcgctgggcgatggccgcgccatgctgctgggcgaagtcatcgaccacaacggccaacgccgcgacatcgccctcaaaggcagcggccgcaccgcgttttcccgccgcggcgatggcaaggcggccgtcgggccgatgctgcgcgaactgatcatcggcgaggcgatgcaggcgctgggcattcccaccacccgcgcgctggcagtggccgccaccggcgaaaccgtgcaccgcgagcggccgctgcccggcgcggtgctcacccgcgtcgccgccagccatctgcgcgtcggcaccttccagtacttcgccatccgcggcgaaaccgacatgctgcgcaagctggccgactacgccatcgcccgccactacccggagctggccggccgggacgaccgctacctggcgctgctggccgccgcggccgagcgccaggcggcgctgatcgcccgctggatgcacgccggcttcatccacggcgtgatgaacaccgacaatatggcgctgtccggcgaaaccatagactacggcccctgcgccttcatggacgcgcaccacccggacaccgtgttcagctccatcgaccgcaacggccgctacgcctacggcaaccagccggcgatcgcgcagtggaatctggcccgcttcgccgaaaccctgctgccgctgatttcgccggccgacccgggcggcgcggtgccggccgcgaccgagatcatcgaaggcttcgccaaccgctatcaatccatctggctggaacaggcgcgccgcaagctgggcttgccggacgcgcaaaatggcgacctggctttgattgaggactggctgacgctgctggccgcccaaggcgtggaccacacgctggcctggcgctacctggccgacgccgccgaaggacagcgcgcgccgctcgccgcgctgttccccgccccgcaggaactggagccgtggctgctgcagtggctgacccgcctcgccatcaagacccgccgcgccagcgacgtggcggcggcgatgcgcaagcaaaacccgctctacatcccgcgcaaccatctggtggaagaagcgctggacgccgccagcgaacgcggcgacatggagccggcactgcggctgctggaagtgctgcgcgacccgttcaccgaacgcgaaggcctgatgcgctacgcgctgccagccgcgccggaggtcgcggagggatatcggacgttttgcggaacgtag

SEQ ID NO: 1869 - DNA, 2259 bp, Chromobacterium substugae
atgactactccgcaagccgccgccaaaccaatcgattcctaccgcaagtactgggccagccgtttcggcaccgccccgttcctgccgatgacccgcgccgaaatggaccagctgggttgggactcctgtgacatcatcctggtcacgggcgactgttacatcgaccaccccagcttcggcatggcgttggtgggccgcctgctggaggcgcaaggcttccgcgtcggcatcatcgcccagccggactggcacagcgccgacgcgttccgcgaactgggcaaaccgaacctgttcttcggcgtcaccgccggcaatatggattcgatgatcaaccgctacaccgccgaccgccgcgcccgctccgacgacgcctacacgccgaacgccgagcccaacaagcgcccggaccgcgcggtcaccgtctacgcccagcgctgccgcgaggcttaccccggcatcggcgtgatgataggcagcatcgaggccagcttgcgccgcatcgcccacttcgactactggagcgacaaggtgcgcccgtcggtgctggtcaactccaaggccgacatcctgctgtacggcaacgccgagcgcgcgctggtggaaatctcccaccgcgccgccaagggcgagaagctgtccgagatgcgcgacatccgcggcaccgccttcatcgtgccgcacggctggcggccggacgacgaatggcaggagatggactccagcgtggtggacgtgccgggccgcgtcgacccgcacctgaacccgtaccaagagataccggagcaggcagccgaggccaccaaggacatcgatccgtccaaaccgcaggtgatccgcatcgaatcgcgcgaggagcgcctggccaagcgccgcgccgaacgcgccaagaccgtgatccgcatcccggcctacgaggccgtcgcccacgacccggtgctgtacgcccacgccagccgcaccctgcatctggaatccaaccccggcaacgcccgcgcgctggtgcagatgcatggcgagcgcgacgtatggctgacgccgccgccgattccgctcaccaccgaggaaatggacttcgtctacggcctgccctacgcccgcaacccgcacccggcctacggcgacgcccacatcccggcctgggaaatgatcaagtactcggtcaacatcatgcgcggctgcttcggcggctgtactttctgctccatcaccgagcacgaaggccgcatcatccagagccgctcggaagaatcgatcctgcacgagatcgaggagatccgcgacaagaccccgggcttcaccggccacatctccgacctgggcggcccgaccgcgaacatgtaccgcctcagctgcaaggacccaaagatcgaatcgtcctgtagaaagctctcgtgcgtgttcccggacatctgcgaaaacctcaacaccgaccacagccacctgatccagctgtatcgcaaggcgcgcgcgctgccgggagtgaagaagatcaacatccagtccggcttgcgctacgacctggccgtgcgctcgcccgaatacatcaaggagctggtgcagcaccacgtcggcggttatctgaagatcgcgccggaacacaccgaggacggcccgctgtccaagatgatgaagccgggcatgggcgcttacgacaagttcaaggaactgttcgagcgcttcagccgccaggccggcaaggaacagtacctgatcccctacttcatcgccgcccacccgggcaccagcgacgaggacatgatgaatctggcgctgtggctgaagaagaacaacttccgcctggaccaggtgcaaaccttcaccccgacgccgatggcgatggccaccaccatgtggcacacccgccgcaatccgctgaagcgcctgagccgcagctcggaaaaggtggacgtggtgcgcgacggctaccgccgcaagctgcacaaggccttcctgcgctatcaccatccggacaactggcagatcctccacgacgcgctgatccagatgggccgcagcgatctgatcggccacagcaagcactgcctgatcccgccgaccccgccgggcgacaaggccgccgcggtgcgccaccgcatgggcgcgccggccgcgcgcggcaaggcgccgggacagcgcgcggcgggcaacgccccgcagcgcggcaagccggccgtcggcgccaggccgcaatcgggcaagcccgcaaccgccaagagcggcggcggcaagcctggcggcaaaaccagccgcagccgctaa

SEQ ID NO: 1870 - DNA, 852 bp, Chromobacterium substugae
atgggcgagcgtatcgtgagcgtggcggcgggggagcgcgatctggtgcggaaactggaggcgggcgccgtgctgcatgtgccagacttcggcttcaccttgagcccggccgaacaggcgctgctcaatccggcgctgtccgatcccaagcgcaagaacatcagcctggagccgaacaacggcgcgctgcacggcgtgctgggcggcgacgagacccaggcggcggtgcgcgcgctgatctcgcgctatcagcaagcggcggccggcctgctggcccgcgtgctgccggaatatcaaggcaagacgcgcgccgcccctaccagcctgcgcctggtgcgggtggaagaccgcaagacctcctggcgcaaggacgacagccgcctgcacgtggatgccttcccgtcgcggcccacctacggcgagcgcatcctgcgtgtgttctgcaacgtcaacccggccggcgagccgcgggtatggcgggttggcgagccgttcgaggacatggcgaagaagatgctgccgcgggtgcccgcgcaatggcccggctcggccgccctgctggcggcgctgaaaatcaccaagcgcaagcgcagcggctacgaccacatcatgctgcatctgcacgacgcgatgaaggctgacctggaataccagcgcagctgcccgcaggaaaccgtgcccttcgcgcccggcggcgcctggatctgcttctccgatcacgcttctcacgcggtgatgtcaggccagttcatgctggagcaaaccttgtggctgccgctggacaagatggacgacccggccaagtcgccgctgcggcaactggagcgcatcgtgggccgggcgctggcgtga

SEQ ID NO: 1871 - DNA, 162 bp, Chromobacterium substugae
atgtccatcaaggacgtcgacgcctctcacaatgagaacctgcgaatcaatctttacgcaaatggcatcgacaataacggcttcaacgccaatttcgaaacctggtccgactccgccatatacagtctcgtcgcctccttcgtcgtagtgggagacgcttaa

SEQ ID NO: 1872 - DNA, 1686 bp, Chromobacterium substugae
atgagcacggaaaacaacgcgccggttgtcaacaacttcatccgaaccatcatcgaccaggacctcgcgtcgggcaagcacagcagcatcgtcacccgctttccgccggagcccaacggattcgcccatatcggccacgccaaggccatctgcatcaacttcggcctggccgaagactacaagggcaagtgcaatctgcgcatggacgacaccaacccggagaaagagtcgccggagtatgtgcaatcgttcatcgacgatatcagctggatgggcttcaagtgggatggcgacgtgcgcttcgcgtccgactatttcgatcgcctgtacggctacgcggtggagctgatccaggccggcaaggcctatgtggacgacctgtccgccgaggaaatgcgccagtaccgcggcagcctgaccgaaccgggcaagaacagcccctaccgcgaccgcagcgtcgaagagaatctggacctgttcgcccgcatgaagaacggcgagtttccggacggcagcaagacgctgcgtctgaagatagacatggcctccggcaacatcaatctgcgcgatccggccatctaccgcatccgccgcgtgcatcaccaccgcaccggcgacaagtggtgcatctatccgatgtacgactacacccactgcatctccgacgccatcgaaggcatcacccactcgctgtgcacgctggaattcgaagaccaccgcccgctgtacgactgggtgctggacaatatcagcatcggctgccacccgcgccagtatgaatcgtcgcggctggagctgctgtacacgctgacctccaagcgcaagctgctggcattggtcaacgaaggcgtggtgaccggctgggacgacccgcgcatgcccaccatcgccggcatgcgccgccgcggctacagcccggagggcatcaggctgttcgcccagcgcatcggcgtgtccaagggcgagaacatcatcgacatgagcgtgctggaaggcgcggtgcgcgagacgctggaaaacgaatcgccgcgcgtgatggcggtggtgaagccgctgaaggtgacgctgaccaattacgacgccgccgtcaccgccagccgcagcgcgccgttccacccgcaccatccggaattcggcgagcgcgaagtgccgatctcccgcgagatctggatcgagcaggacgacttcgcggaagtgccgccgccgaagtggcagcgcctgaccgccggcggagaagtgcgtctgcgctattcctacgtgatcaagtgcgaggaagtggtgaaagacgccgccggcaacgtggtggagctgaagtgctccatcgaccacgacacgttgggcaagaatccggaaggccgcaaggtcaagggcgtgatccactgggtgtcggccgagcacgcgatccaggccgatgtgcgctggtacgaccgcctgttcaccgagccgcgtccggacgcggtgcgcggtgaagatggcgagtacgtcgacttccgccagttcatcaacccggaatcgctgacgctggtgccggcctatgtcgaagcctcggtgctgcaggccgcgccggaatcgcgtttccagttcgagcgcctgggttacttcgtcaccgaccgcaaggagcaccagccgggcgtcaaggcggtgttcaaccgcaccgtcggcctgaaggacagctggagcaaataa

SEQ ID NO: 1873 - DNA, 1647 bp, Chromobacterium substugae
atgcgtgtttcgcccggatccatcctgctttccctgctggccgccggcctgttgtccgcttgcgcggcggcgccaggcaaaggcggctacgtcgccggcaagacctacaagatcaccatcctgcacaccaacgaccatcacggccgtttctggcccaatgccgacggcgagtacggcttggccgcgcagaagacggtggtcgaccaagtgcgcgccgaagtgaaggcggagggcggctacacgctgctgctgtccggcggcgacgtcaacaccggcgtgcccgaatccgacctgcaggacgccgaacccgatttccgcgcgatggaccgcatcggctacgacgcgatggcggtgggcaatcacgaattcgacaaaccgctgccggtgctgatgaaacagcgcggctggatacattttccgatgctgtccgccaacatttatcaggatggcaagcggatgttcgatccttacgccatgttcaatctgggcggcgtcaaggtggcggtgctgggcctgaccaccgacgataccgccaagatggtcaatccggcgcagatccggggcatagagttcaagagcccgatcgccgaagccggccaactggtgccggcattgcgcaagcaggccgacatcgtcatcgccgccacccacatgggccactacgccgacggcaaacatggcgtgaatgcgccgggcgacgtggaaatggcgcgcgcggtgaaggggctggacctgatcgtcggcggccacagccagaacccggtgtgcatgaaggccgaaaacgtccgcgacgacgcttacatgccgggcgccccctgcgcgcccgatcgccagaacggcgcctggatcgtgcaggcgcacgagtggggcaaatacgtcggacgcgccgatttcgaattccataacggcaacctcaagctggtgaagtatcggctgatcccggtcaacttgaaaaagacaatggtcgacgcggacggcaaggcgcagaaaacgctgtatgaggcgcgaattccggaagacggcaaattgcgcagtttcctgaagaactaccaggatcgggggcagaccgaattggatgtcaaggtgggcgagctatccgccaggctggagggcgaccgcgccgcggtgcgcagccggcccaccagcctgggcgtgctcgtcggccgggcgatgatggccaagacccacgcagacttcgcggtgctcaactcgggcggcatccgcgactcgctgccggcgggcgcggtcagctatcgggatgtgctcaaggtgtttccgttcggcagcaccgtagcttatgtggacctgccgggcagcgaggcgctgggctatctgcgggccgcggcgaagatgacgcccggcgccggcgccttcgcgcagtttgccggcgtgaagctgcgcatcgtgggcggcgagctgcgggaggcgaaggtggccggagcggccatcgatccggccaggacctaccgcgtggcgatcaacagcttcatggcggcgggcggcgacggctacccgaagatggccgggcatcccggctatgtgaataccggatttgtcgatgccgagatgctgaaggcttatctcgccagccatgcgccggtgcaggctggggcttatgcgccatcgggcgatgtgacgcgcgaatag

SEQ ID NO: 1874 - DNA, 345 bp, Chromobacterium substugae
atggctcagcaaggcgtattcactcttccggcgcgcatcaatttcggcgccactgtattgaccaatgccgccaatgtgcagaatgtcgccattctggtcgacaacgaagtccgcgccaccttcagcggcagcggcatcaccgacaagaacctgggcactcaggtggtcaactccggcaccggcaacgtccgggtgacggtgactgtcaacggcaaggcttccgacctggtgtccacccaggtgatcctggccaacaaggtgaatctggccttgctgggttcggaagacggcaccgatgccgactacaacgacgccatcgtcctgttgaactggccgctgggctaa

SEQ ID NO: 1875 - DNA, 1356 bp, Chromobacterium substugae
ttgccgccggtcaaggaatcccgttttgccgcggatgcgcggcttgaggcggctttcccgcaagtggtatgttggtggtgtcagcggcgccgctatgcctgcgccgccttgtccgtccactcattccaggttgcgatcatgtccaagctccgagccgtatatctgcaatccggcggccccaccgccgtgttgaacgcttccgcccagggggcgatagagacggcgcgccgcctcggtctgtcgctctatgccgctttcgacggcctggcgggcctgctggacggccggttgtgcgatacggacggcgtgcccgataccgccatcgcccagctggccttcatgcctggcggcagcttcggcgtcagccgccgcatgataggcacattcgaagaggcgccggaagattggctgcggctgcgcgatgtcttggccaggcatgatatccattacctgctgatcaacggcggcaacggctcgctcggctgcgccgagcgtctggtcgatttcgaaaagcacaccggctacaagctgggcgtgatcggcgtgcccaaaaccatagataacgacctgatgggcaccgacaacagtccgggttacggctcatcggccaaattcctggccagcgcgatgcgcgaggtggggctggacatgaccagcatgggctgggggcgggtgttcatcatggaaaccatgggccgccacaccggctggctggcggccgcttgcgccgctgccgcgcgcgcgccgaacgaggcgccgcacttgctgctgctgcccgaggtgccgttcgagccggcgcggtttcttgcggcgctggacgccagcctggccaagtacgggcaatgcgcgatcgcggtggccgaaggcatcaccggtcaggacggccgcttcgtcgccgaagccaagcagtcggaaacctacggccatgagcagttgggcggcgccggccattggctggcgcagctgatcctgcgcgagcgcggcatttccgcccatgtcgcccaggtcgactacctgcagcgcgccggcggccacctggcttcgaataccgacgtgcgccaggcttatctgatgggcgagcgggcggtggagtggctgctggccggcaaaaccgggttgatggccggcattcggcgcttgaacgaccacccctattgctgggacgtggccgaggtgccgctgtccgaggtcggggacaaggaaaagcgcctgccgccggcgttcatcggcgccgacggtttcagcgtgaccccggcttttctggactatgtgaaaccgttgatggagggcgagcgcattccgcctttcaaggacggcttgccggattaccggccgatagcctggccaaaagtttga

SEQ ID NO: 1876 - DNA, 1380 bp, Chromobacterium substugae
ttgatcatgctgagcttgtacaacacactgacccgccagaaggaagcgttcaaacccatcgaacccggcaaagtgagcatgtacgtctgcggcatgaccgtttacgacctctgtcacatcggccacgcgcgtatgctggccgccttcgacgtgatctaccgctggctgaaggcctccggctatgaagtcgactacgtgcgcaacatcaccgacatcgaagacaagatcatcaagcgcgcgctggagcgcggcatcacgccggagcagctggtggaggagaccatcgccgacatgcaccaggacgccgccgcgctgggcctgctgccgccgacgcacgagccgcgcgccacccaccacgtgggcggcatgatagcgctgatcgaacagctgatcgccaacggcaaggcctatccggccgccaacggcgatgtctactacgcggtgcgcgaattcgaaggctacggcaagttgtcgggccgcacgctggacaagctgcgcgccggcgagcgggtggaagtggacccgaacaagcgcgatccgctggatttcgtgctgtggaaggccgccaagccgggcgagccgtcctgggacagcccgtggggcaagggccgtccgggctggcatatcgagtgctcggtgatgagctgccaccatctgggcgagcatttcgacatccacggcggcggcgaggacctgcagttcccgcaccatgagaacgaaatcgcccagtccgagggcgcgcacggccatcagtatgtcaactactggctgcacaacggcttcatcaatgtcgacggcgagaaaatgtccaagagcctgggcaacttcttcaccatccgcgatgtgctgcagcatttcgatggcgaagtgattcgtttcttcatcgtgcgcagccactaccgcagcccggtcaactacaccgatggcatcctcaacgacgccaagcacggcctgacccgcctgtacacggcgctgcgcggcatcgaactgccggccgccagcggcatagactggaacaatgcctacgccgcgcgcttcaagaaggcgatggacgacgatttcaattcatccgaggcggtggcggtgctgttcgagctggccggcgaggtgaacaagagccacgatccgcaacaagcgcgcttgttgaaggatctggccggcgtgctgggcttgctcggccgcgacccggaagccttcctgaaaggcggagtgggcgagggcgagctgtcggccgaacaggtggaagcgctgatccaggcgcgcaaagatgcgcgcgccgccaagaactgggccgagtccgaccgcatccgcgacgagttgaccgccaagggcatcgtgctggaagacggcgcggccggcaccagctggcgccgcgcctga

SEQ ID NO: 1877 - DNA, 216 bp, Chromobacterium substugae
atgaaaaccgatattcacccgaattacaaagaactgtccgttacctgctcctgcggcagccagttcgtgaccaagtccaccatggccaaagacagcttcggcatcgaagtgtgctccaactgccacccgttctacaccggcaagcagaagatcgtcgacaccgccggccgcgtggacaagttcaaccagaaattcggcggcttcttcaagcgctaa

SEQ ID NO: 1878 - DNA, 1650 bp, Chromobacterium substugae
atgctgacttattccgcgcaggccagttcgctggccaagccaaccgagaaaccctgggtgctgctgctgctgtgcttcatctggctatggccgggcatcctggggcatgacccctggaaaccggacgagcctttcgtgctggcggcggcgcaaggcatgctgcataccggcaactggctgttgccgaccctgcagggcgcgccgtatctggacaaccctccgctctattactggctggctgccggcttgatccggctgttctcgccctggctgctgccggcgcatgacgccgccaggctggccacgccgctgctgatgtcgctgtcgctgctgttggccggcatggccggccgcgagctgatcggcaggcgtcatggccgcagcgtggtgatgatcttgataggctgcatcggcctggtggagtccggccaccagctgacgccgatgatagcgggctttgccggcttcgccgccgccttctacgcgctggcgctggcgctgcgctcgcctggcctggccggcgccatgctggcggcttccagcgtggcgattttcctgggcggaagtctggccgatctgctgctgatctggctggcggcgttgctgctgccggcgttcagcggctggcgcaaccggcagtacgcgatcactctgctgctggcgctgttgctggcggtgccggccatcctggtatggccgatgctgctgctgcgcgattcgcccgcgctgttcgccgactggtggggcaattacgcgctggggcagaccagcggctttcatcgtctgcggctgtttcatgatttcggctattacagcctgaacgcgctgtggttcgccttcccggcctggccgctggccttgtggacgctgcaccgcaatcgctatctgcagtcgcccaagttgcagctgccattgttgttttcagtggtgatcgcgctgggcctgaccctgtccgaccgggccaacatcaccgacgcgatgccgctgctgctgccgctagccgtgctggccgcggtggagctggacagtttgcggcgcggcgcggcggctttcctcaactggttcgcgttgatgacttgcggcctgttcggcctgctggtgtggctgggatgggcggcgatgaactacggctggcccgagcgcctggccggacgcgcgcagtatttcagcccgttctaccagccgcatgtgtcgtggtggcaggccggcggcgcgctggcggccacgctggcgtggctgtgggcgttgacgcggccgcacttgcgcgggcgccaggccatcaccaactgggcggcggggctgaccttgctgtggggcctgggcatgactttatggctgccctggttcgatgccgccaagagctatcgtccggtggtggccgccatggaggccaagctgcccgccgacgcgcgctgcgtcgccaccgaaagccgcaaccgcctggcgcagatcagctggcgctattacgcggggatggatctggtatcgttcccggccggcgagacgcctccctgcgattattggctgatcgtgcgggacaagagcgaaggcatggcggaacccggctggcaagtgctgtgggtgggccaccgtccgcgcgaacagaacatgactttcgcgctgctcaggcgcctgccgacggcgcagtag

SEQ ID NO: 1879 - DNA, 213 bp, Chromobacterium substugae
ttgcaggcggccagtcccaaggcattggcgacccaccagcgcggcggctggcgccggatcagccatgatgccgatgcgatgaaaaaggccctgtcgatttgcctggccgaccccggcgcccaatgctggcgctacgcggtggatgacaagacagtctggcagggtatggtaaacaagaggatctcgcggatcccgctgctcgcgcatccatga

SEQ ID NO: 1880 - DNA, 846 bp, Chromobacterium substugae
ttgagccggcaccagcaaagctggggtattgaacaatgggcagcctatctgaaagacaaggacatacccgttttatcggcgacgagagatagtttccaggcgctgaaatcccagggaaacgacgcgcctgagttttcgccgcgggaactggtggacatggtgcacgacgacccctatctcgccctcaaattgctgatagaagccgaacggcatcgctccagacgcctcggcaaggaaactaccacccagttgggcgccatactccagctcggcagcgatgagttgtattcgctgatctccagaagcccggtcgtggcggtgaaccacccgggctggaaagccgccgtggccaccgcagtcctggcgtccggcatcgcgcgggcctggtcgaatttccgctccgacacctcccccgaagaaatctccctggccacgctgctttccgaaacgggcgaattgctgttatggcatttcgcgccggagttgccggcccaggccatcgcggaattcgaagccggacgcgccaaccgaactggcctggcgcaattgaataccgccggattcacgtttcggcaattgacgctggccctggccgacatctggcaattgccgcagatgatcagccagttgatccgcggcgtcgacaggccgcgcacgcatatcgcccaaatcgccatcgactgcgcccggcatctgatgcagaaccccgacaatccggccctgccgtccgacatcggcaatatctcccaatatattcccggcgtcgccaaggaaaagctggtctcggtgctgccgatttccgaaacccagcaagcccatattctcgccggcctgcaaatggaatga

SEQ ID NO: 1881 - DNA, 1962 bp, Chromobacterium substugae
atgcaagcaagccatcaccccatctggacgccctccgccggccggctggccggatgccatctcaccgccttcgccaggctggcgcaaaccgcctggaacaagcccttgcccgactaccacagcctgtggcaggccagcgtggacgaccccggccgcttctggtcgctggtatgggactactgcggcgtgatcggcgacaagggcggcgtggcgctggcgggcgaagacgatatgctgaccgcgcgcttcttccccgaagcgcggctcaactacgcggaaaacctgctgcgccgcgacgacgacgcgctggccgtggtgttccgcggcgaagacaaggtggagcgccagctaagctggcatgagctgaaccagctggtctcccggctgcagcaggcgatgcgcgccgccggcatcacggctggcgaccgcgtggccggtttcatgcccaatatgccggaaaccctggcggcgatgctggccgcctccagcataggcgcggtctggaccagcggctcgcccgacttcggcaccgacggcgcgctggaccgcttcggccagaccgagcccaaaatcctgttctgcccggacggctactggtacaacggcaagcaggtggacatccgcgccaaaatgatccacctggccgaacacctgcccagcgtgcgccgcatcgtggtggttccctaccttggcgacggcaaaaccttcgccgccgccgtgcccagggccgaaacgctggacgccttcctcgccccccacccggcgcgggccgtggagttcgtccgcctgccgttcaaccacccgctgtacatcctttactccagcggcaccaccggcaagcccaagtgcatcgtccacggcgccggcggcaccctgcttcagcatctgaaggagcagcagctgcacgccgacctgcaccgcggcgaccacttcttctacttcaccacctgcggctggatgatgtggaactggctggtcagcggcctggcgtccggcgccacgctgatgctgttcgacggctcgccgttcgccgacgacggccgcgtgctgtgggactacgccgccgaacacggcttcacccatttcggcacctcggccaaatacatagacagcctgcgcaaaaccgacatcgtgccggcgcgcgactggcagctccccaatctgcgcgccttgttctccaccggctcgcctctggtggcggaaagctacgactgggtgtacgaaaacatcaaggccgacctcaacctggcctcgatctccggcggcaccgacatcgtctcctgcttcgcgctgggcgcgccgacgctgccggtgtaccgcggcgagctgcaatgccgcggcctgggcatggcggtggacatctacgacgaacagggccggccggtcagccaggagaagggcgagctggtctgcacccgccccttcccctccatgccgataggcttctggaacgacgacagcggcgaaaaataccgccaggcctacttcggccgcttcgccggcatctggtgccacggcgactacgccgagctgaccgcccacaacggcgtcgtcatctacggccgctccgacgcggtattgaatcccggcggcgtgcgcatcggcaccgccgaaatctaccgccaggtggaggttttcccggaaatcctggaaagcctggccgtcggccagagttggcaggacgacgagcgggtggtgctgttcgtcaagctgcgcgacggcgcggcgctggacgaagacctgaccgcccggatcaaggcccagatcaagaacggcgccagcccgcgccacgtgccggcgcgcatcgtggcggtggcggacatccccaaaaccgtcagcggcaagatcgtcgaattggcggtgaaaaacgtcatccacggccggccggtcagcaatgtcagcgcgctggccaatccggaagcgctgaagctgttcgaaaacctgggcgagctggccgaataa

SEQ ID NO: 1882 - DNA, 885 bp, Chromobacterium substugae
gtgaagattgtggaagtcggcccgcgcgacgggctgcagaacgaaaaacagctggtgccgctggccgtcaagctggaactgatccgccggctggccgacgccggcctctccgccatcgaggccggcgccttcgtctcgcccaagtgggtgccgcaaatggcggacagcgccgaagtgctcaaggctctggaccttggcggcgccgtcgcctatccggtgctggtgcccaacgaccagggactggacgccgcgctggaggccggcgcgcgcgagatcgcggtattcggcgccgccagcgagagcttcagccggaaaaacatcaacgccagcatcgccgaaagcctgcagcgcttcgaatcggtgatgcggcgcgcccaggcggagaagctccgcgtgcgcggctacgtgtcctgcgtggtgggctgcccctacgaaggcccgatcgcgccggccaaggtggccgaagtgacgcaaaccctgctggacatgggttgctacgaagtgtcgctgggcgacaccataggcgtgggcaccccggcctcggtgcaccagatgctggacgccgtgctgaaaaccgcgccggccgcgcggctggccgggcatttccacgacacctacggcatggccatcgccaatatccgcgaagccctcaacgctggcatccgggtgttcgacgcctcggtcgccggcctgggcggctgcccgtacgccaagggcgcctccggcaacgtcgccagcgaggacgtcgcctatctgctgcgcggcgagggctaccacactggcatcgatctgactaaactggtggccgccgcctggcacgtcagcgatgcgctgggcaagccgcccgcgtccaagctcgcgcacgcgctcggacgccaggcctga

SEQ ID NO: 1883 - DNA, 534 bp, Chromobacterium substugae
atggaagctgccatcatcgactgccccggcttggcgctggcgggccacagcatcgccacccgcaaggcggacggcgacaatctgcgcgacatccccgctttctgggcggactacgccgcccgcctgcgccagccgctgctggatgcgctgcgcctgccccatgccgcggagtacggcgtggtctacgatttcgaccccgccggcggcggcttccgctatctgatcgccatcgaatgcccggacgcggccgccctgcctcccggcgtcgaacgacggcgtctgccccctgccagatacgccgttttcaccaccccgccggccgccggccccgccgagttcggccagcgcatcgctcagacctggcaacgcatctaccaggactggttgcctgcttccgccgactggcagcatgcgcccggcgatgtctttgagcgctacgacggacgctgcgcgccaggccagacccgcctccagatggacatctacctcccgattcagcccaagctgcgccaaggaaaaccatgcaacacgtga

SEQ ID NO: 1884 - DNA, 483 bp, Chromobacterium substugae
atgcatatcgctctggagaaaattcagcaattgcgcgctcgcggcgagcacgacgccgctcgcaaacaggcgctggaattgctgcagcaccagccacagcacgccgatctgcattatctgaccgcctgcatccacgatggcatggggctggaggccgcggccattccgcattaccagcaagcgctggagctaggcctgagcggcgacaacgccgcccacgcctggctgggcctgggcagcagcctgcgggcgctggggcagtacgccgacgcggaagccgccttgcgccacggcctgcagcatttcccggacaactcggccttacaggctttcctggcgatggccttgtacaaccgcggccagcacaaggaagccacgcaaagcctgctgcagctgctggccggcaccagcggcgacgccggcatccagaaccatcggcaaacgctgcgcttctacgccgaagacctggaccgcgcctggtaa

SEQ ID NO: 1885 - DNA, 1956 bp, Chromobacterium substugae
atgttcaataagatactgatcgccaaccgcggcgaaatcgcctgccgcgtcatcaagaccgccaaggccctgggcatcgccaccgtcgccgtttactcggacgccgatgcgaacgcccgcttcgtcaagctggccgacgaggcttaccgtctgggcccggcgccggccgccgagtcctatctgcgcgccgaccggatcctggccatcgcccggcagagcggcgcccaggcggtgcaccccggctacggcttcctgtcggaaaacgaagacttcgccgccgcctgcgaggccgccggcatcgccttcatcggcccgccggcctcggccatcgccgcgatgggcagcaagtccgccgccaaggcgctgatggagaaagccggcgtgccgctggtgcccggctatcacggcgatgaccaggacccggcgctgctgcaaaaccaggccgacgccatcggctacccggtgctgatcaaggccagcagcggcggcggcggcaagggcatgcgcatcgtggaaaagagcgcagacttttccgcctccctcgcctcctgccagcgcgaagcgcgcgccagcttcggcgacgacaaggtgctggtggagaaatacctgacccgcccgcgccacgttgagattcaagtcttcgccgacacactgggcggctgcgtctacctgttcgagcgcgactgctcggtgcagcgccgccaccagaaagtgctggaagaagccccggccccccacctgccgcaagccacccgcgaggcgatgggcgaagccgcggtggccgccgcgcgcgcggtgggctatgtcggcgccggcacagtcgagttcatcatggatgtcgacaccggcaagttctacttcatggagatgaacacccggctgcaagtggaacacccggtgaccgagatgatcaccggccaggacctggtggcctggcagctggccgtcgccgccggcggcgcgctgccgctgaagcaagagcagctggccatccgcggccacgccatcgaggcccgcatctacgccgaggacccggacaagggctttctgccgtccactggcacgctggtccatctggccacgcctgcggagtccgccaatgtgcgcatcgacaccggcgtcgagcaaggcgacgccatctcgccgttctacgacccgatgatcgccaagctgatcgtctggggcgaaacccgcgaggccgcgctccggcagatggacgccgcgctggcgcagtaccagatcgtcggcctgtccagcaatgtgtctttcctgcgccgcatcgtcaaccaccccagctttgccggcggccatgtcgataccggcctgatcgcccgccaccatgacgaactgctgccgccgcccgccgcgccgacggcccgccagttggcgctgctggcgctggccgaagcgctggcggaccaaccgacctacccggcgcctgcaggctggcggctgaatggcgagcagacgcgccgcttcagcttccgccaggatgaagaagagcatgcggcgacgctgcgccatgcagccaatgcttacgccgtcgccgcgaacgggcaaacattcgccgcccgcgccagcctgcaaggccagcaactgcgcgccacgctggacggcgccgccatccacgccaccgtggcgcgccacggcgcgcagcgggtgctgttcgcaaacggcgaacgcctggcgctggattgggtggatccctatgcctacgccgaactgggcgtgcacggcgaaacccacctcaaggcgccgatgccgggccgggtggtggcgctgctggccgagatcggcaaaaaggtggccaaaggctcgccgttgttgatcctggaggcgatgaagatggagcacaccatcaccgcccccggcgatggcgtggtgcaggatttttacttcgccgccggcgagcaggtcaatgatggtgacgaactggtggattttgccgcagaatga

SEQ ID NO: 1886 - DNA, 789 bp, Chromobacterium substugae
atgagccacaccacgctgcaaatcgagcaagccggcaaggtagccaccgtctggctgaaccggccggagctgcacaacgcgctgaacgaagtgctgatcgccgagctgaccgaggcgatgcgccagctgaaccgcaagcaagacgtccgcgtgatcgtgctggccggccgcggcaagagcttctgcgccggcgcagacctggactggatgcggcgcgccgccggctacagcgaagccgaaaacctggccgacgcgcaaaagctggccgccatgctgaaggccgtctaccgcagcgccaagccggtgatcgcccgcatccacggcgcggcgatggctggcggcaccggcctggcggcggtttgcgacatcgccatcgccaccgacgccgccaagttcgcgctgaccgaagtgcggctgggcctgatccccgcgaccatcggcccctatgtcgccgacgccatcggcccgcgccaggcgcggcgctatttcctctccgccgagcgcatccccgccggcaccgcgctgaagctggggctgatccacgagctggtcagcgaagaactgctggaccagcgggtggccgaaatcgccgaagagctagccaagggcgcgccgggcgcgctgcgcgaagccaagctgttgctggccgagctgcgggaaggctcgccgtgggacgaccaattgctggagcacaccgccggccgcatcgcctccatccgcgccggcgacgaggcgcgcgaggggctggcgtcgttcttcgagaaacgcgcgccgaagtggcaggaataa

SEQ ID NO: 1887 - DNA, 1599 bp, Chromobacterium substugae
atgcccatcctcgaatccaagctgtcgccgcgcgccgcggactttgtcgccaacaccgacaagatgcgcgcgctggtggacgatctgaaacaaaaagtcgcccaggcggcgtggggcggcggcgaaaaagcccgcgccaagcacaccgcgcgcggcaaactgctgccgcgcgagcgcatcgacctgctgctggaccccggcgcgccgttcctggagctgtcccagctagccgcctacaacatgtatggcggcgacgcgcccggcgcgggcgtgatcgccggcatcggccgcatttccggcatcgactgcctgatcatcgccaacgacgccacggtcaagggcggcacctattacccgatgacggtgaagaagcatctgcgcgcgcaggaaatcgcccgcgacaatcgcttgccctgcgtctacctggtggattccggcggcgccttcctgccgctgcaggacgaggtatttccggaccgcgaccacttcggccgcatcttctacaaccaggccaatctgtccgccgccggcattccgcagatcgccgtggtgatgggcagctgcaccgccggcggcgcctatgtgccggcgatgagcgacgaaaccgtcatcgtcaaggaacagggcaccatcttcctgggcggcccgcccttggtgcgcgccgccaccggcgaggtggtcagcgccgaggaattgggcggcggcgacgtgcacgccaaaatctccggcgtggccgaccacctggcgcaaagcgacgcccatgcgctggccatcgcccgccgcatcgtgtcggacctgaactggaagaaacaaggcgaactcgaccgcgccgagcccaaaccgccgcgctacgccgccgaggaaatctacggcgtgatcccggccgatctgaaaaagccgttcgatgtgcgcgagatcatcgcccggctggtggacgattcggacttcgacgaattcaagcagaactacgggaccacattaatcacgggctttgcccgtttgaacggctatcgcgtcggcatcctcgccaacaacggcatcctgttcagcgaatcggcgctgaagggcgcgcacttcgtcgagctgtgctgccagcgcggcattccgctgatcttcctgcagaacatcaccggcttcatggtgggcaagaagtacgagaacggcggcatcgccaaggacggcgccaagctggtgaccgcggtggcctgcgccaaggtgcccaagttcactgtgctgataggcggcagcttcggcgccggcaactacggcatgtgcggccgcgcctactcgccgcgctttttgtggatgtggccgaacagccgcatctcggtgatgggcggcgaacaggccgccggcgtgctggcgcaggtgaagaaggaacaactgggcgacgccttcacggctgaacaggaagaggcgctgaaagccccggtgcgccagcagtacgaagaacaaggccacccctattacgccagcgcccgcttgtgggacgacggcgtgatcgacccggcccagacccgcgacgtgctggcgctggcgctggatgccgcgttgtcggccccggtcgaagccacgcgcttcggcgtgttccggatgtaa

SEQ ID NO: 1888 - DNA, 345 bp, Chromobacterium substugae
atgaacgccgccgaacgcatcgtccaggcccagctggacgcctacaacgcccgcaatctcgaggccttcgccgcctgctacgccgaagacgtcaaggtctaccgcctgccgtccatggcgctgagcctatccggccgcgccgcgctggccgaccactacgccggcaagcgcttcaacctgcccaagctgcacgccgcgctgctgcaccgcatcgtgcagggcagccgcgtcatcgaccacgaggaggtgacgctggacggcgaaaaccgctttcgcgccgtcgccatctacgatatcaacgccgatggattgatagcagccgtctggttcgtcgacgccgaatga

SEQ ID NO: 1889 - DNA, 1170 bp, Chromobacterium substugae
atgtacagcagcctgcgcttcgccttcggcgagacttacgacctcctgcgcgaatcggtgcgcgacttcgccgatcgcgaaatcgccccgcgcgccgccgccatcgaccaggacaacttgttcccggccgatctgtggcgcaagttcggcgagctgggcttgctcggcatcaccgtcggcgagcagtacggcggcgtggacatgggctacctcgcccacatgatcgcgatggaggaaatcagccgcgccagcgcctcggtgggcctgtcttacggcgcgcactccaatctgtgcgtcaaccagatctacaagaacggcaacgacgcacagcgcgcgaaatacctgcccaagctggtctccggcgagcacgtcggcgcgctggcgatgtccgaaccgaacgccggctccgacgtggtcagcatgaagctgaaggccgacaagactgacggcggctacctgctgaacggcagcaagatgtggatcaccaacggcggcgacgccgacacgctggttgtatacgccaaaaccgacgtcaacgccggtcccaagggcatcaccgccttcatcattgaaaagtccttcgccggcttcagccacggcagcaagctggacaagctgggcatgcgcggctccaacacctacccgatcttcttcgacaactgtttcgtgccggaagaaaacgtgctgggcggcgaaggcaatggcgtgaaagtgctgatgagcggcctggattacgagcgctcggtgctggccgccggcccgctgggcatcatgcaggccagcctggacatcgtggtgccctatctgaacgaccgcagccagttcggccagcccatcggcgacttccagctgatgcagggcaagctggcggacatgtacgtcaagctgtccgccagccgcgcctacgtctatgccgtgggccaggcgctggaccgcggcgaaaccggccgccagacccgcaaggacgccgccggcgccatcctgtacgcggccgagaacgccacccagctggcgctggacgccatccagtgcctgggcggcaacggctacatcaacgaatacgccactggccgcctgctgcgcgacgccaagctgtacgagatcggcgccggcaccagcgagatccgccgctggctgatcggccgcgaactgatggccgaaacccgataa

SEQ ID NO: 1890 - DNA, 471 bp, Chromobacterium substugae
gtgatcagcgtcgacatagccggcacccgtttcaatctgcgcgccgccgccatcatcgagcatgagggcaaggtcttgctgcaccgcctgatccgcgacgatttctggaccctgcccggcggccgtgtagaccccgacgaggaagcggccaaaacggtggaacgagaaatgctggaggagctgggcgaagccgtgcgttgcggcgagatggtcatgctgattgaaaacttcttcagcgcgggcggccagcgcaaccatgagctgggcttgtatttccagactcatctggccgcgggctccgcgctgcctagccgcgccacgccgttcgcaatcgaagacggcggcgctcgcctggagttcgactggttcagccgcgagcagctcggcgagctgcgcatcctgccgcagcccatgaaagacatgctgatcagcgaagaccgcagcctgcgccatgtgatcaatcgcgaataa

SEQ ID NO: 1891 - DNA, 498 bp, Chromobacterium substugae
atggacaagggcaggtatcatggcggcctgttgatagagaaagaagccgacatgacgatctgggtagacgccgatgcctgtcccaaggtgatacgggaagtgttgttccgcgcggcgcagcgcaccggcgtggagttggtgttggtcgccaaccagctgctgacggtgccaaaggcgccgaacatccgcgcgctgcaagtgcccaagggcttcgatgtggcggacaatgagatcgcccgccgcatcgagccgaccgatttgctgatcaccggcgacattccgctggcgtccgaggttctggccaagggcgcgcaggcgctgaactggcgcggcgaggcgttttccaaggaaaccatcgccgcgcaactgacgatgcgcgatttcatggacaatctgcgcgccagcggcgtgcagaccgagggaccgccgcctttgagccaggccgaccggcaggccttcgcacgccagctggacatctggctggcgaagcggcgctag

SEQ ID NO: 1892 - DNA, 1224 bp, Chromobacterium substugae
atgaacgcctcaagcaacgccatccgctaccgtaccctggccggtaccgtcctcacccagttcgcgctgggttccgtctatacctggagcctgttcaacgcccagctgtcgcacaagctgggcgagccggtcagccaggtggctttcgccttcggcctgctcagcctcgcgctggcggtggcgtcgtcgatggccggcaaattgcaggagcgcttcggcgtgcgcaaggtggccatcgcctccggcctgctgctgggcctgggcttttacctgacctcgcatgccggcagcctgatcatgctctacctgtgcgccggtttgctggtgggcttcgccgacggcgccggctacctgatgtcgctgtccaattgcgtgaaatggttcccggagcgcaagggcctgatctcggcctgcgccatcggcgcttacggcctgggcagcctgggcttcaagttcatcaacctggcgctgctgtcgcatttcagcctggaagccactttccagctgtggggcctgatcgccatggccatggtggtggcaggcgccctgctgatgactgacgcgccgcaacagccggccgccgcgcaaaccggcggcagccgcgacttcacgctggccgaggcgatgcgccagccgcagtactggatgctggcgctgatgttcctgaccgtgtgcatgagcggcctgtacgtgatcggtgtggccaaggacatcggcgagagcttcgtccacctgtcggccaccaccgccgccaacgccgtcgccgtgatcgccgtggccaacctgtccggccgcctggtgctgggggtgctgtccgacaagatgccgcgcatccgcgtcatcaccatcgcccaagtggccgcgctggccggcatgctgaccctgctgttcgccccgctcaacgccggcctgttcttcgccgctatcgcctgcatcgcattcagcttcggcggcaccatcaccgtctacccttcgctggtcagcgatttcttcggcctgaacaacctgaccaagaactacggcgtgatctacctgggcttcggtatcggcagcatcgtcggctccatcgtggcctcgctgttcggcggcttcctcgccaccttccacctgattctggcgctgctgatcgtcgccctgctgttctcgctgaccatccgccagccgggcgcggcccaagccgacaaggaagaattcgacgccgaaccgcatctgggcaaggcctga

SEQ ID NO: 1893 - DNA, 747 bp, Chromobacterium substugae
atgctgaaggcgctgattgtggaagacgaatacctggcgcgccaggagctggcctacctgatccgcgagcatagcggcatcgagatcctggccagcgtcgaggacggcctggaggcattcaagtttctgcaggaaaacgaggtggacgtggtgtttctcgacatccacatcccgtcgatagacggcttgctcttggccaagaacctgcacaagaccacccgtccgccgcgcatcgttttcgtcaccgcctacaaggaattcgcggtggaagcgttcgaagtggaggccttcgactacatcctcaagccctacaacgaacagcgcatcgcccacgtgctgcacaagctggaagcgctggagccggcgccgccgcccgccgccgcggcaagcgccccggccgccgacgccgcgccggccagccgcaccgtcaacctggccaagggcgacagcatcatcgtcaccccctgcgacgacatctactacgtggaggccgacgagaaagtcaccctagtctacaccgcccgcgaccgctacgtgatggcgatgagcatcagcgaattcgtgtcgcggctgccggccgacagcttcttccgctgccaccgctctttctgcgtcaacatccacaagatccgcgaaatcgcgccgtggcagaacagcacctacatcatcaaactgtacgacctgaaggcggaaatcccggtcagccgcagcaatatcaaggcgttcaggcagctgatgcatctctag

SEQ ID NO: 1894 - DNA, 1674 bp, Chromobacterium substugae
atgatagaaaacaacccgaatatgttgctgctcgcggtgttcgagcgcgcggcgctgatgctgatggcgctgttcttcctcacccgcatccggccgttccaggacctgttgcgccagcaacgccacaccccggcggaattggccggcgtgtcgctgctgttctgcctgttcgccgtgttcagcacctataccggcattccggtggacggctcgctggtcaatgtccgcaccatcgccatcctggccggcggcatcttgttcggcccctgggtgggcataccggcaggcatcgtctccggcctgcaccgttatttgatagacatccacggctatacctcgctgccctgcctgatctccagcatctgcgccggcttgctcgccaccatcatccatttccgcgccggccgccgccggctgtggctgtacggcgtggccgccggcatagcctgcgagagcctgaccatggcgctgatcctgtggttcaccgagccggccatcggccgcgccatcgtcggccatatcgcctacccgatgatcaccggcaccgtctgcatcggcctggtcatcaagctggtgcaagacctggatgacgaaaaggagctgctggcggcgcgccaggccaagctggcgctgaccatcgccaaccagaccctgccctatttccagaacgtggaccgcgacgcgctggtggaggtgtgcacggtgatccgcaaccacatcggcgccgacgcggtggccatcaccgacaccgccgacgtgcaggcttatgtcggcctgggcaaggactactacgaaccggccgcccactccgccatcggcgaaatcacccgccaggcggtgcaacaggaccagatcatcatcgagaacaatctgcagcgctaccgggtggccgacttccactcggtcatcatcatcccgctgcgcgaaaacgcccgcgtcaccggcacgctgaaaatcttctatcgcaagagcggcggcatcaccagttcgctgcgcgagctggccgtcggcctgtcgcagctgatctccacccagatggaggcgtcgcggatcaagcagctgcaggaaatggcgcgcaaggccgaattcgccgcgctgcaaagcaagatcaacccgcacttcctgttcaacgcgctgaacgccatctcgtcgctgatccgcatccagccgtcggaagcgcgccagctgatcgccaagctggccgactacctgcgctacaacctgtcgctgggcgacacgctgatcgacatccaggaagagctgaagcaggtgcgcgactacgtcgccatcgagcaggcgcgcttcggcgacaagttgaaagtggtgttcgacgtcgacgacgtgcatgtgcgggtgcccagcctgttgctgcagcccttggtggaaaacgccatcctgcacggcatccagccgcgcaaggggccgggcgaggtgtgcatcgcggtgaagcgcgacggcgcgcgcatccatgtctgcgtgcgagacagcggctacggcatcagccaggaagtgatagacggcatcgccgacggcaaggtggagagccgcagcatcgggctgatgaacgtcaacgagcgggtgaagcttttgtacggcgagggcctgcggctgacgcggctggagcccggcaccgcggtatgcttcgacctgccggcggaggaggcggcatgctga

SEQ ID NO: 1895 - DNA, 543 bp, Chromobacterium substugae
atgaaccgcatcgccattcccgcccccgaacacattcccgccgccagccagccgctgctggccgccgtgcaacaacaactgggcatggtgcccaatctgatgaagctgctggcccacagccctgccgcgctggaagggtatctgtcgctgaacggcgcgctgggcaagggcaggctgggcgccgcgctgcgcgagcgcatcgcgctggcggtagccgaattcaacggctgcgactactgcctgtccgcccacagctatctggccaaacatgtggccaggctcggcgatgacgaaatcgtcgccgcgcgcgatttttccagcgccgacgccaaacaggccgccgcgctgcgcttcgcgctgaatgtggcggaacagcgcggccgcgtggccgacgccgagctggcggccttgcgcgaggcaggattcgatgaggcggaaacgctggaaatcgtagcggtggtagcgctcaatatcctgaccaactacatcaacaacgccgccgccaccgcggtggacttcccgctggtccaaacccgcgcgtaa

SEQ ID NO: 1896 - DNA, 900 bp, Chromobacterium substugae
atggaccgattccacttgatgagcgtgttcgtcgccgtggctgaggaagagggtttcgccggcgcggcgcgcaggctgaaagtgtcgccgccggcggtgacgcgcgcggtggcggcgttggaggaaagcctgggtgtgcgtctgcttaaccggaccacgcgctatgtcagggtgaccgaggccggcgcgcgttatctggacgacgcgcgccgcattctggcggcggtggccgaggcggaggatgcggcggcggggggcaacgccgagccgagtggcctgatccgcctgaccgcgccggtgttgttcggccggctgtacgtgatgccggcggtggtggattttttgcgccagcatccgctggtggaggtgtcggcgcagctgcgcgacaacgtggtgaacctgatggaggaggggctggacgcggcggtgcgcatcggccacttgccggattcttcgctgcgcgcgctcaaggtgggcgaggtgaggcggctggtgtgcgcggcgccggactatctggcgcgccatggcgcgcccgccgcgcctgaggatttgcgggagcacacggtgattgcttccaccgccgcgtcgacctcgctggagtggaaattcggcgcggacggcgagcggcgggtgcgggtgaggccgcggctgacggtcagcggcaacgacgcggcgatagacgcggcgctgagcggcttcggcttgatccgggtgatgtcctaccaggtggcggaggcgctggcggcgggcgagctggaacgggtgctgacagcttacgagagcgcgccgctgccgatacacatcgtccatgccgaaagccgttacggctcgacgcggatgcgccgcttcatcgacctgctggccgaacggctgcgcgccgacccgcggcttaaagattga

SEQ ID NO: 1897 - DNA, 1977 bp, Chromobacterium substugae
atggctgaagccaaaacccccagcccctggcacgcgggcgagctggaaatgcagcgccgcgccggcagcctggagcggatggcggcggccggtccgcgcaatatccgcgaccacatgccgcagcagcaccgcgacttcttcccgcaactgccgtttctggcggcggcggcggtggacgaggccggccgcccctgggccggactgatcgaaagccagcccggcttcgcccgctcgcccgacccgcgccggctgcgggtggacagcctgcccagccgcgccgatccgctgcgcgactgcctgcgggccggcgcgcagctggcgctcttgggcatagagctgcacacccgccgccgcaaccgcctgaacggcgcgctggccgagcttgacgacgccggcttcacgctggcggcagaacaatcgttcggcaactgccccaaatacatccagctgcgcgaattcagcttcgcccgcccgcccgacggccgcatcgtcggcaccgtggaatggatggaccggctggacgacgacgcccgcgccttcatcgccgccgccgatactttcttcgtcgccagcgcggcgcccggcgcaagcaactggcaagtggacatctcccaccgcggcggcaaacccggcttcgtccgcgtcgacggcgacaccctcaccatcccggacttcgccggcaacggctacttcaacacgctgggcaatctgctgcggcatccgcaggccggcctgctgttcatcgatttttccagcggcgacaccttgcagctgtgcggtggcgcggaagtgctgccggaagacgggcaaggcttcgccggcgccgagcggctatggcgcgtcaccgcggagcgggtggtgcgccgccgcaacgcgctggccctgcgctggcagctgcgggagttttcgccatatgcgctggccaccggcgcctggccgcaaaccgccgcccggcaatggctgcccttgcgggtggcgcgggtggtggaggaaagcccgcaagtccgctctttctatctggagccggcggacggcagcccgccgccgcccttcgtccccggccagcacctgagcgtcaaggtggccggcgtggacggggtcaggctgcgcaactacacgctgtcgcagacaggcggctaccgcatcagcgtcaaactgcagggcaaggcgtcggcccggctgcatcagctggcgccgggcgacatcgtggaagcgctgccgccgcgcggcgatttcatactgctgccgccgcggcgccccatcgcgctgctggccggcggcataggcatcactccgttgctggcgatgctgcaccaactggccgggcagcccgccgccatgccgcccaccctgttgctttacgccacccgcagcgtggccgagcgcgccttcgacgccgagctggaacagctgcggcgtcaatccgcgggcaagctgcgcattgtgacggcggtgagccggccggaaacctccagccgcgccggcgtcgactaccagcacgccggccgcgccgacctcgcgctgctgcgccaatcaggcgccgatcttgatggcgacttctacctgtgcggcccggccggcttcatgcaggcgctgtacgacgagttgatcgcagccggcgtgacagacgcgcgcatccacgccgaagccttcggcccggcagggctgaagcgcgccggctcggccacccaggccctgccgccgccggccgatcacgcggtgccggtgcgctttgccgcctccgccatcgacgccgagtggcaaccgggccaaagcctgctggaattggccgagtcctgcggcctgaatccggacttcagctgccgcggcggcacttgcggcagctgccgcggcgttctgctgtccggcgcggccacctatctgcagccccccgagtacgccgcccaagccggcgacatcctgctgtgctgcgcctatccggccgccggcgcggacaagctggaaatcaatctttaa

SEQ ID NO: 1898 - DNA, 612 bp, Chromobacterium substugae
atgagcgccatccagctatatgacttccccctgtccggccacagccatcgcgcgcggctgatgctgtctctgctgggcctggaatacgaagccatcctggtcaatttggcggccggcgagcacaagcagccggcatatctgaagcgcaaccgcttcggccaggtgccggtgctggtggacggcgacgccgtcatcgccgactccaacgccatcctggtttatctggcgcgccgctacggccatggcgattggatcccggccgaccccgccgccgaagcgcaagtgcagcgctggctgtccgccgccgccggcccgctggccttcggcgccgcgcaggcgcggctgcacaaatggcgcggcgtgccgctggactacccgctggctgtcagccgcgccgaagcgctgctgcaagtgatggagcaagaactggcggaacggccgttcctggccggccaagccgccaccatcgccgacgtcgcgctgtacacctacactgcgcacgcgccggaaggcgaaatcccgctggcgccctacccgcatgtgcgcgcctggctgacccgcgtcgaggcgctgcccggcttcgtggcgatgccggccaacaccgcaagctga

SEQ ID NO: 1899 - DNA, 528 bp, Chromobacterium substugae
atggccgtacaacgggaaggcgatgcggtagacagaattctggcgcaatgggccagggaaagacccgatctggacgccagcccgatgggcgtgataggccgcctcaaccgctgcgcggcgctgctgtcgcaacggatggacgcggtgttcggacaatacgggctgagcggctgggagttcgacatgctggccacgctgcggcgcagcggcgcgccctattgcctggcgccgaccgagctgttttcgtccttgatggtgacatccggcaccatgacgcaccggctgaaagtgctggaaggaaaaggctggatttcgcgcgaggccagcgcgcaagacgcgcgcagcacgctggtgcggctgagcgaagtcggcttcgccttgatcgagcgcgcgctggaagcgcatgtggccaatgagcacgccattttgtcggcgctgcccccgcgcagcctggacgcgctggaaaaacggctggcggagctgctcgccgcgctggaggatgcgacggcggccagcggcaaaagataa

SEQ ID NO: 1900 - DNA, 879 bp, Chromobacterium substugae
atgtctcttcggcgcgcatccgctctgtggagcgatgtcttgatcaccgccatggtgccggtgatctggggttctacctatatcgtcaccacccagttgctgccgccggaccggcccttcaccgccgccttgctgcgcgtgttgcccgccggtttgctgctggcttgcctgggcggctggcggccggccaaggggcagtggggaaaattgctggcgctgtcggcgttgaacatcggcgtgttccaggctttgctgtttgtcgccgcctatcgtcttcccggcggactggccgcggtggtgggcgcttgccagccgctgctggtgatggcgctggcctggcaggtggaaaagcgcaagccggcgcggctggctttgtgggccagcttgagcggcgtagccggcatggcggccttgctgttgtcgccgggttcgcgctgggacggcttgggcatgctggcggcgttcggcggcgcggtggcgatggcctgcggcacctatctgacccggcgttggcgtttgccggtgccggtggcggccttgaccggctggcagctgactttgggcggcctgatgctgctgcccctggcgcggatcatcgatccgccgttgccggttttgaccgcggcgcagatcggcggctatgcctatttgacggttttcggcgcgttgatcgcctactggctgtggtttcgcggcatcgcccgcttgtcggcggtggcggtgacatcgctgggcctgctgagcccgttgacggcggtggtgctgggctgggccttgctgggccaggccttgtcggcgcaatcgatgctgggcctggccattgtgctggccagcgtgctggcggtgcagtggagcatgctcaatgccgcggccaaataa

SEQ ID NO: 1901 - DNA, 528 bp, Chromobacterium substugae
atgcccaatccctacaccactgcattttccctgcgacacctgagcgccgagcatatcgagaatttctggcgcgtcaccgacagcgtggcccgagaacggcgctacctggcctttctggaaatcccgcaagcggcttcggccgaatacgcgcgcagccaattggcccggaaagccccgcacttgctgctgctggacggcaagcaggtcgtcggctggtgcgatgtcgccccccagcactttcccatctaccagcatggcggcacgctgggcatgggcctgctgccgcgctaccgcggcatgggcctgggcggatggctgctggacagcacattgcaattggccgagcagcgcggctatcgccgcctggagctgaccgtgcatgaagacaacctcaacgcgatcaagctctacgaaagacacggctttctgctggaaggccgcaaacgcgaggcgatctgcatcgatgggcgctacaaggatgtcttgatgatggcgcggctgacgcctaccgcgtcgtccaagccataa

SEQ ID NO: 1902 - DNA, 393 bp, Chromobacterium substugae
atgaaccaagcagaatttttcaccatctccgatctggcgcaagaattcgacgtcaccctgcgcaccatccgcttctacgaggaacaagggctgatcgagccccagcgcgaaggacgccagcgtctgttcaaccgccgcgaccgcgcccgtctgaagctgatcctgcgcggcaagcgcatcggcctgtcgctggcggagatccgcgaaatcatcgacctgtaccaattggcgcgcgatgaagccagccagtcgcaaaagctgctggatctgctccagtcccgccgcaaccagctggaatcgcagcgccatgacatcgacgcggtgctggacgaaatcggcgcgctggaaaaccattgccgcaacgtgatcggcagccagagcacagccgcctga

SEQ ID NO: 1903 - DNA, 1689 bp, Chromobacterium substugae
atgcaacaggccagctacgcccagggggccagcgatcagccgctattgggacagaccataggacgttttttcgaccaggcttgcgaacgccatgccgaccggctggcgctgcgcgtgcggcagcaggacatccgctggagctacgccgaattgcggcggcaggtggatcggctggcctgcggcttgctgcggctgggcctggccccgggggagcgggtaggcatctggtcgcagaaccgcgccgaatgggtgctgatgcagttcgccagcgccaaggccggcctggtgctggtcaacatcaacccggcctaccgccgcgccgagctggagtacgcgctgaacaaagtgcagtgccgcgcgctggtgctgtcgcccggcttcaaaagcagcgactacgtggagacgatgcgccagctggcgccggaactggacgcctgcaggccgggcgagctgcgcgcggggcgcgtgcccgagctgcgctgggtagtgcggatggggcagcaggcgctgccgggcatcctgccgttttccgagctattggccgagccgacggcggccgagctggcggcgctgcaggcggtgggcgaggcgctgcagtgcggcgacgcggcgaacatccagttcacctcaggcaccaccggccatcccaagggcgcgacgctgtcgcatcgcaatattctcaacaacgcctggttcgtcggcgcggcgatgcggctgcgcgccgacgacaggctgtgcattccggtgccgctctaccattgcttcggcatggtgatgggcacgctgtgctgcctgtgccgcggcgcggcgatggtgctgccggcggagggtttcgacgcgctggcggtgttgcagacggttgccgaggagcgctgcaccgccttgcacggcgtgccgaccatgttcatttcgctgctggaccacccgcgcttcgccgaattcgagctgtccagcctgcgcaccggcatcatggccggcagcccctgcccggtggaggtgatgaagcgggtgttgtcgcagctgcacatggccgaggtgaccatctgctacggcatgaccgaaaccagcccggtcagcctgcaaagcgccgccgacagcccgctggagcaaagggtgagcacggtgggcggcgttcatccgcatgtggaggtgaagatagtggacgccgaggggcgcgtcgcgccgcgcggccagcgcggcgagttgtgcgtgcgcggctactcggtgatgctgggctattgggacgatccggacatgacgcgcgccgccatcgatgcggaaggctggatgcacagcggcgatctggcgatcatgcgcgacgatggtttggtcaacatcgtcggccgggtcaaggacatggtgatccgcggcggcgaaaacatctatccgcgcgaggtggaggagttcctctaccgccatcccaagatccaggacgtgcaggcgataggcgtgccggacgcgcgctacggcgaggagctgtgcgtgtggatacggctgcgcgacggcgaaaccgcgaccgaggaggagatccgcgccttttgccagggcgagatcgctcattacaagattccgcgttacatcgagtttgtcgatggctttccgatgacggtcaccggcaaggtgcagaagtatctgatgcggcggaaaatgctggaaaagctgggtttgccggatgtcaaaacagcctga

SEQ ID NO: 1904 - DNA, 678 bp, Chromobacterium substugae
atgaccgttaccgctttcaacgatgccgacctggcccgtctcgaaacgctgttgaccccgttgtccgccagcggcagcaccatgcgcccggacgaagtgcagggcttcttcgccgcgttggtgagcggaccagatgcggtcgataccgatttctggctgccggaagtgctgggcgacgcgccggctttcgaaagccaggccgatgaagccgagctgaaaaccctgctgcaaaagctgttcgacaccacccgcgacgtgctggccgccggcgaagagctggacatgatcttgtacgcggaagaagacagcgaagaagagggcgagccggactactggccgtgggcgaacgcctacctgtacgcgctggatctggtcgacaccgactggttcgaagtggcggaagaggacgagggcttcgaaagcctgatgatgccgatgctggtgctgggcggcgcgttcgaggaagaagacggcgaagacctgctgactttcaccgacgaagaggtggaaggctacaaggaagagctgaccgacgccctgcaggcggtgttcggctactggcgcgccaaggagcaggcgccgaccacggttcgccgcgatggcgacaaagtgggccgcaacgacgtgtgcccgtgcggcagcggcaagaagtacaaggcttgctgcggcagcaactga

SEQ ID NO: 1905 - DNA, 1158 bp, Chromobacterium substugae
atgaaccccgccctcgttttcgattactacaatcccacccatcttcatttcggcgccggccagttggccggcctggagcggctgctgcctgccggcgccaggatcctgctgctgtacggcggcggctcgatcaagcgcaacggcatccacgcgcgcttgcagcaagccttgcgcggccatgactggctggagttcggcggcgtggcgcccaatccagacgtggaggctttagccggcgcgctggcgctgctgcgcgagagccggcgcgatttcatcctggcggcgggcggcggttccgtcatcgacgccgccaaatacctggcggccgcggccttgcatgacggcgatggctgggagctggtttccggcaagcagccagtgcgggcggcattgccgctgggcgtggtgctgacgctggccgccaccggttcggaaggcaacggcaccgcggtgatttcgcggctgtccagccaggagaagctggcttttcgctcgccgctgctgcggccgcgtttcgcggttctcgaccccgacaccctggccaccctgcctgaccggcaactggccaacggcgtgaccgacgccttcgtccatgcctgcgagcaatacctgacctacccggtaggcgcgctggtgcaggatggctgcgccgaggcggtgctgcgggcgctgtaccggctggcttgccgtttcgacgagcgcggcacgccggactggcggcagaacatgatgtgggccgccaaccaggcgctgtccggcgccattggcctgggggtgccgcatgactgggccacgcacggcatcggccgggcgctgaccgcgctgtacggcatagaccacggccgcaccctgtccatcgtacagccgtcgctgctgcgcgaggcctgcgcggaaaaagccgccaagctgcgccagatgggcgcgcgggtgttcgacgctccggaattggccgcggagcgggtgatagacaaggtggaagacatgtatcgcgcgctcggcatgccggtgacgctggccgaggccggcgtgccggatgccggggcggccgccgacgatgtgctggccttgctgcggcgcgacggccggttcggattgggggagggcggcatcttgatcgaggcgcgcgtcggccgcatcgtgcgggcgttttgccgctga

SEQ ID NO: 1906 - DNA, 516 bp, Chromobacterium substugae
atggcaatcgatgacgacatcatcgtcgcgccgataggcggcgtccacccgcgcgccgggggggcgcgcggcgtgcacgcgctggcccagcacggacagcgcgggcgccgccaggacacggaagacaatgccgacatcagcctcagccatggccggcaggccgcccagctgctgtacagcgcggtgatggaccaagtcgcgcaactggccggactggacgtcgacccgggccagctgcaggaaagcgcgctgccgggcgacagccacagccagcacctgctgctgggcatcgcggccctgttcgagcactattgcggccggcatccgcaactggcgcggcaggaagccggccaggccttcgcgccgctggccgaggccgggctggagcgcggccatcaggaaacctgccaggtgctgcggcaactgaatgcctatccgccagccaccgccgcccagctgcagggcctgtgccagctgacggcccggttgctgcgcgagcgcctggcgcaaaactag

SEQ ID NO: 1907 - DNA, 654 bp, Chromobacterium substugae
atgtcgatctcatcgctgaacagcaaccaggccggccagaccggcggcgccagccagacgcagaacgccggctacagcgcccagactgcccgcaaccagctcaactcggtgctggtggagtcgctggacgtatccatcagcagcggcaagcaatcgcaaacgctgctgttccacgcctcgatcaccaatatcaaccagatcctcagcgccgacagcggcggacaaaacagcgacggcagcggcaacgcctcctcgtccacgctgcagatcaacagcacgcagctgagcatttcggtgcagcagcaaagcggacagaacagcgacgacgacaattcgccgcaagccaccgccaagcgcatcctggacggcgccaccagcctgttcggcctgtacaagcagcagcacccggagctgagctccgaccagcaggcgcaaaacttcgtcgggctgatccgccaaggcttcgagcaaggttatcaggaggccaccggcatcctgaaaaacctcaatgtcttcaacggcgatgtctccagcggcatccagcaaacccacgacctggtcgagcagggactggacgccttcctgcagcagaatcagtccgccggcacgcagtcctcgcaggcggccgccggcgacagccagagcggcagctga

SEQ ID NO: 1908 - DNA, 1785 bp, Chromobacterium substugae
atgcctgtctacaaagcaccgctgcgcgacttcgactttgttctcaacgagttgatcaaggtacaggacatcatcccctctctgccaggctacgaagaggccacgcaggacatcttcagctcctacctggaggcggcggcccagttttgcgagtccgagctcgcgccgctcaaccgccaggcggacgaagaaggctgccagtacgacagcgcgaccaaatcggtgaccactcccacgggcttcaaggaagcctacaaacagtactgcgaactgggcttcccggcgctggactgcgatccgtcctacggcggccaggggatgcccaagagcctggccttccccatcatggagatgcaatgctcggccaacgtcgcctggtcgatgtatccgggcctgtcccatggcgcgtattctgccatccacgcgcacggcacagaagaacagaaagccgcttacttgcccaagctggtggacggcagctggaccggcaccatgtgcctgaccgaaccccactgcggcaccgacctcggcctgctcaaatccagggccgagccgaacggcgatggcagctaccgcatcaccggcaccaagatcttcatctccgccggcgagcacgacctatcggacaacatcatccatctggtgctggcccgcctgccggacgcgccgaaagacgtgaagggcatctcgctgttcatcgtgcccaaattcctcgacgacaagagccgcaacgccgtgtcctgcggcagcctggaacacaagatgggcatcaaggccaacgccaccgcggtgatcaatctggacggcgccaagggctggctgataggcgagcctaacaagggcctgtcctgcatgttcaccatgatgaacgccgcccgcctgggctgcggcatgcagggcctgggcataggcgaagcctcgttccagggcgcgctctcctacgcccgcgaacggctgcagatgcgcgcgctgaacggcgcgcagtgtccggacaaggctgccgaccccatcatcgtccacccggacgtgcgccgcatgctgctgactcagaaagcctataccgaagccggccgcgcgctggcggcgctgctggcgctgcagctggacatagaggacaagcatccggacgccggcgtccgcgccgacgccgccgacctggtggcgctgctgaccccggtggccaaggccttcatgaccgacaacggctacaccgccgccaatctgggcatgcaagtgttcggcggccacggctacatccgcgaatggggcatggagcaactggtgcgcgatgcccgcatctcgcagatctacgaaggcaccaacggcatccaggcgatagacctgctgggccgcaaagtgctgctggaccagggcgccaagctgcgcaaattcaccaagctgatccacaagttctgccagcagtacgaaggccatgcgcagttgggcgaattcgtcaatccgctcgccaagctgatgaaggaaatcggcgagatcaccatgggcatcggcatggccagcctgtccaacaaggatgaggccggcgccgccgccaccgactacctgcgcctggtcggccacttgacctacgcctggctgtgggcgcggatggccgaagtcgcctacgccaagctgggccagggcgaggacgcgttctacaacgccaagatcgccaccgcccgcttctactacgccaagctgctgccggaagcggaagcgctgaaggccagcatcaaaacgggcgccaagccgctgatggcgctggaggaagcgcacttcggcttctga

SEQ ID NO: 1909 - DNA, 558 bp, Chromobacterium substugae
atgacctggctcaagcggaaaatgcggcggttcgccggacggcgccaccaatggttcgcccggccgggcatgcgccggctggcgccgtatctggaccagccggcctattgggcgttcaatcggcgcaaggtggcgatgggcgtggcggtgggactttattccggcgtgatgccaggcttcacccagaaggccaccgcgctggcgctggcgctgctgctgcgggtgaacctgccggcggcgatggtggtttccctgtacagcaatccgttgacggtgttgccgctctattatctggcctactgttatggcagatggctgctgggcggccccacctccctgtcgatggcgccgcctcccggcctgggcggagcgggcttggcggcttggctggccggcacggtcggctggctggtggacatggggtggccgctgctggtgggcatgccggcgctggggctgaccctgggggcggcgggctatctggcgacgcgagtgatgtggcgctgggctgtagtcagcgcctggaacaatagaaaggcgaagtgtggatctgcttga

SEQ ID NO: 1910 - DNA, 558 bp, Chromobacterium substugae
gtggatctgcttgaaaaacaattgacgtcggagctggtgtacgagggcggcttcctgcgcgtgcgcaaggaccaggtggcgctgcctgatggcaagcaagccgcccgcgagtacatcctccatcccggcgcggtggccatcctggccctgacgccgcagcgcgagctggtgctggagcggcagtaccgctatccggccggccgcgagttcatcgagattcccgccggcaagatcgacccggacgaggcgccggaagagaccgcgcgccgcgagcttttcgaggaaaccggctatcgcgccgccagctggacttatctgggcaccgcccacccctgcatcggctattcgaatgaaaaaatcagctattacctggcgcaagatcttattcttagcgaaaggcggctggacgagggcgagtttctggaggtgctgaccaagccgctggacgaagcgatggagatggcgctgagcggcgggatctgcgacagcaaatcgatagtcggcctgcactggctggcggcttatttgagcgggaggatgcgaggtgtcccgatttga

SEQ ID NO: 1911 - DNA, 318 bp, Chromobacterium substugae
gtgtcccgatttgacgcgtattacgaccgtcggcgcggccgacgcgtcagcatggggtgcaaggcccggatcaagtcgctgttgagcgggcagacctattacggcgagtgcgtggacttgtcggtggacggcatggcgctgcgctcagcctttgtgccgcagtacggcgaaaagctcaatgtgatcgtgctggtgcccagcgtgggcggggtgtcgggcaagccattcgaggccgaggtcgaggtcaagcgctgcaatgaagtgcagcgtggactcatatatgaaatcggtgtccgcatcctgcagagaaaaagctga

SEQ ID NO: 1912 - DNA, 1929 bp, Chromobacterium substugae
atgcacccggatatcttcagtcactacgcagtgcgctacgacaagacccgcgaggaagagtacacgatccaggagtatctggagctgtgccggcaagaccccggagcctacgccactgccgcagagcgcatgctggcagccatcggcgaaccggagctggtggacacccgccacgactcccggctgtcgcgcatcttctccaacaaggtcatcaaggtatatccggccttccgcgacttctacggcaccgaggaagtcattgaacaggtggtcgcctacttccgccatgccgcgcaagggctggaagagaagaagcagattctctacctgctggggccggtgggcggcggcaagtcctccatcgccgagaagctgaaggagctgatggagctggtgccgttctattgcctgaagggcagcccggtcaacgagtcgccgctgtcgttgttcaattacgacgaagacggccccatcctggaagaacagtacaatatcccgcgtcgctaccttaagggcattcccagcccctgggcggtgaagcggctgcatgaattcaacggcgacatcggccagttccgcgtggtcaagcgctatccgtccgtgctgcgccaggtggcggtggccaagaccgaaccgggcgacgaaaacaatcaggacatcagctcgctggtgggcaaggtggacatccgcaagctggaaaaatacgcgcaggacgatcccgacgcctacagctactccggcggcctgtgcctggccaaccaggggctgctggaattcgtcgagatgttcaaggccccgatcaaggtgctgcacccgctgctgaccgccacccaggaaggcaacttcaagggcaccgaaggtttcggcgcgattccgttcgaaggcatcatcctcgcccactccaacgagagcgaatggaagcagttccgcaacaacaagaacaacgaggccttcctcgaccggatctacatcgtcaaggtgccgtactgcctgcgggtggccgaggaaatcaagatctacgacaagctgatccgcaactcctcgctgggcaaggcgccgtgcgcgccgggcacgctgaagatgatgggccagttcgccgtgctgtcgcggctgaaggagccggaaaactccagcctgtacagcaagatgcaggtgtacgacggcgaaaacctgaaggacaccgatcccaaggccaagtcgctgcaggagtaccgcgactacgccggcgtggacgagggcatgagcgggctgtcgacgcgcttcgcctacaagatcctgtccaaggtgtttaatttcgaccacagcgaagtcgccgccaatccggtgcatctgctgtacgtgatcgagcagcaggtcgagcgcgagcagttcccggccgaaaccgaacagaagtacctgaccttcctgaaggagtatctggcgcccaagtacgtcgagttcatcggcaaggaaatccagaccgcctatctggaaagctattccgagtacgggcagaacatcttcgaccgctacgtgaccttcgccgactactggatccaggatcaggaataccgcgatcaggacaccggcgaaatcttcgaccgcacctcgctgaacgcggagctggaaaagatcgagaaacccgccgggatctccaaccccaaggacttccgcaacgaaatcgtcaacttcgtgctgcgggcccgggccaacaacggcggcaagaacccgacctggaccagctacgagaagctgcgcacggtgatagagaagaaaatgttctccaacaccgaagagctgctgccggtgatttccttcaatgccaaggccagcgccgaggacgccaagaagcacgaggacttcgtcaaccgcatggtggaaaagggctataccgccaagcaggtgcgcctgctgtgcgaatggtatctgcgggtgcgcaagtcctcataa

SEQ ID NO: 1913 - DNA, 159 bp, Chromobacterium substugae
gtgggacatagccacctctcttgcgcgcagccgcgggcggccggttccgttccgaaacccgccgcccgacgccgcgcgcggttgtgtctccttgtcgaccggcgtcaaccgccggacatcgccaacccgcccgctccaatcggagcgagcggttcatga

SEQ ID NO: 1914 - DNA, 1281 bp, Chromobacterium substugae
atgtcccacatcatagacagacgcctcaacggcaagaacaagtcggcggtcaatcgcgaacgctttcttcgccgtttcaaggcgcaaatcaaggaagccgtctccaaggcgatcaagggacggagcattaccgatatcgaaagcggggaaaaggtctcgataccggtcaaggatatttccgaacccaatttccatcatggcaagggcggggtgtgggagaacatccacccgggcaatgaggaattcatcaagggcgaccgcatcccgcggccgcagggcggagcgggcggcgggggcagcaaggccagccaggacggcgagggcgaggacgatttcgtgttccagctgtcgcgcgaagaattcatgaacgtgttcttcgatgatctggcgctgcccaatctgatcaagacccagctgatgggaatcgaggagctgaaaaccgtgcgcgccggctacaccaacgacggcacgccggccaacatcaatatcgtccgctcgctgcgcggcgcgctggcgcggcgggtggcgatggcggcgcccaccttgtcgagcctggacgacgccgaggaagagctggacacgcttatcgagtcggacgacgacaacgcgctggatgtccgcgaaaagcgccagcgcatccaccagatgcgcgagcgcctggccagcatccccttcatcgatcccttcgacttgcgctacaacaaccgggtcaagcaacccaagccgacaagccaggcggtgatgttctgcatcatggatgtgtccggctcgatggatgagcagaaaaaggacatggccaagcgtttcttcatcctgttgtacatgttcctgcagcgcaattacgaaaagatcgaggtggtgttcatccgccaccataccagcgcggttgaagtcaacgagcaggactttttccactcgcgcgagagcggcggcacggtggtgtcgtcggcgctcaacctgatgagcgacgtcatccgcaagcgctatgccagcagcgagtggaacatctacgccgcccaggcatccgacggcgacaactgggacagcgattccgccaactgcggccgcatcctggaggagaacctgctgccgtactgccagtacttcgcctacatcgagatcaccgagggcgagccgcaaaacctgtggtacgagtacctgaaggtcaagtcgcaatgcccgcagttcgcgatgcagaaaatccgctcggcgtcggacatctacccggtgttccgggagttgttcaagcgccagccagccaatggaagggtcggcacatga

SEQ ID NO: 1915 - DNA, 1548 bp, Chromobacterium substugae
atgaaacggactcgcaagggggaagaggaggtcggcaagccgatttccaccggttcggaatggactttcgacctgataggcgaatacgaccggcagatccgcaccatcgcggtggacgaattcaagctggacgtctaccccaatcagcttgaggtgatcaccgccgagcagatgatggacgcctacgcctcggtcggcatgccggtcaactaccaccactggagctacggcaagcatttcgtctccaccgagaaaagctacaagcgcggccagatggggctggcctacgaaatcgtcatcaattccaacccctgcatcgcctatctgatggaggaaaactccatgatgatgcaggcgctggtgatcgcccacgccgcttacggccacaacagtttcttcaagggcaattacctgttccgctcctggaccgacgcgtcggccatcatcgattacctggtgttcgccaaaagctatatcagcaagtgcgaggagcgctacggcatagacgaggtggaggagctgctggactcctgccatgcgctgatgaactacggcgtcgaccgctacaagcggccgcagaaactgtcgctggccaaagagcaggcgcggcaggaggagcgcgagcaatacctgcagatgcaggtgaacgacctgtggcgcacgataccgaagcgcgacaaggacgacagcggcaagccggcgtcgcgcttcccgctggagccgcaggaaaacctgctgtacttcatcgagaaatcggcgccgttgctggaaccctggcagcgcgaggtggtgcgcatcgtgcgcaaggtcgcccagtatttctatccgcagcgccagacccaggtgatgaacgaaggctgggccaccttctggcactacaccatcatgaaccggctgtacgacaagggcctgatcaccgacggctacatgctggagtttctgcagagccacaccaatgtggtgacgcagccgccggtgacggcgcgctggtacaacggcatcaatccctacgcgctgggtttcgccatgtatcaggatatcaagcgcatttgcgaggcccccaccgacgaggaccgcgcctggttcccggaccttgccggcagcgactggcgcgagtcgctggagttcgcgatgcgcaatttcaaggacgaaagcttcatctcgcagtatctgtcgccgaagttgatccgcgatttccgctttttcgccatccgcgacgacgacaaggacgacaagctggagatttccagcatccacgacgaagaaggctaccgtgatatccgcggcaagttggccgagcagtacaacctgggttcgcgcgaacccaatatccaggtgtggtcggtcaatgtgcgcggcgaccgcagcctgacgctgcgccacgtgatgcacaacaggcggccgctggaagaccaaagcgcccaggaggtgctcaagcacgtctgccggctgtggggcttcgatgtgaagctggaaagcgtggacggcaacggcgaggtcaagcagtcgtacgaggttcaggcggtcagggatccggagatggcctga

SEQ ID NO: 1916 - DNA, 468 bp, Chromobacterium substugae
atgccgctgcttgccgctttgcaatcgcttcccaaccagttctgtggcgaaggcatcaaccacgaggaccagaccttcaccggctgcctgcactggcaggcgctgcccggccaaagagccctgctgctgcactacacagccagcggcaccagcggcgatgtgctgcaccgcgaaaccaccctgctgggctacctgccggacggcacgctatgcctgtggccggtgatggaagagcttcccttcgtcttgccccaccctgcggtgcgcctggccgagggcgcccacggcacgctggaagtggtgttcgccagcgcgccgcgcagtctgaccgagcaattccgccaggaaatcaccattcggctggaagccaatggccagatgcaatacacccatggctggggcctgcccaactgcagtttcgaagaccgctcgcgctgcagcctgacgcccgtcgccggcaccgcctga

SEQ ID NO: 1917 - DNA, 777 bp, Chromobacterium substugae
ttgaccctccgccgcaacggccggcttttgcttcaggacatcagcctggcgctgcgcccgggcgagctgctgatcgcgctgggccccaacggcgccggcaagagcagcctgctcaagctgctgtctggcctgtggcggcccgattccggcgcgatccacctggccggcgaaaatctggatgatctgccggccgccgcgcaagccggctggcgcgcggtggtcgagcagcatccggtgacgcccgccggctggaccggcgccgagctggtcgccgccggcgcctaccgctatccccgcctgccttcgcggcagattcgcgaagccatttcggaagcgctggcgctgaccggcgccgaacgactggcggcgcgcagcctgaacgaattatccggcggcgagctgcagcgcctgcaactggcgcgcgccttgtgccagttgctgctctctcccgaaaccgagcgctatttgctgctggacgagcccaccgcggcgctggacttcggactggccgacgaattgatggcgcaggtccgccagctatgccaccgcctgcaaataggcggcctggccgtgatccacgacctcaacctggcgctgcgccacgccgacaaggtgttgctgctcaacaatggccaggcggccggctacggcgacaaccaggagatgatgcggcgcgagcggctggaagcggtatacggcgtcagactggcggagctgagccacccagaacagccatggcgggccttcatccccctgcccgacagcccgcaacgctga

SEQ ID NO: 1918 - DNA, 966 bp, Chromobacterium substugae
atgcgcgcgctcacgctgaccctcactctgctgctcctgctcgcgctgacgtccatcgcgtccctgctccatcacagccatctgctgctcgccagtttgtggcggctgcagcctcagccggcgctggaatggcaattgctggtggagttgcgcctgccccggctgctggcctcggccggcgccggcgccctgctggccagcgccggcgcggcgatgcaggcgcgctttcgcaatccgctggccgagcccggcctgataggcgtcaacagcggcgcggcgctggcatcggcgctggcgctcagcctgggcgccggcctgtacggggtcgccgcctcggccttcggcggcggcatggcggccctgctgctggtgcgcctcctgggcgccgatcaggacggcaaccggctgatcttgagcggactggcggtcagcaccctgctcggcagcctgctgaccctgctgatcaccatgctgcccgacggctcgctgcgcatcgtcaccttctggctgatgggcagcttcgccagcgtggagtggccgcaagcgctattgatgctgctggccgcgccgctggtctggctggccctgttccgccagtggcgctttctcaacgcgctgcagctgggggaaagcacggccttccacctgggcttcgccgtgcgccggctggagtggcgcatcgtgatgctggcggcgctggccaccggcctggtggtgtccggctgcggcatgataggcttcatcggcctgatggcgccgcacctggcccgccagctgctgggcagcgattcgcgccgcttgctgctggccgcgccgctcttgggcgcctggctggccgtctcgtccgattggctggcgcgcggcttgctcgcgccggcggagttgccggtcggcgtgatcaccagcttgctgggcgcgccgtttttcctgtggctgctgcgccggcaggagcgccgccatgcttga

SEQ ID NO: 1919 - DNA, 804 bp, Chromobacterium substugae
atgagccaaaacatcgtcatcgtaggcgcatccggccgcatgggccgcgtgctgatcgaatcggtgttgagcgcccccggcgcgcgcctgcacgcggcgatagaacgctccgactccggcttcgtcggccaggacgccggcctgttctgcggccgcgccagcggcgtcaagatcacttccgacttcatcgccgcgctggaaggcgccgacgtggtgatagacttcacccgcccggaaggcacgctggaacacatgatggcctgcgtcgagcaccaggtgcagatgatcatcggcaccaccggcttcgacgacgccggcaaggccgccatccgcgccgcggccgacaagatagccatcgtgttcgcctccaacttcagcataggcgtcaacctcaccttcaaactgctggacatggccgcccgggtgctgaacgaaggctacgacatagaaatcaccgaagcccaccaccgcttcaaggtggacgccccgtccggcaccgccttgcggatgggcgaagtgatcgccgacgcgctgggccgcgacctgaagcaatgcgcggtctatggccgcgaaggcgtgaccggcgagcgcgaccccaatgccatcggcttcgccaccgtgcgcggcggcgacatcgtcggcgaccacaccgcgctgttcgccacgctgggcgaacgggtggaaatcagccacaaggcctccagccgcgccaccttcgccaatggcgcggtgcgcgccgcgcgctggctgtcggacaagccgcacggcctgttcgacatgcaggacgtgctgggcctgcgctga

SEQ ID NO: 1920 - DNA, 384 bp, Chromobacterium substugae
atgcgcgccctgattttcgccgccgtcatcgccgtctccggctgcagttccataaatccgcttgactggacccacaaggtggaaatccagcagggcaactacgtgacccaggacgccgtcgccaagctgaagccgggcatgacccgctcgcaagtgcgcttcctgctgggcactccgctgctgaccgacgccttccatgccgaccgctgggactacaagtatagcgacaccaagcaaggccggctggaaacctccagcgacaagctgctgaccgtttacttcaagggcgacgtgctcgaccgcgtcgaaggcgccgcccagcccgccccgccggccaagcaactggacgcctcgatgccggcgcaggagacgaaacagccatga

SEQ ID NO: 1921 - DNA, 432 bp, Chromobacterium substugae
atgagcaaagccagtcacctcaaagatatcggcctgaaagccaccggtccgcgcctgaaaatcctcgacttgttcgaggaggcggactccggtcacatgtccgccgaagacgtttaccgcaagcttctggcggagaacatcgacatcggtctcgccaccatttaccgggtgctgacccagttcgagcaggccggcatcctggtgcgccaccatttcgaaaccggcaaggcggtgtacgagctgaaccagggcggccaccatgatcacatggtctgcgtcagctgcagcaaggtggtggagttcttcgatccagagatcgaggcgctgcaggaccgcatcgccgagcagcatggtttccgcatcgtcgaccacgcgctgtacatgtacggcgagtgcccggactgcctggccaagggcggccgccgcggatga

SEQ ID NO: 1922 - DNA, 702 bp, Chromobacterium substugae
atgattccctggctcggtcccgagcctgtcttcccgccggtggcgcaggccttgagtcatcccaacggcctgctggccgccggcggcgatttgtcgcccaggcgcatccttagcgcctactccgaaggcattttcccctggttttccctgggcgagcccattttatggtggtcgcccgccccgcgcatggtgctgtatccgtcgcggctgagggtcagccgttcgctggccaaggcgctgcgtcgtcccgattacgaaattcgcaccgatcaggcctttttcgaggtgatggaagcctgctcccagcctcgggcgggccaggacggcacctggatcgtgccggaaatggtggctgcctactgccggctgcatcagcttggctacgcgcacagtttcgaaacctggatcgacggcgagttggccggcggcctgtacggcgtggcgatcggcaggatgttctacggagagtcgatgttcgcgcgccgcaccgacgcctccaagctggccttcgtgcacatggtgcggcacctggccacgcaaggcgtggaaatgatcgactgccagatgcataccgcgcatctggaaagcctgggcgcctgcctggtgccgcgcgatgtttttcttgctactctgaaggagaagatccggcagccgcagcccggccaaatgtgggactatcattaccgccatgagtcatcgtga

SEQ ID NO: 1923 - DNA, 732 bp, Chromobacterium substugae
atgagtcatcgtgaagccggccaggtcgcggccatccatttctacgccactgcgccttatccctgcagctacctgtcgggccatcaggcgcgttcccaggtagccattcccgccgaggcgatagacggcggggtgtatagccagctggtgcggctgggcttccgccgcagcgggctctatacctatcgtccgtattgcgacgcctgccaggcctgcatcccggtgcgattggcggtcgaccagttccagcccaatcgcactcagcgcaaggtgtggcggcgcggcggcgaactgacggtcgagtggctgccgctggctttcgacgccgagcactacgcgttgtaccggctttaccagcaggcgcgccatgccggcggcggcatgtctgacgacgatgcccagcagtacgccgaattcatactgaaaagcggtgtggacagccatctggccgagtttcggctggagggggcgttgaagatggtcagcctggtggaccggctggcggatggcttgtcggcggtctacaccttttacgatccggccgacgcccagatgagtctgggcgtgtacaacgtgctgtggcaggtggagcaggccagagcgatgggtttgagctatctctatctgggttactggatcgccgattgccgcaagatggcttataaggccggctatcgtccgctgcagatgctgcacggcggccgctggcagacgatgccggagccgagctag

SEQ ID NO: 1924 - DNA, 465 bp, Chromobacterium substugae
atgaagacaactactctcagccgcatcaccgtcatcgccttgctgagcgtcggcgcgctcagcggatgcgccacctcggactccgccgcggtgtattccaaaagccagatgcgccaggcgcagaccgtgcagttcggcacggtggtttcggtgcagaacgtcaagatggaaggccagaacaatgaactgctgaccctgggcggcgccgcgctgggcgggctggccggcagcaatatcggcggcggcaagggccagatcgccggcggcatcgtcggcgcgctggccggcggctacggcgccaaggccgcccaggaagcgctgggcaagaacgcgctggaaatcaccgtcaagctggattccggccgggtggtgtccatcgtgcaggaagccgacattcccttcgtcgccaaccagcgcgtgaagctgctgagcggcggcggcaacgaccgcgtcgtgccgtactga

SEQ ID NO: 1925 - DNA, 1041 bp, Chromobacterium substugae
atgctgtacccgctgctgcgcccgctgttgttcaagttcgacgcggaaaccgcccatgaacacacgctgaagatgctggatcgcgcgcaccggctgcacctgggctcgctggcgggctcgcccgccgccggccacccggtgcaggcgatgggcctgaccttccccaatccggtcggcctggccgccggcctggacaagaacggcgcccacgtcgacgcgctagcggatctgggcttcggcttcatcgaaatcggcaccatcaccccgcgcccgcaagacggcaatcccaagccgcgcctgttccgcctgccggagcacgaagccatcatcaatcggatgggcttcaacaacctcggcgtagccgcgctgctggacaatgtgcgccgctgcaaattcaagggcgtgctcggcatcaacatcggcaagaacgcgatcaccccgatagaaaacgcggtcgacgactacctggcctgcctggatcaggtatacgctgccgccagctacgtcaccgtcaacatctcctcccccaacaccaaaaacctgcgccagctgcagcagggcaacgaactgggcaagctgctggccgcgctcaagcgccgccagagcgagctggcggaccggcacggccgccatgtaccgctggcggtgaagatcgcgcccgatctcgacgacgagcagatcgcagagatcgcccgcctgctgatcggcaacggcatcgacggcgtcatcgccaccaacaccacgctgtcgcggcgtgagatcgccggccatccgctggaaaacgaggccggcggcctgtcgggcgcgccggtgcgcagccgctccaccgcgctgatccgcaaactggccaaggaacttgacggcgctctgcctatcataggagtgggcggcatcctttccggcagcgatgccgtggaaaaactggaagccggcgccagcctggtgcagctgtacagcggcctgatataccgcgggccggaactggtcggcgaatgcgcccgggcggcggcgcaatacctgcaagctcgcacacgagaatga

SEQ ID NO: 1926 - DNA, 591 bp, Chromobacterium substugae
atgagcactcccctctctcatgccacgctggaacagctgttcctgaacgctcgcacccacagccactggcaggctcgcccggttggcgacgacctgctacgccagctgttcgacctgctcaagcactgcccgaccagcgccaactgctcgccggcgcgcttcgtcttcgtcaagagcccggaagcgaaagccaagctcaagccctgcctggccgaaggcaatgtcgacaagaccatgtccgcgccggtatgcgtgatcgtcgcccaagacatgaaattctacgagcaactgcccaagctgttcccgcatgccgacgccaagagctggttcgaaggcaacgacgcgctgatccagaccaccgccttccgcaacggcacgctgcaaggcgcctacctgatcctggccgcccgctcgctgggcctggactgcggcccgatgtcgggcttcgacaacgccgcggtggatgccgccttcttccccgaaggcaacgtcaagtccaacttcctgatcaacttgggctacggcgaagccgacaagctgttcccgcgctcgccgcgcttcgatttcgccgacgcctgccagatcctgtaa

SEQ ID NO: 1927 - DNA, 804 bp, Chromobacterium substugae
atggcatccaggcgcaaacgacatgaagacgagcacgaaaaccacgaacgctggctggtttcgtacgccgacttcatcacgctgctgttcgcgttcttcgtggtgatgtacgccatctcctcgctgaacgagggcaagtaccgggtgatgtcctcggccatcatggatgccttccgcagcggcaccctggtcacagtgcaaacttccccgcccaatggcggagccaacaccatgattgagattccgcaaaccaagcccatctccaaaagcatcaaggccgaccaccatgtggaagaagccgccaagctcggccagctgacgcagaacctggccaaggtgctgggaccgctggtgcaaagcggcgaagtcaccatcacccagagcgaccagggcatcaacatcgatatccgcgacagcgcgctgttcgccgtcggccaggcggtgcccaatcagcagtcgctgccgctgatgtccagcatggccaagctgctggccggcgtcgacaattccatcaaggtggaaggcttcaccgacgacgtgccgatccgcaccccgtccttcccgtccaactgggaactgtccgccgcgcgcgccggcggcgtggtgcggctgttccaggaaaacggcatcaatgcccaaagaatggtggcggtcggccacggcgccaacctggccgtcgccgacaacgccaccgcggaaggccgcgcccgcaatcgccgcgtcaccatttcggtgcaagccaacgatgccggcgcacccgaagcgcagacaacaccccccactgcaaccgaggtaaaaccatga

SEQ ID NO: 1928 - DNA, 360 bp, Chromobacterium substugae
atggctgctgccgcgcctaggctgatctgcccgtccgccgagctgctggacagcggccccgcccaccgctttgaaatcgaacaagccgatggcagccgcctgcccgccttcgccgtccgttaccgcggcaaggtccacgcctatatcaaccgctgctgccacattccggtggagctcgacctggaagacggcaagctgttcgacctgaccggccactatctgatctgcagcatgcacggcgcccgctaccaccccgacaacggctattgcagctgggggccatgccgcggccaatcgctcgccaggctggaagtcattgaacaaaacggccaagtctggctgaatgtcatgcctgactga

SEQ ID NO: 1929 - DNA, 654 bp, Chromobacterium substugae
atgcgagagttcgacctggtggtgttcgactgggatggcacgctgatggattcgaccggccacatcgtccacgccatccagcaagcctgccgcgatctggacctgccggtccccggccgcgaggccgccagccacgtgataggcctgcggctggacgacgccctgctgcgcgcctgcccggcggccggcgcccgcctgcccgaactgaccgccgcctttcgccgccgctaccaggcggggctggagcgggtgacgctgttcgaacacgcccagtccacgctgcaagccatccgggccgccggcatcttcgtcgccatcgccaccggcagcagccgcgccggcctcgaccgcgcgctgcaggccgccggcatccaggacctgttcgatgccacccgcaccgtcgacgagtgccattccaaaccgcacccggacatgctgttccagttgaccgactacttcggcgtggcctgcggccgcgcgctgatggtgggcgacaccagccacgacctgctgatggcccgcaacgccggcagcgtaggcgtcggcatcagccacggcgcgcacgcggacgaagaactgctccgctgccagcccgccgccctcgtccactcgctgccggagctgagctcatggctgctgccgcgcctaggctga

SEQ ID NO: 1930 - DNA, 939 bp, Chromobacterium substugae
atgacagacattcgcaaagattccgtaaccttccttgaagtcgacgcagaagatgccggccagcggctggacaactacctgcagcgcctgctcaagggcgtgcccaaaagccatatctaccgcattctgcgctccggcgaggtgcgggtgaacaagggccgggcggacgccagctaccgcgtggcggccggcgacacgctgcgcatcccgccgatccgcgtcgccgagcgcgccgagaaaaacgtgcccgccgccaccttcccggtggtgtacgaagacgatgcgatgctggtgatcaacaagccggccggcgtggcggtgcacggcggcagcggcgtgtctttcggcgtgatcgaacaacttcgccaggcccacccggagtggcgctacctggagctggtgcaccggctggaccgcgagacctccggcctcctgatgctggccaagaagcgctcggcgctgacccgcctgcacgacatgatgcgcgacaatgtgcccgacaagcgctacctggccctgggcgccggccactggccggaaaacatcaagcaggtgaagctgccgctgttcaaattccacaccgccgacggcgagcgccgcgtcaagatcgccgaaggcgacgacggccagtacgcgcacaccaacttcgccatccagcagcgctacactgaattcacgctggtggaagcgcatctgcgcaccggccgcacccaccagatacgggtgcacatgcaagccaacggctgcgcgatcgccggcgacgagaaatacggcgacttcgcgctcaacaaggagctggcgcgccgcggcctgaagcggatgttcctgcacgcgaaaagcctggcgctgccgcacccattgaccggcgcgccgctgaagctggaggcgccgctgccgccagaattggcgaaattcctgaaaaccctggagccgcgctga

SEQ ID NO: 1931 - DNA, 2922 bp, Chromobacterium substugae
atgaaacgcatgttgttcaacgcgacgcaagccgaagagctgcgcgtcgccatcgtcgatggacaaaagctcgtcgaccttgatatcgaaaccgtaggcaaggaacagcgcaagggcaatatctacaagggtatcatcacccgcatcgagccctcgctggaagcctgcttcgtcgattacggcacggaacgccacggcttcctgccgttcaaggaagtgtcccgctcctatttccagggctatgacggcggccgtccgcgcattcaggacgtgctgcgcgaaggcatggaagtggtggtgcaggtggagaaggacgagcgcggcaacaagggcgcggcgttgaccacctacatcagcctggccggccgctacttggtgctgatgcccaacaacccgcgcggcggcggcgtatcgcgccgcatcgagggcgaggagcgccaggagctgaaggatctgctgtcgcagctggaagtgccgcacggcatgagcctgatcgcccgcaccgccggcatcggccgcaatctggaagagctgcagtgggacctgggttacctgatgcagctgtggcgcgcgattgaaggcgcggccggcgcgcagtccgctcccttcctgattctgcaggaaggcagcctggtgatccgcgcgatccgcgactacttccatccggacatcggcgaagtgctgatcgacaccgaggaaatccacgaccaggcccgccagttcatgagccatgtgatgccgaacatgctgtcgcgtgtgaagctgtacaaggaccatgtgccgctgttctcccgcttccagatcgaacaccagatcgaaaccgcgttctcgcgcagcgtgcagctgccgtccggcggcgccatcgtgatcgaccataccgaggcgctggtgtcggtggacgtcaactcggcgcgcgccaccaagggcgcggacatcgaggaaaccgccgtccgcaccaacctggaagccgcggaagagatcgcccgccagctgcgcctgcgcgacctgggcggactggtggtgatcgacttcatcgacatggaaaacgccaagaaccagcgcgacgtggaaaaccgcctgcgcgatgttctgaagcatgaccgcgcccgcgtgcagatgggcaagctgtcccgcttcggcctgctggagctgtcgcgtcagcgcctgcagccttccctgggcgagaccagccacgagccatgtccgcgttgccacggcatcggcttcatccgcggcaccgaatcgtcggcgctgcacatcctgcgcatcatccaggaagaggcgatgaaggaaaacaccggcgcggtgcacgcgcaggtgccggtcgatgtggccaccttcctgctgaacgaaaagcgcgccgagatccactcgatcgaagagcgtctggacgtcgacgtggtgctgatcccgaacatccatctggaaaccccgcactacaagatcgtgcgcgtgcgccacgacgatctggccgaactgggcgaagcgccgagctacagccgcgtcgaagtgcaggaagaggatgtgatcaccaacttcggccaggaaaagccgaaggtggagcgccaggaagccgcggtcaagggcatcaccccgcaacagccggctccgaccgccgcgccggcagccgccaagcagccggctgccgaggcgggcctgttctccggactggtgtcgtggttcaagggcctgttcgccgaaccggaaaaggcgcccgagccggaagccaagaagaagccggcggcggcgcgcgagcagcgcggcaaccgccagcgcagccaggagcgccgcaccggcggccaggcgcgtcgcgagcacgagcagcgccgcggctccccgcaggatgagggccgccagcgtcgccaggacgagcgcggcgagcgcaaggacgccgagcgcagcgaacgcgccgatcgcgctgaacgcaaggatccggccggccgcgaagcacgcgaagagcgcaacgagcaggcgcgcgaaccgcgcggcaaccgccgccgcgaacgcgaaggccgcgaaccgcgcgaagcccgcgagccgcgtgaacagcagccgcgcgaagagcgtgtgagcgacaaggccgagaagcaggacaagccggaaccgcgtcgtcgccaggcgccggccgccgcgccgcaggaagccgaaaagccggtgcaggacgaattgcgcctggataccgaagccgagcaggcggagcaggccgagcagcaggagcgcggcgaacgccgtcgccgccgcagccgccgcgatcgtcgccgcgacacgccggaaggcgccgtggcagaagcgggcgcggaagcgccggcagctgacgccgccgaggcggtggttgtcgccgcagtggccgctgaggtggttgccgaagccgcccagccggcggttgagccggaggccaaaccggtagtcgaagccgtgactgagccgcaggtggaggcggttgtggaggccgtggcggttgtcgagccggaagccaagccggtggagccggtagtcgttgccgaacctgcagctgcggtgtttgttgaagccaaggttgacgcggcggcggcgcccgctgttgtggaaccggttgaggcccgagccgagcccgaagccgttccggtggccgagcctgtgtcggaagccgtggtgatggcggcagttgtcgaggaggagccgcaagcggccgagccggtggcggttgctgtcgagccggtcgtcgaagccgagccgatcgtggtggaagccaagccggtggaagccaagcccatggatctgggcggcctggtgatggttgcgaccaagccggttgccgagcattcggcagtgcttgagccggaactgccgcaaggcccgcgtcgccgcgacatggcggctggcatcgatgccgctgcgcaggccccgatggagctggttcaggtggaaacccgcaacaactga

SEQ ID NO: 1932 - DNA, 73 bp, Chromobacterium substugae; identical to SEQ ID NO: 1506

SEQ ID NO: 1933 - DNA, 1419 bp, Chromobacterium substugae
atgccccgcgccatcgtgctcaatgtcgtaggactgacgcccaaactgctgcgcttcgccccggcgctgcgccagttggccgaggacggctgcatgcggcccttggccaccgttacccccgcgctgacctgcccggcgcaagccaccttcctcaccggcgcgccgcccaggcagcacggctgcgtcgccaatggctggtactcgcgcgaattggccgagccgttgttctggaaacagaacaacgcgctgatccagggcgagaaaatatggcacgaggcgcgccggcgccatgccgacttcagctgcgcgcagctgttctggtggtacaacatgtacgccgacgtggaatggagcgtcacgccgcgcccgatctacaaggccgatggccgcaagatccccgatttctacagcgcgcccgccgaactgcaccaagaattgcgcgaccggctgggcgattttccgctgttccatttctggggccccgccagcgacatccgctccagccgctggatcgccgattgtgcgctgcacctgtatcgcagccgccacccgaaactgacgctggtctacctgccccacctggactacagcctgcaaaagctggggccggaccatccgcagatcgcccgcgaagtggcggcggtggaccagctgtgcgcagagctgatagcagccgcgcgccgcgacggcacgcgcatcctggcgctgtccgaatacggcatcacccaggtgcgcggtgacatcgccatcaatcgggcgctgcggcaggcaggctggctgcaggtcagggaagaacaaggcgaagacaagctggattgcggcgcgtcggcggcattcgcgctggccgaccatcaagtcgcccatgtctatgtccgccggccggagctggtcggggaggtcaaggcactgctgcaacaactggatggcgtggagatggtgctggacgaggccggcaagaagctgtacggcctcaatcacccgcgctcaggcgagctggttgccatcagccgggccgaccgctggttcagctattactattggctggacgaagccaaggcgccggacttcgcgcgcaccgtcgacatccaccgcaagccaggctacgacccggtggagttgttcctcgacccgcagttggctctgcccaagctgcgcatcgcctggacgctgttgaagcgcaagctgggacagcgcagcctgctggaggtggtttcgctggatggctcgctggtgaaaggctcgcacggcaggccgacggactctcccgacgacggcccgctgctgatcagctccgaagccggcagcctggcggacggcatgctgcccgcctccgcggtgcgcgacatcatgctggcgcatctcgatccaaacccggcgccgtcgcgccagggcaacagcgcgccggccaccgctggttga

SEQ ID NO: 1934 - DNA, 888 bp, Chromobacterium substugae
atgtttgatccccacatccatatgagctcccgcaccaccgacgactaccaggcgatgcgccgcgaaggcatacacgccatcgtcgaacccgcgttctggatgggacagccgcgcacccacatcggcactttcgaggactatttcctgtccttgctcggctgggagcggtttcgcgccagccagttcggcatccgccatttctgcacgctgggactcaaccccaaggaaaccaacaacccggacatcgccgacggcgtgatcgcgctgttggaccgctatctggacaaggacggcgtggtggcggtgggggaaatcggcttcgacgacgaaaccgcggccgaggagcattacttccagctgcagttggaactggcggtcaagcacgaattgccagtgctggtgcacaccccgcaccgcgacaagaaggccggcaccatccgcagcctggccctggtgcgcgacagcggcatccccgaagagcgggtgctgatcgaccacaacaccgaggaaaccctgccactggtgctggacagcggctgctgggccggccactccatctaccccaacaccaagatgagcgaacccaggatggtagcgctggtgcagcaatacggcagcgaacgcatcatcatcaacagcgccgccgactggggcatcagcgatccgctcaaggtgcccaagaccgtcgcggcattccgcgcggccggcatcgccgagcgcgacatcgaaaccatagtctggcgcaatcccatccgcttcttcgcgcaaagcggcaagctggacatcgccgaagccgaagccagcctcgatgtggaccagcgccagcaatggcagggcaactcggtgttgcgcggccagcagccgcaagtcgacaccctggaccaatag

SEQ ID NO: 1935 - DNA, 690 bp, Chromobacterium substugae
atgctgaaaaacctgatccagctgcacatccggcaatcggccgaactccccgccgcgccggctgcgcggcaatggctggaacaactccccgccgcgctggcggcgcttccggatgccgccgcgctgcagcggctttacagcaccgccgcccgcagcctgcagccgctgtcccagctgccccggcaactgcagccggagctggagcgcgccggcgccatcgcgccgctggattggcggcctggcgacatcggccggctgctgttgctgctgtccctgccagaatcacgcgacgggcaggcgcatccctgcttcgcgcgcctgtatcgcggcggcgacgccggcgaacagcaaagcctgttgcgcgcgctgccgctgctgccggcgccggagcggcacctacccctggccattgacgcctgccgcagccacatccagggctgtttcgaggccatcgcctgcgaaaacggctacccggcgcgcttcttccccgagctcaacttcaaccagatggtcctgaaggcgctattcacccgcacgccgctgtcgcgcatccacgggctgcgacacaggctgaccccgcagctgcgccgcatggcggccgatctggccagcgaacgccaagccacccaggccgacataccagacgacgtatacctgatcctgaaaggaagccgccatgaaaatgtttga

SEQ ID NO: 1936 - DNA, 852 bp, Chromobacterium substugae
atgagcgattggcgcgtttttctgaaattgggtcgggtatccaacctgccgacggtgtggagcaatgtcgccgccggcgccgtgctgtccggccagccgccctccccccccacgctgctgatcctgctgctggcattgtcgctgatctacaccgccggcatgttcctcaatgacgcatttgatcgccgcatcgaccagctggagcggcccgaacggcccattccctccgggcaggtttccgccgccgcggtgttcgcggccggcttcgccatgctgggcgcgggcgtgctgctactggcagccatgggcaggccggcgctgctggccgggctgttgctggccggcctggtcctgctgtacgacctgcatcacaagggcaatgccttcagtccgctgctgatgggcctctgccgcgcgctggtctacatcgctgccgcgctggccgtgaccggcggccagctgccgccgccggtctggctgggcgccggcgcgttgctcgcctacctgatcggcctcacctacgccgccaagcacgaacaaagcggccgcatccaacgcctgctcccgctgctgggcctggccgcgccgctgctgtacctgccgacgcagccgccaaactggctgctgctgccaggcctggcgctatttgtcgcctgggtgggccgctgcgtatggctggcgatgtttcgcaaccagcgcgacatccgcgccgccgtcggcggcctgatcgccggcatctcgctggccgacgcgctgctgatggcatcgcacggcatggcagcctgggcgctggctggcgcgctcgccttcctgctcaccacccagttccagcaacgcatcgccggcacctga

SEQ ID NO: 1937 - DNA, 1215 bp, Chromobacterium substugae
atgaggctggccacgacagcctcgccggccatcgagctgggccacctgtgctattgcaccaacatccaccccgcggaaagctgggacgaaacccgcgcggcgctgggcaagcatctgccggcgatcaaggcccaggtctctccgctgcaaccgttcggcgtcgggctgcggctgtcggcgctggccgcgcggcaattggaaacgcaagccggcctgctgccggaattcctgcagttcctggcgcgccaccagctgtacgtgttcacgctgaacggtttcccctatggccgcttccacggccccggcgccaagcgccaggtctatctgcccgactggcgccatccggaacggctggagtacagcgacaggctggcgcggctgctcagccatctgctgccccccgacatcgacggcagcatcagcacgctgcccggcgcgtacgccgcccatttgcggcagcctgatcaagaattgccgctgatcgcggaccatctgctgcggcatgccgccactctgcaccatctgcacatggaaagcggccgctgcatccgcctggcgctggagcctgagccggaatgcctgctggaaaccacgcgcgacgccatcctttttttccagcggcatctgctgacagcgtccgcgctgacgcgcctggccaacttatgccactgtccgcccggccatgcggaaaccttgctgcggcgccatcttggcgtctgcctggactgctgccacgccgccgtggagttcgaggacatcgaatccagcctggaccagctggccgccgccggcatcgccttggtcaaactgcaattgagcgtcggcctgaagctggccgatgtccagccgggccaccaggcgcagctgcaatcgttcgccgacgaccattacctgcaccaagtcgtccagcgcacccccgccgggctgcggcgcttcgacgatctgccggcggccctgtcccaactggagcaggcgcagggcgccgaatggcgcatccacttccatgtgccgctatgggcgcaacaactgggagacttctccagcacccaggactgcgtgcgccaggttctggccaggcaccgccggcaaagcctcaccagccacctggaagtggaaacctacagctggcacgtgctgcctcccggctttcgcgccggcaatctcgatgacgcgatctgccaggagctgtcatgggtcaaggagcaactgcaatga

SEQ ID NO: 1938 - DNA, 1215 bp, Chromobacterium substugae
atgcccgcactggacgacggctcgaaaaccaatggcatttcgcacgactcgatccgccaacgcttcagcgtttcctacgagtatcaggtgtggttcacccgcaagctgctgcagccggacaacccgacgctgcgcgacgccatctgccgggaggcgtcccacatccggcaccgcttcgtggtggtcatcgaccagggtgtggcccagcatcaccccagcctcgcgcaggatttccagcgctacgccgaccatcaccgcgactgcctgcagttggccgccgcgccgcgcgtgctgcccggcggcgaggcggtcaagaaccatccggtcatgctggaggcgctgcagcagtggctgcatgacgagcacatcgaccgccacagctacgttgtcatcgtcggcggcggcgcgctgctggacatggccggcttcgccgccgccaccgcccatcgcggcatccgcaccatccgcgttcccaccaccgtgctgtcgcaaaacgactccggcgtcggcgtcaaaaccgccgtcaacgccttcggcagcaagaatttcctcggctgtttcgccccgccttacgcggtgatcaacgattacgacttcatcgccaccctgccgatgcgcgcgcgcatttccggcatggccgaagcggtgaaggtggccgccatccgcgacatcgccttcttcaactggctacgggaacacgccgacgcgctgcgccggggcgatgacgatgcctgccagtggatgatacgccgctgcgccgaattgcatctgcagcacatcgccggcgccggcgacccgttcgagttcggcaacgcccggccactggacttcggccactgggcggcgcacaagctggaagccatgagccactaccagctcagccatggcgaagcggtggcgataggcatggcgttggacacctgctacgcggcgcagagcgggttgctgccgcaacaagccgccgcccagctgtgcctgctgctggagaaactgggcttcacgctgtggacgccgctgctggaacagcgcgacgcccaagggcagcttcaggttctggccggcctggacgagttccgcgagcatctgggcggcgaattgaccgtcactctgctgcaaaggctgggacacgggatagagatccaccagatggacaaatcgctgctggccagcagcataagctggctcaggcacggcatgcccgaggcctgcgcatga

SEQ ID NO: 1939 - DNA, 1113 bp, Chromobacterium substugae
atgaccaagcgcatacccgccttccagatcgacaaaaaattcatccagggcctgctcagcgccaccacgccggcgcaattgcatttctacctgcaaaaggcgatcgaactggagcacagcaccatcccgccctatctcaccgccatgctgtcgctgaaaccaggccaaaaccgcgaaatcggcaaactgatccacggcatcgtgatgcaagagatgctgcacatgaccatctccgccaatatcctgatcgccattggcggccatccgcgcatcaacacgccggacttcatcccgaattacccaggcccgctgccgatgggcatcgccgacggcctgatcgtcggcatcgaagccttcagcctcgacttgacgcgcaagaccttcatgggaattgaagagccgaccgacccgatcccggtacatgaaatgatcggactttacgcaaaaggccaggaaccggaattccacaccatcggcgagtactacgaaagcatcaagtacaagctggacgagttgagcggccagttgcaattcggccaattgccgcagcaagtgctgaactacttcccgccccaggtgctgttccccatcaccgacgtggacagcgccaagaaggcgatagacgtgatcatcacccagggcgaaggcaccagcgccagcccctatcagaatccgaacgctccggaaaaactggaggacctggcccactactacaaattcgaatccatcgccaacggccgcgaaatcacgccctgtcccgacggcaaaggctattgcttcggcggcaagcccattcctttcaatcaggacggcgtgtggccgatgccgcccacgcccaaaccggaggactacccggaaaacagccaggagcgcacgctgatcgaacgcttcgcctacagctacagcagcctgctcaacagcctgcaccaggccttcaacggcgagcctggccagatggacacggccatcggcctgatgttcgacctcaaggtgctgtcggccagcctgatgaacccttcaatgctgcttggctacgacaagggccagcccaagccgccgatcggactgagttttgtctaccgcgatgtgcaaaacggcatgagttacaactga

SEQ ID NO: 1940 - DNA, 2007 bp, Chromobacterium substugae
atgagctatctcgacgcgccgcgcatcaatttcaccggtgtattccaggcagacccctccaccgtcaacaacgacgtccgctactacgacaacgaagccttccgccccgaatatcagcgtcagcactacccggatggcggcccggaaggcgccgaaggctactggaatccggaaggcaccggcattttccgtttcatagaatgcaagatcaccggcgcccagctgggcgaccggctgctcacctgtccggaggaggatccggtgatcggtctgcgcgtggagaacgccgaccagcagccgccgggcaagatagtcgacctcgacccgcagatgcagtacgtctcgcaactatggggcgtgcaagtgcggctggccagcccgaccgagcgcgcgctcttctgcggcgacctgctgccggtgcccctgatgaacctctggcaacgccagctcaacgcacaaagccgttgggagcagccgatggccgccaactaccagtccatcctgcacgacgtcgactggagcggctgcgccgactccgccgtgctgctggccttgaaggaagccagcgaacaaggttgcctgtcgatcaacttcaacctgtacggctacacccgcgacaacaccagccaacgcttcaccatgggcctggtcagcggcagcatcggcccctaccaccgcgacgagcccaagcacttcgtgctgggccgccacctgaccacccccttgcaacccaccacgcccaatggcgcccccttcccgacccagccgctgggaggcgtgtacggttttcaatgcgtcaaccgtcccgagcagcaaaccctctatgcggatttcggcctggccctgccgatcaccgacgccaccggccagttgcacaatatcggcaccctgacgctggcgctggcgcgactggatgacgacaccgaccacatcccatccctcgtgaaatcgtcagagtttgtcccattgggcaccgtcgactacctgcaggaaggctggtacacccgcacggcgggcatccagggtttctgttacgcggccggcgagagcgacaaccaggcgacactggaaaacaagcaatacatcgccgcctatctgggacaaacgccgctgctgctgctgggcccccaacaaagcagcggcaaatacccggtgctgacttacgaagccatcgacggccagtacgcgcgggccgacggccacgtgttccggctgaatcccgacacgccgcagcaggtggatttctatgccagccagttcggcaagccgctggccaccaagctgcatgtctggcaattgccgcccggcaatcccaacagcaacccgatgggcggcaccggcatgtcgaacaattcgctgaccccgccggtggataccccgcatgtgggcttccccgaagccaatctgcaggtgcccgagcaactggaaaccgacttccacggcaagggctcgctgaccatctccgcgtcgccgccactgggcgaaacgccgcgcggctatatcgacggccagctgtatgcgctcagctacggcttccagccgccgccggacagctacgccgggaaaatggccaccgttccgggcgggccgtactgcgaatactggaatttcgtcagcctgttagccttcaacaagacggccattcccaagcaccccacctgggaacgggatatccaacccatcctgcagcaatacggcaacctgtatccgatcatgagccgccacctggtggatctgggcaactacgaatcggtgcgcgcccatcgccacgcgctgctgctggctttctcgctgccgccgaccgaccccaactacatgccggtgtcgcgcgacctgtccgacgccaacagagagatgctgctctcctggctcagcgccatggcgccgaagcaggcggaaaccacgccgccggaacccgaaatcgtcgagatagagttgcgggaaagcgcgatccgccagccgcggcccaccgcctccacatccttccgccagaaaacggccaagtag

SEQ ID NO: 1941 - DNA, 603 bp, Chromobacterium substugae
atggcttttctcgaatccctgaatcaatccctgttcctgctgatcaacgccacccccgaaacctccccgctggccatcaaggcggccaccctcgtcgccaaggacgtgatgctgctgctgccggtgttcctggcggccatctggctgtggggccggcccgcgctgcgcgataccgtgttgaaatcctgcctgctgacgctggtcgccctgctgggcaactggttgatcggcctggcctggccgcatccgcgcccgttcgcgatgccgatcggcaataccttcctgctgcacgacgccacgccgtcctttcccagcaatcacggcaccatcttcgccgtgatggccttatgctggtgtttcagcccggcgcgcggctggggctggctgctgagcctggccggcatcgccgtcgcctgggcgcgggtatttctcggcgtgcacttcccgctcgacatgctgggcgccctgctggtgtccatcttctggtacgctagcctgtcgccgttgtggtcgcgccgcgggacggccctgaccgaaacgctggaatccttgtaccgccagttgttggccaaaccgatcgccgccggcctgatcaggcgctaa

SEQ ID NO: 1942 - DNA, 1230 bp, Chromobacterium substugae
atgatgtcgccgggagctttcgtgccgcaatcttcctctctgctgtccgtcgccggccgtgcggctatcccgcgcggcgtctgggtgctgggctgcgtcagcctgctgatggacgtgtcgtccgagctggcccatagcctgctgccgctgtttctggccggcaccctgggcgtgcccgtgctggccatcggcctgatcgagggcgtggccgaggccaccgcgctgatctgcaaggtgttctccggcgcgctcagcgactggctgggcaaacgcaagccgctggtcttgctgggctacggcctggcggctttctccaagccgcttttccctcttgccgactccgcctccaccgtgctgttcgcgcgctttgtcgaccgcgtcggcaagggcgtgcgcggcgcgccgcgcgacgcgctgatcgccgacatcacgccgccggccatccgcggcgcggccttcggcctgcgccagagcatggacaccgtcggcgcggtgctgggcccgctgctggcgatcgcgctgatgtttgtttaccgcgacgacatccgcagcgcgctgtggtggtcgttgccgccggctttgctggcggtggccgccatttggctgtgggtgcgggagccggcggaacatggcgagaaaagagagcgcgcgcccatgctcaaccgggcggcgctgtcgcgattttccgcaggtttctggggcataaccgcgctgggcgcggtgttcacgctggcgcgcttcagcgaggccttcctggtgctgcgcggcgcccagttgggcttgccgctggcttgggcgccgctggtgatggtggcgatgtcggccagctacgcgctcagcgcttaccccttgggctggctgtcggaccgcgtcagccgcgcgcggctgctgcagttgtcgctgctgttgctgatcgcggcggacctggctttgggcgcggcctcgggtccggcgctgttgctggccggcgcgctgttgtggggcctgcatctgggctgcagccagggtttgctgtcggcgctggtggcgcagaccgcgccggcgggcctggccggatcggcattcggcctgttcaatctggtctgcggcctggcgaccttgctggccagcgtggtggccggcgccttgtggcaagaatggggtgcggcggcgactttccatggcggcgcggtattcgcggcggcggcgtggctgcttggcctggttttgcgtccgctgcgacagttctga

SEQ ID NO: 1943 - DNA, 1293 bp, Chromobacterium substugae
atgtctgaacgtgaagttaggttgtggccggagttcgtcaaggccctgaaacaggaagtggtgccggccctgggctgtaccgagccgatttcgctggcgctggccgccgcgctggcgacgcgcgagctgggcaagccgccggagcgcatcgacgcctgggtatcggccaacctgatgaagaacggcatgggcgtgactgtgcccggcaccggcaccgtcggcctgcctatcgccgccgcggtcggcgcgctgggcggcgacccggacggcaagctggaagtgttgaagagcctgaccgtcgagcaggtggccgccggcaagcagatgctggccgacggcaaagtgaagctgggcgtggcggcggtgcccaacatcctgtacgccgaagcctgtgtctggcacggcgacgagtgcgcccgcgtcgccatcgccgacgcccacaccaatgtgatcaggatcgagcgcaacggcgaggtgaagctgaagcgcgaagccgccgacgccaagccggtggaaagctacgagctgggcgacgccaccgcgcgcgacgtctatgagttcgcgctacgcgcgccgctggacagcatcgccttcatccacgacgcggcggtgctgaacagcgcgctggccgacgaaggcatgagcggcaagtacggcctgcacatcggcgccacgctgcagcggcagatcgaggccgggctgctgtcggaaggcctgctgtccaacatcctcacccgcaccaccgccgcgtccgacgcgcggatgggcggcgccacgctgccggcgatgagcaattccggctccggcaaccagggcatcgccgcgacgatgccggtggtggtggtggccgagcatgtcaaggcagaccaagaaacgctgatccgcgcgctggcgctgtcgcacctgatcgccgtttacatccacacccgcttgcccaagctgtcggcgttgtgcgcggtcaccaccgcgtctatgggcgcggcggccggcatggccctgctgctgaacggcggttatccggcggtcagcatggcgatttccagcatgatcggcgacctggccggcatgatctgcgacggcgcgtccaacagctgcgcgatgaaggtctccacctcggccggttccggcttcaaggctgtgctgatggcgctggacggcacccgcgtcaccggcaacgagggcatcgtcgcccatgatgtcgacgtatccatcgccaacctgggcaagctggctacccagggcatggcgcagactgacacccagatcctgcagatcatgatggacaagcgctga

SEQ ID NO: 1944 - DNA, 135 bp, Chromobacterium substugae
atggagcagctggcgtcgggcaaaaccgtcgcccaggtgtcggacgcgctgggctacgcctcgcccagcaacttcatcgccatgttccgccgcgcgctgggcgcgccgccggcgcaatacctggcttcccgttga

SEQ ID NO: 1945 - DNA, 300 bp, Chromobacterium substugae
gtgcggctggccgcctgctggcatcctgccgctccgccatcgccggagcagcagcgcatcatcgacgtcatcgtcgacgaaatccgccaggcgccgcggcaggaactgcacctgccgatgccggccgacccgcggctgcgccgcatcgccgccgccatcctggccgcccccgccgccgaccgttccaccgatgaatgggccagcctcggcgcgctgtccggccgcagcttgcgccggctgatccaagccgacaccggcatgagcttttcgcgctggcggcaacaagcgcaactggtatag

SEQ ID NO: 1946 - DNA, 741 bp, Chromobacterium substugae
atgccagcaggcggccagccgcaccagcgcctgcagcaacggcaggacggccagacatatccggcggcgctggcggtggcggcggacggcctgcattcggccttgcgccggcaatggctgccgctggcggaaccgccggcgaccggcgcgctgaatctgtacggcaaagcgcggatggcttgcgccgatgatttcgacgccgatctgctgcgcgggccgaccatcgttttcgccgacggctgcacgctggtggtcgagccgatgcgctttcgcgcgccaatgccggcgtgccggccgagtccggtcgacgattatatctactgggcgctgttcgggcgggaagccagcctaggcggccgtctgccgccggacgagggcgcggcggcgttgcgggagcgtgtcagagcggcggcgcgcggctggcatcccagcttgcgcgccttgctggagcgcaccgacgcgacagccatcatcgggcgggaagtgcggatggcagagcgcgtgccggcttggccgtccggccggctgacggtgctgggcgacgccatccacgcgatgagtccggccggcggcgtcggcgccaacaccgcgctggccgacgccgccatgctggcgcaatgcctggccgaaggcgatatcgggcgggcggtagtccgctacgaagccgacatgcgccagcgcgccgagcgagcgctggcgctgacgcgggccggcgccgaacggctgctgcggcgcgcctga

SEQ ID NO: 1947 - DNA, 930 bp, Chromobacterium substugae
atgaacttccagcaactgcgcatcatccgcgaaaccgtgcgccagggcttcaacctgaccgaggtagccaacgcgctgttcacttcgcagtccggcgtcagcaagcacatcaaggacctggaggacgaactgggcgtggagctgttcatccgcaagggcaagcgcttcctcggcctgaccgaccccggcaaggaactgctgaccatcgtcgagcgcatgctgctggacgccggcaacatcaagcggctggccgagcagttcagcctgcgcgacgaaggccagctgaccatcgccaccacccacacccaggcgcgctacgcgctgccgcaggtggtgaccgccttcaagcgcgccttcccgcgcgtgcacctggtgctgcaccaggccagcccggacgagctggtgcggctgctgctggccggcgaagcggacatcggcatcgccaccgaggcggtgaccgaggtgccggaactggtgtccttcccctactacagctggaaccactgcgtgatcgcgccgcccgagcacccgctgcaccggcaggcgctgacgctggagacgctggccgaataccctatcgtcacctaccaccacggtttcaccggccgcgcccgcatcgacaatgccttcgccgaagccggcctcgcgcccgacatcgtgatggcggcgctggacgccgacgtgatcaagacctatgtcgaactggagctgggcgtcggcatcgtcgcctcgatggcggtggacccgcagcgcgaccacggcgtcaaggtggtggacggcgagccgctgttcggccagcagaccagccgcatcgccatccgccgcggccattacctgcgcagctacgcctaccgcttcatcgaactgtgcgcgccggcgctgggcgagaagagcgtgcgccaggcgctgagcccggcggtgcaggaataa

SEQ ID NO: 1948 - DNA, 1080 bp, Chromobacterium substugae
atgagcatacaggtaaaccatatccgcaaggccttcggcgccttcaccgcgctggacgatgtcagcctgcacttccccggcggcgagctggtggcgctgctgggcccgtccggctgcggcaaaaccacgctgctgcgcatcatcgccggcctggagcaggccgacgccggccaggtgttgctggacggcgccgacgcctccgccacccatgtgcgcgaacgccaggtgggcttcgtgttccagcactacgcgctgttccgccacatgagcgtgttcgacaacgtcgccttcggcctgaggatgaagccgcggcgcgagcgcccgtccgaagccgacatcgcccgcaaggtgcatgagctgctggagctggtgcagctggattggctggccgaccgtttccccgcccagctgtccggcggccagcgccagcgcatcgccctggcccgcgcgctggcggtggagccgcgcgtgctgctgctggacgagccgttcggcgcgctggacgccaaggtgcgcaaggagctgcgccgctggctgcgcaagctgcacgatgaattgcacatcacctccatcttcgtcacccacgatcaggaagaggcgctggaagtggctgaccgggtggtattgatgaaccacggcaaggtggagcagatcggcgcgccggacgaggtgtaccgcgcgccggccagcgccttcgtctatggctttctcggcagcgccaaccgcttcgccggccgcagccaagccggcggcatcgcggtgggcgcatcgctgctggaggccgagcaccagctggcgcccggacaggcggtccaggctttcgtgcgcccgcacgaattggccatcctgcccggcgcggacggcgccggcttgccggccgaggtgcaacgcatcctgacgctgggtgcgctgtcgcggatcgagctggagggccgcggcgagctgaccggccagcagttcgacgccgagctgccggccgacgacccgctgctggcggaaatcgccgtcgggcagccggtgcggctgcaggcgcgcggcgccagggttttcgccaccccgacacaggcaggtgaagcatga

SEQ ID NO: 1949 - DNA, 879 bp, Chromobacterium substugae
atgagcgccgccatcccgcatccgcgcgcggcgtccgacaaggccgcgcagttggagtcccgcgccgccacccgcgaatcgcgcgccgtcaaatacgtgatcctgacgctggcgctgggcttcttcgccgtcttcctgctgctgccgttgttcgtggtgttcgccgaggcgctgtccaaaggctggagcacctacctgaccgcgctggccgagcccgacgccctgtcggcggtgcgcctcaccctgctggcggcattgatagcggtgccgctcaacctggtgttcggcgtggccgcggcctgggcggtcacccgcttcgacttccgcggcaaacaatggctgatcacgctgatcgacctgccgttctcggtgtcgccggtggtggccggcctggttttcgtcctggtgttcggcaaccacggctggctgggaagctggctggccgaatacgggctgaaggtgatcttctcggtgcccggcatcgtgctggccacgctgttcgtcaccgtgcccttcgtcgcccgcgaactgatcccgctgctggaagcgcaaggccgcgaggaagaggaagccgcggtggtgctgggtgcgcgcggctggcaggtgctgtggcatgtcaccctgccgaatgtgcgctgggcgctgctatacggcatcattctgagcaatgcccgcgcgatgggcgagttcggcgcggtgtcggtggtgtccggccacatccgcggcgaaaccaacaccctgccgctgcacgtggaaattctgtacaacgaatacaacttcgccgccgccttcgccgtggcgtccttgctggccatgctggccctgatcacgctggcgctgaaaagctgggtggaatggcgcagcgtcaaggaaaactga

SEQ ID NO: 1950 - DNA, 867 bp, Chromobacterium substugae
atgccagccagtcccgcccttcttcccgccgcccggccgccgcgcgttttgcccggcttcggcctgtcgctgggcttcacgttgagctacctgtcgctgctggtgctgattccgctttccgccgtcatcctgcgcgccggcagccagccctgggacagcttctggcaggcggccaccgccccccgggtgctggcgtcctaccggctgagcttcggcatggccttgctggccgccgccgtcaacagcgtgttcggcctgctgctggcctggtcgctggcgcgctaccgctttcccggcaagcggctggtcgacgcgctggtggacttgccgttcgcgctgcccaccgcagtggccggcatcgcgctgaccgcgctgtacgccggcaacggctggctggggcaatacctggagccgctgggcgtcaaggtggccttcggcccgctgggcgtgctggtggcgctggtcttcatcggcctgcccttcgtggtgcgcaccgtgcagccggtgctggaagacctggagaccgaactggaagaagccgccgcctgcctgggcgcgcgccgctggcaagtgttccgccacgtgatcctgccggcgctgcagccggcgctgctcaccggcttcgcgctggccttcgcccgcgcggtcggcgaatacggctcggtgatcttcatcgccggcaacatccccatggtgtcggaaatcacgccactgatgatcatcagcaagctggagcagttcgactacgccggcgccaccgccatcgcctcggtgatgctggcggcgtccttcctgctgctgctggcgatcaacggcctgcagttctggagcgcgcgccgccatggccgcgcgggaggcagccgatga

SEQ ID NO: 1951 - DNA, 1002 bp, Chromobacterium substugae
atgcgcctgcgccccttgcaccaactcgcccttgccctgctgttcgccggcagcgcctccgcttttgccgacgtcaccctgctcaacgtctcctacgatccgacgcgcgagctgtaccaggaattcaacgcctcgttcgccaagtactggaaggccaagaccggcgaaaccgtcaccatcaagcagtcgcacggcggctccggcaagcaggcgcgctcggtgatagacgggctggacgcggacgtggtgacgctggcgctggcctacgacatcgacgaaatctccagccaggccaagtccatcgcccccaactggcagcagcggctgcccaacaacgcgtcgccgtattcgtccaccatcgtgttcctggtgcgcaagggcaatcccaagcgcatcaaggactggaacgacttggtgaagcccggcgtggaagtggtgacgccgaacccgaaaaccggcggcggcgcgcgctggaactacctggcggcctggggctacgcgctgaagcaaccgggcggcaacgacgccaaggccaaggacttcgtcaagaaactgtacggcaacgtcaaggtgctggactccggcgcgcgcggctcgctgatcaccttcacccagcgcggcatcggcgacgtgctgctgtcgtgggaaaacgaggcctatctcgccacccgcgagcttggcccggacaaattcgacatcgtcaccccatccctctccatcctggccgagccgccggtcagcgtggtggacaaggtggtggacaagcgcggcacccgcaaggcggcggaagcctacctgaaatacctgtacagcccggaaggccagaacctggccgccaaacactactaccgcccccgcgacccgcaggtggcggccaagtacgccggccagttcagcaaggtgaagctgttcaccatagaccagaccttcggcggctggcagaaggcgcagaaggtccacttcgccgacggcggcgtgttcgaccagatcatcgcccgctga

SEQ ID NO: 1952 - DNA, 801 bp, Chromobacterium substugae
ttgcagcaggagggggtggaggccaggctgcagtggaacgagcaggaagtgttcgccagcttcgacggctggtggttgagcagcagtttctttcctcaggcgcgcctgcgcgacgatcgctgtcaattgctgcaatatgccgccaggctgcgtattttcggccagtttggccaggctttgccggccaattggctgtttgcgatgaattacgcggaaagcaaggcggtggccttgctcaagctgatccgcaccctgcacctggtcaaccatctgggccgcaacggccgccacctgccgctgcgcatagacgtggacccgcgcatctgccacgcctacagcgaccgcatcgtcgatttcaccgcgcgcctgctggaggtgctggagtttcccgcccgccaggcgccgctgctgctgtttctcaatgacaagaccagcgagttgggcttgtccttgctgcggcgctaccgccagctgggccatcgggtgggcctgggcgatttcggcgaatgcggcgaggacctgctgcggttgtggcggctggagccggatttcctgtcgctggcgccgcgcttcatgagccgggccatcatgtatccgcaagtgcgcgaccgcctgctgcaactagtgccgcagctggtggagcagggctacgcgctggcggtggaggacatcgtctgtcagaacatgctgggcctggcgcagcagatgggcgccgagcatctgtccggcccgctgctgtcggaacggctgcggcggcagaaagccgcgcagctgatggatttgaatgtcattaacgcttag

SEQ ID NO: 1953 - DNA, 183 bp, Chromobacterium substugae
ttggcaggtttttttgccgcggcgtgcttgtccggctgcgtgatcggcaacaccgacggctaccgcgacgcggcgcaattgcaaaaaacggcagatcaggcgttgaagacgtgcggcgcgggcaaggtcaagtcggtcagcgctggcagcttcgcctgcgtggccgctggcgagcagaactag

SEQ ID NO: 1954 - DNA, 975 bp, Chromobacterium substugae
atggcgggcgcgactgacagccgcgtggcggtgcgtttgttgaacgccgccgatgccgaagcctaccgcgcggtgcgcatcgcggcggccactcacgatccggcggccatccatgccgacgcggctgaaatcgccgctttgtccgatagcgagatcgccggccagatcacggctggcgacacgcagcgggcggtgggcgctttcatcggcggcgagctggccggcgtcgccgccctgcggcgcgacggccgcgccaagatccgccaccgcgccacggtgcagggcgtgttcaccctgccggcgcatcgcggccagggcgtcgcgcgcgcgttgctgcaggcgttgctggacgaggcggcgacgctgccggggctgctgtcgctggagctggcggtgcatgcggaaaacgcgccggccaaggccttgtaccaggcgttcggcttccgccgcgtgggcctgattcccggcgcggtcatgctcgatggccgctgtctggacgaagtgctgatgcagcgtccgctggttttctcatcgtccgccgccgcgccggcttccattccgaaccgcgatgattacgccttgatcgaggccgcgccggatgtcgacacctatcgccgcctgcgcgccgagtccggcctcagccccaagaccgaggaagccgcccggctcggcctggccggcaccgcgtatgcggtgcaagtgcggtgtggcgaggaggtggttggcatgggccggctgataggcgacggcggcagcttctaccaagtggtggacatcgcggtgctgccggcgcatcaggggcgggggctgggcaagcgcatcatggcggccatccgcggccacatcgaccgcgaattgccggtcagcgcctacatcagcctgatcgccgacggcgacgccaagcatttgtatgcgcagttcgggtttgagccgaccgcgccgcgttcggaaggcatggcgctgttcaagcgctga

SEQ ID NO: 1955 - DNA, 132 bp, Chromobacterium substugae
ttgttctttgggaaaggccgattcgatgacgcaatcgaagtgacgccggcgatgttcgacgcgatggaggcgcagttcgagccggccaccgcagacgagttgaaccaggctgcggcggtcgccacctcttag

SEQ ID NO: 1956 - DNA, 603 bp, Chromobacterium substugae
ttgtccgcagagacgctgcgccatcaggtattgcaggccgcgaccgcgctgctgctgaacgatggctatccggcattgagcatagaggcggtggccaaacgcgccggggtggccaaaaagacggtgtaccgtttcgccgacaatcgggaacaactgctggcggccatcgtcgacgactggactgccggactggcccgcgcggtggaaacgccggaggacgagggaaaggatttgccgcatgcgctggaagcgctgctgctggccatcgccgaacgggtgctgtcggcggaggcggtaggcatgttcaaactgctgagcaacgacttccccggccgcgagcaggcgctggaatcgtacgctcaacacggcatccgccgcagcgcggcgctgctggccgactggctggccgaacgccagcgccgcggccagctgcgcgtggatcatccggcgagctgcgccgagctgctgctggcgatggccattgccgagccgctgcggcaaagagtgctgggactggccgcgcccggcgtcgacgcggcgctgcaaggctggatccgagcggcggcgcgcctgggctaccagggcatgcggtctgccgactaa

SEQ ID NO: 1957 - DNA, 672 bp, Chromobacterium substugae
gtgaacgcccagaatcggatatccagtcatgacgaactactgtcatcgcggccgctgcctttggaaaccggcatccgccggctggacgacggccggctgctggtggcggtgagaaccgagctgccgggctgcgccggcaggatgctggagtggtggttcaagtttttcgagaccacccagcatattcgctggtggcatccgcacgaccatctccggatgcatggctgggacgggcgctggaaacgaggcgagtcctacatcggcgcctgcgtgcgcgcggaagagtcgctgggcgactttccgccggtcacggcgacgctgaagtttcacgagtcggaagattttttctcgcccgacgcgctggcgcaggccaggcgcgagcagagggtgtccggagtggtgtgcgcccgcatcgccttcggcgacgagccccgtttggcggccgatggcgacccgctggacggcgagatgatccacctggcgcgcgacaagccgcagggcgcggtgctgcgcagccgcttcgtgctgggcggagaagcgccggtgccggacgagttgggcctggggctgatgcagcattgctacaacgagttcagcagcctggcgcgtttcctgccttcgctgtactacggcgagcacgccaacggcgagaaggggccgctggcgtggtga

SEQ ID NO: 1958 - DNA, 141 bp, Chromobacterium substugae
atggccatcggcattcctgcatgcgacggccattcggtttcttctctttattcaaaaaccggctataaaatcgcctggggatattctatgttctgccgccagagcaaaccatccaaaaaaaaaccacttgccggcatctga

SEQ ID NO: 1959 - DNA, 747 bp, Chromobacterium substugae
atggaatcgaaaaaattagtgtgcggcgtgatggcgctggttatcgcggcgtcctcgatgagcggctgctcaagcgcgaagaaaccgcgcaaaaataaataccttgcgcaagccagcagcgcggctgcaatcaagaatatcgacatctactaccataaagcggattacggcgtaatggacctgggcggttcgagtggattgcaagtgggaggtttgttcggcgtagtaggcttgctggcgtctttgggagccgaggcagccagcagggcgacggcgaaggacagaaccgtcgcgcgcagcgaggagttttccaaactgatgaacagtttggatggcgataacgatatcgatttggcgcaggcgaaaaaactggcggacatgctcacagcctccgggcgcaccgtgaggctggtggagatcaagcggccgcaggccgaaagattgttgctcgaccaaacgccgaatctgccggatagcgatgagaacgccgtgttggtgttgcggacgactttgggctatggagcggagtccgccaccgcctcatacaagtcgatagtggtgaccgagtatgtgttgcagaagataaacggcgaagtggtgcatcgtgggaagcaaacgattcacgacgatggccagacttatatgacgttttcgggtttgaaggaggcctacgtggaaacccatcaggcgctgggaaaagatgcgcaggcgatcgccgacagaatctttgccgcggtggtgaagtaa

SEQ ID NO: 1960 - DNA, 1137 bp, Chromobacterium substugae
atgaaacaagtactgaaccacgcccgcatcgtgctggccgaccgcgtgatcgaaaacggagcgctggagatcgagaacggtttgatcgccgccatccacgaacaaccgctgcccgaaggcgaagacctggccggcgcgctgctgctgcctggcttggtggagatccacaccgacaatctggaaaaacacctgatgccgcgcaacggcgtgctgtggcctaccctgccagccgtcatcacccacgacgcccaatgcgtggccgccggcatcaccacggtgctggacgcgctgtcggtgggcgatctggaaggcgacagcgtgcggctggacacgctgcacagcgccttcgccgccatcaaccagggcatggacgaaggcgcgctgcgggccgagcacttcttccacttgcgctgcgagctggcctatccgggcctgctggccgaactggaaccgctgatcgcccatccggcggtgaagctggtgtcggtgatggaccacacgccgggccagcgccagtaccgcgacctggaacaatacaagaagtactacggcaagaaaaaagtaggctggaacgaggacaccttcctcgccgccgtggaagagcgcaaggccaagcaggccgagttcgccagccgccacaagcaggcggtggtggaaatggcaaaggcgcgcggcatcgcgctggccagccatgacgacaccgacgccgcccacatagacgaagcgctgcgcgacggcgtggcgatctcggaatttcccaccacattggaagcggcccaagccgcccgcgcgcatggactgcaaacggtgatgggcgcgcccaatgtggtgcgcggcggctcccactccggcaatgtggcggcgttggagctggcgcgggccggcctgctggatatcctgtcgtccgactacgtgccgaccagcctgctgcacggcgcctggctgctgcactcgcaagcaggctggggcctgccgcgcgccgtcgccaccgtcagcctcaacccggcgcgctcggtaggtttgaacgatcgcggcgacatcgccgtcggccagcgcgccgacctggtggcgatgaccgtgcgcggcgacgtgccgctggtgcgaaaggtgtggaacggcggcctaagagtattctga

SEQ ID NO: 1961 - DNA, 708 bp, Chromobacterium substugae
atgaatctattgatagacgcgcaaaacctgagcaagaccttcacgctgcaccagcaaggcgggctgcggctgccggtgctgaccgacgtttcgctgcaagcggccgccggcgaatgcgtggcgcttgccggcccgtccggcgccggcaaaagcacgctcttgaaggcgctgtacgccaactatctggtcgatggcggccgcatcggcgtgttccaccagggcgcatgggtcgacatggcccgcgcgctgccacatgagatcgccgccgtgcgccaccacaccttgggctatgtcagccagtttttgcgggtgatcccgcgggtatcggcgctggacatcgtcgccgagccgctgcgcgaatggggcgccgccgacgccgaggcgcggctggcggccggcgaatggctggcgcggctgaacatcgcagagcgcttgtggagcctgccgccagccaccttctccggcggcgagcagcagcgcgtcaacatcgcgcgcggcatgatcgcgccgcggccgatactgctgctggacgagccgacggcatccctcgacgccgccaaccgcgacgtggtcgtacaattgatgcgcgaggcgctggcccgcggcgcggccttggtcggcatcttccacgacgcccccacccgcgacgccatcgccagccgcgtgttccaggtaccgctggcgcaacaaacggaaaccgcagcatga

SEQ ID NO: 1962 - DNA, 774 bp, Chromobacterium substugae
atgatggcgcccattcttaccgtgagcgggctgagcaaggactacggcaacggccagggctgcttcgatgtcaatttcgagctgtatccgggcgaggtgctgtgcatcgtcggcgaatccggctccggcaaatcgacgctgctgtccacgttggccggccgcctggccgccgacgccggcagcgtgcgcttcgccgaccgcgacggcgcccaacacgaactggtctgcctgcccgaggccgagcgccgccgcctggcgcgcagcgaatggggcttcgtcacccagcacgcccgcgacggcctgcgcatgggcgtctccgccggcgccaatgtcagcgagcggctgatggcgctgggccagcgccactacggccggctgcggcaaaccgccggcgactggctggaaaaagtggagatagaccgcgcgcggctggatgacaagccgtcggccttctccggcggcatgcagcagcggctgcagatcgcccgcaatctggtgacccagccgcggctggtgttcatggacgagcccaccggcggcctggacgtgtcggtgcaggcgcgcttcctcgacctgacccgccgcctggtgcgcgatgccggcatcgccgtgatcatggtgacgcacgatctgggcgtggcgcgcctcttggcccagcgcacgctggtgatgcaaaaggggcgcgtggtggaagccggcctgaccgaccagatactcgacgacccgcagcacccgtacagccagttgctggtgtcttccatcctgcaggcctga

SEQ ID NO: 1963 - DNA, 843 bp, Chromobacterium substugae
atgactgacgcccgcaacgaccgctacaacttcggcttcctcgacgagaacaccaagcgtatgctgcgccgcggcctgctcaaggcggtggcgatacccggctaccaggtgccgttcggcagccgcgaaatgccgctgccctacggctggggcaccggcggcatccaggtgacggccagcgtgatcggccgcgacgacgtgctcaaggtgatagaccagggcgccgacgacaccaccaacgcggtcaacatccgccgcttcttcggccgcgtggccggcgtggccaccactacggccactcgcgacgcgacgctgatccagacccgccaccgcatcccggaaacgccgcttaagcccggccagatcatgatcttccaggtaccggagccggagccgctgcgcacgctggaggccagcgaggtggaaacccgcaagctgcacgcgcaccaggaatacggcctgatgcacgtcaagctgtacgaggacatcgcccgcttcggccacatcgccaccagctacgactacccggtgatggtgaatggccgctacctggcctcgccgtcgccgatcccgaagttcgacaaccccaagctggacaggagcccggcgctgctgctattcggcgccggccgcgaaaagcgcctgtacgcgattccgccctacaccaaggtggaaagcctggccttcgacgaccatccgtttacggcccaaagctggcagcaaggctgcgcgctgtgcggttcgcatgacagctacttggacgaaatcgtcaccgacgatgccggcagccggctattcgtctgctccgataccgactactgccagcgggagacacaagcatga

SEQ ID NO: 1964 - DNA, 1086 bp, Chromobacterium substugae
atgtacgtagccgtaaaaggcggggaaaccgccatcgcccgctcttgggacttgctggccgccgcgcgccgcggcgacgaggccgcgccggagctgagcatcgcccaaatccgccaacagctgcgcctggccgtggcccgcgtgatgcaggaaggctcgttgtacgatgaggaattggccgcgttggcgttgaagcaggccagcggcgacagcatcgaggcggtgttcctgctgcgcgccttccgcaccacgctgccgcgcttcggccagacgctgccgctcaacaccgccgcgatgcgggtgcgccgccgcgtgtccggcaccttcaaggacgtgccgggcgggcagatcctcggccccaccgccgactacacccagcgcctgctggacttcggcctgatggaaacctcgcaaaaagtcgaactggaacaggccgccacgccgctgccggacgcgctgcccagcgtgctgcagctgctggacagcgagggcctgatcgaaaccgacctgccggccgacggcgacccggagccggtggacctgacccgcgagccgctgatgttccccgccggccgtccggcgcggctgcagaacctggcccgcggcgacgaaggctggctattgggcctcgcctactccacccaacgcggctacgccgagagccaccccttcgccggcgaaatccgcatgggcgaagtcagcgtgatggtttgcccggaggagctgggcttcgagatcgacatcggcgaaatcacgctgaccgaatgccagatgatcaaccagttcgccggcagcaagagcgcgccgccgcaattcactcgcggctacggcttgagcttcggcgaggccgaacgcaaggcgatggcgatggcgctggtagaccgcagcctgcgcgcggaagagttgggcgaaaccgcccacgcgccagcccagcagccggagttcgtgctgtatcacagcgacaatgtcgaagcctccggcttcgtccagcacctgaagctgccgcattacgtggacttccaggccgagctggcgctgatccgccagctgcgcgccgccgccgatcaggagaaggccgatgactga

SEQ ID NO: 1965 - DNA, 573 bp, Chromobacterium substugae
atgttgaccgcttttgcccagccggtggatgacgcccagcaaactttccgcatattgcttagcgcgatggcggagccgctgctaccgcgcgcgctgccggtgttgccgccggccctgcccggtctccaggccggcatcgccgctttgctttatacgctggcagaccaggacgtgagcgtctggctgccggcgctgccggacgaaaccgtctccagcctgcgctttcacaccggcatgcgcatgaccgatctgccggaacaggcggacttcatcgtcatcgccgccggcatgccgctgccggatctgatgagcctgaaggccggcagcgccgaatacccggaccgctccgccacgctgctgatcgaggtggccagcttcgctgaggatcaggtggaaggcagcggccccggcttcgccatgccgcgccgtttcggcgccgccggtttgccatccggcttctgggccgaatggcaacgcaaccatgcccgcttcccgctgggcgtggacgccatgctgatttccgacacccacatcgccggcctgccgcgcagcgcccgcatccgcgagggttga

SEQ ID NO: 1966 - DNA, 435 bp, Chromobacterium substugae
atggacacctccacccgacagcgctggctgggcgcgctggccaacagcccgatggaacggctgcaggccctgctgccgccggccctgcccgccgcgccgcgctggctgcgccgcgccgaaaccggcctgatgatgctgcaaggccgcagcggcggcagcggcgcccgcttcaacctcggcgagatcagcgtcagccgcgccagctgcgagatagacggccatatcggccacggctgggtgcgcggcggcgacggccgccatgccgagctgatcgcccaggccgacgcgctgctgcagaatccggcccgccacgcggaactgatggcagcctggatcgccccgctggaggccgagctggccgaacgccgcgccgcccgttcgcgcgaggccgccgccagcaaggtggagtttttcaccatggtgcggggggaatga

SEQ ID NO: 1967 - DNA, 723 bp, Chromobacterium substugae
atgatagagagaggttccggcgtcgccgtctggcggcagatagaagacagcctggcggcgcagatcgccagcggcgccttgcaggcgggcgcgcagctgccgaccgagctgcaattggccgagcgtttcgccgtcaaccgccacaccatacgccgcgcggtggctaccttggtggagcgcggcctgctgcgggtggagcaggggcgcggcactttcgtgcaggataatgcgatcgactacgccatcagcaagcgcacccgcttcacgcagaacatggcgcggcagaacctcagttccgacatcgacatcctgctaagcgacactgtaccggccaatgccgagctggccggcctgctggaagtcgcggtcggcgacgaggtgttccgcatcaagaccctcagccgggtggaggcgagggtggtggactgcgcgacgctgtttttccccgccgcccgtttcgccggcctgccgcaggtgtaccagcgccagcgctcggtgacgcgtgcgttgcgggagttcggcatagacgactacacccgccgcttcacccgcgtcaccgcgcggctgccggacgcggagacggtggattatctgggcattcccaagaaccgcccggtgctgcatgtgaagtcgctgaacgtggacctggacggcaggccggtgcaatacggcatcacctgcttcaatggcgacctggtgcaactggtgatggaggacgactga

SEQ ID NO: 1968 - DNA, 693 bp, Chromobacterium substugae
atgcgttgcgcgctgtattacgcgcccaggccggacagcggcttgtggcgagccggcagcctctggctgggccgggacgcggccagcggccagagcctggcgcagccggcgctggatggggttgacccggccacgctggccgaccttaccgcggcagccgcccgctacggctggcacgccaccttgaaggcgccgttcgagctggcgcccagcatggatgcggccggcctgctggcggccgccgcgcggctggcttctggtttcgagcctttcgcgctgacgctgcgggtggagtggctggacgattttctggccttgcgccccgcggcggcgtcggccgagctggaagagctggccgcggcatgcacgacggcgatggcgccctgggccgacccaggccaggccctgaagccccgtcccgggctggacgcccgccagcaaagcctgtatcggcgctggggctatcctttcgtgttcgagcagtttcgtttccacatgaccctcagcgccgggctggcgcgggaatcggcgctggccgccagcctggagcggggcgcgcgccggcatttcgccgggctggggccggtggaggtggacggcatcgcgctgttcgcggagatgacggccggcggcccgttccgctatctggcccactgcggcttcgacggaaaggtggcgcgctatggcggctga

SEQ ID NO: 1969 - DNA, 564 bp, Chromobacterium substugae
atggcggctgagacgggcgcgctgtggtatgtgatcggcccttccggcgccggcaaggacagcctgctggcctatgtgcggcagcgggtgccggccgatggcggcttgatgttcgcgcatcgctacatcacccggccggccgacgccggcggggaaaaccatgtcgcgctcagcccggaagagttcgaccagcgcgagcgcgccggctgtttcgcgctggcctggcggcgcaatggcctggcttacggcttgggggcggaggtgggtctatggcttgcgcaggggctggacgtggtggtcaacggctcgcgctcgtcgctgccgctggccgtccggcgttttcccggcctgcggccgctgtggatcaccgccagcccggaggtgctggcggcgcggctgagggcgcgggggcgggaaggcgaggaggcgattgcgcgccggttggcggaggctgcgtccttcgtgcctcccgccggctgcgcggtgctggtcaacgacggcgcgctggagctggccggggagaccttgctgggctggctgcgggcgcagcggcgcgttctatag

SEQ ID NO: 1970 - DNA, 543 bp, Chromobacterium substugae
atggctgaaatcatcttgtatcagaactcgaattttggcgggcgcagcatcgatttgaccagcaactccgccaatttggggacggattacaatttcaatgatcagacctcatcgattcgcgtcgtcagcggcacctggctgctgtacaaagatgccggttttgccagcacctgctggattctgacgcagggcgaatatcccagcccgggcacctggggcggcagcaacgattccatttcctcggtgcgcgccttgccgggcaattacggcgaccactacgcgattctgttccgcgacagcgattacggcggccagatggtgtcgttcactcaatcccaggccaatttcaacgatatcggcttcaacgatgcggcatcttccgcgatcgtcctgggcggcagctggtccatgtacaaggacatcaatttttccggacagagctggatcatcgcctccaataaaggccccggcaacgatggccgttatcccagctactccggcttctgggacaacgacgccgtgtcttcgatccagcccctgtaa

SEQ ID NO: 1971 - DNA, 1635 bp, Chromobacterium substugae
atgagcttgttgcaaaacatcaaagtcggcccgcgcctggccgcatccttcatgctgttgctggccattctgctggcggtcagcgccagcgtctggaacggcctctccagcatagaaaccagcactcatcgcatcgtcggcgacgacgccggcaagctgcaattggcggcggagctggaccgccattcgcaaaacgccgccctgctgctgctgcagatcatctccacccccgaccgaccgcagcgcgtccccctatatgccgcgatggacgaggccaaccgccgcgccaaccagactttccaacgcctgaaagacttgccctggacgccggaacagtccgacgtcctgcgccagctatccgaattgcgcgcccgctacaccgccgccttcagcaacacggtcgaccttgtggaatcggacgacccggcggcgctggcgcgccagtacgccggccagacccagccggcgctgcagcaactgctcgccgccaccaccgccctcgcctccgcccagcaaaacgacatgaaccgggaactggccgacgtgctggcgctgatgggcaatacccggctgttattgctggctttcagcgccgccgctgctgtggccggagtgctgctgtcctggcgcgtcacccgcagcatcacccgtccgctggagcacagcgtggcgcggatgggtgcgatggcccagggggatctgcgcggcgaggtgcagatagtcggcagcgatgaaaccgcgctgatgctgggccggatggcgcagatgcagtcgcacctggcgacgctggtgcgggaattgcgcggctccgccgacatcgtcgccgccaccgccgcctccacccagtccggcgcggccgaagtcgccggcggcgtcgagcgccagcaggcggaaattcaccagatcaacgcggtggtggaggacttcgccggcaagctgcgcagcgcggcgcaaaccgcctcccaggcgcaggagcgcgccaaaagcgcggccgcgctggcgctgcgcggccagagcctgatccagaccgcctccggcgaaatcacgctgatcgccgggcagatccagggcagcgcggcggcggtggacgcgctgcgccagcgcgccaattcgatgcgcggcatgatagagtccgtcaccgacatcgccgagcaaaccaatatgctggcgctcaacgccgcgatcgaggcggcgcgcgccggcgaaatgggccgcggcttcgcggtggtggccgacgaggtgcgccggctggccgaccgcaccgcccaggccacccgcgaaatcagcgaagtgatctcggcgatagacgaccagaccacccaggcgatgcggcagatcgaacaggggcagacggaaatggcccgcggcgtcgacatgatccgcggcatcgtcgacccgctgaccgagctgaaagacggcgccaccgccacctccagcgaactggaccggttggccgtcaatatcgccgagcaggtgcgcgaaagccaatccatcgcgcgcagcgtcgccgccatcgcccagtccgccgacgaaagcctgcatgccacccacagcgccagacagaacagcgcccggctgctgaccgtgagcggcgcgctgcaggagcagatgcggcgcttcgtgctggacagctga

SEQ ID NO: 1972 - DNA, 1068 bp, Chromobacterium substugae
gtgagcgcggcggattcgctgcactggccgataagccgcttcagccgcgcggtcgatgcctaccatcgccttccatcgccgcgcgccaatccggcgcgctggctggacgcgctgcgccaggcgatcacgcgccatggggtggacctggtgctgcccacctgtgaagaaaccttctacctgtccagcggccgcgacaccctgccttgccgggttctgactgagcgcttcgacctgatgcgccagttgcaccacaagcaccgtttcgctctgatgacccgcggctggacggcccaggcgccggaaacccggctgttggaatcgccggacgccgtcatgcgcatgcgccacgccgcgccgggctgggtgttcaagcctgcctattcccgctttgccagccgcgcgctgctgcgcccctctcccgcccaactggcgcgcgcgcggcccagcgccagccggccttgggttgcccagcgctacatgccgggccgcgagcactgcagttatagcgtgctggcggcgggacgcgtgaccgctcatgcctgctaccacccgcgctaccgggcaggcaaagccgcgggtgtctggttcgaacccaccgacccggcacccatccgggcgttcatcgaacgattcggcgccgaaaccggctacagcggccaggtaggcttcgacttcatcgaaaccgccgacggcgcctgtcacgtactggagtgcaatccccgcgccaccagcggcgtccatctgttcagcgaccagccgcaacaactggtcgccgccctgctggacgacattccgcccggagaagtgctgcgtccggccgccagccccaagatggtggccgcggcgatgctgctgttcgccgcgcggcgccatggctggcgccgcgaattctggaccgacttcggccgcgccgacgatgtgctggcccggcgggacgaaccctggctgctgccggcgcagtgcctgggcctgctggaaatcgccggccgcgggctgctccggggccgcggcttgctcgcggcctccaccgccgatatcgaatggaatggacaagcgctggatgaatga

SEQ ID NO: 1973 - DNA, 1662 bp, Chromobacterium substugae
atggctgagcggaaaagccaccaaggcgatccgtctcaatacatcctgtattcaaagggcctgcggtacctctttgacagcatagttacccgcctgctggcgctggcgctgctgatcgtgctcaccggctccatatcgcgttattacacgctgagcaattttctatatgaagacctgagcaaggtggtggaaaaccagcagttgacgctggccacctatgtcgcgcacgacatcaacggcaaagtcgcgcaaagggaagacctgctcatccacctggccgcggtgctgccgccgcagctgctgaagcgcccgccccagctgcgggactggctcaaggagcactaccagtaccagccgctgttttccatcggcttgttcgtagtgaggccggatggcagcgccatcgccgactatcctctcaatcccagacggatgacagtcaattaccgcgaccgcgactatatccgggcagcgctgcaaggggacccctacatcggccgcgccgtagtcggcctcacttcgaaaataccggtgctgccgatgggcgcgccgatatacggcgccgatcgcaaagtgaaggcggttctggttggcgtcaccgcgctggacgcgccaaactttctcgatctgctgcaacacacccatatcggcggccacatcgacagttttctgctagtctcgccgcgcgacaagcagttcgtctcctcctcgcaaccggacatggtactgaagccgctgccccgccccggcgtcaacccgctgcacgacagggcgatggcgggctttcgcggcgccggcatcaccgtcaacgccaaaggggtggaagaagtcagcgccatcgcgtcggtcccgcgcgccggctggttcgtggtggcccggctgcccagcagcgaggccttcgccaccgtggagagggtaaagggcttcacgctgcgcaacaccatcgccgcgatggtcgttttcgcgctgatctgctgcggcggcctgtacatcgtgctgcggccgctgttccaggccgcgcgccacgccgaccgcatgacgcgcggcgagctgccgctggagccgatgccgatccgccgcaacgatgaagtcggccacctgatcgcggcgttcaaccgcctgctgcacaaactgaacgaccagaaagccgaactggcccgcatggcccatcacgactcgctgaccggcctgcccaaccgctcgctgctgtccgatcgcctgcacatggcgctggcgcaggcgcagcgcaaacgcagcgcggtggcgctgctgttcatggacctggacggcttcaagctgatcaacgatacgctaggccacaaggccggcgacaaggtgctgtggcaggtggcgcagcgcctgtccaacatcgtccgccagaccgacacgctggcgcggataggcggcgatgagttcgtgctgctgctcagcgatctggacgacggcgcggaaggcatcgccaacacggtggcgcagaaatgcatagaggcgttcgacgccccgttccagaccgccggcgcctcctgcaagctgggcatttcgatcggcatcgcgctgggagacggcctgagcacctcggacagcctgttgcaggcggccgaccaggccatgtacctcgtcaagaaaaccggccgcagcggcagcgaaaccatacggatatga

SEQ ID NO: 1974 - DNA, 3162 bp, Chromobacterium substugae
atgtcgttccggcttaagaccatactcggcatagcgctgatcgaattgatgatgctgtgtatcctgctgtattttggtttgggcctgctgcgcgataccagcgttcgagaaatgatcaaacggcggcagatcatagccgagcagttcgcccaagccaatcaaaacgctgtgctaagcaccgacctggcaacgctgcagagcgcagcggagcagatggtgaaatcttccgacatcctctatgctcgcgtgttcgacggccatgacaggcttctcgccgaggccggcgatcctcgaagcttggccctgcatgactcagccaaacaggactcagccacgcagaacatagaccagctctcgcccgaccaaccgctcaccatcacccgaaacatcgagatcggcggcatccattacggtcgagtggaactcggcacctcggtggctaaccaccggcaattgatgcagaaagccctacaaaatggccttatgctcgccctgtccgaactcgccttatccgcgctgttctctctgctactgggtacctatctgacccgccagctcgagtcgctgcaacaggcctcccaaaaaatggctgccggcgagctgggctaccaagtggaagtgcaaggcaaagatgagctggcgcgcacggcagagatgttcaaccggatgtcgacccagctggccttggaccgcagccagctggaaaccgcgctgaaccgcgctgaagaaagccgaaaggatttacagcggcaagaagatctgctggatgcaatcaattacatgcaaagcctgttcattggcaaggtgcatcccgaaacattgttcagctacgcccgcgacatcctactgctgtggttcaatgccgaacacggctttatatgcgaattgaacaaccaggcaagccagccccagtttctccccatcacgcctgctctgagccccccgccgcagatggacacagacgagctgttgcaatgctgtctctatcaagaacaggaacagctgctgggcctgcaacagagttcgtccggcgccttatcccaaggctactatttcctgagcatccccatcattctggcctccagcgtaattggctcgtttaccctgttcttccctcgcccggtcgacccggaccatggcaacaagctcccggcgccattgatgaaaacattgggacaactgatgcaggcaagccaggcccaacgcaagctagaacaaacacagcttcaactttcgcggcaacaaatactgttatccgctgtcatcgacacctcgatagacggcatcgccaccttagacaggctaggcctgttcaccagcgccaacaaggtgaccgaatacatgttcggcctaccgcgcggcagcctgatcggcaccgccttgctggactgcctggaaccgtccagccggcgcgcgctgcagccgctactgctcggcgacgacatcaaattgagcagtttgctgcaactcaccgccaaacgcgccgacggtacgccgtttccgatagagctggcgatcacccacatgccggacacaggcaaagattactacaacctgaacatccgcgacatcacggagctaaagacagcagagagtgagttgcggcgcgccaaggataaggccgatgcggccaaccaggccaagagctccttcttggccaccatcagccacgaaatccgcaccccgctgaacggggtgctcgggatgctggagttgctgaagttgagccaattggactctgggcagcaagacatggtggacactgcgcgcgactccgcgcacaccttgctgctgctgatcgacgatgtgttggacttcaccaaaatcgaggccaaccagctggagctggttaagacacccaccgatatctggccactgctacaaagagtgctaagccgctacgcccataccgccgagcaaaaggatctgaatttcgacctgcagatcgatcctctgctcgcccccaccctgctgcttgacccgctgcggctgcggcagatcttacaaaactttctcagcaacgcgataaagttcaccgccaccggcgccatcaccttgcgcgtccaagtggaaaaagaggccaccggctggcaaaacctgattttcgacgtcatcgataccggtatcggcatcccgcccgaacaattgcaaacgctgttccagccattcagccaaggcgattccgccacctcccgccgctatggcggcaccggactgggcttggctatcagccgccgcctggcagagctcatgggcggcgaggtggcaatagacagcgaactggggcatggcacacgggtttcactgcatctgtgcgtggaagtggctgaacgcaaagctcctccccccctcgcacttctgccctccgcagcgcccaatgcggaaaagcgcatattgctcgtggaggacaaccccaccaatctgaagctagccaccaagcagctggaaaagctcggttatcggcccgatacagcggaggatggcgcgcaggcttttgaaaaatggcggcgcgatcattaccatctggtgatgaccgactgcctgatgcccaatatcggaggcttcgaactcgccaggctgatccgaagctacgaggcggaacaccccgtccgcccccgttccgccatcatcgcttgcacagccaatgccgcgccagaagagctgcaaaagacccgtgatgccggcatgaatgactacctcatcaagcccttcgcgctggaaaccctgtccgcggcgctggaaaaatggttgcagggcgcacctcctagcgttagccccccggcagcgggggctcaaccggaaggccccgcgccgctcgacctgttaatgctgcgaacacgctgcggcgagagcggaaaatccgaaagtcaactgctgggcgagttcctgaagaacacccgccgacacacctcatacatccgcaacgccataatcagcgacaacctgccgctaatcgccctcaccacgcgggacatccagaccgacgcgaccccaataggtgcgcacaatatcgccgaggcagccagacacctagagcaagccgcagaggccgagcagaaagagacgatccccaggttggtactgcaactggaagccgcctgcctggaggtggagcaatggctgacgaagcgccgcgcaccgcacgagttaagccatggctga

SEQ ID NO: 1975 - DNA, 609 bp, Chromobacterium substugae
gtggccaagggccagtacgacatcgtgtacttcaacccgctgcactacgtggtctttcacgacagcgcgggctatcaggcgctggcgagggaaaaagatacccggttggttgggctgattgtggtgcgcaaagacagccccatccagaacgttcgtcaactggaaggcaaaaccctggcccttcccgcgccagagtcgttcgccgcgagcgtactgccccaagcggagctggagtccatgggcgtacatgtcaatgtcagttatgtcggctcacacgactcggtctatctcgccgtcaggcaaggtctttattcggcaggcggcggtatcaaccgcacctggagccagcaacctgatgctgtgcgcaatgcgctgcgcatcttgtggcaaacgccgccgcacacgccgcacccgttcgccacgcggcccggcttgccttcgacgcagcgccaatgcctgcttcggacattgacccatctgcaagacacaccggagggactcgccttgctacagcaagtgcaactgaaaccgctgacggcggctcgggatgaagactgggacgatatccgccgcctgggcatacattaccaagcgccgggagagcaatag

SEQ ID NO: 1976 - DNA, 1020 bp, Chromobacterium substugae
atgaagaagcagctagctgtcgcaatcggtctggccgtgtccggacttttgtccccgctggcatacgccaaaaccacgctgacggtgtacaccgcgctggaggccgatcaggtcaaggattacaaggaggctttcgagaaagccaatccggatatcgatatccgctgggtgcgcgaatccaccggcatcatcaccgccaagctgctgtcggagaagaatcatccgcaagccgacgcggtgtggggcttggccgccaccagtctgatgatcctggaccagcaaggcatgctgcaggcttacgcgcccaagggcgtggacaagctcagcccgcaattcgtcgacaaggccaagccgcccaagtggaccggcatggacgtgtgggccgccaccatctgcttcaacaccgtggaagccgccaagaagaacctgcccaagccggaaagctgggccgatttgaccaagccggtctacaagggccagatcgtgatgccgcatccggcctcgtccggcaccggctacctcgatgtgtccgcctggctgcagatgatgggcgagaagccgggttgggactatatggacaagctgcacctcaatatggcgcagtacgtccactccggctccaagccgaagatggccgccaccggcgaattcccgatcggcatttcgtttgaataccgcggcgcggaactgaaggcgcagggcgcgccgatagacctgatctacccgaaagaaggccttggctgggatttggaagccaccgccatcgtcaaaggcaccaagaatctggaagccgccaagaaactggcggacttctccgccagcctgccggcgatgcggctgtacgaaaagaactacgcggtgctggcgatgcccggcgtggccaagcagaatccgtacatcccggcggattacgccaagcgcctgtcgaaaaataatttcgcctgggcggcgaaaaaccgcgacgccatcctgcaggaatggtcgcgccgctatgaaagcaaggccgcggccaagaactga

SEQ ID NO: 1977 - DNA, 1101 bp, Chromobacterium substugae
atgaaaccggtcgatagcctgcagggcttgtccgaacacctgtccgtccacggcctgagccgccgcttcggcggcttcgccgcgctggacgcggtgtccctgtccatacgcaagggcgagttcgtctgcctgctggggccgtccggctgcggcaagaccacgctgctcagattgatcgccggcctggacgcgcccgacgacggccgcattctgctgtccggccgcgacatcaccgatgccgcgccggccaagcgcgattacggcatcgtgttccagagctacgcgctgtttcccaatctgaccgtcgccgacaatatcgcctacggcctgaccccgcggcgcgacaaggcgcggcatgaaccgcgggtgcgcgagctgctggatgtggtcggtctgccgggcgctgagcgcaaatatccgtcgcagctgtccggcggccagcagcagcgggtggcgctggcgcgggcgctggccaccgcgccgggcctgctgctgctggacgagcccttgtcggcgctggacgcgcgggtgcgcgagcggctgcgcgacgaattgaaaagtctgcagaagcggctgggcgtcaccacgctgatggtgacgcatgatcaggaagaggcgctggccatcgccgaccgggtggtggtgatgaacgccggccgcgtcgagcaggtgggcacgccggcgcaaatctaccgccagccggccagccgtttcgtcgcccagttcgtcggcgcggccaactggctgccggcgcagcgccagggcagccgcgaggccagggtgggcgcatgcgcgctgcggctggagacgccattgccggaaggcgggccgctgaccctgtttctgcggccggaggacatcctcgtcaaggaccgctgggagccgcggcccaataccctgctggcgcgggtggaggatgtcagcttcggcggcgcgatgacccgcgtccggctgcgcccggagggcatgccgggtcagacgctgctcgccgagctgtgcccttccatgctgcggcgccagccgctggcgccgggcgagatcgtgccggtggagctgccggccgcgctgctgcgcgcctatgccggggaggccgcatgctga

SEQ ID NO: 1978 - DNA, 1704 bp, Chromobacterium substugae
atgctgagcctggcgctgcgatcggtccgcctggccgctggccgcgccgacggcgaaaaactggcggcggctgcgctggtgtggacgctggcggcgttgctggcgttggcgctgggtttgccgctgctgttcatcctgggcaaggccttcgtcaccgtggatggcgtcttcgccggcctggccaacttcgcccaggtgctggactctcccggcctgatgcgcgccgcctggcatagcctgctgctggcgctgacggtgagcgcgctgaccttgccgccggccttcgccttcggctggtgcctgagccgcagccgggcctgggggcgcggtctgttccgccagatcgcgctggcgccgctgctggcgccgtcgttgatgccggccatttcgctggtatacctgttcggcaaccagggcttgctcaagggttggctgggcggcgccggcatctacggtttttggggcgtggcgctgggcgaggtgttctacacctttccctacgcgctgatgatcatcgccaccgcgctggccgcggcggacgcgcggctgtacgaggcggctaggacgctgggcgccgggccgtggcggcagttcttcaccattaccctgcccggcgcgcgctatggcctggtatcggcggcgctggtggtgttcacgctggtggtcaccgatttcggcgtgcccaaggtggtgggcggcgactacaacgtgctggcggtggaggcgttcaagcaagtggtcggccagcagaacttcccgcgcggcgcggtggtggggctgatgctgctgctgccggcagtgttgtccttcttcatcgagcgcgcgctggcgcggcggcaacaggcggcgctgaccgcgcgggcggtgctgctcgttcccgcgccctcgctgcccagggatgccgcggcgacggcgctgctggccgtggtgtcggcgtttttgctggccttgctgggcgtgggggtggcggcgtcttttctcaaatactggccgtacgatttgtcgttcacgctggcgcattaccgtttcgaccatgtcgacggcggcggctgggacgcctatttcaacagcctgaagctgggcggcgcggtggcgctgctgggcagcgcgctggtgtttctgggtgcctacgtctgcgagaaacagcaggcggcgccgctgggccgcggcctgctgcgcttcttcgccatgctgccgatggcggtgccaggcctggtgctgggcctgggttacgtattctttttcaaccatccggccaacccgctgaacgcgctgtacggcggcatggcgctgatggcggtttgcaccatcgcccacttctacaccaccgcgcatctcaccgtcgccaccgcgctgaagcagctggacggcgaattcgaagcggtggcggcctcgctcaaggtgccgttctggaccaccttgcggcgggtcacgctgccggtggcgctgccggcgctgctggacgtggcgcgtttcctgttcgtatcggcgatgaccacgctgtcggcgctggtgttcatcatcagtccggaaaacagcctggcggcggtatccatcatcaccatggacgacgccggcgacaccgcggctgcggcggcgatggccaccttgatcgtgctgacctccggcagcgtgtcgctgttgtcgctggggctggaaaaggcgttggccagacgcagccggcgctggcgcgagccgggttga

SEQ ID NO: 1979 - DNA, 876 bp, Chromobacterium substugae
atgacccgcccgctttcttgccttgtccgcgccgccgcgctggccctgccgctggcgcttgccgcctgcgccagcctggacagcgccaagttcgccgcgctgagcgaggcggcgcgccagatggacgacggcgccgcgtccagcttcgccgcgctggagcaatcggcccgcgacagcgcggtgctgaccgcgcccgatcgcaaggtcggcctgcaaggctttccgctgctgaatgcccaggggcagccgtatgacctgtccggccaactggacaaagtgaaggcgtcgctggacctgctggcctgctattcggcggcgttggcgcagctggccgccgccggcaaccccgccgacatcgacaaatcgtcgcaggacctggcggccagcctgcgacagttgcagggcagcggcctgagcggggcggcggccaatggattggcgaccgcgatcgacgccttcggccaggccaagctcgcgtcgcagcgcaaggacagtctgcgcgcggtgatggaccgggcgcagccggggctggaggcgctggcgcaggaaatgggccgcgtgcagcaggatttgcagctgtatctgaccgacatcagcctgcgctacctaagctttgtcgaccgcgacggtttccggccggcctttggcagctgggcccgctatcagggcgatctgcaggtggcggcgcagctggccgatttcgaccgccagcaccgggcgctggacctgataggcaaggagtcgcaggcttttcccatcctgcaccggcaactgcggcaaagcctggatgatccgggcgcgcggcaggaccggctgcgcgaattcgtcgacgaagccaagcggctgcgcagcctgtaccggtcgctgcccggttag

SEQ ID NO: 1980 - DNA, 327 bp, Chromobacterium substugae
atgaataatcatgatctggccgagcggctcaccgggctggcttcccggttcaacaacctgatgatcgccaccaccggcgacatcagccggcaatgcggcgatctgcaggcgacgctggcgggccagtctatggccgccatctcccgcgatctggacgccgccgccgcacagtacgccgacgcggtggccgcgctgcaggacgcgacgcaagcggcggacagcgcggcgcagcaattgcagcagaccagcaattccatcgcgtttgtggccaaggcgatacagctggcgggcaaggcgtcgggcctggcggcgccattgttggcctga

SEQ ID NO: 1981 - DNA, 174 bp, Chromobacterium substugae
atgatctggagaagatgctggctataccggttaccactgctcggccgtcagattttccaccggctttccctcaatatcggacagccgccgcgctttagtaaaggaaggaaaagcttgttaaagaacttgcgcgcggcaaggggcgccggcgccggtggcagacggaccacataa

SEQ ID NO: 1982 - DNA, 3234 bp, Chromobacterium substugae
atgatagatacttcggaagccaaactcggattgggaaaaggcaagccgtcttcttctgcatggtgggcgctgttcgggctgttcatcgcattgtgcggcctggcggtgtcgctgttcctcaacgaggttcatacctcgcggttccaggcgatgtttttcagccgcgccgcccgccatgccaccttccaggtcgaacctggccgcagcaaggacatgcgctttcccgagcgcggcggcccttacgacctgcgcatgggctattccgacctgccgcgctacctggatcgcttgcaaaaccgcggcttcgccattatcggccaggctcgccagtcgccggacatgatacggctggtggacagcggcgtgaccgggcccttgctgccgctggggctgttcccgccgtatcgggaaaaggaccagtccggcttgctggtttacgacggctatggccgcgctatctaccagtcgctctatccgcagcgggtgtaccgcgatttcgatgcgctgccgcgcctcttggtttccgggctgctgtacatcgaaaaccattcgttgctggacgacagcaatccgcagcagaacccggcggtggagtggtcgcgcttcggcaaggcgctggcggacgagggcctgcacctgctgcggcccggctaccattcggccggcgccagcaccctggccacccagatcgagaaattccgccactcgcccggcggccgcaccggcacccccaaagagaagctgcgccagatgctgtccgcctcggtgcgggcctatcatggcggcgaggataccagcgccgtgcgccgccagctggtggtggagtacctgaacacggtgccgctggcagcgcgcgccggcttcggcgaaatctccggcatcggcgacggcatgtgggcctggtacggccgctcgttcgacgaggtgaaccgcacgctggccagcgacgcgccgctgtcggtgggcgagcaggccaccgtgttcaaggaggcgttcagcctgatgatctcgcagcgcagcccgtcctacttcctcaacggcgacatgaaggtgctggaggcgctgacggactcctacctgcggctgatggcgcgcgacaaggtgatcacgccggaactgcgcgacgccgccttgcgggtgtcgctgcggcagcagcgggaaaaggccagcttcgtcagcaagtcgctggtggagcgcaagggcgccaacgcggtgcgggtgaagctggccggcatgctgggcatgccgcgcatgtacgatctggaccacctggacctgacggtcaacagcacgctggattcgcaattgcagcaggaggtgaccgacaagctgctgaagctgcgcgacccggattacgccaaatcggtggggctgggcgacaaattcctgctgcagcaaggctcgcccggcggcgtcacctacagcttcacgctgattgagcgcacgccggtcggcaaccaggtcagggtgcaggccgacaatttcgaccagcccttcgacatcaacgaaggcaccaagctggatctgggctccaccgccaagctgcgcaccctggtcacctatctggaagtcatcgccgatctgcaccggcagtacgcgggcctggacaaggcggagctggccgccatccggccgaccgagcatgagtcggtgctgcggcgctgggcgatagactacctgaagcaaaacgacgaccgcagcctgtcggcgatgctggcggcgtcgatggagcgcaagtacagcgccaacccgggcgaaagcttcttcaccggcggcggccgccataccttcgaaaacttcgagaagagcgacaacagccgcatcctgacgctgcgggaagcgacccagcactcggtcaacctggtgtacatccggctgatgcgcgacgtcgcccactactacatgtacccggctggctatgaccgcgaggtgatgggcgacaaagacgacccgcgccggctcgcctatctgcagcgcttcgccgaccgcgaggggaaaaccttcatggccggcttctaccgcaaataccacggcaagagcgccagcgagatcgacgccgccctggttgaaaaggcgcgccgcagcgccaagcggctggcggtgatcttccgcagcgtgcatccaaccgagggccaggctgcaatggcggccttcatcgcccgctaccagacgccgccgtccaagatggaccccaaaaacctggccaagctgtacgacgaactggggccggatcgcttcaacctggccgaccgcggttatctggccggcgtccatccgctggaattgtggatggtggcttatctgcatgcccatcccaaagcggggtggtcggacatggtgcaggccagcgcagcgcagcgccaggaagtctaccaatggctgttcaacagcaagcacaagggcggccaggacaaccgcatccgccagatccaggagatcgacgctttccgccagatccacgcggcctggaagcgcatgggttatccgttcgattccttggtgccgtcctacgccaccgcgctgggcgcgtcggccgaccggccggcggcgctggccgagctgatgggcatcatttccaacgacggagtgcggctgccgactgtttacatcgacaaactgcatttcgcttccgccacgccgtacgacaccacgcttgcgcaggcgccggcgcgcggtgtgcgggtgctgccgccggaaatcccgcaactggtgcgccaggtgctgtccgaggtggtggacaagggcaccgcccaccgcgccgccggcgcgttcgaccgcaagggcgagcacgtgctgataggcggcaagaccggcaccggcgacaaccgtttcaagaccttctcccgcggcggcggcctcacctccgcgcgggtggtcagccgttccggcgccttcgtgttctacatcggcgaccactacttcggcaccatcatcgcctatgtggccggccccaaggcggccgactacaaattcaccagcgccttgccggtgcaggtgctgaaggtgctggcgcccacgctggcgccgcggctggatctgacgccgcgcggcaccagccagggcgccgacagcgtggcggaaggcaccccggacttgggcttgccgccgggcactccgttatgcctggtgcccagcctgggcggcatgtgccagttgctgaagcagccgcagatggatgcgctgccgcaacggcggcgcgaggcggactggcgggcggacggccgggaaggttag

SEQ ID NO: 1983 - DNA, 774 bp, Chromobacterium substugae
gtggaaaaaatcgcccgctggcgagacgaaatccgcccggcgacgatggacgacttgctggcgggcatcgccccgctgatgccggtgctggacctgatccccaacgcggccatcttcatcaaggacaggcaggcgcgttatctctgcgccaaccaaacgctggcgcagcgctgcggcttgaaggatttgccgccgctgctgggaaaaaccagcgccgaagtgtttcccatccagctggggcaggtctacacggcgcaggatatcaaggtgctgcaggacggccaggtgctggaaagccagctggaactgcatctgttcaaaagccgggagccaggctggtgtctgacctacaagtggcccttgtacaaccggcaggaagaaatcatcgggctgatcggcatctcgctggatttgcagtcggccagcaagacgcacccggcttatacgcgcctggcggcggtggacgaattcatccgccgccatttcagccagccgatttcaatggcggagctcaccgccatcgccggcttgtccatcgcccagctggagcgctactgcaagaaagtgttccacctgtcgccgcggcaaatgatactcaaagccaggctggaacatgcgcaccggctgctgcatgaggacatggccatcaccgaagtggccctgagctgcggctataccgaccacagcgccttcagccgccagttcaaagccttgactggtctgacgccgcgccagtatcggcaagagctgggccatggcagcggagcggaataa

SEQ ID NO: 1984 - DNA, 939 bp, Chromobacterium substugae
atggacaagcgaatcaagcagattgaagtcatagattcccacactgggggcgaacccacccggctggtgctgagcgggtttcccgcgctggcgggggccaccatggcggaccagcgcgatgaattgcgcgagcggcacgacccatggcgccgcgcctgcctgctggagccgcgcggcagcgacgtgctagtgggcgcgttgtactgcgagccggtttcgcccggcgccacatgcggcgtgatcttcttcaacaacgccggctacctgggcatgtgcggccacggcaccataggtctgatcgcctccttgcattacctggggcgcatcgcgcccggcacccaccagatcgacaccccggtggggccggtggacgccgtcttgcatgagaacggcgcggtgacgctgcgcaatgtgccggcttaccgttaccgccggcgggcgtcggtgcaggtgcccggccatggcacggtgatcggagacatcgcctggggcggcaactggtttttcctggtggccgagcatggcctgagcatgcggctggacaatgtcgaggcgctgagcgcgttcagctgcgccacgatgcaggcgctggaggagcagggcgtcaccggcgccgacggcgcgcgcatcgatcatgtggagctgttcgccgacgacgagcacgccgacagccgcaacttcgtcatgtgcccgggcaaggcctacgaccgttccccctgcggcaccggcaccagtgccaagctggcctgcctggccgccgacggcaagctggccgaaggcgaagagtgggtgcaggccggcatcaccggcagccgcttcatcggccgttaccagcgcgaaagcgatttcatccgcccctacatcaccggccgcgcccacgtcacggcgcgcgcgacattgctgatagacgaagaagaccccttcgcgtggggcatctga

SEQ ID NO: 1985 - DNA, 948 bp, Chromobacterium substugae
atgagcgataacattttcaccggttgcattccggcgctgatgaccccgtgcaccgctgatcgccagccggatttcgacgcgctggtggccaagggcaaggagctggtgtctctgggcatgagcgcggtggtgtactgcggctcgatgggcgattggccgctgctgagcgaagctcagcgccaggagggcgtggcgcggctggtggccgccggcgtgccgaccatagtcggcaccggcgccgtcaacacccgcgaggcggttttccatgccgcccacgccgcccaggtgggggcgcatggcttgatggtgatcccgcgcgtgctgtcgcgcggcgcgtcgccggccgcgcaaaaggcgcatttctcggccattctggccgccgcgcccaagctgccggcggtgatctacaacagcccctattatggcttcgccacccgcgccgacctgttcttcgagctgcgccgcgcctatcccaatctgatcggcttcaaggagttcggcggcgccgccgacatgcgctacgccgccgagcacatcacctcccaggatgacgaagtcacgctgatggtgggggtggacacccaggtggtgcacggcttcgtcaattgcaacgccaccggcgcgatcaccggcatcggcaacgcgttgccgcgcgaggtgctgcacctggtggcattgagccgggcggcggccagaggcgatgccgtcgcccgccgccgcgccggcgagctggaatcggcgctggccgtgctgtcctccttcgacgagggctgcgacctggtgctgtattacaagcacctgatggtactgaacggcgacaaggaatacgcgctgcatttcaacgagagcgacgcgctgagcgccgctcagcgccgctatgccgaaacccagtacgcgctgttccgcgagtggtaccgcaactggtcggccgagcagaacgtcgcctga

SEQ ID NO: 1986 - DNA, 1572 bp, Chromobacterium substugae
atgaatctgacaggcatgatgctcatcggtgggcgggcggtcgccggccgccgcgagacgatccgggcgatagacccatccaccgatcaagctctggagccgggctaccccggtgcagaccgcgaacaggtggagcaggcctgcgcattggcctgggaggcgtttgacgcctaccgcgacaccgcgccggaaacgcgggcgcgttttctcgaaaccatcgccgacgaaatggaagcgctgggcgatgcgctgatagaacgcgcgatggccgaaaccggcctgccgcgcgcccggctgcagggcgagcgcggccgcacttgcggccagctgcggctgttcgcctgcacgctgcgggccggcgagtggctggacgcgcgggtagacccggccatgccgcagcgccagccgctgccgcgcgctgatctgcgtcagcgccaggtggctttggggccggtggcggtgttcggcgccagcaattttcccttggccttctcggtggccggcggcgacaccgcttccgcgctggcggccggctgcccggtcatcgtcaaggcgcatagcgcccatcccggcgtcagcgaactggcggggcgggccatcgcgcgggctgcggagaaatgcgggctgccggccggggtgttcgcgctgctgttcggcgcaggccgcgaagcggggcaggcgctggtggccgatccgcgcgtcaaggcggtgggtttcaccggctcgcgcggcggcggcctggccttgtgccggctggcgcaaagccggccggagccgattccggtgtatgcggaaatgagctccaccaatccggtgtttctgctaccggcggcgctgcgggcgcgcggcgaggcgctggcgcagggcttcgtcgcctcgctgacgctgggcgcggggcagttctgcaccaatcccggcttgatcatcgccgagcaaggcccggcgctggacggcttcatcgccgccgcgtccgccctgctgcggcagagtccggcgcagaccatgctgacgcccggcatcttccgcgcttaccaggccggtgtggacgcgctgtccggccatgcccggctggcggccgccggcttgccggccactgggcccaaccagtgccaggcccagctgtggctgactgatgcgcaggcgtatctggccaatcctgcattgcgggccgaggtgttcggcgccgccgccttgatcgtgcaatgccatgacgcgcgggagtttcgccaacttgccgagcagctggaaggccagctcaccgccacgctgcagctggacgagggcgatctggacctggcccacgcgctgctgcccacgctggagcgcaaggccggccgcattctggcgaacggctggcccaccggcgtggaagtgtgcgacgccatggtgcatggcgggccgtacccggccacctcggacgcgcgggccacctcggtgggcacggccgccatccagcgcttcctgcggccggtctgctaccaggacttgccggacgcgctgctgccgcaggccttgaaacaggccaacccgctggcgctgcgccgcctgctggatggcgggcgggagggctga

SEQ ID NO: 1987 - DNA, 1260 bp, Chromobacterium substugae
atggcgcccgctcttgcgcccggcgcggccgtcatcgtggtgggcgctggcatagttggcattgctacggctttgcagctgcgcctggccggtttcgaggtgacgctgctggaccgcggcgagccggcgatggaaaccagctacggcaacgccggcgccttcgccgtcagcgacgtgatcccgctggccgagcccggcgtgctgcgcaaggtgcccggctggatgttggatccgctggggccgctggccctgcgttggcgctacctgcccacgctggccccctggctgctgcgctttctggccgccagccggccgcgccgcgtggccgaactgacccaggcgctggccgcgctgctggggcgggtcaatgacgactacgccgcgttgatagcgcgggccggcctcggccatctgtggcggcggcacggcaacctgacgctgtatcgcagccgggaggagttcgacgccgccgcgccggcctgggatgccaagcgccgccatggcgtgcgatggcaggtgctggaccgcgaggcgctggaggaagaagagggcgttgtgggcgaggaatggcgctacgcggtcaaggtgccggcgtggtcccatgtggacgacccctatgtcttcagccgcggcctgttcgacgccttcctccgcgagggcggccgctttgtgcgggacgaggcgctggccacagcgacggaagccggccgcgtggccggcgtggaaacggcgggcaacggccgcctgcgcgccgacgcggtggtgatcgcctgcggcgtgtggagcgaccgcttcgtcaaacaacatcaataccgcgtgccgctggaaagcgagcgcggctatcacgtcaacctgcccaaggccggggtggcgctgcgccacttcatccagtgcgccagcgagagcttcgtcatcctgccgatggccaacggcggcttgcgcctggccggcacggtggagctggcgcaccgcgacgccccgccggactggcgccgcgcccgcatcctgctggacaaggccaggcgcatcgtcggcgatttctccaccgaagacatgacggtgtggatgggcaaccgcccgtcgctgccggacaccctgcccatcatcggcccggcgccgcagccggggctgtggttcgccaccggccacggccatctgggcctgaccctggcggccaccaccggcgcgctgctgcgcgacatgttgcaggggcggactccggcgctggacatgcagccgtatcggctatctcgtttttga

SEQ ID NO: 1988 - DNA, 1149 bp, Chromobacterium substugae
atggcttggaacaaactgtttgcggacgtgaattgggtggtggcgctgggcggcatgatggcgccgttcgccatggcggcggcccatgccgataccgtggtcaagataggcttcgcctcgccgctgtccggcccgcaggcccactatggcaaggacaatgaaaacgccgccaaaatggcggtggacgatgtcaacgccaagggcctggtggtgggcgggcagaagattcagttcgaactggtgtccgaggacgaccaggccgacccgcgcatcggcacccaggcggcgcagcggctggtggatgccggggtgaaggccgtcatcggccatttcaactccggcgtgtccatcccagcctcgcgcatttactcagaagccggtatcccgcaattgtcggtggccaccaacccggcttatacccagcaaggctacaaaaccaccttccgcctggtgggcagcgacagccagataggcggcgcgctggggcagttcgccgtcaagacgatgaaggtcaagaccatcgtcgccatcgacgaccgcaccgcctacggccagggcatcgccgacgaattcgtcaaggcggtggcggccaacggcggcaaggtgacgcgccgcgaattcaccaccgacaaagccaccgacttcaccgccatcctcacctcgctgaaggccgtcaatccggacgtggtgttttacggcggcgccgacgcccaggccgcgccgatggtcaagcagatgaaacggctgggcctcaaggccaagctgatgggcggggacatgctcaacacccccaccttcatccagctggccggcgcggacgcggccggccattactcggcggtggccggcggcgtgctcagcgcccgcccggcgggcaaggcgtttgagcgtcgctacaaggcacgcttccatcaggacgtggtgctgctggggccgcagttctacgacggcgtgatgctggtggccgcggccatgaagcaggcgggctcggtggagccggccaaatacctgcccaagctggccgccatccgctacagcggcgtcaccgccgacttcgccttcgcgcccaatggcaatctgttgaaagcgccggtcacgctgtccacggtgaaaaacaacgcctgggcggtggagacggtggtccgctga

SEQ ID NO: 1989 - DNA, 477 bp, Chromobacterium substugae
atgaaaatcactgccaacaccgccgttaccctgcgcatgaaagtcaccgacagccagggcctggtctacgacgacggcaagcacccgatcgcctacctgcacggcgactacgacaacctgttccccaagctggaagccgcgctggagggccaggaaccgggcttccagatcacggtggatctcgccgccgaagacgccttcggcgagcgcgacgaagcgctggccaccaccatggccaaggcggacttcccgcccggcatcaaggtgggcggccagatccagcgccccggcccggacggccagccgcgctactacttcgtcaccaagatcaaaggcccgaccgtcttgttggacggcaaccacccgctgtgcggcaaaaacctgcgcttcgccctcaaagtggtggatgtgcgcgaggcgacggccgaagaaatcgctcaccagcatgtgcacggcgagcacgggcatcagcactga

SEQ ID NO: 1990 - DNA, 1908 bp, Chromobacterium substugae
atgaacaaagaatggcaattgccacctgcttatgagtctgaaatgcagaattcatacacaatcgccgagtcgttaattggaaacttcgcagaaggtagattttcacctcccgatttattgatcacgtctgtaacagaatacttctgcatccaggatgatgccgagaatgctcttaagaggtttaccactcacttgaacggttctcacgaggacttcgatgcgtcggacgatccgagaattcaggcgattttggtgatcggaattgtagcagcctgggcctcttcagaaactgaaaaccggtacacagctttcagggctctcgccaaaaactcatggtgggtcgagcatttgtggacggaagtggcactggtcgtagctctgaaaaatgatgctttcaaagaggcactcttaaatttagccgaacaacatttcgccgatgctgaaaaaaagctacttcagaaatatggggttgatccatcccatccaatcaccctcgatgaaatttggtacggacatgccagggaaagtcggaccgatgactccagttggccatgggttaaattactagcaaagcttgatctcaacacattgtttaaatggatgaactccacacaaagcctagtcttgatcaatcgagtactcgacagccctgagttttaccgtaactacgatttatgggaacagttcacatacaggtctccaacaagtttccaaagcgatggctcgtgggatggtgccctattgctacctagcttgctcaggcacggaagcatgcaactcattcacattgctgatgggcatggacatcctcactctgtgttagagccgcacgtcgaatctctgctcgcttctttcgttgatactatcgccaaaagatccgatgtcgagggcctgtttaagcgttggggcacatggctcacttgccagtaccttaacttccctgataacaactcgggtcaaaaacgatctctgagtagccaagatatattatgggcattagccgataaactcccacatccttgctccccaaccatttccgagcaattgaatttttcttgggagccatgggtttatcaatccatgctagcacttctacattcgaatcagcccgacaggttcccggcaccggacgtcagagatttcatcaacgaatggagcttgacacctaccgagtggaactcctccaaaggtcagtcgattagaagccatgttagtgaatatcacgctactcagcccaacaactatgcttgccgggtgctcgggtattccgtcgcattgaacgataacttcaccagtcactggctgaatatgtggaactctagcgttgcgctgagggaaattctcgaattccgtcccatttataaaatttccgcagaatggcaaccctcagatgcttcaagactgatgcgcacattggttgacgtaggcctagggattctggactgtactgctaactcacaggaaactcacaatcccgaaatacttaaccaatccgccgcgctatttcaagcgctgtgggaagctaccactgagatgttaagtattgacttctatggtaacgacttctggccaatcatgcagcaacacctagtcattcgtcggctacagtggacagtaaaagcaaaaaacgcgaatgatgaccattacagtatatggctggataagaccgcctacccgacgtcacgggagatattggccttagtcgccagcaatccctgttcattcataagcctgctgcccctgcttgtgcaaaaccagatccctaaggaatacttgaaggacttgctcaaccaggccgaaattgacttaacttcactcgcatcgagtgcagccagatacgagagtggacctaagatgaaattcaagatacatccaggtcacgtcagcttgattgaagagttagcttag

SEQ ID NO: 1991 - DNA, 1701 bp, Chromobacterium substugae
atggaaagtaacgaaagcagtaacccctacagtaaattgactgacggcttcgaacatgcggtcgtgcatgtcgctgtggttgtaccaccacgatctacatctgagcgacctcctctacgtttgctgttcgcatcggtatggttgctggcatcaggtaggcaagcccctttgagacctgccaagccttacttaaaaaaattcaaggaagaaggcgctattgcggtcgaccgtatcgtcatgaccgcagaagaagccatccggtggtaccgaaccgcatctgatgaacttggtacacccattccccttcgtgatgccaggaaggactctgatggagtgcccctctccgctggcaggctaagtgactttccaacatggcctgtattgggcgtgcccttggaaagtgacgacatcacgcttaaatctgaacgtccttcaatccccttccgtaaccttggtatcatcaggtactcacgtcgaatttcagacagtcaagaatggccgagtttccttgaccaagacggacaaagcaaaaattgccaagaagccttcaaattcctagagcaccacatgcatgtcgattttagggagtaccctgaatatctaggtgggatggcgctcgctgtgcctgactgcgatgttcattcagtccggcaattcgttgatcctaaagaagacggttccgaatcgttgtatatccatttgaagccccacccaggcaggaaacttgaaggtttgagcctgacctcaatggaagggcaagaagggatactcacctcctttgatacagttccggtaccggaagatggtttggttgtgattgaaagaccgtcatctatccatggctccggtcttatcctgacacacacagaacgcggagtcttattgcaaactcccatgcgacagttcattcgacaaatgaaaacgagtattgaagtggtcgagcaacgcattaaagtttcggttcccgagacggataaaaagaagagcgcagtaaatgagtacgtcaccgataaaaaaaccttagcgtcctcacaaacattggggaaagcaccgaatacaacaaatgctttccagcgtttgctagacgcaaaaaatgagcgactccttaatcacagtgccacagtatatgagcaaacgtggtttacggctaaccaacgcaaggaagcgctcgaacacatcaggaaaaagttcaagcacgctcactcaagcatcttcatcgctgatccatacttcagcgcaaaccagattccccaatatctatttgctattgaacgagacgagatcaagatacaaatcctaacttcaagcagtgctttcaaacagatcaacgaagcgacaacgggtaccgaaattgatagagaggcgacacaggacacacaccaaaaattgctagaaaatctagctatcttccaaaatagtcacaagaacaatattgaaataaaagtcgcgaatacagaaaacagtctgtttcatgatcgattcatcgcgatcgatagtcgtgtatggatgatcggaagttctctaaactctatcggtatacggccaacgcttatcatgcgtataccccatggcgagaaaatcctcgaccatcttctgcgcctctacaacaacgctcttcctcttgaggatttcaaagtcccgcggaaggcacttgagaagccatgcgttcactgtgggcgtgacgtgaaggacgcgaaataa

SEQ ID NO: 1992 - DNA, 681 bp, Chromobacterium substugae
ttgatcgccgccactcgcattcgttatggcgcgcgccgcatctacgtcctactgcggcgcgaaggctggcggatccatcacaagaagacctaccggatctattgcgaggaaggcttgaatctgcggcgcaagcggcccaaacggcgagtggcagcggcgcatcgccacgctcggccggccgtctccaatttgaacgcgtgctggagcatggatttcgtcgccgatcagctgttcaacggccagaaaatccgggccttaactgtggtggataattttagccgggagagcttggcgatcacggtggatttcgcactgaaagccgcggacgtggtggctacgatgcagcatgtgcaagccttgcgcgggacgccgcaacggattcaggtcgacaacggcagcgagtttatttcgttggcgctggaccagtgggcctatgagcaaggcgtcacgctggacttctcacgaccaggaaaacccacggataatgcctttatcgagtcatttcacggcagtctgcgcgatgagtgcctgaatgtgcattggtttctatcgctggacgacgcacgtgaaaagatcgagcgttggcggcaggattacaacgaattcaggccgcacagttcgctgggcgaccagaccccgagcgagttccgacttgctcaccttgaagccggaaatctctag

SEQ ID NO: 1993 - DNA, 321 bp, Chromobacterium substugae
gtgaagccggctcgcaaacgcgagctggccaacttcctgatcgacgcgtaccgcgtcagcattaggcgtgcgacggccgttattcagctgcggcaagctacctatttttatcgccctcaccctcgagacgatcgtgcggagcggcagcgaatccgcgagatcgccgccactcgcattcgttatggcgcgcgccgcatctacgtcctactgcggcgcgaaggctggcggatccatcacaagaagacctaccggatctattgcgaggaaatagatccggtaggtcttcttgtgatggatccgccagccttcgcgccgcagtag

SEQ ID NO: 1994 - DNA, 267 bp, Chromobacterium substugae; identical to SEQ ID NO: 1290

SEQ ID NO: 1995 - DNA, 471 bp, Chromobacterium substugae
atgaacagcatcacctttgacggccgcctggccgccgacgccgaactgcgctacaccccgagcggcgaacccgtcctgtcgttccgcgtggccagcgacatcggcttcggcgaacgcaagagcaccaactggttcagctgccaggtttggggcaagcgcggtgagtcgctgaagaactacctggccaaaggccagcaagtgaccgtatacggccaactgaccctgcgcgaatggcaggacaaggacggcaacaagcgcgtttccccggacgtgcgcgtcaacgaactgagcctgcaaggcggccgcaatgaaatgggcggcggcgcctccagcggcatgggcggcggcatggacgacggctacggctacaacgccccggcccagcgccaggaagccccggccgccccgcgccgccaggagccgaaagcggccccgcgcatggacgacatggacgacgacatcccgttctag

SEQ ID NO: 1996 - DNA, 126 bp, Chromobacterium substugae
atgcggccaaccggcctggttaccatcggcaagccgatgcgacgccaagccgccgcgccgccgccatgcaacgccgccttcgcggcgcgggccaagcagtttgaacttatccggagaattgaatga

SEQ ID NO: 1997 - DNA, 660 bp, Chromobacterium substugae
atgaacaagaacgctgtagtggccgccgtggtggcggtaagcctggccggttgcgccaatatgagcgacacgcagaagggcgtgggcggcggggcggccatcggcgccggcgtgggcgcggctatcggcgccttgaccgcgggcggccatggcggccgcagcgcggctaccggcgccgccatcggcggcttgctgggcgcgggcggcggttatctgtggtcgcagcacatgcagaagcagaaggaggcgatggagcaggcgaccaagggcaccggcattggcgtgagccagacggcggacaatcggctgaagatcaacattcccagcgacgcttccttcgataccggcagctacgcgctgaagcccagcctgaagccggtgctggacaagctggcggccacgctgcagcagaatccggtcacctcggttaatatcatcggccataccgacaacaccggcagcgacgcgatcaacaatccgctgtcggtcaaccgcgccaaggcgacgcagggctacatcgcgtcccgcggcgtggacatcaaccgcatcggcatagacggccgcggctcgcgcgagccggtggcggacaacggcaccgtgtccggccgcgcgatgaaccgccgcgtggagattttcgtggcggagccagcgcagaagtaa

SEQ ID NO: 1998 - DNA, 1362 bp, Chromobacterium substugae
atgaatgccaccgaattgcgggccagcctggggctggccggtatctacgccctgcgcatgctgggcatgttcctgatcctgcccgtcttcgccctgtacgccaacacgctcaagggcgccgacaaccataccctgatcggcatcgcgctgggcagctacggcctgacccaggccatcctgcagctgccgctgggcatgctgtcggacaagataggccgcaaaaaagtgatctacggcggcctgctcctgttcgccgtcggcagcttcgtcgccgccggcgcgcacgacatcgccaccctgacgctgggccgggtgatacagggcgccggcgccatttccgccgccatcaccgcgctgctggccgacctcacccgcgaggaaaaccgcaccaaggcgatggcgatgataggcatgtccatcggcaccaccttcgcggtgagcctggtggccggcccggtgctggccaaatacatcggcgtcaacggcatcttcgccctcaccggctttttgtcgctggcggcgctgataggcgtatggctggtgatacccgacccgacggtgtcgcgcttccactccgacaccgaagccaacgccaaacgcctgcccaccgtgctgaaagacagccagctgctgcgcctcaactacggcatcttcgcgctgcacgcggcgcagatggcgatgttcgtcaccattccgttcgcgctgatcaaaaccggccatctggacaaatcccagcactggcaggtgtacctgccggtgacgctgataggctttatcctgatggtgccggccatcatctacggcgagaaaaaagccagactgaagccggtattcatcggcgccatcgcgctgatgaccgccgcccagctgggcatggcgctggcgctggacagcttctggcagatcgccgcctggctgtcgctgtacttcatcgccttcaacatcctggaagccaccctgccctcgctgatctccaagatcgccccggccgacgccaagggcaccgccatcggcgtgtacaacacctcgcaatcgttcggcctgtttttgggcgcggccgccggcggctggctgtacagccactacggcccggccggcgtgttcggcttcaccaccctgctgatgctgtcgtggctggcgtggtcgctgggcatgcagccgcccaaggcggtgcgttcggtaatgctgcacatcggcgaatcgtggcagggcgacgccgccgcgctgtcgcgcgagctggccggcgtggccggcgtccacgaagcctcggtattgctgaccgaccgggtggcgtatctgaaggtatcgcagcagcaatgggacgaggccgaagtgaagcggctgatagacgccaccttctaa

SEQ ID NO: 1999 - DNA, 2832 bp, Chromobacterium substugae
atggacagcatccgtatccgtggcgcccgcacccacaatctgaaaaacgtcaacctggacctgccgcgcaaccagttgatcgtgattaccggcctgtccggctccggcaagtcctcgctcgctttcgacacgctgtacgccgagggccagcgccgctatgtggaaagcctgtcggcctacgcgcgccagtttctgcagctgatggaaaagcccgatgtggacttgatcgagggcctgagcccggccatctccatcgagcagaaggccaccagccacaatccgcgctccaccgtcggcaccgtcaccgaaatccacgactacctgcgcctgttgttcgcccgcgtcggcgatccgcactgcccggagcacggcgtgccgctgtccagccagaccgtcagccagatggtggaccacgtgctggcgctgccggaggaaacgcgggtgatgatcctggcgccggtcatcgtcggccgcaagggcgaaaacctggacctgttcgacgacctgcgcgcgcagggtttcgtccgggtgcgggtggacggcgaagtgtacgagctggacgcggtgcctaaactggacaagaacaagaagcacaccgtcgaagtggtgatagatcggctgaaagtgcgcgccgacatgcagcagcggctggccgaaagcttcgagaccgcgctgcgccacgccgagggccgcgccatcgccgtggaaatggatggcggcaaggagcactggttctccgccaagttcgcctgcccggtgtgcagctacagcctgccggagctggagccgcggctgttctcgttcaacaacccgatgggcgcctgtcccaaatgcgacggtctgggcgagatcaccttcttcgacccgcgccgggtggtagcccatccggagctgtcgctcgcctccggcgcgatcaagggctgggacaagcgcaaccagttttactaccagatgctgctggcgctgggcgagcattacggcttttcggtcaatgacctggccttcgaagacctgccggagaaggtgcgcaatgtggtgttgcacggctccggccgcgacagcatcgaattcagctatatgtcggagaagggcgccaaattcactcgcgcccatccgttcgagggcatcatccccaatctggagcgccgctaccgcgaaaccgactcgatggcggtgcgcgaggagctggccaaataccagaacaaccaggcctgcccgcattgcagcggctcgcggctgcggctggaggcgcgccacgtgttcatcggcacgcgcacgctgcatgaaatcaaccagctgccgctgaaggaaacggcggacttcttcgagggattggaattcaccggccagaagcaggcggtggcggagaagatcgtcaaggaaatccgcgagcgggtgtccttcctcaataatgttggcctggattacctgaacctgtcgcgctccgccgataccctgtccggcggcgaggcgcagcgcatccggctggccagccagatcggctccggcctgaccggcgtgatgtatgtgctggacgagccgtccatcggcctgcaccagcgcgacaacgaccgcctgctgggcacgctgaagcggctgcgcgacctgggcaacagcgtgatcgtggtggagcacgacgaagacgccatccgcgaggccgattacctggtggacatgggccccggcgccggcgagcacggcggcgaggtgctggtggccggcaccccggccgatgtggccgccagcgagaattcggtcaccggcgctttcctgtccggccgccgcaagatcgcgctgccaggcggccgccgcgaactgggcgaggagcggatgctgcggctgatcggcgccaccggcaacaacctgaaggacgtgacgctggatctgccgctgggcggcctggtgtgcatcaccggcgtgtccggctccggcaagtccacgctgatcaacgacacgctgtacaagatcgccgcgcgcgacttgaacggcgccagcgaggagccgtcgccgtaccgcgagatcaagggcctggatcagctggacaaggtgatcaacgtcgaccagagcccgatcggccgcacgccgcgctccaacccggccacctacaccggcctgttcacgccgatccgcgagctgttctcgggcgtgccgctggcgcgcgagcgcggctacggcccggggcgcttctcgttcaacgtcaagggcggccgctgcgaggcctgccagggcgacggcgtgatcaaggtggaaatgcacttcctgccggatatctacgtgccctgcgacgtctgccacggcaagcgctacaaccgcgaaacgctggaagtgcagtacaagggcaagagcatccaggaagtgttggagatgacggtggagcaggcgctggaattcttcgccgtggtgccgccagtggcgcgcaagctgaaaacgctgatggacgtgggcctaggctacatccgcctgggccagagcgccaccacgctgtccggcggcgaggcgcagcgggtgaagctgggcctggaactctccaagcgcgataccggccgaacgctgtatattctggatgagccgaccaccggcctgcacttccacgatatcgacctgctgctgcaggtgctgcaccgcttgcgcgagagcggcaataccgtggtggtgatcgagcacaatctggacgtgatcaagaccgcggactggttgatcgacctggggccggaaggcggcgccggcggcggccagatcctggtcagcggcacgccggagcaggtggcggcccatccggccagccacaccggccgctatctggcgccgctgctggaacgagacaagaaataa

SEQ ID NO: 2000 - DNA, 447 bp, Chromobacterium substugae
atgctgagcttaggcaagatcgatcacatccacatccgcgtcaaggacgtggccgcggccctgaaatggtaccagcgcgtgctggggctgagtcaggatgcccgctacaagaccgacggcgagcacaacaacgccatgctggccaacgccagcggcaatgtgcggctggccatcagcgaggacgcggacgcagcggcgtccggggcgcagggcgcggtggccttcgtggtcagcggccaggaattcgtcgaatggatagaccagctggcgggcgagcgcgtcaccaaccgcgagggccagaccatcgcccgcgactcggtgcatgaccaccgcttcttctgcgcgctgtccttcgtcgatccgttcggcaatccgttcgagatcgtcagctacgaccacacctggctggtcggaaaattgaagctgggcggccagctggccgtctga

SEQ ID NO: 2001 - DNA, 309 bp, Chromobacterium substugae
atgggccattacttggtcgacaatcccgcgcctgaggatgtcgctgcgctgccgggcctgacgctgctggaattcggtgtcgactggtgtccgcattgccagggcgcgcagcccttgctggcgcagttcttgtccgcgcatcctggcttgcgccatctggcgctggaggatggcaagggcaagcggctggggcgggtgtttcgcgtcaagctgtggccatcgttcattctgctgcgcgatggcgtggagctggcgcgggcggcgcggccgcaagatgcggccgagctggaggcgctgctcgcgccgtaa

SEQ ID NO: 2002 - DNA, 381 bp, Chromobacterium substugae
atgttcgaactgggcaaaagctatacccgcgaagaaatccacgccgtggtcggcggcaacaaacactcctacctgccgcgcaagaagggcaaggtggtggccgcctgcctgcggccggatctgaatccggacgcgccccatgtcatcctgtgcaactcctgcccgccggagcgcaccgccggcgaacagctggcgcgccagggcggggcgatcccggtattcctgaagcagagcgccagcagctgggcctatcagggcatgttccgggtggtgggcaacgaaacccacccgcaagcgtgcgcgccgcacgccgcccgcagcgcctggaccgcggggcagatcaagcaggtgctgacgctggaaaagcaggtgcaattctga

SEQ ID NO: 2003 - DNA, 537 bp, Chromobacterium substugae
atgaccgacgccaagcgcattctgatcgtaggctgcagctgctccggcaaaaccacgtttgccgacaaactgtcccgggctaccggcatccccgccgccgacctcgacccgctgtactggggccccggctggacgccgcgacccgccgagaccttcctgcaatcggtccggcatgccgccgatcagcccaactggatcatcagcggcaattacagcgcggcgcgccacctgctttggacgcgcgccaccgacatcatctggctggactacgactttcccttggtgtttttccgcgccatccggcgcacgctggcgcgctgcatcagccgccgggaactatggaacggcaaccgcgaatcgtttcgccagagcttcctgtcgcgcgattccattctgcgctgggtagcttccagccatggccggctgcgtgccgacttcggccacgccaaggcgcaagccgattacccgcagctgcgctggcggcatttccgctcgccggccgaagccgagcgctttctgcgccaggcggccgtctag

SEQ ID NO: 2004 - DNA, 1146 bp, Chromobacterium substugae
atgaccgacatccagcagcccggcgccgccgaccaccccaccgcgcattggcaggaagccggcgccgaacgcagcgcccgctggcgctccgaagccggacttccgccgcccaagcgcatcgtgatcgccgacgacagcctgtccgccgacgccgcctacaagctggcctgcgaaggcggcaccctgctgtggcgcggcgactaccagaacgcccgccagctgctgcaggcgctggcgcggcgcgtggaccgcaagggcgccaagcccggcgccacgccgctggaatccttccacctgcaccgccaggcgcaaggccgccgcgcgcagatcctgtcgcggctggtgctgccgctggacgccgactacgccatcccgttgcggcgcgcgcccgacttgcgccaggcctgccgggaagcctacggcgaaggcggcgaagcctcgctggtgtcgctgcgcgagctgctgggcctgataggcgcgcatgaatggcgcaagaaaggcgtggaagtgaaggcgctggcagcgcgcatccaccctcactacggcgtattcgcgccgatacgcggcgaatacgtcgacctggcggccgacgccccgctgccgggcgcggagctggccttcgacatcggcaccggcagcggcgtgctggcggcgctgctggccaagcgcggcgtggcccgcgtggtggccaccgaccaggacgcgcgcgcgctggcctgcgccgccgacaatctgcagcgcctgcagctggacggccgggtggagctgcggcgcgccaacctgttcccggaaggccgggcgcagctggcggtgtgcaacccgccctggctgccggccaagccgagctcggcgatcgaatacgcggtctacgacccggacagcgccatgctgcgcggcttcctggacggcctggcggcgcacctgctgcccggcggcgaaggctggctgatcttgtccgacctggccgagcatctgggcctgcgttcgcgcgagcaactgctgcaatggatagaccaggccggcctcgcggtgctgggcaggctggacgtcaagcccagccacaagaaagcggtggaacaaatcgacggcctgagcgcggcgcgccaggccgaaatcaccagtttgtggcgattgggcgttaaataa

SEQ ID NO: 2005 - DNA, 1296 bp, Chromobacterium substugae
ttgacgctgttggccggctccgccctggccgccccgtggaatgcccacatcgcctaccagaaaggccaggtcgtccaatggcagggccgggactggcaggccaaatggccgacccgcgccgaaacgccgggcgccaatcccaaaggctcctggatcgcccacgtcggcgcgacggtacgtcgcatggacgacgccgcgccgcccatccccacgctgcagcaggcgctgcagcatgaggccgacctcaccaacaacgactttttccgcaaggtgaaagcctccatccgcaccctgcccagcgaccaggtggaactggtgtcgccaggccgcgccgccaacccggtcaacgtgcgccgcgtggagcgcctgctgccgtcggccaagtgggactactacttcacccgccgcgaccccagctacacctacactcgcttcctgcaggcggtggccaagttccccggcgtctgcgacgactacagcgacggccgcgacgccgacgccatctgtcgccacagcctggccaccatgttcgcccacttcgcccaggaaaccggcaaccacgacgccagcgacaccgtgccgcaatggcgccagggcctggcctacctgcgcgaaatgggctgcaccgacagcggccccggctgcggctacaacaccgaatgcgacgacccggtgttcaacaaggtatggacctgcggcaaaaacgccgacggcagctggaagaagtatttcggccgcggcgccaagcagctgtcctacaactacaactacggcccgttctcgcaggcgatgaacaacggcgaccagtcggtgctgctgcagaacccggacctggtggccagcacctggctcaatctcgcctccgccaccttcttcttcgtctacccgcagccgcccaaaccgtccatgctgcacgtgatagacggcacctgggtgcccaacgcggccgacatcgccgccggcgccggcaacaacttcgccaccaccatccagatcatcaacggcgaatgcggcggcggcaccgagcgccaggccgcgcagaaccgcatcgactactacaagcagttcgcccatgacctgggctgggattacggcgcggagcagctgtcctgcgccaatatgcaacgcttcaccgccgccagctccgccgcctacaacatctactgggaaaaggactggaaatggggcgacgactaccagtgccagctggtcagctaccaaacgccgtacagcgcgctgcaggccggcaactaccagcactgcgtggaggacaactggggcatcaagctgaaatga

SEQ ID NO: 2006 - DNA, 186 bp, Chromobacterium substugae
atgaaagtaaatgaattgcagccaggcgatctggtcaccgaacaacacggtcaagacacggtcgcctttgaagtagtggcaatccagcagttgggccgccgtttcgcggtcaccttccgctccgcgctcggcctcggcagcgcgcattacgccggcgacgcctggatcagcgcgatgcgccgttga

SEQ ID NO: 2007 - DNA, 267 bp, Chromobacterium substugae
atgtccaaagaagacatgatcgaactggaaggtgttgtcatcgaaatgctgccggaatcgcgcttccgggtaaaactcgacaacaacgttgaaatcctggcctacggctccggcaagatgaagatgcaccgcatccgcgttctggtcggcgaccgcgtcaccgtggaaatgtcgccttacgacctgaccaagggccgcatcaacttccgccaccccaccgccaatgtcggcggcggctcccgcccgccgcaacatcggcgccgttga

SEQ ID NO: 2008 - DNA, 1443 bp, Chromobacterium substugae
atgcagaaccacgcctccaccctttaccagcaactggctgacgacctgtcgctggcgatcagccgcggcaccttgccgcccggatcgcggctgccctcggtgcgccgcaccgcgcacagccgccagctcagcctcaacaccgtggtcagcgcctaccgggtgctggaagaccgcggcctggtcgaagcgcggccgcagtccggctattacgtgcgcgccaggctgccgtcgccggcgcggccggcctccacccgcagcggcccggccacccccacccgcgacgcggtgctggacctgataggcaccgtgctgcaagcgcagcagaccgagggcttcatcgacctggcgctggcctgcccgcgcggcggcgacttctacccgggcaacaagctggcgcggctgatggggcagatcctgcgccgccagcccggcatggtcagcacctacgcgctgccgccgggctcggagcggctgcgcacccagatcgcccgccgcggcatggacctgggcatggcgctgcagccggacaacatcatcctcacccacggctgcatggaagcgctgcagctggccttgcgcgccgtcacccgccacggcgacgcggtggggctggaatcgcccacctacttcaacctgctgccgttattggccagcctggggctgaaggcggtggaaatccccaccgacccccaaaccggcctgtcgatagacgcggtggaggtgctgctggccgaacggcgcatccaggcgctggtggcgatgcccaacgtccacaacccgctgggttgctgcatgccgctggaggccaagaagcggctggcgcggctggtcaaccactatcaggtgccattgatagaagacgcgctgtacgccgagctgcagttcgccgacacgctggcgccggcggtcaaggccttcgacgaggacggctgggtgatcgtctgcgccagctacaccaagacgctggcgccggacttccgcatcggctggatggaaggcggccgtttcgacgcccagctgcgcaagctgaaattcgcctcttccgtggccgagccggtggtgctggcggaaacgctgggcgcctttctcgaatccggcggctacgaccaccacctgcgcacgctgaagcgccgctacgccgcccacgtggagaaggtgcgcggcctgatcgcccgccacttcccggccggcacccgcgccacccagcctcaaggcggctttctgatctggctggagttgccggaaggctgcgacagcgtggcgctgttccacgccgcgatggccgagaagatcagcctgatccccggcccgctcagctcgcccggcggccgctaccgcaacgcgctgcggctgtcctgctgctacccgctggacgagcgttacctggcggcgctggtgcgcgtcggccaattggccggccaacagatcgctccggaagcatag

SEQ ID NO: 2009 - DNA, 618 bp, Chromobacterium substugae
atgcccgaattcgccttgctgtcctatgtcgccctgatgtcgatcacgccggggcccaataacctgatgctggcttcgtccggcgtcaatttcggctttcgccgcaccgtgccgcacatgctgggcatcagcctgggctgcgcgctgcaggtgttcgtcgtcgccatgctgctggcgcaagcgctgggctggctggcgtcgtggcgcttgccgctggccgcggccggctgcgtctatctgctgtggctgtcgtggaagatcgcccgcgccggccggccggaggcgcgcgagcaggccaggccgctgggcttcgtcggcgcggcgatgttccagtggctgaatcccaaggcctgggtgatggtgctgaacgcgtccatcctgttcatgccggccggcggcgccaagctggcggcggccttgctgctggccgtggtgttcgcggcggtgaatctgccgtgcatcagcgtatgggcctggggcggcgagcggctgcggcgttggctggccgcgccgcacgccttgctgatgtacaacctgacgatgggggcgctgatggccgtcaccgcgctatggctgctgtacgacgaactggctccggtgattgcccggatggcatga

SEQ ID NO: 2010 - DNA, 555 bp, Chromobacterium substugae
atgaaaaagaccgcattgctggtgatcgatgttcaggaatccttccgccaccgtccgttctggaccgagcaggatctgcctgcctaccaggcggcgcagcaggcgctgatcgccggcgcgcaggcgcgcggcgtgccggtgatcaacatcctgcatcaggcgggcgaagacgggccgttttcggcggcctccggcctggtgcgtccgctggactggatgacccaccagccggcggccaccttcgtcaagcacgtgcacaacgcgctgaccgactccggcctgcagacctggctgatcaagcacggcatccagaaactggtgatttccggcatccgcaccgagcaatgctgcgaaaccaccacccgggtggcgtccgatctcggctacgaggtggatttcgtcaccgaggcgacgctgacctttccgatgacgcatgccggcagcggcgtcacctacagcgccgccgacatccgcgcccgcaccgagctggtgctggccggccgcttcgccgccatcgtcacggtggaggaggcgctgcgccggatggcagactga

SEQ ID NO: 2011 - DNA, 213 bp, Chromobacterium substugae
atgccgcaatccgcatcccataccccgcccggcggcctgccggcctatcggctgctgaccggcccggacgattcggccttctgccagcgggtgagcgaggcgttggcgctgggctatcggctgtacggctcgccggccgccgccttcaacggcgagcgggtgatcgtcgcgcaggcggtgctgtggccggggagcgacgatgccgctggctga

SEQ ID NO: 2012 - DNA, 906 bp, Chromobacterium substugae
atgccgctggctgatctggcgcaggcgctggccatcgtgctggcttggggcgtgaatttcgtggtgatcaaatggggcgtggccggcgtgccgccgttgctgctgggtgcgctgcgcttcctgctggtggcgctgccggcggtgttcctcgtccggcggccggcgctgccgtggcgctatctggcgttgtacgggctgacgatgggcgtcgggcaattcggctgcctgttttcggcgatcaagctgggcatgccggccgggctcgcctcggtggtgctgcaatcgcaggccttctttacgctgctgctggccagggtgtttctgggcgagcgctggcaggccagccaattggctggcctcgcgctggcgctgggcgggctggccctgataggcatgggcaagggcggcgacatgacggcgctgggcttcggcctgacgatcgccgccgccaccagctgggcggcttccaatatcgtggtgcgcgcgatcggccgcgacggcttcaaggttgagccgctggggctggtgatctggtccagcctggcgccgccgctgcctttcctgttgctgtcgtggtggttggagggcggcgagcggatggccgcggcgctgcgcggtttcgacggccagtcgctgttcgccgtcgcctacctggcttttgtcgccaccatgttcggctacggcctgtggagccggctgctggcgcgccacgccgcggccaaggtggcgccgttttcgctgctggtgccggtggtggggctgatggcctcgcactggctgttgggcgaacgcttgactgcccagcagttggccggcagcggcttgttgatggccggcctgctggccacggtgttcggcggccgtttgctggccgccgccggcgccgggagggccagccgtgcgtga

SEQ ID NO: 2013 - DNA, 915 bp, Chromobacterium substugae
gtgcgtgaaatctatttcgtgctgccgcccagcctgctgttgctggacctggccggcccggccgacgccttccgggtcgccgcgcagctgggcgccgattttcgcctgaatttcgtcagcgcgacggccggcgtcggcacttcgctgggcttgccgctgagcggtttgtcgcctttgccggaaacgctgccggacggcgcgctggtggtggtgcccggctccacgccgtcggaacaggcctatgccacgcccgacgcgcgccgcatcgtggcctggctggcggtgcgccgcggccaggccggcgtgcgctgggcaggcatctgctcgggcagcttgctgttggcggaggcgggactgttcgacggccgcgcctgcaccagccaccacaccttgctggagcgtttgcgcggcttggcgccggcggcccgggtgcaggaaaaccgggtgtttgtgcaggatgggcattgttacagcagcgccggcatcaccgccggcatcgatctggcgctgcatctgataggcgaattggccgagccggccatcgcccgcgccgcggcgcgcgaaatggtggtgtatttccgccgctcgccgcaggatccggaactgtcgccatggctggcctggcgcagccatctgcacccggcgctgcaccgcgcgcaggatttgatctgcgccgatccggtgcgggactggccgctgccggagctggccgaccaggtgcatgtcagcgcccgccacctgtcgcgcctgttccgcgagcatgccggcgtcaccgcgcacgattaccaccgcgcgctgcggctggcgctggcccggcagtggcgcgcggcggggctgggcaaggagaaggcggcgctgtcggcaggcttctcctcggcccgccagatggaccgcgcgatggacgcgaatgcctga

SEQ ID NO: 2014 - DNA, 639 bp, Chromobacterium substugae
ttgctggccggcttgtccgcctgcgccgcgtccacgccgccgaaggcgcagccgatgccgatggccgcgccggcgcgcgactccggcatgacgccgacaggagtgggtttcgtcggctccggcgaagacggcagcagcgaggaaaccaaggtgctgatcaaggaggtcaacccctaccaacccatcgtcgtgcgggtggtgggaacgggcgcggcgccttacaccaacagcctgacgccctcgcagcgcaagctgctggcgatgcgggcggccaggctggacgccttccgctccatcgcggagcaggtgcagggcatgaaactggtgggcaatagcgcggtgtccaacatgatcgccaacagcgatagcttccgcacctatgtggacgcctatctgcgcggcgtgtccatcgtctccaccagcatgaagccggacggcaccagcgaggcggtggcggagatcacgctggatcaggagttctacaagcagttcaagaacgcgctggacaagaccggcagcgtgatgaaggcctcgcaggaaaccggcgccgtcggcgcgaccaccagcagcaacagcatgcaggcgatgccagccgccgcgccggcccgcttcagcagcaatttctacgtgaaccagtaa

SEQ ID NO: 2015 - DNA, 1275 bp, Chromobacterium substugae
atgaaaagaaacggactggccattgccgcccttgtggcggcatttcttttgagcggtccggcccgcgccgaggtgttttccgccgaaggggtggcgccgctggacaacgggctggtggcggcgcgcgacatggcgctgcgcgacgcgctcaagctgatcgccattcgccagggcgcgcgggtggagtcggcccaggtgctggaaaacggccgcgccagcgaatccggcacgctgacggcgtccggcgcggtgcagggcacagtcaaagtggtgagcgaataccagcagggcaagctgtaccacgtcaaggtgcaggtggacgccggcgatcctgccgccgcagccccgcgtccccgcgacccctcctgcgcgatgccgccgggccgctcgctgcggcgcaagctggtgaccacctatttcggcgtggagcggccggccgaggcttccgacatgccggacctggcgacggcgctgccgaccgagctgtcgcgccggctggcgcgcaacagcatgctgacggtgcgcgacgccaacacggtgtcggtgctggccgacagccgcatcgccgagcccgccgccggctgggacatcgccagccagctgggccagcgcgaggacgtgcagttcgttgtggcgggcagggtgctgtccacctcggtcaccggcaagggcgcgcgtccctcgttcttcgaatccaacaataccagccagcagggatcgttctataacggccccttcgccggcatgttcggcatgggggtcaagtatgtgcccacccagcgccagttcgacgcggaagtctggatttacgacggcctgaccggttcgctgctggccaacgagcgcgtcagcggcctggccaagggccaggtggtgccgccgtcgccgcagcctttcgcctccgccgccttctggcaaggcgactacggcaggctggtggacaagctgatggaccgggcggcgcagcgggtgaacgacatcatttcctgcatcccgttctccgcccgcatcgtccgccaggagggcaagcgtgtctacatcaacgccggcctgctggacggcatggcggtgggggacaagctgctgctgtatcggcgcgtgcccggccagccggtgcgcgacctgatctccggccgcgagctgggcatgccggaaaccctgaacggcgacgtcagcctggtgcaggtgcagcccaacttctccatcggcatcgcgcagagcaacagccagccggtgtccgaaggcgattacgtgcgcttcgtgcccgggcgctga

SEQ ID NO: 2016 - DNA, 468 bp, Chromobacterium substugae
atgagcctggaatcggtccgccagtttctatcggcccaagcgccgcacatcgccatcatcgaactgccggtcagcaccgccaccgtggcggaggccgccgccgcgcacggcgtggaagccggccgcatcgccaagacgctggccttccgcctgaacgacggccgagaagtcatcctggtggcgcgcggcgacgcccgcatcgacaaccgcaaattcaaggacgctttcggcaagggcaagatgctgccgccggaagaagtggaagccatcaccggccacccggtgggcggcgtctgcccgttcggactggcgagcgaactgccgatctacctggatgtgtcgatccaggctttcgacgaagtgctgccggccgccggcgcggttcacagcgcggtgcgcatcagcccgcagcagctgcgcgacatcaccaccggacaatgggtggatgtctgccaggctttcgcctga

SEQ ID NO: 2017 - DNA, 489 bp, Chromobacterium substugae
atgaaggcaatatcctcctccgccaaagcgctggacaagatggaccgcaagatcctgcgcatcctgcagaaaaacgcccgcatcgccatgaccgagctggccgagaaggtcggcctgtccaccacgccgtgcaccgagcgggtgcggcgcatggagcgcgacggcatcatcgaaggctattacgcgcgcctgaatccgcacgcgctgggcggctccttgctggtattcgtggaaatcaagctggaggccaagtccggcaacatcttcgacgccttccgccgcgagatcatgagcattccggaaatcctggaatgccatctggtgtcaggcgatttcgattacctgatcaaggcgcgcatcgccgacatgtcgatgtaccgcaagctgctgggcgacatcctgctgcagctgccgtcggcgaaggaatccaagagctatgtggtgatggaggaagtgaaggagacgctggcgctgccgctggcggactaa

SEQ ID NO: 2018 - DNA, 1308 bp, Chromobacterium substugae
atgaaggtaatcgtgctgggcggcggcgttttgggcgtatccaccgcgtggtatctggccaaggcgggttgccaggtgacggtgctggagcgccaggacggcgtggcgctggaaaccagtttcggcaacgccggccagatctcccccggttactccgcgccgtgggcggcgcccggcattccgttgaagggtctgaagtggatgttccagcgccacgcgccgctggccatcagtccggacggcagcctgtaccagttgcagtggatcgccaagatgctggccaattgcaatgaaaaggcctacgcggtcaacaagggccgcatgatgcggctggccgagtacagccgcgacaagatcaaggaactgcgcgccgaaaccggcctgcagtacgaaggccgccagggcggcacgctgcagctgctgcgcagccaggcccaggtggaaggcatggccaaggacatcgccgtgctgcgcgagtgcggcgtggatttcaatgtgctggatccggatggctgcgtccgcgtcgagccggcgctggcggcggtcaagcacaagctggccggcggcctgcagctgcccaatgacgaaaccggcgactgcaatctgttcaccagccgcctggcggagttggcgcgcgccaagggcgtggaattccgcttcggcgtgaccgtggacggcatcgagaacgacggcaagcgcatcaccggcgtgcgcgtcggcgacgagctgctgcgcgccgaccattacgtggtggcgatgggcagctattcccgcgacttggtgaaggagctgggcatcgacatcccggtgtatccggtcaagggctactcgctgaccgtgcccatcaccaacgcggccggcgcgccgacctccaccatcctggacgaaacctacaaggtggcgatcacccgcttcgacgaccgcatccgcgtcggcggcatggccgagctgtccggctacaatctggaactgaacccgcgccgccgcgagacgctggaaatggtggtcggcgatctgtacccgaacggcggcgacatcaaggcggccagcttctggaccggcctgcggccgatgacgcccgatggcacgcccatcgtcggcggcacccgtttcgccaacctgtcgctgaataccggccacggcacgctgggttggaccatgtgcgccggctccggcaaggtgctggccgacctgatcaccggcgccaagccggaaatcagcgtcgacggcctgtcgatgcagcgttacgccaagcagggcgaaaccctggtggtgccggtgatccgtcccgcggtgcaaggggcctga

SEQ ID NO: 2019 - DNA, 1062 bp, Chromobacterium substugae
ttgatcgcgacgatacggctggaccatctgcgccacaattatcagctggcgcgcgccgcccacggcgataaaacgctggcggtgctgaaggccaatgcctacggccacggcgcggttcgctgcgcgcaggcgctggccgacatcgccgacggcttcgccgtcgcctgcctggaggaagcgctggaattgcgcgccgccggcatcgcccagcccatcctgctgttggagggcgtgttcgaggcggaagaactgaaggcggtggacgagcatggtttgtggatggcggtgaccagcgaggagcagctgcggatggtcgagcagtcgaatccgacccggccgctcaccatctggttgatgctggactccggcatgcaccgcgagggctttctgccggaaaactatcaccaggcctggcatcggctgcaggcttgcggcaaagcgggcggcatcaccaagatgacccacttcgcccgcgccgacgaaccggaagtgccgatgaccttcgcccagctggaggctttcgacgccgcggtgcgcggcctgccggccggcgacgagtcggtggccaactccgccggcatcctgtgccacccgcgcgcgcagcgcaactggggccgcgtcggcatcgcgctgtacggcgtgacgccgctgccggcaggcttcggccagggcgacgcgctgcgcccggtgatgcgtttctccagcaaggtgttcggcgtgcgcgagcttggcgtcggggagcccatcggctacggcgacaacttcgtcaccgaccgccccactcgggtgggcctggtggcctgcggctacgccgacggctatccgcgccgcgcgtccagcggcagtccggccgtggtggacggccagcgcacgcgcttgatcggccgggtgtcgatggacatgctgacggtggatctgaccgatctgccggaggccggcgtcggcagcgaggtggagctgtggggcgacgcggtgtcggtcaacgaggtggcggcgcaggccggcaccataggctacgagcccttgtgcaatatcaagcgcgcgcatttcgtctaccgttga

SEQ ID NO: 2020 - DNA, 1320 bp, Chromobacterium substugae
atgtggtttgcaggcaacaagatgatccatcagctggaaaacgccaccgacgccgcgctgcgcggcgaatccgcgccatggcgcatccacggcaacgagcgctggcgcgcgctgggagagaaactatcccgggtatgggaggcgcgcgaccgccagatcagccaggccgacgaagagcgcctgtccaccacgcggcagctccagcaactgcaagaggcgctgctggagtccgaggagcagctggcgctggtctccacccgcttcgatctggtcaaccgcgccgccagcgagggtttgtgggacatgtcggtggtcgcgggcgacccggtcaacccggacaatgtgttctggtggtcgcagacgttccgctcgctgctcggtttttccgaccagcgcgatttccccgatgtgctaggcagctgggccaaccgcctgcacccggacgacaaggcgcgcacgctggacgccttcgccgcccacctgggcgaccgcagcgcccagaccccgtacgacatcgagtaccggctgcaatgcaagaacggcgaataccgctggttccgcgcccgcggcgccaccttgcgcgacgagcgcggcatcccgctgcgggtggccggctccttgtccgacatcaccggacagcggcagcagcaatcgctgctggagcgggcgatgacccgcttcgagctgggcagcgccatgcaggccgacggcttatgggacatggaggtggacgcggccaacccggtcagcggcaacaacgccttctggtggtcgccgcagttccgccgccagttgggcttcgacagcgagcacgaatttcccaacctgctggagagctggtccagccgcctgcatcctgaagacaagcagcgggtgctggccgccttcgccgcccacctgaacgaccgcagcggccagacgccttacgatctggaataccggctgcaatgcaaaaacggcgaataccactggttccgcgcccgcggccagacccggcgcgccgccgacggcacgccgctgagagtggtgggcgcgctgaccgacatcgacgcggaaaagcgctccgaggcgctgaacagcgaaagccagcagcgccagcaattggaaaaaagcctgagcgagatcgccgccatcgtcagcaccatccagtccatcgccgatcaaaccaatctattggcgctgaacgccgcgatagaagccgcgcgcgccggcgaaaccggccgcggcttcgcggtggtggccgacgaggtgcgcaagctggccgagcgcacccgcgacgcgacgcaaagagtggaaaaactggtggtgcagcgcggctga

SEQ ID NO: 2021 - DNA, 1677 bp, Chromobacterium substugae
atgaatccttcccgtaccgcgctgggcctgttgctggcctgcgccttgcccgcctgggccgacgcgccgccgatcccgcccgacttgcgcgacggcgccgacgcgcgccgcctgctgcaggacaatagccggcgtttcgacgacctgatccagcagcagcggctgcggcagatccagagcggcggcagcgaagtcgccagtccgcaggcgccggtgctgagcgggcgcgattgcctgccggtcaaggggctgcggctggcgggcatttccctgctgtcgcgggaagacgtcaacgccttgggcctgccgcatggcgattgcctggatctggctgaaatcaatcgcttcagccgcgcgctgaccgcgctgtacctgcggcgcggctacatcgccgcccgggtgctggcggaggggccggacgagcgcggcgtgctgacgctgcgcgtggaggagggcaaggtggcggctatccgcagcgacgacgccagcctgcgcgtggccaacctgtttcccggcatggcggggcagccgctgaacgtgcacgacctggaccaggggctggatcaggccaaccgcttgcgctccaaccacgcgacggtggatgtgctgccgggcgagcgcgtcggcgacaccatcatccaattgcgcaaccagcccgactcccgctggtcgggcgggctgacgctggacaacgccggccgcgagtcgaccgggcgtctgcaggccggcgtcagcctgggctgggacaatcccgccggttggagcgatttgctcagcctgtcggcgcagaccaccggcgagcggcaggaggtaaggcacagccgcagcgagtcgctgttttattcgctgccttacggttactggacgttcagcgtcttcgccagccgttccgactatctcaatccgcagcagctgcagtcccgcgtggcgcagttgtccggcgaaacggcgcaaaccgggctgcggctggaccgggtgttgtcgcgcgaccagacccgggtgctgagcgccgacctgcagttggtgcagaaacgggtgcgcaatttgttccaggacgtagagctgggcgtcagcagccccaatctgacagtgctggaggcggggctgtcgcagatgcgcatcctgccgtccggcctgctgcaactggatggcagcctgcagcgcggcatgcgctggctgggcgcggacgcgcccgacgccattcatccgggcgcgcccaatccgcagttcagcaagctgaagctgagcctggcctggtaccagacgctggccttgcccggcgggccgtaccagtggcaaagcgcgctgtccggccaggccagccgcgaccgcctgcccggcgtcgagcaattggacatcgccgacgccagcgcggtgcgcggctttcgcaacaattcgctggtggcggagaccggttggtattggcgcaataccttgtcccggcggctgcagtacggcggggtcacgctgacgccgcgcatcgggctggatggcggcagggtgctgcaacgcggcagccaggatgcctggcaggacatcgccggcctggcgacgggggcgacgctggggcgcggcggcctgacgctggacctggactacagccggccgttgtacaagccggcctcctggcaggccgaaggccacatcctgttcgcgcggctgaactggcagtggtga

SEQ ID NO: 2022 - DNA, 4836 bp, Chromobacterium substugae
gtgtcgcgcggctgtgattttggtttcgaggggatgatgatgaaaagaacaaagttcgacttgtccgtaaccggcaaggtagccgcggcattgacgctggctttcgtattggccgacgccagcctggccggcggcatcaccgcggcgggcggcagcggcgcgcagccgcaggtttccaccgccggcaacggcgcgcaggtgatcaatatcgtggcgccaagcgcggccggcgtgtcgcataaccaataccaggatttcaacgtcggcaagcccggcgcggtattcaacaactcgctgcaggcgggccagtcgcaactggccggccagcttggcgccaatgcccagctgggcggcaaccaggccagcgtgatcctcaacgaagtggtcagccgcaatccgtcgttgctgctgggcaagcaggaagtgttcggcaaggccgccgactacgtgctggccaaccccaacggcatcgcctgcaacggctgcggcttcatcaacatcccgcgcgcgtcgctggtggtcggcggcgccaatctgcaggacggcgccatcgcctcgctgcaggccgccaataacggcaacgcgctgagcatcgccggcggcggcgcgtccggcgtcaacgtgctggacctgatcgcgccgcggctggatgtacgcgccaatgtctcggccgccgacgccatccgcgcgcgcgccggcttcaacaccgtcgattacgccagcggccaggtcacggcgaccgcgccggctccgcaaggcgtgggcaatctggacagctatttcctcggcgcgatgcaggccggccgcatcaatatcgtcagcaccgcggccggcgccggcgtcaatgtcggcggcaacctggccggcggcgacgagctgagcatccgctcggccggcgcgctggcggtgcaggccgcccagctcaagggcaagcagctggcgctggacggcgccagcgtggatatctccggccgggtggacagcgaaaccggcaaggacagcaagcacgacgaaagctggttcatctggaagaccggcgagagcagcagcgcctccagcaagaccgacagcagcgtcaagcgcgcgtcgctgcagggcgacgatgtgtcgattaaggccgcgggcaatgcccacgtcggcgcggccgacatccagggccaggacgtgaagctgagcgcgggcagcctgaatctcgacggccagctggccgagagcagcgccagcagcagcgaccacgcctggaagaactcctgggcctacaaccaggacaagagcagcgtcacccaggcgcaatcggtggcgcgcatcaaggcgcagcatgatgtcgaactgaacgccacggctggcggcgccagcatcgccggcgccagcgtggacgccgggaacaacctcaaactgtcggcgaccggcgacgtgaaattgtcggcgctgctggaaaccgatagcagcagcgacgtcggcaaccgcaagaacgacggcgcggcgctggaaaccggcagctggaacaacagcagcagccagcagcggctggtgcaaagccagctgcgcgccggcaacgcgctgggcgtcaccgccagcggcgacatcgccgcccaggcggcggtattgaaatccggcggcgacgccgtgctgtccgctcagggcaagaccacgctggcgacgcagaccagcgccaacagcagcagcacccagaacggcaaaacctattggggcggcatcggcggcggcggcaaccagaacaacagcgacagcgccaccgtcaacaccggcagcgcggtcaacgccggcggcaagctgttcatcaacggcgacgccggcatcgccatcaatggcagccaggccaagggaacgcagggcgcctacgccaagacccagtccggcggcgtggtcatcgacagcgcgctggacctggcccagacccgcaccgaccagcgcaccggcaccgccttcaacatcaccagcagcgccagcaagggcagcaccagccaagagaccgcggtcggttctgcgctgaagtccgacgccgacctgcagctgctctccgccggcgacgtggcggtgaccggcagcctggtgaaggcggcgcaggcgctgaacatccaggcggtgggcgacatcaaggtggccagccaggccgctgaaacgcacaatcagtcgcaggacagccagctggcgctgcgcggcgtcggcgccgagaccggcgacaagcaataccgcggcggcgtgcggctggaaaacaccagcaccagccagcagctggaccagaccagccagaccggttcgcaattgtccggcggcagcgtcaagctggcggcgggcaacgacctgagcctgagcggctccaagctggaaaccgccggcgacgccagcctgtccggccagaatgtcagcctcaacgcggcgcagagcgccagccacaacgatagttccaccaccgtcagcggcggcggcctctatctgaccggcggcctggacaagaccggcgccggcatcgagttcggccagaacagcagccgcacggtggcggacggcagcgcggcgcaagtttccgaagtgaagaccggcggcaagctggacatcaccgccggcaacggcatgggcgcgctgcagaaccagggcacgcagatcaaggcgggcggcgcggtgaccatcgccgccggcgacgtcagcaaccaggcggccgtcagccagcagtccacccagcagacttccagccactggggcgtggatgtcggcgtcaatgtcgactacagcggcatcacccgtccgatcgccaatgccggcggcagcgtggccaagggcgacgtggccggcgcggcaggccaggcggccaatctgggcgcggccaacctgggcgtggacatcggcgccatcggcggcagcgccagctcgcaaagccagagtagcgcggcgcaggccaccagcatcgccggttcggccatcaacgtggccgcgagcggcgccttgaaggaccaggcgacgcaataccaggcgacccagggccaggtgagcatcagcgccgacagccaccagatgacggcggcggcgaatagccaaacccagagcagccaggccagcgaaggcggcgccagcgtgcgcgtctacaccaccaccggccaggacgtgaacgtcaagggcagcggccagggcagctacagcaacagccagagcgcgtccagcaacgcggtgaccggcgccatccagtccgccggcggcgtcagcatccaggtgaacaacgacgccagctaccagggcgcggccatcaacggcggcagcggccaggccgctatccaaaccggcggcaagctgacgctctcccaggccaacaacaccagcagcagccagcagcatgatgtgaaggtagacgtcggcctgggcatcagcaccagcccgatcgacggcggcagcaagctgggcggcagcggcaatctggcggtgggcaatcagcaaagccaggcggccagcagccaggcggcgacaggttcggtgcagtcggccggcggcatcgcgctgaccgccggcaacggcctgaccgtgcaaggcggcagcctgcagagcggcggcgacgtcaagctgcagtccgacggcaaggtgagcctgcaggccgctaccggcaacgacagcaaaaccggcagcggctggggcttcaacgtcaacgccggcggcaacaacagcaagggcaaggacgcgtccggccagggcttcaatgtcggcggcggcgtgcagctgtccagccagaacgaaagcagcgccagccagtcgggcgcgcaggtgagcagcggcggcgcgctgagcgtggccgccggcgcgaccggcaacaacgccatccagctgcaaggcagccaattgggcggcaagacggtcggcctgacggccgataacggcggcatcagcctgcaatcggcgcagaacagcagccagaaaaacgactggagcgccagcgccagcctgggcggcggcggcaacagcagcgtggccaaggaaaacggccagcccaaggccgacggcgcgagcaagacctaccaggcgaacggcggcttcgacgtcaaggtggaccagcaggacaagctggccaacgccaacgcgacggtcaagggcgaccaggtcaacgtaaaggccgatggccaactgacgctggctggcggcaacatcgccggcggcaaggtggacggcagcgtcggcggcaacgtggtggtgcaaagccagcaggaccgcaacaacagcacccaggtggaagtgggcctgaacgtcagcagctccaacgccaaggcccccagcgtggtggaccaggccgcggccgtggccggcccgctgtccggcgcggtgaaggacaaggcgactgacgcggtgaacgcggtggctgacaaggtgcagggcgctccggcagcggcagatgccaagccgggcctggtggacggcgcgcggcagcaggccggcagcacgctgaaggacaagctgctgaacccgcaggacaagggcacccaggtgtcaggcgtgatcgacgtcagcgtcaagaccgacaacagcgtgggcagcgtcagcgccatcagcggcgaccagggcgtcaatctcgcggtgggcggcaaggcgcagttgaacggcggccagatcgcctccagcggcggcaaggtgaacctgggcgacgccaaggtggaaaccagcgacatccagaccagcagctataccggcgccggcggcgtcaagctggacggcacgccggcggccatcatccagcaggcggtgaaggatgtcacctccggccagatgccgctgatccatgtcgagcgcggcagccagaaccagactgtggccggccaggtgaagtcgggcagctga

SEQ ID NO: 2023 - DNA, 408 bp, Chromobacterium substugae
atgacgtgtgaaaacaacgcgcgcatcctggtggccgacgaccatccgctcagccgcgagctgctgaggcagatgctggagcatctgggcgcggaggcggatttcgccgccgatggcgaagaggccgtcgacatggcaggacgcgcggattaccggttgatcttgatggatgtgaaaatgccgcagatgaacggcctggaggctgccttgaggattcgcggccggcgggagcggccgcagccctgcatcgtcgcgatgaccgcttgcgcgtttggatgcgagcgcgatggttgccgggaggcggggatgaatgccgtgctggtcaaaccgttcaagctggaggaattgcggcgcgtattggcagcctgtttgccggatggcgcggggggagactgctgcccgttgtag

SEQ ID NO: 2024 - DNA, 819 bp, Chromobacterium substugae
gtggaacgcatcgtcaacggacaggaagtatcggacggcgccggcgtgcgcttgctgcgggtgctgacccagccgctgcagcggcggctggaccctttcctgatgctggacgaattccgctccgacaatccggacgactacatcgccggctttcccagccacccgcaccgcggctttgaaaccgtcacctacatgctggcgggccgaatgcgccaccgcgacaacgccggcaacgaaggcctgctcggccccggcggcctgcaatggatgacggccgggcgcggcatcgtccattcggaggttcccgagcagcaggacggcctgatgcacggcttccagctatggatcaatctgccggcggcggacaagatgactgcgccgggctaccgcgacatccaggcggcggacatccccagctggcaagacgccgatggcaaccagctgaagctgctggccggccgcttcgacggccgccacggcgcgatcgagcgcccctccaccgagccgctgtacctggacatcgcgctgcccgccaacggcagcctatggctaccgctgccagccgggcaccatgccttcgcctatctctatcagggcgagctgcaggccggcggcgccgacatccgcgcgcgccagctggcggtgctggacaatgagggcgaaggcctgttgctggccaatggcggcgcgcccagccggctgctgctgctggcggcgcggccgctgggcgaacccatcgcgcagtgggggccgttcgtgatgaacacgcggcaggagatcgagcaagcgatggaggactacagcgaaggccgcttctaa

SEQ ID NO: 2025 - DNA, 909 bp, Chromobacterium substugae
atgaagccattcaggacgacgctggaacaatggcaggtgctgcaggccattgtggaagagggcggtttcgcccaggcggccgcgcggctgcatcgcagccagtcggcggtcagctacgcggtggccaggctgcagcagcaactcggcgtggaattgctgcggcctgacgggcggcggatgcgcttgaccgccgacggcgcggcgctgctgcgcgaagcgggtgatttgctgcaggcggcggaccggctggagcggcgcgcgcagggtttgcaggcgggctgggagccggagctgcgggtggcgttggacagcctgctgccgaccgaggtgatgctggccgcctgcggcgatttcgccggccactgccgggaaacccggttgcagctgcgcgaagtggtgatgtcaggcgccgacgacgccttgcaccagggcgaggcggcgctggcggtggcggggagggtgccgcagggctttttgggcgattggttgctggacgccgagttcgtcgcctgcgcggcgccggggcacgcgctgcacgcgcaaggcgggatgctcgacgaggccaggcttcggcgcgaagtgcaggtggtgctgcgagattccggcagccggcagccgcgcgacgagggctggctgggtgcgcatcagcgctggacggtgtcgcagccggaaaccggcatcgcgatggtggaggccgggctggctttcggctggctggcgcggcaccgcatcgccgcgcaactggctgacggcaggctcaagcccttgccgctgaagagcggcgcggtgcgcaaggcgtccttgtatctggtgctggcggatccgccggcggcggggccggcgtgcctgtatctggctgaggcgctgcggcgcgcggctcaggcctggatagccgcgctggctcagtga

SEQ ID NO: 2026 - DNA, 675 bp, Chromobacterium substugae
atgaccaccctgcagccgatcaagcgccagacgcttaccagtgccgttaccgaatccttgcgccgccgcatcctgtccggcgaattcgccgacggccaacagttgcgccaagaggcgctgtccaacgaatacggcgtcagccgggtgccggtgcgggaagcgctgcgccagcttgaggccgaaggcctgatccagatcatcgaccacaagggcgcgctggtttccaagctgtcgctggaagacgtgctggagctgctggaagtgcgcgccatgctggaaggctcgctgctgaaggccgccatcccctgtcagacccaggccgaccacgacgccgcccagcagacgctgcgcgaattcgaggccgccctccacaacaacgacgtgcgccactggggcgagatcaactcgcgcttccacctggcgctgtaccgcgccgccaagcgccccaacacgctggcgctgatcgaacagctgcacaacaagaccgaccgctatacccggatgcagattctgttcacccgcaccatggagcgcgcgcacgaagagcacacccggctgctggaaatgtgccgccagggcaaggcggacgaggcggcggaattcctgcgcttccacattctttccgccggccacgcgctggaaagctatctgaaaggccagcaggccaatcactga

SEQ ID NO: 2027 - DNA, 73 bp, Chromobacterium substugae
gtggatatagctcagttggtagagtcccggattgtgattccggttgtcgtgggttcgagtcccattatccacc

SEQ ID NO: 2028 - DNA, 73 bp, Chromobacterium substugae; identical to SEQ ID NO: 2027

SEQ ID NO: 2029 - DNA, 73 bp, Chromobacterium substugae; identical to SEQ ID NO: 2027

SEQ ID NO: 2030 - DNA, 74 bp, Chromobacterium substugae
gcgcccgtagctcaaccggatagagcaccagccttctaagctgggggttacaggttcgattcctgtcgggcgcg

SEQ ID NO: 2031 - DNA, 74 bp, Chromobacterium substugae
cggggcgtagcgcagcctggtagcgcacctgatttgggatcagggggtcgcgagttcgaatcccgccgccccga

SEQ ID NO: 2032 - DNA, 852 bp, Chromobacterium substugae
atgtcggcacaattgatcgatggcaaggcggtagcggaaaagctggtggagaaagtgcgcgaaggcgtgggcgagcgtttgctgcagggcaagcgcgcgccggcgctggcggtggtgctggtgggcgacaacgcggcatcggcggtatacgtcggcagcaagaagcgcgcttgcgagaaggcgggcatccgctcggtggcttatgacttgccggccaccaccagccagcagcaattgctggaaatcatcgacgacctgaatgccgatgccggcatcgacggcattctggtgcaattgccgctgcccaagcagatcgatccgcaagcggtgatcgagcgcatcgatccgaaaaaggacgtggacggcttccacccttataatgtcggccgcctggcgatcaagatgccgctgatgcggccgtgcacgccgcgcggcgtgatgacgctgctggaggagtacggcatcgaccccaagggcaagaaggcggtgatcgtcggcgcgtccaatatcgtcggccgtccgcaggcgctggagatgctgctggcgcgcgccaccgttaccgtttgccatagcgcgacgcagaacctggccgaagaagtggccggcgccgacatcctggtggcgggcgtgggcattcccaacttcgtcaagggcgagtggatcaagccgggcgcggtggtgatcgacgtcggcatcaaccgcctggaaagcggcaagctgtgcggcgacgtggagttcgacgccgcgcgcgagcgcgccggcttcatcaccccggtgccgggcggggtcggtccgatgacggtggccacgctgctgcagaacacgctcgacgccgccaatcagtacgcctga

SEQ ID NO: 2033 - DNA, 864 bp, Chromobacterium substugae
atgagtcacgaaaaacactcggcgacgctgctgatgagcgcgccggacaaaaaaggcctggtcgcggccatcgccaatttcctgatgacctacaatgccaatatcatgcatgccgaccagcatcaggataccagcgaaaacctgttcctgatgcgggtgcagtgggacctggatggtttcaccctgccgatggacagcttcgcggccgctttccagcccatagccgacgaacacaatatgagctggacggtatcgctgtcggcgcgcaagccgcgcatggccgttttcgtgtcgcaatacgagcactgcctggccgacctgctgcaccgctggcgcatcggcgagctggagtgcgacatcccgctggtgatctccaatcacgaaacctgccgccgcctggtggagttcaacggcattcccttccatctgatccaggtgaccaaggacaacaaggccgaggccgaggccgagcagttccgcctgctggaagaggcgggcgtcgatttcatcgtgctggcgcgctatatgcagattctgtccggcgagttcgtcgagcgctacccggaccgcgtgatcaatatccaccacagcttcctgccggctttcgatggcgccaagccctaccatcgcgcattcgcccgcggtgtgaagctgatcggcgccaccagccactacgtgaccgaggatctggacgaaggcccgatcatcgagcaggaggtcacccgcatttcgcaccgcgacgcggtggaggatttgatccagaagggccgcgacctggaaaaagtggtgctgtcgcgcgcggtgcgctggcatctggacaaccgcgtgctgtcgtacaacaacaagaccgtggtcttcgattga

SEQ ID NO: 2034 - DNA, 597 bp, Chromobacterium substugae
atgcgtttgttgatcgacgatgtgctcgatttgctgcggctgcgggtcaagccgctggccgtctaccaatatccgtggtggcaaccggcgctgctgctgaccctgctgggcctgatcgccagcggcgacaccgccgagcttggcggcaacatcgccggccgcatcggcttcatggtgttgttcacctggctggagacgctgctctttacccgcttcatcaccttctggctgcgcctgtccaagggcgagctggccgcgccgctgttcggcctggtggtggtggccagcggcctgcagttcgtcgagccgctgaccagctggctaccggacgacgcggccgccgtggtggacgtcctgttgtctctgatcggcctggtggtgctggtgaacgcgctggccgtggtgtcggcggtgtcgcgcctgcgggtgttgctgggcgtggcgctgttcatgccgctggcgctggtgctgctggcggcgactttgtctttcgccaagaccgccggctgggtggatttgccggccgacatggtggcgatgatgcaggagcggggcgtggcggtttcggcgtcggagccggcggccaaggctcgctag

SEQ ID NO: 2035 - DNA, 462 bp, Chromobacterium substugae
ttggaagaacgcaagaatgaacgcctgcccagcgacctggccaggcgagccacagccatcatcgagatgcccgacggcgtgctggtcaccgccagccgcggcggccgttacaatctgccaggcggcaaggccaaccgcggggagctgcgctcccaggcgctgatccgcgaagtgcgcgaagaaaccggcctgcgcatcaactccatgctttatctgttcgaccacatcacgccgttcaacgcgcacaaggtctacctctgcatcgcccagggccagcccaagccgcagaacgagatcgaacgcatcgcgctggtgtcgtcgccggacaccgacatggatctgttcgtggagggccgcgccatcctgcgccgctacgccaggctgcgcggcgaggaaaccgccaagggccaggccctgcgcgcgctgctggggctggcgcgctacatcgccaaggtggactaa

SEQ ID NO: 2036 - DNA, 828 bp, Chromobacterium substugae
atgaacgcaatcgaagctttgctgtttgccgtcatccaaggaatcagcgaactgtttcccgtcagcagcctggggcatggcgtgctgattcccgactggctgcactggtcgatcaaccgcacccatccggacttccttcccttcatggtgatgctgcatctgggcaccgccgccgcgctactgatttacttccgccgcgactggatcgcgctgatcggcggctggctgaaggcccgcggccgcgccagcaatcccgaagcgcggctgatgtggctggtgatcgccggcaccatcccggccggcttgctcggcctgctgctggaaaaacagctgcgccagctgttcaccagcaccaccgcggtgctgatcttcctggcgctcaacggcctgatgctgctgtggggcgaccgcctgaagaaaaaaaccgcctcgcacgagctgtccgaactcagcctggccggggcgatcaagatcggcgccggccaggcgctggcgctgctgccgggcttttcccgctccggcgccacgctggtcaccggcctcgcccacggcctggactacgcgtcatcggcccgtttctccttcctgctggccacccccatcatcaccgccgccggcgtgctggaaatccccaagctcgcccacagccatgccccggcgccctggggcctgctgctggcctgcggcgcggtggccggcctgtgcgcttatgccagcacctggttcctgatgcgctacttcaagaaaaccgaaatcgaatcgctgcgccccttcggcttttactgcctgctggtgggcataggcggcctcgcggccaaattcgtgtaa

SEQ ID NO: 2037 - DNA, 627 bp, Chromobacterium substugae
atgccgcacaagccgctcagcgagcaggactaccagcgcctgtccgccaccctgaaccgcttcaccagccagcaatgcatgaatctggaacagctggacggcttcttctccgccctgttgtccggcccgcaagccattccgccggccgaatgcctgccgctgatcctgggcgaggctttcgacgatgaaagcgccttccccagcgaaaaatcgctggaacagttcgtcgcgctgctgcgcggccactggcaggatatttccaacgcgctgtccggcggcgaattccagccctggctggacgccgacgccaacggcgcggtgctgggcaacgactggtgcgagggcttcatcgccggcatggaattgctgaacgacgactggggcatgctgttcgaatcggaagaaaacgccccgctgctggaacccatcctggcgctgggcttcgaacgccacccggacgccgaaatgcgtcccttcgtcgaagccgtcagcgcggagcagcgcgcggcctggctggccgccatctcgccgtcggtgcacggcatccatgacttcttcgccgcgatccgccgccagctggaacaggaagagcaagcgctggagcaacaggagcgccgcccgcactga

SEQ ID NO: 2038 - DNA, 1191 bp, Chromobacterium substugae
atgcatatcgtccaattcatcatcggcctcgtggtcgtgctggccctgacccagctggtcgcccgcgaccgcaagaacatcaagatccgctccgtgatccagttgctggtcatcgagatcgccctggcgttcttcctgctgaacaccacttacggcctcgccatcgtcggcagcatctccagcgtcttcaccaagctgatggacttcgccaaggaaggcaccgacttcgccttcggcggcatccagaacaagggcgagttcagcttcttcctgaacgtgctgatgcccatcgtgttcatctcggtgctgatcggcatcctgcagcacatccgcgtgctgccggtggtgatccgcgcggtcggcttcgtgctgtccaagatcagcggcatgggcaagatcgagtcgttcaacgccatcagctcgatgatggtgggccagtcggaaaacttcatcgcctacaagaacatcatccacaccttcgacgagaagcgcatgtacacgctggccgccaccgcgatgtccaccgtgtcgatgtccatcgtcggctcctacatgcagatgatagagccgcgcttcgtggtgaccgcactggtgctcaacctgttcagcaccttcgtcgtgctgtcgctgatcaacccctacgacagcgcgctgggcgaggatgagctgatcagcagcgacgcgcaccgcgtgtccttcttcgaaatgctgggtgagtacatcctgaccggcttcaagatcgccgtgatcgtggccgccatgctggtgggtttcatcgcgctgatcgcctgcgtcaatttcatcttcaccgccatcttcggcatcaacttccagaccatgctgggctacgtgttctggccgttcgcctggctgatgggcgtgccgacgcacgaagcgctgaccgccagcagcatcatggccaccaagctggtgaccaacgaattcgtcgccatgctggaactgaagaaccaggccgcccacctgtccagctacacccgcggcgtgctgtccatcttcctggtgtccttcgccaatttcagctcgatcggcatcatcgccggcgcggtgaagggcctggacgaagatcgcggcaatatggtgtcccgcttcggcctgaagctggtttacggctcgtccctggtcagcattctgtccgcgctgatcgccggcctggtgttggcttcctactaa

SEQ ID NO: 2039 - DNA, 147 bp, Chromobacterium substugae
atgcatgagattagtatcgcttttgggtttcccctgccttggcaggtttcgagcaacgtttcggtcccgcaagcgggccgcacgccagtttttatagggctgcgggcaaagccgcggccgccgcgccgccatgttccggggatatga

SEQ ID NO: 2040 - DNA, 1545 bp, Chromobacterium substugae
atgacgcacccacagactattgccctggtcgaatcgctggatcacgaaggccggggggtcgcccacgttgacggcaagaccattttcatcgatggcgcgctgccgtacgaaaaggttgtctacagcagctaccgcaagaagcccagctacgaaaacgcccagaccagcgccgtattgaaggaaagcttcatgcgcgccgagccgcgctgcccgcacttcggcacctgcggcggctgctcgatgcagcacgtggaattcaccgcccaggtggcgatcaagcagcgcgtgctggaagacaacctcaagcgcatcggcaaggtcaaggccgaacgcattctcacccccatcgccggaccggcttggcactaccgtcatcgcgcccgcctgtccgcacgcatggtggccaagaagggcggcgtgctggtgggcttccatgagaaaagctccagctacatcgccgagatgcgcgagtgccacattctgcccaagcacatctccgacctgatcatgccgctgcgcgcgatgatcgccacgctgtccatcagccagcgcatgccgcaggtggaagtggcggtcggcgacaagctcgacatcctggtgttccgcaatatggacgccatcaccgatgccgacttcgccatcctgaaggcattctccgaccggcacggcaccgccgagcgtccgctgcaggtctggctgcagcccaagggcccggacacctgctatccgatctacccgctggacgcgcccaagctgacctacagcatgccggaatacgcggtggaaatgccctactaccccaccgaattcacccaggtgaatccgcagatcaacgcggtgatggtggcgcgcgcgctgaaattcctcgacccgcagccgggcgagcgcatcgccgacatgttctgcggcatcggcaacttcacgctgcccatcgcccgttccggcgccatcgtgcacggcatggaaggcagccagccgctggtgaagcgcgcggtggaaaacgccacccacaacggcctgcaggacaaggtgagctatgaaatggccaacctgttcgaggtgaccgaggagtcgttcgccgcgctgggccatttcgacaagatgctggtggacccgccgcgcgacggcgcggtgcagctgttgaaggccatcaccgaggaaaccgcgcccaagcgcatcgtctacgtgtcctgtaatccggccacgctggcgcgcgacgccggcatcctggtcaacaccaagggctacacgctgaagacggccggcatcatcaatatgttcccgcacaccgcgcacgtggagtcggtggcctggttcgaaaaaaccagcccctgcaagacgcgcaaggaagtcgaggaaatcgaggcgttggaagccgccgagcgcgaggccgccaaggccgcgcatctggcggaggaaaacgcggagaaggccaagaaagccgccgagctggcggaaaaggccgccgccaaggaagcccgccgcgcccactatttcgcggagaaggcgcgccgcgaaaacgaagactcgtctccccaggcgtaa

SEQ ID NO: 2041 - DNA, 894 bp, Chromobacterium substugae
atgttgaagtgcttatcggtgctggcgctggggggctcgctggcgtttccgtgcgcggctgcggtgatgccggcgccggacatccaggtgaacccggcgggacgacacctggtgctgaacttgccgcaggcgcggctgttcctgtaccaggatggcaagctggcgcggatttttccggtggcggtgggcaagatgctgacgcagacgccgaccggcagcttcgacatcaccggcatttacaaggcgccggcgtggcatgtgcccaagtccatccaggatgaaatgcgccgcaacggcaaggaagtgcagaccgtggtgccgccggggcccaacaatcccttggggccggtattcgtgcgctttggcgaaagccggctggggctgggctttcacggcaccaacgctcccggctcggtgccgggttttcgcagccacggctgcgtgcggctgaaaaacgacgacgcgctggagctggccggcacggtcagccgcggcgacgcggtcaccgtcgcctatcagaccattctgctgagccaggatgaagccggccagttgtggctgaccgtctaccgcaaccattacaagcaggaagatccgtcgctgaaatacctggcgcagacgctgctggactggcagcgccagcaccagcaggcgctgtacggccagcgggtggacgatgcgctgaagcagcgcagcggcaagccggtgtgcttgagctgcaagagcgccagcggcgcgatcagcggcggcttgcagccttttgcctggctgtcgcgcctgacgccggccgccgcgcccgagacgccggcggccagccagccggcgccggatcgcgagccgggtccgccggccagggccagccagcgcggcagaaccgccgcccgggccggttga

SEQ ID NO: 2042 - DNA, 1278 bp, Chromobacterium substugae
atgaaactggaaaccctagccgtccacgccggatacagccccgaccccaccaccaaggcggtggcggtgccgctgtatcaaaccaccagctacgccttcgacagcacccagcacggcgccgatctgttcgacctcaaggtgcagggcaatatctacacccgcatcatgaacccgaccaccgacgtgctggaaaaacgggtggcggcgctggagggcggcataggcgcgctggcggtggcgtccggcatggcggccatcgcctacgccatccagaccatcgccgaagccggcgacaacatcatagccacccgcacgctgtacggcggcacctataacctgttcgcccacaccttcccgcagctggggattgaagtgcgtttcgtcgactaccagaatccggccgccatcgccgctttggtggacgaacgcaccaaggcggtgttctgcgaatcgataggcaacccgctgggcaatgtggtggatttcgccgccttcgccgccgaggcccatcgccacggcctgccgctgatcgtcgacaacaccgtgccttcgccctatctgtgccggccgttcgaacacggcgccgacatcgtcgtgcacagcctgaccaaatacctgggcggccacggcaacagcataggcggcgccatcgtcgactccggcaaattcccgtggggagagcacaaggcgcgcttcaagcggctgaacgagcccgatgtcagctaccacggcgtcaattacgtggaagcgctgggcgcggccgcctacatcgcccgcgcccgcgtggtgccgctgcgcaatatgggcgcggcgctgtcgccgttcaacgccttcctgatcctgcaaggcatagaaacgctggcgctgcggctggaccgcatttgcgacaacgcgctgaaagtcgcccatttcctgcaagcaagcccggcggtggagtgggtggaatacgccggtctgcccgacaacccaagcaagccgctggtggaccgctacctgggcggccgcgcctccggcatcctgtccttcggcatcaagggcggggaagccgccggcggccgcttcatcgacgcgctgcagctggtgacgcggctggtgaacatcggcgacgccaagtcgctggcctgccacccggcctccaccacccaccgccagctgtcgccgcaagaacagctgagcgcgggcgtcaagccggagctggtgcggctgtccatcggcattgaacacatagacgacatcctggccgacatcggccaggcgctgaaagccgccgcgcagtaa

SEQ ID NO: 2043 - DNA, 1428 bp, Chromobacterium substugae
atgagcagcgaaccgctttaccagcaactggtcaacgaatggaccaccctgatccagaccggcaccatccgcccgggcgagcggctgccttcggtgcgcaaggcctgcgcgatgcacaaggtcagcccgtccaccattctgcagacctaccgcacgctggaagaccgcggcctgatcgaggcgcggccgcagtcgggcttctacgtcaaatccgccgccagcctgcccttgccgcggatgcgccgccagagcgccgcccatcacaccggcgaggtggtagaccagatcgaggccgtgatgggcgcgcaaaaccaggccgacttcatcgacctgtcgctggccagcccgcgcggcagcgacttctaccctaccacccgcttcaagcacatcatggggaggctgctgcgccagcacccggaactgaccaccgactacccgttcccgcccggctcggaacggctgcggcggcagatcgcccagcgcgccgtcagttggggctgcgtgctggccgccgacgagctggtgatcagcaacggctgcaccgaggcgctgcagctggcattgcgcgccacctgcaagccaggcgacaccgtgggcgtggagtcccccacctatttcgcgctgctgcccatgctgaaggacttggggctgagcgtgatcgaaatccccacccaccccaccagcgggctggcgctggacgcgctggaactgctgctgtcggaaaaacggctcaacgccgtggtggccatgcccaccgtgcacaacccgctgggcagcaccatgccgccggaagccaagcagcggctggcgcaactggtcaacgactaccaggtgccgctgatcgaggacgtgccgcacgccgacctgttttacggcgccgcgacgccaaacgcggtgaaagcctacgaccgcgacggctgggtgctgctatgcgccagctacagcaagacgctggcgccgggtttccgcatcggctggatcgcccccggccgcttcctcagcgaagtgcggcggctgaagttttccagcagcctgggccagccggcgctattggaggaaacgctggccgaatacctggaaagcggcggctacgaccaccacctgcggctgatccgccgccacttcaacagccagatggaaaagctgcgcggcgcggtggcccagcacttccccgccggcacccgcgccacgctgccctctggcggctgcctgctgtgggtggagctgcccagccacgccgacaccatgcagctgttccaggccgcgctggccgaacgcatcaccgtggtgcccggcgcgatgtactcggccaagggccgctatcgcaactgcctgcggctgtcctgctgctatccgtggaacgaggcctaccagcgcgcgctggcgcgggtcggagaactggcagccgatctggcggatagggactga

SEQ ID NO: 2044 - DNA, 624 bp, Chromobacterium substugae
atgaatctgcttgcactggtcacctatctgctggtgatgtccatcacccccggccccaataatctggtgctggcgtcgtcgggggtcaatttcggtttttcgcgcacgctgccgtcgctgctgggcatggcgctgggcctgtcgctgcaggtaggcatcctctctgtcggtttgggcgcgctgatgtcgctgatggagtcgctgcagctgtatctggcgatcgccggctgcggctacctgctgtggctgtcgtggagcatggcgcgcgcgggggcggccaagagcgccgacgccggcgtccggccgatgggcttctggggcggcatcctgttcaactggctcaatcccaaggtgtggctgatgggcttcaacctggtgatggtgttcctgccggcgcacatgaatccgtggcacgccgccgcgctgttcgcgctgatcacctttttcaccagcctgccgtgcatcgcggtgtgggccggctccggcgtggccatccgacgtttcctcgattccccgccgcggctgcgcgcgttcaacttcagcatggccgcgatgctggcgctgaccgccttctggctgctggcgcagatgatgccgagcggggccttgcccaatatggtctga

SEQ ID NO: 2045 - DNA, 1386 bp, Chromobacterium substugae
atgatccgtacccgtttcgcccccagccccaccggttacctgcacatcggcggcgtgcgcaccgcgctgttctcctgggcctatgcccgcaaaaacaacggcgtgttcgtgctgcgcatcgaagacaccgatctggagcgctccacgccggagtcggtgaaggcgattctggacggcatgcactgggtgggcctggactacgatgaaggcccgttctaccagacccatcgcttcgaccgctacaaggaagtgatccagcagctgctggcctccggccacgcctaccactgctattgcagcaaggaagagctggaagcgatgcgcgccgagcaggaagcccgcggcgacaagccgcgctacgaccgccgctggcgcccggaagccggcaaaacgctgccggccatcccggagggcgtgcagccggtggtgcgcttcaagacgccgctcgctggcgtggtggcctgggacgacgcggtcaagggccgcatcgaaatctccaatgaagagctggacgacctgatcatcgcccgtcccgacggcagccccacctataacttctgcgtggtggtggacgactgggacatgcagatcacccacgtgatccgcggcgacgaccacgtcaacaacaccccgcgccagatcaatattctcaaggcgctgaacgcgccgctgccagtgtacggccacctgccgatgatcctgaatgaagacggccagaagatgtccaagcgccgcgacgcggtcagcgtggtggactacgccgacaagggcatcctgccggaagcgctgctgaactacctggcgcgcctgggctggggccatggcgacgacgaattcttcagcatggagcagttcgtcgaatggttcacgctggaggcggtgagcccgtccgccagccgcttcaaccaggaaaaattcatgtggctgaacgcgcagcacatcaaggccgccgacaacggccgcctggccgagctgatcgcgccgcgcctggcgaaagccggcgtcgataccacccatggcccggccatcggcgacgtgctggcgctggtgaaggagcgggtgcaggacctgaacgcgctggcgctggaagtcgattacttctacaaaaagcgcgaaccggtcgccgccgatgtggagaagcatctggccggagacgctgtagcgcgcatgggccgcttcgtcgaccgactggctgctctggaagcctggagcgccgaatccatccatgagctgttcaaaccgttctgcgccgacgaaggcatcaagatgggccagctgggcatgccgctgcgcgtgctggtatgcggcaccacccagaccccgtcggtggacgcggtgctggccttgatcggcaaggacgaggtgctgcgccgcctgcgcggctga

SEQ ID NO: 2046 - DNA, 1422 bp, Chromobacterium substugae
atgaccccagccattgcctacgacgacgtgcagggcaccattctgcgcggctaccgggtggaacgcgcccgccacttcatcctgcgcatcgacgacaaagcccgcgcggcggcgctgatactcaagctggtggacggcgaactggggttgccccccatcaccaccgcccaacgcggcgcgcaaaaacccatccacttcctcaatctcagcttcacctgcgccggcctggcgcggctgggactgagcgatgcgcagctgcaaaccttcgacgcgtctttccgccagggcgcgaccgatcccggcatcgccgccagcatcggcgacactggcgacagcgcgccgcagcactggataggcggcctggatcagggcgcccaagtccatgcgctgctcagcctatgggtggatgggtctgcagaacagctggagtcggccagcgccaagctatgctgcgccttcgccgattacggcgtgaagaaattgtcggcgcaagacgccgtggcactgccggataacaaagtgcacttcggctatcgcgacagcatcgctcagcccaccatcatcggcgcgccgccgcgcaagcgcgacatcccggacgatcaaccgccggtggccaccggcgaattcctgctgggttatcccaacgaaagcggcggcagctacacgctggagccgaaagaactgtcgctcaacagcagcttcgccgccttccgcatcctggagcaggatgtggaaggcttcgaaagctttctgcaaacctacgctccccgcctgggagtcgatgccgaaacgctggcggcgaaagtctgcggccgctggcgcaacggcaacccgctgaccttgcgtcccgacgcggccggcgaggtcttgccgccctcgcagctgaacgacttccattacgtcgacgccacgctggacaaggacgatacgctgggcctgaagtgcccgataggctcgcacatccgccgcagcaatccgcgcgacggcgcggtggtgggcgccggcagcccgctgcaccgcatcgtgcgccgcgccatgccatacggcccggaatacgacccggccaagccggacgcgcaaaagcgcggcctgatcggctatttcatcaatgccagcatcgccaaccagttcgagttcgtcaccagccagtgggtgctgcgctccgacttcgtcaaatcggccaccggaccgggcgggccggaacaaggcaacgcggtgttcaacatcagcggggaggacgtgttcatcggcgtcaacccggtcgaccaaagctccttcaccgatgcccaggccggccccaaggggcagaacaacaaacggatcaccggctttccccggctgatccacacccgcggcagcgcctattgcttcttccccagcatcagtggcctgcgctacctggcgaaactggcggccggctga

SEQ ID NO: 2047 - DNA, 453 bp, Chromobacterium substugae
atggccagtccccttaccctgctgatgccggtggcgcccgacgcggacctgaccgccctggccgccaccgtgaaggaaaaccagccgctgctgcacgcggcgctgaccaagatcggcaccgtccactacgcccgcacccagttgctggaccgcgccgcgcccaatctccagcccggcatcaagcccagcaaaagctacgtgctggcggtgatcaccgaatacgacggcagcttcgacagctacatccaggacttcgtcaaggaagtcggccccatcttcgacgccttgctgcgcttcatcgacggcgcctccggcctgattccggtcgccagccacgtcgccgcgttcaaggccttcatcgccgccaacgacgcctcgcagcacgcccccaacaatgacatgtaccaggcctacaccgccaccgtgcagcaggtgctggcctcgctgccctga

SEQ ID NO: 2048 - DNA, 381 bp, Chromobacterium substugae
atgtggaaatcgatattcgccatcgccgccggcgccgccatcggcgcgctgctgcgctggtttctcggcctgcggctgaacagcctgttcccctccctgccgctgggcacgctggccgccaacctgataggcggctacatcatcggcctggcggtggcgctgttcgccgacatgcccagcctgccgccgatgtggcggctgctgatcatcaccggcttctgcggcggcctgaccaccttttccactttttccgccgaagtggtggaactgctgcgccaggggcaactggttcccgccttcaccgccatcgccgcgcatgtcagcggctccctgctgatgaccatggccggcatcgccagctggcagctgctgcggcgctga

SEQ ID NO: 2049 - DNA, 426 bp, Chromobacterium substugae
ttgactacgcattatccggtaatagacaagcgcaccatcagcatgcgctggggcgatatggacgccgtcggccatctgaacaacacctactatttccgctatctggagcaggtgcggatagagtggctgaattcgctgggctacggcatcgacccggaaggcatcgggccggtgctggccaataccgcctgcaccttccgcaagcaactgacctacccggcgacgctggacatcaccatcgaactggaaaaactggggaacagcagcctgaagctgcgccaccacttctaccggcaggacgaccccggcacggtttacgccagcgccgaggtgctgctggtatgggtcgattacaaggcggaaaagtcggtcgccattcccgaccccatccgcgaagccatccagcgcgcgctgccggcggcgtga

SEQ ID NO: 2050 - DNA, 1917 bp, Chromobacterium substugae
gtgtatttttcccgcgacgccggcctcgacgaaacccgccacgttttcctccagcacaaccagctggccgagcgcttcgccgccctgccgcagcgcgggcaattcaccatcgccgaaaccggcttcggcaccggcctgaatttcctctgcgcctggcaatgctttgagcagcacgcgcccgccgacgcccggctgcatttcgtcagcgccgagaaatacccgctgaccccgcaggacctgtcccgcgcgctggcgctgtggccggagctggcggcgcagtccaaccagctgctgcgccaatacgacatgctgacgccgggctggcaccgcctgctgctggccggcggccgcgtcagcctgacgctgatggtgggggacgtgctggacgtgctgccgcagctggacgcccgcgtcgacgcctggttcctcgacggcttcgcgccgtcgaaaaatcccgacatgtggcagcagccgctgttcgaccagatggcccgtctgtccgcccctggcgccactttcgccaccttcaccagcgccggcgccgtgcgccgcggcctgaccgcggccggcttccaggtggaaaaagcccccggccacggccagaaacgccatatcagccgcggctggctgcaaaccgccgccgcgatgccctggcaagccccctggttcgcccgcccgccgcagcgctggcgcgaacgcagcgccatcgtggtgggcggcggcgtcgccggcgcgtccaccgcgcacagcctggccgtgcgcggctggcaggtgacgctgatcgaacggatgccccggcttgccagcgccgcctccggcaacccgcagggcgtgctgtacaccaagctgtcgccgcacctgacgccgctgtcgcgcctggtgctgtccggctacgcgtacagcctgcggaccctgcgcgaactgctgccggaggatggcgaaaactggcgcgcctgcggcgtgctgcagctggcgcatgaagcgaaggaaggggaaaaacagcaggcgctggcggaactggggctgccggaagcggtgatgcgcaagctggaccgcgagcaggccagcgagctggctggcgtggcgctgccctcaggcgggctgttcttcccgcagggcggctgggtgcatccgccggccctggtggcgcggctggccgaccaccccaatatcgccgtgcgcaccagccataccgtgctggagctggagtatgaccagaacgagcgccattggctggccagcgacgaaagcggcccgctggccctggcctcggtggtggtgctggcgggcgcggcggaaaccgcccagttcgacgccaccagccatctgcccttgaaaaagatacgcggccaggtcaccagcatcgccgcgacgccggacagcgagcggctggccaccgtgctgtgcggcgaaggctatatctcgccggcgcgcggcggccgccattgcctgggcgccaccttcaagttcgacagcgacgacctggcggtaaacgacgccgaacatgcggaaaacctgcagatgctggccgagctggcgccgcaattgcatgacggcctgaccagcggcggccgcggcgcgctggatggccgcgccgccttccgctgcaccagcccggactacctgccgctgatcggcccggccgtcgcccgccgcgacttcgcgcaatgctacgccgaactcgcccgggatgcgtccttgcagccgcagcaaccttgcccatgggtggaaggcctgtacgtcaacaccgcgcacggctcgcgcgggctgatcaccgcgccgctgtcgggcgagatcctggcggcgctgctggaagacgaaccgacgccgctgccggcccacctgatgcaggccatccatcccagccgcttcctgctgcgcgacctgatccgccgcaagctggatccggccgcgtga

SEQ ID NO: 2051 - DNA, 2031 bp, Chromobacterium substugae
atgaggcgagcgagcagcataggcagtcggctggtattgacccaggtagtgctgatggcgctggtggccggcgcgatcctgtatcccttgtatgtgttcagccagcgcttgatgctggagcgcacccagaaagtgcaggcccagctgctggcgcagtcgctgaacatggtggacggtttcaacgaatcgttgcgcctgtccacccggcaattcgagaaagtgttcttcgccgagttcaggagcggtttcagcctgaatccggcagagaagatcaatgtggccggcgcggcgacgccggcgttgttgatgggcggcgagccggtcaacggcaataaccggatggtcgaccacttttccgcggtcagcggcaatgtcgcgtccatcttcgtccgcgacggagacgacttcgtgcgcgtgtccaccacgctgctgatggaaaacggcaaccgcgcgctgggcagccggctggagcgcgccgcgccggcttacgccaagctggccgccggcgacggctacatcggcctggccaatctgtacggcaaggattacgtcaccagctacagcccgatcaaggacggcgacggcaaggtgataggcgccaccttcgtcggcgtcggcgccaccgagggtatcgccagcctgctggtgcggctgggcaaggtgaagctggaggatagcggccacatcgacgtgatcgatgtcaatccggcttcggccagtttcggccgctatctgctgcatccgcggctgaacggccgttcggtggacaaatcgctggacgccgacggcaagccctatctgcgcgaactgctcaagggcggcagcggcaatctgtcggtgcgcctgcccggcgacaagggcgccgccgcgcacatgctgtcctacgccagcttcgcgccgtggaactggctgctggtcagcgacgaaaccgagtccgagctgcagcgcgaaaaccgcatgctgatcgcctggctggccgccggctgcggcgtgctgctggcggtgctggcgctggcgttgtggggcgcgacccgcatcctggtgacgcgtccggtgcgccaactggtggccgaggtggcgtccattcaggacaaccatgatctgcagcgccgcctgccgacggggcggggcggcgagatgggcgaaatggccaatgcgttgaacggcctgctggacagcttccagctggcgctcaaccgcaccagccatcacgcgctggacctggaccgggcggcgcaggatctgtcgcacaaggccggcgcggcggcggcttcgtcgggcgagcagcgcgacagcgcccggcagatgtcgcagcacaccgagctgctgatcgccggggtggagcagatcgaaagggtggcgggcgaggccagcgaggtggcgcaggcgtccagcgaagcggcgcagaacggcagcgccagcctggcggcggcggtggacgaggtcaatcgcatcgccgcgacgctggacaacgccgccgacagcctgctggcgctggagagcaacgccggccagatcagcgacatcgtcaacgtgatccacgacatcgccgaccagaccaatctattggccttgaacgcggcgatagaggcggcgcgcgccggcgagatgggccgcggcttcgcggtggtggcggacgaagtgcgcaagctggccgagcgcaccagccagtccacccggcagataggcgaaatgatcgccgcgatgcagcaggcggcgacgctggcggcgcaggcgatgcgccagtcggtgagctgcgcgtctgaaggggcggccatcaccgccagggcgcgggaggcgatggggtccatcgtcgccgacgccgaacgttcgatggcggtggtgtccgccatcaaccaggagctggcgtcgcagcggcagaccgtggaaaacatcgcggaacaggtggcgcaggtggcccggttggccgaaacccacaatcaggaagccgagcgttcggcgcaaaccgccggcgaaatggcgcagctggccgactcgctgaagcaggaagtgcgggtgttccgcgcttga

SEQ ID NO: 2052 - DNA, 2580 bp, Chromobacterium substugae
atgcgattcgacaagctgaccaccaaattccaacaggcgctgggcgacgcccaaagcctggccgtagcgggcgacaacgcctatatcgagccgcagcatctgctgctggcgatgctggacgacgccgaagccggcgtcggcggcctgctggcgcgcgccggcgtcaacgtgccggcgctgaaggccggcctgaagtctgccatcgaacggctaccgcgggtgcagggccatggcggcgagatcaccgtgtcgcgcgatctggccaatctgctcaacgccgccgacaagatcgcgatgaagctgggcgacgaattcatcgccagcgagctgttcctgtccgcgctgagccaggacaagggcgagaccggccgcctgctgaaagagcacggcggcaaccacgcgtcgatccaggcggcgatagacgcggtacgcggcggcgagaacgtcaacagcgccgacgccgagggccagcgcgaagccttgaagaaatatacgatggacctgaccgagcgcgcccgccagggcaagctcgacccggtgataggccgcgacgacgaaatccgccgcgccatccaggtgctgcaacgccgcaccaagaacaatccggtgctgatcggagagccgggcgtgggcaaaaccgccatcgtcgaaggcctggcgcagcgcatcgtcaacggcgaagtgccggaaagcctgaagaacaagcgcctgttggtgctggacctggcggccttgatcgccggcgccaagttccgcggcgaattcgaagaacgactgaaggcggtgctgaacgatctggccaaagacgacggccagaccctgatcttcatcgacgaaatccacacgctggtgggcgccggcaaggccgaaggcgcgatggacgccggcaatatgctgaaaccggctttggcgcgcggcgaactgcattgcatcggcgccaccacgctggacgaataccgcaagtacatcgagaaggacgccgcgctggagcgccgcttccagaaggtgttggtgggcgagccatcggtcgaggacaccatcgccatcctgcgcggcctgcaggaaaagtatgaaatccaccacggcgtcgacatcaccgacccggccatcgtcgccgccgcggaattgagccagcgctacatcaccgaccgcttcctgccggacaaggcgatagacctgatcgacgaggccgcatccaagatcaagatggagctggattctaagccggaagcgatggacaagctcgaccgccgcctgatccagctgaagatcgagcgcgaggcggtgaagcgcgagagcgacgaggcttcgcaaaagcgtctgcagctgatcgaggacgagataagcggcctatcgcgcgaatacgccgacctggaagagatctggaaggcggaaaaagccgcccagcaaggctcgcagagcatcaaggaggaaatcgaccgcctgaaggcgaatatggaagacctcaagcgcaagggcgactggcagaaactggccgagttgcaatacggcaagttgccgcaactggaagcgcgcttgaaggaggccgaggccgccggcgagcagggcgaggccaagcccaaccgtctgctgcgcacccaggtgggcgccgaggaaatcgccgaggtgatcagccgcgccaccggcattccggtgtccaagatgctgaccggcgagcgcgagaagctgttgcacatggaagacgtgctgcatcggcgcgtggtggggcaggacgaggcggtgaccgcggtggccgacgccatccgccgctcgcgctcgggtctggccgacccgaacaagccgtatggatcattcctgttcctgggaccgaccggcgtcggcaagaccgagctgtgcaaaacgctggccggcttcctgttcgacagcgaggagcacctgatccgcatcgacatgtccgagtacatggagaagcattccgtcgcccggctgatcggcgcgcctccgggctacgtcggctacgaggagggcggctacctgaccgagcaggtgcgccgcaagccgtacagcgtgatcctgctggacgaggtggagaaggcgcatccggacgtgttcaacgtgctgctgcaagtgctggacgacggccggttgaccgatggccagggccgcaccgtggacttcaagaacacggtgatcgtgatgacgtccaatatcggcagccagcagatccaggcgatggccaccgacgattaccaggtgatcaagctcgccgtgatggccgaggtgaagacccagttccgcccggaattcatcaaccgcatcgacgaggtggtggtgttccacggcctggacgagaagcacatccagtccatcgcccgcatccagctgaagggcctggaggcgcggctggccaaactggacctgaacctgcagatcagcggcgaggcgctggcgctgctgtccgaggccggtttcgacccggtttacggcgcgcgtccgctgaaacgggctatccaggccgaactggaaaatccgctggccaaggcgattctggccggcaagtacccgcccaagtccacggtgctggtggaggcgaaaaacggccagctggttttcgactga

SEQ ID NO: 2053 - DNA, 570 bp, Chromobacterium substugae
atgaacgagacccaacgctgcgcctggtgcggcgacgatgcgctgtacgtcgcctaccacgaccaggaatggggccggcccgagcgcgacgaccgcaaattgttcgaaatgctgattctggaaggcgcgcaggccgggctgtcctggatcaccatcttgcggaagcgcgaaggctatcgcgccgccttccacggcttccacccggaaaaggtggcggcgatggacgaggacgacgtcgaacggctgatgcagaatcccggcatcgtgcgcaaccggctgaaaatccgcagcgccatccgcaacgccaaagtgttcctgcaaatgcagcgggaacacggcagcttcgccgactggctgtgggggcacgtggacggccagccgattctgcgccgccgcgacgacgaacgggtgccggccagcaccgagctgtcggaccatatcagcaaggagttgaagaaagccgggatgaatttcgtcggcagcacggtagtctatgcctacctgcaggcctgcggcgtggtcaacgaccacctggccggctgcttcctgcacccgcacggcgacgcctga

SEQ ID NO: 2054 - DNA, 444 bp, Chromobacterium substugae
atgcgtttcgattccggccagcttggcaacgtagaggtggacgaacagaccatcctcacctttccccacggcattccggccctggagaactgcacgcgcttcaaattgttccacgacgccgcccacaaaacgccgcaggtctattggctgcagtcgctggacgacccgggcatcactttcagcctggcgctgcccgagcggctgggcgtccgcttccaggtggagctcaccgacgacgaagtggcgcagctgcaactgcgcggcccggaggacgccgccatcctgctgatgctgtaccgcccgctggaaaccgagcgcgattcccacccggcgctgggccagctgcaggccaacctctgcaatccgctggtggtcagcctgtcgtcccagcgcggcatccagaaaaccggcctcaagatcgacatcctgctgcatacgccatga

SEQ ID NO: 2055 - DNA, 1215 bp, Chromobacterium substugae
atggagctgaaaccgaagcgttttttgattctggacgatcagctggtattgcggaagctgatctcgcgccaggccagcttcttcagccgtttcgcggtggagatagacgaattcagcgacccggccgaggcgctgcgcagcatcgccgaaggcggctaccagctggtcatcaccgatatcggcatgccgggcatgaacggcatcgatttcatcaagaatgtggccaggctgggctaccagtccgccttgctgatcatctccggctatgacggcaaaaccctgcagaccatcgccgacatgtcggccaatctgggcatctcctgcacccgcttcctggccaagccgtattcggccgaggcattcgtcgccatgttgaacggcattttcaatgaaatggagcgcgccgaggcgccggcgcaactggatatcgagccgctgctggccgatatctgcgacgaccgcttcgcgctggagttcgttcccgtggtgacgctggccgaccgccgcccggtcagcttttcgctgcgcgcgctggcgttgggcgagaggcgctgcggcatcgatcatctgctgccgctgctggcgggccggcgcatggcgtcggcggtggccctggaaacgatagtggagcggatggccaagctattgcagggcatttcgctggcgtcgggccaggacgagtgccagatgcacatccgcatcgacgaggcgtgcctgtgcgccgacaacgtgttcgaccactgtttcaccctggtgcagcaatacggcgtcgcgccgcgccgggtgagcttcgagctggcggacggcttgagccggcgctccgacgcgctgtgcttcgagaacatcgccaagatcaagtacctggggtttcatctgacggcggacgcgttcggcatcggctcgctgaccatcggcaacctgctcaagtttccgttcgaccaggtcaatgtgccggtggaaaccctgcactggctgaaaaccctgcagggcgaagatccgcacacctttcgtctgttgcgtcatttcggcttgtcgcagaccgcggtttgcgccacccgggtggatgacgaggagggcagggagctggcgctggcgatggggtgcgtcaagggagtgggggatgggctggccggcgtcgtcgcggagcaggatctggccaggctcatcgtggactgccagggcgaccgggcagcctcaagcggaaccatagtgtaa

SEQ ID NO: 2056 - DNA, 735 bp, Chromobacterium substugae
atgatttcggtcgacctggcgcggttgcggatcatgatcgtcgatgaccagacgctggtcaggaccctgatatcccaggccttgcagaacatgggggtcaagtcggactatatcttccaggccgccgacggcaccacggcgatgcggctgctggatatccgcatggtggacatcgtgctgtgcgatgtgcagatgctgccgatgaacggcatggatctgctgaaggagctgcgttgcgggcataccgccaacgtctccaatctgcccttcgtctttctgtccggccacgccgaccgctccaacgtggtgctggccagccagctgcacgccgacggtttcgtggtgaagccgccgaagcccgccgacgtggagaaggcgatccaggccgcgatgcaccggcccaggccggagatcgatccattcagctactacaacatcgcgaccggcaccgactacgacaacaaagtgttcggcaagctgttcgaaacccgggcgccggtgtatcaggaagagccggcggagcaatgcctgccgctggacaagatcaagccgggctcctatctgacgcgcgacttgcgcagcaaggccggccatttgctgctgccgcgcggcgccaccatttcggccaaccagctggcggtgctgaaagacttcagcgagcgctacggcgtggcgcagattttcgtcaccgaaagcctggacgcggtggcgagctcttccgcggcaaggcattag

SEQ ID NO: 2057 - DNA, 3876 bp, Chromobacterium substugae
atgctgcaacccaaggcgcgccatagccaggcgatggcgataggccggagcgtgctggccattgtgctgctgctgggcattctgcaggccggcgtgatggtccagctgcaggtgacggcctggagcgaataccggcaggccgaccggctggtggagctgaatcaggacagcagcctgttgtatcgcttctccgatatccagcatcaggaaagcggccagctgcgggcgctgttgctgggacggcagccggacgccgcgaccctggcagccttggaccggctgtctcggctggtggacgagcgcttcctcgccatggtcacttcgctgcatggccgcgacgaagcgcggaccagcgagaagatcgcccggctgcagcagctattccgccagtatcaacagctgcgggtgcaggccaaggcggtgtggcagtcgagctccggcccgaacgaggcgctgaccaccagcctgtacgagcagacccgcgacgtgcaggagcaggtgcagcatctggtggacgactccgtggtgcagatggcggccagcggcgacgccaggatcaacgacttggcctggctgacgcaggatgtgtggatactggactactggctgcgctccaatgcgcaggcgctggtgctgcgcgcggagctggaccaccggctggatcgtaggatggaggaggatctggcgcggcggctggcggccggcatgctgacgctgggcaagctccagcccagagtcgacagcgtgcgggatgtcaggctggctcagcagttcatccagctgacccgtcttgccagcaagctgcagctgttggcgcagctgcagctggaacagttggacggcaggctgaagttcagccaggccgccgactacccgctcaatctgcggcagctgacctcggcgttgcagcagttgcaggcgatggtttccgcgcgggcggaggcgctggccacggaaaaccgccagtactatctgcacattctgctgcgcgagggggcgtttggcctggcggcgatggcgctgctggtgttcctgctgtacgtgatggtgcgcaaggtgctcaagccgctggatttcctgcagcgcatgctggacatctccggcgacgcgatgctggtggtcaatcaggacggagtgatagagatcgccaacgagggcgcggggcggatgttcggctacccgctcgccgccttggtgggcatgccggcgcggcaattgttcgtgatgaacgacgagatgcacggcgtgatggcggcgctggagctgcaggtgggacggacgctgccggtggagggcatgggcagcggcggcgagcatttccatgcgatgctcaacatcagccgtttttccggggaatctgacccgccgctgaatatcctgatcgtgcgcgacgagcacaagcgcaggctggcggaaagctcgctggagcgcagcgtggcgctgctgtcggtgatttcggaaatcgaggcgatgctgctagcccgttcggcgcgggatgcggtgttccagcgcctgcacgacactttcgtcgagttcaccagctccgaagagtgcatgctggtggcctggtcggcccaggacggcggcgacgaggcattgcagctgcaagccggtgagtggcctgagttcctgccgctgatccagcaactgtcgcaggcggaaatgccgctggcggcgctgttccgcagcttgtcggcgcagccttcctgggtatcgctgccggtgatgctgggtggcgaggccaccgctggcgtctgcctgctgcggcccactttgtcgcagctgggcatcagcatcctgccgctattgggcgcctacgccaatattctcggtttctacgccgaagaagaccggcgcaagctctccgaagcccagctgcgggcggtgctgcaggaggaggaggcggtttattcggcgtcgccggtcggcctgctgcggctgaacgagcatttccagatcacccgggccaacctcaccgcggaaagcatcttcgatgtgggcgacgagtacggcctgtccgggatgcatctgatggagctgctggcttccgagcatggctggtatgagctggccgagcaaatgtcgaagatgcagcacgacaatgcccgcatccattgcgaactggaatgcctgaccggcaccggccggccgatctgggtgctgttcgaaggccagttgctgttcccggacgcgtccgaatcggtgatcatcctggcctgcctcgacatcaccgaacgcaagatggcggaattcgaactgcgcatggcgcgcgaccaggccaacgcggccaaccgcgccaagagcgccttcctggccaccatgagccatgagatccgcacgccgatgaacggcgtgctgggcatgctggaattgctggcgatgaccaagctggacgccgagcagagcgataccgtgctcaccattcaggactcggccaacaccctgttgcgcctgatcgacgatatcctggatttctccaagatcgaggccgaccggctggagatcgtgcccacccgcaccgcggtgcgccccttcatggaaagcgtgcgcagcctgtaccacgagaacgccagcaagaagggcctggacctgtcgctgacgctggacgaaaaactggcgcccaccctggtgctggacccgctgcgggtgcggcagatcctgcagaacttcatcagcaacgccatcaagttcacctcgcgcgggcgggtggacatccgcgtgaaggtgatggacaccctggccaattaccaggtgctgagcttcgaagtggccgataccggcatcggcatgtcgcaggaacagctgggcaaactgttccagccgttcacccaggcggattcggaaaccacccggcgcttcggcggcaccggtttggggctggcgatctgccgccgcttggccggcctgatgggcggccacgtggaaatggagagcgagcagggcaagggcagctgcgcccgcttgctgctggaagtggagtggctggccgagctggtggagccggtggtgctgccagagcagcgggtgccgctggagtcggtggcggcgctgtcgggcggcaacctggcggacgagggcgaggagctgttccccatcttgttcgccgaggacaaccccaccaatcgcaaactgacgctgaagcaactggaaaagctcggttatccggcggactgggccgaggacggcgaccgggcgttcagcaagtggctggccgggcggtattcgctgatcctgaccgattgccatatgccgggcatagacggctaccagttggccagactggtgcgcgcccacgaggagtcccatccggaacgcggacgcattcccatcgtcgcctgcaccgccaacgcggccaaggaggaggtggacaagacccgtgaggccggcatggacgatttcctcaccaagcctttgtccatccactcgctggaggcggtgctgcgcaaatggatgggccatggcggcgaggaagagatcgagccgctggcgcgggagctggctccgccgccgccgcccgagccggcgcaggatcccttgccggtggaccgcagcgtgctggaggtttacagcaatggcgaattgagcgtggagctggagattctgcgcgaattccagaccggcaatttggaggacgtggccgagctgcgagccgcgctgcaggcggaagacgctgatcgggtgggcttttccgcgcatcggatcaagggcgccagccgcatggtcggggccaacgagatgggcgcggcggccgaggcggtggaaaaggcgggcaaggcgcatgacctggagcaggcgcgccgcgcgatggcgctgttcgaggaaaagctggccgccttcgaaggctggctggccggccaggtggaaatcgccatgtga

SEQ ID NO: 2058 - DNA, 831 bp, Chromobacterium substugae
atgaaccgccctcaatcgctataccctgcgctggagcaggcgctgctttgtccggacgtggaagagaagctggcgctggcggaggccgcccgccgcgactggctcgccggcgcgctgccccggctggacgcccccgcgccgtattccctgccggaagccggccgtcccgcccggcccgaactggtgcacccggccaaggtgccgcgccgcggcctctccacgccccacggccacgccgctttgctgcacgccatcgcccacatcgaattcaacgcggtcaatctggcgctggacgccgcctggcgtttccgtgaaatgccggacgatttcgtcggcgactggctgcaggtggcggcggaggaagccaagcatttccggctgttgcagcgacggctgctggacctgggtttcgcctatggcgatttcccggcccacgatggcctgtgggcgatgagccgccgcaccgataacgacgcgttggcgcggatggcgctggtgccgcgggtgctggaagcgcgcggcctggatgtcacccccggcatccagcgccggctggcacgcatcggcgacgacgccagcgtggcggtgctggacgtcatcctgcgcgaggaagtggggcatgtgcggatcggcaaccgctggttctgcgagctgtgccggcaacgcggcctggaaccgcaagccgctttccgcggtctgttggaagcgtacgcgatgccgcatcggcccgggcagtacaatttggccgcccgcgaggcggcgggtttcttcgccgacgaattacaggcgctggccgcgctggacgacagctccgccgccatcgacaattga

SEQ ID NO: 2059 - DNA, 216 bp, Chromobacterium substugae
atgatgaatctgatcaagcgcatgcagcgcaaccgcaagctggctttggccgtgttgatactgtctactttgctgttcaccgccttgtcggccgcgtggcgcggcggagaggccggctcgatctggctgacgatcgcgtgcccggtgctgctgttgctggcgctggcggggcagctgagcgcgctgttggctttattgcaaaaaccacgaaaataa

SEQ ID NO: 2060 - DNA, 420 bp, Chromobacterium substugae
atggagcaccaggtattcctgcgccagctggaaagccattcgctgcctgcatcggatttcaatcaccaagcccacctgtacgcagcctgggggtatcgccgggagtacccggcgcccgaggcggcggcccgttgcgcccacgccttgtcgcgcttcgccatggcgaacggcgcggcgaccaagtacaaccacacgctgacgatggcgctgctggcgatcgcctacagccgcatcgagtccagcccggcgctgggcggcgactggccggcctttctcgattgctgcagcgatctggcgcaagacgcccgcgcggtactcgaacaatattattccgccgagcgcctgatggccgactccgcgcgcaaggccttcgtcaagcccgacaagcagcctttgcccgtgtcctgtctgctcaactaa

SEQ ID NO: 2061 - DNA, 1101 bp, Chromobacterium substugae
atgaagaagaaactgattcgcaaggttctgtattcgctgctgctgttgttgccagccgccggcgcgctggcggaggacaaggtgctgaatgtctacaactggtccgattacatcgccaagtccaccatccccggctttgaaaagcagaccgggatcaaggtgaaatacgatgtctacgacagcgacgacacgctgcaggccaagatgctgaccggccgcgccggctacgacatcgttgtgcccacctccaacttcatggccaagcagatcgaggccggcatctaccagaagctggacaagtccaagattcccaacctcgccaacctggacaaggcgctgatggccaagatcgtcgacgccgatccgggcaacgcccacggcgtgccctgggcctacggcaccgatggcctgggttacaacctgaccaaggtgaaggccgtcctcggcgccggcgcgccgctggacagctgggacatcctgttcgatcccaaatacctgtccaagctgaagggctgcggcgtgtcggtgctggaccaggccaacgacgttttcgccgtcacgctgcaccatctgggcaaggatcccaacagcaagaacccggccgactaccaggccgcgttcgaggcgctgaagaaaatccgcccctacatcacccagttcaattcctccggctacatcaacgacctggccaacggcgacatctgtctggcgctgggctggtccggcgacgtcaacatcgccaagcaccgcgccgccgaggccaagcgcagctatcagctggcctacgtgatccccaaatccggcgcgccgatctggttcgacgtgatggtgattccgaaggacgcgccgcacccggaggcggcgctggaatggatcaactacatcgaaacgccgcaggtgaacgccgccatcaccgacgaggtgttctacccgacggtgaacgccgcggcgcgcaagttcgtcaagcccgagatcgccaacgatcccaccatctatccgccggagtcggtgatgaaggcgctgttcctgctcaagccgctgccgccggacatcatgcgcctgcaaaaccgcctgtggacgcagctgaagaccggccgctaa

SEQ ID NO: 2062 - DNA, 861 bp, Chromobacterium substugae
gtgatttcggtgcctttcctgttcctgttcgtgttcttcctgctgcccttcctcttggtggtgggcattagcttctcccagcagcagctgggcattccgccgtacacgccgctggtcaagctggaaaacgacgtgtacacgatcgcgctcaatctgagccattaccgcttcatgttcaccgacgacctgtatttcgccacctatgtcagctcggtgaagatggctttcttctccacggtgctgtgtttgctgatcggctatccgatggcctattacatcgcccgggccgaaggcgcgacgcgcaacacgctgatgatgatggtgatgctgccgttctggacctcttacctgatccgcgtctacgcctggattggcattctgaagaacgacggctttctcaatcagttcctattgtggctgggggcgatagacagcccgctgcacctgtaccacaccaattggggcgtttacatcggcatggtgttctcctatctgccgttcatgatcatgccgctgtacgcccacttggtgaaaatggacctgacactgctggaggccgcctacgatctgggcgccaagccgtggcgcgcgttctggcaggtgactttgcccttgtccaaaaacggcatcatcgccggcagcctgctggtcttcatcccggcggtgggcgaatacgtgattccggagctgctgggcggatcggacacgctgatgataggccgggtgatgtgggacgagttcttcaacaatatggactggccgatggccgccaccgtcacttgctgcatggtgctgctgctgttggtgccgatggcgctgtttcagcattaccaggtgaagaccatggaggaagcaagatga

SEQ ID NO: 2063 - DNA, 840 bp, Chromobacterium substugae
atgatcaagccgagcaagccgctgtctttcctggtgctggggctgggttacggttttctctacctgcccatcgccttgctggtgatctattcgttcaacgaatccaagctggtgacgctgtggtccggcttttcgctgaagtggtacgccgccttgctggacgatgacgaactgatcaccgccgcctggctcagcctgaagatcgcgctgatgacggccaccgcctcggtggtgatcggcacctgggcgggtttcgttttgggccgtttcggccgctttcgctttttcaccctgttcaccggcatggtcaacgcgcccttggtgattcccgaggtgatccagggcatttcgctgctgctgctgtttgtggcgatggagcaaagcttcggctggccggagggcaggggagtgttcaccatctggatcggccacgtgatgctgtgcgtgtcctacgtcgccatcgtagtgcagtcgcgggtgcgggagttgaacctgtcgctggaggaggcggcgatggacctgggcgcgcggccgctgaaggtgttcttcgtcatcacgctgcccctgatctcgcaggcgctggtgtcgggctggctgctgtcgttcacgctgtcgctggacgacctggtgctgaccgccttcctgtccgggcccggctccaccacgctgccgatggtgatcttctcgcgggtgcggctgggcctgaatccggaaatgaacgcgttggccaccttgttcatcgtgttggtgtcggtgggcgtggtggcggccaacatctatatgagcgtgatgacgcgcaagcgggaaaaggagatgcggctggctttcgccaatggctga

SEQ ID NO: 2064 - DNA, 1470 bp, Chromobacterium substugae
atgaagagggtactgatcagtgcattgatcgcggcgctgcccggcgtggcgttggcggatgcgaaagcggacgaaatcgccaggctcaaggcgcagatgcagaaactgcaggcgcagatggcggaattgcaaaaggcggtggaagcggccacggccgagaaaccggcccctgcggcatcggccgccgcggatgacgccaatgccgatctgaaggagagggtggccggcatggaattgaaagtcgaccggctcaacaccgccgccaacgaggggccgatcgccggtctcagcgtcaccggttacctggaccccacctatatctataaccgcggcaacaacagcgcgggcttccagttcctcaaccaccagaacacctacgcctacagcaacagcaccttcggcgacgtgtacctggacatcaagaagacgttcggcgtcggccccaccgcgcccagcgccgaaatcagcatcatgcccaaccgcggcagcggcaacaccctgttggatggcggcagcggcaacaacatcatcaacaccgcggtgatcaatgttccgttgtcggacacctggtcggtcaatgccggcttgatgaacagcttcggcggttacgaggtgcagcagtccaaccagatggtgacgctgacccatggcctgctgtacgacttcagcgaccccggcagctatgtcggcgccggcttcgcctggagccacgacgtgtgggcgtggaagttcctgctggccaacgagcaataccgcacccacgccaacctggccaatgccggcaacagcagcgtcaccggcgcgccgcaggtcaagagcaacaacacgccgacgatgaccgcgcgcgtcgactacacctggagcagcgcgctggatctgggaggatcgttcaacgctggccgccagacgctgctgacaggctcgaattgccaaggcagctacggttaccagtgcacggcgaacagcccctactcgaattacttcttcaccgaagccgacgccagctacacgctgggcgacgtccagtacaacgccgaattggactacggccagcagcagaacgccgcctggaacggcggcaacgcgcagtggtacggcgtgtcgctgctgggccaccgcaagtggatgacggacacggtgggcaagatgggggcgacgctgcgctacgactatctgaatgacagcaagaacggcggcggcggcggcggcatcgcgctgggcagcagcgggtatgacggaaccaacgcgttcggcgtgtcgccagcctgcgtggccagcggcgcggccaactgcaagggggccaaccgccaggcgctcaccgccgatctgctgttcttccccaccgaccagctgacgctcaaactggaataccggcacgactgggccagcgaaagcgtgtttctgcgcaacgacggcagcttccgcaagaacaacgatctcttgggcgcgcaagcggtctatagcttctga

SEQ ID NO: 2065 - DNA, 1035 bp, Chromobacterium substugae
atgtttcgtaattttctgccgcattggccattgccgcgctaccgggccgactccgcccgttcccaccacggcgcggccggctatcaaaacctgtatccgttcaagcagccgcgctttgccgatctgttgcgctggaactggcaacgctggcggatgccggcggtggcgcaccggctgcaggacatccgccggcaaacgcccgacgccgcggcgctggcggccaacgccagccagccctcgtacacctggatcggccacgccagcggcttcatccaattggccgggctgaacctgctgctggacccggtgtggtcggagcgggcgtcgccgttgaggtgggccggccccagacgtctgctgccgccggcgctggcgctggagtcgctgcccagaatagatctggtgatggtcacccataaccattacgaccatctggacttcaccaccatccgccgcctggcgcggcaggccggcggcgcgccgcagttcgtcgtgccgctgggcgtggcgcccaccttgctgcgcgccggggtgcccgccgcgcacatccatcagctggactggtgggagagtttcaaattgggcggggtggaggtggtgctgacgcctgcgcagcattggagcaaacgcatgatcttcggcgaccgcaaccgcgcgctgtggggcggtttcgccgtgcgcggcgacggcctgcagctttggtacccgggcgataccggttatcatcccgagctcttcgcgctgattgccgagcgcatcggctcgctggacctggcattgctgcctataggcgcttatcagccgcgctggtttctgcaagcgcagcatatcgacccggccgaagcggtggagatcttccgcatcatgcggccgcgccgcgcgctggccgtgcactggggcactttcgtgctgaccgacgaggcgctgcaccagccgccgctggatttggccgcggaacgggacaagcatggcatcgatgccgccgatttctcggttcccgcgatgggcgagactttctggctgccccccgattga

SEQ ID NO: 2066 - DNA, 1719 bp, Chromobacterium substugae
atgacaattcatcaactgatcaacgagcgggtacaggcggcgctggcggcagcgggcgcgcctgacgcgcctgccgtgattcagccggcgtccaagccggaattcggcgactatcaggccaacggcgtgatgggcgccgccaaggcgctgaaaaccaacccgcgcgcgctggccgaaaaggtcgtcgccgcgctggatcttgccggcatcgccgacaaggtggaaatcgccggaccgggtttcatcaatattcatctagcccctgaatatctggcccgacgaagcgaagccgccctgaaagacgacaagctgggtctcgcgccggtgaagccgcagcgcgtgatggtggagtactcgtcgcctaacctggccaaggaaatgcacgtcggccacctgcgctcgtcgatcatcggcgacgcgctggcgcgcgtgatggaatacgtcggccatgacgtggtccgcgccaaccacgtcggcgactggggcacccagttcggcatgctggtggcctatctggtggaaaccagccacgccggcgacgccgacctgcagctgtccgatctggaaaccttctaccgcaacgccaaggtccgtttcgacgagagcgaggacttcgccaataccgcgcgcgactacgtggtgaagctgcaaggcggcgaccaggaggtgctgaagctgtggcgccagttcgtcgacgtgtcgctgaagcactgcgaagaagtgtaccaaacgctgaacgtcggcctgaagcgcgagcatgtgcgcggcgaatcgtcgtacaacgacgacctgccggtgatcgtgcaggaactgcgcgcggccggcctcttgaccgagagcgatggcgcgcaggtggtgttcctggaggagttccgcacccaggaagacaagccgatgggcgtgatcgtgcagaagaaggacggcggcttcatctacactaccaccgacatcggcgcggtgcgctaccgccatcgcgagctgaagctggaccgcgtgatctacgtggtggacgcgcgccagagccagcacttcgcccagatgttcaccatctgccgcaaggccggtttcgcgccggaagcgatgaagctggagcacgtcggcttcggcgtgatgatgggcgatgacggcaagccgttcaagacccgctccggcggtaccgtcaagctgatcgagctgctgcaggaggcgcaggaacgcgcctacgcgctagtggcggaaaagaatccggacctgtccgaagagcagaaacgcgaaatcgccaacgcggtgggcatcggcgcggtgaagtacgccgacctgtcgaagaaccgcatgagcgactacatcttcaactgggacaccatgctggccttcgagggcaataccgcgccgtatctgcagtacgcgtacacccgcgtgcagagcgtgttccgcaaggccgaggactatgacgcgggcgcgaagatcgtcatcgccgagccagccgagaaacagcttgccgccgcgctggcgcagttcgaagacacgctgaacgcggtggtggaaggttgctacccgcactatctgtcgcaatacctgtaccagatcgccacgctgttctcgcgcttctacgaggcctgcccgatcctgaaaagcgaaggcgaagtgcgcgccagccgcctgcagttggccgcgctgaccgcccgcacgctgaagaccggcctggacctgctgggcatcaaggtgctggaggcgatgtaa

SEQ ID NO: 2067 - DNA, 633 bp, Chromobacterium substugae
atgaaacccgacctcgccatccgcctgctgcatcaatgccgccacgccacgcttgccacccagtcgcggcaatatcccggctacccctatgccagcgccatccagtttttctgcgacgagcgccagcggccggtattcgtggtcagcgcgctggccgaacacagcaagaacctgctggccgacccgcgcatcagcctgtccttgctgtctccggacgatgacgccgcccaatctgccgctcggctgaccatgctgggcgacgcagagcgcttcgatgcgtccgacgccttgtgcgcgcggctgctgcgctaccagccggaagccgaggaatggctggcgctggatttcatgtttttccgcctgcggcccatgcggacgcggctgatcgccggcctgggcagcatgggctgggtggatggacgcgcctggaacgaactgcccgccttgagcctggaggaagagcggctgctattggaagaagcgcaggccgcgttgccggaatcgatccgcgcattgggttgcgattgcttcggcgcggacttgctctggcgtggcagctatcgccgggtggattgggacgaagcgctgccggagccggcccgcatccgcgagcggctggcgcagctgggctga

SEQ ID NO: 2068 - DNA, 165 bp, Chromobacterium substugae
atgtctttccctgatatcggcggggtttgtattgcggattgtgtccgcgcccttcgccttgaaacatcctctccgtttcgggaggcatgtcgtaatttcatacgactatttcgcaatagattaaacgcagagaaaatgccaaatggatttaacacaaattcataa

SEQ ID NO: 2069 - DNA, 2556 bp, Chromobacterium substugae
atgaattacaagagaaaaactctggtggtggcgctttcgctgatcggcaacgtcggctatgtccaattggcgcacgccgacgacggcacgctggaccgtgtggagatcaccggctccaacatcaagcgctcgatcaagaaggaaaccgctgtgccgatgaccgtcgtcaagactgacgacttggtcaagcaaggcctgacgacggtagagcaagtggtgaacagcctggccgcgaaccagtcttcgcaaggcgccaacgccgctgtcggcgcttccaccggcggcgccgcttttgccagcctgcgcggcctgggccagcagtacaccctggtactcctggatggccgccgcatcgtcaaccagccgctggatggcactgcggttgacctgaacgccatcccgctgtccgtcatcgaccgcgttgaagtggtgcgcgacggcgcttccgccatttatggcaccgacgccattggcggcgtgatcaacttcatcaccaagaagtcgattaccggcctgaccatcggcggcgagttcgtcggcccgcagcatcccggcggcaaggaaaagagcggctccgtcacctatggctacggcgacctggccaaagacggcttcaatatctacggttcgttcgactaccacaagaccgatccggtttttgccagccagcgtgatttcgcctccctggtgaccagcagcaccaagctgagcgcgaactccttcccgaccacctacctggacccgaccactgggaaaatggtcagcgccggctacccgcagtgctcgccgccgtattccattccgaaaggcggcgtctgcaaggaggtcttctcgctgttccccggcattcagcccgaggttgagcagaagtccggcatagtcaagggcactacgatgctgggcgaccatgagttgtcgctgcagtacatggttacccaaaccaagaatatcagcagcgtcgctccggccccactgtccggcgatgtgacgtctccgactgcgcctggcctgccgagcgccgacggcccgttcccgttgtacggccgcacggtgccgatgggcaatcgagttgaccagagcatcgccacgacccaacgtctgcaagtgaatttggaaggcttgttggcggggtgggattatcgcgccggtttggggcactcgatgagcatcgtgacccacgatctggtgagcggctacccgggaacttcgcagctgcagagcgcgctgaataacggcttcgatccttccaatccgaatcccgccgcatggcagagcatcggcgtttccggccagatcgaaaacgccaagtcgactctggacaccgctgacttcaaggtcagcaaagaggtatttcagctgccggccggcatggctgcggtggccttgggcatcgaggcgcgccatgaggaaatggcgcacaactataatctgggtctggctggcaatgcgctcagcacaggcctgaacaacacgacttcggctagcggcaagcgttcgtcgcaagcgctttacggcgagatggacatcccggtgatcaagaatctggatgccaacctggccgtgcgttacgaccactacagcgatttcggcgattcggttaacccgaaaatcgcgctgaaataccagccgaccccgcaagtgctgttccgcacttccgcgagcaccggcttccgcgcgccgtcgctgtataacatcaaccagccgagccagcttcaactgaccgaagacaactataccgatccggtatattgccctggcggcattaagcagccgggtgcgggcagccagtcttgcgtgagcacccagcagaatctgcaagtagggggcaacaagcacctgaatgcggagaagtcgtcgtcgctgtcgtttggcgtggtgttggagccggtgaagaacttcaccgccagcgccgacttctggtggacgatgattcagcacaccatcggcacgctgccggagcagaccatctttggcaacccggctaaatacgccaatctgtttgttcgcgacgccaacaacaatctgctgtatgtggtcgacaactaccagaacctcggcaataccagcgccgcaggtgtagacctggggctgtcctactcgttcccgcacaatgccttcggcaacttcaccgtttcgctggatggcacgtataccagcaagtactcgtatcaacacgaggaaaacggtgtgtatgtgagcagcctgggcgcctatgtggattccgctccgaccttccgctggcagcacaatctgtctctgaactggagcaagggctcgtggggcgcgttgctgagccaggaatacaagtctggttacaccgaccagaacacgattattccgggcgcggcgcacaacgtgaactcctacgccacctggaacctgtccggctcctacgtttggaacaagcagctgtcgctgacggccggcgtgcgcaacctgtttgataagactccgccgtggagcaaccagcaggctaccactccgcagggctacgatccgcgctttaccgacgcgatcggccgcgcttacttcctgaaggcgtcttacaagctctga

SEQ ID NO: 2070 - DNA, 654 bp, Chromobacterium substugae
atggtaagtgcctccctcaaacgtaatcccaatctgagaaaccggcgcagcgccggcctgatcggcgtgatcgcgttccatgctctgctgatctacgcgctggtgacgggcttggcgcagggcgtggtcaaggtgatccagcagaaagtggaagtgtcggtgatcagcgaaccgccgccgccgccaccgccgccgccgccgaagatcgagaaagtggtgcagccgacggcggcgccgaagccgcaagcgtatgtgccgccggtcgtgaatccgccgccggtcgtgcaatcggcgaacgcgatccagtcggtgacatcggatccgaagccgcaacccgcgccgacgccggcgccggtggtggaagcgccgaaagggccgatttcggcgaaagccaactgcagccacctggaagcgccggagtacccgagcaaagcgcaggaagacgaaatccagggcgtggtgcgggtggtgttcggcgtaggcgcggacggcaaattcagcgggatcagcaatatcggtttcgacggcagcatcccgccgcgctaccgcagcagcttcaagtcggcgatcagcgccgcattgcaaggctacacctgccaggccaattcccagctgacgcaggaattcggcttcaaactcgactctggctcctaa

SEQ ID NO: 2071 - DNA, 747 bp, Chromobacterium substugae
atggctaaattcacacaagctctgctgggcaaggcactggctgcggccgcggcgctgagcgcgctgccggcgatggcggcggagacggtgaccacggacaacccgtacggcatcgacgcgctgtggtcgcaaggcgacttcgtggcgcgcggcacgctgatcattctgctgatcatgtcggcctccacctggtacgtgggcatcgtcaagctgctggagcaacgccgcctgatcaagcagggtcacgaattgctgggccaccacggcgtggacctgcaaaaagccgccagcgaactggcggacgaaggcatgtacagcgcggtagcgcaagccggcatcgaagcggcgagcgaacacaagggcgaactgtccaaccgcgtggacctgaacacctgggtgtcgatggcgatttctgacgcggtggactccgccagccatcacatgcaaaacggcctgtcggtgatcgccaccgtgggttcgaccgcgccgttcgtcggcctgttcggcacggtatggggcatttaccacgcgctggtgaagatcggcacctcggggcaggcctccatcgacaaggtggccggtccggtgggcgaagcgctgatcatgaccgcgatcggtctggcggtggcggtgccggcggtgctgggttacaactggctggtgcgccgcaacaagctggtgctggacaacgtacgcgtggtgtccggccgactgcacgccagcctgctgaacaacccgacccggtaa

SEQ ID NO: 2072 - DNA, 387 bp, Chromobacterium substugae
gtgctgtcggcgatcaacaccacgccattggtggacgtgatgttggtgctgctgatcatcttcctgatcaccgtgccggtggtgacgcaaacggtgaagatgacgctgccgaaagagcagaacatcccgacgcagacgaagccggaaaacatcgtgctgggtgtggacacgcacaacacgatttactggaacacgctgccgatgaagagccaggaagacctgctggcgcgactggtgaaggaagcgaagaagacgccgcagccggaagtgcacatccgtggcgacgcggcggcgaagtacgcgccgataggccgcatcgtgctggcggtgcagcaggctgggatcgtgaagatcgcgttcatcaccgagcctccggcgcggaactag

SEQ ID NO: 2073 - DNA, 693 bp, Chromobacterium substugae
  modified_base (420)..(420): a, c, t, g, unknown or other
atggcgatgaatgtagggtcgtcgggagaagacgatctgatgatggaaatcaacaccacgccgttgatcgacgtgatgttggtgatgctgatcatgctgatcatcacgataccgatccagacgcacgcggtgaagctggacatgccggtgaacacgccgtcgaagccgctggagaagccggtggtggtgcagatcgacatagcgccggacaattcggtgctgtggaatggcgagaagctggcggggcgggagcagctggaggcgaagctgacggcggcggggaaggcgagtccgcagccggagctgcacatcaagccgaacaaggacgcgagttatgagccggtggcgatggtgctggcggagtcgcagcgtctgggtttgacgaagctgggcatcgtcggatcggaacagttcgtcaanggttcgaccgcgccgttcgtcggcctgttcggcacggtatggggcatttaccacgcgctggtgaagatcggcacctcggggcaggcctccatcgacaaggtggccggtccggtgggcgaagcgctgatcatgaccgcgatcggtctggcggtggcggtgccggcggtgctgggttacaactggctggtgcgccgcaacaagctggtgctggacaacgtacgcgtggtgtccggccgactgcacgccagcctgctgaacaacccgacccggtaa

SEQ ID NO: 2074 - DNA, 387 bp, Chromobacterium substugae
gtgctgtcggcgatcaacaccacgccattggtggacgtgatgttggtgctgctgatcatcttcctgatcaccgtgccggtggtgacgcaaacggtgaagatgacgctgccgaaagagcagaacatcccgacgcagacgaagccggaaaacatcgtgctgggtgtggacacgcacaacacgatttactggaacacgctgccgatgaagagccaggaagacctgctggcgcgactggtgaaggaagcgaagaagacgccgcagccggaagtgcacatccgtggcgacgcggcggcgaagtacgcgccgataggccgcatcgtgctggcggtgcagcaggcggggatcgtgaagatcgcgttcatcaccgagcctccggcgcggaactag

SEQ ID NO: 2075 - DNA, 384 bp, Chromobacterium substugae
atgatggaaatcaacaccacgccgttgatcgacgtgatgttggtgatgctgatcatgctgatcatcacgataccgatccagacgcacgcggtgaagctggacatgccggtgaacacgccgtcgaagccgctggagaagccggtggtggtgcagatcgacatttcgccggacaattcggtgctgtggaatggcgagaagctggcggggcgggagcagctggaggcgaagctgacggcggcggggaaggcgagtccgcagccggagctgcacatcaagccgaacaaggacgcgagttatgagccggtggcgatggtgctggcggagtcgcagcgtttgggtttgacgaagctgggcatcgtcggatcggaacagttcgtcaaatga

SEQ ID NO: 2076 - DNA, 1071 bp, Chromobacterium substugae
ttgccgcttgccgcctgcaacaagagcgatggcgccgaaaagccggccgccggcaagagcgcgtccgcgccggtcgcccgcagcttgtccagcgccgatgtgatcaaggcgcagatccagccgctggcggccaccattcccttcaccggctcgctgaccgccctggccagcagcgcggtggcggccgaagtggacgccaatgtgcgggaagtgaaagtgagggaaggcgaggcggtgcgccgcggtcagttgctggcggtgctggacgccgaggcgctcgggcagtcggtggaggagcagaacgcccagctggacaataccaagtcgcgcttgaagctggccaaggttaagttggacaagcagcgcgagctgctgggcaagggcttcatttcccaggtggcctatgacgaactggaaagcgattaccgggtgaaggagggcgaattgcgcgcccaggcctcgcaagtggcccgcgccaagcgcctgctgcaggacacccaggtgaaggcgccgattgacggcgtggtgttcgagcgcaagatcaatccgggcgaagtggccagccgcaatatgaagctgttttccatcgccaacctgtcggtgctggaaatcgccgccaccgtgccttcgcgcctggtgtcgcaggtgcgcgtcggcatggacgccagtttcagcgtggatggccgcagcgagctgcagcatggcgaagtggtgcgcatcaatccggtggccatccccggcacccgcagcttcacgctgttcatccgggtgcagaaccctgccggccaattgaaggtgggccagttcgccaagggcggcgtggtgctgcgcgcagtgaaggaccaggtggtggtgcccttgtcctcggtgcgcgacatcgacagccagccgtggctgatggtggcggagaagggcaaactggtgaaaaagccggtgacggtgcaactgcgcgccgaaaacgagcgccaggcggcggtggcgggcatcgcgccaggcgccagcgtgatcgtcggcgagttgctgggcagcaagatcggcgacgccgtcggcctgccgggcggccagggttga

SEQ ID NO: 2077 - DNA, 1707 bp, Chromobacterium substugae
ttggccgcgcctcaccagttgcacgtccggcggcagctgcatgccctccagcagcttgttgacgtcggacatcgccgagctgacgtcgcgcccttccacattggccatgatgctgatctcgcgcatcatattggtgcgcttgatctggcgcgggctgatcccctgccgggtttcgatcagcgaggacagcggcaccatttgcgaggcgccgttctcgtcgcggttgcccgccaccttgagctggtccagcaactcctggcgccgcgcgtccttggggatgcgcaagcgcacgtcgtagttgtcgccattgggcgcttcccaggtggtcaccacgttgccggccaacagcatcgacaacagattgcccacccggttgaggtccacgcccaggctgagcgcggcgtcgcgcttcagggtcaggctcagcgacgggtcgccctcggtgaggttggattcaatgtctcgcacgcccttgatcttggcgatcttgcgcatgatctcgcgcgacaccgcgtccaactcgcgcagatcgccgccgcgcaggccgatgaataccggcttgccctgctgttcgtcgttggccaccgccttgatcagcacgccggccaccggctgcacccgcttgcgggcatcggcgatcacttcgttcaagctgcgttggcgttgatgcttgtcgccgatgtccagagtcagcgtgccgtcgttcttgccggcgccgaaattgccggcgccgacatccagcgacaccgtgcggatctcctggatgcccgacagcgcctgggccagctcccgtcccttggcggtggtgtattccagcgaggagccgggcgcggtctggtacaccacgttcagcttgccgctgtcgcgctcgggaatgaattcgccgcctatcatcggcaccagcatgaagctgcccgccgtgatgcccagcgccagcgccagcaccgtcttgcgatggcccagcacccaatggatcaccttggcgtagcgctcggacaggccgtccagcgaggattcgaaccaatccagcatccgtcccagcgggccgcggtgcttgtcgccgtggtggtgcgggtcgtgccagatcgacgacagcatcgggtcgagcgagaagctgacgaacatcgaaatcagcaccgccaccgccacggtgaggccgaactggtggaagaagcggccgatgatgccgctcatgaagcctaccggcaggaacaccgccaccacggtcagcgtggtggccagcaccgccaggccgatttcattggtgccgtccagcgccgcctggtaatggctcttgccgagcgcggcgtggcggacgatgttctcgcgcaccacgatggcgtcgtctatcagcaggccgatggacagcgacagcgccagcagggtcaggatgttgagcgtgaagcccatcagctgcatggcgaacaaggtgcccaccagcgccaccggcagcgtcaggccggtgatcaccgtgctgcgccagctgcccagaaacaggaacacgatcaggatggtgaggccggcgccttccagcagcatcgactccacgctgtgcagcgctttcttcacatcctcggccgaatcataggtgtagcgcagcacggtgccggccggcatccgcggcttgaattcttccagcaacttcttcaccccggccgccaccgccacctcgttggcgccgcgcgccgccttgatgtcgatgcctag

SEQ ID NO: 2078 - DNA, 480 bp, Chromobacterium substugae
atgccggtaaccatcatggtgtcgctgccgctggctttcggcggcgtgttcttcgccttgttcctgtgggggtcgacgctgaacatgttctcgatcatcggcatcatcatgctgatgggcctagtggccaagaacggcattctgctggtggacttcatcaaccgctgccggcaggagggcatggagcgcaacgcggcgatcgccgaagccgggcgggtgaggctgcgcccgatcatgatgaccagcctggcgatgattttcggcatgctgccgctggcgctgggcactggcgatggctcggagaccaaccggccgatggcgcacgccatcatcggcggcctggccacttccacgctgctgaccttgctggtggtgccggtggtatacacctatctggacagcttgcgcggccgcattcgccggctgttgggcgggaaacgcaaggacgcgctggtattgaaggccgaaaacggtaaatag

SEQ ID NO: 2079 - DNA, 369 bp, Chromobacterium substugae
atgaagacccctctcaccgtcctgctgctcgcagcctgcctgctgagcgccggctgcgccacccagcagggctacgcgcagaaggtgctggtctggcaaggccgcgacgccaacgaactactggccgcctggggcacgcccaccagccagatgaccatgcccaacggcaagctgctgtacacctaccgcaacgcgtacagccaggacatgccgatccagagcagcggcttttaccacccctggggcatcagcggcggcggttcggtgtactacagttgcaccaccaatttcgtggtggacccgcatgaccatgtcgtccagtcggtaagcttcgacggcaacgattgcgtcgcccagccgcgcaaataa

SEQ ID NO: 2080 - DNA, 1788 bp, Chromobacterium substugae
atgtgcctgagaaagcccatcgcggcggcactgatggtctgggggagcatgttgccgatgcacgcatcggcggagaaagtgctacatggcgtattcaacgcgcaggaaaccggcttcgacccggccaaggtgtcggacgtgtattccgccgcggtgatcgaacatatctatgaccccttgctgaccttcgactacctgtcccgtccggtgagggtgatccccaatgtcgtcaccgcgatgccgacggtcagcgccgacggcctgacttacacctttcatctgaaaaaaggtatttatttcgcgccggacccggctttcaagggcaagaagcgcgaactgaccgccgccgactacgcctatacgatcaaacggctgtccgaccctacggtggcctcgccgctgagcgacaccttcaccggcaagctggtggggctggacgcgctggtgaagaaagccggcaagggcaagctggattacgacgcgccgctagccggcatccagacgccggaccgttacacgctgcagctgaagttcaagcagccgttcccttcgctgccctacgtgctggccggcagctgggtggaagcccaggcgcgcgaggtcatcgaggcctacggcgacaacaccaacgcccatccggtcggcaccggcccctacatgctgaaggactggaagcccggcaacagcatgacgctggtgcgcaaccccaatttccgcagcgagacattccattaccaggccggcgccgacgcccgggaccagcggatcgccgcgcagatgaacggcaagcgctatccgcagatcgaccggatcgagatttcggtgatccaggaggagcagccgacctggctggcgttcaagagcggcgagctcgacgtgctgagcggcaaccccagcattccgcagccgctgattcgccaggtgctgcggctggacccgcataatcccgcgcgcgcggaactgaaggcggaataccgcgagcgcggcatccagctcaaccgcagcctggaagagggcatcacgttctacgccttcaatatgaaggatcctgcggtcggtggtttcggcaaggacaagatcgccctgcgccgggccatcgcgatggccttcgacaacagcgagacgataagcaacatccgccgcaaccaggcggtgccggtgcagtacatcgtgccgcccaacgtcgcgggccataaccccgacttccgcgccgcctatccgttcaacccggcgctggccaacgcgctgctggaccaagtcggttacaagataggcgccggcggctaccgcaaccagcccgacggcaagccgttcacggtggatttcgtcaccgggccgacggccatcgacaagcagtggaacgaatactggcaaaaagccttcgaccgcatcaaggtgcgcgtcaacttccgcgtggtgcaatggaacgagcaggccaaggcgctgcaggagtgcaagttcggcatagccggcgcggcctggggggcagattatccggacggcgacgatttcatgcagctgctgtacggcccgaataccggcggcagcaattactcctgctaccgttccgcccgcttcgacagcctgtatgaacagtcgcgggtgctgcccgacggcccggcgcgcaaccgcctgtacgatcagatgaacaagatcgtggccggcgacacgccctgggtctacggcgacatccgctatgtcaacggcgtcgcccagccctgggtgagaggcttcaaggtgcatcccaacttcaacgccatctggcgcttcctggacgtgcagaaataa

SEQ ID NO: 2081 - DNA, 939 bp, Chromobacterium substugae
atgtccgcattcatcattcgccggctgctgcaaatgatcccgaccctgctcggcgtcatgctgctggttttcacgctgttcagcgttgtcggcggcgatccgacgctggtgctggccggcaaacacctgacgccggaagtgctggcgcagatccgcagccagctcggcctcgacaagagcctgcccgagcaattctggctgttcgtccatcaggtgctgacgctgaatttcggcacttcctggtccacccagcagccggtggccgacatcatcggcagccgcgtcggcccgtcgctgacgctggccggggcaatgctggtggtcgacctgctgatcgccatcccgctggccgcgctggtcgcctattttcgcggcggcctgaccgaccacctgatcaccatcatctgcacggtggcgatgtcgatcagcgcgctgatctacatcatcgccggccagtatttcctggcgttcaagctgggctggttcccggtgcgcggctggggcgattcgttctggaccaatctgttcctgtacgtgccgctgcccttgctgatgggcctgatggtgtcgctggggccggacatccgcttttaccgcagcttcttcgttgaggagctgggccaggactacgtgcgcaccgcgcgcgccaagggcttgtccgagcgccgcatcatgctcaagcacgtgctgcgcaacgcgctgatcccggtggtgaccagcgtgatgatgtcgcttccttatttgctgatcggggctttggtgctggagaacttcttcggcatccccggcatgggcaacgaggtgatccaggcggtcaacaagagcgattttccggtgatcaaggccatcaccatctacatcgccatcgccaccatggcgttcaatctgctgggcgatctggtctacaagtggatcgatccgcgcgtgcaactgaaataa

SEQ ID NO: 2082 - DNA, 1062 bp, Chromobacterium substugae
atgacgacactgcagaatgccgcgggccatccgccggccatgccgtcccgcagcctgtgggcgctgggttggcagcgtctgaagcgcaacaaggtgggcttcatctctttatggatagtgctggcctatttgctggtcgccatcggcggctggtgcaatttgataggcagcagctggaccgacgaggtcggcgtgccatacgcgccgcccagttggataaaaccgtcggctgacgacgtgttgccgcctgagcgggcggcggcgaaagcggcggccgcgcccatcgtggcgatgagtccggcggaagacccgataagcgaagagctggccgcggcgcagaagcatgtcggcgactatgccggcaaggcgcagacgcgacgggacacgctgccgttcggcggcgacttgcaaggccgggatgtgatccagaaaaccctgaaaggcacgtccacctccattttcgtcggcgtcttcggcgcggtgtgctcgctgatgataggttgcgcgctgggcgcggcgtccggttacttcggcggcaagaccgacgacttcctcaactggttctacagcgtgttcacctcggtgcccgacatgctgctgctgctgtccttcgccgccgtgtcgggccgcggcatcggcactatcatttcggtgatggcgctgaccagctggaccggcacctatcggctggtgcgcgccgaatacctgaagttgaagggacgcgaatacgtgcaggcggccaatgcgataggcgccggcgacatgcgcaagatgttcatccatatcctgcccaatatctcccacctgctgctggtgcagttttccttgctgacggtggcgctgatcaaatacgaggccattctgtccttcctcggcttcggcgtcgacgtgcgccaggtcagctggggatcgatgctggaagaagcgccgaccgaactgatccagggctattggtggcagatgctggcggtgaccgtggccatgtcggtgctggtgacagcgttcagcctgctggtggatgcgctgcgcgacgcgctggatccgcgcgcggtggccaagtag

SEQ ID NO: 2083 - DNA, 564 bp, Chromobacterium substugae
  modified_base (533)..(533): a, c, t, g, unknown or other
atgaatcagcaaaacaccctgctgtccgtgcgcaatctgaaggtgggtttccgccaggaagacggcggccgcttcgaggcgctcaagggcgtcagcttcgacattccggcccaccgcacggtggcgctggtcggcgaatcgggctccggcaagtcggtgacgtcgatggccatcatgcagctgctgccgccgcaatccagcgagatcgatccggcgtccgaactgctgttccagggccgcaacctgctgcggctgtcgcgcggcgagctgcgcagcttgcgcagctcgccgcgcgacagccgcagcaggttgcggccctggaacagcagttcggacgccggatcgatctcgctggattgcggcggcagcagctgcatgatggccatcgacgtcaccgacttgccggagcccgattcgccgaccagcgccaccgtgcggtgggccggaatgtcgaagctgacgcccttgagcgcctcgaagcggccgccgtcttcctggcggaaacccaccttcagattgcgcacggacagcanaccggattggcaagagcattttctctgctga

SEQ ID NO: 2084 - DNA, 1320 bp, Chromobacterium substugae
atgctgataggcctggccattgccgtggcgctgataggcatggggctggcgtatctgggcgtgcgccaggtcggcgaatggcgggccagccgcggccaactgttgggcggcgcgctggcggacctgggcaagggcgtacagagctacgtggtgcagcaccatgaccagctggtgctggccgtgctcaatcaaaccgtgattcccccgctgaatggggtggcaaacccgttgagcccgaccccagctgaaatcgccagcgtggtgggcttgccctcgcttggcaccaagccgccgctggctggcgcgtcatatcaaatcgtgatcagcggcgacgacccgacgcaaggtaataggcaatgcgtcgctagtagtcctggcacctgcaatatcaacgccttgacctatgtcgacaagccgctgcgcctgccttatccatcggcgagcgacgacgtcgactatgtcgccgtggcttccgcggtgcagcagattggcccggacggcggcgccgccatgcctcccgacttcagcaagctgactttcagaaccgccgccaatagtaactcgataccgattgccaaccccatgactaacgtggcgggcatcgtggcggtgcgtggcggctacaaccgctctgacctgaatgttttcctgcggttggatggcagcaaaaagatgctgggcaatctggatatgggggcgaaaagcattgtcaatgccaaggatatcaatggtgcgggggcgctggtgatgaacggcgacatcaccagcaacttcggcaacatgaacgtgaatagcggcagtgtgaccgcggcgctggacgtgaccgccaagaggaacttgattgccaatggcaatttgtccgtaggccagaatggcaatatcaacggaagtctgggggttaacggaaacgcgacggtgggcggtagtgtgaatgcaggggggcgcattcagactggtgagtatttgctagctgggcaggttagcgagggggacacgcaggggtgcaacacccccgggttgattgcgcgtgatgccaatggcttgatactttcttgccaatccggtcgctgggcaacctctactaaaaataatccaggagtagtcattgatggcaataatgcatgcggtcatggagcagtaagtgccgcaacttgccctaatggaaaattaatatactctggtggatacgttatgaccgcatggtggtctgaaggtcaaaactctcctgatagctccttgcctctttcggatacgcaatggcaggttaaccttggtggcggtgctaatttttgcgctaaagcaagaattatatgtagatag

SEQ ID NO: 2085 - DNA, 948 bp, Chromobacterium substugae
atggcgcaacagatcattaccgatgtccagctgcacgtgcgcgactggaaatccagcgtgcttttccccgggcagatcaagcccggcgaggagtacaagaatttcctgatgaagctgaccgaagtggtgctcaccgaacagcaggaagtgggccggcgcaccggcttcaccatcaccatcggcgggctgcgctggcgggtgcagcgcatgcagcagtaccgctacgcctgccggctggtgatgaacaaggcgccgcgcctgaatgatctgcgcctgctggactttcacaccaccatgatgcagtcggacgagctgaagaaaagcggcggcctggtgctgttttccgggctgaccggctccggcaagaccaccaccatgaatgccatggtggtgagccggctggagaagttcggcggtttcgcccagacggttgaagacccggtggaaattgttatcgagggctggcatggcgacggttactgcacgcagatagacgtggccgactcgccatccgggcaggaattcaatttcgaccgccgctacgcggaggccatcaccaccgctctgcgctccttcccggcgcgggaccgctccatgctaatgataggcgaggtgcgcgacgcgcatagcgcggcggagctgttgcgcatcgcggtggatggccacttggtgctgtctaccatccattcccgagacatcccgtcggcgctgcgccgcctggcgtcgctggccagagccggcggcgaggcgcaggccgacgaattcatcgccgactccctgcgcatggtgtttcaccagcgcctggacaacggcattccgcaggtcacttcgcttgatctgcgcgatcgcaaagacctctcccaattcatcaacaagggcgaatacgcgcgcctggagggagagatagacatacaaagacgcaaaaacattcagggcaggggggcgtaa

SEQ ID NO: 2086 - DNA, 570 bp, Chromobacterium substugae
atgaatgcttcgaaatggcgttcggcttctggcagaagcggctcgctcaaacgccaggcgggtattgacctgattcagctgtcggtggcggtgggcatcatcgccttcatcctgtcgatcggctttctcgtggtgccgtcaatcatgaccaacatcaagtcgaactccgagacttccgacttgcagcaggaggtttcgcaagcgcagcgggtgttcggttccggcgtgccggcggccggcttgactaaccagttggctatcagcctgaaactgatggcggcggaccgtgtgtctggcaccaccatcctcaaccgtttcggcggcaccgtgacctggtccgctatcgattactacgcctccaaggacgcggtgcagttggtatcgaccggttattcgtccgaggcctgcttgcgtctggttcctaatatccagtcgctgtttgtccagatccaggtcggcaccaccacggtgaaagatctgaaggctggtgttgctttgaatgcggctgcattggctaccgcctgcaatgcctcgacgtccaatacccttacctatgcattttccttgtaa

SEQ ID NO: 2087 - DNA, 1107 bp, Chromobacterium substugae
atgctgaacctgatcaagcggtttttcggcatcgccccggcgcatgagcagaaatacgccggcctggccaaagccaagcgcaagttcatgaagctgcgcaccaagttctacggcgacctggccgactccatcgaggatggcgccaacccatacgagctgttttcccacaaatacatgctggcgcgcgagcgcggcaatgtgatggcgccattgttcgcctattggcgcgaccgcgcggcgtcgatgaacctgcgcggcgcctgggagggcaccatcccggccgacgacctgatggtgatcggctccggcgagcgcggcgacctgccggaagcgctgcgctttctggccaaggtggtgaaaatccgcgagggcaacgccgaggcgatcaagatggcgatcgcgctgccggtattcctgctgctgctgatgaccggcgtccagctgggcgtggcgttgggcatgatgcccatcatggagcagatcatgccggcggaccactttccgctggtgggcaaggtgctgtactacctgtcgcaggccatccgcaattactggtatctgatttacggcttgccgggcttgctggccgtggcttacttctggtcgctgccgcgctgggccagtccgctgcgcaatcggctggatcgccatctgccgtattcggtataccgcgacctgaaagccagcgagtttctggtttcgctggcggcgttgtcgcaagccaataccgcggtgtacgacgccgtgctgctgctggagcagggcgccacgccgtggatgcgctggcacctggcgcgcatccgcctggcgctgaccagcaaccgcagcattctgaaggcgatggataccggcctgttctccgaggagattttcgaccggatttcggaatattccgaacgcagcaacttcgaaaacggcatccgcaagataggcctgaccaccatcgaggaaatctccgaggtgatcagcgcccgctccgccgtgatgcgtaacgttttgatcgtagtggtgggtcttttcatcttgcttactatcgccgggatgatgatgacggcattggaggccggcaaccagattcagcagatgaccggtggcggcagcatgtga

SEQ ID NO: 2088 - DNA, 1920 bp, Chromobacterium substugae
atggccaatggtgatgacgccttcaagagtctgctgggcagattcgggtatggcaaaggcccggccggcagggccatggacgccgcgccggcggagcatggcgcggaggatgacgaagcggaggaagtgttgccgctggcggtggagcccgatttgttgctggacgcgccattgcagcactttcctgacagcggtttcggcataagcctggacagcgtgcgggaagcggtttccgccgccggccagccagaagcgccggcgatagcgcctgccgaggccgccgaggagcgagcgcctttcgcgccgctgcggatggaagagctgctggcgccgctggagccggtgccgtccagtccgcccccggctaggcgcgccgccagtctcagcgaggagaggctggccttgctgcatcgcgtggcgcaggaagcgcgcggcgagggcgtgcatagcagcgaagagttcgacatgggatacctcgaaccgctggtggatgcggtgcggcaaccggtggcgctggctcaggaacatgaagtgagcgaggcgctgccggtgccatcctgggcgcggatcgcggcggagcgcggcctgttggggcatgaggccggccaggtgttcgacagcctggacgccttgggcctggtcaatgacgaccgctacgccgagcaggcggctgcgtattggccggtggaggcgcagccgcaggcgtttgccgatctggcggccatcgcgctgaccgcgcgcagcgaattgccggcggccacccgcaacggcgacgggcttggccggcacggctacttctacctgaagggcgccgcttacggcgtgccggcattgatcgtggcggatggctccagccgcgaggccagaggccgcgtggcggaaatctgcggcgaattggaccaggccggaaaacgctggcgagtggttttgctgacctcttattcctaccgttgggcgctgcgccgcttcctgtggccggagatcgtcgcggcgggagatgtcggctatgcgatggcggtggctgacgccgcccgcgtctacgccgcgccggctgcggacggccggcggctgttgctgctggagacggcgcaaggcatggaagcggtagccatgatggatgccggcgaggcggcgcaatggctgggcgctttgggcgccgagccggacccggccgatgccggcatctggtgcgcggccggcaaagtcggcggggagcgcggcaaggcggcggcgcttgcggcgttcggacttgacgacaagatggtggtcaaccgcctggtgaaagagttgtcgcgccccggcgcgattgtcttcgtggcgggcgagatggccgaggcgatggccgcggcgctgatggcggaggcctggagccagggagtggctggcgccgccgccggttcggccgccgcgtcgggcctgccgtcggtgtggctgaacccggacgcgcaaaagctgcgcgcccatcacggcccggcgctggcggtgtttccgggccgcaacagcacggctgagtcggcgttgatgctgcttctgggcgagcagccaggctgggccaaggggcgtgtctccatgggcgtcaatacggtgcgcctgccggggctgtgtccgatttgcgcgttgtcggtggatgccgacctggcggcgcgcgagctgaccgaagtggtcagcaacttccgcagcgccgatttcggcaatgtcaaaacccgcaatctgcgcgagccctgctgcggcagcggctacgccggcgaggtatggcttagcgaggtgtgggacggcaagctgtgccagcgcgatttcggcgtcagcatgctggccgacctggtggacaagggcttgcggccggatcagcgcatcagttcgctgctgttccaggcgattcaggccgggcgggtggattaccgtagcgcggggagcttgtga

SEQ ID NO: 2089 - DNA, 1740 bp, Chromobacterium substugae
atgtgcagttggttttctgaggtaatggggcgcggggacgccaaatcggccgcttcgccggagtcccggcaggatggccgcagccggcagccggcatcccagggtttggcggtgcgccggatcggcgggctgaaatcggagtccatccgtcaccttggctggcggcaggagggcgacctggtgttgcccggctatgagaacagcgccttattgctggggtccgccaaatccaagcagtacatcctgctgttggaggacgtggcttatctgcagctgcgcggcggcgatctgctgcagcgcttcgacgccggcgtgcgctcgcgcaccaagtggagctgcctgggcatttacgtggggtcgatggaagagatcctgctggtgcactcgcagctgcagcagcacagcgtggaatccagccaccgcgacggcgacgccaagaccggcggctatcgcaacttcgacctggtgatcgaaaaggcgatcgatctgcgggccaccgacatccacttcgaattccgcgacggcaaccaggtgctggtgcgctaccgcgttcacggcaagctgcgcgacagcgatcccaaagaccggctgctgcgcgatttcaacgcgatgatggatgcgatctccaccgcctacaactcgcgcgccgactccagcagccgcagccacaaccacttcgacgaaaacaagcatcaaagctgctcgatcaacatggctgtccaagggcgcagctaccagctgcgcttccagagcgtgaaggaaaaccgcggggtggacgtgatcctgcgggtgctgctgaacgaggcggtggagaaggacatcctcaccctgtcgcagctgggatattccgacgaccaggtggaggctctggaagatgcggtgtaccgctcgccgggcctgaccatcatcgccggcgaaaccggttcgggcaagaccaccaccctgcgcacgctgatgacctacgagcgcgagtccggcaagaaattcttctcgatcgaagacccggtggaatacatccagccgcatgtcacgcagattccgattcagcgcaaggcggaagacggcaagaaagagggtggcgaaacgccgttcggcgcggcggccaaggtgctgctgcgcggggacccggacaaggtgatgggcggcgaaatccgcgacgccgaaaccggctccttcgccaaggcgatgacgcagaccggccaccaggtgctgtccaccgtccacgcctccagcggcttcggcatcatcccgcggctgaccgacgacgaaatcggcattccggtgcaggcgctggcggcgccggatttcctcaccgcgctggtctaccagaagctggtgccggtgctgtgcccggagtgcagcctgctggccgcggaagtgctggatgatgagtacctgatggtgatcgcctcgctgggcatagacgtgggcatggtgcgggtgatggggccgggctgcccggcctgccgcaacctgggcaccaagggccagaccgtggtggccgaagtgtgcgaggtgacggaagacatgctgccgctgatacgcgaggggcgcttctgggaggcggagaaggattggcgcgccaagagcaacggcaagctgtacgaccccaggatgctgggcaagaccgcgatggagcatgctctctacaagatgtcgctgggattgctggacccgcgggacgtggagtcggcgttccgcaagctgaaaaaataccggccgttgagtctggccaattga

SEQ ID NO: 2090 - DNA, 396 bp, Chromobacterium substugae
ttgctgttgctgctgcctgcgctggcctgcgcggaaaccattgattcctttgccaagaacgcgctggcgccggctcccgcggcgatacctggcggtttgccgcccttgccgtcgcaggcgccgcctccgccggtggtgaacagcggcacggcgcttccgggcaagaacggctcctcccaggtgttcgacgtggtgttcatccagggcaatggcaaggtgcgcaaggcctatctggtggtggatggccgctacggcaagatggtgcgcgagggggatgtggtgcagtcgtggaaagtggtggcggtcggcgacgactacgtggacgtcgcccatgcgggcaagcgtaaacgtctgctgatggatgccggcgcggccagcgggcctgaacagcgttga

SEQ ID NO: 2091 - DNA, 1284 bp, Chromobacterium substugae
atggccagagtgcttttcggcaacctggcggtcgaggtccagtgggaaccgctgctggggctgagcaaggagtccgaagaggttcgcgaactggcttcgcgccgcggcgccaagcaatgcctggtgttgcagaacgcgctgggcgtccgggtggctggcctggcgaatctgccggccaaggggcgcaagagcgagcttttcgcgctggccggcttgctgcgggaggtgtcggacgatccgaacatcctgttcctgcatcaggatccggaggacccgtcccggctggtgctggtggcgatccacgacggcaagccgatgcaggaccgggtcatcgcccgcgaggcggcgctggacgccgcgcgccagttcatccaggaggtcggcaccggcgtcaccatcctgggcgatatcgacgacgacatgctgcaggtcactcggcacgtcaacctggaagacatcgtcacctcgctgaccgacgaggaaaaggcggcctaccggctgcagccgctgccggggacgcggctgttgggcgtcgccttgttgttcgtggcgctgggcgtggcggctggtggcggctggtggtggatgcagcagcaggaaaaagacaggctggccgcgctggacgcggcggccagccagcagccggacccgatgacgacttaccgcaaccagatgcagagcgcgctgaagcaggcgccgctcaatcatggcgcggcatacgccaggacggtgctggcggtggtgcagcagttgccgttcgaggtgggcggctggcgggtgggcaatatttcctgcaaggaaaagggatgcacgatcaactggaagcgccaggacggcggcaacttccagaccttgctggagcaacgcaagacggtgcagttcctggacatgggcagcgcgacggaagtcgtgcccctgccggaggcgcaggccgcgctgcagtccgctccggtggacgtatcaaagttctacatgacggccggcgtgcggatgcaggcgctggatgatatggggaaaacaggcaagaacgaggacaagctgatggccgtggtattgggcaaggttgaccccttggtgccgttgccccaagagctgaaggggcgggtgggcaagctgcccgcgctggccaagggcagctggagcatgcagggccatctggcgttcctggattcggtgccgggtttgatggagcgggccggcaatatgacgctcgatgccgtcgaggtgacgctcaacgataaaaagccggaattcacggcgaagggtactttttatgttcaataa

SEQ ID NO: 2092 - DNA, 1710 bp, Chromobacterium substugae
atgaagaagattgtcgccgcgttttgcggaaccacgttgctggccggttgcggcacgcccggcatgttgcagaagaccgacgaccgcgtgacggaaacgcagcaggtgatgcgcagcgccgaatccaatctgacctacccttcgctgccgctggtggagcgcgatgccggcgcctggttcgcccagcgctcggtggtgatggatgacatagacagcctgccgccacgcttcgatcagcgcgccagtttcagctccggccgccagctgccgttgtcgctgatgaccgagcagatcggcagggaacagggcgtcaccatccggctggcgcgcgatatcttcggcatcacgcccagcaagaacaacgccaatggcggcagcccgcaagcgggcatgcccacgccgccggccggcatgccgccgctgccgggcggaatgggaatgggtggctcgggtgtgatgggaggcatgggaggcatgggcgctgccacgtatcccggcgcgcagacccaggacgccgagccgcgggcgcagctgaactactccggcaccttgcgcggcctgctggacgcggtggcgaacaaaaccggcaccaactggagctaccgcaacggcgtggtggaattctctcgcctggtgacccgcaccttccagatcaagaccatgcccggcgtatccacctattcggccaaggtcggcaagagctcgcaaaccacgtccggcggcagcggcggcagcagtagcggcagcggcagcggcggcggcggcggttcgtcgatcaacttcggttcggactcttcggtcagcatgacctccgaactgcgctactgggacaagctgagcgacaccgtcaatagcatgctgtcgcctatgggtaaggcgatgccgtcggaaatgaccagctccatcaccgtcaccgactccgccgacgtggtggagcgggtgcggcagtacatcgatggcgaaaacgcggtgctgggccgccaggtgagcttgtcggtgcaggtgttcacggtcagcctcagcgagaagagcgcggccggcatcgattggaagcttgtgtaccaatcggccaacagcggttggggcagcacattcagctcggcgttcggcaagccgatggaaggcgccggccagttcggcgtcaccatgaattccgggcagttcaacggttccaagattttgctgcaggcattgagccagcaggggcgggtcagcacggtggtgaacaccaatgtggtgacgctgaacaaccagccggcgccggtggccgtcaccaacaaccagggctatctggccagcatcacctcgacgccgggctccaatggctcggcgcccagcgtcggcctgacgccgggcgtggtgaccaccggtttcgtgatgaacctgctgcccaccttgctggacaaccgcagcgtgatgctgcaagtgcagatcgacctgtccgagctgatcgaaatcaaggaagcctcgtcgggcggcgacagcagcaatagcagcagcatccagacgccgatcacctcggcggtgcagaccatgcagcgcgcgtcgctgaagtcggggcagacgctgattctgagcggtttccgccgcgccaagaacaacactacccgcaagggcgcgttcaattacgagggcggcaccaaaacggcggaacagggcgacgacgaaaccatcatcgtgatcacgccgcagctcaccgagggagtgtga

SEQ ID NO: 2093 - DNA, 414 bp, Chromobacterium substugae
atgaagcaaaagacattgatcgcggcgtcgttgctgatgtgcgcgctgcatgccgaggcgggttttctctatctggacaacgactcggccaaggatggcggggccagcgagactgccggccccgccgcggatgggcgcgccatcgagttcggccaggggcgcggcgtgctgaagctggtgccgggcaaggggcgcatttcggcggccctgcgcgattacgccagggccaatggctgggaactggcctgggagatggagcgcgatttccccatcgactacccggcgacgttcagcgggacattcctagaggtgatggagcaggtggccaaatcgctgcagaacagcgatacgccgatccgcatcaaggtttacgaggccaacaaggtcattcgcgtgatccacgcgacacgctaa

SEQ ID NO: 2094 - DNA, 915 bp, Chromobacterium substugae
atggcggcgcgcaatggaggcggcgggggcggcggcgacgacaaggtgttcgtcatcatcgcggcgctggccttggctggcctggcgatatatttcgcgccgcatttgtggctgaagtggatgcagagcacctacagccgctacctgtttctggccaagattccggtgctgggcgcgccgttcgcccacggcgcggaatggctgcgcgagcagcccacgctggcgcgcgccatcgcgctcgactacgcgctgggctggctgatcgccttgccgatcgcgcccttgctgctcaagcacatccgcaaggagcatgcggtgcggcgggtatggtccggccgcccggccaaccgccagaccttcaacaaggtgatccgcgcccgcggcctggatccgaaggagcgacagctctaccaggtggcggaatggatgcgcctcaacggcctggatcacgaggcggcggatttcgacgagaaattcctggcggcgctggagaagcaggtgggcgagccgtcgaacccgaacgatccgctgctggtgggcttcgcgcgcaagctgggcgtcagccccaagctggtcaagctggcctgcgacaagcatgcctaccgctccaccgccatggtcaggctgctgcatcaccatcgcgagaagaacggcgtggtgcgctgcgactgggcgcggcccatcctgtttcgccatgaccaccccgagctgtgggcggcgctggccagcgtggggcgcaaaacggtgttcatggagggtgtcggggtgatggcgcactattacatggagctggccgagcgcaagcctttgcgggatgtgcgcctgtatggttgcctggtgatcatgcggcgttatctcaatctgaccatccagcagattctgcaacaaagaggcatgccggtgccgggtggctga

SEQ ID NO: 2095 - DNA, 258 bp, Chromobacterium substugae
atggaaggacaattgtgggtgtttgccgcccagtcgccgcgattcaccccctggctggattccaaggcgttttacatacttccggtgctgatcctgaagttcaactggtttacggtgctgacgatgctggccatcttcggcgcgctgatcctgtttgaatacaaaggcgtgccgatcgagcaggccttccgttacgtcaaggccaagttcagcggccgcctgtaccgcgcgcggcccgcctaccggagtccggactga

SEQ ID NO: 2096 - DNA, 252 bp, Chromobacterium substugae
atgatgacacaacacaagacttcgacaaagttcgccgagctggcgaaggcggctttcgaccgcttgccctacgaggcgctgctggcggcggtgggcatcctgattttcctggccggcgtcacggtcggcgcttcttggggcggcggcagcgggacgagcgcggcggcgccggcggacgccagcatccgctacaagggcaaggatgaacaaggccgcccccattatgtcgtgacaaaagattctctctggtga

SEQ ID NO: 2097 - DNA, 1119 bp, Chromobacterium substugae
atgtccgggcatgacgacgatttcgacaatagctcgaaagtcagccgcgccgatctggaaagcctgctcaaccgcttctccgacgccagcgacgtcttcctcaagcaagacacctacccggtggccaaggtgttcggccgcaaccggctggtgatgcagcggcgcctgcagcagaacgaaatgcgccagctgctgaccgcggcctacaaggacaacgtcaacggttacgacatggtgatgggcaaggcgcgctcgctggacttcgtttacgagggcgtggacggccagcgctaccgggtggccgtggcgcgcgacatgcagagcgaaacctctggcccgtcggccaccttccgccgcatcaagccggagccgtggacgctgaaagaggccgacacgccggaagacctgatctacgtcagccgcacccagcgttccggcttgattctggtgaccggccccactggttcgggcaagtcggcgacgctgtcgtcgctgctgcgcgaccacgtggagcggccggattcgtcctgcattctgcgcaccatcgaagacccggtggaattcgtttacggcaaagtggcggcgccgacggcggtgatagaccagatgcaggtgggcacgtcggtggagagcttttccgacggcatccgcgcgcatttgcggatggcgcccacccacatgctggtgggcgaggtgcgggacgcggaaaccgcgcaggcggcgatctgggcggcgcaatccggccacctggtgtacgccaccatgcacccgaacaccatcccggagctgttcgactactggtccaagtttttcccgcaggcgatgcgcgcggtgatgatctacaacctggccaccacgctgaaatacgtggtgtgccagcacttggtgccgaccaccgacggcaagcgcgtgccggtgcgcgaatgcctggatttcaccaagctgggcagcgcgggcacggtggcgcaggagatcgccgccaattcggaacgggtattccagctgatgcgggagaaggtgaacctgtacggccagccgatgcggcaaagcgcgctggacctgatcgagcagggccgcgtccggcaggaagacgtgattacatacctgatgagcggttga

SEQ ID NO: 2098 - DNA, 801 bp, Chromobacterium substugae
gtgttgtccatcggtctggcgggcggagcctgggcggccgactccattccgcaggaggatggcggcgcgttgcaaagcgctctgaactggcagccgaaaagctatctgtcgcaagaagcggcgctcaaggtgcgcgcggtctacaacgccggcctgtcctacggcgcgcagctgggccaggcgcgggagtgcgagcggctgaacgcgatgctgcagtcgcaggacgcgacgttgtcgcaggtattcgacttctcccggctgttgttgcccgattcgctgctgccgccggtgctgtcgtcatccaagaataccgtgcggctggagagccccaccagcatggtgtctgtggaagcttcgtaccgggtgcgcgaggatgcgcgctttgtcaccaccgcgcccagctggtgggattacatgcagcagccggtgccggaagtgcgcgagccggacgcggcgctgaaaccggccacgccggaggaaaaggccgcctgggacgacggcgtgcgccagggctgggccagcggcgtggcggcggccaagggcgcgtatgagagcaagctcgcgcagctgaaggaaaccttcaacggcatgctgctgtacaagatgctgtggctcaagcagatggtggacgcgcccaaggtggtccgccaggagcagaaggtggtggacgccgacggcggcatcgatgtgagggtgtcgcgcaaggtggtgtcgcagccggtggtgttcgtcaaggacctgccgcgctggaaggcgatcaacgatctgggcgccggcgaatttttcgaaggaggccgctga

SEQ ID NO: 2099 - DNA, 735 bp, Chromobacterium substugae
atgagagctgctacgccattcctgatcgccggccttgcttgcgccctggccggctgcgccgcgcccgccgcgcggcaagcggccgccagcccggagctggcgatgctggccaaggctgccgaggatgccgcgcgcagccagcagctgctggcgcgcatgacggtggtcaacagcggcgacaaggccatgcaggacctgaaggccagcctggcctccacgcccagcaatgacctgaaccgcctgtattccaccgaatacgtcggcgtgccgcacggcatcgtgcaggacatcgcgcaaagcataggctggcgcttcgaggagcgcggctcggccgacgtggacagcatcgtccgcatcaagagcgcgtcgcagccggtgatcgcggtgctgcgctccatcggcgaccagttccccttcgtgctggcggtggatgagaagtcgcgcaccatcgtgctggactacacgcgctccatcaacgatacccgcgagccgaaaaccgccttccaggcttcggcttccaagccgctgatccagaagtattctatggacggcgggatcttcgccgaccgcaagctggcggcgcgagtggcggatggctacaagaaccagggcttcgccgcccaggtccggccggcgggccgcaagttccagatcgcggtgggcccctatgtcgacgacggcgcgggcgagcgcaaggtgcgcgaaacgctgggactgcaccagcgggtagagtga

SEQ ID NO: 2100 - DNA, 378 bp, Chromobacterium substugae
atgctggcctactggttcgccgacgaggagggcgatgtgtcggtgccggaagactgggcgcgcgagcatggcggccggatagggcgggacgcgccggcggtcggttttcaggacggggtttggtatcggctgcacgggtttctgccttcgcatctgctgctggcgcggctgatcgacatgccgcacgaatcgttgctgagcctgtgcgagtgggcgggcgcgcatccgcgcaccatgctgttccgcaagctggagcgggtgccggagcagatcgggcgctggaagtcggatttcgactatcgccgcggcgagctggaacaggtgttgggcgatgcggatctggcggcgcaggtactgccgccggccacgcttcaataa

SEQ ID NO: 2101 - DNA, 2949 bp, Chromobacterium substugae
gtgacgacaatatttgacgcgtttgacaacttcatgaagcgcatacccaagatccgcggggccgcgctatgggacaagtgcgcgtggaccaccggctcgggcaatgtcatctctttgcgcggcggcagcctgatgaccatctacaagctggacggcgcgctgcaatcgttcgacggcgaggcctaccaggagcggctgggcaagctgtcggcgatgctggccagcctgccgcggcgctccggcatcgtggtggacatcattttccagcgcgacaaggaaacctcgcgcaaggaggtcaggaagcaggccaacagcatacgctcggccaccgcccggatcggcatggacgtcaacttcatcctggacgagcgcgaggagattctgtcgcgcaccgtgacgtcggagatcgcgctgatcgtggtcaccacctcgccttccatcctgcccaaggaaatgcgcaaggtggctgccaactggtccggcggcgagatggcgcaaagcgaaagcttcgtgccagcgatgcgcaaccgccacctgggggtgtgcaaggaatacgtggaagggttggtcagcattttcagcctcaaggcgcagcccttgacgctggagcaggccatcgtgctggacgccgacttgtgggacggctccggagagggcctcagcccgatcacccccgattcggtgaagaagaccggcgtgttgccggcgcgggcgaaatcgaccatcgccggccagcgcgacgacatcattccgccgctgcccggtttgcagattttccgccgccaactggaaaacatcccggaagaaggcgtggccagggtgggcaaccgcttctattccagcggctatttcgaatttccgatttcccagcccgaggtgttcaacaacctgctgcgcatcctgcccaccgcgcgcatccatggcgaaattccgttccgggtggcgttccagctattgtccggcagcgcttccgggcgcttttccgccaagaagtcggtggcgcaattcctcaagttttccaccttcggcgggcagaactccaagatcgtcgacgccatcaacgaggtgaaggagctggagcgcatcggcgccaccacctttgtcggcgtgaagatttcggtggtgacctggggcggcagcaagcaggaggcgaccgaccgcttcaccgagctggcggcggcgctgaacggctggggcggcggccaggtgatacaggaattcggcaacccttgcgaggtggcgatgggcaccttgccgggtttccgcaatctggcgcccgaattgatcatgccgtcgcagatgctggcggccatcctgccgatcgagcggccggcctcgccatggggctacggcaatatgatgatgctgaccgaggacggcaagctgttcgtctaccaggtgggctcgcagctgcagcaggcctgggtggatgtgatgttcgccaccatgggttccggcaaatcggtgttgctgcaggcgctcaacctgggctccattctgcagccgggcaaggacgacatcccgcgcatggccatcctggacgtcggctattcgtccaaggggctgatcgacaccgtcaaggcctcgttgccggtggacaagcaatacctggcgcagcattaccggctgtcgatcgacaagcgcaacgcgatgaatccgttcgacaccatgctgggttgccgcgcggcggtgccggacgaaaaggcgtttctcgtggacttcgtcaccttgctgctgacgccggtggggcagcagcagccggtgccggaaatcgccgagctggtggatacgctggtgaccgccgcctatcgctatttctcgatcgaaaaacccaagaaataccagccgcggcgcaatccggaggtggatgaggcgctgcagcgcaacaatctgcatccggaggaggaggcgtcgtggtggagcgtggtggacatgttgttcgatcgcaacgagatccgcgccgccacggtggcgcagcgttacgcggtgcccatcattcccgacctcagccaggtgatgcaggccacgcccagcatcaaggacaactacaccgacgcggtgattcccggcggctcgtcgatgctggatttctgcaaccgcatgctgggttcgatcagcagccgcttcccgctgctggcctacgaaaccgcgctggacttctccaacgccaagatcgtcgcggtggacttggccgacgtcaccggcggtcagggcgcggcgtcgcagaagcagggcgaggtgatgtatctggcgaccagcgccttcctggcgcgcggtttctatatggatgacgaggtggtgccgaccatggattgcccggggcaatacatggagtaccatcgccgcgaattgcgcaagaaccgcaacgaggtgaagcgcatcgtctacgacgagttgcacaacatcagctcgccgatggtgctggggctgatcgaaacgctggtgcgggtgggacgtaagtacaaggtgcatatcgcgctggcctcgcaggaacataccgactttcccaagtccatcatgaacctggccaccaatatctgggtgctgcgcgccgactccaaggaagtgcgcgatgacctgaaaaaaaccatggacttgagcgagtacgccgacgaggcgctggccaaccgcatccagggcctgacgccgctgggcgcgccgatgctgctgtacagccgcatcaagggcgcggtggtggagcgggtgctgtacttcaagccgggcggggtggagttgtgggcctacgccaccacgccggccaatgtggaaatccgcagccaggtggcgcgcttcgtcggctatcgcgaggcgctgagccggctggcccggcgcttccccggcggcgacgcggtcagcgagctggacaagcgcatcgacgcctggggcggcgccaagcgcgaggcggacatcataaaagaaatcgtagccgagattgcgggggggcattga

SEQ ID NO: 2102 - DNA, 603 bp, Chromobacterium substugae
atgctgagcgtgcaaatataccgcaatcggaactatcccggcgtcgacgacggcgtgtatgccgtttccggccgcccagccgccggtttccttgcttcgctgtttgaataccgccggcacgcctgccagttttgcggctaccgcagccgcgaattcctggaaggcgaaccgctggacgatgactacggcaatgagagtccggataactggttggtgctgtgccattactgccgcgccacccagcatgtgggcgcggcgctgcgggccggcgcgttctggggcgtggagaagggccgttcgcaagaggcgatcaaccggatttgccgcgcgatgccgcggctggcgcggggcggcctggggcataacctggagctgcacctggagcagtcggtcaagctggtggaaagctatatgggcgggcgcggcacggtggacaatctggccacctttttcaaggtgctgatgaagaaccgggaagactcctacgaggaaacggtcaagcttctcacccgcaacggcctgagattgattttccccttgtcgtaccggccggacggggtggaggcgctgcggcgccatgatgcggcgcagagcgagggctga

SEQ ID NO: 2103 - DNA, 360 bp, Chromobacterium substugae
atgttgaagttcaaaaaaggaaatctgattctgatggttgcggtgctggccttgctggcgacggaaacctcgctggcggacacggtggccaccacggccggcagctccggcaagagcctgatggataccgccaagcagaccaaggatctgatctcctcgttcaaggaagtgatgggcatgggcctgcagctggtgggcgtgatgtgcatgggcttctccggctggaacatctacgtgtccggcaagccgggccgcgaagaccgcggccatatgaagacggcgctgttcgccggcctgggcggcgtgatcgcctatttcgcgccggactggatcggcatgggcggccacaccctgatgtaa

SEQ ID NO: 2104 - DNA, 261 bp, Chromobacterium substugae
atgtttgatcaaaccttgctggcgggagacgcgctggcggcgggcaacgcgatacgccaggtggtgtacgcgctcagccagctgctgggcttggcggcgatgggcagggccggctgggcgatgtacaagagcggcgatgcccgctttgcccaggcgggagacggctggaagattttcatactgtttctgtccggcatatttctttactacatggaggacgcttgggcgctggtgcgcaacaccttccccaatctgtcctga

SEQ ID NO: 2105 - DNA, 1161 bp, Chromobacterium substugae
atggtcgatttcaataaccaacccaagggcgccggcaaagaccccagcaagatgaagctgatcctgttcggcggcgtggcgatcgccttcttcgcggcgatgctggtttacaagaaggtcagcgcgccgaagacggaagggcaggatcagaccgcgatggccagcacgcccggcaagatggccgataccggcgcggccgacgccggcaatctggcccaggccgacgaccacagccagccggctctgtacggcaccgcggacgccctgctcaatggccagcgggatgacaggcagaaggcggccatcgccagcggcggcgcttacgtggccgaagtgggcgcgctgaacgacaggggagatcccggcgcggcgccgtcgggcggcggcggcatgccgccggtgccgcagatgccgtccatgcagccgctgctggacgccgccggcatgcagaagcagagcgcgtggctgcagaagttccagaacaaccggagccgcggcgacgcgccgcagcaggagcgcaagctggtcaactggtacggcggcgcggcggccgcggcgggccgcttcgatggcggcgcgtcggatggcgcgcggccgcagcggggctggaaggtggcgtccatcggcgagcgggtggcggcggtgacgctgaatgaaacctcgtcctaccagaccggcaccacggtgatggtgcggatcgtggaggacggcggcaagcgcgacgcgcagctgttcggttcttacaccgagggctatgacgcgctggtggtgaagctgaacaagatgcggctggcggatggccgggtagtgccggtggacgcggtgctggtggacaaggaaaccaattcccaggcggtggccagcgcggtcaaggggcactatatcgaccgcttcggcatgatcgccgccggcgccttcctgggcaactacgccacggcgatgaccagcggcggcgagacctcggtggtgaacggcgcggcggtgacgacggtgcccaagatcgatcagccggccaagtacgcggtcgggaaaacggtggaggcggtggcgcaggtggcgaccgccgcggcggcgagattcaacaagtcggaggtgatcctgagcagaagcgaactggtgggcgtgctgtttcttgatgatgcatttgccgggggacaatga

SEQ ID NO: 2106 - DNA, 1059 bp, Chromobacterium substugae
atgcgcctgatggcggcctgcctgctttcccaggccgccgcggcggcccagccgggcgacgcggcgggcgggcagttttataccggcagcgccaacgatccccggctggcgatgcaggcgtcggcggcggccgcgccgcaagcggcgaggccgcaggcgcgcgatccgctgcaaagggcgatggaggccgatccggtattcggctcggtgatgaaagaggcggtgccattcgatccgggccagatccgcatgtaccgccgccaagtggaaaaagtggaaaagctgaaggattcgccgccggtggccggcgagcagcggaccatcccggtgcgcccggggcggacggtggatctgacggtggcggtgggctatccggtgacggtccgcctgaccgacgtcgccggccaacccttgaagatttccggcagcgtgccgggcatggcctttctcgcgatccacccgattcccggcgacgcgcaggcgtctgtggcaacccaggcggcgtcgctggccggcgcggcggcaggcctgccgccggctccggcaggctccggcggcgaggccaaggacgcgatcgtgatcgattcctcgggctcgggctcgacttcgctgacggtgttcgccgccggttcgttccggccggtggtgatcaaggtgcgctcgctgtatccgagaggcggcgagcgggtggatttcgccgcagacctgcggctgacctggatgggcggcgacgcgctcaatcgcggcgacgagtaccaatcgccgttgtccggcgcgctgatggcggtgctgaaggaaaccgtcggcgaggaaatgcagacggtgccgcataacggcggcgacgcggtgaagatctggaaacggcagtcggacaaccgggttttcgtcaaggttcgccccggcgtcacgctgctgtcgccccgcaatttccgcaccagcacgcgcgacgacgatggcggctcggcctatgaattcgattaccggccatcttcgatggtggcgggcatgggcggcacctcccgcgccatcgtgatccgctggggcagctatgagcaataa

SEQ ID NO: 2107 - DNA, 660 bp, Chromobacterium substugae
atgtcgatgatgaatttgaatgatcaagaggtggaccgggcgctgagggacaccatgggtgagtcgggaaatctgcgccatgattcgcgccgcaaaaccctgatcattctggccctgggcgcggcctgcctgctggaggcggtggcgctggcggcgctggcgcgcaaggaagcgccgttgccgcagttcaccgcggtgacgccggatggccgccagtaccagctgctgaccagcaacaccccggtgttgaatgaaggccaggccgggcagtggatagcctatgccttgccccaggtgctgaattacaactggaccgaactggagccgcatttcgccgatgcgtcgcgcaagtatttcaccgaagactcctggctgactttcaagagccagctggaggcggcgggaaccttcaagtcggtgctggataacgagctgatcagcaatatgaagttcaccagctcgcccattctggtgggcaaaggccagcaggccggggtggaggcctgggagttcgaagccaatggcacgctcagttatctgaaccgcaccaagcgtacggacaattcgatgaaattcagggtggtggtggggctggtgacggtgggcgggacgaaggactaccggattctcgctctttacatggccaaggacagagggtaa

SEQ ID NO: 2108 - DNA, 3423 bp, Chromobacterium substugae
atgaaaatcctgaccctgcggctgaagaacctcaattcattgaaaggcgagtggaagctcgacttcacccgcgcgccgttcaaggacaacggcctgttcgccatcaccggccccaccggcgccggcaagtccacattgctggacgccatctgcctggcgctgtaccacaagacgccgcggctggacgccatttccgcctcgtccaacgaaatcatgacccgccacaccgccgattgcctggcggaagtggagttcgaggtgaagggccgcgcctaccgggccttctggagccagcgccgggcgcgcgacaaggccgacggggccttgcaggcgcccaaggtggagctggccgacggcgacggcgccatcttggccagtcagagccatgaaaagctcaggcgggtggaggaaatcaccggtctggatttcgcccgtttcaccaagtcgatgatgctggcgcaaggcggattcgccgcctttctcaacgccagcgccaacgaaagggcggagttgctggaggagctgaccggcaccgacatctacggccagatctcgcagcgggtgttcgaacgcgcgcgcgatgtccgtcaggagctggcccagctcaaggcccgcgccgacggcgtggagctgctgggcgacgagcaggcggcgcggatgcgggacgagcaggccgcactggcggcgcaggcgtcggcattgctggccgagctggaaactttgcggcgccagcgccagtggcggcacgaactgcggcaagctgaacatgaggaggccgccgccgcgcaggcggcgcaagccgcgatggaagccatccgcctggccgagccggagctggaggcgctgcgcgcgggcgaaccggccgcggcgatcgcgccggtttatcaggcgcgactgcgggcggatgagctgctgggcggcgcgagacaggcattgaatgaggctggggaacgattggacgcgtgccgagcggagcaggcggccgagcattggcgggcccaggcgacagcggccgcgctggcggccgaagaggcgcgccgcggccgggaattgagcgagcgcaagcggcagctggatgactggagcgggcaacatggccgttatgcccgcttgggcgagcggctggccggctggcgcagccagttcgcccagctggcgcaactgaggcggcagcggcaggaagaggagcggggatgggccgcgctgatgagcggcctggcgcaaagagacggcgagatcgagcggcaacggacggcgctggacgaggcggagcaggcgctgcgccaggcgcggcaagcgcaggaagccggcggccgcgagcgcgatgccttgttggcggggaactcgctggaccgattgcgcggcgattggcagcgcagccagcgcgaggccttggcatggcggcaactggatggccaggcggcggggctgcggcaggccgccgccgccgcgcgcgatctggaagccgagttggccgaagccgcgcgccggctggagaggcaaggcggactggtggaggcgctgcgccgcgattatcgccagctgaaggagcgggtggacgacaagcgccggctgctggcgcaggagcagcgcatccgcagtttggagacgcatcgggccgctttgcggccgggcgaagcctgcccgctgtgcggcgcgctggagcatccggcggtggcggcttaccaggcgctggacgtttccgccggcgaagcggccttgcaggcgctggaggcggaactggagacgttggcggaaaacggccagcgggcggcggccgaactggcggcgttgcaagccggccgggagcggctgcggcagtccgccgcgcagtccgccgccgccatggaggaggcgcggcaggcgtggcgcgccggcctggccgaatgcggggcgggcgaggcggattgggcggatccggaggcgccgcgccgccgccgcgcggacgcggagcaggccgaagctcggctgcgccaggccttgcaagccgctgaagccgcggaggccagccatgcccaggcgagcgccgccgtcagccggcaggatttgcaaaagcaagcggcggactcggcgctggccttgctgctgcaagcgcgggaaggcgcccggcgcgaggcggagcaggcgcaggcgcgcgacaaggcactgcaaagccaatgcgcggggttggccgccagcctgcatgccgacatcgccgccgccggctttgacggagaggaggcggatgccggctggctggagcggcggcaggccgattggcaaagctggcaggatgcgcagcaaagcctgcggcagctggcggaaagcctgagccggcagcaggcggtgcgcgagcaggcggaggttcaggccgccgactggcgcgcgcgctggcaggcgctgggcgcggccgagccggccggggcggaagccgcattggccgatgccgacgcgctggcgcgttgcggcgccagggcggaggagtgggatcgggaactggccagcttgcagggcggcaaggcgcagctggaagcggaccttgccaggcagggagagctgcggcagcgggtggacgccgaatggcaggcggcgctggcggccagcccgttcgccgattcggcggcctttttggcggccttgctgccggagggcgagcgcgaacgcctgcaggcgcgcaggagccggttggagggcgagtcggcgcaggcggcggcggtgcggcaagcggcggccggccggctggcgtcgctgcgggagcaggatttgggcggggccgatctggaggcgctggagagcggttggcaggcgctggacggtcagcgccaggccttgacgcaaaaacagggcgcgctggaggcgctgctgcgcgacgatgcgcagcgcaggcaagggcagcgggccttgctcgagcggatagccgagcaggcggccgaggccgatctgtggcagcggctggacgggctgataggctcggccaagggcgacaaataccgcaagttcgcccaggggctgacgctggaccacttgatgggtctggccaaccgccacctggccaggctgcacggccgctatctgctgcggcgccggccgggaggcgagctggagctggagatcgtcgacgcctggcagggcgacgccgcgcgcgacacccgcaccctgtccggcggcgagagtttcctggtgagcctggcgctggcgctggccttgtccgacctggtcagccaccgcacctcgatagactcgttgttcctggacgagggcttcggcacgctggacggcgaaaccctggaggtggcgctggacgcgctggacgcgctcaacgccggcggcaagatgataggggtgatcagccatgtcgaagggctgaaggaacgcatcgcgacgcaggtgcgggtgggcggccgcgccggacttggcgtgtcggggctggaggtggcggtttga

SEQ ID NO: 2109 - DNA, 1221 bp, Chromobacterium substugae
atgcgcatcctccacacttccgactggcacctgggccagcatttcatcggcaaaacccgccaggcggagcaccaggccttcatcgcctggctggtcgaacagatcggccggcatcaggcggacgcgctgatcgtcgccggcgacatcttcgacaccggcgcgccgcccagctacgcgcgcgaactttacaaccagctggtggtggcgttgcatgatgccggcgtccagctgctgctgcttggcggcaaccatgactcggcggcgacgctgggtgaaagccggcccttgctgtcctatctgtccgccacggtggtgcccgcggtggaggacgatcccgccgatcaggtgcggctgctgcgccggcgcgacggccagcccggggccattgtctgcgcggtgcccttcatccgcccgcgcgatgtgctgcaaagccaggccggacaaagcgccgaggaaaagcagctatcgctgcggcaagccattcatgatcattaccagcggctataccggctggcctgcgcccggcgcgaagagctggggctggcgctgcccatcgtggccaccggccacctgaccaccgtcggcgccagcgccagcgaatcggtgcgcgaaatctacgtcggcgcgctggaagcctttcccaccagcgcgtttccgccggccgactacatcgcgctgggccatatccaccggccgcaaaaggtgggcgggctggagcacatccgctattgcggctcgccgatcgcgctgagcttcgacgaagccggccagcaaaaggaagtactgctggtggagctggacgacgccggcctgcgcagcgtcacgccgctgccggtgccgatcttccagccgctgctgtcgctgaagggcgacctggcgcgcttggccgaagccatcccggcggccgcgcgccaggcagacgccggcctgccgctgtggctggaagtggtggtgcggggcgacgactacgtggccgatctgccggcgcgcatccagcagatgacggagggcctgccgctggaggtgctgcgcatccgtcgcgagcgcggcgacgcggcggcggcgctgcaggctcaggccagcgaaacgctggatgagttgacgccgttcgaggtgttcgccaggcggctggcgctggaggatatcgacgatgagctgcagcggggcctggagacgcgctaccgcagcgtcgtcgagagcctgcgcgagggcgaagcatga

SEQ ID NO: 2110 - DNA, 114 bp, Chromobacterium substugae
atggcgggcaccggtttcggcatggcctgccgcgtgtttttcgccaagcgcggcggccgggacgagccgctgttggcgcggtatttcctgatggcgctcaagccgcagcggtga

SEQ ID NO: 2111 - DNA, 1098 bp, Chromobacterium substugae
atgaatatcacatctgacgccggccggcctctgccggtcctgatgattccgttgcgccgctgcggcagccacgcgctgcggctgcggcttaacttcagccgggaattctattcgccctacccgctgcacatcgtcgatttcatgccgctgctgcctttgtacggtgacctggcggacgacagggcttatttccagctgatcgtcgatgtggtgggcctgcaggcggcgagcatggtcaaatggccgggcatggctttcgacccggtggagatcttcgaagcgataggcgacaggccgcgcagcgtgcaccaggtggtgtgggagctgctgctgcgggcgggggagcacaatcaggcgcgggtggtgatggacaaatcgctggacagcgtccgctacgccgacgaattattggcgctgtttcctaacatgcgcttcctcaacgtggtgcgcgacccgcgcgcccaggtggcttcggtcaaccgcgccatcatccacgatttcgacaccgcgctgaatgtgcgcacctggctggccgcctaccaggcggcggaccgcctgctggccaaccacccggacaaggtgctgacgatacgctacgaggacttcctggccgaccagcagaccatcctgcgccaggtgtgcgacttcttcggcatcgcctttttgccgcagatgctggacatccgcagctcggccgaggcggcgcagatttctcagctgtcggcgctgtggtcgtcgaaccacttccctcccatcgtcgcgcatgccgacaagttccggcagcagctgtcgctgcgcgagatcgagatcatagaaaccgcctgccgcgactatatggaacgctacggctacccgatgctgacgccggcccagctgccgatcaccgatgagctggccgccgcggccgaaacgcattcccgccgcgcgagagagcaagcctgggaagacctcaagcgcgacaactaccgcgactacatcctgcgccaagggcgggcggactatctggcaaacttgaaacagcgcctgttgcggaccgccgcggtgtcggtcaccgggctggctgagccgccggcggcgaggacggcggacacgcattga

SEQ ID NO: 2112 - DNA, 660 bp, Chromobacterium substugae
atggacaccgcgcccacgcaaaccgggcttcccgccaatattttcaaaaccggcggccgcatcaggctggtagaccgccagcagctgttcggccaccgcgcgctcaccatctggcttaccggcctgagcggcgccggcaagtccaccatcgcttacgaactggaagcccggctggtccgcggcgggtattccgcggtggtgctggatggcgacaacctgcgccacggcctcaaccgcaacctgggtttcagcgcggaggaccggcaggaaaacatccgccgggtggctgaagtggcgcggctgatgaacgacgccgggctgatcgtggtatgcgcctgcatttcgccgctgctgcgcgaccgcgaaacggcgcggggcatcatcggcgaaggcaagttcgccgaggtttacgtcagcacctcgctggctgtgtgcgagcagcgggattgcaagggcctgtacgccaaggccagggcaggcgagatccaccacttcaccggcatttccgctccgtacgaagcgccgcccaggccggcgctggcgctggataccggcgcgctgcggctggatgagtcggtcgacatgctgttccgcatggttctgcactgttgcagcccgctggcggccgaggaaaggcacgatcatgaatatcacatctga

SEQ ID NO: 2113 - DNA, 1743 bp, Chromobacterium substugae
atgagcactttaccgtcagggctgggggaaggcagccgctttgattggggggcggccagcctggaagtgaagggggcgatgtcggccggcagcgtctaccggacgggcaatcccgatccggcctatgtcagccacgccaatatgatggataccctgaacgacggcgacctcaactaccgccgcggcggcctggtgtccgaatcctggcagggctatctgcaaggcgacctgcgctaccgcgacgccggcctgtttgtcagcgccaaggcctggtacgactacggcctgagtcatggcgcggttccgcacggccattctcccaacggctatgcgcccggcgcgccgctggacgatagccgcttcaccgcattgggccgtttcagcggcgtggtgctggacgatgcctatgtttacggccgctaccctctggggcagtcgacgttgtcggtgcgcttggggcaacaggtgattccgtggatcacgcccaccaccttcctcggcggcatccagcaggtgaacgcgctggatttcaacgcgctgggccgcgccggcaccatcccggaaatggccaatgtgccggcgccggcgctgtacgccaagctggaggccaccccgcgtctgacgctggacggctactaccagttcaaattcgaacccaacgcctatccggcctgcggcacattctattccggcagcgactacgcgcagcccggctgcgacaagctgaccttgaacggcagcctgctgagcatcctgtcgcatagcaatatcgccaccagcgaccagcagtcggccgccaatccgctcgactacatccagcgcgcgccggacgacaagccctatggcggcgaattcggcgccagcctcaactatctgttcgaaggcgtgggcttgctggggctgttctattccaatcagaccagcccgatgagcttcaaccagatgctgcgcaccggccccggcgtgttgctgccggcggcggccaatcaggggcgggccgcgccggtcggcatcgccgggcaattccgccgcagctatccggacaacatccatatgttcggcgtcaatttcaagacgcggctgccgggcggaaccggcatctacggcgagctaagctaccggccgaaccagccagtggcatggaacggcgccgacttcctgtacggcgtgcagaccggcgccgggccgctgggctatctggcgcacacgcccaccggctatctggcgcgcggctacgacactttccgcagcagccagttgtcgctgggcgtccagcagccgttgggcagatggttggggggcgaagcccgcctgtcgggcgaggctggcgtcaaatacctggccggcctgccggacccgtacacgatgcgctacggccgggtgggtttcggtccggcgcccagcgccgccagcccgttctgcggcggcggcgggccaagctgcgcgctggatggcttcgtcacctcggtggcctggggcctgcgcgccaagctggcagagcgttatgccggcgtcgcgccggggctggacctgacgccgtcgctggtgttgggctacgacccgaaaggctattcgcaggacggtcagttcatggaggggcggcgcagcgcgttgtggcggctgcagggcgaataccgcaaacgttatgttttcgagttgctgtacctggctaccgggggcggcagctacaacgtcttgtccgaccgcagcctggcgatgctcagcgccggcgtccgcttttga

SEQ ID NO: 2114 - DNA, 1179 bp, Chromobacterium substugae
atgtccaaactgccgggggtcattcccgccatcgtgcagcacgaagaacagttcatcgccatccgccgcagcatccatgcccatccggagctgggcttcgaggaggaggccaccagcaagctggtggcggaatcgctgaaagcctggggctaccgggtgaccgccggcctgggcggcaccggcgtggtgggacagctgcgctgcggcagcggcgcgcgcagcctgggcatccgcgccgacatggacgccttgcccatacacgaggaaaccggcctgccttacgccagcaagctgccgggcaagatgcacgcctgcggccacgacggccacaccgcgatgttgctggcggcggcgcgccatctggccgagagccgcggtttcgacggcacgctcaacctgattttccagccggccgaagaggggcagggcggcgcggcgcggatgatggcggaaggcttgttcgaacgcttcccctgcgacgcggtgttcgccatgcataacggccccactttgccggtgggcagcttcatcgtgcaaccgggcgtgctggccgcgtccgccgacatcgtgtccatcaccctcaccggcaagggcggacacggcggcatgccgcacacctgcgtcgatcccatcgtggcgatggcatccatcatcctgtccttgcaaaccatagtctcgcgcaatctggcgccggaccagccggcggtggtgacggtcggttcggcgcatgccggcagcgccagcaatgtgattcccgattgcgcgcaactggagttgacggtgcgcgcctacagctccgccatccagcgccagatcgagggcaggctgcgcgaactggtgacgctgcaggcgcaaagctatggagtggaggcgcgcatcgagtggaaaccggtgacgcgggtgctggtgaacacgccggaggaaacccgcatcgcgcgcgaggtggcggagggcatggtggggccgcagggcatcgtgccgctgccggccggcgcgatgggcggcgacgacttttcctggatgctggaaaaggtgccgggctgctacgtggtgctgggcaacggcgtcggcagcaagggcggctgcatgatccacaacccgggttacgacttcaacgacgacatcctcagcctgggcgccagctattgggtgaagctggccgaggcctacctgaaatag

SEQ ID NO: 2115 - DNA, 240 bp, Chromobacterium substugae
gtgctgcacgatggcgggaatgacccccggcagtttggacatgtcttctctccgtttccatcaggtgggaaaggcggcgccggcagaagaagatgccggccacgcgcggcgccgctccgacaccagtctatgaacggagcaagcatgaggaaggggggaaaatggccattcagcgggctgatatcgccagcctgccgaactgcggagcttgacggcgggcgccgcctcaaatctgcataa

SEQ ID NO: 2116 - DNA, 1053 bp, Chromobacterium substugae
atgaacacctgcatagacctgctttgcctgcccaactgcctgagcggaaccttgttttccgccatcgacgcgctgcaggcggccaataaactgtggcatctgcgccacccgcggcagaaatcgccgcgcttccaatggcggttgctggacgcaagcggcgatccgctgccgccgccgccctggctcaacgcgccgacgcccgccgcgccggccagcggacaatcggcgctgctggtgccgggcctcgacatggacagcgtcccccatctgaaacagcagctggagcaatgcggcccggcgctgcggctgatcgcccgccgccacgccgccggcgatgtcatcgccgccaattacaacggcgccgccatgctggcccgcgccggcattctggacgagcgcaacgccaccatcacctggctgatcgccggctggttctccggccagcatccgcgggtgcggttgctgatggaccggccggtcagcgtggacggcaacatcttgtgcagcggcgcgccggcgtcggccaccgatctggcgctggcgctggtgcgccatttcgccggcgacgagctggcgcaaagctgcggcaatggcctgctgtaccaggcggcccgtttcgagcagtccggccagaccctgcccctgctcaatacacctacccgcgacagcgcggtattcaaagcgcgccgctggctggagcagcacgtgaccgagccctaccggctggaccaggtggccgaagccgccgcggtgagcagccgcaccctgctgcgccacttccgcgaagtggccgacatgacgccgctgcaatacctgcagcaattgcgggtggaaagggccaagctgctgctggaagtcaccaccgtcgatttgtccggcatcgtcgagcagtgcggctacgaggacgccgcctccttccgccggctgttccgccgccagaccggccttacccccaccgcctaccgccgcgcccattctttgcgcgcctcccggcgctggtggcgggcgggagacgacattcccgccgccgcgccgggcccgctcacggcgtga

SEQ ID NO: 2117 - DNA, 513 bp, Chromobacterium substugae
atgaacacaatgaacaagcttgcgatggccggcgcgtgcgcgctggcgtggatgatgtcttcggcggcgggcgcggcgacgatcacgccgccgggcgcgggcggggcagccattccgttttccgcggtggggccggccacggttagcaagggcgaggtggatgtcgactgcagcgccgtgttcagcggcacggtggacggcgccggcaatatcctgatcaccagcgccgccttcaagggcattccggtgtgccggatgatcaaggccagcgccaccgcgtccgcgccctgggtgggccgagtgacggcgcagaaccagttggccatagacggggtgatggtgaacgtgaacacgccgatcctgggcggacaatgcgggcccagccggatagccgggacgataactgacagcggcagcgacaccacgataggcctggcggcggcgccgctgactggcggctgcgcgatttccgccaccttgaccactacgccttatatgcgcgtcacgccgtga

SEQ ID NO: 2118 - DNA, 1443 bp, Chromobacterium substugae
atgcaagatgccttcaccgccgcagatgaattgctgctcaagccttacggcctggacgagtccgccatcgagcagaccctggcgcatatgcgccgccacgatatcgactacgccgacctgtatttccagtacacccgcaacgagggttggcacctggaggagggcatcgtcaagtcgggcagcttcagcatcgaccagggcgtgggcgtgcgggcggtgtccggcgagaagacggctttcgcctactccgacgccatcagccaggacgcgctgacccgcgccgccgaggcggtgcgcgccatcggccggaccggcggcgacggcagcgccggcgcggtggagaagcgcaagccgcaatcgctgtatccatcgatcgacccttgccacagcatggaggccgccggcaaggtggccttgctggaaaaggtggaacgcctggccaaggcgatggacccgcgcgtgatccaggtgatggccggcctcgccaccgaatacgacgtggtctacgtcgcccgccatgacggcgtgcgcgccgccgacgtgcgtccgctggtgcgggtgtcggtgatggtgatcgccgaacagaacggccggcgcgaacagggctcgtccggcggcggcggccgcttcgacctcaactatttcgacgacgcggtggtggagcgctatgtgcgcgaagcggtgaagcaggcgttggtcaacctggaatcgcgcccggcgcctgcaggccagatgaccgtggtgctggggccgggctggcccggcgtgctgctgcacgaggccatcggccatggcctggagggcgacttcaaccgcaagggcacgtcggccttcagcggcatggtggggcagcgcgtcgccgcctccggcgtcaccgtggtggacgacggcgtgatgggcggccgccgcggcgcgctggccatcgacgatgagggcaaccccacccagcgcacggtgttgatcgaggacggcatcctcaagggctatatgcaggacgcgctcaattcgcggttgatgggcgaggcctccaccggcaacggccggcgcgagtcctacgccagcattccgatgccgcggatgaccaacacttatatgctggccggcgagcgcgatccgcaggaaatcatctcttcagtcaaggatggcctgtacgcggtgaatttcggcggcggccaggtggacatcaccagcggcaagttcgtgttctcggcgtcggaagcctggcgcatcgaaaacggcaagctcacctatccggtcaagggcgccacgctgatcggcagcggcccggaagtgctgaactacgtgtcgatgataggcaatgacctggccttggaccagggtgtgggcgtgtgcggcaaggaaggccagagcgtgccggtgggcgtgggccagccgacgctgcgcatcgacggcggcctgacggtcggcggcaccggcgtctga

SEQ ID NO: 2119 - DNA, 810 bp, Chromobacterium substugae
atgaagcagaagttcgtcgccgctgctgtgcagatggtgtccggttgcaatccttcggccaatctggcccgcgccgccgaactggtggcggaagccgctggcaaaggcgcccgcctggtggtgctgcccgagtatttttgcctgatgggcgcgcatgagaccgacaaggtggcgctgcgcgaagcctatggcgaggggccgatccagcaggcgctgtccgacatggcccgcgccaacggcgtgtggctgctgggcggcacggtgccgctggccgccgataatccggagaaggtgctcaacaccagtctgctctacaatccacagggcgaggtggtgtcgcgctacgacaagatccacctgttcggcttcaccggccagggcgagagctaccgcgaatccaacaccatcagcgcgggctgcgtgccggtgaaggcggaaacgccgctggccgacatcgcgctgagcatatgctacgacttgcgcttccccgagctgtaccggctgctggcgccgttcgacttgctgatcatgtcggcggcgttcaccgccaccaccggcgaggcgcactgggagccgctattgagggcgagggcgatagaaaaccaatgctacctgctggcctcggcccagggcggcgtgcatgaaaacggccgcaagacccatggccattcgatgatcatcgacccctggggccgcattctggccgaactgccgcagggcgagggcgtgatcgtcgccgagatcgaccccgatttgatccaatcggtgcgcagcagcctgccggcgctggagcaccgagtcatacgttga

SEQ ID NO: 2120 - DNA, 3804 bp, Chromobacterium substugae
ttgcgcgtgctcaagcgcagcctgctcgttctggcgctgctgctgtcgactgtctgcgtcctgttgaccgccgctttctgcgcgttcaccttctggctgctgccgaatctcgatcaataccgccccaggctggagcaaagcctgtccggcgcgctggggcacgatgtccgcatcgccaagctgtccggccattgggaaggcgtggcgccgttgttcgaactgagcggggtggcgatcgccaacccggtgtccggccaggcgctgacgctgagcctggtcacggtgcagccgtcgtggacgtcgatgctggcctgggagccgcgcctgtcggtgctggtgaacggcccggcggtggagctgcgccgcaccgccgccggggtgatctatctgaatggttttgatctgagcagcgggccgtcgtcggacaacgcgctgggcaactggctgctgcgccagctttcgctggacatccgcaacgcgcggctgagctggcaggacgacaggctgggcctgccccggctggacctgaagcagggacagttgctgctggaacgcaccttgctgggccatcggctgcatctggccggcctgccggccgccacgctgggcaagggcttcgagctggacgccagctggcgcggcgacgacatcaacagctggctgcagtggtcgggatcgctgcgggtggcgctcaacggcgcgcgcgccgacgtgtggtcgcgctatatgcgcgagatgggggtgctgcgcagcggcgagggcgacggcacgctggaaatgtcgttcgccgacggcagcatcggcagcctgcgggcggacgtcaacgtgcgcaacgccgcctataccccgcccagcgcgcgcgagctggtgttgccgcagctgcagggcaagctgcagttggaccgccagggcgacggcagctacaagatcctggccagcgacctgaccctggccagcgccaccggcctcgccttcgacaagtcttcgatcaagggccagtggcgtcccggcgcccaaggcggcggcgagctgacgctggacaatgtcgacgtcggccatctgaacccgttcatccgcgccctcggcgtggacgccaacccgctgttcgcccgattttcgccgcgcggcgcgctgcatggcttgaccctgggctggcaggggccggcggaggcaccgcgcagcttccagctgaaaacccgtttcgaagcgttgggctggcagccgttcgccgacttgccgggcgtggccggcgtcaccggcagcatagatttcaacgagcagggcggccgcttgcaactggacaccggcaagtccgaagtgatctacccggccttgtacgcgcagagtctgcctttcgacagcctggcggccgacatttcctggcgccagcgcggcgcggcgctggacatcgacttcgacaagctggccttcgccaacgccgatctcgccggcaggctgcagggcagctaccaccatggcggcggcggcgccggccatatcgacctgaccgcctcggtcgacgaagtcaaggcgacgcgcatacccgcctatctgccgcaccaagtaggcgaacataccagcgcctggctgcgcaaggcgctgctggacgggatggcgaaaaatgtccgcttgacgctcaagggcgatctggatcaattccccttcccggcaggcaagggcggggaattcctggtggaggccgacgttgaaaaagccaagctgctgtatcagccgggctggcccgccattgacgatatcgacgccaagctgactttccataacgaggcgatgcgggtggaaagcacgcgcgccagcacggtcggcgtgcctttgcgccaggtgagggtgggaatcgaccagctgggcgcgacggcgccgtggctgaagatagagggagagatcgacgacaagctggaccggatgctggccttcaccaccaagagcccggtggatggctggctgggcggcttcaccggcaagatccgcgccgccggcccggccgcgctgaagctgcaactggcggtgccgctggccggcgaggacagcaccaaggtgcgcggcgatatcgatttcaagcataaccggctgttgttcacccaactgccgctgcctgagttgacggcggtgcagggccggctgaccttcaccgagcgcggcatagacagcaagggcgtggccatggaagccttcggcggcgctttccgcctgagcgcccataccggcgcggacaagcgcatgcgcttcgaggtggggggcgaggcggacggcaaacgagtcttgcagcaatatttggcgccgttggcgccgctggccgagggacgcagccgcttcgacagccagttcgtggtgcgcgacggcctggagagcctgcagctgtcgtccagcctgcaggggctggcgctggatgcgccgccgccgctgggcaaggccgccgcggcggcgcaggccttgcagttgcagctgcatccggccccggcgcgcttcggccaggcgatgcggctggaattcgcgctgggcaccgcgctgaacggcaagctgcggctggatgagcatggcaatctgcaagccggcgcgctggggctggagcgcgatgccggcgaatggccggcgacgggcctggcgttgcgcgcgcagcaggcgcgggtggatctggacgactggtggcagcggctgtcgcggctgggcggcgccgatgggctgtcaaacggaaatatgatattgtcctttgatctggacgcgcccgagctgtcggctcaaggcttcacgctgcatcaggtgaatgcccacgttttcaaccggcccggaacggagctgtggtcggtgaagctgcgctcgcgcgaggccaccgggctggtcagctaccaaccgggcgggggcggcgcgctggaggccaatctggaccggctggccttgaactggccgctgcgccccgacgcggcgccgacgcctggcgcggcggcgaagccgcagctgccggcgatgaagatccatatcgccgagctatcgctgcaggggcgggaaatcggcaagctggacatgacggcgcggcgcgacggcgcagtctggatcatggacccgctgaagctgaccacgccggagggcagcctgtccggcagcgccgaggtcaacgaacagggcgcgggcagcgtggatagccgtttcgcgctggaaaccgccaacgccggcaagctgctggcccgcttcggccagggagacgtgttccgcaacggccagggcaagctgtctggccagctgaactggcccggcggcctcagcgacctggacgcggcccacttgtcaggccagctgagcctggatttcaagaatggccgcttcgccaaggtggatcccggcgtggcgcggctgttgggggtgctcagcctgcaatcgctgccgcgccggatccggctggatttcaccgacgtcttcagcgaaggcttcgcgttcgatacgctgcaaggcgcggccggcgtgcgcaatggcctgttcacctccagcaaggtggagatgagaagcccggcggcggaggtgaccatctccggcgaagtggacctgggcaaggaaacccaggcgctgaaagtgcatgtggtgccgcatgtggcggaaagcgtggcgctggcggccggcgcggccttgctcaatccggtggtgggcatcgccaccctggcggcgcaaaaggtgttgcaagacccggtgggaaaaatcctgtcgctcgattacgcagtcagcggttcgctgaaggacccgcaggtggtgagggtgaacgtcggcgatccggtcaacatcaaggggaaaaaaccatga

SEQ ID NO: 2121 - DNA, 2685 bp, Chromobacterium substugae
atgccagcaaacacggccgctgccattgcccgcagctgcgagttttcccactatctgacccgccttctggcggcccggccggaagaaggcgagcggctggagcggcagttgagccagcccttcaccgttgaggatatgcaggacttcgccgactggccagccctgcaggcgccggaacagctggcgcctgcgctgcgccggctgcgccaggcggtgatggcccgcctcatctgccgcgacctcaacgacctggcgccgctggacgaggtggtcgccaccatcagccagctggccgaattcgccgtgcgccaggccttgcgctgcgcctgcgcctcgctgccccaatacggcaagccgataggcgaggacagcggcgaggagcagcagctgatcgtgatcggcatgggcaagctgggcggcggcgagctgaacgtcagctccgacatcgacctgatcttcatctaccctgaaagcggcgaaaccgacggcgcgcgcaagatcagcaatcacgaatatttcacccaggtgggcaagcggctgatcgcgctgatccacgacctctccgccgacggccaggtgttccgggtggacatgcgcctgcgcccctacggcgactccggcccgctggtgatgagcttcgccgcgctggagaactacctgctcagccagggccgcgaatgggagcgctacgcctggatcaaggccaaggccatcaccggcgacgccgaagggttgaatcagatggtccgccccttcgtctaccgcaaatacctggactacaacgcctacggcgcgatgcgcgaactgcacgcgcagatccgccgcgaagtggcgcggcgcgacatggccgacaacatcaagctggggccgggcggcatccgcgaggccgaattcatcgcccaggtattccagctgatccgcggcggccgcgacaagacgctgcaattgcgcggcacccgcgccaccctatcccggctggccgacctgcggctgctggagccgtcggcggtggaagagctgcaagatgcctacgccttcctgcgcaagctggaacaccggctgcaatacctggacgaccagcagacccaaaccctgccggccgcgccggaaacccggcaaaaaatcgccgccagcatgggctacgccgactgggacgccttccagcccgcgctggccgaggtgcgccgcaaggtcagccgccacttcgagcaagtgttcatcctgcccagcgaggacagcccggaccacccgctatcggaattgtggctggacgtggccgaccaggacccctcgctgcggctggcggagctgggctacgccgaccccgccgccgtggcccgccagctcaagggcctggcgcaaagccagcgctacctgcagatgccgctgtccggccgcaagaagctggacgcgctgatgccggcgctgatcgaggtggcgtcgcgcttccccaatgccgacgacacgctgtcgcgcatcatcggcctgatggaagccatcagccgccgcgcctcctacctggctctgctgaccgaatacccgcaaacgttgcagcggctggcatccctttactcgtccagcgcctgggtgtccgcctacctcagccgccaccccatcctgctggacgaactgctggatgtgcgggtgctgtacgccgcgccggactggccgctgctggccagccagctggaagctcagctgacgcaggccgacggcgacgtggaggccaagatggacgcgctgcgccatttccagcacgcgcagaccttccgcctggtggcgcaggacttggccggcatgtggacggtggaagcgctgtccgaccagctgtcgctgctggccgaccacgtgctggacgcggccgtgcgccacgcctggctggacatctccagccgccaccagcagacgccgagcttcgcggtgataggctacggcaagctgggcggcaaggaactgggctacgcgtccgacctcgacatcatctttctctacgacgacccccacccggacgcggccgaactgtactcgcggctggcgcgcaagctgtccacctggctgaccagcgccaccgccgccggcgtgctgtacgacatcgacctgcggctgcgccccaacggcgccagcggcctcttggtcagctcgatctccgccttccgccaataccaggaaaaccaggcctgggcatgggaacaccaggcgctgacccgcgcccgcttcgtcgccggcgacgaagccatcggcgagcaattcgaagccgaacgccatgaaatcctgacgctggcgcgcgagccggccaagctgcgccaggaggtgctggacatgcgccagcgcatgctggacagccacccggcgcggccagacgacgtgaaaaacgcccgcggcggcatcatagacatcgagttcatcgtccagtacctgatcctggcccacgccagccggctgccggctttcaccggcaacaccggcaacatcgcgctgctggcggtggcggccgacgccggcctgatagaccgcgacctggccgacggcgcccgcgccgcctaccggctataccgccggcttcagcacgcggcccggctcaacgagcggcagaaagtggaagtggacaataccctgctggccgcctatcgcaagggttgcctgttgtggcaacaggttttcgagcaagcgctcgatttttcctga

SEQ ID NO: 2122 - DNA, 924 bp, Chromobacterium substugae
atgtcgatggctgatcgtgacggatatatctggtttgacggcaaattggtggactggcgcgacgccaccacccacgtcctgacccacaccctgcactacggcatgggcgtgttcgaaggcgtgcgcgcctacgaaacccccaagggtccggccattttccgcctgcaggaccacaccgagcgcctgttccgctccgccaagatcctgggcatggcgctgccgttctcgccggaacagatcaaccaggcgcatctggacgtggtcaaggccaatggcctgaagtcctgctatttccgcccgatggccttctacggctccggcaagctgggcgtggcgccgctgaagaacgacgtgcaggtgatcgtggccgcctggccgtggggcgcctacctgggcgaggaaggcctggagaaaggcatccgcgtgaagaccagctccttcacccgccatcacgtcaacatcaccatgtgcaaggccaaggccaacggcaactacatgaactccatcctggccaataacgaggccaccgccgacggctacgacgaggcgctgctgctggacgtggacggcttcgtcgccgaaggctccggcgaaaacatcttcatcgtccgcaagggcaagctatatactcccgacctgaccagcgcgctggaaggcatcacccgcgacaccgtggtgcagatctcccaggaaatgggcctgcaactggtggaaaagcgtatcacccgcgacgaagtgtacagcgccgacgaagccttcttcaccggcaccgccgccgaagtgacgccgatccgcgagctggatcgccgcccgatcggcaacggcgcccgcggcgcgatcaccgccgaaatccagaagcgctacttcaacatcgtcaagggccacgacgccgaacacgaacactggctcacttacgtaaaataa

SEQ ID NO: 2123 - DNA, 201 bp, Chromobacterium substugae
atggcagaactcaaagaaaacaccgcacgctatattgaagtcacccagcacgacctgccgctgcactgcccgatgccggacatgaaagcctggaactcccatccgcgcgtctacctgccggtgcacaaaaccggcgaagccctgtgcccctactgcggcacccagtacaagctggtcggcccggtcggccaccaccactga

SEQ ID NO: 2124 - DNA, 1038 bp, Chromobacterium substugae
atgaagaaaaaaatcctggtcatcggcccgtcctgggtcggcgacagcgtaatggcccagccgctgtaccgacgcctgcaccagcgccaccccgagctggagctgcacgtgttcgccccagcctggaccctgccgctcttggcgcggatgccggaagtggcccaatcccacctcaaccccttcggccacggcgcgctgcggctgatggagcgctggaaagtggcgcgccagctggcgaaggaaggcttcgaccaagtcatcgtgctgcccaactcgctgaaatccgcgctgatcccgctgttcgccggcattccgctgcgcaccggctttctcggcgaatcgcgctacggcctgctcaacgacgcccgcgaactggacgaacaggaactgccgatgatggtggagcgcttctgcgcgctggccgaagacaagaagcgcccgctggcccgccccattcccaacccgctgctcagcgccgatgccgcctcgcaacagcaggccgcgcagcgcttgggcctggacaccggccgcccggtggtcgccttctgccccggcgcggaatacggcccggccaagcgctggccggcgcggcacttcgccgaactggcgcgccgcttcgacgccgccggttacgcggtatggctgttcggctccggcaaggacaaggatatcggcgacgagatcgccgggctgtcgcaaggcagcgccgtcaatctgtgcggcgccaccggcctggaagaagcgatagacctgatcggcctgtgccagctggcggtctgcaacgactccggcctgatgcacgtcgccgccgcgctcgacaaaccgctggtggcgctgtacggctcgtccagcccggacttcaccccgccgctgtccgacaaggcggccatcgtgtcgctgaacctggactgcagcccctgtttcgagcgcagctgcccctatggccacaccgactgcctgaaaaacatgcagccggacatggtatggcaggccgcgcaaaccctgcttgccccgccctccaaccagacccgggactga

SEQ ID NO: 2125 - DNA, 618 bp, Chromobacterium substugae
atgagcgccgcggaaaccccgaagcaacccgaagagaacacccgccgcatggagctggtgcgcgcggccgctgtgctgttccgcgaccagggctatgagcgcaccacggtgcgcgacctaggcaacgccgtcggcctgcagtcgggcagcctgttctatcacttccgcaccaaggaagagatcctggtggcggtgatggcgctgggcatcagcagcaccaccgagcaactggccgccgccatctcgcaggcagacagcccgcgccagcgcctggcggcgttgttccaggtccacctcaactccttgctgggcgacaaccaagccgcgctggaagtgatgctgtacgaatggcgcagcgtgtcgccggcggccaaacccgccctggtggtgctgcgcgaccgctacgaggcgctgtggcagcaggtgctggacgaagccgcgcaggctgggttggtgaagcaggacacccgcctgctgcgccgcaccctgctgggcagcctgcactggaccgtgcagtggtaccgccgcgacggcgaactgagcgtggatgcgctcgcgcaacacatgttgcagctggtcttgctggaagcggacgcaaaaacttccaccgaaagataa

SEQ ID NO: 2126 - DNA, 672 bp, Chromobacterium substugae
atggcaaacatcgccagcgtaggcaaccccgcgacgcaaccgctctatgccgggcaaacgccccggcaggtgcagtcgtcgctggacaatgcccagcccgccgttcagcaggcctccagcccgccgcagacccaggtagccgtccggcagaatccggacaccgcccgggtcgagcaacagctgcagcagcaattgagcaatagccgcagccagcaggccctgcaaaacgcccaggcccagaacgccgccgccaacgccgcgccggccgccccccaggcgaacccggcccagatcaacaactccgcggcggtgctcgccaccaacccgcaaccggccgccgcggccgccgtcgcccccgcagtcaacggcaacacggcgcctgccgccgcgcccccgcagcaggccggcaacaacaacgctgcggcgcaggccaccccgacgcaaaccgcgcaagccccctcccaggccgctcccgcgcaacaggcggccacgccgccgcaaccggccacgccggcgcaaagcgccaccgcgccctcaaccctggcgacccaggcggtgaaccgcgcgcagcagctcaccagcagcggccggcaggagttgtcgcaataccaagccactcaatcgctgctggagcccagcgtttccagcaccagcatctccaccaccgcctga

SEQ ID NO: 2127 - DNA, 1947 bp, Chromobacterium substugae
atgaccgatctccacgaagcgttgccgcccgaaatcctgctggacgactacctggcggcgcataacgccaccatcgtcaccaccgagggcagccacgcggtgtcggtgcatggcgagctggcgctgaacggtcacgccattccctaccacctggtgccggacgaaggcttcctgggcaagagcgccaagtggcgcaagctggacgcggaagcgcggctggcgctggtgcgggaacgttggaacgatgccgcgcggcaaaagctggaagagcagctgttggcttgcgcgcgcgaagtgttcgcggtggacggcatcgaaccgttgcgcgcgctcagcgccttcatggcgaagtacgagcgcgccaaggtgcgctgcaccctggcgctggatcgggtggccgccgcgcgcagccggcagagcgccgacaaggccgccgccaaaacccgcgacgcggtcaacctgtcgcgctacccggaatctttcgccaccgcctacgcgatgcagcgacatttcatcgcggtgctggggccgaccaattccggcaaaacccacgcggcgatggagcatctgcaaaaagccaagagcggggtttacctggcgccgctgcgccttttggcgctggaaaactacacccgtttgcagcaagccggcgtggcggtaagcctgatcaccggcgagcagcgcaagctgcatccggaggccacccacgtcgccagcacggtggaaatgctgaatccggagcggcaggtggaagtggcggtgatcgacgaaatccagctcttggacgacccggaccgcggcgcggcctggaccgccgccgtctgcggcgtgccggcgcagaccatctacctggtgggcgcgccggaatcgcgcgaggcgatcgagtcactggtggcgcgcgtcggcggcacgctggaagtgcggacgctggagcgcaagaccgcgctgcagatggacaaggcgccgctgttgtcgttgaagaacctgcggcccggcgacgtgctgatcgccttttcccgccgcgaggtgctgaactggcgcgacaaggtgatcgagcaggggctatcggtgtcggccatctacggcaacctgtcgccggaggtgaggcaatcgcaggccgagcgcttcgtcagcggcgaaacccaggtggtggtggcaaccgacgccatcggtatggggttgaacacgccggcgcggcgcatcatcttcaccaccgccagcaagtgggacggctacgccgaaggcgtggtcgccgcgcctctggccaagcagatcgccggccgcgccgggcgtttcggcaagcatgaaaccggctacgtcgccggcttcgacggccagactcacaagaccatcgccgcgttgctgcgccagaagccggagcccttgcccgagagcggctttttcgtggcgccgggcctgaagtatctggaggcgatctccgaggccactggcgagggcaagctcaaggcgctgctgggtttgttcgcccgccatatcaatgtgcatgatgaattcttcctgcccgccaatctgtccgagcagatggcgaaggccgaatggctggacgccttgccgttgagcctggccgaccgcttcaccttcagcctgtgcccggtctccaccaagatcgcgatgctggagacggcgctgcatgactgggcgcagcaccgcgcccgcggcaaggccgcgccgctgttgcggatgctgggcggcggcggccggcacgagttgcagtatctggaggacagctgcaagctgtacgccgcttatgcctggctgtcttaccggatgccggacaccttcccggacggcgaaatggcgcagctgttgatgcagagcacctcggagcgcatcgacgcgctgctgcaggtgcagaattcgcagaagcgcaagggcaggggcggcggcgagccgatgcggcgcaagccaggcggcaagcggcgctga

SEQ ID NO: 2128 - DNA, 1185 bp, Chromobacterium substugae
atgcaacaacaggaaatcgtgatcgtcggcatggcgcgcaccgccatgggaggcttccagggcgccttgtccggtttgaccgccggccagctgggcgcggcggcgatccgcgccgcggtggaacgcgccggcgtcgccgccggcgaggtggacgaggtgatcatgggctgcgtgctgccggcaggccagggccaggcgccggcgcgccaggcggcgctgggcggcggcctgccgcaggctacgccgtgcaccaccatcaacaagatgtgcggttccggcatgaaggccgtgatgatggcgcatgaccagttgctggccggcaacggccaggtggtggtggccggcggcatggaaagcatgagcaacgcgccctatctgatgcccaaggcgcgcggcggtctgcgcctgggccacggcgagatcaaggaccacatgttcctcgatggcctggaagacgcttaccagaagggcacgctgatgggcgtgttcgccgagcagtgcgccgagaagtacggcttcagccgccaggaccaggacgaattcgccatcgcctcgctgacccgcgcgcagcaggcgatcaagggcggccagttcaaggacgaaatcgccgcggtcaccgtgccgggccgcggcggcgataccgtggtggataccgacgagcagccgctgaaggccaatctggacaagatcccgacgctgaagccggcattcaagaaggacggcaccgtcaccccggccaattccagctccatctccgacggcggcgccgcgctggtgctgatgacggcggccgaggcggccaagcgcagcttgcagcccatcgcccgcatcgtcggccacagcagctatgcccacgagccgggctggttcaccaccgccccggtgcacgccatcgaaaagctgctggccaagaccggctggaaggccggcgaggtagacctgtatgagatcaacgaagccttcgccgtggtgacgatggcggcgatgcacgacctgaagctgccgcacgacaaggtgaacgtgcatggcggcgcctgcgcgctgggccacccgatcggcgcgtccggcgcccgcatcgtgatctcgctgctgtcggctctgaaacagcgcggcggcaagcgcggcgtggccagcttgtgcataggcggcggcgaggccaccgcgctggcagtggaattgatctaa

SEQ ID NO: 2129 - DNA, 399 bp, Chromobacterium substugae
atggcggagcaggttttcaacatcaccgaactggcgcaggagttcgacatcaccacccgcgcgatacgcttttacgaggaccagggcctgttggtgccggagcgggctgggcagcgccgcatctacaaccgccgcgaccgcgtgcggttgatgctgattttgcgcggcaagcgcatcggcttgtccctgcaggaaatccgcgagctgttcgcgctgtacgacgcggcgcgcgacgacgcgccgcagctgcaggaattcatccgcatcctggcgcgcaaggagcagcagctcttggcgcagatggaagacatcaaggtggtgctgacagaaatcggccaattgcgcggccagtgcgaaaaatcgctgggcaagcgcgccaacggccacaaccaagcataa

SEQ ID NO: 2130 - DNA, 849 bp, Chromobacterium substugae
atgagcaagaaaatcggtgtggtgggcgcgggcaccatgggcaacggcattgcccaggtcttcgcgatgaagggcttcgaggtgctgctggccgacgtcagcgacgccgcgctggtgaaaggcatggccaacatcaatatcagcctgcagcggatggccaagaaagaactgatcgccgaggccaacatccccggcatcgtcgcccacatccgcgccaccacccagctggccgatctggccggctgcgacgtggtgatagaagccgccaccgagaacgccgccatcaaggagcagatcttccgcgatctggacgccgccgtcggcgaaaagtgcgtgctggcctccaacacctcgtccatctcactcacccgcatcgccagctgggtcagccatccggaacgggtggtcggcatgcacttcatgaacccggtgccgctgatgcagctggtggaaatcatccgcgcgctgcaaaccggcgacgaggcctacaacaccgtgttccatctgtcccaggcgctggacaagaccccggtgacggtgaaggacggcgccggcttcgtctccaaccgcgtgctgatgccgatgatcaacgaagccgccttcgcgctgtatgaaaacctggccaccgccgaagacatcgacaccgtgatgaagctgggcatgaaccacccgatcggcccgctggcgctggccgatctgatcggcctggatacctgcctgtccatcatggacatcctgcaccgcgaattccgcgacagcaaataccgcgcctgcccgctgctggcgcagctggtgcaggccggacacctgggccgcaagagcggcaagggtttctatagctacaactga

SEQ ID NO: 2131 - DNA, 1503 bp, Chromobacterium substugae
atgagccagtcagtacccagcgtcaaactgttgatcggcggcgagttcgtcgaatcccgcaccacggaatggcgcgacatcgtcaatccggccacccaggaagtgctggcgcgcgtgccgctggccaccgcggacgaagtcaacgccgccgtcgccgccgccaaggaagcgttcaagacctggaagaaaacgcctatcggcgcccgcgcccgcgttttcctgaaataccagcaactgatccgcgagcacatgaaggagctggccgccatcctcaccgccgagcagggcaagactctggccgacgcggaaggagacatcttccgcggcctggaagtggtggagcacgccgccaatatcggcacgctgcaaatgggcgaatacgccgagaacgtcgccggcggcgtcgatacctactcggtgctgcagccgctgggcgtgtgcgccggcatcaccccgttcaacttcccggcgatgattccgctgtggatgttcccgatggccatcgccaccggcaacaccttcgtgctgaagccgtccgagcaggacccgatggtgacgatgcggctggcggagctggcgctggaagccggcattcccaaaggcgtgctgaacgtggtgcacggcgcggcatcggtcgtcgacgccatctgcgaccaccccgacatcaaggcggtgtccttcgtcggctccaccaaggtgggcacccacgtctaccagcgcgccaccctgtccggcaagcgcgcgcaatgcatgatgggcgccaagaaccacgctatcgtgctgcccgacgccaataaggaacaggcgctcaaccaattggtgggcgcggccttcggcgccgccggccagcgttgcatggcgctgaccgtggcggtgctggtcggcgaggcgcaaagctggattccggagctggcggccaaggcgcgcggcctgaaggtgggcgccggcaaggacaacctggacctgggcccgctgatttcccgcgccgcccgcgaccgggtggaaggcctgatcgccaagggcgtggaacaaggcgccaagctggagctggatggccgcggcgtgcaggtggccggcttcgagcgcggcaacttcgtcggcccgaccatcttctccggcgtgaagccgggcatggccatctacgaccaggaagtgttcggcccggtgctgtgcctggcggcggcggacaccttggacgaagccatcgccatcatcaatgccaatcccaacggcaacggcaccgccatcttcacccaaagcggcgcggcggcgcgcaagttccaggaagacatcgacgtcggccaggtgggcatcaacgtgccgattcctgtgccggtgccgctgttcagctttaccggcagccgcgcgtccaagctgggcgacctcggcccctacggcaagcaggtggtggctttctacacccagactaaaaccgtcaccagccgctggttcgatgacgaagccagcatgggcaaggtccacaccaccatctcgctgcgttga

SEQ ID NO: 2132 - DNA, 1161 bp, Chromobacterium substugae
atgaatttcgaactgaacgaagaccagatcgccttccagcaaagcgcccgcgacttcgccgagcgcgagctggccccgcacgccgccgaatgggacgccgaatcccacttcccgctggacgtgatccgccagagcggcgacatgggctttctgggcctgtacacgccggaaacctacggcggcttgggcctgccgcggctggactccgccatcatattcgaggagctcgccgccggctgcacctccaccgccgcctacctgaccatccacaatatggtcagctggatgatagccagcttcggcggcaagcagctggccgaacaatgggtgccgaaaatggtgaccggcgaagtgctgggcagctactgtctgaccgagccgggcgccggctccgacgccgcctccttgaaaacccgcgccgagaaaaagggcgaagtttacgtgctcaacggcggcaagatgttcatctccggcgccggcagcacccaggtgctggtggtgatggcccgcaccggcggccccggccccaagggcatctccgccttcgtggtgcccgccgacgcgccggggatcagctacggcaagaaggaaaagaaaatgggctggaacagccagcccacccgcgccatcaccttcgacaacgtcgaaatcccggtggagaatcgtctgggggaggaaggccagggcttcgccttcgcgatgaaaggcctggacggcggccgcatcaatatcgccacctgcgccgtcggcaccgctcaagccgcgttgaacgccgcccagcgctatgtgcaggaacgccaacagttcggccagccgctggccgagctgcaaaccgtgcaattccgcctggccgacatgctgaccgaactggtggccgcgcgccagatggtgcgcctggccgcctggaagctggacagcggcagcgccgacgccaccgcttattgcgcgatggcaaagcgcctggccaccgatttgagtttcaatatcgccaacaacgcgctgcagctgttcggcggctacggctatctgcaggacttcccgctggagcgccatgtgcgcgacctgcgcgtgcaccagatcctggaaggcaccaacgaagtgatgcggatgatagtcggccgcaagctgctgcaagacggcgcgctggaaacgctgcgctaa

SEQ ID NO: 2133 - DNA, 783 bp, Chromobacterium substugae
gtgcaaaactacgcccacctgaacgtggaaaaacgcggccacacagccgtagtcaccatcgacaacccgccggccaacacctggaaccgcgccagcctcaccgcgctgaaacagctgattgccgacctcaacgccgaccgcgacatctacgcgctggtgatcaccggccagggcgagaagttcttctccgccggcgccgacctgaatatgttcgccgacggcgacaagaaaatcgccaccgagatgaccatgctgttcggcgaggctttcgaggcgctgtcggctttccgcggcgtcagcatcgccgccgtcaatggctacgcgatgggcggcggcctggagtgcgcgctggcctgcgacatccgcatcgccgaagagcaggcgcagatggcgctgccggaagccggcgtcggcctcttgccctgcgccggcggcacccagaacctggcgtggctggtgggcgaaggctgggccaaacggatgattctgtgcggcgagcgcgtcaacgccgccaccgccgagcgcatcggcttggtggaacaggtggtggccaagggcgaggcgctggaaaccgcgctcaagctggccgagggcgtggccaagcagtcgccgtcgtcggtcggcgtgtgcaaacagctggtgcaggccgcccgtctgcagccccccgcctggaacctgatcaaggaacgcgaagccttcatcaagctgttcgacacccacgaccagggcgaaggcacccgcgccttcctggaaaagcgcgcgccgaactggaagaacgcctag

SEQ ID NO: 2134 - DNA, 1119 bp, Chromobacterium substugae
atgcaagacgtggtgctgtttgacgaactgactaccggcgacggccatcgcatcgccatcgccaccctgaatgccgagaaatcgctgaacgcgctgacgctggacatgatccggctgctggacgcccgcctcaccatctgggagcgcgacgcaggcatcgtcgccgtggtgctgcgcggcgccggcgaacgcgccttctgcgccggcggcgacgtgcgcagcctgcgcgacaagctgatcagcgaaccgcactatcccaatccgcacgcggtggccttcttcaccgaagaatacacgctggactaccgcatccatcgctacaggaaacccttgattgtatggggcggcggcatcgtgatgggcggcggcctgggcctgatggccggcgccggccaccgcgtggtcacgccggccacccgcatcgccatgccggaaatcaccatcggcctgtacccggatgtcggcggcagctggttcctgcaacggatgccggcgcacctgggcctgttcctggcgctgaccggcgcgccgctgaacgcgcacgacgcgctgatcgccaacctggccgaccatgtgctggcagcggacgcctatccggcgctgctggaggccttgcaagcggcaaactggggcgacgacgcccatgctcgcccggccttggtcagcgcgctgctgaaccagttggagggccagctgggcgacgcgctgccggcgtccaatgtcgagcgcaatctgctggcggtgcaccggctgatgaacaagggcgacctggccgccgtcagcgccgcgctgagcgaaacggcgttcgaagacccatggctcgctgacgccgccaagaacttccgccacggctgccccacttccgccgccgtcagctgggaaatcctcaaccgctccaaacacatgtcgctggccgaggcgctgcggatggaactggcgctgtcggtcaacttctgcgcccgctccgacttcccggaaggcgtgcgcgcgctgctggtggacaaggaccgcaatccgcattggagccggcagttggccgacatcgaccaggcctgggtggacggccacttcgattcgccgtggcgcgaagccgaccacccgttggctggcttgaaataa

SEQ ID NO: 2135 - DNA, 894 bp, Chromobacterium substugae
atggaaaacatcgccttcatcggcctgggcaatatgggcgggccgatggccgtcaatctgctgaacaagggcttcaaagtcagcgctttcgatctgtcggccgacgcgctggcccgcgtggccgccgccggcggccgggccgcgtccagcgccgccgacgcggcggagggcgctagcgtggtgatttccatgctgccggccggcaagcacgtggctgggctgtaccagagcgacgacggcctgttcgccaagctgcccaagggcgcgctggtcatcgattgcagcaccatagatgccggcaccgcgcgcaaggtggccgaggaagcggccgcccgcggactctcgatgctggacgcgccggtatccggcggcaccgccggcgcggcggccggcaccctcaccttcatcgtcggcggcgcggcggacgatctggaacgcgcccgcccgatgctggaagcgatgggcaagaacatcttccacgccggcggccccggcgccggccaaaccgccaagatctgcaacaatatgctgctgggcatcctgatggccggcaccgccgaagcgctggccctgggcgtgaagaacggcctggacccgaaagtgctgtcggagatcatcagcaaaagctccggccgcaattgggccaccgagctgtacaacccctggcccggcgtgatggaaaatgcgccggccagccgcaactacaccggcggcttcatgtcagaactgatgttgaaggacctgggcctggccgaagagaccgcgctgcaaagccactccgccaatccgctgggcgcgctggcgcgcaatctgtatgaagagcacgtgcacctgggcaacggcaagctggacttctccagcatcgtcaagcacttccaccggctggacggataa

SEQ ID NO: 2136 - DNA, 2520 bp, Chromobacterium substugae
atgaacatgcctcaactgcacgccctgaagagcatcgccgccgccacgctgctggcctgcgccctgcccgccgccgcaggttatcagcaacctccggccaatatcctcaaagcgatgcgcgcgccatcgctgcccggccccagcctcagcccggccaaagacaaaatgctgctggtcgcctggcaggaatacccatccatcgaacgcgtggccgctccgtatctgaaactggccggcacccgcgtggaaacagccaaccgcagcaaacacgacacccctggcggctacggcatcgccccctgcgccgaaagcttcaaactggtgacgattcccggcggcaaggaaaccgccatcgccctgccggccggcgcctgcccggacgcgccgatctggtcggccgacggcaagcgcttcgccttcgccaacgccacccgcgacgcggtcgaggtatgggtgggcgacgccgccagcggcaagatccgcaagattcccggcatccgcctcaacccgatgctgaacgacgaactgcaatggatgccggaccagaaaaccctgctggtcaaggccgtgccggccaaactgggcgccgcgcccgccaaacaggcggcgccggatggcccgaacgtgcaggaagccgatggcgaaaccggtcaaagcagcacctatgaaacccgcgacaccctgtccagcccgcacgacgaggcgctgttcgactactacggcgcctcgcagctgacgctggtggacgccgccagcggcaaaaccgccttgctgggcaagccggccatctacgatgccgtcgaccccgcgccggacggcaagcatgtgctgatcagccgcatcgccaagccctactcctacgtcaccacctacgagcgcttcccgcatgaggtggaggtgtgggacatcaccagccccgcgcgcatcgccacccatcacatcgcctcgcagccgctggccgaccgcgtgccggtgcacggcgagccgctgggcccgcgcgacttcttctggcgcgccaccgacccggccacgctgctgtgggcggaagcgctggacggcggcgactggcagaacactgcgccggcgcgcgacaaggtcatgcagctgaaagcgccgttcaccgccaaaccggcggaagtgctgcgcaccacgcaacgcttcgccggcataggctggaccgaacgcgccgataccgcgctggtgagcgaagtcgacctcaacaagcactggcgccagacccgcgtcgtcaacctggacgatcccaagcagccggccaagctgctgtgggacatggcttacgacaaccgctacgccgatccgggcagcccggtgcaccgcacgctggccaacggcgagcgggtgatccagctggacggcgacgccatctacctggccggcgccggcgcttcgccgcagggcaaccgccccttcctcgacaaattgaacctgaaaaccggcgtcagccagcgcctgttccgcagcgacaagtccgcattcgagcgcttcatcgcgctgtccggcaaggacgccggcagcttcctcacctggcgccagacgccgaccgaggcgcccaacgccttcctgcgcaagctgggcgcgccggtcagcgccgacaagggcgaagccgcgttcgcatcgagcgaaaccgctgtcacccatatcgtcgatccgacgccggaactgcgccagatcaagaagcggctggtgaaatacaagcgcgccgatggcctggacctgtcgttcacgctgtacacgccgccgggctacaaggaaggcacccgcctccccgccattctcaacgcctatccgctggattacgccgacgcagccagcgccggccaggtcagcggctcgcagcagaccttcacccgcctctaccagtacaaatacctgctgctggccggctacgccatcatcgaccaggcctcgttcccggtggtgggcgacccgaaagccgcctacgacacgtatctcgatcagttgaagatggacgcggaagctgcggtgggcgaagcggtgaaactgggcgtagtggacccggaccgcgtcgccgtcaccggccacagccacggcgcgctgatgacagccaacctgctggcgcacaccgatctgttccgcgccggcgcggccaccagcggctcttacaacaagacgctgacgccgttcggcttccagagcgagcgccgctcggtatgggaggcgccggaggtctaccgcaaggtgtccaccttcttctacgccgacaagctgaaaacgccgatcctgatcgtgcacggcagcgatgacgccaaccccggcaccacgccgctgcaggccagcaagttctacgaggcgatccgcggcaacggcggcaccgcccgcctggtgatgctgccgcacgagccgcattggtacgcggcgcgcgaatcgaacgagcaactggtgtacgagatgctgagctggttcgacaagtacgtgaagaacgcgccgccgcgcgcggccaaaaccgcgcaaagccagccggcgccggcccagccgtaa

SEQ ID NO: 2137 - DNA, 828 bp, Chromobacterium substugae
ttggacgcgtatttgttgtcgcgcggcggcggcggattgggtggttggcggctgtcggtccgcgagttctggtttttcggactgaaggaaatgcgggcctgcctattcgccggcctgtttttcgccgcgatattcctgacgccgcgcggcggctggttgggcgtgccgcgttatgacctgctgttgttgatcgcgctggcgatccaggggtggatgttgtggaccggactggagagcctggacgaactgaaggcgatcaccttgttccatctgctgggcttcgcgctggaggcgttcaagacctcaagcggcattcagtcctggagttatccggatttagcctacagcaagttgttcggcgtgccgctgttttccggtttcatgtacgcggcggtcggcagctacatcatccaggcttggcgcttgttgaaattgcgggtggagcaccaccccccgtactggatggcggcgatggtggcggcgctgatctacgccaatttcttctcccaccactatatcggcgactatcgctggtatatcgccgcctgcgccttgggtttatacgcgcgcgccaccgtgattttccagccgctggatcgggagcgccgcatgccgctgctgctggctttcgtgctgatcggctttttcatctggctggcggaaaacatcggcaccttctacggcgtgtggcgttaccctcatcagctgggcgcctggtcgatcgtccacgtcggcaagtggagcgcttggtcgctgctggtgatcatgagcttcaccatcatcgcccatctgcagcatgtccggcgccgcatcaacgtgccggcttga

SEQ ID NO: 2138 - DNA, 1026 bp, Chromobacterium substugae
atgctgaatttcgattttccgcgtctggccgccatcggcctgacgccggcattgctgcaacaagcgctggccatggccggcgatgacgactggcaactggtgcgcgtatgccgggtgcagcgcgactgcgcatgggtgcacgatggcgaagaggaacggcaggcgcatgccttgcccggcgttcacgccgagttggcggtgggcgattggacgctgtgccagccgcgggagcatgagccctggcgcttgcttgagcgccttgaaccgttcaaccagctggtccgcgtcaacgacgaaggcgcgcgccaggcctacgccagcaatgtcgataccgccttgctggtgatggggctggacggcgattacaacccgcgtcggctggagcgctacctggggctggccgcggcggcgggcgtggcgccggtggtggtattgagcaaggcggacttgtgcccggacgccgaagccaggctggccgagctggagcagcggctgcggccgttgccgcccatcctgttgttgaacggcaccgatccggcctgccgcgacgctttgcggccgtggctgggcatgggccagacgctggtgctgctgggctcgtccggcgccggcaagtccacgctcagcaatacgctattgggcgaggagacgcaggcggtgggcggcgtgagggcggatgacagccgcggccgccataccaccacggcgcgcacgctgctgaaatgcccggacggcgcttgcatcatcgacacgcctggcgtgcgcaccctgcaagcgccgcccgacgccggcgctttggccggcagcttcgcggatatcgaggaattggccggccgctgccagttccgcgattgcactcaccgcgaggagccaggctgcgcggtgagggagggcgtagcgggagaccggctgcgcaactaccacaagctgaggcgcgagctggagcgtcacgagcagaccgcgctgcagcgccagcagcagcggcgggagtggaaggtgcgcaacaaggcggcgcggcggggctga

SEQ ID NO: 2139 - DNA, 843 bp, Chromobacterium substugae
atggcgcggttggcgttggtcttgtggatggcgtggcttggcgggccggctgcagcctgcaccctgtggggagcggcgggcgcggccagcgcggatgggacgctgctggccaagaaccgcgactggcggccggaccatgtccagtcgctgcggctgcatcatccggcgcatggccatgcctacctgggcttgtacgccgatacgggcagcgagccgggaatcaaggccggggtcaacgagaaggggctggcggtggtcggggccgaggccagcagcctgccgcgggcgttgcggcaggatagctcgcgccatggcgttctgacgcggctgctgcgcgattacggctcgctggacgaagtggccgccgccgccgatcagctgttctcccaggttcggccggtgttcctgttgctggccgacgccggcggcctgatgcaggtggaaatcggccagcatggccgttaccgcgtcacccggcagcaaaacggcaccctggcgcacaccaatcattatttcgacacgtccttgctggacggggaacagaagatcggtcccagcagccaggcgcggttggcgcgcgttcgactattgctggatcagaatccggcgcacacgctggctgaattcgaacagctgagccgggaccgccatgacggcccggacaacagtctgtggcgcgctggccgcgaacacacgctggccggatggcagctggcgttgccggcggcgggcgcgcccaggctgcacctggtgctggctaatcccggcgagccggagcgcgagcgggactatgcgctggatgcggcattctggtcgcagccggcgcgcacgctgctgccgtag

SEQ ID NO: 2140 - DNA, 345 bp, Chromobacterium substugae
ttgaacgaattccttcccgccggccgcataaaccgcaccggttttctatggcggcacgccatcgttctgccgccggccttgtggctggcccgccaggcggatagcctggcctgctccgccggtacgctggcctcggcgctgctgctgttattcctgatcagcgcctggacaagaaggctgcacgatctggaccgctccggctggcgcttgctgttggccgcgctgcccctgttcggccccatcatcctgatcgcaacctgcctgcgtcccgggcgcgccatcgccaaccgctacggttcggccccgggattgcgcgaagactacaccaccgttcaagcctcatga

SEQ ID NO: 2141 - DNA, 2259 bp, Chromobacterium substugae
atgagccatcaccacatcgtcaacgacgtgacgcgcctgaatcccgtgcgcgtcatggccatcatcgccccggagtccgtcgcggacgtgcagcaggcgctgcgccgcaccaatggtccggtttccatcggcggcggccgctacagcatgggcgggcaaagcgccagcccgggcagcctgcacttcgacatgcgctcgctgaaccgcatcctgtcgttctcgccgcacgagcagacgatacgggtgcaggccggcgtccgctggtgcgacatccagcgcttcatcgacccgcatgatctggcggtcaagaccatgcaaacctacgccaacttcaccgtgggcggctcggtcagcgtcaactgccatggccgttacgtgggtctggggccgctggtgctctccgtgctctcgctgctgatcgtgctgcgcgacggcgaaacggtacgcgccagccgcgacgagaacgcggagctgttcttcggcgccataggcagctatggcgccctgggcgtgatcgtggaaatcgagctcagcctgaccgcgaacaagcgggtgaagcgccagcacaaagtgatgccgctggccgactactggacttatttcaagaatgcggtgcgcgacaatcctcaagccgtctttcacaatgccgacctctacgcgccgcgctacggcacggttcgggcgaccagctggatggaaaccgacgagccggcgaccacgcccgaccggctgtccccgctgaagaagtcctacccgctgcaccagtacgtgctatgggccatctcggaaacgcccttcggcaaggaaaggcgcgaaaagctgctggacccactgttgtactggcggaaaaaagtgcattggcggaatttcgaggccggctacgatgtggccgagctggagccgccatcccgccagcaccgcacctatgtgctgcaggagtatttcgtgcccgtcgcgcagcttgaggctttcgtggcgcgcatgggggagattttgcgccgccatcgggtcaatgcgctgaacatctccatccggcatgcgatgccggaccctgacacattgctgggctgggcgccggtggagacgttcgccttcgtgctgtattacaagcagcgcacgcgggaaaacgccaggagccgggtcgccgtctggacccgcgagctgatcgacgccgtgaccgcggtcggcggcaagtactatctgccctaccagccgcatgccacccacgcgcaattccaccgcgcctatccgcgtgccgagcagttgttcgagctgaaaaagcgcctggatccggacttccgcttcaccaatgccttatgggacaagtactaccaagcctggctcgcgcgcggacaagccgcgccccttcccgccccggcgtccgaattccatcaggtgtttgacgatgtcggcctttccgacgcgttctaccgcttcctgcaaacggtgttccgcatcgccccggaggacagactgcaccagctgatccgcgaggcctgccggcattgcggcgatgaagaaagcgtttaccgctacctccagcaacgcttcgccggcattcgccccgcgctggccgatctgcgctatgccgtgccgtcgctgttgcggcaaaagcgggaaatgacccggcagaccctggccttgctgaatggccggcgccgcttcgacggctacgccgaaatcggctccaaagggcgttattaccggggcttggccgcggcgctggacatccgcggaccgcgcttcttcatcgatgagcatgcgcaaaccttctcgccggccgacatcctggaacgcggccaattcaagcgcctgccccggcacctgccgctgaacgactacgcgcccatctgcccaaacgccatccccgacgccagtctggacctgctggtctgctatgtcggcttgcatcacatgacgccggacaccctgacggcctttctggcctctgccgcgcgcgcgttgcgccccgacgggctgttcatcgtgcgcgaccatgatgtctgcgacgacagcatgcgggcgctggtttcgctggcgcacacggttttcaacgccagcctgggcgaaagctgggaaaccaaccaacgcgagctgcggtatttcgcgccggtcgcgcactggtcgcgctgcctgcggacagcgggcttcgaggacagcggccagcggctgctgcaagccaacgacccgacggccaataccctgctgtgctttgtccgcctcccggcggcggacgccgcggcaaggagcgcatcgtga

SEQ ID NO: 2142 - DNA, 612 bp, Chromobacterium substugae
gtgaggccgccgcgccgctggctggcgcgcgccgcgttgacgctcgtccttgccctgcccaccgcaggaagcgccgccgccccggcggaatatcgccgcccgccggagcagacctacctcacctttcccgaatggtatctggtgcacagcccggccgaatatgccggctacctgcaaagcggcgcgcctcccagcggctttcccttattcgcccacatcggccagttctggcaaggctatgccgccatgacccgcgaaacggaacgctatccgttcaacggcggctaccatctgatggtgatggtcatcggcgccagcaccaccatcgaatacggcatcaaggggctttacgaacaaaccgtgggccggctggcggaagccagccgcggaaccggcccgatgctgcccgaagagcgcttcgccgcgcgctatgcccgcgactacgtcgacttcatccgcgttgacccctggtaccagttcgatttcttttcccggctgcgccaattgtggcaaggttccctgccgctggacggaaaccatccgctccgccgctgggagcggcgttacctgctgagcagcgagctgctggccaaagggattacggccagttga

SEQ ID NO: 2143 - DNA, 426 bp, Chromobacterium substugae
ttgatcaagttggcgacccgcacggtttacgatgaggccaaacctcaaaccgccgtcgtcctgcgccacgcgccgccggcctcagccgatcgccgcaactatatcccgcaagccgctcaagatggcctcacgcccgccctgctgcctcgctatcaagccttccaagactatagcctgtggctagcgcgaaacggcgcggacttccaggaaatcgccggcaaccgcggcgaaatcctgatcagcctgctggcgcctgacgcctggcgcgcgcctggcgacgggcggctattgctggagcagccgatattgacccagccgggccgcaagcgcgcgctggtcgccgtgccggtaggacaattggccggcctgctgcgcctgagcgccgcgcaagccggagtcgacctggagcatgtgtacgattattga

SEQ ID NO: 2144 - DNA, 510 bp, Chromobacterium substugae
gtggccgggtccgaccccagcattcatcgttctttcaaagagaaaaaatacatgagtcccatcctttatcgcgccgcgcgtccggacgacgtgccggcctgcgtcgtcatccgcggccagacccgcgaaaacgccatttcggaagccaggctgaacgaactgggcatcacgcgcgcgagctgggcgcaaagcgtgcgcgtcggcgagctgcccagcgtggtggccgaggctggcggccgcatcatcggctactgctttggcgacgcggcaagcggcgaagtggtggtgctggccctgctgcccgattacgaaggcatgggcgcgggcaggacgctgctgtcgcaggtgatggccagcctgcgcgaggctggccaccagcggctgttccttggctgcagcagcgatccggcggtgcgctcccacggtttttaccgccgcctgggctggaccgccaccggacgagtcgacaaatacggcgacgagatgctggagtacgcattcccgtcctga

SEQ ID NO: 2145 - DNA, 768 bp, Chromobacterium substugae
atgcaagtcggcgcgctgattatcggcgacgagctattgtccggcaaacgccaggacaagcatatgcaggccttgatccgcatcctggccgcgcgcggcatcaagctggcctgggcggaatatctgggcgacgatcccgcccgcatcgaagccgccttgcgccgcgctttcgccagcggcgacctggtgttcagcttcggcggcatcggcgccacgccggacgaccatacccgcgtctgtgccgcccgcgcgctgggcctgccgctggagccgcacccggaagccaaggcgctgatcgaggcgcgcttcggcgccgacgcctatccgcaccgcatccagatgggtcatttccctcaaggcgcggccatcattcccaacccggtcaaccagatcgccggcttttcccacggcagcgtccattttgtgccgggcttccccagcatggcctggccgatggcggagtgggtgctggacacgcactgccgccacttgttcaacgaccagcccgacatcgaaaaatcctgcatcgcgatccaggcccgcgagggcgatctgatcggcctgatgcaggaattcagcgcccgctatccggcgttgaaactgtccagcctgcccagtttcggcaatgaggcgatcccagagatgcatatcgagttcggcttcgccggccagccggcactggtggaaatcgccatcggcgagtgggtgaaagcgatccaggcgcggggctacgaagtgcgcgccaaagatccgggcgcggagagctaa

SEQ ID NO: 2146 - DNA, 480 bp, Chromobacterium substugae
atgctgccggccagcctggatgaactggacgccatccgcgacgaatgccgggcgctggtgaacgggcgggcggcgctatcggctggtgcctcggctttgcccgcgcctgggatggatgtcgccgccgacgtggccatcctgctgcggctgattccggcgatcaatcagcgcttcggcgtggcgccggcgcagatcgccggctacgacgcggcgcgcaagcagctgctgtatcagctgatccgccgcgccggcagcgcgctgttgggcctggaagtcagccgcgcgttgctgaccgccatggttcgccgcatcagcgggcgctgggccggcaagcaggcgttgaagctggtgccggtgctgggctgggcggccaatgcggcgataggcttcgccgcgatgaaatacatcggcaacagccatatcgacgattgctacgccgtgtgccggcgcatgctggaagagggcggcgttaaaccgtga

SEQ ID NO: 2147 - DNA, 1089 bp, Chromobacterium substugae
atgacccaaacgactttgaatctgccgcgcggcccggtgatggtggacgtcgccggcttcgcgctgaccgaacaggaacgcgcccggctgtcccatccgctggtgggggggttgatcctgttccgccggaatttccagaacatcgaacagctgcgcgcgctgaccaccgagatccgcgccttgcgcagcccgcacctgttgatcgccgtcgaccacgaaggcggccgcgtgcagcgcttcctggacggcttcacccggctgccgccgatgaatgtgctgggcgaagcctgggatgaagaccgcgaacaggcgctgaagcaggcggaaaccgtcggctacgtgctggcggccgagctgtccgcctgcggcatcgatctgtctttcaccccggtgctggacctgaactgggagcgctgcgcggtgatcggcaaccgttccttccaccgcgatccgcaagcggtggcggcgctggccgaggcgctgcagcaggggctgggccgcggcggcatgatgagctgcggcaagcactatcccggccacggctatgtggaaggcgacagccaccacctgatgccgcgggacgagcgcagcctggccgagatcgaacgcgacgacctggtgccgttcgcccgcctggctgatgccggcatgggcgcggtgatgccggcccacgtgctgtatccggcggtggatggccaaccggcgggcttctccaaagtgtggctgagcgacatcctgcgcgacaagataggctttgacggcgtgatcttctccgacgcgctggacatggccggcgcggccggcgcggggacttacgtgcagcgcgccgacgcggcgctggccgccggctgcgacatggtgctggtctgcaatcagccagaagaggcggatacgatgctggccgccctggttccgccgccgcagcccaagttggcggagcggctggagcggatggcggccaagagcggcgccgaagattggcggcgcgtgatcgccacgacggatttcgccgccgcgcaggcggtggtcaagcaactggcgatgccgaaggacgcgttggccggtccgcaagtgggcgaggcgcactga

SEQ ID NO: 2148 - DNA, 378 bp, Chromobacterium substugae
atgatttacggcatcggcaccgatctggtggagatcgccaggatggaggcgtggtgccagcgctggggcgccaaggcgggacggaggctgttgacggcggcggaacaggttgaattcgccgcgcatgccgaaccggcgcggttcctctccaagcgtttcgccgccaaggaggccttcgccaaggcgctgggcaccggtgtggtggcgccggcactgctgacggcgataggcgtcggccatgacgcgctgggcaaacccttgttgattttgtcggacgagctggcggccttcgccgcgtcgcgcggcgtcgcgcgcatgcatctgtccatcagcgacgaacgcggccacgcgctggccttcgtcgtgctggaatcgtag

SEQ ID NO: 2149 - DNA, 564 bp, Chromobacterium substugae
atgccaaccgtcttcacccacgcgttggccggcgccacgctggccggcctggccagccgcaagccggtctccacgccgggcatgctgccctggctggcgctgtgcggcgcggccgccatgctgccggacctggacgtggtgactttcaagctgggcattccctacgagagtccgtgggggcaccgcggcttttcccattcgctggcggccgcggccttgatcgccggcgtgctgacctggctgtgccgcccgctctggcggcggatggggctgagcgcggcggctgcggccacgctgctattcctggcggcggcttcgcacgcggcgttggacatgatttgcgacgccagcttcggtccggccttgttcatgccttggtccggccaccgctacctgagcgactggcgcttgatcgaaggctcgccgctaggcctgaaacgctggttcagcgccaagggctggcgcgtggtgtataccgaattcgcctacgtctggctgccgtgcctggcgctgtggacggcgcgttggctgtggctgcgccgcggtagcgaggcgcgggcatga

SEQ ID NO: 2150 - DNA, 723 bp, Chromobacterium substugae
atgatattgttgggcgtaaacatcgatcacgtcgccaccctgcgccaggcgcgcggcacccgctaccctagtccggtggaggccgcgctggtggccgaatccagcggcgccgacctgatcacgctgcatctgcgcgaagaccgccgccatatccaggacgccgacgtgaaggcgatgcgtccggtgctgaaaacccggatgaacctggaaatggcgatgacggcggaaatgctggcgcatgcgctggaagtggcgccggaagacgtctgcctggtgccggaaaagcgcgaggaggtcaccaccgaaggcggcctggacgtgcggggccacttcgacgacgtcaagcattacaccggcaagctggccgaagccggcatccgcgtctccatcttcatcgacccggaccgcgcgcagatccagaaggcccacgacgccggcgcgcgcgtgatcgagctgcacaccggcgcctacgccgacgcgccgcacgccaaggaacgcgaggccgagctggcccgcatccgcgaggccgccgcgttcggcgcgagcctcggcatggtggtcaacgccggccacggcctcaactaccacaacgtcaagcccatcgccgccatcccgcagatcgcggaactgaacatcggccacgccatcgtcgcccacgcgctgttcgtcggtttcccgcaggcggtgcgcgagatgaaggcgctgatggacagcgcccgctga

SEQ ID NO: 2151 - DNA, 738 bp, Chromobacterium substugae
atgagccagccgggcagggtggacaagcagcccgcttacattctgcatacccagccttatcgcgagaccagcctgctgctggaagtgctgactcgcgaccacggccgtttcagcctggtggcgcgcggcgcgcggcggccgcgttccgacctgcgcggcgtgctgttgccgttccagccgctgaccctgtcgtggttcggcaagggagaattgcgcacgctgcacggcgccgactgggacggcggggtgcggcccttgtccggcctgccgctggtctgcggcttttacctgaatgaattgatgatgaagctcacggcgcgggacgaccccgagccgcgggctttttccgtttacgacgccgcggtgcgcgacctggccgcgcggccgtcgctgtcgccggtattgcgccgctatgagttgcggctgagccaggtgctgggctacgcgccgtcgctgaagcgcgacagccgcggcgacgagatagacgccgagcgccactacctgtgccgcaacgcggccatgccggagctggacgagcagccgcatctggagttggccggcaaggcggcgcggctgtccggcgcggcgctgctggcgatagacgccgacgactattccgaacacgccacccgccgccaggcgcggcagctcagccgggtctggctggacgccctgctgggcgacgaaccgctggcggcgcgcgaattattgcaggccatccagtccctgtcggactga

SEQ ID NO: 2152 - DNA, 276 bp, Chromobacterium substugae
atgacaacgcggccgccgcaggcctgctgggcagtcagcctggcggcggaggcggcccgctccgatccggcccgctgcgtgctgcggctggcggcggcgcagccgggctatctgggcggcgaaggccgggtcacgtattgggattcggtcgaggccatcgcggcttggcgcgcccgcgccgagcaattggcgcggcagggcaggggcgcggatgacgcggcgccggagctgtccttcctggtgagccggatcgatccgcgggaatccagcgcatga

SEQ ID NO: 2153 - DNA, 891 bp, Chromobacterium substugae
atgaccgatacccctttccactgcggctttgtcgccatcgtcggccgccccaacgtgggcaaatcgacgctgatgaaccacctgatcggccagaagatcagcatcacctcgaaaaagtcgcaaaccacgcgccaccgcgtcaccggcatccataccgaagacgcggcgcagttcgtgtttgtcgacaccccgggcttccagacctaccacaagggcgcgctgaacgaggcgctgaataagagcgtcaaggattcgctcggcagcgtcgactgcgtgctgttcctgctggaggcgatgcgcttcaccgccgccgacaaggaagtgatggcgctgctgccgaagaagaccccggtgatcctggtggtgaacaagctggacaaggccaaggacaagctgacgctgcaggccttcatcaatgaggtgacggccgagttcgagttcgccggcgtcgaagtggtcagcgccaagcacggccagcgcctggccgagctgctggaccaggtgcgcccgcacctgcccgaatccatgcccttgtatccggaggacatggtcaccgacaagaacgagcgcttcctcgccgccgagatcgtccgcgaaaagctgttccgctatctgggcgaagagctgccgtacgagatgaacgtcgaagtggaaatgttcgagatggacggcgcgctgcgccgcatccatatcgcggtgctggtggacaaggagcatcagaagcccatcgtcatcggcaaggccggcgagaagctgaagaagatttccaccgaggcccgcctcgacatggaaaagctgttcgacggcaaggtatttctgcaggtgtgggtgaaggtgaagtccggctgggccgacgatgtccgcttcctgcgcgagttcggcctgaactga

SEQ ID NO: 2154 - DNA, 711 bp, Chromobacterium substugae
gtgacccaaatcgacaaccgtttccggcgcctgtcccaggcgctggattatgctttccagaaaccggaattgctgcgccaggccctgacgcaccgcagctacagcagcgccaacaacgagcgcttcgagttcgtcggcgacagcattctcaattacaccgtggcgcggatgctgttcgaccagtttccgcaactgaccgaaggcgaactgtcccggctgcgcgccaacctggtcaatcaaaacaccctggccgaaatcgcccatgagctgaaactgggcgactacctgtacctgggcgagggcgagctgaaaagcggcggcttcaaccgcccgtccatcctcgccgacgcgctggaggcgactttcgccgccgtcagcttcgacgccgacttcggcgccgccgaacaagtggtgcgccgcctgtacgaccagcgggtgtcgaccatagacaccacccgccaggccaaggacgccaagacccgcttgcaggaagcgctgcaagcgcgcaagctgcagttgccgaagtaccgcatcctgtcgcagagcggcgaggcgcatgagcaatggttcaaggtggagtgcgacctgggcgagctggccctgatatccaccggcgacggcggcagccgccgcgccgccgaacagcaggcggccgaagcggccctgaccctgctggaacagaaattcgctgcgagcaagaaaaaatcatga

SEQ ID NO: 2155 - DNA, 360 bp, Chromobacterium substugae
atgaggcagcagaaaggtttgtcggtaattgcggttttgttggttctggccctcgtcggcttcgcgctgttgctggtgttcaaggtggtgccggtttattccgaatacggcgacgtcaagtcgtcgctgagcgcgctgtccaccgagaccaatgtcggcgagcatacgctgcgccaggagttcgacgccaaggccagcgtggccggaatcgtctcgatcaagggcgacaacctgatcgtggtcgccggcggcaacggcaactatctgcgtgcccagtatcaccgcgaggtgccgctgttcggcaacgtcagcctgcttttcaatttcgacacccaggcaggtcaaccgcctgcccaataa

SEQ ID NO: 2156 - DNA, 951 bp, Chromobacterium substugae
gtggcggcggccgtggtcggcgccatcctggtggcgctgggcggcaagaagcaggacggcgacaaggactggccgcagtccgtgcagtggggctatctggccctggtgatcggcggcttcggcctgctgtccagctatatgagctttaccgcggtcatgctggtgttcgtgctgatcaccggcgtggtctgggccctggacaagtggctgctggcgaagaagcgcgccgccagcggcgcccagccgggacatttcgtcgattactcgcgcggcttcttcccggtgatcctggtggtgttcgtgctgcgctccttcctggtggagccgttccagattccgtccagctcgatgcgtccgggcctggtggtcggcgatttcatcctggtgaacaagttcacttacggcatccgcgtgccggtgctgaacaatgtgctgatcccggtgaacaaggtggagcacggcgacgtggtggtgttcaactacccgccggaaccgaagatcaactacatcaagcgcgtgatcggcctgccgggcgacacggtggaataccgcaacaagcggctcaccatcaacggcaagccgctgcaggatgtgccggacggcagctatgactacctggaaaaggacttgggcctgcagaccatcacggccaatcaataccgcgaaagtcaggccggcaagacctaccatgtattgaacaatgtcggcacgccggtggtggcgcttagccaggtgcgagatttcgactaccgcgacaactgccgctatgacgaggacggcttcgtctgcaaggtgccgcagggccactacttcatgatgggcgacaaccgcgacaacagctccgacggccgctactggggcttcgtcgacgacaagctgatggtgggcaaggccttcatgatctggatgaacttcggcaatctgtcgcgtatcggcacccaggtaaaataa

SEQ ID NO: 2157 - DNA, 1794 bp, Chromobacterium substugae
atgaagaacatccgaaatttttcgatcattgcccatatcgaccacggtaaatccaccctggccgaccgcttcattcaattctgcgggggcctggagctgcgcgaaatgagcgcccaggtgctcgactcgatggacatcgagaaagagcgcggcatcacgatcaaggcgcagaccgccgcgctgacctacaaggcgcgcgacggccagatctacaatctcaacctgatcgacaccccggggcacgtggacttcagctacgaagtgtcgcgctcgctgtccgcctgcgaaggcgcgctgctggtggtggacgcgtcgcaaggcgtggaagcccagaccgtggccaactgctacaccgccatcgagctgggcgtggaagtggtgccggtgctgaacaagatcgacctgccggcggccgacccggagcgcatctcgcaggaaatcgaagacatcatcggcatcgaggcggtggacgcggtgcgcgcgtcggccaagtccggcatcggcatcgaagacatcctggaagaagtggtcagcaagatcccgccgccgcagggcaatccggacggcccgctgaaggcgctgatcgtcgactcctggttcgacaactacgtcggcgtggtgatgctggtgcgggtgatcgacggctcgctgaagccgaaggacaagatcaagttcatggccaccggcgccgagcacctgtgcgaacaggtgggcgtgttcacgccgaaatcggtgcagaaacccagcctgagcgccggcgaagtgggcttcgtcatcgccggcatcaaggaattgaaatcggccaaggtcggcgacaccatcaccctggtgaacaaccaggccgccgaggcgctgccgggcttcaaggacgtgcagtcgcaggtattcgccggcctgtacccggtggaaagccacgattacgaagcgctgcgcgacgcgctggaaaagctgcagctgaacgacgcctcgctgaagtacgaaccggaagtgtcgcaggcgctgggtttcggcttccgttgcggcttcctcggcctcctgcacctggagatcgtccaggagcggctggagcgcgagttcgacatggacctgatcaccaccgcgccgacggtgaactacgaagtggtgatgaaggacggcacggtggaagtggtgtccaacccgtcgcggatgccggattccggcaagtatgaagatttgcgcgaacccatcatcacctccaccattctggtgccgcaggactatgtcggcgcagtgatgacgctgtgcaaccagaagcgcggctcgcagcgcaatatgcagtacatgggccgccaggtgatgctgacctacgacctgccgatgaacgaagtggtgatggacttcttcgacaagctcaagtccaccagccgaggctacgcctcgctcgactacgagttcaaggaattccagagcgccgacctggtcaagctggacgtgctggtcaacggcgagaaggtggatgccttgagcctgattgtgcaccgcgcttccagcgtgtaccgcggccgcgagctggtgtccaagatgcgcgaattgatcccgcgccagatgttcgacatcgcggtgcaggcggccatcggcggccacatcatcgcccgcgaaacggtgaaggcgctgcgcaagaacgtgttggccaagtgctacggcggcgacatcacccgtaagaaaaagctgctggaaaaacaaaaggccggcaagaagcggatgaagcaggtcggcaacgtggaaatcccgcaagaggctttcctggcgattcttcaagtaggggacaaataa

SEQ ID NO: 2158 - DNA, 240 bp, Chromobacterium substugae
gtgaagctgacattgtattttcgcgagtactgcagcctgtgccaccagatgctggccgagctcgcgccgtggcggcaacgctacggcttcgagctggaagtgctggatgtggatgccgacccggcgctggaggcccgtttcaacgaattggtgccggtgctgatggatggcgaggccgaaatctgccattggcatctggatgctgcgagattggctgcacacttgggcgaaatcggctaa

SEQ ID NO: 2159 - DNA, 936 bp, Chromobacterium substugae
atgttcggggccgcctgcgcggcccatgctgaggatgacatgcagctgttgcgcaacgtcggcaatgccggacggcagcaggcgctggatggcacctatctgcatcagatgaacggcatgttggaaaccttccgcatcgtccgccaggggcaaggcgacggggtgcgcgagaagcgcgtctcgttggacggcccctcgcgcgaggtggtgcgaaacggcggcgaactgacctgtttcgcgcccgacaagcgcgcgctgatggcgtgcaagatcagcgcgatgcggctgttcccggccttgctgccggacgatctggaagacatcacccgttcctacgtgctcaagcgcaccggttcggaccgggtggcgaagcgcgattgccagtggctggatttgcagccgcgcgatccgcagcgctactcgatgcggatgtgcatcgagcccagcacctacctgcccttgaaagtgatcaccctgtcgccgcgcggcgactcggtggagcaattcactttcaccgaggtggagctggccggcgcgaaggacaagaaggcgtacaagccgcggctggcgcagaagttcctgctgcggccggccaaggcgccggtgggcgctgatccgtcggtgtcgcagaacgaggtgagcggtctgccgcaaggtttccgcttgctgcgttcggtgcagcgcgtgctgccggggcagggcggcaagccggtgcgccatctggtgctgtcggacggcctggtgatgctgtcggtattcgtcgagccgccgccgcctgagaacgccaggctggagcgggtgggcaatctgcacggcgccatcaatatggccaccagctatcagggcgacatgcagctgactgcggtgggcgatatgccgcagacggcgatgatggcgctgctcaaaggcctgcacatcaatggcaagaacgattga

SEQ ID NO: 2160 - DNA, 477 bp, Chromobacterium substugae
atgaaagaaacgatatccgcgctgatggatggcgagctggacggaacagaagccgacaaggcgctttccgccatcgccgctgacaaggacctggatgcggcctgggaccaatatcacctgatcggagacgcgatgcgctccaatcgcatggcggggctgaatgtgcgcgccaaggtggccgagcgcatggtggacgagccgacggtgctcgcgccgcgccgctggatgcggccgcgccgcgcccgggcggccagcgcggtggccttggccgccagcgtcagcttcgcggcggtggtgggctggcagcagctcgcccaccgctccgcgccggcttcggccatcgcggaccggggcgtgccggtgcagatcgcccagccggcgatggagcaggacgatccctatgtgctggcgcaccaggaagtgaccgccgaccagagcgtgatgcgcgtgtcttacggaaacggagctcgccactga

SEQ ID NO: 2161 - DNA, 600 bp, Chromobacterium substugae
atgagtgatcgggacatcgatcaacagttggtggaacgtgcccagcgaggtgaaaaaagagctttcgatctgcttgttgccaagtatcagcgacgtctcgccaggctgttgtcgcggtttatccgcgacggttcggacatcgaggatgtgacgcaggaagcgtttatcaaagcgtatcgtgccttgccgtctttccggggtgagagcgcgttttacacatggctgtacaggatcggcatcaatactgccaagaatttcctcagcgccagcgggcgacgcccggtggtgaacagcgagatcgaggacgaggatggcgagagcttcgacatggcgtcgcagattcccgacatgaacacgcccgaaaccgagctgatgaacaaggagattctggcgacggtcaacgccgccgtggaggctttgccggaggaactgcgcaccgccatttcgctcagagaaatggagggcttgtcctacgatgaaatcgccagggtgatggactgtccgataggcaccgtgcgttcgcggattttccgggcgcgcgaggcaattgctgctgagctcaggcctctgctggatacggccaagaacagaaggtggtaa

SEQ ID NO: 2162 - DNA, 879 bp, Chromobacterium substugae
atgaacactcccgggcagcgtttccgccaggccgtggccgcagaaaaaccattgcaggtggtaggggcgatcaacgcctattccgcacgtttggccgaacactccggtttcaaggccctgtacttgtcgggcggcggcgtggccgcggcctcctgcggcattcccgacctcggcatcaccacgctggaagacgtgctgatcgacgtgcgccgcatcaccgacgcgagcgacctgccgctgctggtggacatcgacaccggctggggcggcgctttcaacatcgcccgcgcggtgcgcagcctggaaaaggccggcgccgccgccgtccatatcgaagaccaggtgcagcaaaaacgttgcggccaccgccccaacaaggccatcgtatcgcaggatgagatggtggaccgcatcaaggccgccaccgacgcccgccgcgacgacagcttcgtcatcatggcgcgcaccgacgcgctggcggtggaaggcctggacgccgccatcgaacgcgcagtcgcctgcgtggaagccggcgccgacatgattttcccggaagcgatgaccgacctcgccatgtaccagcagtttgccgaagcggtgaaagtgccggtactggccaatatcaccgaattcggctcgaccccgctttacaccaccgcggaattgggcgccaacggcgtcggcctggtgctgtatccactgtcggccttccgcgcgatgagccaggccgcgctcgccgtgtacggcgccatccgccgcgacggcacccagcgggcggtgctggacaccatgcagacccggatggacctgtacgaccacctgggctaccacgattacgaacaaaagctcgacgccctgttcgccgccggcaagcaataa

SEQ ID NO: 2163 - DNA, 1149 bp, Chromobacterium substugae
atgactgaagtggttctctccggcaaaccgaaaaaatccgtcgccctgtccggcgtcgccgccggcaacaccgcgctgtgcaccgtcggccgcagcggcaacgacctgcactaccgcggctacgacatcctcgatttggccgacaaggccgaattcgaggaagtggcctacctgctggtgcacggcaagctgccgaaccaggcggaactggccggctacaagaaaaagctgaaatcgctgcgcggcctgccggcttcggtaaaagcggtgctggaggcgctgccggccagcgcccacccgatggacgtgatgcgcagcggcgcgtccgccttgggttgcgcgctgccggagaaggacgaccacaacctggccggcgcgcgcgacatcgccgaccgcctgatggcctcattcggctccatcctgctctactggcaccactacagccacaacggcaagcgcatcgacgtcgaaaccgacgacgacagcataggcggccacttcctgcatctgctgcatggagtcaagccgccccaggaatgggtgcgggcgatgcacacctcgctgaacctgtacgccgagcacgaattcaacgcttccaccttcgccgcccgcgtcatcgccggcaccggctccgacatgcacagcgccatcaccggcgccatcggcgcgctgcgcggccccaagcacggcggcgccaacgaagtggcgttcgaaatccagcagcgctatgaaagcccggacgaagccgaggccgacatccgcgcccgcgtcgagcgcaaggaagtggtcatcggcttcggccacccggtctacaccgtgtccgacccgcgcaacgtggtgatcaaggaagtggcgcgcgaactgtcccggcaaaaccaggacatgaagatgttcgacatcgccgaacgtctggaaagcgtgatgtgggacgtcaagaaaatgttcccgaatctcgactggttctccgccgtcagctactacgcgatgggcgtgccgaccgcgatgttcaccccgctgttcgtgatcgcccgcaccagcggctggagcgcgcacgtgatcgagcaacgccaggacggcaaaatcatccgcccgtcggccaactacatcggcccggaagaccaggcctacatcccgctggaacagcgttga

SEQ ID NO: 2164 - DNA, 567 bp, Chromobacterium substugae
atgaagcaatcgttgttctggcagcgcctggattgtcccgggctggagcaagtccagctcgaaaccggctcaggcctgtctctttccgccagcggcagcctgctgcacgccgacagcggcgccagcctgcgctaccggatgcagctggaccatcacggccggctcagccacgcccacatcgacgtttccgcccccgaacccaggcaactgacgctgcagcacaccgaaagcggccgctggctgctcaacggccaggcccagccggcctgggacggctgccaggaactggacctgcaggcctgcggcctgaccaacgccttcccgatccgccgcctgaaactgggcgtcggcgacagcgtcgaactttccatgctgttcgtgcgcctgcccagcctggagccgacgcgctgcccgcagcgctacacccgcctgccggaccgcgacgggctggcctgctaccgctaccaatcgcccggcttcgccgccgacatcatcgtcgacgagcaaggcttcaccattcattacagcgactttctgcaacggctgcccgacagcggccgcgactga

SEQ ID NO: 2165 - DNA, 2604 bp, Chromobacterium substugae
atgaaccgccaataccgcaccgccctgcccggcaccgggctcgactatttcgacgcccgcgccgccgtggaggccatccagcccggcgcctgggacaagctgccctacaccggccgcatccacgccgaaaacctggtccgccgttgcgagccggcagccctgaccgaatgcctggaacaaatcgtctatcgcaagcgcgagcgcgatttcccctggttccccgcgcgcgtggtctgccacgacatcctgggccagaccgcgttggtggacctggccggcctgcgcgacgccatcgccgaccaaggcggcgacccggcccaggtcaacccggtggtgccggtgcaattgatcgtcgaccactcgctggcggtggagtgcggcggcttcgacccgcgagccttcgaaaaaaaccgcgcgatagaggacaggcgcaacgaggaccgcttccacttcatcgattggaccaagtccgccttcgacaatgtggacgtgatccccgccggcaacggcatcatgcaccagatcaacctggaaaagatgtcgccggtaattcacagcgacaagggcgtggcctatcccgacacctgcgtcggcaccgacagccacaccccgcatgtggacgcgctgggtgtgatcgccgtcggcgtgggcggcctggaggcggaaaacgtgatgctgggccgcgcctcgtggatgcggctgccggacatcgtcggcgtggagctggccggcaaaccggccgccggcatcaccgccaccgatatggtgctggcgctgaccgaattcctgcgccaacaaaaagtcgtcggcgcgtatctggaattttacggcgaaggcgcggcggcgctgacgctgggcgaccgcgccaccatctccaatatggcgccggagtacggcgcgacggcggcgctgttcttcatcgaccagcagactatcgattacctgaaactgaccggccgcagcgacgagcaggtgaagctggtggaaacctacgccaagaccgccggcctgtgggcggacagcctgaaaacggcagaatacgagcgcctactcacatttgacctctccagcgtggtccgtaatctggccggcccgtccaacccgcacaagcggctgccggtgtcggcgctggcagaacgcggcatcgcggtcaatctggcccaggcgcgcgaacaagaggcgcagggcctgctgccggacggcgcggtgatcatcgccgccatcaccagctgcaccaacaccagcaatccgcgcaatgtgatcgccgccggcctgttggcgcgcaacgccaacaagctgggcctggttcgcaagccgtgggtgaaatcctcgctggccccgggctccaaagcggtggagctgtatttgaaggaagccggcctgctgtccgagctggaacagctgggcttcggcatcgtcgccttcgcctgcaccacctgcaacggcatgtctggcgcgctcgacccgaaaatccagcaggaaatcctagaccgcgacctgtacgcgacagcggtgctgtccggcaaccgcaacttcgacggccgcatccacccctacgccaagcaggctttcctggcctcgccgccgctggtgatcgcctacgccatcgccggcaccatgcgcttcgacatcgaaaaagacgtcttgggcatcgccgacggcaaggaaatccgcctgcgggacatctggccgtccgacgccgaaatcgacgcggtgctgaagcaatcggtgaagccggagcagttccgccaagtctacgagccgatgttcgccatccaccgcgacagcgccgccaaagccagcccgctatacgcctggcggccgcagagcacctatatccgccgcccgccgtactgggagggcgcgctggccggcgagcgcacgctgaagggcatgcgcccgctcgccttgctgccggacaacatcaccaccgaccacctgtcgccgtccaacgccatcctggccagctccgccgccggcgagtacctggcgaagatgggcctgccggaagaggatttcaattcctacgccacccaccgcggcgaccacctgaccgcgcagcgcgccaccttcgccaacccgcagttggtcaatgaaatggccgtggtggacggcgaggtgcaaaagggctcgctggcccgagtggagccggaaggcaaggtgatgcggatgtgggaagccatcgaaacctatatggaccgcaagcagccgctgatcatcgtcgccggcgccgactacggccagggcagctcgcgcgactgggcggccaagggcgtgcggttggcgggcgtggaggccatcgccgccgaaggcttcgagcgcatccaccggactaacttgattggaatgggcgtgctgccgctggagttcaagcccggcgtcaaccgcaagactttgcagctggatggcaccgaaacctacgacgtgatcggccagcgccagccgcgcgccgacctggccctggtgatccatcgccgcagcggcgaaacagtgcaagtcgccgtgacctgtaggctggacaccgcggaagaagtgtcgatctacgaggctggcggcgtattgcagcgcttcgctcaggatttcctggcggcggcgcaagcctga

SEQ ID NO: 2166 - DNA, 1191 bp, Chromobacterium substugae
atgactcacccggctcagattcgcattcccgccacctatatgcgcggcggcaccagcaagggagtatttttccggctgcaggacctgccggaagccgcccgccagcccggcgcggcacgggacaaactgctgctgcgcgtcatcggcagcccggacccgtacggcaagcagatagacggcatgggaggcgcaacgtccagcaccagtaaaaccgtcatcgtgtcccaatccacccggccgaatcacgatgtcgactacctgttcggccaggtcgccatcgacaaggccttcgtcgactggaccggcaactgcggcaacctgtcagccgccgtcggccctttcgccatcgccaatcgcctgatcgacccggcgcgcgtgccggagcatggcatctgcaccgtgcgcatctggcaggccaatatcggcaagaccatcatcgcccacgtgcccgtcagcgacggccaagtgcaggaaaccggcgatttcgagctggacggcgtcaccttccccgccgccgaggtgcagctggaattcctcgacccggcagatgagggagacggcgacggcggcgcgatgtttcccaccggcaagctggtcgacacgctggaagtgccgggcgtcggcgccttcccggccacgctgatcaatgccggcatccccaccatcttcgtcaacgccgccgacatcggctacaccggcacggaattgcaggacgcgatcaattccgatccggcggcgctggcgcgtttcgaaaccatccgcgcccacggcgcgctgagaatggggctgatcaagagcctggacgagatcgccggccgccagcacacgcccaagatcgccttcgtcgcgccgccggccgactacaccgcgtccagcggcaagccagtcaaaacctccgatatcgacgtactggcgcgggcgatgtcaatgggcaagctgcaccacgcgatgatgggcaccgcggcggtggccatcggcaccgccgcggccattcccggcacgctggtcaacctggccgccggcggcggcaagcgccaggcggtgcgtttcggccatccgtccggcacgctgcgggtgggcgcgcaggcccgcgaggaacgcggcgaatgggtggtcaccaaggcgatcatgagccgcagcgcccgcgtgctgatggaaggctgggtgcgagtgccgggcgacgccttctga

SEQ ID NO: 2167 - DNA, 441 bp, Chromobacterium substugae
atgacggccagccggcgcgacaaagacatgaattccatctgcatggccatccgcgccggcccgactgaatctcaaccggaacccgccgccatgagcacccccgcccccatcctgaccgcctccaccgactggcactggagccccacgccctatcccggcgtggacttcacctggctgcgccgcaatccggacggcggcggctcggccttgctcaagctggccaagggcgcgaagctgccgctgcaccgccatcccggcgccgagcaggtgttcgtcaccgccggccggctgaaaataggcgcccacgtgctgggcaagggcgaccatctgttcatcgacgcccatgtcccgcattcggtagaggcgctgcaatccgccgtctatctcaccgtatcggaaaacgacggcgtggaattgctgccgccggaccaggctggctga

SEQ ID NO: 2168 - DNA, 1077 bp, Chromobacterium substugae
atgaacagcatgaaagcgacggtcttcgtcgcgccgggccggatagaactgcgcgagaagccgattccggcggtggggccgggcgatgcgttggtgcgggtcaccaccaccaccatttgcggcaccgacgtgcatattctgaagggcgagtatccggtggcgtcgggtctgaccatcggccacgaaccggtgggggtgatcgagaagctgggcgcggacgtcaagggctatcgcgaagggcagcgggtgatcgccggcgcgatctgtcccagcttcacctcctacggctgtcaggacggccatccggcgcaggatggcggctgcgaatgccacggctacaaaccgatgggcggctggcgtttcggcaacaccatagacggcacccaggccgagtacgtgctggtgccggacgcccaggccaatctggcgccgattccggacgggctcagcgacgagcaggtgctgatgtgtccggacatcatgtccaccggcttcgccggcgctgaggcggccaatatcaagatcggcgacgtggtggcggtgttcgcccaggggccgataggtttgtgcgcggtggcgggcgcgcgcttgcgcggcgcgtcgtgcatcatcgcggtggacgggatagacgacaggctggcgatttcgcggcggctgggcgccgacatcacgctgaatttccgccaggtggatgtgatctcggaaattctgaagctgaccggcggccgcggcgtcgattcggccattgaggcgctgggcacccagggcacgttcgagtcggcgctgcggatattgaagccgggcggcaccttgtccagcctgggcgtgtactccaccgatctgagaatcccgctggacgcgttccatgccggcctgggcgacaagaggatcgtgtcttcgctgtgcccgggcggcaaggagcggatgcggcggctgatgaatgtgctggggagcgaccggctggacttgtcgccattggtcacccatcgctacaagctggaccagatcgtcgaagcttacgacctattctcgcaccagcgcgacggcgtgctgaaggtagcgatcaagccgttctag

SEQ ID NO: 2169 - DNA, 858 bp, Chromobacterium substugae
atgaacaagccgatgcgctacgcgctcgccgccatcgccatgtgggcctcagtcgccaccctcagttcgctcacccatgccctgccgcccttcttcgtcgccggcgtcggcttgatcttgggcagcctgttgaccgcgcgccgcgccgcggaatggaaagtgccgctgaaaagcttcgccaatggggtttacggcatcttcggcttctactttttcctgttcaacgcctaccggctggcgccggtgatggatgccaccgtgctcagctacatctggccgctgctgatggtgctgctgtcgccgctgctgctgccgggcacccggctgggcgccaaccacatcctgggcagcctgatcggcttcgccggcgcggcgctgatcgtcaccggcggcaagctgtcgctatcgctgtccgcgctgcccggctacctgatggcgctgggcgccgccgtggtgtgggccacctacagcctgttcacccgccgcctgcccgccacctccgacaacgccgtaggcggctactgcctcgcctccggcctgctggcgctggcgctgcacttcgccactgagcccgccgcccacccgtcggccatccagtggctgatgatcgccgtggtgggcctgctgccgatgggcgcggccttcctgtgctggaaccgcgcgatgcagctgggcgatccgcgccagataggcgcgctgggcaacgccaccccgctgctgtccacgctgatgctggtcgcatccggccaggccgcgctcaacggctccgccgcgctggccatcgccatgatcgtcggcggcgccgcgctgggcacgctgccggcgcggcgcctgctgccccgctggctgcaagcctga

SEQ ID NO: 2170 - DNA, 936 bp, Chromobacterium substugae
atgactttagaccattcaaaacaagtacaagatctctttgtccagcatctgaacggcagcgccaacggcattgccgtgctggacgccgaggatcgctttcttttctacaaccagtccttcatcaccatgttcgcctttgaaggcatttccatgatcggcaagccttatgacgacttgatggcccgcgccttcaatctgcggctgatcgcggaatgcggcaaaaccacgctggaggcctggctggaggtggttcacgcccgccaccgcacccaggaggtgtggaactacgagatggagtggacggacaagcgctggctgctgctgaccaagcaggtataccagcagggcatgatggtgatggtctgcgccgacatcacccggcacaagcagaccgaattggcgctgcgcgccgcccatgccgagctggagcggctggccatgacagacgaactgaccggcatctcgaaccgccgccacttcctcgcgcagatggagcgggaatacgaacgcgccaaacgctaccagcaccccgccagcctggtgatgttcgacctggaccacttcaagcgcgtcaacgacagctacggccacccagccggcgacctggtgttgaaacacttcgccgactccctggccgcccatgcccgcgaccaggatgcgctggggcggctgggcggcgaagaattcgccctgttgctgccggaaaccagcgccgccggcgcgatgagcctgctggagcgcgtgcggaccgagctggcgaacgccagcctggaattcgtcgcgcccggcttttcctacactttctccgccggcgtggcggagttgtccattccgcccggattcgaccgccgccactggattcaggctgccgatcaggcgctgtaccaggccaaggcatacggccgcaaccgctcggtcatctaccgggacggctag

SEQ ID NO: 2171 - DNA, 1392 bp, Chromobacterium substugae
atggatctattcgacgcaattcacctcgccagattgcagttcgccttcacggtttccgtgcacatcatctttccggcgatcagcatcgggatggccagcttcctggcggtgctggaatggcgctggatcgcgacaggcgaccgcgcctacaaggacatgtacctgttctggtcgaaaatcttcgccatcggcttcgggatgggggtggtttccggcgtggtgatggcttatgagttcggcaccaactggagcggcttctcccgcgtggcggggaatatcaccggcccgctgctgacctacgaggtgctgaccgcgttttttctcgaagccggctttctcggcatcatgctgttcggctgggagcgggtcggcccgcgcgcgcacttcttcgccacgctgatggtcgcgatcggcacgctgatttccacgttctggattctcgcctccaacagcttcatgcagacgccgcaaggctttgccatcgaaaacggccgcatcgtcccggtggactggctgaaggtgattttcaatccctcgttcccgtaccggctcgcccacatgaccatcgccgccttcatcgtggcgggcttcatcgtcgccgcctgcggcgcctggcacctgctgcgcggccgcgacgacgcgccgatcaagcgcagcttctcgatggggctgtggatcttgctgctgctgacgccgatacagattctggtcggcgacgcccatggcctcaacacgcgccaataccagcccgcgaagatcgccgccatcgaggggttgtgggaaaccgagaaaggcggcaccgcgctgaacctgatcgggctgccggacatgcaggcggaaacgacgcgctatgcgatccaggcgccgcatcttggcagcctgatcctcacccatagctggaccggggagatccgcggcctgaaggaatttccgccgcgggaccgcccctattcgcccatcctgttctggactttccgcatcatggccggcctgggcatgctgatgctgctgacggcgctgctcggcctgctgctgcgccgcggcggccgcctctaccatgcccgctggtttcaacgcctggtgctgtgcatggggccatccggcctggtggccttgctggccggatggatcaccaccgaagtcggccggcagccctggaccgtgtacggcgtgctgagaaccgaagactcggtatctcccatcaccgcccagcaggccggcgtgtcgctgctgattttcgtgatcgtgtatttcctggttttcggcgtgggagtctactacatgctgaaactgatgaagcacggccccgccgcgcatgccgcgcatggcgagccgatggcgcacccgggtttgcacaatcgcgcgctggacatgctggaagaagaggagtaa

SEQ ID NO: 2172 - DNA, 1008 bp, Chromobacterium substugae
atgcagatcgatcttcccgtcgtgtgggccgcgatcatcgggctgggcgtcttcatctacgtggtgctggacgggttcgacctcggcattggcttgctgtttccgtttttcgagctgaaaaacgagcggcaagtgatgctgaacaccatcgcgccattctgggatggcaacgagacctttctcgtgctgggcggcgccggcctgtacggcgcgttcccggtggtttactccaccctgctgccggccaactacctgcccctgatcatgatggtgatcgggctgatcttccgcggcgccgccttcgaattgcgcgccaaggccaagcgcacacagcacttgtgggacctggccttcatctgcggctcggcgctggcggcgttctgccagggcatcgtgctgggctcgctgctgcaagggatcaaaatcgccgacgggcaattcgtcggcgggccgttcgactggctctcgccgttcagcatcttttgcgggataggcgtgctgatcacctacgcgacgctgggctgcgcctggttgatcctgaaaaccgacggcgaactgcagagaaagatgttttccttgatgcggccaatggccggcaccttgcttggcgtcatcgccatcatcagcctgtggacggtgctgggcttgcccgccgtcgcctaccgctggtttggcagcggccatctcggctggtttctgcccgtgcccatcctggtgctggcgtcggtttggggagtctaccgcgcgatccgccggcaaaatgattccctgccttttctcctgacgctggcgctgtgctttctgggctacagcggcctggtcatcagcatctggcccaacatcattccgccatcgctgaccatatggcaggcatcgtccagccactccagccagttattcgcgctggtcggcacggtgatcatcctgcccatcatttttgtctacaacatcatgcaataccgcgtattccggggaaaggtccgcgaaggcgacgccggttatcattga

SEQ ID NO: 2173 - DNA, 147 bp, Chromobacterium substugae
atgatcatccggccgatgcccaattggttccgcatgctgttcgtgtggaacggctccgcgccgcagtccatgattccccagctgatatttgccgcatcgccaacccgcaaaagcggcgccgcccagccggctcaggtcaggatgtaa

SEQ ID NO: 2174 - DNA, 891 bp, Chromobacterium substugae
atgattgtgcgctctgaaagcagctggctgaagctgctgttcgtttgggaggggtcggttattcggcggatcatcccccagcttttgttcatggccgggatcagcggggtggcgctgttgaccgatgggcatgtgttcggcgataaaatccctctgaataccgtgccgttcacgctggtgggcgtggcgctgacgatatttctggcattccgcaacaatgccagttacgaccgctattgggaggcgcgcaagctgtgggggcactttctgatcgccatccgcagcctggcgtcgatggtgatttccattcggagcgcccagccggccatggcggcggagggcgaggccatcatccgcaagctgttgctgctgcctagcctgctgaaaagccagttgcgcggcgatgcgcttgaaaatgccagctgcgcgggaaaagcgtacaaaccgaccgtgctgtgccatgaaacacgccgcgccttgtacgcgttgaatcggcaaggcctggtgacggacatgcagttattggcctgcgatgggcagatgggcgagatcttcaatgtgataggcggctgcgagcgcatcaaatcgacgccgattccgttcgtgtattcggtattgctgcaccggaccgtatatatctactgcctgttcttgccgttcggcctggtggacatcatcagttacgccacgcctttcatcacggtgttcctgtcttataccttgttcgcgctggagtctatcgccagcgagctggccgagccgttttcctgttcgcccaacggcctgccgctggatgcgatgacgcgcaccatagaacgcaccgtgctggagttgaatgatgaagccctgccgtcggattggcgggtgggcagccattacatcctgacctga

SEQ ID NO: 2175 - DNA, 1068 bp, Chromobacterium substugae
atgagcgaacagtcagcgcaagacaagagcggaatggcggtgttggacgcgctgcggcgcccgttgctggatctgcgcctgtcggtaatcgacaagtgcaatttccgctgtccgtactgcatgccgaaagacgtgttcggcaaggactatgcgttcctgaaacatgcccagctgctgtcgttcgacgaaatgcgcaagatggcgggcgccttcgtcgcgctgggggtggagaaaatacgcatcaccggcggcgagcccttgctgcgcaaggacatcgagcgcttgatcgaatcgctggcgcggctgagcaccccggcgggaaaaagcgtttccgtgtcgatgaccaccaatggcgtgttgttgggcgccaaggcgcaaagcctgaaagacgcggggctggaacgggtcacggtaagcctggacagcctggacgacggcattttccggcagatgaacgatgtcggcatcggcgtcgggcgggtgttggacggcatagcggccgcctgccgggttgggctggcgccggtcaagatcaacaccgtggtgcagaacggcttgaatgacggccagatcctgcccatcgccgactatttccgccatagcggcgtcaccgtgcgcttcatcgaattcatggacgtaggcggcgcagccaactggagcggcgccagcgttttgcgttcggagcaggtgcgggagcggatcgagcggcggcatgcgttgatcgcggcgccggtcgagcgggccagcgataccgcccgctatttccagtacgccgatggcggcggcgaggtcggcttcatctccagcatgtccgcgccgttttgcggagactgcagccgcgcccgggtctccgccgacggccagctgtttacctgcctgttcgccaatcgctcgctcgatctgcgcccctatcttggcgagcaggtttctcccgccgccttgcagaccgtcatcgcgtcggcctggcgcgcgcgggacgaccgctattccgaatggcgcggcgagcaatatcgcgagcacggacggaaaaaatacccgacggtgcggatgtccttggtcgggggctga

SEQ ID NO: 2176 - DNA, 261 bp, Chromobacterium substugae
atggacgaaccgaacgatcaggtcttgctggcggtgctggcccagctgtggcaggccgcgctgaaggaccgcgagcggccttggtcgctggcccggctgtccaagcagtcgggcgtgccgatgagctcgctgcggcgctggctgagctatctgcgcgccagcgcgctggtggaggtggcgatgcgcgaagacggctgcgtcggcaccgcctggctgacagaggaggggctttgtgcctgccgggaactgtttgcggcatga

SEQ ID NO: 2177 - DNA, 987 bp, Chromobacterium substugae
atgacacctacttccacgcaggagctgctgagccatgcctggttcggcatcatcggcctgatgcttttgctgtacgtcgtgaccgacggtttcgacctgggcgtcggcatcctgtcgctgttccagcgcaagcagcatgaacgggatctgatgatccagtcgatcggccatgtctgggacgccaacgaaacctggctggtggcgctgggcggcgcgctgttcggggctttccccgcggcttacgccatgctgatgacccagctgtatgtgccggtgatggcgttgatcgccagcttcatgatgcgcggcgcgtccatcgagttccgccatctcgcccgcggcagcaaggcgttctgggaccgggtgttcggcctcggcagcctgctggcggcgctggcgcaaggcctgattctgggccgggtgatcagcggcctggcgcccggcatccaggcggacgcgttcgtggcggtgacggccataggcgtggcgtccggctacagcttgctgggcgcgacctggttggtgaagaaaaccacggggcaactgcaaaaccgcgcccgccgcggcgcggtggcgtcggtgtgcgccacggtgctggccgccatcgtggtgtcgctgggcacgctgtatttcagcccggtcggcctggggcggtggcaggatggcggcaccctgcatgtgctgatggggctgggcctgctggcggcgctcgcctttgtctatgtgctgtacgccgtctacaccggcggcgagcacagcccgtttgtcggcgcctgcctgctgttcaccgcgtcgtttgccgggctcgccatcagcctattcccgtggctggtgccgggcaagttgacgattgcggcggcggcctccaacagcgcctcgctggccttcatgctgctgggcataggcacggtgctgccgatcatgatcggctacaacctgtaccaataccatttgttccgcggcaaggtggcgttggcgccgcattga

SEQ ID NO: 2178 - DNA, 1407 bp, Chromobacterium substugae
atggtgattgatatgtctgtcgaatccctggatcttgcgcgcggccagttcgcgctgaccgcgatcttccacatcttgtggcccatcctcaccatcagcctgtccggctttctggtgattgtcgaaactctgtgggtgcgcaccagcaatctcgtctggtaccaccacgcccgtttctggagcaagctgctgctgctcaacttcgccgtcggcgtcgccaccggcatcccgatggagtttcagttcggcaccaactgggggccgttctccgaatacaccgggcagttcttcggcaacatcctgggctttgaaggcgcgatggccttcatgctggaggccggcttcgtcggcatcatgatgttcggctgggacaaggtgtcccgccagatgcacttgttcgccacggccatggtggctttcggctcctcgctgtcggcgttctggatcatggtggccaattcctggctgcaaaccccggccggcgtcatcgtggtgggcggcaagctggtggtgaccgactatctcgccgccattttcaacccggacatggtgtggggcgtcagccatatgtggttcgccgcgatggagaccgggctggtggtggtggcgggcatttcggcctggtatctgctcaagcgccgccatccggcgttcttcgcccggtcttttcgcctggccttgctgttgctggcgatcgccgcgccgctgcagatctggttgggggattccagcggggtggatgtgtttgaaacccagccggccaagggcgcggccatcgaaggccattgggaaaccaatacgccgggcagcggcgccaattggtcgctgatcgcctggcccaatgccgaacggcagcgtaatgactggtcgctggaggtgcccggcatgctcagcctgctggccacccatacgctgcatgggcagatcaagggcctgcgcgacattcccaaggccgatcagccgccgatgctgcccttgctgtactacgccttccgcgtgatggcgggcatcggtttcctgttcatggcgctggcgttctggagcatgtacgcgatccgcaaggcgcgcggccgcctggacagcctgctggcgcagcgcaagctgctgtgggcctgggtgctggccattcccttgccctacatcgcagtggaatgcggctggatcgtgcgcgaggtcgggcgtcagccgtggaccgtctacggcatgctgcgcaccgaacacgccgcatcggcgattcctgcggctacgctgagcggcagcaccatgatgttcggcgtcttcttcgtcgtgatgctggcgtctttcttcgtgttcgcccgccgctggctgcaaaaaggcccggacctggcgctgcgtcccgcggccatgccggagcggctggatcaagcgcgcggcttcgaacactga

SEQ ID NO: 2179 - DNA, 2328 bp, Chromobacterium substugae
atggacaagtcaaatccaccgggaaagatcgaaccctaccaccatcccgccgcgggctggggcgcgctgaaatatgtggcgatcaatctgatcaaggaacgggtgtcgggcgggaattaccgcatgctgttcaaacagaatcagccggatggcttcgattgccccggctgcgcctggcccgaccgccagcatgcctccacgtttgaattctgcgagaacggcgtcaaggcggtggcggcggaagccaccaccaagcgcgtgacgccggccttcttcgccgagaacaccgtcgagtctctgatgcagcagaccgactacgagctggagcagcacggccggctgaccgagccgatgagctatgacgccgccagcgacacatacgtccccatctcctggccgcaggcgttcgaatgcatcgccgggcatttgaatcgcctgccctcggcgaaccaggcggcgttctacacctccggccgcgccagcaatgaggccgccttcctctaccagctgttcgtgcgcatgctgggcaccaacaattttcccgactgttccaatatgtgccacgaggccaccagccgcggcctgcccggtacggtgggggtgggcaagggaacggtgacgctggacgatttcgagaaggccgacaccatcatcatcttcggccagaacccggccaccaaccatccgcgcatgctgggcgaattgcgcgaggcggcgcgccgcggcgcgatcatcgtttcggtcaatccgctgcgcgagcgcggcctggagcgcttcgccagcccgcagcacccgatcgagatgatcaccatgggcagcacgccgattgcctccaccttcatccagcccaggctgggcggcgatttcgcgctgatcaagggcgtggccaaatatgtgctggcgcgcgacgacgaggcccgcgccaagggcgagccgggcattctggatagggacttcatccagcgccacacgctggggttcgacgccttcgccgacgacctgcgccgggaagactgggcgctgctggaggccgaatccggcgtcgcgcgcgccgacatcgaaaacctgggccgcatctacgccgcgggcgagcgggtgatcgccacctgggggatgggcatcacccagcacaagcattcgctgcaaacggtgcagctgttgtccaatctgctgatgatgcgcggccatatcggccgcgaaggcgccggcatctgcccggtgcgcggccactccaatgtgcagggcaaccgcacggtgggcatcgaggaaaagccgtcgatggcttttctcgaccgcctgggcgaggtgttcggcttcgagccgccgcgcgagcacggcctggacgtggtggaaaccatcgaacacatgctgcacggcaaggtgaaggtattcgtcggcctgggcggcaacttcgcgatggcaacgccggacaccctgcgcactttcgagggcctgcgcgcctgcgatctcaccgtgcacatcaccaccaagctcaaccgcagccacctggtgcacggcaaggccgcgctgatcctgccgacgctgggccgcaccgaaatcgacgaccgctccggcgtggcgcagggcatcacggtggaggactcgatgagcatggtgcacatctcctatggtatgaacacgccggcctcgcccgatctgttgtccgaaaccgccatcatcgcccatatcgccgatgccacgctgggcgacgccaaagcgccgtggctggaatacgcgcgcgattacggcaaaatccgcgacgccatcgagcgggtgatacccggtttcgaagactacaacgcgcgcatccagcagccggggggcttccatctgcgcgtggcctcgcgcgagcgggcgtgggaaaccgccagcggcaaggccaatttcatcgcccacccggtgcagcgcgacacgccgatcagccgcgcccgcaagctgcatggcgaacggctgatgacgctgatgaccacccgttcccacgaccagtacaacaccaccatctatgcgttggatgaccgctatcgcggcgtgttcggccagcgccgggtcattttcatccatccggccgacatcgccatgctgggtttccaggatggcgactgggtgaacatttccacggtgtgggaggacggcatcgaccgccacgccaattatttccgcctggtcagctacgacattccgcgcggctgcatcgccggctattacccggaaaccaacccgctggtgccgctggacagcgtgggcgatgtctgcaacacgccgacgtccaaatcgataccggtgctgttgcacctgtccgccgcgccgccggtgatgccggcgttttga

SEQ ID NO: 2180 - DNA, 1431 bp, Chromobacterium substugae
atgaaaatgtatgaaacgctggcccgcgaactggagcagcatgtgatgtcgggcatgttgaaagccggcgacaaggtgccgtcagtccggcaattgagccagcaacgcgacatcagcatcaccaccgtattgaaggcctactcgctgctggaaagccggggcgtcatcgaaagccggccgcaatccggctatttcgtgcgcaaagccacgctcgccggccatgccgccgccatgccggcgccaatgccgcccacgctcaggccccatccggtcgccagcaatgtcgagatcagccagctggtattgcgcaccttgaaaaccatcagccggcacgacgccgtgccgctgggatcgccctatcccgaccccacgcccttccccttggtcaggctcagccatctggccaacaatatcgccaaaaagagcagcggctggggcgtgctaaatgacttgccgccgggcaacatagacctcatccgccagatcgccggacgctatttcctcaatggcctgctggtggatcccgccgaagtcatcatcaccgtcggcgccaccgaggcgctgaatctttgcctgcaggccgccgcccggcctggcgacaccatcgccgtggaatcgccgacctactacgccatcctgcatgcgatagagcgcatgggaatgcgggcgatagaaattcccaccagcggcacaagcggcatggatgtggactacctggaaagcatcctggaatcggacaatatcgctgcctgcatggtgatgccgaattttcacaatccattgggcatcgtcatgccggaagcgaacaagaaaaagctggtggagatcatgacccgggccaagaagcccatcatcgaaaacgcggtctacaacgagctttactactccgacacgccgccaagctcgctcaagcaatacgacaccgaaggctatgtgctgcattgctcgtcgttctccaaaaccttgtcgtccgcattccgcatcggctgggccatgccgggcagataccgggaaaaggtcgagaacctgaaattcgtcaatacgctcagcacctcggccattccgcaaatggccatcgccgagtatctgtcgcaaggcggctatgatcagcatctgcggaaaataagaaaattctatcagcagcaggcaaaaatcatcacccatgtggtgagacggtttttccccgaggcgtgcatcatttccgagcccgccggcggctatttgctctgggtgcagctgccgccgcatattgacgcgatgcggctgtacaacgaggcgctggagagaaaaatcaccataggcccgggcaccattttttccaataccggaaaattcagaaactgcattcgcctgaattacagttattcatggtctaaagaaatcgaatccgccatcgtcaccctgggaaaaatcatttcccactacaaatga

SEQ ID NO: 2181 - DNA, 903 bp, Chromobacterium substugae
atggcaaaacactggggcaaggtgctgacggcgatggtgacgccgttcgacgccgacggccggctcaatcttgacgcggcccgcgcgctggcgcggcgcctggccgacaacggcagcgatggcctggtggtggcggccaccaccggcgaagcgccgaccctgtccgacgccgaacgcttcgacctgatccgcgcggtcagcgaggcggtgaccatcccggtgctggccggcaccggcagcaacgacacccgccacgcgctggcgctcaccgcccgcgccgaggagctgggcgccgccggcgccttcctggtgtcgccgtactacaaccgcccgccgcaagccggcatcgaggcgcattttcgcgcgctggccgccgccacgcgcttgccggtgatgctgtacgacgtgcccggccgcaccggccgccgcatcgcccgcgacgtgctgctgcgcctgctgggcgaggtggacaacatcgtcgccttcaaggacgccaccggcgatccggccgccgccgccagcctggtggccgaggccggcgaccgtttcgagctgtactccggcgacgacgcgctgaccctgcccctgctggccatcggcgcggtcggcgtggtgggcacctccacccactggaccggcccggagttcgccgcgatgatcgccgccttcgagcagggcgacgtgcgccgcgcgcgcgccatcaacgcggcgctgcagccgtcgttcgccttctccaataccgacgactctgtgtactcgatgtcggtgaaggcgatgctgcgcggccagggcctggccgtcggcgagtgccggctgccgctgccggccgcgccggaaaacgtgggacggcaggccgccgaagtctggcgccggctggaagcctggcgcgccggccaacgctga

SEQ ID NO: 2182 - DNA, 501 bp, Chromobacterium substugae
atgccgtcttttgatgtcgtttccgaagtaaacaaggtggaagtgcgcaacgcgctggatcaggccaacaaagaagtgggcaaccgatatgacttcaagggcagcgacgcccgcatcgagttcaacgacaaggaagtcaccctgttcggcgacaccgagttccagctggaccaggtcaacgaggtgatggtgggcaagctggccaagcgcggcgtcgatgtgcgcagcctggactacggcaagctggagaaagtgtccggcaacaaggtgaagaaggtattgaagatcaaggaaggcctggattccgacctggcgaagaaaatcgtcaagctgctgaaggattccaagatgaaggtgcaggccagcatccagggcgaggcggttagggtgtccggcgccaagcgcgacgtgctgcaggaagccatcgcgctgctgcgcaaggatatcggcgacgacctggaaaacggctcgccgctgcagttcaacaacttccgcgactga

SEQ ID NO: 2183 - DNA, 636 bp, Chromobacterium substugae
atgctcgtcaccctgccccaactggccgcttttctcgccgccgccgtgctgatcacgctgtcgcccggccccgacaacctgatggtgctcagccagggcatctcgcgcggccgccgccacggcatggccttcggcctgggttgcgcgctgggctgcctcaaccacaccgcgctggccgcattgggcatcagcgcgctgatcgccgcctcgcccgccgccttcgccgcgctgaagatcgccggcggcggctacctggtttacctgggctggggcgccatccgcagcccgggcgtcggcttcgatgccggcggcgatggcgcgggtccgcagggttcgctggccgccaccttccgccgcggcctgatcgccaacgccatcaaccccaaagtggtgctgtttttcctggcctttttgccgcagttcgtcaatccggcgcaaggcccggccgggctgcaaaccgccatcctgggcacgctgttctccgcccagggcgcgctgatcttcggcgcgctgggctatttctccggccatgtcggccaatggctggccagaagccgcaagaccggacagtggctggaccggacggccggcgccatcttcatcgcgctggggctgcgtctgatcctggcgcgctga

SEQ ID NO: 2184 - DNA, 180 bp, Chromobacterium substugae
atgcttattgccctcagccctgccgcctacgcctacatcgaccccagctccaccctgtttgcctggcaaggcgctttagccctgctgggcggactgctggttttcgtcaaagcccccgtctcctcgctcaagcgcttgttgcgccgagtcttcaagaggaaagacgacgatcatgcgtga

SEQ ID NO: 2185 - DNA, 648 bp, Chromobacterium substugae
atgcgtgacccgctaggccacctggaactgaaggaacgcaccgccgtccgctcgctgtacgccccgctggagccaagccactacttgcacagccccctgtcgcagcagctggtcggccagggcatgctgctggacttcgactttctgggcagctccggcatcgtctccgaacggctgcccttcgtcagctacccgcacgaatggtcggcgccgcaattgcgcgacgcggcgcggctgacgctggacatctcccgcaacttgctggaatcgggctgggagctgaaggacacctcggcctggaacgtgctgttcaaaggctgcgcgccgatcttctgcgaccacctgtcgttccagcccatcgccagccgccactggtgggccttcggccagtatctgcagcatttcgtgtttccgctatgcgtcgcccgttatcgcgactttccggtcagcgacagcttcctgctcagccgcgacgggctggacgccgcgcgcttccgcgcgctgatgggcacgcgcatcttcgccacccgcttctggccgctggccctgggccgcggcagcggcccggctaccacggcaatctgtacagcctgctggactggtttctggcggctaccgcgcgccagagcggccgtagcgcctggatag

SEQ ID NO: 2186 - DNA, 381 bp, Chromobacterium substugae
gtggccaatctggacgatctggacggcggccgcggctggggcggcgccgaattcaacggcctgcccgcgcgcctggccgcggtgacagaattggcgctgatgctggcgctgactcaccacctggcgatttcgctttccatcccctaccgcaagatcgccgaattcgccgccgcctccacccggaaatggctgatcgtcgaactgatcgaagaaaacgatccgctggtggaacggctatgccgcgaacgcaagcgccatcccgccgaatttccgctgtcgctgcagcgcgccgcctttctggaacgcttccgcctgctgggagagcagcaattgcccggcatcggccgccacctgctggcgctggaaaaacggcaagcatga

SEQ ID NO: 2187 - DNA, 429 bp, Chromobacterium substugae
atgagccgccgcgccgacagctgggtcctagcgctcgccatcgcgctgggcgccaccgtctgctggctgccggcctggcaggccgcagcgcgctaccatggcggctacagcgtcgccgaaaccgccgcttacctgctgctgccggcgctggcggctgtcctgctcgccggcatggcagccgcgctgggcgcgcgcggccgccagttgctgtgcgcgctgctgctgctcaccgctctctacctgcttcacaagtttgtccgcggcctgctgcccgccgccccggccttgccgcccggacggtcattttcctgctttgcgccgccagttggctggcggcggcgcggctggccgacgcgttctggcggcagctgggccacgtcgtcatcgccgccgccctcctgttcgcgctcactccgtatgcgctgctga

SEQ ID NO: 2188 - DNA, 897 bp, Chromobacterium substugae
atgagcgaccaggccggcgcttacccggtgttttcgctggccagcccgtacgccctggcctcgcccagccgcaacaccctggcgattctgctggacgaaaccggacccgagttcaccgcgccgctgctcaaggccgcgcaggagcgccaattgcgctgggccagcgtcgtggttcccgccgccggcgccaatactgtcaacgccatccccgccatgctcaccggtaagcgcttcgacaacgtggcgccctgcggcccaagctggctgtgctcgcccacccgttcgctggatttcggccaactgtacgccggccggcccgacctcgacatcgtgggtttctggcacccgtactgcgccatccgcggcctgcgctattgccgcaggatagccggcgtattttatccgccgccggcgcgatcctttctgtgcagcccgccctacctcccggcgctgctgaactgccggcccgccgccggctcgcgcgacgccgccgtcgacaggctgctggcggccgcttacgccgcgccgttctggcgcgagggcggcatgctctacctgcacctgcccctgccccatcccagcatggaaacccgcgagaacctgcgcagccactacctggccaatctggccgatgccagccaggtgctgggccaactgctggacaagatgcgcggccgtttcggcgacgacttctccgtcatcgtgacatccgaccaccctttgcgcaccgagggctggtgccggcccgagcgcgaataccacgccgcggactgcagcctcgggctgccggccaaccgcaaacaagtgcctttcatcgtgatcagcccgcggctggcggagcagccgcgcatgcctgccgacaatctgggcgtgtttcacggcgccgcgcgcagttga

SEQ ID NO: 2189 - DNA, 525 bp, Chromobacterium substugae
atgtccctcaccatgcatcaagccgccattcccgcgctgacgcgcggcctcaacagcctgtcggccattctggccaaggccgccgcccacgccgaagccaggaatatcgacccccaggtgtttttgcaagcccggctggcgccggacatgttcccgttgctgcgccaggcgcagatcgcctgcgacctggccaagggctgcgccgcccgcctggccggccaggaggtgcccagctacgccgacgacgaaatcggcttcgacgatttgcaggcgcgcatcgccaagacgctggcgctggtggccggcgtgacgccggcgcagctggaaggcagcgaagaccgcgcggtgacgctgaaagtgcggggagaagagataacattcagcggcctgggctatctgcgcaatttcgcgctgcccaatttctatttccacctgaccaccgcctacgccatcttgcggcacaacggcctggagctgggcaagcccgactatctgggcggcgcgcccgccagcctcgccgaataa

SEQ ID NO: 2190 - DNA, 204 bp, Chromobacterium substugae
gtgtccgaagagcaatttaccaatatttcgctggtggtgtgcctgaccggcttgatcattttcatgggcttcatcatctgggacctgggcaagaagtccaaggcgggcaaaaccggcatgtttgtgttgttcctggtgctgggcttcggcgtgtcaggcttcgtgttcaaaaatatcctggccgaattcctgctgcgcaagtag

SEQ ID NO: 2191 - DNA, 912 bp, Chromobacterium substugae
atgcgggcaagcagttggattccgtgggttttcgtcgcgttatggagcaccggcttcaccggcgccaagttgggtttgccgtattgcggccccttcaccttcctcgccatccgcatggcgctgacgctattgtgcttcgccggcctgatcgccgcgttgcggcccgcgtggccgaccctggcgcagatgcgcagccagtgggtcagcggcggcatgctgcacggcggttatctgggctgtctgttcgccgccatcaagctgggcgtgccggcgggcttggccgcgctgatcatgggcctgcaacccttgttgaccgctttgctgtccatggggctgggcggccagcgtttccgcgccgggcagtggctggggatggcgctggggctggccggcacggcgctggtgattctcggcagcaagggcgtgtctttcggcggcggcgccggggcggccttcgccgcgggcgggctgttgctgatcaccggcggcacgctgtaccagaaacatcgcggcggcggcgcgcaccccatcgccggggcttttcatcaatacctgtcggctttcgccgtgaccggcctgctggccttgctgttcgagcgcggccagagcgtggcgtggagtggccagttcgttttcgcgctggcctggagcgtgttgatgctgtcggtgctggccatcctgctgctgatgcgcatgctgcgcgatggcgacgtcggcaaggtggcggcttatctctacctggtgcctggcctcaccgccatccaggcctggctgttgttcgacgagcgcttgagcccattggcgatggggggtatcgtactggcagcggcgggcgtggccctggtgttgcgcggcggccgcttccgtccggcggcccggccggcagggcaaatgaaagcagacaagggttga

SEQ ID NO: 2192 - DNA, 1227 bp, Chromobacterium substugae
atgtctgacatcaagaaagtagtactggcctattccggcggcctggatacctccgtcatcctcaagtggctgcaggacgtttatcaatgcgaagtggtgaccttcaccgccgacatcggccagggcgaagaagtggagccggcgcgccagaaagccgtgtcgctgggcatcaagccggagaacatcttcatcgaggatctgcgcgaggagttcgtccgcgactacgtgttcccgatgttccgcgccaacaccgtctatgaaggcgaatacctgctgggcacctccatcgcccggccgctgatcgccaagcgccagatcgcgatcgccaaccaggtgggcgccgacgcggtgtcgcacggcgccaccggcaagggcaacgaccaagtgcgcttcgagctgggctattacgcgctcaagcccgacgtcaaggtaatcgcgccgtggcgcgagtgggacctgctgtcgcgcgagaagctgctggcttacgccgaagcccacggcatcgacatcagcaagaagaaaaacggcggcagcccgtactcgatggacgccaacttgctgcacatctcctatgaaggcacctcgctggaagacccggcgcgcgagccggacgaggacatgtggctgtggagcgtcagcccggaaaacgcgccggaccaggctgaatacgtcgagctggaatacaagcacggcgacatcgtcgccatcaacggccaggcgctgagtccggccgcggtgctgactgagctgaaccgcctgggcaacaagcacggcatcggccgtctcgacatcgtcgaaaaccgctatgtcggcatgaagtcgcgcggctgctatgaaaccccgggtggcaccatcatgctgaaggcgcaccgcgcgatcgagtcgatcacgctggaccgcgaagtggcgcacctgaaggacgagctgatgccgaagtacgcgcagctgatctacaccggctactggtggagcccggagcgcgcgatgctgcagcagatgatagacgcgtcgcaggccacggtgaacggatgggtgcggctgaagctgtacaagggcaatgtgatcgtcgtcggccgcgaatcgaaaaccgattcgctgttcgacccgaccatcgccaccttcgacgaagacggcggcgcctacaaccacgccgacgccgccggcttcatccgcctgaacgccttgcggatgcgcatcgccgccaatgcgcggaacaagcgcggctga

SEQ ID NO: 2193 - DNA, 924 bp, Chromobacterium substugae
atgaagtccgtaaggcattacctgcagttcagcgacctgactcccgacgagtaccaccatctcttcgagcgaaccaaggttctgaagcgacgacaaggcgccggcgagttgcaccggccgctggtcggcaaggtgatgtccatggtgttcgaaaagcactccacccgcacccgcgcgtcgttcgaggccggcatggcccagttgggcgggcatgcgatgtttctggacaccaagagctcgcagatgggccgcggcgagccggtggaggacaccgcgagagtgttgtcgcggatgagcgacatcatcatgatccgcaccttcgagcagcgccaggtcgaacggctggcggcgcattcccgcgtgccggtgatcaacggcctgaccaatgaataccatccgtgccagattctggccgacatcttcacctatgtggagcggcacggttcgatcaagggcaagaccgtggcctggataggcgacggcaacaacgtctgccgcacctggctgcaggccgcgcgcgtgctcggcttcaagctgaaggtggcgtcgccgctgggctacgagctgaaggcgttggacggccaccattacggctcggagctcctggagctgacgcaagacccggcacgggcggcgagcggggcggacatcgtcaccaccgacgtgttcaccagcatgggttacgaggccgagcaggcggcgcggcgcgaggctttcgccggctaccaggtgacggctgagctgatgaagcacgccaagcccgacgcgctgttcatgcactgcctgcccgcgcatcgcggcgaggaggtggcggccgaggtgatagacggcccgcaaagcgtggtatgggacgaagccgaaaaccgcatgcacgcgcaaaaggccctgatcgaatttctgttgctggggcaccgcgaggactga

SEQ ID NO: 2194 - DNA, 1959 bp, Chromobacterium substugae
atgaaacccgtcagccgcgttctcgtggtcagcgatgatgtgacatggcaagccgaagtgctggccggacttggggctgcagcggtgcggctggaaaatccgttcggcctgaccttcgtcgccgcggcgaccagcgccgaaaccatggacctcatcgcgcgcgacggcgaaacgcaagtcgtgctggtcgaccgccaattgaaaggcgccggcgcgaaccaggcggcggcccagctggccaaccgcatcagcgcgttccggccggaggtctcgctttacgtgtttctgcaggacgatgacgagcgggcgctggtggaagagctggccagccacgcggtggacggctatttctaccgcgacgaggccgatttcaacggctggttccgcattctggcggccgagctggcggaaaagtcggccacgccgttttacgacaagctcaagcagtacgtgcggatggccaaggactcctggcataccccgggccattccggcggcgactcgctgaagggcagcccctgggtaggggatttccacgatttcgtcggcgagcacctgctgcgcgccgacctgtcggtgtcggtgccgatgctggattcgctgctgcacccgaccggggtgatcgcggagtcgcagatgctggcggccaaggctttcggcgcgaagaagacctatttcgccaccaacggcacctcgacatccaacaaggtgatcttccagacgctgctggcaccgggcgacaagctgctgctggaccgcaactgtcacaaatcggtccatcacggcgtgatcctttccggcgcgctgccggtgtatctggattcgtcgatcaatcgccagtacggcattttcgggccggtgccgaagaccaccatcttcgaggcgatagatgccaatccggacgcgcgggtgctgatcctcacctcctgcacctacgacggcctgcgctacgacctgaagcccatcatcgaggccgcgcacgagaagggcatcaaggtgatcgtcgacgaggcctggtacggcttcgcccgcttccacccggccttccgtccgacggcgctggagtccggcgccgattacgtcacccagagcacccacaagatcctgtccgcgttctcgcaggccagcatgatccacgtcaacgatcccggtttcgacgcgcatctgttccgcgaaaacttcaacatgcacgcgtccaccagtccgcagtacaacttgatcgccagcctggacgtggcgcgcaagcaggcggtgatggaaggctaccgcctgctggaccgcaccttgaagctggcgcaggaattgcgcgagaagatcaactccaccggcgtgttccgcgtactggagctggccgacttgctgccggaggaggtgagggaagacggcatccagctcgaccccaccaagctgacggtggacttcacccgttccggcttcaccgccgacgaactgcagcaggccttgttcgagcgttacaacgtccaggtggagaagtcgacgttcagcaccatcacgctgctgctgaccataggcaccacccgcagcaagctgtcgcggctgtacgacgcgatgctgcggctggcgaaggaaaaccgtccggcgcgcgcgctggggcggatgccggagatcccgcatttcagccgattggcctgcctgccgcgcgacgccttctacgaggccggcgaacggttgccgctgctggacgacgatggccgtcccaatgccgagctgtgcggccgcgtgtgttgcgaccagatcgtgccttatcctcccggcattccggtgctggtgccggggcagctgatagacgacaccatcttgtcgtatttggcgcggctgcaaaaaacacagaaaaccatagaaatgcatggtttggctgaggatggcggcgaattttacgtgcgcgtgctgcgtccggccgagttggcggaattgccgggacgaggattgttcaattga

SEQ ID NO: 2195 - DNA, 2124 bp, Chromobacterium substugae
atgctgaccgatgccgaaaaagacgcgattcgcgaccactaccgtaccctctccgacaacctgccgggcttccgcccgcgcgcctcgcagcggcggatgctggccgaaatcgccaacaccctctcccgcgcccaggagaaggtggacgacgagtggccgcagcgcgaaggcgaaagcatcgccgtgatcgaaggcccgaccggcgtcgggaaaagcctggcctatctgctggccggcggcgtgatggcgcgcgcgcgcggcaagaaactggtggtcaccagcgccaccgtggcgctgcaggagcaactggtcaaccgcgacctgcccttcgtggtggaaaacagcggcctgccgctgagcttcgcgctggccaaaggccgcggccgctacctgtgcccgtaccgtttgtacgggctcaccgcccagcacgcgcagcaaagcctgctgcagcccgatccgatgatggcgctgtgggaccacaagcccgaacaagccgaactggacgcgctgtcggcgatggccgacgccttccactaccgcaaatgggatggcgaccgcgacaactgggacaccgtgatcgaggacggcttgtggtcgcgcgtcaccaatgatcgccacggctgtctgaaaaccgcctgtccgaaccgcgccgagtgcccgttctacctggcgcgcgacacgctggaaaacgtcgacgtggtggtggccaaccacgacctgatgctggccgatgtctccatgggcggcggcgtgatcctgccggcgccggaagaaagcttctactgcatagacgaggcgcaccatctggccaaaaaggcgatcaaccagttcgccgccgagcattcgctggcgcaggcgctgggctggctggacaaagtggccgccgtggtggtccacgccgaagcgcacaccggcaaggccgagctggccagccaggcgatagactccgccgccgcctgcgtggaaaccctcaccgaatggctgtggctgctggagggcgaggacgcgctggccgccagcagcgacaatctggagccctcctggctgatagaagacggcatcctgccggaacggctcaaaacgcccgccgccaatatggccgtttccgcccgctcgctgtccaaacagctggacgacatgggcaacgcgctgtcggaaacccgcaaggacaagaatggcgacggcgacctggacaagaccgccaccgagctgggcttcctgatcggccgcgcggaacagctgatggcggtatgggatttgttcgataccgaaaccgccgaaaacgcgccgccgatcgccaaatggatcacccgccgcgccgaaggcaagggcgactacctgttctcggcctctccggtgagcgccgccgccagcctggccgccacgctgtggcgccgcgcctgcggcgccgtgctcacctccgccacgctgcgctcgctgggcgatttcgagctgctgctgtcgcaaaccggcctgaaatggctgcccaaggtcagctgcctggccctggattcgccgttcaacttcgatgagcagggcgaactgtacctgccgccgctgcaggccagcccgaaagacccgggcggccacacccgcgagatcatcgaatggctgcccaagctgatcgacccggcccaggcggtcggcaccctggtgctgttttcttcgcgcaaacagatgcaggaagtggccgccgggctgccagccgagctgcgcgatcgcctgctggtgcagggcgaaatccccaagcgcaccctgctggacacccaccacaagcggctggaagagcagcaatccagcgtgattttcggcctggattcattttcggaagggctggacctgccaggcgaaagctgcgtgcacgtgatcatcgccaagctgccgttcgcgatgccggatgacccagtgggcaagaccctgtcgcgctggatcgagaaacgcggcggcaaccccttcatcgaactgacggtgccggaggcgtcgatcaaactagtgcaggcggtgggccggctgatccgcaccgagcgcgactatggccgcgtcaccatcctggacaaccgcctgacacggcaaagctacggcaaaaaactgctggcctcgctgccgccattcaagcgcatatga

SEQ ID NO: 2196 - DNA, 315 bp, Chromobacterium substugae
atgatctgcaatccatacgaaatcgtcatccagggcctcacctccgagggccgcactttccgccccagcgactgggcggaacgcctagccggcatcctggcctccttcgacaccaaccagcgcctgtcctaccacgcctatgttcgcccgatgctgctggaaggcgtgcgttgcgtggcagtcgacaaaaagctggaaaaagtgcatccgcagatctaccagttcctgatggacttcgccaaggacaatgacttgcgcgtggtcgattgtcggacactaattgacgaagtctacccgaacaaattttcggcataa

SEQ ID NO: 2197 - DNA, 1185 bp, Chromobacterium substugae
atgcagaagaagaatctggcagccttggttgcatctttgttcatcctcccggtggccgcccacgccgacgtcaccatctacggtttcatcagcgccggcatcgaatccgccaaagccaccggcaacggcaacagcgccaaggattacacttcccgcacccgcgtgagcgatcaaaactcccgcatcggcttcaagggctgggaagatctgggcggcggcaccaaggccatctggcaagtggaaagcagcctgcgcaactttgagaacggcggcaccaacgacaagggccaaaccgcgtccttcggcacccgcaacaccttcatcggcatcgacaacgccgacttcggcaaggtgctgctgggtcagaacgactccgcctacaaggtgttcaccggcagcagcaacagcgcgctgggcaccgacctgatggtcaataccaccgccgacaacttcggctccagctcggtcaacagccgcggcgaagcccgtctggccaactcggtccactggttctccccgaaatgggccggcttcacgctgggcggctcctggggcgtggatgaagcccgcgttgccggcaacgactccaaacgcatctcgctgggcctgggctacaactggggcggcctgaatttggccactgcttgggataagcagtatgacatggcggtaaaaaacaatagcaacggctacaacacctccccgaccaacgacccggcggtactcgccctgaacgctggcaagaacgtttccttctacagcatcgcagccagctacaaattcgatttcggcaccttcatcggcggcaactacgaatggggcaacttcgatcagatcggcggcggccaagtgaagcaggatgactggctgatcgcgctgggccaagacttcggcgccgcttcgatcaagctgtcctacggccaactcggcacgctgaagaatgtcggcgccggcgttaacggcgacgacttcaaggccaagcaatggatcctgggcggcacctataacctgtccaagtccacccaactgctggcctacgccaccaaaatcactaacaacgcccagtccaaggccaactttgccaacaatccggtctacgacaacaacctcggcacttcctctgccggcctgaccgcaggcaatagcccgcaagctttcggcatcggcatgaaggtagcattctaa

SEQ ID NO: 2198 - DNA, 783 bp, Chromobacterium substugae
gtggagtcggtagccaaatcaggagaagtgcggcagcttgcggccttgggtcaggctttgctgactagctccaagggggagcacgctttgcctgatgcgccagctgttgaggcggcgcctctggtgcgcggcggcaaggaggttggccatcgtgattttcccgctgccaagcgcatcctgcccagggtgtatgccggcatggaggtggacttctactgcggttgccgctatcaaggcaaggcggtggattgggcctcctgcggttatcagccgcgcaagtcggaaagccgcgccagccgcatagagtgggagcatgtggtgccggcctgggtattggggcatcaacgtcagtgctggcagaaaggcggccgcaaagcttgcggcgatacggaccccctgtttcagatggcggagggcgatctgaacaatctggtgccggcggtgggagaggtcaacggtgatcgcgccaatttctcctacggcgcctgggaaatccatccgcgccccatttacggccagtgccagtcgctagtggacttcaagcagaagcgtttccagccgcgggaggaagttcgcggttcagccgcgcggatcacgctgtatatgcaccagcgctatggcctgcgcatcagtcagcaggacaagcagctgatgtgcgcctgggcgcgcaagtatccggtggatgaatgggagcggcagcgcaatcgccgcatcatccagtggcagggagaagggaatttcctggtgtcgcagccaggggagttggatagagtctgcaactga

SEQ ID NO: 2199 - DNA, 2004 bp, Chromobacterium substugae
atgaaattgaaactgatggtgctggcgctggtcatggccggccaggcctgggcgcacgagctttccggcatcgacaccaagaatttcaatccggatgtgcgtccgcaggacgatatctatctggcggtgaatggcaagtggctggatacccatgaaattccggcggcggagtcctgggagggcgcgttcaaggagttgcgcgacctgagcgaggagcgcagccgcagcctgatcgagacggcatcggccgcgagcggcgcggcggggaatgcgcagaagatcggcgcgctctattccagcttcatggatgaggccgcggcggagaaaaagggcctgcagccgatagaggcggacctgcaggccattaccttgttgtccagtcggaacgagctgttgcggctgctcggcgccgggcaggcaggcaacgcgcgtttgccgttggcttttgaggtcggcatagacgccaaggatgccaagtcctacctgccggagctgtaccagagcggcttgttgatgccggaccgcgattattatctgggcaaggatccgcgtttcgccaaggcgcgcgccgccttcctggtctatctgcagcagttgttcaagcaggcgggttacgcgcagccggccaagcgcgcggccagggtattggcgctggagacgcagctggcacagctgcaacgcagccgggtggataaccgcgatccgcaaaaacgctacaacaagatgacggtcgcccagttggcgaagctggcgcccaagcttgactggcatggcttcttcgccgaggccggggcggccgatctggcggtgcttaacgtcaatcagccggagtatgtgagcggcttggcgcaattgctgcggaagcagccgctgctcaattggcaggactacctgatcgcccatacgctggatggctatgcgccctatctgaacaaggcgctggtggatgcgcggttcgacttctacggcaaggccttgtccggcacgctggagcagcgcccgcgctggaagcgcggcgtgcagctggtggagtcgtcgctgggagaggcgctgggcgagcagtatgtcgccaagtatttcccggccgagcacaagcagaaaatgcaggagctggtggccaatctgatgcaggcgtaccggcaaagcatagacggcttgagctggatgagtccggcgaccaagcaggcggcccaggtcaaactgtctaagtacatgctgaagatcgcttacccggatcattggcgcgattactccggcctgcagttgcaagccggggacctggtgggcaacgtcaagcgcgccaatcgcttcgaataccagtggcagctgtcgcatcttggcaagccggttgaccggaccgagtggggcatgacgccgcaaacggtgaatgcctattacaatccgagccagaacgaaatcgtgtttcccgccgccattctgcagccgccgttcttcaatgcgcaggcggatgacgccgccaattacggcggcatcggcgcggtgatcgggcacgaaatcagccatggcttcgacgatcagggcagccagtacgatgccgacggcaacctgcgcgattggtggaccgcggaagacaaggcgcgcttccatgaactgaccaacaagctggtggcgcaatacgaggcctacgaaccgctgcctggcaagcacatcaacggcaagctgacgctgggcgagaacatcgccgacaacgttggtttgcagatcgcttacaaggcttatcagctgtcgctgggcggcaagccggcgccggtgatcgacggcatgaccggcgatcagcgcttcttctacggcttcgcacaggtttggcgcggcaaggtgcgggacgaagcgctgttgtcgcgcctggtgtccgatccgcactcgccggaagcgttccgcgccatcggggcgacctcgaacagcgatgcgttccagaaggctttcgaagtgaagccgggcgacaagatgttcaagccggaagatcagcgcatccgcatctggtaa

SEQ ID NO: 2200 - DNA, 384 bp, Chromobacterium substugae
atgatggaaatcaacaccacgccgttgatcgacgtgatgttggtgatgctgatcatgctgatcatcacgataccgatccagacgcacgcggtgaagctggacatgccggtgaacacgccgtcgaagccgctggagaagccggtggtggtgcagatcgacatagcgccggacaattcggtgctgtggaacggcgagaagctggcgggtcgggagcagctggaggcgaagctgacggcggcggggaaggcgagtccacagccggagctgcacatcaagccgaacaaggacgcgagctacgagccggtggcgatggtgctggcggagtcgcagcgtctgggtttgacgaagctgggcatcgtcggatcggaacagttcgtcaagtaa

SEQ ID NO: 2201 - DNA, 387 bp, Chromobacterium substugae; identical to SEQ ID NO: 2072

SEQ ID NO: 2202 - DNA, 747 bp, Chromobacterium substugae; identical to SEQ ID NO: 2071

SEQ ID NO: 2203 - DNA, 588 bp, Chromobacterium substugae
gtgatcatattccatgccgtgctgatctacgcgctggtgaccggcttggcgcaaggcgtggtcaaggtgatccagcagaaagtggaagtgtcggtgatcagcgaaccgccgccgccgccaccgccgccgccgccgaagatcgagaaagtggtgcagccgacggcggcgccgaagccgcaagcgtatgtgccgccggtcgtgaatccgccgccggtcgtgcaatcggcgaacgcgatccagtcggtgacatcggatccgaagccgcaacccgcgccgacgccggcgccggtggtggaagcgccgaaagggccgatttcggcgaaagccaactgcagccacctggaagcgccggagtacccgagcaaagcgcaggaagacgaaatccagggcgtggtgcgggtggtgttcggcgtaggcgcggacggcaaattcagcgggatcagcaatatcggtttcgacggcagcatcccgccgcgctaccgcagcagcttcaagtcggcgatcagcgccgcattgcaaggctacacctgccaggccaattcccagctgacgcaggaattcggcttcaaactcgactctggctcctaa

SEQ ID NO: 2204 - DNA, 2580 bp, Chromobacterium substugae
atgaaaagaacacagctggcgctggcgctggctttgataggcattggttcgcatgctcctctggcgttggcagacggcaacggagagctggaccgcgtggaagtgaccggctccaacatcaagcgcagcatcaaacaggagaaggcgctgccggttaccgtcatccgcactgaagaggcgaccaagcagggcttcacgacggtggagcaggtggtgaattcgctggccagcaaccagtccggcatggtgtccgcgtcttcggtccaaagcgtgagcggcggcgcgtcctatgccagcctgcgaggcttgggttcgcagtacacgctggtgctgctggatggccgcagggtcgctagccaggccatcagcggctacgccaccgacctgaatgcgataccgctttcggccatcgaacgcattgaagtgctgcgcgacggcgcctccgcgatttacggcaccgacgccatcggcggcgtgatcaacttcattaccaagaagtcggttaccggcctgaccgtaggcggagaaatcctgtccaccgagcaccgcggcggcaataccggcaacttcaacctgattggcggcgtcggcaatctggcggaggacggctggaatgtctatggctcgctggcttatcaaaagacccaacgcatcaccaccttggagcgcagctacgcgcataacaatctgactgcggacaacctgagtggctcggttttccccgccaactttatttacaagggcgttggttacaacccggcggcgccgaagtgccagccgccctatgcgcagccgctggatgccaattcctgcggcgagatgtccacgctgttcatggatctgacgccggaggtggagcagtggacagccaccgccaaggccaccaagcagatcggcgatcattccctgtcgctgcagtacatgggcgcgcgcaatatcagcaccacccggatatccccgaccccgctggcgaagatcgccacgctggtggcgggcgacaaatattatccaaccaccttgccggatggcacgcctaccgatggcagcccggtggtattgaacgcgcgctcggtgccgctggggccgcgcaccaccaagagcacctccgacacgcagcggatcgccttcaatgccgagggcttgctgggcggctgggactaccggaccggggccatctattcggaaaacaaaaccaccatcaattaccagagcggctatgccaacgaaaccttgatccgcaacgcgttcaagaacggcaccatcaaccctttcggtccttccgatccgggcgcgtgggatagcgtgaagttgtccggcgacggctggatcgccaagtacaccaccgcgctggccgacttcaaggccagcaaggaggtgctggagttgcccgccggcatgctggcgaccgcgatcggcgccgaagtgcgccacgagaagctggatagccagatccaggcggcggccaggaacgccatcggctcgggcatcgccaattcgcaatccacttcgggccagcgcaatgtgtccgcgctgtatgccgaggcggacatcccggtgctgaaggggctggatgtccaggtcgccacgcgtttcgaccactacaacgatttcggcaactcgttcaaccccaaggtggccttcaagtaccagccggtttcccaggtgttgttccgcggctcggccagcaagggcttccgcgcgccatcgctgtacgacgtgttcatgccggactccaaaacctatagcgccgacaagttcaacgacccggtgcgttgcccgggcggcgtgccagccaacggcggcaacaagccgcaggattgcaatcagcagttcatggtgatgcagggcggcagccgcaccctggcggcggaaaaagcgtcttcgctgaccttaggcctggtgatcgagccggtgccggcggtgaccgccagcgcggacttctggtggaccatggtgcagaacagcataggcacgctggatccgggcgccatcttcgccgatccggcgaagtacgccgaccgcttcgtgcgcaatccggatggctcgctggactacgtcaagaccccgactgagaacctgggcaatctgagcgtggccggcgtggatgtcagcctggcattccgcctgccgaaaaccgccatcggcgatttcagcgtcaatctggacggcacctacacctccaagtacgtgcagcagttggaaaaggacggcgtgtattacagcccgctgggcggctggtatcagaacatcctgctgccgacgctgcgctggaagcatagcctggccttcaactgggcgaagtcggcctggagcgcctcgctggtgcagaactattcgtccggctacaccgacatgaacccgaacgacgaaaaccacagcgtgcgctcctactcgaactggaacctgtccggcagctatgtctggaagaagaaactgacggtgacggcgggggtgaaaaacttgttcgatcagcagccgccgttcagcaaccagaccaagtcgttccagtatggtttcgacccggttctgaccgatccggtggggcgcgccttctttatcaaaacgtcgtacaaactgtag

SEQ ID NO: 2205 - DNA, 1704 bp, Chromobacterium substugae
atgagcaacaacaaacctttgctgtccgtgcgcaatctgaaggtgggtttccgccaggaagacggcggccgcttcgaggcgctcaagggcgtcagcttcgacattccggcccaccgcacggtggcgctggtcggcgaatcgggctccggcaagtcggtgacgtcgatggccatcatgcagctgctgccgccgcaatccagcgagatcgatccggcgtccgaactgctgttccagggccgcaacctgctgcggctgtcgcgcggcgagctgcgcaagctgcgcggcaaggacatcgcgatgattttccaggagccgatgagctccttgaacccggtgttcagcgtcggcgagcagatcgtcgagacgctgacccttcacgccggcttgagccgttccgccgcctggaagcgcgcggtggagctgctgcgcgaagtgggcctgccggagccggaaaagcgggtgaaagcctacccgcacgaactgtccggcggccagcagcagcgggtgatgatcgccatcgccatcgcctgcgaaccgaagctgctgatcgccgacgagccgaccaccgcgctcgacgtcacgattcagaagcagatcctgcaactgatcgccgacctgcagaagaagcacggcatgtcggtgctgttcatcacccacgacctgggggtggtcggcgaattcgccgacgaagtgatcgtgatgcgccacggcgtgatccgcgagcaaggcacggtgaagcagatcttcgaaaacccgcaggacgcctacaccaaggcgctgctgtcgtgccggccgcacctggaccgccgcccggagcggctggcggtgatcgacgacttcctccagccgggcggctatgtcgaaccggccgaaaggacacgtggctacgccgccggcgacgaaatcgtgctggacgtgcaagggctgtgcaagagcttcgacatccgcgaagggctgttcggcaagcgccagttccacgcggtgaaggacgtgtcgttccagttggcgcgcggcaagacgctgggcatcgtcggcgaatccggctcgggcaagaccaccgttggcctgacgctggtgcggctgcaccaggccaccggcggcaaggccttgttccacggccaggacctgatcggcatgagcgccaaggcgttccacgcctacaagaagcggatccagatcatcttccagaacccgtacgcgtcgctgaacccgcgcttcaccgtcgagcagatcctgaccgagccgatgctgctgcacggcatcggccaggacggcgggcagcgccgcaagctggcgctggacctgctggacaaggtggggctgccggcgggcgcgctggccaagtacccgcacgagttctccggcggccagcggcagcggatcgcgatcgcgcgctgcctgaccttgaagccggaagtgctgatctgcgacgaatcggtatcggcgctggatgtgtcggtgcaggcgcaggtgctgaacctgctgcaggacctgcaggacgagtacaagctgtcctacctgttcatttcgcacgatctggcggtggtgaagcacatctcggaccaggtgctggtgatgaacaagggtcaggtggtggagcaggcggatgcggacgtgatctaccgcgagccgaaggacagctacaccaagaagctgctgggggcgattccgcaggggtggagcgcggcgctggcgccggcctga

SEQ ID NO: 2206 - DNA, 285 bp, Chromobacterium substugae
atgttcgtccacatcctgcccaatatctcccatctgctgctggtgcagttctccttgctgatggtcggcctgatcaaatacgaggtgatcctgtccttcctcggcttcggcgtcgacgtgcgccaggtcagctggggatcgatgctggccgaggtgccggaggagttgctgcagggctattggtggcaactggcgatggtggtggtgttcatgtcggtgctggtgacggcgttcagcatgctgaccgattccctgcgcgacgcgctggaccccaaggtaaagtga

SEQ ID NO: 2207 - DNA, 609 bp, Chromobacterium substugae
gtgcagtacttcacgccggccggaaccgatgccaataccaatgcgatcagcttcatgggccagcagtatcagccctgggcaatccaggcagagggattcgagaaaacagtgcagggcagtgcgccgcggccgacgctgtccatcgccaatgcggtgatgggcgctaatggccccatctatggcatctttacccagttggtccgccagttccgaggcttggccggctggcgggtgacgcgcatggtgacctacgccaagtatttggatggcggcgcgctggccggcgctccagagttccaccagcaggaaatctggtttgtgaaccggcggacccaggatgacggcacggttctgcagtttgagctggtgagcgcgctggaccttgaaggcaagacagtgccaaacaccatggccagcgtctattgcccggcccagacgcagtaccggagcgcggcgtgcggctacgccggcgctgccatgttcgacgtcgatggcatgcctacgaacgatcccagcaaagatgcttgcgggaagcacttcagcgactgtcagcgccgggggaatcagaccaactatcccggattgctggggctgcggcgctacggttaa

SEQ ID NO: 2208 - DNA, 684 bp, Chromobacterium substugae
atgatcaacgaaatgctgcacctggcggagctggcgcacccgcaggaagcgtgcggggtgttgctggactccggccgtgtctacccgtgcagaaacattgccggcgatccccgcgcgcaattcgagctcgatccggtggactatgccgccgccgagcagctgggccgggtcgttggcatctggcacagccacccggacgacacggccgacccgagcatggtggatcgtgtgatgtgcgagcgaaccgggctgccctggcacatcgtcagctggccgaatggcgagcacacgctgaccgagccaggcggctggcaggcgccctacgaagggcgcccgttctgctggggaatgttcgactgcttcagcctggcgcaggactggcatcggcgcgagacgggcattcagttgtcacgggcgcaggtggcggaagagttctggctgaagggtgacagcccgttcccggcctggctggccagcgcgccagtggatgtcgtggagggagagcccgtgcgcggtgacctgatattcatgatgtgcgaggccaacgtggtcaaccatgtagccgtctacctcggcgatagccgaattctgcatcagctctaccatcagcccagccaggtcggcatctatggcggctggtggcggcgctgcaccgtaaccgttgtgaggccacgccatgagtga

SEQ ID NO: 2209 - DNA, 594 bp, Chromobacterium substugae
atgagtgaaaaacgtaccgtccgcctcggcggcgagctgggcgagaagttcgtgaagcaggtcgccgcctacgtggatagcgtcggtgaggccgtccggatgctggacgcgaactggccaggattcatccagcacctgcgcgacagcgatccggaaaaagtgggataccgggtgaccgtggctgaccgggatgtcgttgaagaagatgaactggtgctggtgagcaagggtgacatcctcatcatgccggtaatcggcggagccagtgcagggttgcgggtgtttgccggcgccgtcatcgctgttgtcggggcatactttggccagccttgggcggttcagctgggtgtagggatgatgattggcggggccgttgagttattgacgccgataccgaagcagcccgactggcaggccaaggacggcaagccgaactactggttcaacggcgcgcagcagaccagcgcgcagggcctgcccattccgattggaaccggcaccatgctgattgccggcacggtgatctccgccggcgtcagcgtcgaggacatcggcaccggggcgctgcccagcaattcccctgtactcatatag

SEQ ID NO: 2210 - DNA, 3669 bp, Chromobacterium substugae
atgtccgacgatgcaatctttggcgccaagggcggaggcggcagccagcacaccccggtagagtcgcccgatactgcgcagtcgatcagctacggccgcatgatggtcctgctgagccatggtgagacgggcgggccggcggacgcggccaacccactgaagagcatctatctggatgatacgccgatccaaaaccaggacggctcgttcaacttccagaacatgcaggtctcctaccgcaatggtacgcagacgcagccggccattcaggggtttcctgcggttgaaacagagattggcgtcgggctggaggtgaaggctgcgaacccgatcacccaaaccgtggcggatgtgaacgccaccgccatccgggtgacggtttcgttgccggccggcctccgatcgacggatcagaaaactggagataccgctggcgcgtcggtgcaatatgcgattgatctggcaccagcgaatggggccttcgctcaggcggccattgtcaccatctccgacaagaccgcggccaattatcagcgtagcactcggctgcagctgaccggcgccgggccttggctggttcgggtccgccgcatcacgcccgacagcacgacgcagtacctggccgaccagaccgtcttcacctcctttaccagcatcatcgatgcgcagctacgctatccgaacctgactgtgcttgccctcaagttcgactcgcgccaattttctcggatgccgacggtgtcggcgctgtggcagcagctgaagtgccaggttcccagcaactatgacccggtggcgcgcacgtacaccggcccatgggatggtaacttcaagccggcggtgaccagcaatccggtatggttcttgtggacctactgcacggacaaccgcttcggcatcaacattccggccgccaacatggaccggtgggggatgtacgccattgcgcagtggtgcgaccagcccgtcccggatgggtacggcggcaccgagccgcgcttccagttccacaacttccagcaggacacgcaagacgcctggaaggtcgtgtccgacatcgtgtcttccttctgtggccaggcatactggtcggccggcggtattcggattgtcgcagacatgcccggcaagcagccggtcaagcacttcaacgccaccaatgtcattgaaggcaaattcacctattcgtctactccgaagaatggccgctttaccgcggcgtcggtagcctggacggatccgggtgaccgctaccggcgcgcagttgagtatgtcgagcatggccagggtttgctggcttatgggctgcagcagaccgcggcggtagcgatgggggcggtgacgcgaggccaggcgcgccgctgcggccggtacattttggagacggcgcagcgcagcaccgaaatggtggtgttcaaggcggctgcctatggtgcggatctccagccgggtgacctgtttgcaacgtctgacttccacgtgaccggcgcgcggatgggcggcagggtggggtcggtcgccggcacggttgtcaagctggatgcaccggttacgcttcaatccggcgtgacctacacgctggaggtgaccggacctgacggcgtgccggttcgccgcggcgttgtcgcgtcgcctggcacaactgacaccctcaatatcgtttcgcagtatccagcccagccggtcgccggcgcgacctgggtgctgatcgctaccaacctgcagccggacttgtggacctgcgtgtccatcaagtcggtagacaacggcgagttcgaaatctcaggcctgcagtacgacccgaacaagtgggccgcgattgagacagggctgaggtttgacccggcgcccaccagcaacctgccagatccaggtgtgatgccggcggttctagcagttcagttgcaggagcagccctacctggcgccggacggtagtcggaaggtgaagttgctagtggactggccggcggtcgtgcatccctacctgcgtggctatcgggtgacctatcggcagaacggcggaaactggattgcgctgccggaccaggtgagtaatcacgccgaaatcatggatgtcgtgcctggcagttacgacgtacgggtgtcctcggtgtcggtgactggggtggtcagcatcccagtgacaggcaaccaacagacgcaggggcaggtgacaccgccttcggcacctacgctctcggcggcaggcggagcgatgaaggtagatttgacctggatgtatcctgccggccggcccgatatcaagcgggcagagctgttctacagcaccacggcagccgatccgaaccctggcaaactggcggatgtcagttatccgactacggcttttaccttccagggtgctcaactgggcgtgacgtacttcttctggctgcggatctacgacacctgggggaatgtctcgtcgtttgccacagcccaagcccagacgatgaaagatcccacgctgctgctccagcagttgcagggcggtgtcgactacagcttgttggcgccggatctggccggcagcatcaccagcaacgacaacgtggctaacgcgctgttgcaagcgctgctgcaggttgacacgtcctggtcgcaagcgcgtggcgcgcgcgtgatcagcggccaggctacggccgccatcgtgaacgagcagaaaatccgcgccgaccagaatgcctcgatggcgtcgaatatctcggcactccaggcatccgtcgccggcaatgctgcggcgatcacgagcgaatggatggcgcgcgtcaccgccgatagtgctgtggccagccaaatctctcagatgcagacgacgctcattggcaacagcgcgaccattacccagcaggcccagagcattaacggtcttcttgggcagtgggcggtgcaggtccagcttgacgcgaatggccaaaatcctcgcgtggccggcattcagttgagcaatgggcagggggggtcatcgtttgcggtcctcgcagacaagttccaggtcgcgtttccggatggctccaacccgcgggcggctttcacggttggccgaatcaacgggcagactgccgtcggagttgacggatccatgattgttgatggctcgatcagcggccgaaatgcaatcgtttccggctctatcgatgcggggcagatcaacacgcgagggctgaccatttgcgatgcggctggcaatgtggtggtcgacatgaccgggatgggcgctgcctatatcaaggggcagctgactgtcggccagattgacacccggggcatgacgatcagggatgccgtggggaatatcgtcgttagcatgaacgggatcgacggctctttcatccgcaacctgatggtggacaccttgcagatcaagggggaagcggtcagcaagaacgacacccgcagcatcacggtcagcggctggaccaatgccttcgactactcgttccagttcaactgcagcgattccggcacactgctggcgtttgcggattctccattcacgacgccgatacctacgctatacggtcgcggacgctcggcgcccatcaatggcagtgcggtgctggtgctgaatgttaatgcaggtgaggtggtgacgattggtgtttcctcgcctgcgatcaatgtgagcggcatgattcgctatggctgcgtgttgttcaggaggtag

SEQ ID NO: 2211 - DNA, 357 bp, Chromobacterium substugae
atgcccatcgatatcatcgaatacgacgacgccggccgcatcctgcaggtcggcaccagccggccggagaatatccagctggacgtggccgccggcaagcgcatcttggtcggcgcggcagacccattgacgcagtacgtgcgggacggtgcggtcgcgccgcgcccgctggccggcgcggtgctggacggcatgacgctgcggcagttgccggcgccgtgccagctgatactcgacggcacgccgtacccgtgcccggatgaggtgtgcgagttgtcgttcgcgcatcccgggcgccaccaaatcgtggtcgatgccttcccaatgcaaaccgctgtttttgaggtgacgacatga

SEQ ID NO: 2212 - DNA, 219 bp, Chromobacterium substugae
atgatgaagatccaccacgctggcgaccacgccgcggcgcgccgccagcagtacccggacattggcgatcagctggacgcgctgtggcgcatggtggccgacgcgccgcccgaccagttgccgccgcaaacgaaggcgatgctggcggagatccaggccgtcaagcaaacctacccgaagccccgcgatgacagcggggcttctcctttggaggtgtga

SEQ ID NO: 2213 - DNA, 834 bp, Chromobacterium substugae
atggaccagttcaatgcctggctgaccagtgccggcatggtgacgctgaccgacgccgccggcggaactcacacggtgcccagcgccgccaatgtgctgcgcgctgacggctccaatgccagcggcacctggcccatctcggtgtcgggcaatgcgggctcggtcagcagcgtgactgctgcccaggtggccgctggtctcggctatcaaccggtgcgacaggacagcattccagacacaaaaggagcgatgtcctatgtccagcttggcacattcacttgcggccagaatggcgccaagctggctttgtcggttgtttttggcaatggatacaacgcagccaacagccagctgggcatggcgactctgatcttcagcacgagcaatggcggtgcccagcagccaggctctgccggcccattttttggtgccgcgacggccatggttttcggcaacagcggctgcacgtttctgatcgcgcagaacagccctacgtcgtacacggtatttgtccagctccaggcttgggccggcgctggcggctgcagcgcgtttggggatgcctcgaatggaggctgggtggcaagcgtggtgaataccggcagcaaattgcccgctggcaacctcctgacggtacagccgcaaggcattttgacggtcagcagtttcaacacgacgccaactcctgctccagcctacacccgggcaactgcgccggcggcggcggcctacgctggcgcattggtttacatcacagacgccactggcggcgctgcgctggcatggtcaaacggcaatgcctggatcagcgtcagaaccggcaaccctgtctga

SEQ ID NO: 2214 - DNA, 144 bp, Chromobacterium substugae
gtggcggatggtcagagcggcctgaagctggcggatgtgctcgggcaggtggctaccgtggcgctgtcgcaaaatcaggcattgcagctgcaattggcagacgtgcaaaacaggctggcggcattgccggagggggcgaagtga

SEQ ID NO: 2215 - DNA, 285 bp, Chromobacterium substugae
gtgatctggatcgcgcttttcattctgctgcagctggccgacatcgccagcaccaactacgcgctggtccgcctgaatgggagggagctgaatccgttcgtcaggcgcctgatggcacgcgttggcatcctgccagcattggtggcgagcaaggcatttctgttctttgcctgctacctgctcgcgccaccgccactggcctaccaactgctatgcgcgttctacgtgttcattctgttccgcaatctgcgggcagttaaacagggccgggattcccggccctaa

SEQ ID NO: 2216 - DNA, 291 bp, Chromobacterium substugae
atgctgaaaaaactgcacgactatcgcatctacctgctgatccttccggccgcgctggcgctgttctggattgactccgttgttgcccaaacctggctgcagctgggtttggcgttgccggtgctggtgggcgtggcgctgctgctacgcaaagcgctgttccatgctgacatgtcggaggccgccgacattgctctgcacgcgcctactggtgctgctctggtggtgctggccgaccgtttgttcatggctgcggtggtgattggtggtgtgttgtggctgcggggctga

SEQ ID NO: 2217 - DNA, 618 bp, Chromobacterium substugae
gtggctgcggggctgagcgccggcgcgctggccctgttgccgctgctgaacaccgctgtgactcagcactggcccgacatgccgtcccgctctgtgctggcggctcaggttgagcaagaaagcggctggcgtgtcaacgcaaagctgcagacgtcgcgcgagctgggcgccggcctggggcagttcaccaaggcgtacaaggcagatggctcggttcgcttcgatgcgattcgagagatggtggttgcgcatccagagctccgaggctggagctgggcaaacgcttatgatccgcgctatcaactgccggccatcgtgctgaagaaccgtggcaattaccagctgatccgctgggcagcttccgacgctgaccggctggccatgatggacgcggcctacaactccggcctcggaggggtgatccagcgccggcggaagtgcgccaatacttccggctgtcagcctggcgtctggttcggcaatcttgaacgcagcagcgcgcagtcgaaggctcggcatgccggctacgggcaatcgtttgcagatatcaccaatacgcacgtcaggaacgtgatggtcgtgcggaggggcaagtatcgcgcttactttggggagtag

SEQ ID NO: 2218 - DNA, 240 bp, Chromobacterium substugae
atgggtgatgaagttgtgctgccgcgggaagagttccgggcactgctggaggcggcggccaaggccggcgcgcgccaggctctggacgaggccggagtggctgatgcagtgaagctggccaagagagtggatggtgtggcggatgctgtgctgaaggcattggccggcggcattgtgattggcctgctgggcgcgatctgggccggcatcgtagttctggccaaggcaaaaggagggtga

SEQ ID NO: 2219 - DNA, 120 bp, Chromobacterium substugae
atggatattttggcagaaagtattatttcatcaatgtttttattgatttttgaaatggtaatgacagcaaatctacctgtaacggtattgcaattattgcaatcgcatataattttatag

SEQ ID NO: 2220 - DNA, 1272 bp, Chromobacterium substugae
atgagcgcgccaacccttttcgcgctggtggacggcaacagcatgtacgccagttgcgagcgcgtgttccggcccgacctgatcggcaagcccatagtggtgctgagcaacaacgacggctgcgtggtggcggccagcgccgaagccaaggcactgggcatcaagatgttcggccccttctttgagatcgccgaccagtgccgccagcacgatgtcgcggtgttttccagcaactacgccctgtatggcgacatgagccggcgcatgatgcgggtgctgtcggagtttgctgccgagcaagaggtttacagcatcgacgagtgtttcctcgacatgacaggcatgccggatctggacagccatggccaccggatgcgcgaggcggtgctgcgccgcgtcggcatccccacatgcgtcggcatgggaccgtcgaagaccttggccaagttggccaaccggatcgcaaagaagcaaccgaaatgggccggcgtgttcgaatgggacttcgtgacgccggccgaggccgaccagatgatggcgcagattgaggtgggcgatgtgtgggggatcgggcgtcggctgaccgagcagctgcaggcgatggggattcacagtgcgctccacctgaaacaggccgacccgcggcgcatcaaacgcgcgttctcggtggtggtcgaacgaacggtgcaggagctgaacggcgtcagctgcttggcgctggaagacgtgacacccagcaagcagcagatcattgccagccggtcgttttccaagaaggtgcgcgacctgaacaccctgatcgcgtccatctcgcaccacgcggcgcgggcggccgagaagctgcgcgcccagggctcggcggcgcgcctggtcggcgtgggtattcgcaccagcccattcagcgatgtggcgcagtaccggccctatatcgtggtgccgctggtccaggcgtctgacgacaccctcgaaatcacgcgcgcggcgctggcgggcctgcgggccatctacaagaaaggctacctctaccacaaagctggaatcgtgctgatggagatcagcccgcgaggcgtggtgcagtcggatctgtttgcggcgccgccagatccgcgccgagagctgctgatgcgaacaatggacgccatcactcgacaattcggccgcggcacggtgcgactggcgtctgagaacatgactcagcgctggcagatgaggcaggatgtgaggtcgccgcgctatacgacgcggcttgatgaattgctggaagtgaaatag

SEQ ID NO: 2221 - DNA, 429 bp, Chromobacterium substugae
atggccaccatcccctacttgatgccgatacctggaggccagcctctgccgttggtcttagcccccgtccgcgccggcttcccatcgccggccgacgactacctcgacgacaacatcaacctgcatgagtacctggtggacgaccctccggcgacgttcatcgtccgtgtgcgcggtgactccatgatcggcgccggcatcgacaacggcgatctgctcgtcgtgaacaaggggctcgcgccggcgcatggcgacattgtggtggccgtgatcgatggcgaattcaccgtgaagcgactacacagccgcggcggctcctgtgcgctgatgccggagaaccccgcctatgcgccgatcaccctgcattccggccaagagctgctggtatggggcgtagtgaccggtgcagtgaagaagttccggcaatga

SEQ ID NO: 2222 - DNA, 303 bp, Chromobacterium substugae
gtgaaggtgcaagtcgtcgccgacgagaagagcaaccgcaagggctacagcgctgcgcagttcctggcgaatcagggggtgccggtgcgcctgaatggcaattactccatcttccaccacaagttcatggtgatcgatggccagcacctggaaacggggtcgttcaactacagcgcggccgcagccagcaagaacgccgaaaacgtgctgctgctacgcaacgtcaagccgctagccgacaaatacgcagttgagtggacgcgactgtggcaggaggcgacacccttgccgaaagcatactga

SEQ ID NO: 2223 - DNA, 204 bp, Chromobacterium substugae
atgcgcctctacctctccgccgaccgctactacgctatcgccatccagctggacctgttcgacaggccggtgatcgtgcgcgcctggggcggacgcgggagccggcgcggcggcatggcgacggaaccattcagcacggcgcggctcaaggacattgaccgccgccggcgacagcatggctaccaactacacaggcccaactga

SEQ ID NO: 2224 - DNA, 543 bp, Chromobacterium substugae
atgatcgacatcgacgcaatcatagacagcatgggctggtcgttaaccgacagcgactgggtggccatgcgtcggctgtgccaggccacgctggcggccgctgccgctgcggaaagcgcagccgcttcccgtttgggcctggagtggcgcgcctgcgtgaagcgcccagtggttgttcatgtgcgcaagcagcgggagggtgaaaagcatgtcggcacgcgagaaggaatcactccgctccgccctgacgatttaatcatgcgcggcatcgctggcgaggaatatcccatcggcagtgagctttgggcgaagacctactggcttgaggccgatgccaatctgcctaatgaaaaggcaattggtaaggaatccttacaggttcaggctgtgccggatggatggaggcttgtcccgatcaaaccgaccgaggaaatgatccgcaagtcctactggtctggcgctggagaaataaacatccatgaggaatgggcgaagcgcgaggtgtgggggcgcatgctcgccgctgcgccgtcgcccaattga

SEQ ID NO: 2225 - DNA, 246 bp, Chromobacterium substugae
atgagcaagaccagcctgaaagcattcctggacggcggcgaggcggaagcaccgaccaaggaagagaagcctctgccggactttgtgtccatcaaggtaaaggtccaccccgacgaccaccgccggctttccgacctcgccaaggcggaacggccgtcgagcctgcaggacctgggcgtggaaggcttcaaccgcgtgcttgccgagcgcggcctgccgccgctgcgccgttacaacgaggggtaa

SEQ ID NO: 2226 - DNA, 255 bp, Chromobacterium substugae
gtgaagatcgtcaccgccgcgggcaaggagccgctgttcgtgctgtccgcctgcccttctcgggtgccggaggtcgccgacgcgcgccaggcgctggccgacttcggcgaggtggcgccggtggagatcggcgagcgcatcgcattttcacgcgccatcgccaccggccagtcggtgacggagtttgacccgcgcggcaaggcggcggccgagatccgggccctgtggcaatgggtcaaggagaagctgcaatga

SEQ ID NO: 2227 - DNA, 144 bp, Chromobacterium substugae
gtggacttacccgagccgcctttttgcgagaatgtggcgatggttttcatgtttcctctgggcatgaaaaaacccgccggcggcgggtttgtggtggcgggaagctgggcggtacaaatcgcccaaatttcgcccaaattttga

SEQ ID NO: 2228 - DNA, 468 bp, Chromobacterium substugae
atgaaaaaaaccatcctgaccctctcgctgctggcgctggccggcggcgcgctggcggccgacctgcccttcctgcccaagccggcgggacaggccgtcaccatcaacggcaaaacctattacaagcaagcaagccaagccaaggcagcggccaaatcggccagcggcgccagttttcgcgccagcggcgctccggccttgaaccgcggcgacgtggtccagtcgcccaagcaggcgctgcccgccaccgtcagcggcacggtgctggtgcaactggcctctgcccaggatgaagccgccgtcgcccgcgaccacggcctgagcgtgcgcttccgcacccaaagcgtggtggtatacgaagcgccggcccagaccgaactcttgggcctgcagcaaaggctggccgccgacaagcgggtgaaaaaggcgcagctggagctggccagcaacgacaacctgccgcaataa

SEQ ID NO: 2229 - DNA, 1458 bp, Chromobacterium substugae
gtggcgcagtcggccacccttctggtgcgcgacctgccgcaggccgaatactttaccgccctggtggaaatcatcaaggcagtttccaaaatcaacgccgacaccgacatgtcgctgaaagagagggtgaaaaccctgctctatgtcgacgacaaggccgcaggcatccatcgccagttatgccaggactatctgcagtcgaaaagcggcagcaagggctatcttcccaccatcctggcttactggcacgaactgtccagcgcctaccagatctgcctgcgcttgagcaagaacgccgccagcccggcggccgagcccgacctgcagctggtcaccatccgcggcttgcatcaccagatgcggctgatcgcctggaacgcgctgcgctacctgaagccggaaggcaccgcctggcaacagggcttccgcttttacacctacgccgaagaggcgggattttcccgcaccgcgatgctgctatacccggacgcgcgccaggaaatcagctgcgagcacctgctgatccagatcggcatgctgcacctggcgcagaccgagaacatgctgcacaaggaaatcatcgcggtggaccagctgctgatgctgctgagccagcacatcccgctggacaagcaggcgccgccggaaggcccgatcttcgtctacaacctgtccatccccgagccgccgcagccgatgctgcgcggcatggccggcaagtggcaccgctactggtcagcctatgaaatcaccagccgcctggccgacctgatgttcgacctggacagccgcataccttcgtccctcgccacgctgggctgcgagctggaacgcgaggagtgggccgacctgtgcgaaaagctggcgatacgctggtccaacgacggcggcaagtcgctgcgcaagtcggaacgctcgctgcacacctccaatgcgcaagtgtccatcggcttcgaccgggtggcgttccagatcaaggtgcaggatgtcggatcgctggaccccgagcgggtggacgaatggcggatcaatgatatcagcagcaccggcatggggctgactttcatcggcaaaaccatagaccagctggccataggccggctgatcctggtgaaaacagagagccacccgctgctgctgggcgtgatccgccgcatcctgcgccagaacaacggcaccaaggtcgggatagaaatcctgggccagacgccggtaggcgtctcgctgcaggacccctcgcgccaggatatcccgcccttcaccgccatctacatcacccagcccaattcccgcaaaggacagcgctggttcctgatgccccgagccctgacctcggccgacaaggaactggtcctcaccgcgcagggaaaatcgtaccagatcaaactgaaagacccgcagcaggaattcgaggattgctgccacagcaacttcgatactctgtccaagatagattga

SEQ ID NO: 2230 - DNA, 2106 bp, Chromobacterium substugae
gtgctgggcggcggcggcgcgcgcggcttcgcccacctgggcgttctcaaggaattggagcgcctgcgcattccgatcgcctgcatttcgggcaccagcgcgggggcgctgattggtggcatttacgccaacggcctgccgctggatgagatcgaacgcgaattcaatgccgccgattgggaccagatgctgtccggcaagccggcgcgggcggatattccgtatgaccgcaagcgcaatgattacaaaaactatctcgatgtcagcttcggcctgaaggacggcgcgctgcgggtgccgcgcagcgccatcaactcgcaaggcatcgagctttacatccacaagctgacccgcgaccgcgacatcgacgatttcgacaagctgcccattccgttccgggcgatcgccgccgatttgagcaccggcgacgcggtggtgttcaagcagggctcgttgacgcgcgcgctgcgcgccagcatggcggtgccgggggtgttcgatctggtggaggacgaggggcggctgctggtggacggcgccatcgcccgcaatgtgccggtggaggatgtgaagggacgctgcgccaagcaggccatcgtggtggatgtcggcacgccgctgatgaagccggatgaaatccagaccctgttcgacgtggtggcgcaaagctccaatctggcggtgctgcgcaatgtccaggagcagatgaagctgctggacaagaaagacatcgtgatccggccggacctgaccggctatgccgccacttccttcggcgatcaccaggccatcgtgcggcgcggcgaggaggcggcgcgcaagatggccaagcagctgtcggcttactcggtgtcggaggaggcctacgccgcctggaagcgcaagctgcagcggccgcgctatccggtgctggacgaagtgaaggtggaggggacggacggcaccttcaccaagctttccacgctgcgcgaatcgctggcctttccggggcctgtgccggtgggaacggcgcgcaaccgcttggctgaaatcttcaccggcggcgaatacgacaagctgggctaccgcgtcgacaatgtgtccggccgcagcgtgatgacggtgatgccggtggagcgcagcatagggcaaaactatctgcatttcgggctgaacctgcgcagcgataccccgggcgacaacagcttcacgctgcgcgccgcccatgaatggacggccttgaacgacgccggcgcgtcctggcgcaacgacttggcgataggctacgacaagtcgatcaccaccgagctgtaccagccactgtggaacggcagcccgttcttcgtcgccggctcgctgggttatgagcaaaagccgttccgcgtgttcaatgacaaccatacggtgctggccaccttgaagaacgatgtgctgagcggccaggtgaatgtcggcctggctctgggcaagtacggcgaatggcgggtgggcctgtaccggcaggacaacgattactcgctggagcagggcgaccccagcgaattcaacggcaacgatcgtttccgcaacaccggggtgcaaagcagcctggtggtggaccaattcgacaatccgcgctggccgagggccggttattacttcagcggcaaggtcggcgccggtttgccggggctgggcagcgaggtcaaccagaaattctatgacctgatcggcgagacggcccacacctatggcgacgtcaccgcgcgcttcaccgccaaggccaggggttatgtggatatccgcaatggcgacattccgcagacgctgggcggtttcctcaatctgaccggttaccagaacggcgagttgctggccgatcaggtggcgttggcgcggctgatggtgtattggcgcgccgcgtcgctgccggcggtgctgggctccggcgtatacgccggggtgtcgctggaggccggccggctgtgggggcagaactattccgacctccaaaccgcccgcggctggattcccgccggttcgcttttcctgggagccgacaccattctggggccgttcttcgtcggcgtcggcacggcgcgcggcggccagttgaccggttacatctacctgggcgtcgattactga

SEQ ID NO: 2231 - DNA, 2049 bp, Chromobacterium substugae
atgaaaaacactccgcaccgccaacgcaaggcactatcgcaggccaccattctggcgctggcctgcctgggaagcaccgccgccctggcggccggcgcgcccgacctgcaggacaattccaccactctgcccgcggtcaccgtcaccggcgagaagatcaatcgctcgctgcaggacaccaccaccgcggtgacagtgctgcgcgacgccgacaagggcgaagtcaaatcggtttatgacgcggcggccgccacgcccaacgccagcctaaacggcgccggcatcgtcaacatccgcggcgtggaaggcaccggccccggcaccggctacaacacgctggtttccggctctcgcccgcgggtgagcaccacggtggacggcatggcggaaagctggaccggccagcgctacgtcgacgccagcccgtgggatgtggaacagatcgaagtgctgcgcggcccgcagtccaccacccagggccgcaacaccatggccggctccatcgtggtcaacaccaaggacccggcttccgattgggaaggcgcattgcgcgccggctacgaagacaaaggcggccgggcgacgctggccggcatggtctccggcccgatcaccgacgagctggccttccgcgtcaccgccgagggcctgaacggccacagctacatcgactatccgggccagatgccctgggacggctcggacatcaatcacagcagctaccgcggcaagctgctgtggaaacccagcgccctgcccggcttcagcgccaagctgacggtatcgcatcgcaaggacaagggcgactacctgaactacgtcgacggcaattacttcgactaccagtaccatcgcctgtccacccaggcccgctatcaggactcgtccaacaacaccatcagcaccgacctgcaataccagttcaacgacgcctggagcgcccacctgctggtcgggcacgccgacaacgtcagcgcgttcaaggacaccgacaccccgccgctgaacatgcgcctggatgagaaaagcgacaccgtcgaagcccgactcgcctatgcgccgcaaaacggctggctgagcgggatgatgggcgtataccactacgaccgcgaccaaagcctgcgcaccttccagttccccaatctgctggccaaggaccgcctcaagaccgaagcgctttatggggaggccaccttggcgctcagcgataagtggagcctgaatctgggcggccgcgtcgagcgcgaaatgcagcgccgccacaccctgttcaatccggataccgccgcgcaaaaccaggccagctacaacgtgggcgaaaccttgttcctgcccaaggccggcctgagctaccgctacagtccggacaccacgctgggcctcaccgcgcgcaagggctacaacgccggcggctccggcctggacaacaattacgtctactacacctacaacaaggaagaagtcaccgcctatgagttgagcagccgctccgctttcctggataaccgcgtcagcctcaacgccaacgccttcttcaaccagtacaccggctaccaggccatcctggcttcgcgcttcaccaacattccggaaggccagagctacggcctggaattggaaaccaaggccagggtgacgccgacgctgaccgtcaacgccggtctcggcctgctcaacaccaaggtgaccggcaccgatgccgccaaccccggcatcatgggcaaccagttcaactacgcgccgcacatgaccgtcaacctgggcttcaagcagcgcctgccgcgcaatttctacgtgggcggcagcctgaaccgcgtcggctcctattactcggagatcaccaacgaccccagtctgaaggccggcgactacacagtggtcaacctgaacaccggttacgaggatgcccgctggggcgtgcgcgcctacgtcaacaacctgaccaaccgcggcgtgctgtatgcccagatcgcatcccgcggcaacaacctgggcgtggtcggcgcgccgcgcacggttggcgtgacggtggactaccgcttcttctaa

SEQ ID NO: 2232 - DNA, 1380 bp, Chromobacterium substugae
atggcgcgccgggagaaatgcgcgatccgactgccggagtggattgaaatcatgggtggaaatgtgaaatggaatcaaatggctgccgagagtgcggcctggctgcaacacccggacgcgggcctgccatcctggtgggaacgtctggctgtcatcggcgcgccgctgcgcgagcggttgccggacgggcgcgtctgcgtgactttcctgtggcgcgatccggccggcggcccggccgcgtcggcgacggtgcgggtgtacgccgatgtcaattccgtcaccgaccaccatagcccgcagccgcagtcgctgtcccgcctgggcgataccgatgtctggtggtggcaggcggtgttgccggcggattggcgcggcagctatgcctatatcccggtagcggccggacagacgccgccggttcccagcgacgatgtccgtgaaagccggctgcgccaccgcgaatggtggctaagcatcatgagccaggccatcgcggatccgctcaaccccgccgccggctaccgcagcagctggggcgccagcttgtcgccgctgcatctgcccgacgcgccggaccagtccgcctggaccgcctgggacaaaaccgggcagggggccgatccgcaccgcctgacggagatccgctgggacagcgccatgctcggcaaggcgcgccgggtctggatctaccacacaggcgcggtttctgttggagaatgggccgggaggccgctggcgatcctgctggacggccagcattgggcgcagcgcctgccggtgttcgccgcgctggacgaggatacccgccgcggccgtttgccgcccgcggtgtatttgctgatcgacagcatcgacggcaagcaccgcgaggaagacctgccctgcaacgccgcattctggctggcgctgcaagcggagctgctgccgcaggcggccttgatcgcgccgttcagcgaccgcgcagaccgcaccgtggtggccggccagagttatggcggcctggcggcgatgttcgccggcctcaactggccggaccgtttcggctgcgtgctcagccagtccggttcgttctggtggccgcatgtcgagctgcatgaaaaggcgcgcgcggcgagcggccgcctgccgggcagcaagggctggctggccgagcagctggaagctggcgagacgccgcccggacggctgcgcgtgttccaggaggtgggccgccgcgaggaggtgatggtggacgtcaacgatagccaccgcgcggcgctggagcgcgccgggcatgacgtgcattaccaagtgttcgaaggcgggcacgactggctgtgctggcgcggcggtttgttgcaggggctgggctgtctgtggcggccctgggtcgccccgtaa

SEQ ID NO: 2233 - DNA, 213 bp, Chromobacterium substugae
atgagcgcggagcaaaccaaccctttcgatgacgaaagcctttcctttcttgtcctggtaaatccccaggaccagcacagcctgtggccgtcgcaactcgcgtcgcccgcgggctggcgcgccgtattcggcccggccggccgcggcgcgtgcgtttcctatctcgacgccaactggaccgacatccgtccgcgatcgctgcgcagcggttaa

SEQ ID NO: 2234 - DNA, 8484 bp, Chromobacterium substugae
ttgaccattgaaaccaaaccctccgccgtagagcgcgagctgccgctgttcggctcgcaactgggcatctggctagcggaccagatcgccgaacaaaagaacacctacaccgtcgcccactgcgtagcgctggacggcgcgatagacgccgagcggttgcggcagtccatccgtttgggcctggccgaggccgacactgtcgtcgcccagtatctggaaacgccggaaggcccggcgcagcgtctgcggcaagggctgagcgccaaggatctgccccttcccgaaatccatgacctgagcgccgaggccgatccggaaagcttggcccgcgaatggatgcgagccgacctggctgccgagctggcggccgacggcgagcggccgttgcatctgcaccgcctgttcaagctggccggcggcgcgggcgagcgctggttctggtatcagcgctaccaccatgtctgcgtcgacggctacagcttcgccgcgctgacccgccgcatcgccgacctctaccaggcgctgggccgcggcgaagcgccgtcgccgtcgccatttgtttctttcgtcgatgtcgcggccgagcgcgacagctatctggccagcccgcgctgcgaggaagaccgcgcgttctggcgcgactacgccgccgcgctacctgcgccgtccaccttgtccgcgcgcgacgcgctggccggagacggcgcggccaatgtcgacgtgctgcgccgacggtttgaaatcgccggaggaacggcggcgccgcaggccatggcggccgttttcgcctacctggccaggatgagcggcaagagcagggtggcgatgggcatgcccttcatgcggcgcatgggttcggccgcgctgcgggccgtgggcccggtggtcaacgtgctgccggtggcgctggatatcgacaatggcgacgatctggctacgctcgcgcggcggctggccgacgaattgaaacaggtgcgccgccatgagcgctacgatgccgagcagatccagcgcgacagtggcatggtgggctcccgccgcgcgctatacggcgcgacgctgaacctgaagatctacgatcagtcgctgcggctgggcgaggtggcgggcgtcacgctgccgctggcggtggggccgatagacgatatcgaattcggcctttggcagcagggcgagagcctggtggtggagctgagcgccaatccggcgcgctacggcgcggcggagctggagtggcatgcgtggcggctgcgcggcttcatcgccgccctggccagcggcgcggccgtaggcgacgcgcccttgcacagcgccgcggagaaggccgcgcttgacgagtggtcgcgtgggccgcgggtagccgcgccggccggcgtgcgcaccgcgctggacgtattcctggtcagcgccttgcaataccaaaatgagaccgcgctggcgtgcggcgacgagcggctgagctatggccagctgtcggcccgcgtcgcgcagctggcgcgcgagctgctggcgcgcggcatcggcgacggcagtgtggtcggcgtcgccgtgccgcgcagcgtcgacaccgtggtggcgatactgggcaccttggcggccggcgccgccttcctgccgctggacctggactacccgcccgagcggctggcgatgatgtgcgaggacgccgcgccggcgctgctgctgacccgctccgacgtccgcggccggctgccaagcctgccggcgttgtgcctggacgacgaggcggtccgcgcgcgcttggccgcccgcgccgcccagccgctggacgacggggaacggctgcgtccgctgaacggcgaccggctggcctatatgatctacacctccggctccaccggcaaaccgaagggcgtgatgatcgcccatgccagcttcctcaacttgctgctgagtcagcagaccggcttgttcggcgacttcgtccgttcccgcggtcgccgcgtgcgtacgatgcagaccgcctcgctgtccttcgacggcgcgctggagcagctgttctggctcttcatgggccaagaagtgcatctgtgcgacgaagaactgcgccgcgacgcgcagcagctggtggagctggtgcgccgcgagcgcatagacgagatggacgtgccgccgtcgctgctgcggcagatgctggactgcggcctgatggacgacggccattggcagcccggcatggtgatggtcggcggcgaagcggtgccgccggcgctgtggaaggaaatgcgcggctactcgcagctgcatttccataatttctatggcccgaccgaatacacgatctcggcgctgggcgcaccgggctcggtcgcggaggagccggtggtgggccggccggtggccaatacccgcgcgctggtgctggacgccgcgctgcgtccggtggcgataggcgtggccggcgagctgtacctggccggcgccgggctgggcctcggctatctgaaccgcccgtccttgaccgcggcccgctttgtcgccagccccttcggcgacggcgagttgatgtaccgcaccggcgatctggtgcgttggaacgcccacggccagatggacttcatcggccgcgtcgaccaccagatcaaggtgcgcggcttccgcatcgagatgggggaggtcgagcacgcgctggccagcctccccggcgtcaacgccgccgtggtgctggccgaggcggtgggcggcagccaccggctgatcgcctattgcacgatggccgacgccggccgccacgaggaggccggcctgtccgccgccttgctggcgcaagtggccgagacgctgccggactacatggtgccgtcggcgctggcggtgctgccggaatggccggtcaacatcaacggcaagatagaccgcaaggcgctgccggcgatccggccgcagaacgccgccgcaggacgggagccggccaacgacgccgagcgcctgctgtgcgcggcggtggcccgggtgctgaacctggagcaggccagccccgacgacgacttcttccagctgggcggcgacagcatctcggcgatgagcctgggcaccgagctgcgtcgcgccggcttcctgctgcgcccgcgcgacgtgttcgccaaacggacgccggccggcatggccgcggcgctgcagcccttgagcgccgccaatccggcggccgacgacaaggccggcccgctgggcaagctgcccatcgtcagctggttcgccgagcaatacggcatggccagccgcttcgtccagggcgtgtggctgaaagcgccggcagcgctgggcaccgaacacctggccgccggcctgttggccttgcagcgcgcccacccggccttgcgcagccgcgccgccgatggccaactgcatctggatgccgctccaacggcattggacgcgcgggtactgatcgaggccgcgccggaggcgacgccggatcagctattcgaaaccgcctgcgcgcggctggacccggaaaacggcctgatgctgcaggccgcgctgcgggacggggccgacggcaagcatctgttgctggccgttcaccacctggcggtcgacggcgtgtcttggcgcgcgttgctgcccgagctgcaggccgcctgcgaggcggcgatggccggagaggcggtccaactgccgcgcgaggacttcggcctgcgcgaatgggcgaaaacgctggcggcccaggttccggcgcgccgcggcgagctggcgatgtggcgcggcatgctggccggaaaagccgacgcattgagcgccaaggcgctggacccggcccgcgaccgccacgacgcggcccgccaccgccgcgcgctgctgggcgaggcggccagcgcggcgctgctgcaaaagctgccgaacgcctgccgcgcgacggtggaggaaatcctgctggcggcgctgctgctggcttgccgcggcgaattcgacgcgccgcgcttgcgcgtgggcctggagtcgcacggccgccatgccggcgacgacggcatcgatcttggtcgtacggtgggttggctgaccgccgaatacccggcgctgttcgacctgtcagtccagacggccggcgacgcggcggctctggcggcgctgcgcgcggtcaagcgcgtgatgcgggcgatcccggaccatggcctgggctacggcgtgctgcgttatctggacgacgagcacggcccggcgctgggcgcgctggaggcgcagaaccgcccggcgctgctgttcaactacctgggccgcttccaggccagcgacggcgaatggatgccgctggccgccggcggccgcttcgccgacgccttcgccgtcgacatcgatccggctttgccgctgcaatacgggctggaggccaatgtcttcgtcgacgagtccggcgccgcgccgcgggtggcggtcaactggacctgggccgacgcgctgtatggcgccgacgccatcgagcgcctggggcaaaggatggacagcgcgatcgccgcgctggcccagttggcggagcgtgatccgctggccgcggccgataccttggtggccgctgagacgctgggcgccggcggcgcgccgctgtccgacgcggagctggcggcgctctgcgcccgccatggcagcctggccgcggcgctgccggtgttgccgctgcagcagggcctgctgttccacgcccagctgggcgaggcggccggcaagtacaactccatcacccgcgtcactttcgcaggcccgctgggcagcgacaggctgcgcgcggcgctggcggcggtattgcgccgccatccgcagttggccgccggtttcgacagcgaagctcaggccgaaccgttgcaactgctgccgcttgcgctgccggaatggccgtggcgcgagctggagctggccgcctcggccgacgaggccgaggcgctgcaggcgctggagcgtgaggagctggaccgcgactttacggtcggcggccccggcgatggcccgctgctgcaggccacgctggcgcgccacggccaactgtccacgctgttcctgaccgcgcaccatctggttgtcgatggttggtccacgcccatcatgctgcgcgacctgctggccgcctacggcgacgggccggacacgctgccttcgatccgcgtcgactaccccagcgtggtccgcgcgctggccgcgcgcgacctgacgccggcacggcagctgtggctgcagacgctggacggcgtcaagcctacgctgctgttcggccagcagacggccgcgccggaagtgcgggaattcgagctggtgctgccgcaagcgctggaagacgcgctgaccgagcgctgccgcgaacgcggcctcaccctgaacaccgcgatgcagggcatgtggggcgcgctgctgtcggtgctgaccggccgcaacgacgtggtgttcggctcgccggtgtcgggccgtttcagcccggtggacggcgtggacgagcatatcggcctgttcagcaacaccattccggtgcgggtggcgctgcggccggacgcgccgctgtgggaacagctggccgacttgcaggcgcggcagatccgtctgctggagcatgacgggctgggccttgccgaaatccagcgcctggccggcgcgaccacgctgttcgacacgctgctggtggtcgagaactacccggatcaggacatgcagtcgcgcgactaccactgcgcgcgcatcgcctcgctgcgcaaccgcggccatacccactatccgctgacggtgctggcgctgccgggtgaccggctgcgcctgctgatcgagtaccgcaatctggtgaaagagccgcagcagctggccgagcggatgctggcgctgctggcgcatctggcctaccggcccgagctgccgtggtcggccttcgacccgttgaccggcgccgagcgcgagctgatcgacaaggtcaacgccaccgcagctgcgataccggaagccacgctgccggacttgctggccgagcaggccgccaggacacccgacgcgccggcgctgctggacgagacgcatgcgctcggctacgccgaaacccgcgctcaggtcggccatttggccggcaggctgaaggatgccggcgtcaagccgggcgacatcgtcgcggtggccttgccgcgctcggtgcacctgagcctggcgctgatggcggcgcaggaggccggcgccgcctatctgccgctggacaccggctacccggacgagaggctggcctatatggtggccgacgccaagccggcgctgatcatcacttgcgccgaactggcgccgcgcttcgcaggggtgggggaactgctgctgcaggacgcgctggcggccgagccgcaggccttcgacgcgccggcgctgacgccggatcacgccgcctatctgctgtacacctccggctccaccggccggcccaagggcgtgctggtttcgcaccgcgccatcgtcaaccgcctgctgtggatgcagcacgagtacggcctgggcgcggacgacgtggtgttgcagaagacgccttgcagctttgacgtgtcggtgtgggagtttttctggccgttgatcgtcggcgcgcggctgttcatggcgccgccggacgcgcaccgcgacccggaagcgctgctggagctgatcgccgggcgcggcgtcaccaccttgcactttgttccgtctatgctggcggcgctgctggcccacatgcagggcgacgccgcggcgcgctcggcccaagcggctggcttgcgtcgggtgttctgcagcggggaggcgctgtcgcgcgagctggccgacggctatgccggcctgatagacgcgccgctgcacaatctgtacggcccgaccgaagcggcggtggacgtcagttaccagccggtggccaagccggcgccggagtcggccagcgtgcccatcggcctgccggtgtggaacaccgcgctgcggatactggacgccgcgctgcggccggtgccggtcggcgcgccgggcgaactgtatctgtgcggcgtgcagctggcccatggctatctgggcaggccggacctgaccgcggcccgcttcgtcgccgacccgtacgccgatggcgaacggatgtaccgcaccggcgacatcgcgcgctggctgccggacggcaccgtcgagtatctgggccgcagcgacgaccagctgaagatacgcggtcagcgcatcgagctgggcgagatcgaggcggcgctgctctcgcagccgggcgtggcccgcgccgtggtccacgcctgcgcgctgggcggccaggcggcgcatgccgccggcgccgacaaccgccagctggtcggctatgtgatcgcgtccgatccggaccatccgcccgaggccgacgcgttgcgggcggcattggccaaggcgctgccggcgcacatggtgccggtggcggtgatgcggctggcggactttccgctcagcgccaacggcaagctggaccgcaaggcgctgccggagccgtcggctgcggcgtcgacagaaggccgcgagccgcggccgggcctggagagccgcatcgccgcgctgttcgccgaggttctggagtgcgacgctgtgttcgccgatgacgatttcttcgcgctgggcggccactcgctgctggcgatgcggctggcggccgcgctgcgccgcgagctgaagctgccggtctcggtcggccagatcatgagctcgccgacagtggccaagctggcggcggtgctgtctgacgccggcctggcatccgacccggcgctggccggcttcggcgaggtgctgccgctgcgcgccggcaaggggcggccgctgttctgcatccacccggcctccggcttcgcttggcagtacagcggcctgtcgcgccatctgcgccccggcctcgcgctggtgggcctgcagtcgccgcgcccggacggcgccatcgcccgcagcgtcgacatggacgaggcgtgcgaacgccatctggccaatctgcgccgcatccagccgcaaggcccgtatcacctgatcggctattcgctgggcggcacggtggcgcaggccatggcggccaggctgcggcagcagggcgaggaggtggccttcctgggcctgctcgacacttatccgccggagggccaggactggaacggcccgaccgaggaagaggccaaagccgaagtggcccgcgagcaggagcagttcatgtccgccaccgaggatgccgccgacgccttcatgctgcgcgagaagaccgagatgttcggccacatcgtcgccaactatcaggacgcggtgcggctgttgtcgcaggcgcgcacgccacgctacgacggcgaggccacgctgttcgtcgcccgccgcaccctgccggaaggcatggacgtgcgcgagacctggcggccgcatctggccggcctgaccgtgcacgagctcgattgcgcgcacgaggacatcgtgtcgccgcagtcgctggagacgctcgggccgttgctggacggcatgttgaaggaggtggacagcctggggtga

SEQ ID NO: 2235 - DNA, 507 bp, Chromobacterium substugae
gtggatgtcgcgttcttctatgacagcatcgccggactgatggaagcactgatgaaggcgcgcaatgagcgtacctgcctgatcgtgatcggccacggttttcagattattggcgggggcgcggtgcaattgctgaatgggaagggggcgaatagcattgaagataaagacatcaatgctattcgcccggatgtatacatcggcctgcattgctatccgggagccatcctgaataagctgagcaatagctgcattgcttgtgggctgaccggactgaatgtcgggcaaaatggccatatcaagaatttttgcgagtctgacaagctggatcgattgtttgaggatgtttgtcaattgttttttatcgtcgacatagaaggcatggacaagccgacaatcaacgagcatgagaaggcggtgattcaggcgctgaaaggattcaaggatcattccacgcctgagttcgcggtgacggaaaccgcgtcgctggcgctgagcaagagctga

SEQ ID NO: 2236 - DNA, 840 bp, Chromobacterium substugae
gtgaccaccctgtccttcaagctcaaccccgccgcggcactcgacgccaccctgcccgcgtccggccggccgcggctgtccggcgacggcctgcgcctgggttaccgccaacggacgatctgcgagcggctgaacctgcggatacccgatggctccttcaccgtcgtcatcggccccaacggctgcggcaagtcgacgctgctgcgcagcctcagccgcctgttgaagccgctggatggccaggtgcggctggacggccgcgacatccacagccagccggccaaggcggtggcccgccagctgggcctgttgccgcaaagcgccgtcgcgccggacagcatcaccgtggccgacctggtggctcgcggccgttatccgcaccagggcctgctgcggcaatggagccgcgacgacgaaaccgccgtccagcaggcgctggaagccaccggcaccgccgagctggccggccggctggtcgacgagttgtccggcggacagcgccagcgcgtctgggtggcgatggcgctggcccagcagacgccgctgctgctgctggacgaacccaccacctacctggacatcgcccaccagatcgagctgctggagttgttccgcacgctcaaccgcgacggcggccgcacattggtggcggtgctgcacgacatcaaccacgcctgccgctacgccacccacttgatcgcaatgaaggacggccgcatcgtcgccgaaggcgcgccgtcgcgcatcgtcagcgccgaattgatcgagcaggtgttcggcctgccctgcctgatcatcgaagacccggtcagccatacgccgatggtgattccgcgctga

SEQ ID NO: 2237 - DNA, 1044 bp, Chromobacterium substugae
atgaaaacagcgcacctgcggctgggccatccagacggccgcttcaaccttcgcctccggcctagccggctatggccggcgctgctgctgatggcggcctgcgccgcgctggcgctgatcagcctgcgcgcaggcgccttgcatctgagcgtcgagcaagtgtgggcggcgctgcaaggccagggcagccggctgaacgtggccgtggtgcagcaatggcggctgccgcgggtggcgatggcgctgatcatcggcgcggcgctgggcatgagcggagccattttccaatcgctgctgcgcaaccccttgggcagcccggatgtggtgggtttcaacaccggcgcttacaccggcgcgctgctggtgatcaccaccataggcggcagccatttccagatcgccggcggcgcgctggccggcggcctcgcctccgccgcgctggtttatctgctagcctggcggcgcggcgcgcacggcctccggctgatcatcgtcggcatcgccgtcagcgcgatgctgagcgcgctcaacagctggctgctgatcaacgccagcctggagtcggcgatgagcgccgccatctggggcgccggtacgctgaacggcatgacctggagcaagggcttgccgtcggcgctgctctgcctgctggcgatgctggcggcgctgacgctgaagccacggatgcagctgctggaaatgggcgacgacagcgccaatgcgctgggcgtgccggccgagcgcacccggctgtggctgatgggcctgggcgtggcgctgatcgcctccgccaccgcggccgccggccccatcgccttcatcgcgctggccgcgccgcagatcgcccagcgcctgcagcgcgcgcgcgccaccagcccgatgaccgccgcctggaccggcgcgctgctgctgctggcggccgactacgccgcccagcatctgttctacccgcgccagctgccggttggcgtcgtcaccatctgcatcggcggcctttacttgctatggctgctgctgcgccaaaccggaggcgcgaaatcgtga

SEQ ID NO: 2238 - DNA, 1116 bp, Chromobacterium substugae
atgcgcgccgcggggatgatgacaagccgcgccatgggcctgtcccttcatgtaacaggcatggtaacatcggcagttgttattaggaatcattttcatttgattatgcagacaagtcccgcccgcggacgccgcgccaccctgctgctggcctgcctggcgctgctggccgtcgtatccgtgctgagcctggccctgggcgccaagccgattccgctcgccaccgtctggaacagcttgctgggccgcgccgccgggccggacagcgtggtcgtattgcaggggcggctaccgcgcacgctgctgggcctgctggccggcgcggcgctgggcttgtccggcgcgctgatccaggcgctgacccgcaatccgctggccgatcccggcatcctcggcgtcaacgccggcgccagcttcgcgatggtgctgggcgtcgccttcctcgccgtggacagccagggcggctacatggcctgcgcggcggcaggcgcgctgtgcgcgacgctgctggtctacgccgtgggcgcgcgcggccgccgcgccgatccgctgcgcatcgtgctggccggcgtagcggtcggcgcggtgctgatgggcctgtccgccgccatcaccctgctcgaccccatcgccttcaaccggctgcgctactggagcgccggcaccctggacgtgcgcgacatggccgccgtcggcctggccgcgcccgccatcctggccggcggcgtgctggcgctgctgctggcccgcccgctgaacgcgatgggtctgggcaacgatctagcgctcagcctgggcggccggccgctgctgatccagggcggtaccgtggccgccgtcaccctgctgtccggcgccagcaccgccgtcgccgggccgataggcttcgtcggcctgatgattccccacgtcgcgcgccggctgggcggcgccgacctgcgctggagcctgcccttcaccgtcctgctcgcccccatcttgctgctggcctcggacatcgccggccgcttgctgacgccgggcgagctgcgcgtgtccatcgtcaccgccttcatcggcgcgccggcgctgatctggctggcgcgcagccacggcggcgcgggaggtaaaccatga

SEQ ID NO: 2239 - DNA, 1275 bp, Chromobacterium substugae
atgaaaaaatcgcccatcttcgtcgatttcagcctgctcaggcttaacccgcatttccgctccatcttcatcgcccggatgatctcggtgttcgccttcggcatcctgatggtggcggtgccggtgcagatccatcagctcaccggctccacgctgcaggtgggcgcggcgatggcgctggacggcatcggcatgttcgccggcctgatgtgcggcggcgtgctggccgaccgcatggaccgccgccgcttgatcctgctgggccggacttcttgcggcctgggcttcctggcgctggccctgaacggtttcatgaccaacccgtcggtgacggcgctgtatgtggtgtccacttgggacggcttcttcagcggcatcggcatcacctcgctgatggcgtccattccggtgatcgtcggccgcgagaacctgccggcagccggcgcgctgagcatgctgaccgtgcgcttcggcgcagtgctgtcgccgctcctgggcggggtgatcatcaccgccgccggcgtcaactggaactacctgctggccggcatcggcaccttggccacgctgattccgctgacgcggctgccgtcgctgaagccgcaaaacgccgaaccgtcgcacccgttgcgctccttgagggaaggctttgaattcctgtggcagaacaaggtggtcggcgcggtggtggcggtgggcacgctgcagacgctgctgagcgcggtgcgggtgttgtacccgtcgctcgccgaggatggctacggcggcggcgcgttcgaagtggggctgatgtattctgcggtgccgctgggcgcgatgctgggcgccttcaccagcggctgggttggcggcctcagccgtcccggcgcgatgatgctggcttgcgtgacggcctcgtcgctggccatcgcatccttgggcgctttcacccacctggcttacggcctggcggcgctggtagtgctgggttatctgggctccatcgcctcgctgctgcagttcacgctggtgcagggccagacgccggaccacctgctgggccgcgtcaacagcctgtggaacgcgcaggacgtggtgggcgacagcctgggcgcgctgggtctgggcgcgctggcgcgggccttggcgccgctgctggcggtggcctggttcggcgccggcgcggccgcggcgggtttgctgatgtgcgtgggctttggttccttgcgccgcctttccggcggcaagccggagcaggccgaaggcgagccggcggagcaggctgcggggtcttga

SEQ ID NO: 2240 - DNA, 1086 bp, Chromobacterium substugae
ttggcatcggcgacaatgttaatgataatacttatcacttgcaataaaatcgccggacgctatcgaatgcaaaggaaacactccatgccgctcccctacgccacgcgccgcggcgcgctgcgcctggccgccgcagccggcctcgccgcgctgctcggcgcttgcaacgcccccgccgaatccgacaaggcggccgccgcctccgccggctggccgcgcacgctggacacgcccaagggcaaggtgacgctggacaagatgccgcagcgcatcgtctccaccagcgtgacgctgaccggcaccctgctcgccatccacgcgccggtggtcgccagcggcgccagcgccgcccattccaaggtgacggatgatcagggcttcttcacccagtggagcgcggtggccaagcaacgcggcgtgacgccgctgtatcagggcgaacccaacgccgaggccatcatcgccgcccagccggacctgatcgtgatggccggcaccggcggcgactccgcgctgaagctgtacgagcaattgagccagatggccccgaccctggtggtgaattacgacgacaagagctggcaggaactggcggcgctgctgggccaggccacgggccgcgaggccgatgcccgcgccgccatcgccggcttcgacgccgaagcggcccagctgaaggcagcgttaaagctgccgccgcagccgacggcagcgttggtctattacgaggacggctccggcgccaatctgtggacgccgcaatcggcgcagggcaagctgctgcagtcgctgggatttgagctggccaccgcgccggacagcgtcaaaggcaataccagcatgggcgtgcggcacgacatcatccagctgaccggcgaaaagttcgccgacggcctgcaaggcaaatcgatgatcctgttcaatgccgaccaggaccaggtgccgcaggtgctggccaatcccttcctggccggcaatccggcggtgaaggccaagcaggtgtacgccgccgggctggacaccttccggctggactactacagcgcgcgcaatctgctggcgcggctgcgcaagcagttcggctga

SEQ ID NO: 2241 - DNA, 1125 bp, Chromobacterium substugae
atgcggatattgacggttgttgcgatggcggcgggcttggccggctgcggagggaaggagccagcgccggaggcgggcaagccgcccgaggtgggcgtggtgaaactggaggccaaggatgtggcggtaagggctgaattggctggccgcaccgtcgcctaccgcagcgccgaggtccggccgcaggtcaacggcatcgtgctgaagcgccatttcaccgagggcagcctggtcaaggccggcgacctgctgtaccagatcgacccggccggctaccaggctgccttgcagcaggcggaggcgacgctggcgtccgcccgcgccgcgctgggcagcctgaaggggcgcgccgaacgctatgccgaattggccaagatagacggcgtcagccgccaggagcgcgaggaggcggacgcagactaccgcaagggcctggcggcggcgaagtccggcgaggcggcggtggcggcggccagggtggagctgtcccgcacccgcgtgctggcgccgatttccggccgcatcggccgctccgccgtcagcgagggcgcgctggtcacttcaggccagagcgcgactctggccaccatccagcagctggacccgatgtacgtggacatcgtccagtccagccaggatttgctggcattcaagcgccgtcaggccgacggcgagcttgagcccgccggctcggccgccaggctgacgctggaggacggcgtgccgtaccggcatcccggcaagctacgtttcaccgagttgaacgtggaccgcgtctccggcgcggtgacgctgcgcgccgaattccccaaccccgaggggctgctgctgcccggcatgtatgtgcgcgccgagctggagcagggcgtgcgccgccaggcggtattggcgccgcagcagggggtggcgcgcgacgacaagggccgagccaccgcgctggtgctgggcgccggcgacaaggtggagcagcggctgttgacgacggaaggcacccacggcgcttactggctggtgacgacgggtctgaaggccggcgaccggttgatcgtcgacggcctgcagcgcgcccgtccgggcgaggcggcgacgccggtggccttgccggccctggccgggaggagttga

SEQ ID NO: 2242 - DNA, 3129 bp, Chromobacterium substugae
atgctggcgcgtttcttcataggccgcccggttttcgcctgggtgctggccatcgtcatcatgttggccggcctgttcgccttgcgcgcgctgccggtgtcgcaatatccggacatcgccccgcccacggtgatggtcagcgccagctaccccggcgcgtccgcccaggtggtggagaccagcgtgatccaggtgctggagcaggagctgaagggcctggacaatctgatgtatttcagctctaccagctcctcgtccggccaggccgagatcatgctcaccttccgccagggcgccaacgccgacaccgctcaggtgcaggtgcagaacaaggtcagccagatgttggcgcggctgccgcagcaggtgcagcagaatggcttgtcggtgcagaagatgcagggcgacttcctgctgatcgcctccttttatgatgtcagcggcaagcgtagcgacaccgacatcgccgactggctggccagcaatgtgcaagacccgctgagccgggtggacggcgtcggctcggtgcgggcctttggcgcgccgtacgcgatgcgggtgtggctggacccgcacaagctgaacagctacggcctgattccgtccgatgtcagcgccgccatctccaagcagaacaccgaggtctcggtcggcgagctgggcgctttgccgtcgccgccgggccagcagctcaacgcgatggtcaccgcctggtcgcgcttgtccacgcctgagcagtttcgcgagatcgtgctcaaggcgctgccggacggcggcgcggtgcggctgggcgacgtggcgcgggtggagctggggcaggaggattacagcagcagctcgcggctgaacggccatccggcttccggcctggcggtgatgctggcgccgggctccaacgcgctggccaccgccgaggcggtgaaggcgcgcgtcgccgagctggagcgaaacttcccgccgggcatccgcgtcgcctatccggaggacaccacccacttcgtccggctgtcgatacgcgcggtgatggagacgctgctggaggcggtggcgctggtggtgctggtgatgtacgtctttttgcgcaactggcgcgcgacgctgattccggcgctgacggtgccggtggtgctgttgggcacgttcggcatgctgtcggcggccggcttcggcatcaacacgctgaccttgttcggcatagtgctggccatcggcctgttggtcgacgacgccatcgtggtggtggaaaacgtcgagcgggtgatgagcgaggaggggctggacgcgcgcgcggccaccatttgctcgatgagcgagatcggcggcgcgctagtcggcatcggcctggtgctgggggcggtgtttctgcctatggccttcttcggcggctcggtcggcgtcatctaccgccagttctccatcaccatcgtcgcggcgatggccttgtcggtgttgacggcgctgaccttgacgccggcgctgtgcgcgacgctgcttcggccgcatgcgccgtccgaacgcggcccgctggcggcgttcgagcgccgcttcaatcatttgcagtccgcctacgccggccgctggctgccaagctggctgcgccgtcccatgcgcggcggcatggtttatctggcgctggcggctggcctggcggcgctgtatccgcggctgccgacggccttcatcccggacgaggaccagggcacggtgatggtgcagttcacgctgcccaccggggccactcacgagcgcgccgacaaggtggcgcgcgcagtggagcagcatttcctggagaccgagaaggccaatgtcgagtcggtgtacatgttgtccggcttcagcttcggcggctccggtcagaacgccggcatggccttcgtcgcgctgaaggactggtcgcagcggcgcggccgggagagcagcgcccaggcgatagccgaccgcgccaccaccgcgctggcctcagcgcgggacgccgaggtgttcggcatggtgctgccgcccatcgggggcctgggtcagaccaatggtttcgagttctggctgcaggacgcgtccggcatggggcgcgagggcctggccaaagcgcgcgaccaattgctgaaggccgcgcagggcgacgacaggctcagcgcggtgcgctccggcgcagccgacgacaagccgcagctgcggctggatgtggaccagagcaaggccgccgcgctggggctggacccggccaatgtcgccgacacgctgggcgccgcctggggcgggcgctacatcaatgatttcatcgatagaggccgggtgaagaaggtgatgatgcaggccgacgcgccgtatcgttccaagcccgaagatctaggcctgtggttcgtccgcggcgcggacggcacgatgacgccgttttccgccttcgcccgcgcgcgttgggaatacggcccggcacagctgaaccgctacaacggtttgccggcgctgccgctgtcgggctcggccgccgccggcgtcagctccggcgaggcgatgaaggcggtggaggccgtggccggcaagctgccgggcacgcagtacgagtggagcggcctgtcttatcaggatcggttgtccagcggccagacgccgctgctgtacgcggtgtcgatattgttcgtcttcctgtgcctggcggcgctgtacgaaagctggctggtgccctgcgccgccatgacggcgattccgctgggcgtgctgggcgcggtgctggcggtgatggcgcgcggcctggccaacgacatctatttccaggtgggtctgctgacgacgataggcctgtcggccaagaacgccatcctgatcatcgagttcgccgaggcggcgatacggcgcggcgacgatgcgctgagcgcggcgctggccgccgcccgccagcgcctgcggcctatcctgatgacctcgctggccttcggcgtcggcgtcgcgccgctggtctgggccggcgggccgggcgccggcagccagaacgcgatcggcgcggcggtgctgggcggcgtggtatccgccacgctgctgacgctgttcttcgtgccgctggcgcatctgctgatacgcggcctggcggggcaagtcgcgcagcggcgtttgaaaatggcggaggcgcgcggatga

SEQ ID NO: 2243 - DNA, 1398 bp, Chromobacterium substugae
atgaaaccaatccccattttgctggtttgcgtaggcctggccgcttgcgccgcgccgcagccggattaccaacggcccgccgcgccggtgccggcgcattggccggcggcgggcgcggagggcgcggagggcgcggagggcggacaggccgatgtggcctggcggcgcttcttcgtcgacgagggcctgcgcgcaaccatcgcccaggcgctggcgaataaccgcgatttgcgcgcagcggtcgccaatgtgcaggcggcgcgggcgcagtatcgggtgcaggacgcggcgcggctgccgaccgtgcagctgcagggcaacgccaaccgccagctcactcgcggcggcgatccgtcgctggcggctgacagccgcggtgtcagcgccggagtgggtgtcagcgcgttcgagctggatttgtttggccgcgtgaaaagcctgagcgatgcgcagtggcggcgttacctggccagcgagtccggcgcgcaggcggcgcgggtcagcctgatcgcggaaaccgccaatgcttatttgaccttggccgccgaccgcagccagctggctgcggcgcgggcgacgcagcaaagcgccgagcgctcgctcgctctgacgcgcgagcggctgcgcctgggcgcggcttcggcgctggacgtcagcgcgatgaataccgtggcgcaacaggcgcgggccgatgtcgcccgttaccaagggctagcggagcgggacaggctggcgttgcaattgctggtcggcgcggagcttggcgaggcgaggctgccggcggcgctggaggacaagccttacacgctggcggcgctgccggtggacgcgccggccgatgccttgctgcgccgaccggacgtccgccaggcggaaaatctgctgcgggccgcccatgcggatgtagacgccgcgcgggccggcttgtggcccaagctggggcttagcgccagctcaggattcagcggcgtgacgctggccggtctgctgaacgcgcctgcgcgggccttgagcctggcgctggatgccagcctgccattattggatggcggcgcggccagggccggcgcggatcaggcggaagcgcagcggctggcggcgctggccgcttacgagaaagccctgcaaagcgggtttcgcgaagtggccgacgccttgagccagcgccaggcgctggccgaggaaaaacaggcgcggcaggcgacgctcgccagcgcggaaacctcgttgcggctggcggaagcgcgttatcggcaggggctggacggctatctgagcctgctggaggcgcagcggatggcgcaggcggcgcgccagcagtggatcggcgccagcctggccgaggcggagaacatggcggcgctgtaccaggcgctgggcggggggctggatggctag

SEQ ID NO: 2244 - DNA, 933 bp, Chromobacterium substugae
atgaaacacctgttgtcgcgcagcgcattcgtcctcgccttgctcatgttgccgttcgcatcggccttcgcttcctccggctacacccaaacccgctatcccatcgtgctggtgcatggcctgttcggctttggccagatgctgggggtggattatttctaccaggtgccggccgcgttgaaggctgacggcgcccaggtatacgtggccgaggtttccgccaccgacagcaacgaggcccgcggcgagcaattgctgcagcaggtgcagaagatcctggccatcaccggcgcgcagaaggtcaacctgatcggccacagccagggcgcgcccaccgcgcgctacgtggccggcgtgcggccggacctggtggcttcggtcaccaccataggcggcgtcaacaagggctccaccgtggccgacatcgtgcgcggcgcggcgcctgcgggcacggtttccgaagcggtggccgccgccatcgccggcgctttggccaaggtgatcgccttcttctccggcaccagcgacctgccgcagcagccgattgccgcgttgaactcgctgaccaccgccggctcgctggccttcaacgccaagtttccggccggcgtgccgcgctcggcttgcggcgaaggcgactaccaggtcaacggcgtgcagtactactcgtggaccggcgcggccaccaccaccaatgtgctggatccgctgaccatcccgatgggcgtgttgggcctggctttcggctccactgcctccgacggcctggtggcggtgtgctccgcgcacctggggcaggtgatccgcgacgactacaagatgaaccacgtcaacgaaatcaaccagagcttcggcctggtcagcctgttcgaagtcagcccggtcagcctgtaccgccagcaggccaaccgcctgaagaacgcgggcttgtaa

SEQ ID NO: 2245 - DNA, 927 bp, Chromobacterium substugae
atgcgcaaggcccgtctgttgcttggcttgacgggcgtctgcgccggcctgctggtttggcaggcctggccgcaggcgcagaaaaccgctcctgcctcggcgcaggccggcaaggacggcggtttcgcgccgtccctgcgcggcacgcggccggatggcgcggtcaaggctgcggccgacggcgcgctgcaggtcaatcaggagctgcgccgcctgttcgactactatctggccgcgttgggcgagcgcgagctgccggcgatccgcgccgagctgcgcgcctatctgcagcgcaccttgtccgccggcgccttgaagcaggcgatggcgctgttcgaccgctacgtcgcttaccgccagtcgctggcggggatggcggtggcggcgagcagcgacctggcgcagcggctggcgcgggcgcagtcgctgcggctgcagtacttcttctcgcaggcggaagtggagggtttgttcggcgatgaggaccgttacgacgctttcaccgccaagcggctggccattctggccaattcggccttgagcgcggcggaaaagcagcggcagatcgcgctgctggagcagcagctgccgccggccttgcgcgcggcgcgtgaagagccggtcaagcatctgcagctggcggaggccgaagccgaattgcgcaagcggggcggcggcgagcaggaactgtacgcgctgcgggccggcatggtgggacaggccgctgccgaccggctggcgtcgctggacaaggaggaggccgcctggcagcagcgggtggccgatttcaatcgcgagcgggcggccattctgcaaaacggccaactgagcgatcagcagcgccagcaggcggtcagccagctgcaggcgcagcgcttcagccagcaggaagccttgcggctgggggctttctcgccggccagatag

SEQ ID NO: 2246 - DNA, 798 bp, Chromobacterium substugae
atgtccgatattctcaacaccatcatcgccaccaagcatgaggaaatcgccgcggcgcaaagcggccgcccgctcgccagcgtgcgcgccgacgccgaatcccgcggcgaccgccgcgacttcgtcgccgccatccgcgccaagcatgcgctgggcaaggccgccgtgatcgccgaaatcaagaaggccagcccgagcaagggcgtgatccgccccgacttcgacccggccgccatcgccgccagctacgccaagcacggcgcggcctgcctgtcggtgctgaccgaccgccagtatttccagggcgacgcgagcttcctggaagccgcccgcgccgcctgccacctgccggcgctgcgcaaggacttcatcgtcgacgaataccagatctacgaagcccgcgcgatgggcgccgactgcatcctgctgatcgccgccgcgctggagctgccgcagatgcaggcattcgaggcgctggccgacgagctgggcatggcggtgctggccgaagtgcacaacgaggcggagctggatgccgcgctgcagctgaagaccgagctgataggcgtcaacaaccgcaatctgcgcagcttcgaagtgagcctggccaccacgctcaaactgctgccgcgcatcgacaacggccgcatcgccgtcaccgagagcggcatcgccggcgtcgacgacgtgcgcctgatgcgcagcagcggcgtgcacagcttcctggtgggcgaagccttcatgcgcgaagccgagcccggcgaggcgctggcgcggctgttcagccagcagccctga

SEQ ID NO: 2247 - DNA, 759 bp, Chromobacterium substugae
atgagccaatcccacttcgcaggaaaagtcgcgctggcagtcggcgcatcgcgcaatatgggccgcgccttcgccgaggcgctggccgccgacggcgccgccgtcgccatccactacaacagcgccggctcccgcgccggcgcggaagaagccgccgcccagatccttgccgccggcggccaggctttcgccgtgcaggccgacatcaccaagatcgcggaagtgcgccgcctgttcgacgcggtggaagcgcgcttcggccatctggacatcctgatcaacaccgccggcatgatggtgaaaaagccggtcaccgaggtcagcgaggaagagttcgacgccatcttcgccctgaataccaaggcagccttcttctgcctgcaggaagccggccgccgcctgcgcgacaacggccgcatcctcagcatcggcacctcgctcttggccgccaccaccggctactacggcgtctacgccggcagcaaggcgccgctggaggacttcacccgcgcgctggccaaggaagtgggccagcgcggcatcaccgtcaacgtggtggcgcccggcccgatggacaccgaattcttctacgcggtggaaaccccggaaaccgtggcctacctgaagcgcgcaagcatcaacggcgagctgggccaggtggcggacctggtgccgctggtcaagcatctggtttccccggaaaaccgctggaccaccgcccaaaccctgttcatcaacggcggcttcgtctcgcgctga

SEQ ID NO: 2248 - DNA, 1044 bp, Chromobacterium substugae
atgtttgctgctccgttggctgtgccgcatgtcgcggcgggtgttgacgcttcgcagtgtattgtttggatatctcctgataaatatgatgattttgattacactatccataaagtcgatctaattggagcaggcatggaccggattcaggcgatgcaggtattcgccaccgtggtggacgccggcggcttcaccaaggccgcgcagcagatgcagttgccgcgcgccacggtgtccagcgcggtgcagcaactggaggcgcagctgggcgtgcggcttttgcaccggaccacgcgccgggtgcaattgacgctggacggcagcggcttctacgaacgctgccagcagctgctggccgatttcgaggaaatcgaggccttgttcagccagcagggggccaatccgcgcggcaagctgcgcatagacgtgccggggccgataggccgccaggtgctggcgccggcgttgccggagtttttccgccagtaccccgacatccagctggagctgggcgtcaccgaccgcccggtggacctgattcaggaaggggtggattgcgtgatccgggtggggcagcttggcgagtcgcggctggtggcgcggcgggtgggcatgctggcgcaaggcaattacgccagcccggcctacctggcgagtttcggcgaaccgcgcagcccggacgatctggcgcggcaccaggcggtgaactacgcgtcgccgtccagcggcaaggtgttcgcctgggagtggcagcgcgacggcgagtggcaggagagggcgctgagcgccaaaatcagtgtcaaccaggtggaaacctatctggcctgcgcgctggccgggctgggcctgatccagttgccgcgctacgatgcggcgccgcatgtggccgccgggcggctggttgaggtgctggccgactggccgccgccggcgatgccggtgtcggtgttgtatccgcaccggcgccatttgtcgcggcgggtgcaggttttcgtcgaatgggcctcggccctgctgcgggagcggctgggtttggccgactag

SEQ ID NO: 2249 - DNA, 501 bp, Chromobacterium substugae
atggaacacgcgctgtatcgcctgctggacgcgcagcaggtccactatcaacgcttcgagcatccgccggtctatacctgcgaagaggccgcgcgactgattccagacctgcccggcgcggagtgcaaaaacctgtttttatgcgacgccaagggccgccggcattttctggtggcagtgccggccgcggccggagtggacatcaaggccctgggcgaaacgctggacgccaaagggctgcgtttcgcctcgccggaaaggctgaagcgccacctggggctggagccgggatcggtgacgctgctggcggcggtcaacgaccgcgacgacgcggtgcaggtggtggtggacgccgaactgtgggcggcggaggccatcctatgccatccgctggtgaataccgccacgctcagcgtgccggtggccgacctggagcggctgttgcggcactgcggccacccgccgcgggtgttggcggtgccgcggcgcgatagccgctag

SEQ ID NO: 2250 - DNA, 564 bp, Chromobacterium substugae
atgaaaccgaatccatccagcggcatcgccgcgctgccggcgcgggaacgcatcctcgccaccgcgcaccgcttgttctaccgcgaaggcctgcgcgccaccggcatagaccggctcatcgccgaatcctgcgtcaccaaggtgacgttttatcgccacttccccagcaagcacgacttgatacaggcctacctggaacaacgccaccagcaatggatggcgggctttcgcgccgcgttggcgcgccatgccgccgacggcgccatggcgctggcccaggcgctgcgggaatggttcgcctccgacgactttcgcggctgcgccttcatcaacggcgtcggcgaaatgccggccgaagcggagctggccgaggcggcgcgccggcacaaaagcgaaatgcgcgatgcgatcgccgcgctgctgccggcccgcccggccccagccggcttggcagacatgctggcgctggcggccgacggcgccatcgtgcgcgcgcagatcgacggccggccggaagcggcgctggcggcgctggaaggcttgatcatgaaactggcggggtga

SEQ ID NO: 2251 - DNA, 468 bp, Chromobacterium substugae
atggaaaaccgcccgccgctgccgccgttcactcgcgaaactgcgatcgagaaagcccgcctggccgaagatggctggaacagccgcgatccggcccgggtggcgctggcctacagcgtggatacccgctggcgcaaccgcgtcgactttcctcagggccgggccgaagccgaggccttgctggcgcgcaaatggaaacgcgagctggattaccgtttgatcaaggagttatgggcattcgacggcaaccgcatcgcggtgcgcttcgcctacgaatggcatgacgacgccggccagtggtaccgcagttacggcaacgagaactgggccttcggcgccgacggcctgatgaccgaccgccacgccagcatcaacgacatgccgattgcgcaagccgagcgccagttcttctggccgctgggccgtcgtccggacgaccatccaggtttgagcgatctgggcttgtag

SEQ ID NO: 2252 - DNA, 1464 bp, Chromobacterium substugae
atgcttgaaaccatccggcagcgcttcctggcgctgcaaccgcaggcggatttttgttcgctgcgctacgtggaggaagaccgcgaacggctgcatgtccggcaggggcggcagcagccgttgagccgcagccacgaccgcggcgcgatgatcgtcgtgatcgatggcggcggctatggctatgcggccaccgccgacctgagcgaggcgggcctgcgcgccgctttcgcgcgggcgaaggcgtgggcccgcgccacggccggctgcggggtgttcgattaccgccaagtcgagttgcccagcccgtccggccgctacgccggcccgggcagcgagagcgaggctccgtggcgccgcgctgaattgctgggtttgctgatggaggaatctgccgcggccaagggcgaggacgcgcgcatcgtggattggtcggccggcctggtgcggcaggacatccgccagctctacctgacgtcgcgcggcggcgaggcggagcagcgtttccgcatgctgacgccgtcgttgacggtgacggccttcgccgacggccgagtgcagacgcgcagcctgggcggccagtatggcggcatggcgcgccagggcgcggaggaggcgttgatcgcggaggccggcctggccggcgccggccgccgcgtcgccgacgaagccttgcagctgctgcatgcgcccaattgcccgagcggcaagatggacctgctgctgatgccggagcagatgatgctgcagattcacgaaagcataggccatccgctggagttggaccgcatcctgggcgacgagcgcaattacgccggcaccagcttcgtcaccctggacatgttcggccattaccagtacggctccaacctgctcaacgtcaccttcgatccgctgcgccgccaggaattggccagctatggctgggacgacgacggcaaggccgccgacaagacgtggctgatccggaacggcgtgctggagcggccgctgggcggcgacatctcttcggcccgggccggcttggaggagatcgcgctggacggggtggcgaacagccgcggctgcaactggaaccggccggcgatagaccggatggccaacctcaatgtcgaacccggcgacaagactttcgaacagctggtggccggcgtggagcgcggcgtgctgatgcagaccaatgtcagctggtcgatcgacgattcgcgcaacaagttccagttcggctgcgaatggggccagttgatagaagacggcgaattgaagggtgtggtgcgcaatcccaattaccgcggcatttccgccaatttctggcgctcgctgcgggcggtgggcgacgagtctacgctgtcggtgctgggaacgccttattgcggcaagggcgagcccaaccaggtggtgagagtgggccacgcttcgccggcctgcgtgttcggcgaggtggatgtattcggaggagcggcgtga

SEQ ID NO: 2253 - DNA, 1317 bp, Chromobacterium substugae
atgcgggcgcatttcaaattattggcgaacgaactgaagcggcagctgcgggagggcgagggctttaccctgtggctggaggccgagtccaccgatttcgtcaggttcaaccatggcaaggtgcggcaggccggctcggtgcggcaggcgtatctggatgtgcgcctgctgcggggaagccgccaggtcacgcagcagctgtcgctatccggcgacgaccacgatctggccttgctggagagcagcttgccggccttgcgcgcggcgctggacgatgtggaggatgatcccttcctgttgctgaacgacaagccgcaggacagcgaacggctgtccgctgcggcgctgccggacggcgcggccatggcggaggatatcctggccgccgcgcgcgggcatgacttggtcggcatcctggccgccggcgagatgagcttcggcttcgccaatcatctgggccaattcaattggcagcagggcggcagctggaatttcgactggagcctgcatgcgtttggcgacaaggccgtgaagcgcagcatggccggcggcgaatgggacgcgggccggctgcgcggcgccatcgacgaggcggcggcgcagctggagtggctgaagttgccgcccaagacgctggagccgggccgttatcgcgcttatttcacgccttcggcgctgggcagcctgctgtccatgctcaactggggcggcctgtcggaaaaagaggtgcgttccaagcgcagccccttgttgaagctggccgccggcgaagtcggcctgtcgccgttggtgacgttgacggaggatgccgcggccggcctggcgccgatgttccagagcgatggcttcatcaagccggatcaggtgggcctgatcgtcggcggcgcgcaccgcaacagcctgatcgggccgcgcagcgccggcgagttcggcttggcgcccaatgccggcgcgcatgagatagcggaatcgttgcggatggaggcgggggccttgccgcagcagcaggcgctggaagcgttgggcaccggggtgtacctgtccaatctgtggtacctgaacttttccgaccgggccgcttgccgcatcaccggcatgacgcgtttcgcctgtttctgggtggagggcggcaagatcgtcgcgccgctgggcgtgatgcgtttcgacgatagcctgttcgatctgttgggcgggcagctggaggcgctgaccgccgagcgcgaattgctggcggacgccagcagctacggcggccgcgccacccagagcaaactgctgcccggcgccttggtttcctccttgcatttcagcctgtaa

SEQ ID NO: 2254 - DNA, 171 bp, Chromobacterium substugae
ttgggcgatatcggtcacaacgcattccttgattcagttcgcggcgcgcggtcagccgcgtcgcctggcacaacattcgccatcgcggcgaaagctggaaaaatgatgaaacgccgctgcgcggggagaaatcccggcccgccgacggcgcttgctaatccgtcacgttag

SEQ ID NO: 2255 - DNA, 1455 bp, Chromobacterium substugae
gtgaccgatatcgcccaactcgaacccaaagccgtctgggaacacttccaaaccctgtgcgacattccgcgcccgtccaagcacgaggaacaggtgcgcgactacatgaaaggctgggcggagctgcgcggcctggaaaccgtcgtcgacaaggtgggcaacctgatcatccgcaagccggccacgccgggctatgaagaccgcgccggcgtggtgctgcaaggccacctggacatggtgtgccaggccaatagcggcaccgagcacgacttcttcaaagacccgatccgcccggtattgaaagatggctggctgatcgccgaaaacaccacgctgggcgccgacaacggcatcggcgtggcgctgggcatggcggtgctgtccggcgacgacgtcgcccacggcccggtggaagtgctgctgacgctggacgaagaggccggcatgggcggcgcgctgggcctcgagaccggcctgctgcaaggccagtacctgatcaatatcgataccgaagagtggggcgagttctacatgggctgcgccggcggcgtggatgtcaatgtcagccgcgaatacgcggttgaggccgtgccggccggcttccagaccgcgagcctgaccatcaaaggcctgaagggcggccactccggcgccgacatccacctgggccgcggcaacgccaacaagatcctgatccgcctgctgcgtgaattggaggcggaaaccgaactgcgcctggccacgctcaagggcggcacggcccgcaacgcgctgtcgcgcgaggccttcgcggtggtggcctatccggccgccgacgccgccaaggtggcggccaagctggatgccttccaggcgctgatgcgtttcgaactggctggcgtcgacgaaggcgtggcggtgttgtccgaagccgccgccgctgccggcgtgctggctcgcgccgaccaagccgccattctgtccgcgctgcatgcggcgccgcatggcgtcaagcgcatgagccagcgcgtggacggcgtggtggaaacctccaacaacctgggcgtggtcaccgtggccgacggcaaggttttcgccaacctgatggtgcgctccctgctggattccggcacctggatgctggcgcgcgaagtggaaagcctgttcaagcttgccgcgttcaaggtggaaatggaaggcggctacccgggctgggcgccgaatccgggctccaagctgctggccttgttcaaggacgtgttccgccaggaattcggcggcgaagccgaggtgcaggtgatccacgccggcctggaatgcggcatcctgggcgccaaatacccgaatctggacatggtgtccttcggcccgaacatccgcggcgcgcacgcgccgggcgagcgagtggaagtggagtcggtaggcaaggcctggcagttgctgcaggcggtgctgaaagccattccggcgcgttga

SEQ ID NO: 2256 - DNA, 582 bp, Chromobacterium substugae
atggcgtctctgccgcttcccagcctggaaacccggctgcaattgcatgccgaaacggcgctgtctctggcctgcgccgctctgctcactctgctgtggcacggcgcgggcctgcatgcgctgctgccgcgccagggcgagcaatggctggcctgggcggtgttcttctggccgctgtggcgcaccgtgcggcacatcctgcggcggccgcgccaacgccaattgggcgacctgatcggcctttacgtcggcctggtgctgcaattcgccgtggtgtactacctgttcgcgctgctgctgaccggcggcagcgccttccacggcatgacggcgctgtacgacggccagggcggcttcctgcccggcttctacggccacgccgccttgctgttcctcgattgcttccacctgtccatcgccaccgccgccaccgtcggctatggcgacatgtaccccacctactggccggtgcggctgctcgccgacttgcagatcatcttcaccagcgcgctggtgatcataggcttcggccgccatttctccggccagggtccgcgcggcgccggcaagcaagccgactga

SEQ ID NO: 2257 - DNA, 1851 bp, Chromobacterium substugae
atgtatccgctgctagaaaacatcaacagccccgccgacctgcggcagctgtcccgcaaccagctgccgcagctggcgcgcgaactgcgcgaattcctggtggaaacggtcagcaagaccggcggccacttcgcgtccaatctgggcagcatcgagctgaccgtcgccctgcattacgtgttcgacacgccgcacgatcgcctggtctgggacgtcggccaccagacctacccgcacaagatcctgaccggccgccgcgagcagatgggcagcatgcgccagtacggcggcctggccggcttccccaagcgcgaagaatccgaatacgacaccttcggcgtcggccattcgtccacctcgatcggcgccgcgctgggcatggcggtggcggccaagacgctgggcgtggagcgcaagagcgtggccatcatcggcgacggcgcgatgaccgccggccaggccttcgaggcgctgaacaacgccggcgcgatggacaccgacctgctggtgatcctcaacgacaacgacatgtcgatctcgcccaatgtcggcgcgctgaacaactacctggccaagctgatgtccggccgcttctacgcggcgatgcgcgaaggctccagcaaggtgctgggcatcgccccgcctttgaaggaaatcgccagcaaggtggaagagcacgtcaagggcttcttcaccccgggcacgctgttcgaggaattcggcttcaactacatcggaccgatcgatggccatgatgtggacgtgctggtggacacgctgaagaacatcaagagcctgaaaggcccgcagttcctgcacatcgtcaccaagaaaggccagggctacaagctggccgagaatgacccggtcaaataccacggcgtcaccaagttcgaccctgccaacggcctcgccggcgccaagagcggcggcggcaaaccgcaatacacccaggtgttcggcgactggctgtgcgacatggccaagctggacaagcgcctggtcggcatcaccccggcgatgcgcgagggctccggcatggtgcgcttcgagaaagagcacccggaccgctactacgacgtggccatcgccgagcagcacgcggtgactttcgccggcggcatggcctgcgacggcctgaagccggtggtggcgatctactccaccttcctgcagcgcggctacgaccagttgatccacgacgtggcgctgcagaacctgccggtgatgttcgcgctggaccgcgccggcctggtcggcgccgacggccccacccatgccggcgccttcgacctcagcttcctgcgctgcatccccaatatgacggtgatcgcgccgtcggacgaaaacgagtgccgccagctgttgtacaccgccttccagctggacagcccgactgccgtccgctacccgcgcggcaccggccccggcgtggaaatccagcagcagatggcagcgctgccggtcggcaagggcgtggttcgccgccagggcggcaagatcgccatcctggccttcggcagcatggtgcgccccgccctcgccgccgccgaagcgctggacgccaccgtcgccgacatgcgcttcgtcaagccgctggacatggagctggtgcgcacgctggcagaaagccacgagctgatcgtcaccgtggaggaaaacgtggtgatgggcggcgccggctccgcttgcctggaagcgatgcaggaaatgtggctgagcacgccggtgctgcagctgggcctgcccgacgactatgtcgagcacggcgacccggcgctgctgctgtccaaatgcggcctggacgccgccggcatcgaggccagcatccgccagcgtctggccggctga

SEQ ID NO: 2258 - DNA, 897 bp, Chromobacterium substugae
atggccaatgaaaccttcatcggctggatgaccgccatccagcagcaaatggaaaccgcgctggaacgcctgctgcccgccgccgatgccgcgccgcagcgcctgcaccaggcgatgcgctacgccacgctggaaggcggcaagcgggtgcgcccgctgctggccttcgccgccggcgagctggtggacgccaagccggaaaacctggcccgcgtcggcgcggcgctggaaatgatccacgcctattcgctggtgcacgacgacatgccctgcatggacgacgatgtgctgcgccgcggcaagcccacctgtcacgtggcctacgacgaagccacggcgctgctagtgggcgacgcgctgcaaacccgcgccttcgagctgatttcgcagccgctgccgggcatcgccccggccagccaattggaaatggcgcgcacgctggcgcacgcctccggccatgccggcatggcgggcggccaggcgatagacctggccagcgtcggccagccgctgacgccgccggagctggaattcatgcacatgctgaaaaccggcgcgctgatccgcgcttcggtgctgatgggcgcgatggcaggcagtgaactgtccgccgcggataaagaagcgctggacgtgttcgccaagcgcgtcggcctggccttccaggtggtggacgatattctggattgcgaggccgacaccgccacgctgggcaagaccgccggcaaggacgccgcccatgacaagcccacctacgtcagcctgctgggccttgccgaggccaagcgcatggctaaggatttgcacgaccaggccttcgccgcgctgcagggcttcggcccgcgcgccgaccgcctgagacaactggccgactacatcgtcgcccgctcgttttga

SEQ ID NO: 2259 - DNA, 234 bp, Chromobacterium substugae
atggcaaaagccgccaaagcgccggccagcttcgagagcgcgctggcccagctggaggacatcatccaggcgatggacagcggcgatctgccgctggaaacagcccttgcctcctacaagcaaggcaccgaattgatcaagttctgccaggccaagctcgccgacgcggaacagcagctgaaaatcctggaaaacaacgaactgaaggcgctggatctgcccaatggccaatga

SEQ ID NO: 2260 - DNA, 132 bp, Chromobacterium substugae
atgccgctggagcaaccggtgatcaagatggaaggctggatgtctgacatgaaaaacctcgcgcgatgggcaaacgtccaaccctacaccaatcgccgcggcgccggaatcggccacatgacaaacatctga

SEQ ID NO: 2261 - DNA, 813 bp, Chromobacterium substugae
ttgatcaccggttgctccagcggcatcggctaccacagcgcgaaagtgctgagccagcgcggctggcgggtgttcgccagctgccgccgtccagaggacgcgatgcgtctgcgagaggagggactggagtgcctgcagctggatgtggacgaccccgcgtccatccaggcggcgctggccgaggtgctggaacgaagcggcggtcggctggacgcgctgttcaacaatgccggcttcggccagccgggcgcggtggaggacatttcgcgccaggcgatgcgcgagcagttcgagaccaatctgttcggcccgtgggagctgaccaacgcggtgctgaaagtcatgcgcgcccagggctacggccgcatcgtgttcaacagctccatcctgggcttcgccgcgatgcgctggcgcggcgcctacaacgccagcaaattcgcgatggagggtctgtgcgacacgctgcgccatgagctgcacggcaccgacatccatgtctcgctggtggagccggggccgatagagagccgtttccgccccaacgccttggcgcgtttcttgaagaatgtcgatatcgacgccagcgtgcaccgcgacaactaccagaaacagttggaaaggctgaaaaaggaggggcacgccgcgccattcacgctgccggccaccgcggtggccgaggcggtgtggcgggcgatttcctgccgccggcccaaggcccgttatccggtgacttttcccaccaaactctactggctattgcgccgctggctgccgcagcgctggtacgaccatgcctgccgcagcgccacttga

SEQ ID NO: 2262 - DNA, 1794 bp, Chromobacterium substugae
atgaagcacctgaaatggctgcccatgctgctgatgggcgtggcactcatgcctcatgcccaggcggccgatcccggcaaagtgctcagggtggcgttttccgcgccagagaccggattcgacttggtcaaagtgcacgatgtttattccatggcggttggcgagaacatctttgacggcctgctgacctatgactacctggcccggccgttgaaagtggtgcccaataccgccagcgcgatgcctgaggtgtcgccagatggcaaagtctttacattcaaggtgaaacccggcatttattttgcggatgatccggcgttcaagggcaagaagcgggagttgaccgcggcggactacgcctacactttcaagcgtttcgccgatccgctgaacaacgctcccagcggcgcgtcctatatggatttcatcgccggcctggaagaggcatccaaaaaagccgctaaaaccggcaagttcgattacgacacgccgatttccggcctgcaggtgctggaccgctacacgctgcgcatcgtattgaaaaagccgaatttcggattcctgtacaccatcgccgccaaggattccggcgcggtggcgcgcgaagtgatcgagacctatagcaaagacaccctttcccatccggtcggcaccggtccgttcatgctgaaagagtggaagccgggcaaccgcattgtgctggtggccaatccgggctatcgcaagacggtgttcgacggctcgccgggcagcgagccgggcgacgcggaaatctaccggtcgctcaagggcaagaccttgccgcaagtgggccgggtggaaatccgcatcatcgaggaagaccagccgcgctggctgtctttcatgaacaagcaactggactggatcaacgtgcctaagtcggcgatgaagtccgcgttgaacatcaatccggccgacccttacgacaccaccctgcggccggtgctcgccaagcgcagcatccggcttagccatacgctcggcttggatgtcacttacgcctatttcaatctgaaagatccggtcatcggcggttacggcaaggataaagtcgcattgcgccgcgccatcgccatggcctatccgttgcagaaggaagtgattcctctgttatacggcaatcaggccattccgcttcaggggctggtgcctgtcggcatggtcggttttgatccgcatttccagggacaggtgccttacgacccggctaccgccaacgccttgcttgacgagttcggttacaagatcgggccggatggctatcgcaccctgccgaatggcaagccgctggtcatagagcagggcactcagtcctccgcgaccgacaagcagttcaatgagatctggcagaaggcttttgacagcatcaaggtgagagtgcgcttcaaaaccgccaagtggaatgagaacctgaaggcggcttacgcctacaagctgcagatgtggagcctgggcgggtcggcctcgacgccggacggcgacgatttcgtctccagcttttcctcgcgcttgatcggccagggcaatctggcgggctatcaggtggcggcttacgacaaggcctacgacgcatcgcagatactgccggacggagcggaacgtcaggccttgtacagcaagatgaaccgcctggtcgcggcgcagcagccctatgtgctgggcgtcacccgcttttacaacgaattgacccagggttacgtcagcggtttcaagcgccaccccatttccactttcggcggtttctggcgttatgtggacgtcgcgccgcactga

SEQ ID NO: 2263 - DNA, 942 bp, Chromobacterium substugae
atgattgcatatgtcattcgccgtctctggcagatgatccccaccatgctgggcgtcatgctgctggtgttcgtgctgttcaactgggtgggcggagatcccacctatattctggaaggcaagcgccttacgccggaaatgatggccaacttccgcgcccagatgggcctggacaagagcctgcccgagcaattcctgctgttcgccaagcaagtgctgacctatgacttcggcaactcgtgggccactcagcattcggtggcgcatacgctggccagccgggtgggcccttcgttgctgctggccggcagcttgctggtgctggagctgttcactgcgctgcccatcgccgtggcggtggcttatttccgcggcggcctgaccgatcgtctagtcacgctgatctgcacggtggcgatgtcgatcagctccctggtctacatcatcgtcggccaataccagcttggcttcgcgctggattggttcccggtgatgggctgggacgacgacagcatcgtcgccaatctgttcgtctatctgcctttgccgttgttgctgggcctgctggtgtcgctggctcccagcgtgcgcttctaccgcagcttcatcgtcgaggagctgaaccacgattatgtgcgcaccgcgcgcgccaagggtttgtccgaacccaaggtgctgttcaagcacgtgctgcgcaacgcgctgatcccggtggtgaccaacatcaccatgtcgctgcccttcctgatgctgggctcgatgctgctggagcgcttcttcggcattccaggcatgggcaacgagctgctcaacgcggtggacaagagcgacttcccggtgatcaaggcgatcaccatcaccatcgccgcagccgccatggcgttcaacctgctggccgacatcctctacaagtggatcgacccgcgcgttcagttgaagtga

SEQ ID NO: 2264 - DNA, 1047 bp, Chromobacterium substugae
atgacgacattgcagaataccgccggcgccgcgccggccgcgccatcccgcagcctgtgggcgctgggttggcaaagactgaagcgcgaccgcatcggtttcgcgtcgctgtggatcgtggcggctttcatgctgctggcgctggccagctggctgggcctgatcggccgcggctggaacgacgagatcgccgtttcctacgcgccgcccaccgcgatctaccagcaggacaagtcggtcgccgtgcacaagtccaaggccgccgaaccggcgctggaaggcttgaaaccggcggaagacccgatctgggcggaaacccagcgcgcccgtcagaaccgcgacaaatacgtggtgccggaagtgaagaaggcggaatcgctcaccttcggcgccgatcagcgcggccgcgacatcctggacaaggtgatcaagggcacttccacctcgctgttcgtcggcttcttcggctccttgctggccatcgtcatcggcgcggcgctgggcgccagcgccggtttcttcggccgcaaggtggatgatttcctgatgtggttctacagcgtgttcaccgcgatgccggacatgctgctgctgctggctttcgccgcggtggccggccgcggcctgggcaccgtggtgctggtgctgtcgctgaccacctggaccggggtgttccgcctggtgcgggccgagttcatcaagctgcgctcgcgcgaattcgtgcaggccgccgacgccatcggcgccagcagcgcgcggcggatgttcgtccacatcctgcccaatatctcccatctgctgctggtgcagttctccttgctgatggtcggcctgatcaaatacgaggtgatcctgtccttcctcggcttcggcgtcgacgtgcgccaggtcagctggggatcgatgctggccgaggtgccggaggagttgctgcagggctattggtggcaactggcgatggtggtggtgttcatgtcggtgctggtgacggcgttcagcatgctgaccgattccctgcgcgacgcgctggaccccaaggtaaagtga

SEQ ID NO: 2265 - DNA, 1545 bp, Chromobacterium substugae
  modified_base (1478)..(1478): a, c, t, g, unknown or other
atgagcaacaacaaacctttgctgtccgtgcgcaatctgaaggtgggcttccgccaggaagacggcggccgcttcgaggcgctcaagggcgtcagcttcgacattccggcccaccgcacggtggcgctggtcggcgaatcgggctccggcaagtcggtgacgtcgatggccatcatgcagctgctgccgccgcaatccagcgagatcgatccggcgtccgaactgctgttccagggccgcaacctgctgcggctgtcgcgcggcgagctgcgcaagctgcgcggcaaggacatcgcgatgattttccaggagccgatgagctccttgaacccggtgttcagcgtcggcgagcagatcgtcgagacgctgacccttcacgccggcttgagccgttccgccgcctggaagcgcgcggtggagctgctgcgcgaagtgggcctgccggagccggaaaagcgggtgaaagcctacccgcacgaactgtccggcggccagcagcagcgggtgatgatcgccatcgccatcgcctgcgaaccgaagctgctgatcgccgacgagccgaccaccgcgctcgacgtcacgattcagaagcagatcctgcaactgatcgccgacctgcagaagaagcacggcatgtcggtgctgttcatcacccacgacctgggggtggtcggcgaattcgccgacgaagtgatcgtgatgcgccacggcgtgatccgcgagcaaggcacggtgaagcagatcttcgaaaacccgcaggacgcctacaccaaggcgctgctgtcgtgccggccgcacctggaccgccgcccggagcggctggcggtgatcgacgacttcctccagccgggcggctatgtcgaaccggccgaaaggacacgtggctacgccgccggcgacgaaatcgtgctggacgtgcaagggctgtgcaagagcttcgacatccgcgaagggctgttcggcaagcgccagttccacgcggtgaaggacgtgtcgttccagttggcgcgcggcaagacgctgggcatcgtcggcgaatccggctcgggcaagaccaccgttggcctgacgctggtgcggctgcaccaggccaccggcggcaaggccttgttccacggccaggacctgatcggcatgagcgccaaggcgttccacgcctacaagaagcggatccagatcatcttccagaacccgtacgcgtcgctgaacccgcgcttcaccgtcgagcagatcctgaccgagccgatgctgctgcacggcatcggccaggacggcgggcagcgccgcaagctggcgctggacctgctggacaaggtggggctgccggcgggcgcgctggccaagtacccgcacgagttctccggcggcctgccgctggccgccggagaactcgtgcgggtacttggccagcgcgcccgccggcagccccaccttgtccagcaggtccagcgccagcttgcggcgctgcccgccgtccncctcccccccacccaaagccggcgccatttgcgtcaccggaaaacgcctaatcccgcgcatggctga

SEQ ID NO: 2266 - DNA, 447 bp, Chromobacterium substugae
atgaacgacccgatacccctgtttctggatatttcatcccagctgaccggtttcagcgcgaccgagctggaagccaccggcatggccagcctctactgggacaccgtcctgcgccagaaccccccggccgatgtcgaaggcttcctgtcctgttcgcgcagaatcctgcaggagggcggaggcgatgaaaccgccatccacgagatgatcgccgcccagctctttcccgtcagccagttcggcggcctcgcgcagaacctcatcaatctctggtacctgggccaatggattccggccaaccagaacttaggcctggccatgcagcacaacgtcagcagcgaggcctatgtgcagagcctggtctggcgcgccgcccaaacccatccgcccggcgccaggcagcccggcttcggctcctgggcggaaaagccgctcaatcccaactga

SEQ ID NO: 2267 - DNA, 1908 bp, Chromobacterium substugae
atgcgcgactcccaatacgacgttgtgattgtcggcaccggcatcgccggcgcggtgctggccaaaagcctcacccaggctggcaagcgggtgctgatgctggaagccggactgcaagccggtctggagctggacgccgaatccgcgttcgccaactaccagtcttatgtcgacaccttccactacaaggccaacccggccaccaacggcccctatccggcgctgcaggatgccccgacgcccaatgtgctggacatcgcgctgggcgacccgatggaccagaccggctacctggtgcagatgggtccgctggccttcggcagcgactgcctgcgcaccccgggcggcaccacgctgcactggctgggcaatgtgccgcgcatgctgcccaacgacttccgcatgcagacgctgtacggccgcggcgtggattggccgatcagctacgacgagctcaagccctactacgaactggccgagctggagataggcgtgtcaggagatgcggccgcccaggtcggcccggacatgggccgcgccaactacggcgccggctacgtgtttccgatgcaggccatcccgcagtcgtaccaggacaaggtgtggatccgcaacgcccagggcgcgaaggtgcgggtggacggcgccgactacgacgtcagcttcatcagcatgccgcaggggcgcaactccacccccaatccggactatccctactccgccatcgcctgggagccggcctcgcagcgcttcgctccgcagcgagtcggcgcgcagtatcaagtcatagggtccacctggtcgccgtataccggcgagcgctgcgaaggcaatgccagctgcgtgccgctatgcccggtccaggccaagtacaatgcgctgaaaaccctgaagcaggctgaccgcagccggctgaccatccacacccaggccgtggcgtccaaagtgcggatcgacccgcaaagccggcgggtgaccggcatcgaatacaagcgctaccagaagccggacgccggcggctacaccaaccataccgccgagggcacgctgtacgtgctggcggccaacgcgctggaaaacgccaagctgctgctgatgtcgggggcggccaacagcagcgaccaggtggggcgcaacctgatggaccaccaggtgatgctgacctgggggctgttcaagcacgaaaaggtctatccctaccgcggcccgggctgtaccacctacatccccactttccgcgacggcgccttccgcaaggatttttccgcgtggatctccccggtggacaactggggctggtcgtggcccgttttctcgcccggcagcgatctaagcgacggcatgaacaagggcctgttcggcaaggcgctgcgcgcctatctggccgaccgcgtgccgcgccaggcgctgttgcatttcgagtgcgaacagctgcccaggccggaaaaccgcatcaccatagacgagcgcttcctggaccggctgggcaaccccaggccggtgatccactactcgctgtccgactacgagctcagggccttcgccgccgccaaggaagcgtcggaccagatcttcgcccaggcgcagatcaaggactacacgcattaccccgccaacgagggcgaccaggacgtggtgcagtggcagggcaagacctatcagttctggggcgccggccacatcgtcggcacgcaccggatgggcagcgaggcggccagctcggtggtgaagccgacccagcaaacctgggaccacgacaatctgtatctggtgggctgcggcaatatgcccacgctgggcacctccaaccccaccctgaccctgaccgcgctggccttcatggccgcggaaaacatcctcaagcaactggactcgccatcccgccaaggagacgctcatgagcaatga

SEQ ID NO: 2268 - DNA, 1149 bp, Chromobacterium substugae
atgagcaatgactacctcgtccagaccgcccagggccgccgccgccaacgcctggtccgtccgctgcaaagcccgctgcaggcgctgcgcttcaccgccgagccggcggagtttcaagttagcggcaccatcaaaaccctgccgcaattgcgcgagcacctgcaaaccgccatccagctggaacacaccaccattccgccctacctgaccacgctgtacacgctggatgaacgccgcaatcgcttcgcctaccaggcgatacaaggcgtggtgatggaagagatgctgcacatgatccaggtttgcaacatcctcaacgcccttggcggcagcccggccatcaacacgccgcacttcatcccggaatacccggccccgctgccccacagcgacaacgcgttcaaggtgccgctgcaaaaattctcgcccgacaccataagcgttttcctgcagatagaaatgcccgcgccaagcgacgcgccgcccgaggccaaccattacaacagcatcggccagttctacgatgccatccggctggcgatagaggagctggacgccgaaaactggctgaagcatggccgcagcctgtttgacgagtttccggaaaaagccggctatcaaatcctgcccgagcactattacggcggcggcggcaaactgctggcaatccgctcgctggaagacgcgcggaacgccatcgaggaaatcatcggccagggcgaaggcgtggatggcaccatcatcgataccgacagcattgagttcggccaggatgtcgaatacgcgcactacttccgcttcaacgagatcaagcacgcgcggcgctatctgccggacgacagcgcgcgcctgccgcccaccggcccggccgtggaggtggactggaacgcggtcatcgacatggcgcccaaccccaggatggccgactacccggaagattcgccgctgcggcggcagtcctgggaattcaaccgcacttattgccaattgctgaacctgctgcacatctcctgcaacggcaagcccgaccggctgggcgaggcgataccggtgatgtaccagctcaagtaccaggcccaggccttgctcaaccttcccaacggcgccggccaaagggcggggccaagcttcgaatacgttccgctgtaa

SEQ ID NO: 2269 - DNA, 1059 bp, Chromobacterium substugae
atgcgcatccaggaactgcaccaagccctagccgacatcggcgcccgcccctgccacatcggccgtatccatcgcgcctggctgcaaggcctgccgctggatgccggcaccagccggcaaaagagcgaagactacttcccgctgtcggtgcgcaacggcctgccgcccatcgccgcgcggctggaagcgctggcgcgcgtccactcgcgacaccccgccgccgacggctccttgcggctattggtggcgctggccgatggccagatggtggaaagcgtgctgctaccacgggacggcttgtgcgtatccagccaagtgggttgcgcggtgggctgcaccttctgcatgaccggcaagtccggcctgctgcgccagctgggcagcgccgaaatcgccgcgcaggtggcgctggcgcgccgcatccgcccggtgaagaaagtggtgttcatgggcatgggcgagccggcgcacaacctggacaatgtgctggaagcgatagactggctgggcaccgatggcggtatcggccacaagaacctggtgttttccacggtgggggacccgcgcgtgttcgaacggctgccccagcagcgcgtcaagccggcgctggcgttgtcgctgcacaccacccgcgccgacctgcgccagcagctattgccgcgcgcgccgcggatagacccggccgagctggtggcgcagggcgaaacctacgcccgcctcaccggctaccccattcagtaccagtggacgctgctggccggcatcaacgacagccagcaagagatggacgccatcgcgcgcctgctcaagggcaaattcggcgtgctcaacctgattccctacaacagcctggaggccgacagctttcagcgccccgccgccgaacgcatagaagaaatgaagcgctatctgcacggccagggcgtgctgaccaaggtgcgcgactccgccggccaggacattgacggcggctgcggccagctgcgcgcgcggacggcgcacgtgatagacgccagccggctatcgcggcgggagcaggccggcatagcccgcgcgtaa

SEQ ID NO: 2270 - DNA, 936 bp, Chromobacterium substugae
atgcctgcccgcaacgccccgcccgtagtcgacctgcttgccatgcagccgggcgacatcattctttcgcgcagcgtctcgtccgaccgcaaattgattttcgcgcaacgcgtgctgcacccgacccgcgacctgctgcgcgcccgcagggagttttgcacccatgccagcgtatacctgggccacggcctgctggtggaagcggtgcgcgatggcatcgccctgcgcgcccttagcctgaaagcagacgacttcttccacgatgcgcccgccgcgctctcgcctgacgccgcgccgccaaaactacgcgtcaactatcgcccgcaggccgacggctatgaatatttccgggtagtccgactgaaacaggacgccgccgccctgggccgaggcatcgcccaaaccgcgctggacttatggggcggggattacgccagcgtgaaggaattcctgaagtttctgcccttgcatccggccacggggaagatcagcggcggcgcaaaggaacaaggcgagatgttctgttcgcaactggtttgccatgcctaccatgccaacggcgcgcggctccacgccggcaatctggccaaaagcccgatgtcgctgcggcccgaccactgccgccagcttggctggccgcataccacgccggtggcgacgcaatatccgctgccggagctggcgcaaaccgaagtcggcttctacttgataagccgggccgcgctgatcaatgccttgccgatgcgcaagaccctgttttccatccacgcgctgctcactcccggcggccagccgctgacaagtgaacggcacacccatgccagtgaaatcgccggccagatcgacgcgctggaccagcactgggctgcgttgcacctgcccctggaacagaaactgcagcgcctgaccggcatgctggccacggccggcgcatag

SEQ ID NO: 2271 - DNA, 951 bp, Chromobacterium substugae
atgtatgcctgcctggccttgcatcccgcggtcagggacaaggccgcggctggcgaaccggtgcgcctgctgctgggtttcgatgggtttcaccagggcatagccagcgccatcgcggccggcgccgccgccgagtttcccggcgacgcgcagctgctgccgctggaaacagcccagcccgacgacatcgccgacgcgatagcgcgctgcgatgcgttcatctttctgtaccgctcatccacgctgcaggcggttggccacctggggccggcgtttctgcagccgatcaagaagaccatgcaggacaactggaaaaaatccatcctgttcaaggactacggtccgcactttcatgaggcgttcgccgagccgcgcgccagcatcgccgcgcgcaaccaccgcttgatggcgctggccaaggagtcgcggcaggtggtgtttgaacaagcggacggcggccggctaactggctccatcggcccggagcaggcctggacttcgatagacggcgacggcaatgtcgacctgacgcccggcgagatcgccaccaccatccgcgatctggacggcgaagtgcgtttcagcggcgcctttctcagcaccatcccctttgccgtcaaatacggcgtggtgcgggatttcgtttccatccgcatacgcgccagccaggtagtggatttctcttgcgacgacgcgcgcttcgccgccgatttcgacaaatacctggcggccaatgccggcaaccgcacggtggaggagttcggcatcggcaccaattgcggggtgaagggcctgtacggcttgaacgccggcttcgaggagcgccatcccggcctgcacctggggctgggcggcggcgtgctgggcagccaccacctggatctgatctttgccaacggccggctgagttttgacggcacgtcgtttttcgacgacggctttctgatctaa

SEQ ID NO: 2272 - DNA, 132 bp, Chromobacterium substugae
atgatcgaaaacatccaaacccaggatatcgaactggatgcctggttccaggaagaaactttcgccgaagcggttgaaatgatgcaggacaaggcggttgtgccgttcggcacggcgctgtggccggtctga

SEQ ID NO: 2273 - DNA, 330 bp, Chromobacterium substugae
gtgttcgcgctgaaaatcggcctgatggcggcgacggtgtacggcgcggtgaagacggcggacatggcctgggggctgggcgatatcggcgtggggctgatggcttggctgaacatcgtcgccatcatcttgttgcgcaagccggctctggcctgcctgaaagactacgaagcgcagcaggcgcaagggctggacccggtgttccacccggaaaggctgggcatcgccaatgccggctattggagcggcggccgagccgagctcaaccaggcggcggagcggcccggcgagcagcctgccggcgaagccgctccggtcaaggcaagctga

SEQ ID NO: 2274 - DNA, 267 bp, Chromobacterium substugae
atgcggctgtatggtgacgagcgcgccgacgaatggaaagccggcgcggcgttctgcacctgctcgaacagcaccaaactggtcaacctgccgccgaccgagaagatgctggccgccaagcgcaccgggccgaagccgccgaatttggcggaggcctacaagttcttcactggccaggatctgctcggcgcgcacaacgccatggtggacgtggccggctgccgcgaggtgtatttcggcatcctgcggcaccgggaggcagcgtga

SEQ ID NO: 2275 - DNA, 132 bp, Chromobacterium substugae; identical to SEQ ID NO: 1309

SEQ ID NO: 2276 - DNA, 216 bp, Chromobacterium substugae
atgaccaccaagcccgccaccatcaccgccaccatggatggcgacgcagcctaccaattggcgcagttctgcaagcgcgtcaatttcagcacgttctacgagctgaccgaggcgcatttgtcccgcgacgaacgtacccggcgcgcctacctcatggtcgatggactgacggccatcatgaccgggctgaacgaagccggccactccccgcgatag

SEQ ID NO: 2277 - DNA, 369 bp, Chromobacterium substugae
atgcaacacctgcacgacatccccgacaccggcgcggcgattgccgcagtcaacgaggccaacgcggccggcgacctcaacctgggcgagcagcccaccagccacatcaacggcgtccacgtctacgaaatgaacgactgcgactgggttgttgcgcgctcggagcaagaggcacaggcctactactgcgacctgaatggcgaagacgatccgccgcgcgcattgactgccgaggagctggatcgattggactttttcgtcgatgccgagaagcccgacggccactcaatcacgttccgtgagcgtctgcagcaactggtagacaacaacgagcaaattcccgacctgttcgccacgacggagtattga

SEQ ID NO: 2278 - DNA, 663 bp, Chromobacterium substugae
atgcaacccctgacccaactggcggacgccgcgcgcgccgtcatcgcagctttcgaccgtgccggcgagctgaccgacgaactgatcagtgcgctggagctggcactgaatggagccgagctgtcgccggccaccgagcagagcggcgaggagttggcgtggctggtggtgaatatcgacgaccaggacgagcagtatgttccggcgagcgataagcgccgcatagagcatttccgcgcatctccgggcgcatgggaaatgacgccgctctacacccgccagcagcccgcgccggctgtgctggatgggtggcaatctggcgtggaggcatgcgccaagatgctggagaagaaggctgaagactacgcaagcgagttcggccattcggacatgggcgcgttgtcattcggcagcgggttccatgcagatgtgaagcgcgaccatcattccacactgctggaactggccgaagagctgcgcgccctgctcgccgccgcgccgcagccggcacagcagctgccatccgtgatcgaagagatcgctctgcagtgggacggctgcgaatacgaatcgtcgaccggccaaattgacattggctgggcgatccgcgccgctggccagcgactgctagccgcgccgcagccgagggaaggggccgcgtga

SEQ ID NO: 2279 - DNA, 633 bp, Chromobacterium substugae
atgcaactaatcggcctcgccggcccgaagaaatccggcaaagacaccattgccgaccatctggtcgccaatcacggcttcgtgaagatcggcttcgcggacaagatccgggaggaactgcgcgcggcctaccctggcttggaaacgggtgcattcgaaaatcaagcattcaaagacgtcaatgacatttctcttgctcttgagcattgcgagaacttgggcttcatagactggctgaggcaaagacgcgtagtagagatatacgccgagctgagcgagtcccgctcgcctcgctggctccagcagcaatggggagactaccggcgcgcgaccgccggctgggattatttcatctgcgacgtgcgggcgcgcattgaggcatcaacggcaccggtcgtcgtgtccggcctgcgctacgcagccagcgcgccgatcccgaccgccgaggccggtttgatccggcagctgggcggctgggtttggcacatcaaccgaccaggctatcaggcgtcggccgagcacacgaccgaaatcgccctgccgcgccactcacgcgacctcaccatcgacaatgacggcgacgtcaagaccctgctcgacgtggtcgacctgacagtcggggcgcttgcatga

SEQ ID NO: 2280 - DNA, 705 bp, Chromobacterium substugae
atgaatgatggcatgatcgaattcaatccactggatcgagtggctttgcgaaagctgctttctcaaacctcacacaaatctgactattttgtcgacccattttcgattgaggagattgaagcaatcctgaaattcgcatcgggaaacgatgtaaatatgtatcaattttggtttgagactggtttgcggcaaggggagctaattgctttgcgctggtcgaaagtcgatttcatccatggatcagtcaggattgaagaaaacatcgtagtcaaagaggagaaagggccaaaaactgccgcaggtatccgtgacattaccttgacggccaaggcgctggaagccctgcagcggcaaaaggcgatttcgtttctggccggtgatcgagtcttcactcaccacaagaccggcaaggggtgggagacggaaaagcaaatccgaatgagctcctggacacccctgctgaagcgggctggcgtccgctacaggaatccctatcagatccgccacacgttcgcctctcaccacgtcagcaacggtgcgaacctctggtggttagctcgccagctcggccacgagactatcgagatgatcatccggcactacggcaagtgggttccgctggagcgaagaaacgtgggcgaaaattgggcgaacacgacgacagcaggaggcggcaccagacagcaaagaaaaacggcagactag

SEQ ID NO: 2281 - DNA, 621 bp, Chromobacterium substugae
atgtcgtcattcccgttgccagattccgcagagcccgtcatccagtatgtggccagctgcgaattgcccacgccctggggcgagttcgtcatgcacggtttcgaagaagaaggcggccgcgagcatgtggcgctgacgctgggcgacgtgtcggacggccagccggtgttggcgcggctgcattccgaatgcctgaccggcgacgcgctgttttcgctgcgctgcgactgcggtttccagctggaggcggcgatggaggccatctgcaaggagggccgcggcgcgctgctgtatctgcgccaggaaggccgcggcatcggcctgatcaacaagatccgcgcctacaagctgcaggatggcggcgcggataccgtggaggccaacgagcggctgggcttcccggccgacatgcgcgacttccgcatcgcccgccacatgctggagcacctgggcataggcagcgtgcgggtgatgaccaacaatccgcgcaagctggccacgctggcggccgccggcatcgacgtggccgaacgggtgccgctgcaagtggggcgcaatccctacaacgatcgttatctggacaccaaggcggccaagctgggccacatgctgagcaaataa

SEQ ID NO: 2282 - DNA, 723 bp, Chromobacterium substugae
atgatacccgcaagccagctgaccgactatctgcgagagcaggcgctgaatctggatgtcacggagctgcagatcgccgtgatcacgctgcaggccgtcctcagcgtggacaagcccgcgccgcgccgcgacctgtaccgctaccgggtgcccaagctgggcgagggcggcagctgctcgctggtgaacgagctggacgacaccccgtacgacctgtcgttcgtgctgggtggcgaaacgccggagctgaccgccgcgctggtcaacctcaacgcgctggtggagtcggtcaacgccaaggtcggcgccgaatggctgggcatctaccgcaagatcggcgtcggcaaggacgccatcctggtcaagctggcttaccagggggtggagagccgcgccgaattcccgctgaccgaagccttcgccgaatacagcaacaacagccgcgtcggtctgaccggctgggcggtggtggtcgacgacgtggcgcagtggcgcgccgatggcggcggctactacgaatgcgacccgaaagtgaaaagcgaggtttgcctgccggtgctgggcggcgacgacaatgtgctgggcatcatcgacgccgaggctttcgagcccggcttcttcacgccggagcgccaggtgtggctggcggccctcgccatcgtgctggcgccgcagctggccgcgctacctgcgcttgaaaaaccggattcgctccccaactaa

SEQ ID NO: 2283 - DNA, 1074 bp, Chromobacterium substugae
atgacagccattcatatccgccacccggcgctcaccatcaaggccggcgccaaagcccggcaaatcctgcaacgcggcctgtcggcgcaacaagtcggcagcctgcccggcgcggccgggggacccaaggcggtggggctgaccgggctggaccaggcggtgttcgaatggctggccggcgcgccgcgcgagcgcgagctggtgggcgcgtcgataggcggctggcgcttcgcctgcgcgatgcagccggacccggcgcgggcgctggcgcgactggccgaacgctataccgaggagggctattccccccgcgtcaccaccgcccagatcaccgcgcagacccgcgccatgctggacgacatcctcggcgcggacggcctcgccaggctgctggaccatccgcattatcggctgagcctgctgctggtgcagtcgcacggcctggccaatagcgaggcgaagccggcgctgttgtccggcctggcggtggcggcggcgctgaacatggtgtcgcggccgctgctgcggcacagcttcagccgggtcatctgccatgatccgcgcagctcgctgcgcttcaagccgacggacgccatccccacccggctgctggcgctggacgccggcaatctgcggcaggcgctgatgggcacggtggccattcccggctttctgcacggcgtgcagctgcccgacgcgccgccggccatctaccgcgacggcggcctcaccgactaccacatcgacttccccttcgccgacggcgaagagatcgcgctatacccgcacttcaccgaccgcatcgtgccgggctggttcgacaaatcgctgccttggcgcaaggccagccgcagcaatcaggccaataccgtgctgatcgcgccgtcgcgcgagtacctggcgcggctgccctccggcaaattgccggaccgcaaggatttccaccgctacctgcggcgggacgcgctgcggcgcgagcactggaaaaccgccagcgcggaaagccagcgcctgggcgacgccttccgcgaatggctggagaagcccggctccatcgcggtgcagccgctttaa

SEQ ID NO: 2284 - DNA, 2622 bp, Chromobacterium substugae
atggcctcggcgctgctgtcggcatgcgtgggcactggcggcggcgatcaggccgcggccaagcagcccgcgccgcaagccaaccagccgtcggcgcgctattcctcccattctccggccttgccggaaaaaccggactacccgcacggcctgccgccggccgcgccggataacggcgccgggcagccgccggccaagccgcaaggccagcaaggccaggccgcccgccgggcggcgaaggccgaagcggccgcgccggcctatgccgattgcgacgaagccaagctcggccagctgtccggccaggccttggtgcgctacgtggccagcgtggacggcacttgcatgaaccgcctgttccaggcagacactttcagctaccgggtggtgtcgccggccaatatgcagctggtggcggccgaggcgcgccagcgcgcggccgcctgggacgggcagaacgccaatggcctgtggccgctggcggtgttcctgaaggcgggttacttcctgcagtacagccatgccaaggaagtgggcgactacggcgcggcggtggaccagccagtgatgcaggtggtggaggcgctggcggccaacccggcgctgtgggaggtcaaggcgatagacagccgcggcgaccacgatgcgtggtatcgcgagcgcgacgcccgccagagcgtggcggaaacgttgatcctggccgattcggtgcgcaaggccgactacgcgctgcctttgctgacgcgtttcttcaaccgttacaacgccgcggccaaggacaattgggcgcgtttcgcgctgcacccgatgcagacgctgctgttcaatatgcattaccagcccgaattcgcccaaaaggtggagaagggccagcttgacggactggcggccagcctggcagggctgacccgcgccggccagccggctttcgccgacgagcagatgttcctcaacaccctgcgcgaaaccggccgcttcatgcaatacccgcgcaccgcgccgcaagccgaggccgccgtcgccttgcacctgaaaggcgagaggttcggcgccgcctgggccgaagcggtgtatgcgctgaagaagctgggcaaggtgccgtgcgaacgctacggcatctgccaggctgaacaggagttgcgtgccagcctgtttcccaaccgctggagcttcgacaacggcaatctggtgttcgagacgccgctgagcctggccgaggtggagccgctctattacgcgatgaagcaggtgcagacccagctgttccgcgtcgccggcaccaagcagccggtggcggacgaccccaacgccaagctgcggatggtgatctacggcaccaagaccgcctaccagcgcttccagggcctgctcaacgagctgtccaccgacaacggcggcatctacatcgagaaagacggcaccttctacaccttccagcgcgaagtgccgcgcgagagctatctgaccctggaagaactggtgcgccacgaatacgtgcactatctgtccggccgcttcatccagccgggcatgtgggggacgtcggagttttaccgcgatgatcgccgcatgccatggtacgacgaaggcttcgccgaattcatggcctggagcaccccgcgcgacggcatcaaggtgcgcggccacgtggtggacgtggtggcgaacggctggccgaacagcttcctcgagccgtcccgcatcatgcgttccagttatagcgacggctgggacttctacagccattccgcgctgtggttctactacctgaaccagcggcagccgggcaagatcgccgacatcctggccgcgctgcgcgtcgacgacgtcaagcgtttcgacgcgctggtgaacagcatgggcggcgacgccgcgctggtgtccggtttccgccagtatgtggaccagcaggtgcaggcggccaagtccggccagttgggcaatacctccacgcaggaggggacggactggctggcgcaggataagtggcaggccggcgacgccgccgcggtggaggcggcgctgcgccgctcgctgccagcggtttgccaggtatgggcagacggcaaggacagcgcgctgcgccgtttcgagtgcaacggcacgctgccgctgaatgcggcgaacaacacccaagcgcgccaggagctggacaagctgctggacggcgcgttgcagagcctggtgaagactggcggcgtcaacaacctgatggcgaccaactgctcggccaccgactacgacttcaagcgcaagaccgccgtgctgcgttgcgaagggccgctgggtccggccggcagcgccaagccgcagccgccgcaaaccggcgagctgaacctggccaagctgagctacggcggcccggcgcgctgcctgcgcggccagtttgaaggcgtgggcggcgtcgagcgctaccagctggtgcaggcgccgcaactgggccgagcggtggtttccgactggggcacgttcagctatcgccgcgacctcgatcagccgggcgtggccgacaagatcaccgttcgtctcagcaagggcgcgcaatcccgcgacgtggtggtggagctgaacgcgacgccgcgcgacatgccggaagagcagtgctgggcgcaggcgggttga

SEQ ID NO: 2285 - DNA, 879 bp, Chromobacterium substugae
atgaaccaacacgacaaactgcaacgattccttttcgacggcgcgccggtgcgcggcgcgctggtgcgcctggacggcgcctggcagcaggtgctgtcccgccgcgcctatccgcaagccttgaagaccattctcggcgaaatgatggcggcctcggtgctgatggccgccaatctgaagttcgacggcacgctgatcctgcagatccacggcaccggcgcgctgaagctggcggtggtggaatgcaacaacgaccgcaccgtgcgcgccaccgccaaatgggaaggcgagctggagggcaagccgctggccgaactgctgggcagcggcggccgtttcgtgctgacgctggagccgcgcctggacaagaaccagacctggcagggcatcgtggcgctggagggcgagtccgtcggcgaaatgctggaaaactacatgcgccgctccgagcagctggacaccgcgctggtgctggccagcggcgacgatgccgccgccggcatgctgttgcagcgcctgccggaaggccatggcgaagctgagggctggcagcgcatccaggtgctgggccgcacgctgaagtcggaagagttgctgacgctggacgccgaagacatcctgcatcgcctgttccatgaagaagaagtgcgggtgttcgaacaggaaagcgtcagcttcaactgcaattgctcgcgcgaacgggttggcggcatgctgaccatgttgggcggcgaggaagtgggcagcgtgctgctggagcagggcagtgtggagatcgtttgcgactattgcaaccagcactatgtgttcgacgaggaagacgtcacccagttgttcgattacgacgtggtggccagcgcgcgcgatgcgcggcattga

SEQ ID NO: 2286 - DNA, 156 bp, Chromobacterium substugae
atgatggagaaaatcgcccatgccggcgatatccgcttgaagatatggccggatggcggattttccaagcccggcgcggcgccgaacccgcaaatataccatagccggcagctgcggcgcagcagcgtggacgcggcggcgcccgatcgaagctaa

SEQ ID NO: 2287 - DNA, 261 bp, Chromobacterium substugae
atgcttgacagcaacttcgacctggatgagccgttggaggccattctgcagcgtcccctgacctggtttgaaaaacagcagattcaggaaaacgaatccgcccctctggaggtcatcgacgccgctgaagccgcaaccgatgctcacccgctacgccgccatctgaaagatctggccaaaatgcaggtcatccacatcgaccgcagccgcgatggccggccgtccctgatcgacatgcccttcaacgccgaagcgttctaa

SEQ ID NO: 2288 - DNA, 972 bp, Chromobacterium substugae
atgaatttgattgcaactggcaaagccttgccgacacaagcggtcagcgccgccagcctcgacctcaaactgggttatcgcagcggccgctgcctgcaaaaaagcggcgtgcacacccgctatttcgccgccgatcatgaaacgcaaagccaattggccgcccgcgcgctgcgcgatgcgctggacaacgccgcgctgcgcgcgtccggcatcgacctgctgatcggcgcctgcggcatccccgagcaggcgctgcccggcaccgccagtttcatatcccacgccgcgggcctgtcggccggcaccgccgccttcgacgtcaacaccagctgcctcagcttcctcagcgccttgcaggtggcggacagcctgctgcgcgccgggtcttaccgccgcatcgccgtcgtctccgccgatctcgcctcgcgcggtctggactgggacaacccggaagcttcgctgattttcggcgacggcgccgccgccgccattctggagcgcggcagcccggcgcagggcctgaaggccttcaagctggccacctatcctgatggccgccattactgcgaaatccgcgccggcggcacccagcgcaatccgcgccgcggcgtagcggaacacgacttcctgttcgacatgaacggcaaggcggtgttcaagctggcatcgaagctgatgccggacttcatcgatcagctgatggccgccacccctggcgggctaggcagcatagactgcgtggtgccgcatcaggccagccacctgggcatgcagcacatggccaagaagttgggcatcgcggcggaccgcatcgtcgacatctacgcctcgcacggcaatcaggtggcggcctcgctgccgaccgcgctgcacgaagcggtcagcagcggccgcgcccgaaacggccagcgcgtgctgatgataggcaccgccgccggcctgaacctgggcggcctggtgtgggatctgtga

SEQ ID NO: 2289 - DNA, 1008 bp, Chromobacterium substugae
atgcggattctggtcaccggcgctaccggcggactggggcgcaacgcggtggaaagcctgctggcgcgcggctgccaggtgcgggccaccggccgcaagatggatatcggccggcaattggcccgccagggcgcgcaattcgtcgcgctggacctggccgccgccacgccgggagagctggcggagctgctgcgcggcgtgcaggcggtatggcattgcgccgccttgtcgtcgccatgggggccggaggcggacttcgtcgccgccaacgtaaccgccacccgcaatctgctgcaagccgccggccagtcgcaagccacccgcttcgtccacatttccaccccggcgctgtacttcgatttccgccaccatttcgacattccggaaaactaccgccccgcccgctacgtcaacgcctatgcccgcaccaaggcccaggccgaagaatgggtgcaagcggcggcgcgcgactatccgcggctgcgctgcgccatcctgcggccccgggcgatcttcggcgagcacgaccaagtattgattccgcgcctggcgcgcatcctgcgcgagcgccgcggccgcctgccgctgccgcgcggcggcgcggcgacgctggatctgacctatgtcggcaacgtggtgcacgcgatgtggctggcgacgcagggcccggacatcgccagcggcgaagccttcaacatcaccaaccaacagccggcggcgctgcgcgacatgctgcggcggctgttcatcgacgaactggggcaagacatgcgcatcgtcgacctgccctacccgctgctgaacgccgccagccatctgttgcaatggctggccgccgccagcggccgcgagccggcgctgacgccctatagcctgggcgcggtccagttcgacatgacgctggacaaccgccgcgcccgggaaagactcggctaccagcccatctacagcctggaggacggcgtggcccgcaccgcgcgctggctgcgggagcaggctcatggctaa

SEQ ID NO: 2290 - DNA, 804 bp, Chromobacterium substugae
atggctaacatccgcgaattcagcgtcggccattgcacccacccatcctgcatggctttgaaaggcagcggcctcgccagccgatgcttcccgtcgcgcgcctacctgattgaaacccgcagccggctatacctgtgggacaccggctacgccgaacatttcatcgacgccacccgccgcggcatctaccggctgtacccgctggtgacgccggtgttcttcaacgccgacgattcgctgcgcggccaattgcggcggatcggcgtcaatcccgacgacatccacgcgctgctgctgtcgcacttccacgccgatcacatcgccggcctgcgcgattttccgcaagcccggctgctggcctcaggcgccggctggcgcgcggtgcgcgggctgacaggactgacggcgctgcgccaggccttcgtgcccgccctgctgccggccgacatcgacagccggctggaatgcgtcgaagcgcagccgcgggtggcgctgccgccggagctggcgccgttcagccacggctgggatgtctccggcgacggcgagattctggtagtggagctgcccggccacgccgtcggccacctgggcgcctttgtccgcaccgaagccggctggacgctgctggcctccgacgccgcctgggccgtcgaaggctacgcgcaattgcgcggcccttccgaactgtcgttcctgattcagcacaaccgccgcgactactaccagacgctgggcaaattgcatgctcttcaccgccgcggacaggtggacatccgcctgacgcaccaggaagccaactga

SEQ ID NO: 2291 - DNA, 1290 bp, Chromobacterium substugae
atgcttcgcctcttccgcattttgcgcgcctaccggcgcacccgcggcctgcgcttcgccgaccgcgccgcgctggcgcgccatcaaagccggcaactggcgacgttccgcgcccgcctgcagcgccgcagcccctatttcgccgacctgggcgagctgccgttcgcgcaatggccattgatggacaaagccgccatgctccgccacttcaaccggatgaacgccgccggcctgacgctggagcaggtgatgcgcgccgcgcagcaggcggagcgcagccgcgatttctcgccgaccataggccgctacacagtgggcctgtcgtccggcaccaccgcgcagcgcggcgccttcgtcgtcagccgcgccgaacaggcgcaatgggccggcgtcatgctggccaaagccttgccggacggcctgttcgcccgcgagcgggtggcgctgttcctgcgcgccaacagcaatctgtacaccgcggtgcgcagccgctggctcaccttcgaatttttcgacctgttccagcccttcgccagccagctgtcccggctggccggctaccgtcccaccattctgctggccccggcccaagtgctgcgcgcgctggcgcaggcccaattggccggccagctgcaattggcgccgaagcgggtttattcgatcgccgaggtgctggaaacccaggatcgcgccatcattgaaaaagctttcggccaggtccaccaaatctaccaggccactgaaggctttctcgccagcagctgcgagcacggcgtgctgcatctgaacgaggaatacatccatgtcgagccggaatggctggacgaggagcggcgccgcttcgtgcccatcatcaccgacttcagccgccacacccagcccatcgtccgctaccggctgaacgacgtgctgctggcgcgcgccgctccctgcccatgcggccgcgccacgctggcgctggacggcgtggaaggccgctgcgacgatatgctgctgctgcccgaccgcgccggccggcagcagaccgtgttcgccgatgtgctcagccgcgcgctggcgcaagccttgccctgggatgccgattaccggctgcgtcaaaccggcccgcgcgcgctgacgctgcacctggagttggacgatgccggcgccggcgcggtccggcagcggctggagcagaccctcgccgggctgggggtggatgtcgccgcgctggaatggcggctggagggcgcgctgccgccgctcgaccccacccgcaagcgccggcgcatcatccgggaggcggcatga

SEQ ID NO: 2292 - DNA, 621 bp, Chromobacterium substugae
atgctagccttgtcctggctgccgccccggctgcgccacatgctgctgggctggggggcggtgggctgcgcctacacgctgggcagcgtctggcccggcgcgccgcggctgctgccggagtggccgaccgaccgctggatagcgttcgacccggccgccatctggctgtacctgtcgtttttcttgctggtgccagcgggctttctgttggcgccgcctgacaggctgccctggctgcggcgttcgatgcagctgtgcgcgctggccgccggcgcgaccttcctgctgctgccgaccacgctgccctacccggccgtcgccggcggcggctttcacgccgaactgctgcgcgccgccctgcgcttcgatacgccgcacaactgcctgccctcgctgcacggtgcgctgaccgtgctggcggcatgggcgctgtcggagcggcgccggccctggcgcgctgtgctggcctggctgtgggccgccgccatcctgttcgctgtgatacagctgcgccgccacctcaccttggacctgggcgccggcgtcgcgctgggcctgctgtgcggctggctgtgcgcgcgtcccgcattcctcttttctttccgctatcgcaccacatga

SEQ ID NO: 2293 - DNA, 1092 bp, Chromobacterium substugae
atgaacgtattcgccctcaccttcatcctgatgctcgccgtggttctgctggagctgcttgccttgcgcctatggcgccgcgaagccattccctggcgcgagatcatcttcaacctcaactccggccacatcctgatgtgggtcttccgcggcgtggaggtggccagcttcggctggctgcttgaacacgccaacctgcacctggtggaccggctgccggcgctctggcaatgggttttcgccttcatcgcctgggatctgagcttttactgcatgcaccgggcccaccacacctggcgcattttctgggcggtgcacgttgtccaccaccagggcgagcatttcagcctgtcgctgggcatccgcaattcctggtattcgtcgctgacttcgctgctgttcgtcgcgccgctggcggtgctggggctgccgctggagatgttcgtcgccgcgtcgtccttccattacgcggtgcagctgtacaaccataatgctttcgtcggcaagtccggctggctggaccgcgtgctggtgacgccgtccaaccaccgcgtgcatcacgccaccgaccccatctacctgaacaagaacttcggcggcaccttcctgatctgggacaagctgttcggcagctatcaagccgaacgcgacgatgtgccgctgcgctacggcgtgcgcggcgagtcgcccggctacaatccgctgtgggccagtaatcccggcttgctggcgctggtccgccgccgctttcccgcgtggcttgcgcgcgcgcgcatggacgtgccggccggctatatcgccagcggcggcgtgctgctgttcggcgtggtgatctattacgtgcaaaacgtggcggaatggtcggcgccgcagcaatggacgctgttcggctacctgctggccggcaccctcgccatcggcgggatgtccgaccgccagcgctggggctggcgcggctggcaggcgctggtgctgaccctgcccgtcctgtgcgccggctggctgggcatgcgcgacctgtgcgcgctggcgctgttcgcgctgctgctgggccatggactgctgggctggcgcctgaaggaggccgcatga

SEQ ID NO: 2294 - DNA, 1080 bp, Chromobacterium substugae
atgagcaaattgcgttttcaatcgtcggccgagctgccgttccgcatcgagctgcaacaggcggcgcaagcctatctggagcaaagccgcgaccaccgcttcgccagcgccggcatctggctcaaggcctggctgctggccggcctgagcctggcctgctatctgctggcgttgcgcgccgacgcgctgtggcagttcgccccggcctatgtcgccgctatcctgctggccatgctgctggcgatgaacagcctgcacgacgccgcccacggcgcggtgttccgccgcccctggctcaaccggctgctgagccgcgtcgccagcctgccgatgggcatagactccgatatctggatccgccgccacgtgcatctgcaccatacctatcccaatgtcgacggctacgatctggacatcgaacccaatcccttcctgcgccagacgccgtttcaggactgggcgccgcaattccgccatcagcaccgctattggccgctgatcgccgcgctgtcgctgccctatctgtgctggtacggcgactggctggacctgatgggcaagagcaagctgcagctgcgcgacgccaagccggtgcgcgctccgggctttctgctggccaaggccggccacctggcgctggcgctgggcctgccgatctggctgctgcacgacggcggcatcggctggggcagcgtgctgctgtgctatctgctgggccaaatggccgcatcctgcttcctggtggcgatgatactcggcacccactgggccgacgtggcgtttttccagcccggcgccgacggcaagctgccgcacacctggcacgagcatcaattcctcacctgttgcgactgggagccgcggccgcgcgcgctggcccatctgctgggcggtctgcacctgcacctgacccatcacctgttcccgtcctacagccaccgccattatccggcgctggcccgcatcacccggcaggtggcgcaaaagcacggcctggattaccgctgcttggactaccccgagctgtggcaggcgcagcagcgcttcctcaagtccatggggagccggccgcagccatga

SEQ ID NO: 2295 - DNA, 552 bp, Chromobacterium substugae
atgtctttgactaccgattttctggagaacccgcaggctttcatgcgttctcaggcgatattgattccggcgcaggttccgcccggcaacggcaaataccagttcgcggcgcagggcgcgcacgcggcggtgctgcagtccaccgccgccagcccgaacatccccggtttttacgcgcatccggtggccaacaacatcaatctgttcgtgctgcccacccagcagccggcaaggtattacatgttcaccgacggcatgaacggctgccagtttctggcctacgggccggacaggcagcacatcaccgtcgagcacaacaacttcatcggcgacccgacgcgctacgcggcgcggctggcggaggtggtggcgctgaagccggcctatctgctgcatatcagcccgtcgggggtcaataacatcccggccggccaatacaacagccagcagggggtgaacatcgtcggcgaatacggccaggccaacggctggcgcttctgggtgcgggacagggtggaccagaaccagggcacggtgtacgggccgctgtaa

SEQ ID NO: 2296 - DNA, 1326 bp, Chromobacterium substugae
gtgtccacattgttctggcgctacgccatcccctccgtcgccggcatggtcgtcaccggcctgtacgccatcgtggacggcgtgttcgtcggccactatgtcggcagccacggcctggccgccatcaatctggcctacccgctggtgatgctgcaggtgggcctgggcgcgatggtcagcatgggcgcggccacccgcatcgcgatccggcagggggccggcgatgtcgccggcgcgcgcggcacgctgctggcggccctggcgctgctggccttgctgggcgcggcgattccgctggcggggctgcccaacgtcggcaagctgctggaatggctgcaggccgacggccagcctgaagtggcggcgcaggcgcgcgcctatctgtggtggatgctggccggcgcggcgctgaccatggggcagatgctggtcacctatctggtgcgcaacgatggccgcccgggcctggccaccgcgctgaccatcctgggcgcgctattgaacatcccgctgaatttcctgctggtgggcgggctgggcctggggctggccggctcggcgataggcacgctgctggccgaatcggtggtggtggcgctgggcctgggctatttcttcacgcgccatgccgcggtgcggctgcgcgtcggcaatatgcggctggacaaggccgcgctgtggcccatcctggcgctgggcgcgcccagcctgctgatggagctgaatctcgccttgctgctgtacgcgcacaaccaccagctgctgcgctggggcgacgacctgagcgtggcggcctacgcggtggcaggctacaccgaagcgctgttcacgctggcgatccacggcctggcggtgggcatgcagccgctgctgggccacgccaccggcgccggccagccgggccgggcgcgcgaggcgctgctgcacggcgtcagggggggattggcgctgggcttggcggcgctggcggcggtgcagctgtttccggcctggatcgccggctggtacagcgacggcagccaagatttggtggcggccggcagccatgcgctgcgcctgcatctgctggcgatgccgttggacggcctggtggtggtgggctgcaccgcgctgcaggcgatggcgctgacgcggctggctctcggcatcaccatcagcaagaccttgctgttgctgccgacgctggggctgatgcccctgtggctgggcgtggacggggtatggctggcgatgccgctggtcaatctgttgctgggcctgctggtgggcggggtgttgctggcgcagtcgcgccgcctgctaggcgcgcaggcggcggcccggtag

SEQ ID NO: 2297 - DNA, 618 bp, Chromobacterium substugae
atggcccgcaaaaccaaggaagattcgcagaaaacccgcgacgccattctggacggcgccgaacaggcttttctggccaagggcatcgccaacgccaccatggccgacatcgccgaagccgccggcgtgtcgcgcggcgcggtctacggccactacgacaacaagctgctggtatgccaggcgatgatagaccgcgccttcgcgctggacgcgctggacttcccctcccagcgcgaatcggcttgcgacaccctgctggcggccagcctctactacctggcccagttcctggagccgggctcgccgcagcgggtattcgaaatcctttacctcaagtgcgagcgcagcgaggaaaaccgcagcgtgctgcgccggcgcgagatgatggaccggctgacgctgcactacacccgccgccagctgcgccgcgccatcgccggccgcgaactgccggccaccctggacgtgggcctggccgccgactacctggtgtacctgttcctgggcctttacgacctgctggaaaccgggccggcggcgctgccgcgctgcgaacgcatcctgcgcggcgcgctggaagccctgccgcacgcggccagcctgcagcgccagccctga

SEQ ID NO: 2298 - DNA, 1083 bp, Chromobacterium substugae
ttgctgtggctgatcatcaaggagcttcaggccgtcgccggcagccgccagggccgcctgttgctggtggtgccggtgctgctgcagctgctggtgtttccgttcgccgccacgctggaggtcaagcacgccagcctggcggtgtacaaccaggacggcggcgcggcctcgctggagttgatcaagcgcttgtcggccagcgcgactttcgaccgggtggtgccagtggccagccaggcggggctgcgggcggcgatagaccggcaggacgcgcttctggcggtggtgttcccggccgatttctcgcgcgatctggcggcggggcgcgccgcgccgctgcaggtgatcgtggacgggcggcgctccaacagcgggcagattgccggcgcttacgtcggccaggtggcggcggattacgcgcaggagagggcgggcggcgcggccggcggcgtggtggtgcgcaatctgtacaacccgaacctggagttccagtggcacgtgctgcccagcctggtggctatcatcaccaccataggctgcctgatcgtcaccgcgctgtcggtggcgcgcgagcgcgaagagggcaccttcgaccagctgctggtgtcgccgctgacgccggcctacatcatggccggcaaggcgctgccgggggtgctggtggccttgctgcagggcagcctgatcgccgcggcggcggcgtgggcgtaccgggtgccgttcggcggttcattgccgctgctcttggccagcatggccagctacggcctggcgctggccggggtggggctgttcatctcgtcgatttcccatacccagcagcaggccttcctcggggtgttttccttcatggtgccggcggtgatcctgtccggctacgtgtcgccgatcgagaacatgccgctggcgctgcaatggctggcgcggctcaatccgctcagttacttcattcccattctcaaggggactttcctcaagggttatggtttcgccgacgcctggccgtggctgctgccgctgtggctgatcgcgctggccacgctggcgctggcgctgtggcgtttccgccgccatgtcgaatag

SEQ ID NO: 2299 - DNA, 1116 bp, Chromobacterium substugae
atgcgcggactgaagctgcgccggctgctggcgctgtgccgcaaggagagctttcagatcgtccgcgatccgagcagcatcctgatcgccttcatcctgccggtggcgctgctgttcatcctgggctatgcggtgaatctggattcagcccatatccggctgggcctgctgaaccaggatggcggcgcggcagcggcgcgtttggcggccgccttttacggctcgccgtcgttcgaggtgcacccgatggtttcgcgcgcgcagctggaagagcaactggcgcatggcgagatacgcggcgcggtggtgatccccgatgatttctcccgccgcggcgccggcgccgccatccagctgctggccgacggcgccgaacccaataccgccaatttcgtcgccgcctacgcgcagggggtgtggctgcaatggcggcagtccgaggccgagcagcgggagctgccgccgccggcggccatcgatatccgccagcgcgtctggttcaaccccagcgccgaaagccccaactttctggtgccgggcaccatcgccatcgtgatgaccatcgtcggcgcgctgctgtcctcgctggtggtggcgcgcgaatgggagcgcggcaccatggaggcgctgctggccacgccggtgagccgggcggagctgatcctgtccaaaatcctgccttactacgcgctgggcatcgccgccatgctgctgtgcctgctggtggcggtgttcgtcatgggggtgccgttccgcggcccgctgtggctgctgtggctgatgtcctcgctgtttctggccaatgcgctgggcatggggctgtttttgtctaccacgctgaaaagccagttcgacgcggcgcaggcggcgctgaccgccggctacctgccggcgctgatgctgtcgggcttcgtgtttgaaatctccagcatgccggcgcccctgcaatggctgacgcgcatcctgccggcgcgctatttcgccagcacgctgcagacgttgttccaggccggggtgatcccgtcgctgctgtggttcaatgccgccagcctgatcctgctcggcgccttctggctgggccagaccgtgcgcaaaacccgccggaccctggactga

SEQ ID NO: 2300 - DNA, 1734 bp, Chromobacterium substugae
atgagcgccgtgccggccattctgacgcaaggcctggcgaagcgttttcccggcgccgagcgcgacgcgctggccgatgtcgaactgtcgattcccgccggctgcgtcgccggcctggtggggccggacggcgcgggcaaaaccaccttgctgcggattctggccggtctgctggcgcccagcctgggcgcggcgcgggtggcggggctggacccgcaggcggatggggagaggctgcgccgcgaggtcggctacatgccgcagaagttcggcctgtacgaagacctgacggtgcgcgagaacctcgacctgtactccgacctgcgcgatgtgacgggcgcggagcgggaaaaagatttcgaacggctgctggcgctgaccgatctggcgccgttcaccggccgccacgccggcaagctgtccggcggcatgaagcagaagctgggtttggcctgctcgctgctggggaggccgcgggtgctgctgctggacgagccgggcgtgggggtggatccgatctcgcggcgcgaattgtggaagctgatccgcgcgctgtcggccgacggcatcaccgtgctgctcagcaccgcctatctggacgaggccgaaggctgcgacgcggtttacctgatggaccagggacgcatccgcgccgccgggccgccggccgagctgacgcgtccgctggccgggcgctgtctgaaactgtccggcatcgccggcaatcgccgccgcttgctgcaaaggctgttgcgccagccgcagctgatggacggcgccatccagggcggcagcctgcggctgctgctgcggcatgagggcgaatggccggatctggcgcaggcggaagccgggccggacgcgcggctggagccggcgccgccgcggctggaggacgccttcatcagcctgctgggcggcgggccgggcggcgattcggtgctggcggaagtgatgccggcggtgccggcgcgcggcgcggaggcggtgatagaggccagggcgctgaccaagcgcttcggcgattttcgcgccaccgacaatgtcagcttcgcggtgcggcgcggcgaggtgttcggcttgctgggccccaacggcgccggcaagtcgacgactttcaagatggagtgcgggttattgaagcccagcgccggccaggcgctggtgatgggcatggacctgaagaccagccccagcgccgcccgccagcagctgggctatatggcgcagaagttttccctgtacgcgcagctgtcggtgcggcgcaacctgatgttcttctccggcgtctacggcctggcgggccaggcgcagcgcgccaaggtggcgcagatggcgcgggtgttcggcctggagccgtatctggacggcccggcggccacgctgccgctgggcttcaagcagcggctggcgctggcctgcgcggtgatgcacgagccgccgctgttgttcctggacgagccgacttccggcgtggacccggtgacgcggcgcgagttctggacccatatcaacgggctggccgacaagggcgtcaccgtgctggtgaccacccacttcatggacgaggcggaatactgcgaccgcatcgcgctgatctaccgcggcaagctgctggcgctggacaccccggacgcgctcaaaagcggggtggcgagcgcggcgcggcccaatcccaccatggaagacgccttcatccagctggtggaggaggccgaccgatgcgcggactga

SEQ ID NO: 2301 - DNA, 981 bp, Chromobacterium substugae
atgaggaagatcggggtcgcatttgcggcgctggcgctggcagcttctggcaccggctattacgcctatcaacgctcggccggcgcggagcggaacgccactttgtacggcaatgtcgacatccgcgagctcagcctggctttccgcgtatccggccgcctggccgcggtgcaggtggacgagggcgacagcgtgcagccggggcagatattggcgcggctggacgccgagccgctgcgcaacagtctgaacgcggcgctggccaatgaggcggcgctggccgcgcgcaacgccttgatccacaaaggcaaccgcggcgaggacatcgcccaggccaaagcccggctggaggccgccgcggccgcgctgacgcaggcgcaaagcgagtaccgccgccagcgcgatttggtgccggccggcggcagcagccagcagtcgctggaggccgcccgctcgcagcgcgaccaggcgctggcgcagcgcgacgcggccgcgcagcaatggcaggcgctggccaggggctaccgtccggaagagattgccgaatccgatgcccaactgaaacaggcgcgcgccgacctggccgccgccaggctggcgttgcgcgacgccaatctgcaggcgcccagcgccggcatcatcctgacccgggcggtggaggccggcagcatggtgcaggcgggcgcgccggccttcagcttgtcgctgcgccagccggtgtgggtgcgcgcctatgtcggcgaggcccagttgggccgctttcccagcggcggcaaggtgctgctgagcaccgacagccatccggacaagacctatcacggcgtggtgggcttcgtgtcgcccaccgccgaattcacgccgaaatcggtggaaaccgccgatctgcgcacctcgctggtctaccgcatccgcatcgtggtgagcgacgccgacgccggcctcaaccagggcatgccggtcacggtgaggctggcgccatga

SEQ ID NO: 2302 - DNA, 498 bp, Chromobacterium substugae
atggtcgccacacatgttgcgtttggcgcgttttgcgcggtgtccaccgccttgttgctgcattttccgccgttgatggcgctgttgctgttggccggcggcctggcaggttcgctattgccggacatcgaccaccccaaaagctggctgggccggcgcattccctttctttcgcgcccggtggcctatctgttcggccaccgcggcatcacccacagcctgctggcggtggccggcgtgttctacgcctgcgccgcctgcctgcacggctggcatgtcaagctggggcacgcgatgcccgtggtgctgggcatctgcgtcggctatgcctcgcatttggccggcgactggctgacgccggccggcatcccgctgctgtggcccatccgcgtccgtttccgcgcgccgttgatgctgctgcgcggcaagatggccgagcctctgatggtggtgggtttgtggttcggcgccggcttcctgatgtgcaaaacgctctga

SEQ ID NO: 2303 - DNA, 810 bp, Chromobacterium substugae
gtgctgtccgactggccgcccaacttcatcgtgcgcgaaggcaagcccaccatcgggcagaacgatgtctatctgcggctgatcatcgaacgctggccgcaggtgcagcaccgcttcgtcgtgatgagcaccgcgcgcagcatactggagctgcagaacaagacccgcctgtgccggcccaacctgatccccaccccggagcggcagcgattcgcctatttcacgctgacccatatgcagctgccgctgcagctgatcatccgccgcgacctggcggccaaggcgccgctgaacgccaagggcgaagtggagctggccaggctgatccgccagccggggctgcgcggcatcgtcgccgccggccgcagctacaccgccgcgatcgacagcgtgctggccgccgcgaaaaccggctccaacatccgcgcgctgcaaaacctgcccgccaacgagggcctgttcaagctgctggcgctgggccgcgccgactacacgctggattacgagcccaatctcgaataccacaatcggcacaaccgcgaccagacgctagccggcctgccgatagccggcgccgcgctgattccggtcggcatcgcctgtccgcgcaccgaatgggggctgcaggccatccgcaagatcgacgcgctgctcgcccaggcagtcgccgaccccgcttatcgcgccgcgcaggccagctgggcatcgccggcctccttgcagcgctacaaggccgggctggaccgcttctaccagcagcgcagccatcccgcgcccgcagcggaattcgcgccgccgctgcggccttga

SEQ ID NO: 2304 - DNA, 1635 bp, Chromobacterium substugae
atggcgaaaaccatttcattgaagcgacgattgctgctgcagaccgccagcaccatcgtattggtatgcgtattgggcgcgttgctgatgaacgctttgcgccagcaaatgctgtccgaccgccacgatcaggtacgcggccaggtggaggcggccgccagcctggtggccgcgcatgaggaaatggcggaaaagggcctggtgccggaagcggacgccaagcggcaggctttgctggagctgagcaagctgcgtttcgacggccgcgagtatttcttcacgctggaccgcaatatggtgtggctggcccatggcatgaatcccaagctggtcggcagggacatgcacggagtgaaggacgcggccggcaccagcatgggccagttgttcgacggcgtgctgagggaaaacggcggcaagggcttcgccgagtattactgggacaagccgggcaccagcgcgccgcagcccaagctcgcgtatttccagaccaccgcccgctggggctgggtagtgggcaccggcctgtatctcgacgacatcaacacggtgctgctgcgccagctgctgggcgtgggcgcccaggtgctgctgttcatggcggtgagcctgtctttgggctggtgggtgtatcgcagcgtgatgcgcgagttgggcgccgagccgtccgaggcggccgccatcgtgcgcgagatcgccgccggcaagctggaccgcgagatacggctggaggccggcgacggcgacagcctgctggcgcatatccgcgagatgcaggcgcaactgcgccagttggtgggggaaatcatgcgcgatgccgaggagctgggccggctgaacgccgatgtggtcgacggcgccaagatggtggcggacaactcgcaggggcagagcgaaggcgcggcggcgatggcggcctcggtggagcaactgacggtcagcatcaaccacatcgcccagcacgccaaggatgcccgctcggtgtcgcaggactcgggccagctgtcggaaaccggcagcgaggtgatcgcgcgcgcggtggaggagatgcagggcatcagcgccacggtggacatgacggaagcggcgatcgccgacctggccagcaagaccgccaccatctccaacatcatgcaggtgatcaaggacatcgccgaccagaccaatcttttggccttgaacgcggcgatagaggcggcgcgcgccggcgagagcggccgcggcttcgcggtggtggcggacgaggtgcgaaaattgtccgagcgcaccgccaaggccaccgagcagactgcgacgatgatcaccgaaatccaggtcagctcggacctgtcgcggcagaacatgagcgagacagtgaccaaggtgagaaccggcctggagctggccgagcaaggcggccagctgatccagcagatccacggcagcgcgagccaggtggtgcgggtggtcaacgacatctcgcacgcgctgcaggagcagggcaccgccagccaggacatcgcccgccacgtcgagcagatcgcccaggtggcttccggcaacgcggtggcagccacccaggcgtcggagagcatacagcggatagacgaggtgactggcagcctcaggcagtcggtggcgcagttccaggtgtag

SEQ ID NO: 2305 - DNA, 585 bp, Chromobacterium substugae
atgcgcttctttcgccacgactccggccgccattgcggcggccgccgccacgcccatcacgccggcgacagcgaacacctgtcgcgcggccgcaaattcagctccgacgacctgcaattgctgttgctggcgctgatagccgagcgcccaagccacggctacgaactgatcaaggcgctggccagccgctccaacggctattacagccccagcccgggcatggtctatcccgccctcacctatctggaggaaatcggccatgtcaccgtggcgagcagcggcaaccgcaagtgctattcgatcgcagaacccggccgcctgcacctggcagtcaaccgcgaacatgtggagcggatgctggccaagctggagcacatcggccgcaagatggagctggcccgccgcgcctacgccggcgaggaaatcggcgaagaaggcgcggccggctgggtccgggagctgatagaggcccgccgcgcgctcaagcacgcgctgctgctgcgcgacaaggccgacgccgacgagcaacgccgcatcgccgacatcctgcaacgcgccactgccgagatcatcggccaaaattaa

SEQ ID NO: 2306 - DNA, 795 bp, Chromobacterium substugae
atgcgccacgatctgaccatacaaaaactgcgccacccgctgcaattccgcttgctgcgggttagccgcatagagcggctcgccgggcgcctgctgcgcgtcaccttgagcggcgccgacctggagggcttcgcctcctcctcattcgacgaccacgtcaagctgttcttccccgcgcccggcgagatccggcccgtcagcccctccgtcggcgagggcggcatcgtcttcccggccgaccaagccaagcctgcgatgcgcgactacacgccgcgccgttacgccgccgacgccggcgagctggacatagacttcgtgctgcacgaaggcggcgtcgcctccgactgggccgcccaagcccaggtcggccactatctgggcgtaggcggaccgcgcggctcgcgcgtggtgccgacgggattcgactggcactggctgattggcgacgaaacggcgctgccggcgatcagccgccggctggaagagctgccggccgacagccgcggcgccgccgtcatcctggtagacaacgccgatgcccgcctgccccttggcggcccagccggcatggaaatcatctggcgccagcgcgaccggcgacaagacctgctgcagacggtgacggaaatgcccctgccgggcggcgatggatatgtctgggccgcaggggaaagcggcgaaatgcgcgccgtgcataaacatctgcagctgcgcggcgtggacaaggacaggatgcgtgtggccggctactggaaacgcggcgacgccggcgcgcatgaaaccataggcgaataa

SEQ ID NO: 2307 - DNA, 117 bp, Chromobacterium substugae
atgccgcaatattttttatcggatgatatgaataagtatttttactgggggatggcattggaaagcctggcgcgccgggctttcatgcaggtattcgttttggactgcggattttaa

SEQ ID NO: 2308 - DNA, 567 bp, Chromobacterium substugae
atgctcgtctcccatgccggcctcaaccagatgctgcacgccggcatgttcttctcgattcccggccccgccctgctcagccccttcgtcggcctggtcggcatccgccaggactatcacggcgcgccgctgtacggcggcccgatagaacggctgggccggctgaaatacatcgacggttgctccgacagcctgctgatttcgccgatgatcaagggcgacccctgcctcaactatctttacgtgccaccgcatctgcaccaaaccgcccacacccacccatcggtgcgcatcggcatcatcatcgaaggcgaaggctactgtctgaccgaacacgagcgcctggaactggttgccggcaagatcttcgtgttgccggccgacgaaatccatagcttccacaccgagcacagcccgctgcgcatcgtgatctatcacccggattccgacttcggccccacccacgaagaacatccgatgatcaaccgcaccctggtggatggcgtctccctggccggcgacaacccttaccgcaccagcaaaatcgccgaatacgtagccaactga

SEQ ID NO: 2309 - DNA, 1515 bp, Chromobacterium substugae
ttgccgccgctgcctgcctggctggcagaccccagaccagccgcgccgcgcctgccgtggccgccgcgcccggacaggcgggaccccggcctgagccagggcgagttcgcccgcctgctcaagcacgccggcgtttgcgatctcggcgccgtgccggtgccgggcgcctgcgtgctgctgccgtggggggtggcgctgagcgaaaggctggcggggctgctgcgcgccgccctcgacgatctgggactggacgaatacgcctatccgcacgtggtgccgcaggaatgtttcgagccgatggccgatttgctcgatgccgaacgctgcctgttgcaggtcgccaccggccacgaccgcgaacgcaaccgcctgcgcggcgtgctgacgcccaccggcgaacaggtgatcgccagccactggcggcagctggtcacccaggccgaggcgctgcctatccgcatgttccagcgcgcgcgctacttccgcccggtcagttcggccgaccgcagcggcaaaggggtgttcgccgcgctggaggcggccgacgtcttcgaattccactgctgccacgccgccatggaagaggcgcagggcgacctgcaacggctgcacctagggctggaacggctggcagaatcgctttgcctgccgcaatttgtcggcgtgcgcccgccctggggcaaccgcgaagccctgtacgaatgggcgctgggcggcgacaccccgttgcccagcggcgaatgcgtgcagacttcggcgctgtatttccaaggccagcgcttgtccagccgctacgacatcggcctgggcaaaggcgagcggcggcggcacgcctggcagctggacggcttcgccagccgcaggatgctgtacgcccagctatgcctgtcggccaaggccgatggctccctgacggtgcacccgcagctggcggcgacccaggtggccatcctggcgcgcagccaggatgaagacgaacggcgctttctggagacgctgcgggaacaactgaaggcctgcggcctgcgtccggctctggagcgctgcgccgatgcccggacgctgacttcgcggatgcggcaatggcggcaccgcggcgcgccgctgctgctgctgtatttcggccgccgccacgcgcaagaccaacccaggctgcgcctgtaccgcaccgatgccgacctcgagctggaagccgctgcggactgcgcagcggaggcgctggcgcagcagctggcggacgcgctggccgacgtagaagccgacgcgggcgccgatgtcctgcggcgcgcccgcagccagatcgccttcgccggctcggaggccgaagccaagcaggcgttggcggcgcgcaagagcgtgatcgcgcccgtcagcccgacccgccgccacgcggaggccgcggcggcgtggcaaatgggagagctgtgcagtttcgcggcggcggacgaacccgccccatgcattttctcaggccgaccgacctgggcgcgcgccctgctgtcgcgacgcatctga

SEQ ID NO: 2310 - DNA, 1077 bp, Chromobacterium substugae
atgacaagcagccatgcagaccagctggaaatgatagtcgggccggtgcgcctgccgctgaagatcgacgacagcgtcaactacttccagctgcactacttcgaattccagggcaagcgctgggcctgcgcggcgcttggcgatctcgccgcgcaggaagcggtgccgctgcgcatagaatcggcgtgctttttcggccacgtgatgcattcgcagcagtgcgactgcggcttccagctggacgaagccttccgccgcatctcgcagcgccagggcgggctggtgatctacggcatagaccaggatgcccgcggcctgggaatagaaaagcatttccgcatctacgactaccggcagaaccaccaactggacaccgatgaagtctaccagcgcttccatgccccgctggatagccgctcctacgaggcggtggccgccatcctgcgcttcctcaaggtggaaagcatcctgctgatgtcgaacaaccgcgcgcggctggagtttctgcgcgaacagggcttccgggtggagcgcgaccagatcgaggcgccgctgacccgctacaacatggccaccatgatgctggagaaggaagacctggcctaccaatggagcttccagacccacggcgactggctgcggccgctgcaggaccaggcggaggcgcatcccgaccgccgcgccgcgcgcatcgtccgcgacaaccagcaggtggtggcggaatggcagggagacagctgggacgtggcccgccatctgctggctgggctggcccagcaaccggcaggcgagctggtgatctacctcagcgatctgcccagactggacgaactggcggcctacgccgccaccggcgcccgcttcgtggtggtgcctttcgccaccctgccaggctatctggaaacggaagcccgccagctcggcatcaagctgcaggactggggccgtgaaaacaagtacgcgcagcctcggccgcaatggcaactggaggaccagaccggcgacagccacgtctatcgccgcggcgatgaaagacggacctgccgccgggacggcgcggcggatgccgtagcctga

SEQ ID NO: 2311 - DNA, 693 bp, Chromobacterium substugae
atgccccatctggccctctccacctccaggcaggccgcgctggccgccatgcaggacgacgcctccgactgcctgatggtggacagcttcaacggcgcgcccgccaatatgcgcggcttccgctgcttcaatcccttccaactctggcccgatcccgtcatcccggtgccggggcaggccggacggctggcgcgatcggtcgaatcggtgtggcagggcttgaagctggtggacgggcgcaccgacttcgagcagtttctggccgagccgcgcaagcggcccagcgacgatgagcgccgccgccaaccaggctactgctattcggacagccgcttcatttatggcgaccggcagctgggcctcctggaagcccgcttcctgatctacctgccgacctatctgtttctgctggacaggctggccccggagccggtgctgcgggagctgcgccggcacatcgccgccgatggtccggtgctgttctacgactgggacgccaatcaggacatcgccgacaccagttcttcgttcagccactccgccattctggccgcctggttcaacggcacgctggagcggcgctaccgcgagctggccggccgcctgctgtcgcccgccgacaaaccggccttcgacgccgcgctggacggcctgctcggccgctatcgcgccatccatcgggagaaaccatga

SEQ ID NO: 2312 - DNA, 1383 bp, Chromobacterium substugae
atgacgctcaatccggctctggcccgccggctgtactggggctgcgaaaaactgcaaggccgccaggatgtggcgcaacgcctgcgttggctggaagaaacccagcacctgtcgccgcaggcttgccgcgaactgcaaatgcgcaagctgcacgcgctgctcagccatgcctacgaaagcgtgccctattacacccgggtgttccgcgagcgcggcctggtgcccgacgacttcaactcgctggccgacctggccaaactgccgctgctgacccgccaggagctgaccgccaaccaggcggagctgatctccagccgcgccgatcgcgccacgctgcaaaccaattacagcagcggctccaccggcaagcgcgcctgcttcgtccaggacgccgacttcaggctgtggatgcgcgcccaccaattgcgcacctaccaatggtgcgccggctggaaagtgggcgaaccgttcgcgctgctatggggctcttccatctactggagcttgaaaagcgtgtcggaccagctgaagaatctgctcagcaaccggcgcgaattcaacaccttccggctgtctcccgaattgatcggccagttcacccgcagcctggccagcttcaacccggtgctgatcagcacctacaccaacgccatgcacctgatcgcccggcaaatggagcgcgaagcggtcaaggtgccggcgctgcgcgccatccagggcacctcggagccgctgccgcccatcatccgcgagcggctgcaaaaggtgttcggctgcgaggtgtacgacaagtacggctcgcgcgaaaccaatatcgtcgcgcatgaaagcccctgccacgacggcatgctgatccaggtggaaaacgtcgcggaagaattcctgcgcgacgacggcgccgcctgccagcccggcgaaaccggccgggtggtgctgaccacgctgaacaatttcgccatgccgctgatccgctacgaaaccagcgatctggccgcgccgctgtccggccactgcgcctccggcctcggcctgccgcgcatgagccatgtcgccggccgtcagcaggatctgatcgtcacgcccgacggcgcttatgtcgacgcttacctgttctctttcctgatcatgcgcttcgaggaaatagaatggttccaggtggtgcaggatagcctggacagcctgcgcatccgcttgatggcgccggccggcatctcccgccagcgctgcgacgccatcgtcgagcgcatccaccaccacaccggctacccattccgcatcgaattcgaaccattcgaccgcatgccggaatcgcccaccggcaaattccgtctgtgcgtgtcggcgctcagcgacatcggcacccgccatccggtgaacccatga

SEQ ID NO: 2313 - DNA, 1068 bp, Chromobacterium substugae
atgaacgcagacatcgcggtggacgagatgcgcgaactggccgcgcaagcgctgcaacgctgcggcgccccgtccgcgcgggcccggcaggtgatcgacgacctgctggaaaacgaacaggtcggctatccctcgcacggcatgctgcgcctgctagactacgccgccgatatccgctccggcgcgctcgaccccgccgccctgcccgccatcgagcagaccgcggccaatatcgccatcgtcgatggcaggcgcgccttcggcatcctcgcccggcagtccatcgccgaggccttgcagcgcatgtgccgcgagcagcccttggccatggtctgcctgcggcatggccaccaccttggcaggctggcggcgctaggccgcgaactggccggcgccgcccggcaaccgctggcggtgatggggttttgcaacttccagggccgcggccagagggtggccgcgcccggcggccggctggggcggctctgcaccaatccgctgctgctggccttcccctccgccgatgccgacccggtggtgctggacatgagcaccaccgccgtgtccgaaggctatgtccggcgccgcgcccaagaaggcgccgcgctgccttccggctgcctggtcggcgcggacggagagccggcgctcgatcccgccctgctctacgcccagccgccgcaagcgacgatgcagccgctgggcggagccctggccggccacaaaggctacgggctggcggtattcatcgaattgctcgccggagcgctggccggcgccggccatgtcgcccgaccggaggacgcaggcaacggcggcttgttcctggcgatcaacccggcgctcgcgccatccggcctagccgccgtcaaagccgaggcggccgccatcgcccggcattgccgcgagaccggacaggctggccgtttggccaggatgcccggcgaaggctacgccgaacgccgccgggccgccgccgcacgggccatactgacacttcccgccgccacgctagacgccatccggcatctggccggccagcaccaggagaacccgcatgtcgaatga

SEQ ID NO: 2314 - DNA, 804 bp, Chromobacterium substugae
atgtcgaatgacgcgcccttccatccgctattgaatgccggcaatccgatcaaggacaaactggctgccggccgcacctgtttcggactgttcctggtatcggccagcgcgctgatcgccgaatgctgcgccacccgcgggccggactggctgctggtggacatggaagcgtccccggccgaccgccgcgacttgatccagatgctgcaggcgctgaacggatcgcacaccgccggcatggtgagggtggcccgcaacgagcgccacttgatcgaggcggcgctggacagcggcgcgcagggcctgatggtgcccaaagtagactcggcggccgatgcccgggcagtggcgaattgcgcctattacccgccgcgcggccgccgcggcgtcaaccccatccgctgctccgcttatttttcacgcctgcccgactacttcgccgaagccaaccagtccttgctgaccatcgtccagatcgagtcggcgcaagcggtggccgaagccgacgacatcgccgccgtcgacggcatagacgtgctgttcatcggctgcggcgacctggcctgcgacctgggccaggccggccaggtgaccggcgcgctgatggacgccgcgatcgaacaagtgctcgaggcctgccaccgccacggcaagatcgccggcatcttcgcctacagcctggaattggcgcaacgctacgcccgccagggcttccgcttcatcgccttcggcaacgacatgaaactgctggcgcaatcgctggagcaacagatgcgcagcctggaggaattcgcttcaccatga

SEQ ID NO: 2315 - DNA, 480 bp, Chromobacterium substugae
atggtcgcacacaatgaaaccagcgccggcgtcgaaccgcgccccgcctccggccgcgagcaggaagcgctggcgctgatgcgcagctacatgccctgggcggccggcgccggcctggtgccggtgccgctgctggacatggcagtgatcgctggcgtgcagctgaaattcctggccaggctgtcggcgctgtacgacgtgccgttcagcgaaaaccaggccaagtccatcatcgccgcgctgctgggcagcgtggtgccggccagcatcgccaccacggtgttctcgctgctcaaaggcattccgctcctgggcttcgccgccagcttcctgacgctgccggcgttgggcgccgcctccacttatgcgctgggcaaggtattcatccagcacttcgagtccggcggcaccttcctcaacctcgatccgcagaaagtgcgcagctattaccaggaacagtttgaacaagcacaaaaataa

SEQ ID NO: 2316 - DNA, 543 bp, Chromobacterium substugae
atgaagccctgccctccccgccggccgcgccgcggcctgctgacactcgccttttgcgccgccgcggcttcgcacccggccgcgcgcgccgacttcccttacgccaaggaccagacatccccggtgcagaccgccacgcagaacctgccgacacaacgcggctccatcgacatcgccatcagccaggcgcatgtctacggcctggacacgcccggctcgcatagctattgctcgccatcgatcaaaatcatcaatcacgcgtcggacacgctgcgcacgctgatcctcggcatcgaataccacaagaacggcagccgcgagtcctccggctcttcggtggtcaatctgacttcgccgctggagccggacaattacagcaccacctatttcaatccgctgaatgtcgccagttgcaaggacctgcaaggcgccgtcactgtgctgagctgccagtacgccttcaatggcgattgcggggccgatgtgcgcgccatcggcttcggcgccatcccgctgcagcgcgccgccggcaagaaaccatga

SEQ ID NO: 2317 - DNA, 162 bp, Chromobacterium substugae
atgattatttattcctacttgggactatgcctggtggtcgcctacatgggcagacacacccggctgggctttctgcgcaccatgctgttctcgatattcatgacgccggtgctgatgatgatctatctgctgatcgcctacgccaccgacgaacgccgctga

SEQ ID NO: 2318 - DNA, 1629 bp, Chromobacterium substugae
atgctgctatccaaattccttttccaaaacagcaagctgccgatgaaacggctgggcgtgatggccgcgctggccagcgcctccaacgccagcctgttggcggtgatcaatcacgccgccgagcacatcaaggacgtggacatgcagttcttccacgtgctcatctacggcctggtgctgaccctgtacatctacagccagcgctatgtgctgctggctacctgcgacgaggtggaggacatcgtccaccagatccgctgccggatggtgaagaccttgcagtcgtgcgagctggccatgctggagcacagcggccacggccgcatctattcggccatctgcaacgatacccagaccctgtcgcaggcggcctgcaccatcgtgctgggcttccagtccatcatcctgatcgtgttcgcgtcgctgtacattgcctggctgtccctgatgtcgctgctgctgatcattgcggtgatggcgatcgccaccctgatctactgggccaagatgaaatcggtgcatgcgatgctgtaccaggccaacgaacaggaaagccggctgcacgaccagatcggcagcctgctcagcggcttcaaggaggtcaagctgtccagccgccgcgccgaggcgctgatagacgatgtcgaaaccacgtcggaaatcaccgcccagttgcgcaaggtggcgcagcgcggcatctccatcaacttcatgttcgcccagatcgcgctgttcctggtgctgggcagcatggtgttcgtgctgccggtgttttcgccggcctataccgacacggtgatgaaaacgctgaccgcggtgctgttcctggtggggccgatctccggcatcatcgccgccattccgcagatcgccactgcaacagccgcggtggaaaacctgcaggagctggagcgcgcgctggccagccatgcccaggccgcgcaaaccgcggccgacgaagcggccgccttccgcagcctggaattgaagaacatccatttccgccatgaacgcagcgatggccagggcttcgccatcggcccgatcaatctatccatccaggccggcgaaatcattttcatcaccggcggcaacggctccggcaaatccacgctgatcaagctgctcaccgcgctgtacccgccctctggcggctcgctgctgctgaacggccgcgcggtggcggcggagcgggcgcaggcctaccgcaaccacatctgcgcggttttctccgattttcacctgttcgacaagctatacgggctggaggactggaaccgggacgaggcggagcggctgctggaggagatggaaatcgccgacaaggccgaaatgggggaatacggcttcaacaccatcgacctctccaccggccaacgcaagcgcctggcgctgatcgcggcgatgctggaacacaagcccttgtgcgtgctcgacgaatgggcggccgaccaagaccctcatttccggcgcaaattctacgaaacgctggttcccagcctacgcgaacggggcctgaccctgatcgccgtcacccacgacgaccgctacttccatctggccgaccgccggctgcacatggaagatggccgcctgtacgaacttggcgaggaaagccaccatgcctga

SEQ ID NO: 2319 - DNA, 942 bp, Chromobacterium substugae
atgcctgatgccgcagccagcgccgttccgcgcccgccgctccgccgtttcgaagcctggctccgagagctgaccattcccctcacggtcgccttcgccattttcatcttcctgctgccgctgatgatctacaccatccgtcccggccaactgggcgtgcaatggaaacgcttccagggcggcacccagcttgatcacatctatggcgaaggcacccacatcatcctgccatgggaccacatctacatctacgacgcccgactgcagcgcgtggaacgcgagttcgacgtgctgtcgtcggatggcctgacgatgaaggtcagcatggcctggcgcttccgcgtcaatccgtccaacctgccctacctgcaccgctacgccggcgagaactacgccgaaaccttgatcgcgcccagcgtcggcgcccgcacccgcgatgtgatcgcctattaccggccggaacaggtctacacccagtcgcggctcaccatccagcaacaaatactgtcctcggtgcgttacgacctgatcaacaacttcaaccccgacggccgcaagggcttgaaatgggtggaaatcgaggacgtgctgatcaagggcgtcacgctgccgcggggcgtgcaggacgccatcatcaagaaaaacgccgcctaccaggaaatgcagacctacaacttcctgctgagcaaggaggaaaaagaggccgaacgcaaacggatagaagccaccggcatccgccatttccaggaaatcgtcagcaacggcatgagcgacagctatctgcgctggcgcggcatcgaagccaccgtccagctggccaagtccgacaatgccaaggtggtggtgataggcgccggcgccaacggcctgccgctgatcatgaacatggatgacaagaaggcggaggcgagcaagccgaaggcgcggccgcgcaaaccatga

SEQ ID NO: 2320 - DNA, 417 bp, Chromobacterium substugae
atgaccaatagactatcgggatggttggccttgctggctttggcctgctgcgcgccggctcaggccgcggatgcgccggcgccgaaactggtgatcgagtctcccgtcgatggccaggcggtgggcaatgcgctgattgtccgcttccacgccgaacagatccggctggcgccgcgctacgcgcctgccggggagccggttcccgcagcgctgcggggagtcggccacctgcacgtgtatctggacggggcggcctggcattgggtgcatgccacgcccgatccgctggtgctggtgggcttgccgccggggccgcatcagatccacctggagctggccgcgcccaatcaccaaccgctggatgcgcggcaagtatccttcagcgtaagcgccggagactctcggcgcgcccattga

SEQ ID NO: 2321 - DNA, 174 bp, Chromobacterium substugae
ttgcgcgcaggcaaggcaaacggaagctgcggcttccgtttttttttgcgcgcgcgtgaagcgcttgcgctatgggtgtggccaaccataatgacaatggcgttccggcgggccgccaggctgcgcgctcacgatgacggcggcggaagcccaagcgatgaggaatggggatga

SEQ ID NO: 2322 - DNA, 3960 bp, Chromobacterium substugae
atgtcttacattaccaagctgcgcggtggcgttgccctgtcaccgtttcgtctcgaaaaactgcaggcggcagctgccgatgccggtttgaaggatctggtcctgatggccgagtattggcattttgcggaaagcgacagcgagctgacgctggaagaggtgggcgtgctgggccaattgctcagctacggcgagccgccgctcagcgccgagccggaaggcgaactgttcctggtgacgccgcgcatcggcaccttgtcgccgtgggcgtccaaggccaccgacatcgcccggcactgcggattgccaagaatccgcaggatcgaacgcggcacggctttccgaatcaagtccgccgataaatctttaagtaaagaggctcgccacattctggcgggcctcttgcacgataggatgaccgaaacggtgctggcctcgttcgacgaggtggagaaactgttcgtccatatcgacccgcagccgatggaccgcgtcgacgtgctggccggcggccgcgaggcgctggcggccgccaacgccaagctgggcctcgcgttgtccgaagacgaagtcgactacttggtggaaaacttcgtcaagctgggacgcaatcccagcgacgtcgaactgatgatgttcgcgcaggccaactccgagcactgccgccacaagatcttcaacgcgcaattcgtcatcgacggcgtcgagcagggcaagtcgctgttccgcatgatccgcgatacccacgacgcccatccgcaaggcacgctggtggcctacaaggacaatgcctcggtgatagagggcgctttcatcgagcgcttctacccgcagcccggcagccaccgctacggatacaacagcgagcccaccgacatcctgatgaaggtggagacgcataaccacccgaccgccatttcgcctttcgccggcgcctccaccggcaacggcggcgagatccgcgacgaaggcgccaccggtcgcggttcgcgtcccaaggccggcctcaccggcttctcggtgtccaacctgaacatcccgggcttcaagcagccgtgggagcaataccgcgacggccaggccgagtacggcaagccgggccgcatcgcctcggcgctgcagatcatgctggaaggtccgataggcggcgcggcgttcaacaacgagttcggccgtcccaacctcaccggctacttccgcaccttcgaagaggaagtgcacggcgagatgcgcggctaccacaagcccatcatgctggcgggcggcctgggcaacatccagcagcagcagatccacaagaacgaaatcccggaaggcgcgctgctgatccaactgggcggccccggcctgctgatcggcctggggggcggcgccgcctcgtcgatggacaccggggccaacagcgaaaacctggacttcgactcggtgcagcgcggcaacccggaaatcgagcgccgctgccaggaagtcatcgaccgctgctggcagctgggcgaagccaaccccatcgtctccatccatgacgtcggcgccggcgggctgtccaacgccttcccggagctggtcaacgacgccggccgcggcgcggtcttccatctgcgcaaggtgcacctggaagaaaagggcatgacgccgatgcagatctggtccaacgaggcgcaggagcgctacgtgatggcggtgctgccgcaggacctggagcgcttcagcgcgctgtgcgagcgcgagcgctgcccgttcgcggtgctgggcacggccaccgacgacggccatctgcaggtgcgcgacgaccatttcgacaacaacccggtggacatgccgctggaagtgctgctgggcaagccgccgcgcatgacccgcgatgtgaagacggtggagcctgactaccaggtgttcgacgcgtccaaatacccgctgcgcgaaaccgcctaccgcgtgctgcgccaccccaccgtggccgacaagtccttcctgatcaccatcggcgaccgcagcgtcggcggcatgacggcgcgcgaccagatggtgggccgctggcaggtgccggtggccgacgtggccgtcaccaccatgggcttcaacacctatcgcggcgaagcgatggcgatgggcgagcgcaccccggccgcgctgttcagcgcgccggcctccggccgcatggcgataggcgaggcgctgaccaatatcgccgccgccttcgtcggccacctgggcaacgtcaagctgtccgccaactggatggcgccggcgggccaccccggcgaggacgtgcgcctataccgcacggtggaggcggtgtccgagctgagccagagcctgggcgtcagcattccggtgggcaaggactcgctgtcgatgaagacggtttggcaggatggcggcgagcagaaggccgtcaccgcgccgatgtcggtggtgatttccgctttctcgccggtcgaggatgtgcgcaagaccgtcaccccggtgctgcaggacgtcaaggacagcgacctgatcctgatcgacctgggctacggccgctgccgcctgggcggctcgatctacggccaggtgtggaaggacatgaagggccgctcgcccgatgtggaaagtccgcaacagctggccgccttcttcaacaccgtgcagtcgctgctgcgcgacgacaagctcctggcttaccacgaccgctccgacggcggcctgttcgccacgctggcggaaatgatgttcgccagccatgtcggcatcagcgtcgatctgcaggagctggtgatcgagcgccagaatacccagcgcatcatcgacgactacgtgcagccatcgctggaggccgccacccacggccgcatcatgcgcgtgctgttcaacgaggaactgggcgcggtgctgcaggtgcgcaagggcgacaccccggaagtgatctcgcgcttcatgaaggccggcatcggccgcgagctgttcgtgctgggccgcgtcaacggctacgaccggctggtgatcaagcacaagggcaaggacctgttcagcgaaagccgcagcgagctgttctgcgcctggtcggaaaccagcgcccgcatgcagcgcctgcgcgacaatccggcctgcgccgacagcgagcagctgctgcgcagccacgccaagccgcgcggcttgttcgcccagctgagcttcgacgtgcatggcgatccgtcggcgccgttcatcgccgccggcgcgcggccgcgcatggccgtcctgcgcgagcagggcgtcaacggccagctggagatggcggcggcgttcgaccgcgccggcttcgaggcggtggacgtgcacatgagcgacatcatcgccggccgcgtctcgctggccgacttcaagggcctggccgcctgcggcggcttcagctacggcgacgtgctgggcgccggcgaaggctgggcgaagagcatcctgttcaatccgcgcgcccgcgaacagttcgaggccttcttcggccgcgaggatacctttgcgctgggcgtgtgcaacggctgccagatgatgtccaacctgtcgtccatcatcccgggcgccgagtattggccgaagttccgccgcaacgcgtcggagcagttcgaggcgcgcttcgcgatggtggaagtcaccgcttcgccgtcgatcttcctcgcagacatggtgggcagccgtctgccggtggtggtgagccacggcgaaggccgcgcggtgttcgcgccgggcagccaggagcaggcgctgaccgcgctgcgctacatcgacttcgacggtcgcgccaccgaaacgtatccgctcaaccccaacggctcgccggcgggcatcaccggcgtcaccacgccggatggccgcttcaccatcatgatgccgcacccggagcgggtgttccgcaccgtgcagaacagctggcatccggcggattggggcgaaaacggcgcctggttccgcatgttcgcctcggcgcgccgctgggtgggctga

SEQ ID NO: 2323 - DNA, 339 bp, Chromobacterium substugae
atgaaaaaggtcgaagccgtcatcaagccgttcaagctggacgaggtgcgcgaggcgttgtccgagatcggcatcaacggcctcaccgtttccgaagtcaaaggcttcggccgccagaaaggccacaccgagctgtaccgcggcgccgaatacgtggtggatttcctgcccaaggtaaagatagaagtcatcctgccggacgatctggtggagcgcgcgatcgaaaccatcgtcgccaccgcccgcaccggcaagataggcgacggcaagatcttcgtcaccgcggtggagcaagtggtgcgcatccgcaccggcgaaaccaacgaacaggcgatctga

SEQ ID NO: 2324 - DNA, 792 bp, Chromobacterium substugae
atgaaaagatacgttgttgcagcaatgttggtgatggggcttgccggatgtgcaaccacggaaacctacgacgaaacgcgcggctggaccgtggagaagctgtattcggaagctcacgacgagttgaacagcggcaattatacccgcgctgtcaagctctacgaaacgcttgagtcgcgcttcccttacggacgctatgcgcagcaggcgcaaatggacctggcctacacccattacaaggatggagagccggaacaggccatcgccgcggccgaccgtttcatcaagctgcacccgacccaccccaatctggattacatctattatctgaagggtttggtgtatttcaatgacgattccggcctgctcgccaaatgggccggccaggacatgagcgagcgcgacccgcgcgcggcgcgcgaagctttcgccgcgttccgcgaattgaccacccgctttcccaatagcacctataccgccgacgccagcgccaagatgatcaagctggtggacgcgctgggcggcaacgagatgcacgtggcgcgctactacatgaagcgcggcgcctacctggccgccgccaaccgcgcgcagggcgtggtgaaggattacgccaacaccaagtatccggaagaggcgctggccatcatggtggccgcctacgacaagctgcagctgccgcagctgcgcgacgacgcccgccgcgtgctggcgctcaactatccgaagagccagtacctggccaagccgtggacggtcgaggaaatgccgtggtggaagctgtggaagtaa

SEQ ID NO: 2325 - DNA, 1098 bp, Chromobacterium substugae
atgactgatccttacattgacccggacgattatagcgacatctcggaaaacgagatatccgccacgcaacatctcgaaattccgctgtcgctgggcggcgaaagactggacgccgcgctggccaaactgctgcccgatttctcgcgcagccggctgacccagtggatcaaggacggccaagtcaaggtggacggccaggtggtagcgcccaagaccaagatgctgggcggcgagaaactggaagtttcgctgcagcccacgcatgaggaaatggccttccagccggaagccatggacctgcccatcgtcttcgaggacgaccacatcctggtgatcaacaagcccgccggcctggtggtgcatccggcgtccggcaactggagcggcaccctgctcaacggcctgctgcatcactgcccgtcgctggccggcgtgccgcgcgccggcatcgtgcaccgcctcgacaaggacacctccggcctgatggtggtggccaagaccgtgccggcccagaccgatctggtgcgccagatgcaggcgcgcagcgtcaagcgcgtctatcgcgccatcgccgacggcgtggtgccgttcgacggcaccatagacgccaacatcggccgcgatccgcacaaccggctgaagatggcggtgctgaaattcggcggcaagcccgccatcacccatctgcgggtgctggagcgcttcgccagccactcctacgtggaatgcaagctggaaaccggccgcactcaccagatccgcgtccacatgcgcgaagccggccacccgctgtccggcgacccggtgtacggcaacctgcgccacaagatggatgaagacaccgccgccgcggtgaaggcgctgggccgccaggcgctgcacgcctacgcgctggccctggtccacccggcctccggcgagctgcgcagctggaaagcgccgctgccggacgacttccgccgcctgctcgacctgctgcgcggcgacggcgcgctgccggacgaagaggctttcgcccacgccgacgagcaggacgacgaagactgggatgacgacgacgatgacgacggcgacatcgaggtgatctatgcccgctga

SEQ ID NO: 2326 - DNA, 738 bp, Chromobacterium substugae
atgcccgctgaaacctggcttgccgccgactggccggctccggccagggtccgcaccctggccaccacccgccagggcggcgtcagccagccgccgtacgccagcctcaacctgggcgcgcatgtcggcgacgcgccggacgcggtggccgccaaccgtgcgcggctgcgtgacgaattgccggccgaaccggcctggctgaaccaggtgcacggcgtcgcggtggctgacgccgccgccctccgcggcgccgccccggacgccgacgccagcttcgcccgcgcgccgggcgtcgtctgcgcggtgatgactgccgactgcctgccagtgttgctgtgcgacgacgccggccgcgcggtggcggcggcccatgccggctggcgcgggctgtgcgacggcgtgatcgaggccactgtcgccgcgatggctctgccgcctgccggactgatggcctggctggggcccgccatcggcccggacgccttcgaagtgggcgcggaagtgcgccaggccttcctcgcccgcgatccggcggcggcctcggccttcatcgacatcggcgaaggcaaatacctggccgacatctacgcgctggcgcgccagcgtctgcaagccgcgggcgtcgagcgggtgtacggcggcgatttctgcaccgtgatcgaccgcgagcgtttcttctcctaccgccgcgaccgcgtcaccggccgcatggcctcgctgatctggctgcaggactga

SEQ ID NO: 2327 - DNA, 669 bp, Chromobacterium substugae
ttgacccgcgcgcgccacgcgaacatcatgttgttttcaccacagccccttgccgccatggacatcgccatcgtcacgctggacagtttcaatgagctcgactcgctgatcgctgcgggcatccttggccgcatgtccccgcatggttggaacgtgcgcatctgctcgcccattcccgtcgtgcagtcccgcagcggcacgcgcctggaacgccaggcggacctgtcctatgccggcagcgccgacgcggtgctgataggcagcggctggcgcacccgcgactgggcggcggacgatgccatcatgagccagctgcggctggatcccgcccgccagctgataggatcgcaatgctcgggcgcgctggtgctgcatcggctgggcctgctggccgacggcgtcgcctgcaccgatggcctgacccggccgatgctggagcagttgggcatcaccgtcgcgccccgcgccttccgcgccgtcggcaacatcgccaccgcaggcggctgcatggcttcgcagtatctggccggctgggttctgctgcgtctggccggcgaggcgcgcgcgcgcgaggttttgtcctatgtcgccccggtcggcgaggaagccggcttcgtcgacagggccatgtccgccatcgccgcggcgtccgagcccgttcccgaatga

SEQ ID NO: 2328 - DNA, 873 bp, Chromobacterium substugae
atgaaaaccatcccgctcgccaggctgtcccccgccgacctccatccctgcttcctggaggcgttcagcgactacctggtgccggcgcaacccagcctggaatcgttcagcgccatgctgcgccggcgcggctgggtgcccgagctgagcgccggcgcctggatagacggccggctggccggcttctggctatgcgcgacgccgccgattgacgacggaatggaaggttattgcatcgctgccggcgtggtgcccgccgcccgccgccagggggcgctttccgcgatggcggcccgggtggcgcgcctgctggccaggcgcggcatccaccagcaaaggctggaagtgatagacggcaatcagcacgcgcagctggcctacgcccagctgggcttccagccgctgcgccagcttgactgctacctgctgcaggtgcccatcgacagccggcgccattggcccgtcacggtccatcatggctacacgccggcgcgctggccaagcgctgactggctggcctatccgccggcggtgccgaaccgccgggactcgctgcggcgcgccacgcccgccccgcgctggttgacggtagacgccggcggcgcggcgctgggctcgctgctgctgtcggccgacggcgaagcgctggagctgatggtggacccggcccaccgccgccgcggcatcgccagccaactgctgcgcgcgggacagctgctgacgccgggcggccggctggcattcaacaacgtcgaccgccgcgacctggccctgctcagcctgctgcttcggcaccaggccgcctaccggctgtcgcaatgggaaatgctgaaaccggccgcagccgaggccggcattcgctccgcgcggtga

SEQ ID NO: 2329 - DNA, 654 bp, Chromobacterium substugae
atgactccacaacaacaaaccgactggcagaaccgcctgatcacgctgctcgagcagcaaccgcccgacgacgacggcgcccacgacctcagccacctgcaccgggtatgggcggtggcgcgccagttgctggcccaccatcccgaagccgatgcgcgggtggtgatggccggctgttacctgcacgacctggtcaatctgccgaaaaaccacccgcagcgccagctggcatcgcactggtccgccgagcgcgcccgccagctgctggccgacgacgcgctgtcggccgagcagctggacaacctggcgcacgccatcgaggcccatagctactccgccgccatcccgccgcgcacgctggaagccaagatcgtgcaggacgccgaccgcatggacgcgctgggcccggtcggcctggcgcggatgttctacgtttccggccgcatgggccgcgcgctggcccacccgctggacccgctggccgaacagcgcggcaccgacgaccaggcctgggcgctggaccatatcgcggtgaagctggccaaattgccggcgatgatgcagaccgaagccggccgcggcatcgccgagcgcaagctgcaatggctgctcgccttccgcgacgagttctgccaggactggatggcccgctag

SEQ ID NO: 2330 - DNA, 720 bp, Chromobacterium substugae
atgatccgcaagctgccgcgcaacaccgcaggccgcgactgggtggtgggggatctgcatggctgcttcagccaactgggccggctgttgaaaatcatcgccttcaatccggcctgcgaccgcctgctgtcggtcggcgacatggtggaccgggggccggaaagccggatggcggtggagtggctgacgcagccgtggtttcacgcggtgcgcggcaatcacgaacagatggcgctggacgcgatgcgcaatccgctggaagacctggagcgccacctgcgcaacggcggccgctggctgaccgagctgagccattccgagcgcgacgcctgcctcgccgcattcgccggcctgccgctggcgctggaaatcgacgtggaaggcggcaaaatgggcgtggtacacgccgactgccccgacaacgactggccgtcgctgcgcgccaggctggaagccgacaatccccgcgaccaggactacgaggcgctgctgtggtcgcgcgagcgggtacgaaacgggggcggcggcgccgtccatggtctggacctgctgctggtggggcacacgccgcaggaaaacgccatcctgtacgacaacgtgatgcacctggacaccggcgcggtctacggcggcaagctgacgctgttctgcgtcagcgacttcgtcgaagtctcgttgccggccagcttcgaacacatggcgcagttccagctgcattag

SEQ ID NO: 2331 - DNA, 408 bp, Chromobacterium substugae
atggccgagcacaagaagaaatccgccgcccccaaggcgggccaactggaccgccgcgttcaggagcaacgccacggccaggccgaagacgcctgccgccgcctcgtcgcgctgctggaagccctggccgccgacggccgcctggacggcaaccagcaggccagccaatacctgaactccacccgcgcctactaccgccgcatccgcaacggcaaggtgatgggagcggccgacttcaccgccgccgccgacgtctgcgcctgcgcccgccgcgcgctggccgcgctagacccagaactcgtcttcgccggactgccgcaggcggacgagctgctgcaggccctgcggctgggcgaacaggtggaaaccgaaatgcgccggatcaaagccgccggcaaagctggctga

SEQ ID NO: 2332 - DNA, 399 bp, Chromobacterium substugae
atgtacaaccgcattccccatctgcgcgtcgcccgcccggtcagcaatctcgccgccagcaaggccatgtattgcgaaggcctgggtctgcagctattgggcagcttcgccggccacgacggcttcgacggcgtgctgctggggctgcccgacgccggctatcatctggaattcatcgtcagccatcggcatccggtcagccccgcccccggcgtggaagatttgctggtgctctacctgccggacaaggccgaatgggaggcgctgtgcgcctgcatgcgcgccgccggcttccgagccgtgccgtccgccaacccgtactgggacgcgcgcggcgtcaccttcgccgaccacgacggctaccgcaccgtgctgcaaaacgccaaaagcccggtataa

SEQ ID NO: 2333 - DNA, 750 bp, Chromobacterium substugae
atgttagccaggctgctgtttctgctgcccgcgatgctgtgcgcgcttggcgcccgggcggatgagctgacgatgtgctacgacaagtacccgccgtacgcgctgggcgagttcgacactgtggccggcggcggcatcaaggtgcgcctgctgcaggagataggccggcagctgggcctggcggtgacggtgaagatcatgccctggaagcgctgcctgaccgaggccaaggagggtcgggtggacggcatcctgccgctgtacaaaacgccggagcgcgagcagtacatggagttttccgcgccggtgatgcggcagtacaactgcttcctgtacaagaagagcgcattccgcggcgcggtggactggcgggattacgacaggctgaaaacgcaccggctgggcatggagataggctcggtggtcgacaaggacatggaggccgccttcatgacggcgcacccgatagagcgggcccgggattcggtcaccctgatcaagatgatcgagtccggccgcatcgacctggcgaccatcgattcgaatgtcggcaaatatctggtcaaccaacagggcgtggcggatgcgatcggcgtgtccgacgtgccgatcggcgagttgagctacgccgccttcggcttttcccgggcggccggcgccgatcactgggcgccggagttcaaccgcgtgatcgagcagatgcgcgcgtccgggctgctggagaaaatcgtctccagcgaagtcaaatag

SEQ ID NO: 2334 - DNA, 1788 bp, Chromobacterium substugae
atgcgcatcagtcatagcggcccggccccggccaatcgaaacgatttgcaaaccatcaagacgctgttgccgtatctgtggagtttcaagggccgggtgatgctggcgcttggctgcatggtgctggccaaggtggcggcggtgacggtgccgctctacctgaaggacattgtcgaccagctgtcgctgccggccacgctgctggcggttccggtgctggcgctgaccggctacggcgtggcgcggctgctgtccggcgtgctgggggagttgcgcgacgcggttttcgcccgggtgatccagggcgcggtgcgcagcgtggcgcgcaatgtgttccgccatctgttcaggctgtcgctgcgcttccatctggagcgccacaccggcggcatgagccgcgacatcgagcgcggcaccaagggcataggcttcctgctcaatttcaccgtgttcaacatcctgccgacgctgctggagatcggcatggtgacggcgatcttgttccaccgctacgcctgggaattcgcggcggtgacgctgggcaccatcgggctctacatcgccttcacattgctggtgaccgagtggcgcaccgtctaccgccgcaccatgaacgatctggattccaaggccaattccaaggcgatagacgcgctgctcaattacgaaacggtcaagtacttcaacaacgaggagtatgagtccaagcgctacgaccgcaatctggaagcctgggaagcgtcggcgatcaagaaccaggtgtcgctgtcgttgctgaacgccggccaggcggccatcatcgccatcggcgtcacgctggtgatggtgctggccgcgcgcgacgtggtggcgcaccggatgacggtgggcgacgtggtgctggtggcgacgttcatcacgcagctgtacgcgccgctgaacttcctgggcttcgtctaccgcgagatcaagcattcgctggccgacatcgagcggatgttcaagctgctggacgtcaatctggaagtggccgacgcgccgggagcgaaaacgctggatacccgcagcgccgccatccgcttcgaacgggtgggcttcgcctacgagagcaagcgccagatcctgcacgatgtggacttcgccatcccggccggccagacgctggcggtggtgggagccagcggcgccggcaaatcgacgctgtcgcgcatcctgttccgcttttacgacgtcaacgccggcgcggtgcgcatcaacggcgcggacatccgcgagctgagccaggactcgctgcgcgcccacatcggcatcgtgccgcaggacacggtgctgttcaacgacaccatctactacaacatcgcctacggcaaggccggcgccagccgcgaggaggtgattgaggcggcgcgctccgcgcatatccacgatttcgtcgccagcctgcccgacggctacgacaccctggtgggcgagcgcggcctgaagctgtccggcggcgagaagcagcgcgtcgccatcgcccgcaccattctgaaaaacccgccgatcctgattttcgacgaagccaccagcgcgctggattcccgcaccgagaaagccatccagcacgagttggcggaaatcgcggccaaccgcaccacgctgatcatcgcccaccggctgtccactgtggtcgacgccgaccgcatcctggtgctggacgccggccgggtggtggagcagggcagccaccgcgaactgctggccctgggcggccgctacgcggaaatgtggcagctgcagcaggagagcgaggcggtggaaggctag

SEQ ID NO: 2335 - DNA, 381 bp, Chromobacterium substugae
atggccgacaagacctacctcatggaagtgatggcggagccgcattacatcgacgagcaatctaatgtggccaacgacatctacgtgttcggctaccgcatccgcatcgtcaacaccggcagcgagccggcgcagctggtcagccgccactggatcatcaccgacgccaaccagcaggtgcaggaggtgcgcggcatgggcgtggtgggcgagcagccgcacctggacccgggccaggctttcgagtactccagcgccacccatctgaaaacgccgtacggcagcatgaagggcagttatcagctggtggccgacgacggccagcgcttcgaggcggaaatcccggaaatgacgctggtagcgccgcgggtgctgcactag

SEQ ID NO: 2336 - DNA, 684 bp, Chromobacterium substugae
atgcgcactttccgtatcgcccccagcattctgtccgccgatttcgcccgcctgggccaggaagtcagcgatgtcgtcgccgccggcgccgacatcatccacttcgacgtgatggacaaccattacgtgccgaacctgaccatgggtccgatgttctgcgaggccatccgcccgcacacccaggcgccgatcgacgtgcacctgatggtgaagccggtggacgcgctggcggccgccttcgccaaggccggcgccgacatcatcaccttccacccggaaggctccgagcacgtcgaccgcacgctgggcctgatcaaggaagccggctgcaaggccggcctggtgctcaacccggccacgccgctgtcctgtctggaccacgtgatggacaagctggacatgatcctgatcatgtcggtgaaccctggctttggcggccagtccttcattccgcacgcgctggagaaaatccgtctggcgcgccagcgcatcgacgaatacaccgccaagcgcggcggcgagatctggctggaagtggacggcggcgtcaaggtggacaatatcgcccaggtggccgccgccggcgccgacaccttcgtggccggctccgccatttacggccagaaggactacaaggcggtcatagacgccatgcgcgccgaactggcccgcgtgcaaggataa

SEQ ID NO: 2337 - DNA, 753 bp, Chromobacterium substugae
atgcatgcattcatcgtcaccggcgcctcgcgcggcctgggctacgccatctgcgaaacgctgctgaacgacggctacttcgtcgtcggcgtcgcccgccatgccggtccggcgctggaaggcctggccgcccgccacccggagcggctgctggccgtcaacgccgacttggccgacgccgcccaggcgtcggcgtcgattcactccgcgctgcagcaactgccgctgtctgagtgcgcgaccgtcacgctgatcaacaacgccggcgtggtgacgcccatcgcccaggccggccgctatccggccgacgaggtggtcaaggccgtcgccatcaacgtcaccgctccgctcctggctagcgacgcgctgctgtccgccaccgaccatctgccggcgcgccgccgcattctgaacatctcgtccggcgccgccgccaaggcctaccccggctggagcgtgtattgcgccaccaaggccgcgctcgaccacttcagccgcagcgtcgccgtggagcaggaaggcaaggccaatccggcgcagatcgtcgcgctgtatccgggcgtggtggacaccgacatgcaaggcgatatccgcgccagcgacgaaggccagttcccgcaaaaagcgcgcttcgacgcctacaaggccgacggcgcgctgagcagccccggcgacgccgcgcgcaagatcgtcgactacctggtgtcgccggccttcggccaggcgccagtcgtcgacatccgcgagctgtaa

SEQ ID NO: 2338 - DNA, 684 bp, Chromobacterium substugae
atgaatctcaagcacatcaaagccgtcgccttcgatctggacggcaccctgatcgactccatccccgatctggccaatgccgccaacgccatgcgcgctcatctgggcctgccgccgctggacccggagcgcatcaagagccatgtcggcgacggcatcgccagcctggtccaccgcgccatcaccgacgagcgccacgccgaggccgacggcccgctgtgggagcgcggctaccgcttcttcatccagcattaccgcgaacacctggccgaccagaccacggtctacgccggcgtgcgcgacggcctaagcctgttgcgcgccctcaagctgccgctgctggtcatcactaacaaatccgagcggctggccgtgccgctgctggaacaactggagctgcgcgaccacttcagcctggtcctgggcggcgacaccctgccggagaagaagccatccgctttgccgctgcaacacgcctgccaggtgctgggcatctcagccaaggaaatggcgatggtgggcgactccgccaacgacgtggccgccgcgcgcgccgccggctgcgccgccatcgcggtgggctacggctacggcgacgccgcctcgctgggcgccgacctgaccgtggccagcattgccgagctgtacgatttgatgaagaatgacggctccatctcactctaa

SEQ ID NO: 2339 - DNA, 1467 bp, Chromobacterium substugae
atgcagccacagactttccagcaactcgccgccgaaggctacaaccgcatcccggtcacccaggagctgctggccgatctagacagcccgctgtccatctacctgaagctggccaaccagccgtacagctacctgctggaatcggtggtgggcggcgagcgccgcggccgctactccatcatcggcctgccggccgacacccgcctgcgcgtcaacggccagcgggtgcaggtggagtgcggcgacaaggtgatagagcgccacgacggcgatccgctggccttcatcgaagcgttccagcgccgtttccgcatccccgagctgcccggcctgccgcgctactccggcggcctcgtcggctacttcggctacgacaccatacgctatatcgaacgccgcctggccgacgtccagaaaccggacccggtgggcacgccggacatcctgctgatgctgtccgaggaaatcgccgtggtggacaacctgtccggcaagctgcacctggtggtgtacgccgacccggaagtgcccaacgcgctgcccaaggcccaggcgcggctggcgcagctgcgcgccaaactgcgcgagccgctcgccattccgctgtcgctgcccaccggccccgccgcggaggcggtgtcggaatacggcgagcaggccttcatggacgcggtggccgccagccagcgctacatccacgacggcgacatcatgcaggtggtgctggcccagcgcatgcagcagccctaccagggctcgcccatcgccttgtaccgcgcgctgcgcaacctcaatccgtcgccgtacatgttcttctaccatttcgacgacttccacgtggtgggcgcttcgccggaaatcctggtgcgccgcgagggcgaaaccgtgaccgtgcgcccgatcgccggcacccgcccgcgcggccagagccgcgaacaggacgaggcgctggccgccgagctgctggccgaccccaaggaaatcgccgagcacgtgatgctgatggacctgggccgcaacgacgtcggccgcgtcgccgacatcggcacggtcaagatcaccgacaatatggccatcgagcgctactcgcacgtgatgcacatcgtctccaacgtcgaaggccaggtagaccgcaagatcagcaatatcgacgtgatcaaggccaccttcccggccggtaccctgtccggcgcccccaaggtgcgggcgatgcagatcatcgacgagttcgaaccgaccaagcgcggcgtctacggcggcgcggtcggctacctgggcttcaacggcgacatggacctcgccatcgccatccgcaccgcggtgctgaaaaacggcatgctctacgtgcagtccggcgccggggtggtggccgactcggtgccgcaatcggaatggctggaaacgcagaacaaggcgcgcgcggtgctgcgcgccgcgcaaatggtggccgatgggctggatgcctga

SEQ ID NO: 2340 - DNA, 1680 bp, Chromobacterium substugae
atgaatgaaatgctcagacctcttttgctgacggccatggttgccggtttgacggcatgcggcggaggaggcggaggaggtggttcgccatccgccaatgatggcggcggcgcggttgcgcatggcgccgcgccggaggcgaagtcgggggcggaggcgggagagttggtctgcagcggcaaccgttgccgcctggcggatggcgccaaccaggcggtcggctcgatgtaccgtttttacaatgacagccatcttgaacgtgagctggtggtatcgggcctgtcgccggcgatctggcacgcggtctcgaccaaggtgagcggcgccggcgtggcggccggcgagctcagcctgcgtcaggaagagaaggacgccgggccgcgcgagccggactatcaggcggagcatgccgagctgagcgcgatttacgcgcagaaagcgccggcgcaacgtctgaagctggggcagggcgccaggcgggaggcgccggtcgcatatgcgccgggcgaggaaaagacatggttcgattccatccatgagaatgatgtcgcgaccacgctcaggacaaagcgcgcgctgccgggcggcgcctcggtgcatgtctggaccgagaacggcgccggcgtcagcgccaggcaggccgacttcctggccgagcgtttcgcgggcagcgtctacccgctcgaggtgtcgctgctggggcagccgtggggcgtggtcggcaatccggtgttcgccggatttaccatcccggcggatacccgcgacgtccatatcgtggtgacgccgttgcgcgcccagggcaacgccgccgggctgatgggttatgtctggtcgggcaacgcgctgcgcaatttgtgcacggaagacgcgaaaccatgccagaaataccagcgcagcaacgcggcgctggcggtcttcttgtcatccgaagtgctggcgcgcagcgcggcgggtgaggagtggcatgagcgctcgcaaggcgcgggcgaggcgctttccacgctggcgcatgagttttcccacctgttttacagctacaacaagcgctacaaaccggctgtcccagtcaaggtggaaacctgggaggacgaaatgttcgcccagtcgatcgcttatctggtgctggccgataccttcggcggcgggcgcggcgccgggcgggacgcgcatccggacttgcggccaagagcggacttcgagcgggcgctcgatttcgtcccttgcgacttctctcgctggaatggcgcgagcagctgttatcccaaggcgctggctttgggcgcgctgatggtgcatcaatacggccatcagttgttccggccgtggctggaaagccagaatcccggcgcgcaggcggtctccgagggcttgcgggccgcaggcggcgccggttatgcggacatgctggagcgctacgccggcaccatgctgagcgccggcgcggcgaatgtcgcggggcgctatggttatccggccaagcgggtggtgctgccgggcagtccgctgctgccgcagggcagggaaatccagctgccgggcattgcgctgtccgccgacaagccgctcattcccatggatgggcaatacgataccagcaagcagttctcttatatcggcaacggcatctggactttgcgggtgccggcaaacagctggatcacgctgaccaagcgctga

SEQ ID NO: 2341 - DNA, 1647 bp, Chromobacterium substugae
atgctgctgcacgatatgcggacacgccataaactggccctgctgctggcgatcccgctgctggccatcgccgccgtagccggggaagggctggtgaccatggccgaattgaaggaccacgtcgccaaggtttacgtcagcagcgccgcgccgctgttcgaagtgtccaaggtcagctctctggtgccgcgcacccgcatagacgtgatgcaggcgatgatggacgccatggccggcggcgccggctaccgcacccccacccagcgcgccgaccggctgtacggcaagataggcgaaatgcgggaggcgatcgccaagctgcagcaaggacacatttcagcggaactgaaaccccaggtggacgccatcgccgcgctgtatcaggacatggccgccaacagcctggagcccttcgtcaacgccatccgcgccaaccgcatcgaggacgccaaggcgatctatcccaaattcgtcaagcagtacgaaggactgcgcgaccaggtcggcgcgctgatgccgcgccagctggctatcgccgaaaccgcctaccaggacgccaaccgcacctatcagagccaaagccggctgatttacggcgtgctggcggtgtcggtgctgctcagcctggccataggcttcgcgctggccaagctgattagcgaggaattggacaagctgcgcgccaccatgctggaagccgccgaccacttgcggctgagcctgcgcgcccgcgtcggcggccgcgacgaattcggcgaagtggccgatgccttcaaccggctgatgtcggcgttcgaatccgcattgcagcggatacgcgcggtgggcgaacaggtgagcgaacgctcgcacgcggtggccgacgccgcgcgcgccatcgcccgcggcaccatggagcaaaaccaggcggcgcagcacaccaccaccgcggtggaggatgtctcggccagcgtgcagcgggtggcgcagaccgccagcgacagcaccgccttgtcgctgtccgtgcaaaccctgtccgaacagggcggccaggtgctgacggaaaacgcatccaacgccaacaccctgcacggcgccatccacaagaccgccgaactgacgcagagcctggcgcagcgctcgcagcagatcaacaacatcgtcagcgtgatccatgacatcgccgaacagaccaatctgttggcgctgaacgcggcgatcgaggcggcgcgcgccggcgagcaaggccgcggcttcgcggtcgtggctgacgaggtgcgcaagctggccgaacgcaccaccagcgccaccggcgagatcggcgccatgctgggcggcattcagagcgacgtggccagcgtggtcaaggacactcagatgtgttcggaattgatagaggagagccggcgcagctccgaacgggcgatggaggcgctgcagcagatacgcggcggcgccgagacctcggcgcggcagatcgccgagatcgcctccgccaccgtggaacaaggcgcggcgacagcggatatcgtgcaaaggatagagcacatcgcggcgatggccggcgagaacgacagctcggtgcaggcagcgtcggccgcggcagacagcctggcggcgctggtcagccagctggaagcggaaatcgaccgcttccgcgcgcgctga

SEQ ID NO: 2342 - DNA, 657 bp, Chromobacterium substugae
atggcttcatccaggcggcaatatatccatgcgctgcgcttttcggcattgaccgcgctttacgatccgctggtggcgcttaccgcccgggagaagcatttcaaaaacgcgttgctggacgccgcgcaactgcggcccggacaccgggtgctggatgtgggctgcggcaccggcacgctggcgatagcggccagcctgcgcgcgccgggcctgctggtgcaggggctggacggcgacgggcgcattctgcgcctggcgacggacaaggcggaacgggcgggcgccaggctggcctttcgccaaggcatgtcgttttccatgccctatctggacaacgccttcgaccgggtcttgtccagcctgtttttccaccatctggacaccgaggacaagcgccgcacgctggtggagatccaacgggtgatgaagccgcgcggcgagttatatgtcgccgattggggcgtgccgcaaaaccggctgatgcgcgcgttgttctatccggtgcagtggctggatggtttcgccactacccagggcaatgtcgaaggcgtgctgccccggctgatgggcgaaaccggttttgccggcgtgcggctggtccggcagattcccactctgctgggcaccctggcgatccacgccgccagcaagccctga

SEQ ID NO: 2343 - DNA, 2844 bp, Chromobacterium substugae
ttgaccacctttgaagggcaaaccgccgcagaactcggccgcgccgccgcgccgcaagccgatttcagcctgtacaagaccattcgccgcaatggcgcggtagtgccgttcgagcctgtcaaaatctccatcgcgatgaccaaggccttcctggccgtggttggccaacaaggcgccacctccgccagcatccgcgacaaggtggcccaactgaccgaacaggtggtcaatgcgctgatgcgccgcaagcccgaaggcggcgcgatccacatcgaagacatccaggaccaggtcgaactttcgctgatgcgcttcggcgagcacgatgtggcccgcgcctacgtgctgtaccgcgaacaacgctcgcaagaacgcgccgcgcgcggcgaggcgctcacccaggtgcagatcaacgtgctgcgcaaggatggccgcaaactgccgctggacgtggcccgcctgcgcggcaacatcgaagccgccagcaagaatctggccggcatcgacgtcgacgccatcctcggcgaaacgctgaagaacatctacgacggcgtgccggaagaggaagtgggcaagtccgccatcctggccgcccgctcgatgatcgagcaggacccggcctacgattacgtgaccgcccgcctgctgatgggcaacatccgcctggaaatcctgggcgaagccgtgggccaggacgaaatggccgcgcagtatccgcactatttcgccagcttcatcaagaagggcatcgccgccgagctgctggatgaaaagctggccgaatacgacctgaagaaactgggcgccgcgctggatgccgagcgcgacctgaaattcggctacctgggcctgcaaaccctgttcgaccgctacttcctacacatcgacggcacccgcatcgaaatgccgcaggccttctacatgcgcgtcgccatgggcctggcgctgaacgaagtgaaccgcgaagaccgcgccattgagttctacaacgtgctgtccagcttcgacttcatgtcgtccaccccgacgctgttcaactccggcacccgccgcagccagctgtccagctgctacctgaccaccatcgccgatgacctggacggcatctacgaaggcatcaaggaaaacgcgctgctgtccaaattcgccggcggcctgggcaacgactggaccccggtgcgcgcgatgggctcgcacatcaagggcaccaacggcaaatcgcaaggcgtggtgccgttcctgaaagtggtcaacgacaccgcggtggcggtgaaccagggcggcaagcgcaaaggcgcggtctgcgcctacctggaaacctggcacgccgatatcgaggaattcctcgaactgcgcaagaacaccggcgacgaccgccgccgcacccacgacatgaacaccgccaactggattccggacctgttcatgaagcgcgtgatggaaggcggcgagtggagcctgttctccccgtccgaaaccgccgacctgcacgacctgtacggccgcgccttcgaaaaggcctacaccgcctacgaagcccgcggcgagcgcggcgagctgaaagtctacaagcgcatcccggccctgagcctgtggcgcaagatgctgaccatgctgtttgaaaccggccatccgtgggtgaccttcaaggatccgtgcaacatccgcagcccgcagcagcacatgggcgtggtccacagctccaatctgtgcaccgaaatcaccctgaacaccaacgacgacgagatcgccgtttgcaatctgggctcggtcaacctggcggcgcacctgaaggccgacggcagcctggacggcgacaagctgcagcgcaccatccgcatcgcgctgcgcatgctggacaacgtcatcgacatcaacttctatccggtgaagaaggcgcgcaactccaatctgaagcaccgcccggtcggcatgggcgtgatgggcttccaggactgcctgcacatcaagcgcgtgccctatggctccaacgccgccgtcgaattcgccgatgaatcgatggaaatggtggcctactacgcctacctggcctccaccgagttggcggaagagcgcggccgctacccgtcgtacagcggcagcctgtgggaccgcggcgtgctgccgcacgacagcatcaacctgctggcggccgagcgcggcggctatctggaagtggaccgcaccgaacgcatggactggaacctgctgcgcgaccgcatcaagcagttcggcatgcgcaacagcaactgcctggccatcgcgccgaccgcgaccatcgccaacatcatcggcgtgtccgcatccatcgagccgacctaccagaacctgttcgtgaaatccaacctgtccggcgaattcaccgtcaccaacgaatacctggtgcgcgacctgaaagccgccggactgtgggatgaagtgatggtggccgacctgaaatacttcgacggcagcctgggccagatcgaccgcgtgccggccgagctgaaagccatctacgccaccgccttcgaactggatccgcgctggttggtggaagccgcttcgcgccgccagaagtggatcgaccaggcgcaatcgctgaacctgtacatggccggcgcgtcgggcaagaaactggacgagctgtacaagcacgcctggatcaagggcctgaaaaccacctactacctgcgcaccctggcagccaccagcgccgagaaatccaccggccgcggcggcgagctgaacgcggtgtccagcggcaacagccagcaggctccggccgccgaggtggacaacaccccggccaccgacgccaagttctgcagcatcgacaatccggactgcgaatcctgccagtaa

SEQ ID NO: 2344 - DNA, 8382 bp, Chromobacterium substugae
atgaaccatccgcaaccgtcccaaccgaccagcgcttcggaaaatcgcctcctcccgtcgcgccaaccagaacgcgtcgccatcatcggcgcagcttgccgcttccccggcgccaacagcctccaggcgctcagaaacctgctgctggaagaacgcgaagccgtggaccagatcgccatagaccgcggcgccatcgccgccgacggcgtgagccgggccggcctgatcgacccgccggatggtttcgacccgcctttcttcggcatcgcccagcgcgaagccaatcagatggacccgcagcaacgcctggtgatggagctggcggtggaagcgctggagtccgccggcatcccgcgcgccagcctggccggcagccgcaccggcgtctacatcggcatctccactttcgactacagccggctgcagatgaacgaaggccaggatctcgacctgtacgccggcaccggcaacgccttcagcatcgtcgccaaccgactgtcctacttcctcaacctggccggccccagcctggcggtggacaccgcctgctcgtcgtcgctgaccgccgcccacctcgccgtccgcgcgctgcgcgccggcgaaatcgacctcgccatcgtcggcggggtcaacctgctgctggcgcccgacctgatgaaagtgttcgccggcgccaagatgctgtcgcccgacggccgctgcaagactttcgacgccgccgccgacggctatgtgcgcggcgaaggcgccggcatcgtcatcctcaagcgcgccagccagctacagccggagagcgaacgcgcgttggcgctgatcgcaggcagcgcggtcaaccaggatggccgcaccaacggcctcaccgcccccagcggcccggcccaggtcggcgtgatccgcgacgcgctggctgacgccggactgctccccgccgatatcgacgcggtggagttgcacggcaccggcaccccgctgggcgacccgatcgaagcccaggcgctgggcgaggttttcgccgcggatcgcgaacaaccgctggcggtcggctcggtcaagaccaatatcggccacctggaggccgccgccggcatcgccggcctgctcaagggcgtgatcgccctgcgcgaggccaagctgcccagctcgctcaacttccgccaggcgaatccggacatcgacctagcgcggctgaagctcgccgtcgccagcgcgccggtcgcgctgccgtccgcgcgccgccccgcccgcatcggcgtcagcagcttcggcttcggcggcaccaatgcccacctgatactggagaccgccccggcgcaaccgccgcggacggcccatgccgacgatgccgccagctggctgctgccgctgagcgccgcctccgccgacgccctgcgcgcgcaagccgcccaatacgcggcgctgctggagcgatccggcggcgccgcgctggccgacatcgtccacaccgccgcgcgccaccgcgaccatatggaccaccggctggcggctcatggcgatcgcggccagttgatcgccgccctgcgcgccgcggccggcggccagacgcatcccggcttgtcgctgggccgccgcccggccgccggtgcccgcaagctggcgctgcatggcgctgcgccggaactgcgcgcagcgctcgcccaagccggcatcgccgcggacgccgaactggagagttcgtcgcccgaggcctggcaacagcagttgccgggccgctgggacatcctcgcgcccagccatggcgaagccgccgcgctgccggaaaggcttcggccgctggccgctcccgccgacgccatggccgcgctcggcctgctctacgcctacggccacgaactggactggcagcggatccagccggccggcgcgctggccgaactgcctgcctatccgtggcagcgccgccgctgctggtacggcgaccaaggcctggccgcgcgcgtcaccgaccgcccccgccatctgctcgctctggccgccgccagcgccgaagcgctgtccagccaagccgcgcaagcgctgcaagactgcgcccaactgccgcccgacgccttggccgacttctgccatgccgccaacgccggtttggccaagcagccctggcgcgccagcgtcggcgccgccgactccgaagaattgcgccgcggcctgcagcaactggcctcccggccccagcccgcgcccgcgccggccgccgagcccggcgtggtgttcctgctgaccggccagggcagcgcgctggccggcgccggcgccgaactctatgccagccatccccgcttccgcgacgccatcgaacactgctcctccctgctcaagccggtgcttgacgtttccttgtcgcggctgctgttcgaccgcgtccgcggcgacgcgctgctgcagaacacctgctacgcgcagcccgcctgggtggcgctcagctggtcgctggcccagctgtgggccgactggggcgtgcgcccggcggcgctgctgggccacagcctgggcgaatacaccgccgcggcgctgtccggcatggcatcgatagaacagatcctgccgctggtggcggcgcgcggcgcgctgatgcaggaaaccgccggcgcggccggcatggtcgcggtgaaggcttcggcggagcaactgcgcgagctggtcgccccccatgccggcagcctggcgttggccgccgacaacggccccgccagctgcgtgctgtcgggcgcgtccgacgcgctggccgaggcgctgaaggcgctggacgcccaaggcatacgctggcgcacgctggacgtctccaccgccttccattcccctctgctggacccggtgctggagcggatggccgcgctggccgcgccgatagactggcagcccggcacggtgccggtgatttccaacctcaacggcctggcgcacgcggcagcgcccgacgccgcctactgggcggcgcatgcccgcggcaccgtgcagttccgccagggcgtgcaaaccctgctggcgcaaggccacaggctgttcctggagctgggcccgcggccgacgctgagcgcgctgggccgcgccgccagcggcgagctggccgtcaactggctcagttcgctcgacggcgccggcaacgattggcaagccatgctcgacagcgcgggcgcgctgcacaacgccggcgtcaaccttgactggagccgcttcgaccagccctaccgccgacgcgccctgccggcccccgccgcccgatcctccattccatcttcgctggagccatccatgccacaagtcaacagctctctggatccccgatccaatccgtcgacctccgacgaccacgtgcggcaagtccgcgccgacctggtgcggcaaatcgccaaggcgctgggagagtcggaggccgacctgcaaaccgaccgcctgttcatcgaaatgggcgccgactccgtgatgctggccgaggcgatgcgcggcatccaggccagctacggcgtcaagatcagcgcccgccagctgctgaacgaactgaacaccatagaccgcctcagcgtgcacctggccgagcaaaccgcgccgcaggccgccccggcggcggccgcgcctgcgccggccatcgcgctgccggcccacgccgcggcgggcgacatgaacgcgctgttccagcaacagctgaacctggtgcagcaggtgatccacagccaattggccgcgctgggcggcgcgccgcaagccgcgccggcgccgattcgcccggtggccgcggccatcgccgccctgccggccgcgcccagcagcatcccggcggcaaaagccgcgccggcccgcgccgccggctccgcccagtcccagcagcaggccgcccactttgccgccttttcccaggcctacatcgcccgcaccgccacctccaagcgcctggccgacgaacgccggcagcggctggccgacgtgcgcgcctccgccggcttccgccccacattgaaggaaatcgtctacccgctcaccggcaaccgcgccgacggcgcccgggtctgggacgtggacggcaatgagtacatcgatatctcgatggacttcggcgtcaacatcttcggccatggcgcgcctttcctgaaagcggcgctgcacgagcaagccgaaaacagcctggcgctcggcacccgctccaccctcgccggcgaagtgtccaccatgctgtgcgaaatgaccggcatggaccgggtcctgttctgccagtcgggcagcgaatcgctgatgacggcgctgcggctggcgcgcctgttgcgcgaccgctcgcgggtggcggtgttccgcaagtcctaccacggccacttcgacggcctgttgggagaccgctccgccatcggcgacgccaccgagccggtggcgcccggcatcctccccaacttcgtcgccgacctgctgatgctggactactgcgacgacgccgcgttgcaggcgattgaagccaacgccgatcaactggccgccgtgctggtggagccgatccaaagccgcgtgctggacgcccagccgcgcgaattcctgcacaagctgcgcgaagtcacccgccgccacggcatcctgctgattttcgacgaaatgatcaccggcttccgctgcgcccccggcggcgcgcaggaagtgttcggcgtggaggccgacctggtcacctacggcaagaccataggcggcggcgtgccgatggcggcgctggcggcgcgcggctcgctgctggacggcatagacggcggcatctggcgcttcggcgacgactccgcacccgacgccggcaccaccttcttcgccggcaccttcaacaaccacccgctgggcctggcgatggcgcacgcggtgctgaaggagctgaaacagcgcggcccggccttccagcagtcgctgaccgaacgcacccggcagctgaccgaacgcctcaaccagtacttccaggccgagaagctgccgctgtcgatgatccacttcggctcggtgttccgcttcaagcacgccggcaatctggacctgttctactaccatctgctgcaccgcggcctgttcgtctgggaaggccgcaactgcttcctgtgcgacgcgcacggccaacaggagatcgacttcatcgtcgacagcgtgatcgattccgtcgaagccctgcgcgcaggcggctacctgccggcgcgcccggccggcaccggcctcgccgccggcgaagcgccgctgtccgacacccagcgccagatctggctggcttcgcagctggacgcctccggcgccgccgcttattgcgaaaccgtcgcgctggagctgggcggccgcatcgaagccgccgcgctccaacgcgccctggccgagctgtcggcccggcacgaggcgctgcgcaccaccgtgcacggcgacaagggcatccagcgcgtccacgccgaactggccatcccgctgacgctgggcgaaggcggcgacggcgccgactggctgcgcgcgttctccgccacgcccttcgcgctggaaagcgccggcccgctgcaagccggcctgttccagcttgccgacggcaagccggtattggcgctgcgcgcccaccacatcctgatagacggctggtcgctggcgctgattctggaagagctgggcgcgctgctggacccggccggccgcgccgcgctggaagcggcgcagccgttccgccgccagctggaatggctgctgtcggcgcgcgacgagcaggccgaagccttctggagccaacgcctggccgacgcgccggaagccttgccgctgccgcgcgccaacgccggcgacgatggccagcaggcccgctggcagggcgagcggctgcggctgccggtgccggccggcaccgccgacgcgctgacccagctggccgtgcggcagaaggccacgctgttcaccacaacgctcagcctgacgctggcgctgttccacaccctgttcgaccgcgacgacatcctgctgggggtgccgacccacggccgcctcgacggtctggagcgcatggtgggccaggcggcccagatcatgccgttgcgctcgcgcctcgcgcccggcgcgcgcttcgagcaactgctggaaacggtggactttgaactggaggcgatgtccgaccaccaggcctacccgctggcgcgcctgctggagccggtgctggccggcggcgagcgcccgggcgcgctgaccgtcaccttcaacctcgaccgcgtgcgccagagcgatttcgccggcctgccggtcaccttgctggacgcgccggtgtccggcgtcaagttcgacctggcgatcaacctgatgcagacgcccaagggctggctgctggacctggactaccagagccgccgctaccgccgcgaagacatccagcggctggccgagcgctggctggactgggccgcgcgcgtcgccgccgacccggccgtcgaactggagcgcgccaacccgctgccggccgccgagctgcagcaggtgctgcgcggcttcaacgccaccgccaacggcaaaaccgcgctgccggtgccgcaacgcatcgcccgccaggcggcgctgacgcccgacgccatcgccatcaccgccgacggccgccatatcgactaccgcacgctggacctggcggcgcgcaccatcgccagcgaattggtcaaccacggcgccggcccggagaagatcgtggcggtgatgctgccgcgctcggccgaactggtggcctccctgctgggcatcttctacaccggcgccgcctacatgccgatagacccggacgaaccggcgctgcgccgcgaggaaatcttcgccgagacccagcccatcgcgctggtgaccgatgccgccatcgcctcgcgcctggcggtggactgcccggccatcatcgtcgaatcgccggaagagctggccgccggctggcccagcaccgccgatgcctgggtcaacccggcacccgtcgaagccggcgacctggcttacgtgatctacacctccggctccaccaacaagcccaagggcgtgctatgcacccatggcggcctggccaacctgatggagtggaccaccgagcgcttcccgctcgacgccgccgacgcggtgctgcaaaaagcgccgtacaccttcgacatctcgctgtgggagctgtgctggccgctgctgaccggcgcccgcctggtggtggcgccgccggaaacccaccgcgatccggactacctggcccggctgatcgccgctgaacgcgtcaccgccgcgcaattcgtgccggcgatgctggaagccttcgccgccaccccggccgcgcgcgaatgccgctcgctgcgccacctgttcgccggcggcgaggcgctgctgccttcgcaatgcatcgcggtgcgcgaactgggcttgccgggcctggagctgcacaacctgtacggccccaccgaagccaccatcctggtcacccattacacgctgcgcgccggcggccgcggcgcggtgcccatcggctacccgatcgccaacacttcgctgcgcatcgtcgacagccgcggccgcccggtcggcgtcggcatcgagggcgatctgctgatcggcggcgtccagctggcgcgcggctacctgaaccgtccggagcagaacgccgccgccttcatcgaaaccgtagccgacgacggcgcgccgctgcggctctatcgctccggcgaccgcgcccgctggctggacgacggcgccgtcgaatacctgggccgcgtcgacaaccaggtcaagctgcgcggcctgcgcatcgagatcggcgagatcgagcacgcgctgcgcgcccacccggccatccaggaagcggtggtggacctgcgcggcgacagcgccgccacccagcggctgctggcctggatcgtgccgcgccagcaggcagaagccctgccggccggcgactggcagcaggcgctgcgcgaatacctggcgcaaaggctgccgatctacatgatcccggcgcaattcgccgcgctggccgcgctgccgctgagccgccacggcaagatcgaccgcggcgcgctgatcgagccgcgccccgacgccggcgccgtccaggcgccgcgcaacccggtggaagccgagctgctcgactacgcgcggcagaacctcgcgctggaaatggccggcgtggaggacaacttcttcgtcgccggcgggcaatcgctggccgccgcgcaactggtcacctgggcgcagcagcgcttcggcgcgcgcctggcgctgaaggacttcctgctgaagccgacgctggcgcagctggcgctgctgatcagccaggctgggccggcctccgctgacgacgaaggcggcttgcgcagccgcgaacgccgccgcgtgcgccgcgatcagatcgaaaacgaaaccctgggcggcgccgacaaatga

SEQ ID NO: 2345 - DNA, 10566 bp, Chromobacterium substugae
atgcaagacaacagcatggctcacgaagttttcctgtgcgacgcgtcggcggcgcaacaacgcttgtggctggtatgcggcctggagggcgaacgcagcaactacaccatcgccggcgcgctgcgcctgtccggcccgatgcggcccgaggcgctgcagcaggcgctggacgactgcctggtgcggcacgaaaccctgcgcaccggcttcgtcgacgtcgacggcgtgccgatgcaggcgatcgaacccgccgcctcgctgccgctggcgcgcgtcgatctgggcgcgctgcccagagaagaagcgctgcgccaggccatggacgccgccgccgagctggcgcgccgccccttcgcgctggaaaagccgccgctgctgcgcgcggcgctgttccgcctggccgacgacgactggctgctggcgctggccatccaccacatcgtctgcgacggcccgtcgctgggcctgctgatgcaggacctggcccgcgcctacgcccatcggcaagacccggcccagccggcgctggccgagctgccgctgcagttcgccgacttcgccgaatggcagcaggagcagctggccagtccagccagcgaggcgctgctggcggcctgggaagcgcggctggccggcgtgcccgatctgcagccgccaaccgacttcccccgccccgcgctgcgcgaggccaggggcgcgcgccatgaggcccatctgcccgccgccgtccgcgacgcgatggccgcgcttgcgcgcgagctggaaaccacgccgttcgccgtgctgctcgccgcttggggcatgaccctggccggctggagcggccaggacgatttcgccatcggcagcccggtcagcgcgcgcaacgaccccgcgctggccgaagtggtgggcatgttcgccgaaacctcggcgctgcgcttcaagctggagggcgaccccagcgtcgaccaggttctgctctccatgcgcgacgtctggcgcgattcgctggccttctccggcgcgcctttcgaccgcctggtgcagcgcctgcgccggccgcaggaccgcagccgcacgccgctgatccagaccatgttctcgctgaacccgccggcgctgccgctggacatggccggcctgcaagccgaaacgctatcgttgccggacggcgacgccaaggccgacctgtcgctggaagtcgacgaaaccggcgatggctacgcgctgacgctggactacgacggcgcgctgttccgcgccgaaaccatcgcctggctggccgagcgttacgccgccctgctggcgcaactgcccgccgcccgcgcccagcccttgcgcgccctgctcgccgccgcgccggcccagcgcctggccagcgacgccgagcgcgaacagctggaccgtttcaacgacaccgcgctcgcgttgcccggcgcgccgctcctgcatgcccagctggcccgccaggccgcgcaaacgccggccgcgccggcgctgtggcatgacggcaggcaaatggacttcgccgagctcaaccgccgcgccaaccggctggcgcatcatctgcgcgcgctgggcgtgatgcccgacagccgcgtggcgctgcatttcgagcgcggcttcgaccagctgatcgcgctgtgggcggtgctgaaggccggcggcgcctacgtgccgctcgacccggtctacccgcaggagcggctggaattcatgctcgccgacagcggcgcgcagatcgtgctgaccgaaagcgagctggcgccgcgcctggccggcgccgccgcgcgcgttctggcgctggattcggccgagctcgccgccgcgctggcgcagctgccggacagcgacccggacgacgccgagatcggcctgcgccccgaccacctcgcctacgtgctctacacctccggctctaccggccggcccaagggcgtgatggtggaacaccgctcgctgctcaatctgcaggcggcgttgcagccgctgctggccgcactgccgccgggcagccgccacagcctgaacgccccgatatcgttcgacgcctcgctggagccgctgctgcagctgctgagcggccactgcctgtacatcatccccaacgagctgcgcgccgacgcgccggcgctgctggccttcatccgcgaacaccggctggacgcgctggactgcacgccggcgatcatggagccgctgctggccgccggcttcggcgacggcggccacgtgccgcgctgcgtgctgatcggcggcgaagccatttccgagcacacctggaaccggctgcgcgccatcgacgattgcttcatctacaacacctacggcccgaccgagtgcacggtggactccacctactgcgaattgcacgaggccggcgacatgccgcacatcggccggccgatggccaacacccgcgtctacctgctggacgaggcaggccgcctgctggcgccgggcgaagtcggcgaactctatatcgccggcgattgcgtgacccgcggctatctgaaccggcccgagctgaacgccgaacgcttcctggccgaccccttccgcccgggcgagcgcatgtaccgcagcggcgacctgggccgctggctgcccgacggctcgctgcaatatctgggccgcaacgacctgcaagtgaagatccgcggccagcggctggagctgggcgagatagaagcccagctgtgccgctgcgacggcgtgcgcgacgcggtggtggtcgtgcgcgaggacaccccgggcgacaagcgcctggtggcttacctggtgccggcggccggcgccgcccccaccgccgcgcaactgcgcgaagagctggcgcgcaccttggctgaagtgatgctgcccagcgccttcgtcaccctggacgcgctgccgatgacgcccaacggcaaggtggaccgccgcgcgctgccggcggtcggccagcaagacctggcgctgcaggcctacgaagcgccgcagggcgagattgaaaccgccatcgcagaattgtggcaggagctgttcgccatcgaccgggtgggccgccacgacgatttcttcgcactgggcggccactcgctgctggccacccgcgtcgcctcgcggctgggcaagcgcttcggcatccgcctgccgatgaccacgctgttcgattcgccggcgctgcgcgcgctggccgcccgcatcgaagcggcgcaggcctcgctgcgcgcgccggccgagacgccggccgccgcgccggtcgacgccgcagccggcgcgccgctgtcggctgcgcaaaccggcatgtggttcattcaccaattggcgcccgccaacaccgcctacgtgctgtccggcgccatccgcatcgacggcccgctgcagcccgaattgctgcggcgcacgctggacatcctgctgcagcgccatgaaatcctgcgcagccgcttcgaccagatcgacggcgaaccgcgccagtttgcccagccggccgcgccgctggccttgccgctggaagacctgagccaactggacgaggacgcccgccagcggatgctgcgcgcccggctggaggccgaggcccgcacgccgttcgacctgacccaggcgccgctgctgcgcgcgcggctgttcgcgctggcgccgcaaagccacgcgctcagcctgtcgctgcaccacatcgtcgccgacggctggtccatcggcatcctgtggcgcgagctggcgcagatctacgccgctctggccgccggccgggctccggacctgcccgccgcgcccagctacgccgactacgcccgcgccgaggccgcccgcctgcgcgacgagcaaagccaggacgatctcgcttactggcgccaggcgctggccgacgtgccggcgctggagctgccgctggaccacgcccgtccgccgcaaaccgacaacgccgccgccgaataccgcttcaccctgccggccgcgctgcgcgcccagatggacaagctggcgcaacaggccggcgccagccgcttcatggtgatgctggcggcgttccagatgctgctggcgcgctggagcggccagcgcgacttcgccgtcggcgtgccggtgtccggccgcgacggcctcgacgtgcacgacacggtcggctgcttcgtcaacacgctggcgctgcgcgccgacctgtccggcgactgcggcttcctgtcgctgctggagcgcgtcaaggcgagcagcctggcggcgttcgcccaccagggcctgccgttcaagcgcctggtggacgagctgcgcccggcccacgacgccgaccgcacgccgttgttccaggtgctgttcaactaccagcacaccgaccacggccgccacgcggtggaaggcctgcaaatggagacgctggcggtggacgccggcgccgcccagttcgaactggggctgtatgtggaggacgacgggaccgacatcgtcgccagcctggtgtaccggaccgacctgttcgcgccgcgccacatcgcccgcatgggcgcggcgctgcagatgctgctggaggccggcgccgacccggcgcgctcgctgtggctcgcgcccatcgtcaacgaccacgaccgcgagctgatggcggcctggaaccacaccgacgtcgacttcggccccgccgtccacatcgacaccctgatcgccgaacaggcgcggcgcaccccgcatgcctgcgcggtagaagccgaggacggcgcgctggactacgccgcgctgatggcgcgcgccgacgcgctggccgtccgcctgcgccggctgggcgccggccccggcaagctggtggcggtgcatctgccgcgcggccaggacctgccgatggcgctggtcggcatcctgcgcagcggcgccggctacctgccgctcgaccccgacctgccgcatgagcgcctgtcctacatcgtcgaagacgccgcgccggtcgccatcgtcgcctatccgggcagcaccggctggctgagcgccccgctgccggaggtcgtcccggtggacgaggccgggcctgaaaccgaagcgctgccggcaatcgcgcgcagcgtcgacgacctggcctacgtgatctacacctctggctccaccggcaagcccaagggcgtgctggtgccgcacgtcggcgtggtcaaccgcctgctgtggggccagtcggccttcggcctggcggccggcgacaaggtgctgcagaaaaccagcgccagcttcgacgtgtcggtatgggaattcttctggccgctggccaacggcgccacgctggtgatggcccgccagggcggccagcgcgaccacgaatacctgagcgcgctgatcgagaaaagcggcatcacccacatgcatttcgtgccgtcgatgctggccatcttcctggccgaggtcgacgccgcgcgctgcgcctcgctgcgccaggtgttcaccagcggcgaaacgctgccgccgcagttgcgcgatcgtttccacgactggacccgccacgcccggctgttcaatatgtacggccccaccgaaacctgcatcgagatgaccatgtggccgtgcgcgccgatcgagcgcggccagccgctgcccatcggccgcccgatcgccaacagccgcgtccacatcctcgacgaaaacggcatggagatgccggtgggcgtgcccggcgaaatctgcatcgccggcgtccaggtggcgcacggctacctgaaccggcctgaactgagcgccgagcgcttcctgcccgacacgctggaccaccgcccgggcggcctgctctaccgcagcggcgacatcggccgctggtgcgacggcggctggatcgaatacgtcggccgccgcgacaaccagatcaagctgcgcggcttccgcatcgagctgggcgagatcgaatcggtgctgcgccagcatccgggcgtcagcgacgccaccgtgctggtggccggcgccgacgccgaatcgcagcgcctggtcgccttcctgctggcgccggacggcggcatcgacgtggccgcgctgcgccgcgagatcgcctcccgcctgccggaaatcatgatcccgtcaaccatcctgccgctgcccggcttcccgctcaccagcagcggcaagaccgaccgccgcgccctgctggcccagctggcgcaagcggcggcccccgccgccggccatagcccgctgggcgaggtggagcgccagctggcagcgatctggtgcgaagtgctgggtctcgcctccatcgacacccgcgccaacttcttcgaagccggcggcaattcgctgctgatgatcaaggtgcattcgcggctgaaggccttgtaccagccggccccggcgctggtggatctgctgcgccacccgaccatcgccgcgctggccgcccacctggcccccggcggccaggaccaggccgcgccgctggccgccgcgccgcgccgcgccgaaggcgacgacgccatcgccatcatcggcatggccggccgcttcccgggcgcagacagcgtcgaggcgctgtgggacaacctgctggccggccgcagcggcgtgcgcgagatcagccgcgaggaagccctgaccgacggcgccgacccggcgctgctggaccatcccggctacgtgcccttctccggcgtgctggaaggcatagaccagttcgacgaaaagctgttcggctacagcccggccgacgccgcgctgatcgacccgcaaggccggctgctgctggaaaccgcctgggaggcgctggaaagcgccggcctcgacccggcgcgcgccggcggccgcatcggcatgttcgccggcggctcggtcagcacttacgcgctgggcgcgctgaaaaacctcacgctggccgatagcgagctgctgcgcgcgctgttctccaacgacaaggactacctggccagccgcgccgcctacaagctgggcctgaccggcccggccatcggcgtgcagaccgcctgctccacctcgctggtggcggtatcgctggcgatacgctctgtgctgtccggcgaatgcgacgccgcgctggccggcggcatctcggtggccgtgccgcaacgggtgggctacctgtacgaggaaggctccatcctgtcgccggacggccgctgccgcgccttcgacaacgccgccgccggcaccgtgcccggcaacggcgccggcctggtggtgctcaagcgcctgtcgcgcgcgctggccgacggcgaccccatccgcgcggtgatccgcggcatcgccatcaacaacgacggcgacgacaaggtgggcttctccgcgccgtccatcgccggccaggaaaacgtgctgcgcgccgcgctgcagaacgccggcctgcgcggcgaggacatcggctacgtcgaaacccacggcaccggcacccgcctgggcgaccaggtggagctgagcgccctcaacgctgcgctgggcaaggacggcggcgcctgcctgataggctcgctcaagtccggcatcggccacctcgacgccgccgccggcgtcgccggcctgatcaaggcggcgctgaccgtggagcgcggcgtcatcccggccagcctgcatgtcgaacaaccgaacgcgctgctggccgaaaccgccagccgcttccaggtggccaccgccgcccaggactggcagccggacggccgtccgcgccgcgccggcgtcagctccttcggcattggcggcaccaacgcccactgcatcgtcgagcagccgccgcgcaccgaggcggcggcgatccagaccagcgcgcagctcctcacgctgtccgccaacgacggcgccagcctggcgcgcctgagcgagcgcttgcaaaccgcgctggcgcagcctggcgccgatctggcggccatcgcctggacgctgcagaccggccgccgcgaactgccgtggcgcttggcggtagcggcaagcgacgccgcctccgccgccgaggcgctggccgccgcgacgccgccgcgcgacgccgccgccgcgccggagctgtggttcgccttccccggccagggcagccagcgtgcggcgatgggcgcgggcctgttcgccgaagagccgctgttccgccagacggtggaaacctgcctcgcgctgctggaccgcgaactggccgccaccctgcgcgcggcggtgttctcgccgcagccgccggccgacgccgacgcgctgctggcccgcaccgacatcgcccagccggcgctgttcatcatggaatacgcgctggccacgctgctgcaggcctggggcctgcgccccagcgcgctggtcggccacagcctgggcgaaatcagcgccgccgcgctggccggcatgctgcaactgggcgacgcgctgcggctggtggcgctgcgcggccggctgatgcacgacagcccggccggcggcatgctgcaggtggcgctgtccgccgacgcgctgcgggcgatgctgccggcggagctggccatcgccgcctgcaacgcgccggagctgaccgtggtcgccggaccggcagacgcggtggaccgtttcgccgacgcgctacgcgggcaaggcatcgaccatcagcgcctggacaccggctacgccttccactcgcagttgatggaccaagccgcggcggaattctcccgccagctggacaacctgcagaccgccgctcccagccagcccatcctcaccaacctgagcggcggctggctgagcgccgaagacgcgctggacgccggccgctgggcgcggcagatccgccagccggtgctgttcgcccaggcgctggaacaggcgcggctgcgcggcgcgctggtgctggaggtcggccctggccgcaccttggccgccttcgcccgccaggccggcgtcgccgccgtcgccgcgctgccgcaagccggcgccgaaaacggccgccgcgcgctcttggccgccgtcggccagctgtggcaggccggttgcgcgccggactggcgcgcgctgcagcatgacgcgccgccgcgccgcgtgccgctgcctacctatccgttcaaccgcaaacgccactggctggcgcaaaacgccgccgcgccggttcaaggccgcagcggcgcgcacctggcgctgctggactggcgctacgccgaagcgccggagctgcggccgctgcgccgcgccgccatcctcggcggcgatgccgcgctggccggcgcgctggcggaaaagctgcgcgcccgcggcgtggaagcccattgctggcgcgagctgcccgcgcagcgcgacatagagcttctggtggcgctgacgcccgatttcgacgcgctggcgcggctggccgggcagctggccagccaaccggcccgcctgctggtggtcacccgcaacgcgcagctggacgacgaaaacgccgacgccgacgccgcgatgaccgccgccgccgcgctggcaatcggccaggagctgcccgaactgtcgctgcgccaggtagacctggccggcggcgatccggcgcggcggccgcgccaattggccgcgctggccgatgaatgcctggcctccggtcccgcggtgctggtgctgagcgacggccgccgccgcgcgcccagcctctgcccgctggatgttccggccgccactgcggctcaggcgggcgccgtcacgctgatcaccggcggcttcggcaatgtcggcatggccttcgcccgccgcctggccggcgccggcgccgccaaactcgcgctgctgggccggcgcatcccggccgacgacgatccgcgcctgctggaattgcgcgcgctgggcgccgaggtgctgccgctggccggcgacatcgccgaacccggcgtcgcccgccaggcggtggaagccgcgctggcgcgcttcggccggcttgacgcggtcatccacgccgccggcatcgccggcgacgccgcccaccgcccgatcctggaaaccgacgccgcggaaagcgccgccatctgggccgccaagcgcgacggcagcctccatctggccgaggcgctgcaaggcctgccgctggaccacgtgctgctgtgctcgtcgctgtccaccgtgctgggcggcctgggcttcgccgcctacgccgccggcaaccgctggctggaagtgttcgccgaacggcaaagccgcagcggcgacacccgctggctggcgctggccttcgacggctggcgcttcgacgagccggccggcaaggatgcggcgctgagcgcagcgcaaggcgtggcgctggccgaacaagccatcgccgccggactgagcggacgggtgctggccagcgccggccagctgcaggagcggctggcgcgctggacccagggcggcggcgaaaccgacgcggctcccgccgcgccggtggacatcgccggctacgccaatcccgccgaggccatcgtcgcgcagaccctggccgagaccctggccctgcccgccatcggcccggacgacaatttctttgaactgggcggcgacagcctggtcgccacccgcgtcatcgccaagctgcgcggcgccaccggactgccgctgtcggtcggtctggtgctgcaggcgccgaccgtgcggctgctggccgccgccatcgccgcgctgcaaggcggtgccgcagccgtcgccgacgacgcggaagaatacgaggagggagcactatga

SEQ ID NO: 2346 - DNA, 7065 bp, Chromobacterium substugae
atgagcgccgaagcgatacgcctgctggccgaactgaacaccctgggcatcagcgtctgggcggagcaaggccaattgcgctttcgcgcccccaaaggccggttgaccgaaccgctgaaagccgaactggcggcgcgccgcgacgccttgctggcgctgctggacaaggacgcggcggcggaaaccgccatcgtccgccgcgacatgccagccggccagccggtgccgctgtcgccgcagcagcactcggtgtggatggccgaacaaaacggcggcggccacgccttcctgattcccggcgccctcagcctgcgcggcgcgctggacgtggatgcgctgcgcgccgcgctgcaggcgctggtgaaccgccacgaggcgctgcgctgcgcgatcaggctggtggacgacgtcccgatgcaggtggcgttgccggacgtgcgcttcgagctgccgctgaccgacctgtccgcgcaaggccaggccggccgcgaagccagcgttgcggcgcagctggccgccgaagccgagcaggccttcgatctggctacgccgccgctgctgcgcgcccgtctgctgcgcctggcggccgacaaccatgtgctgatcctgacgccgcaccacatcatgtccgacggctggagcatagacatcatggtgcgggagctgagccggctctaccgtccggactccgcccccgccgacctgggcccggttccgctcggctatcccgacttcgcgctgtggcaggacgcgcgccgcagccagggcggcgaccgcgccgatctggactactggcgccgcgcgctggccgacctgccggcgccgcttgagctgcccagtgaccgcgcggctgcgcccgatgtcgatttcgccggcgccgagctgcacgccgaactgccggccgccaccgccaacggcctgcgccagctggccaagcagagcggcaccacgctgttcagcgcgctggccgccgccttcgccgcgctgctgcaccgctacaccggcgaaaccgacctgaccctgggcaccgccatcgccggccgcagccgcgccgagctgcaagacgtgatcggcctgttcgccggccgcctgccgctgcggctggatctggacggcaatccctccttcctgcagttgctgcggcgcgtggccggcgccgcagccgaagccttctcccacgccgaggtgccggccgaacgcatcctggccgaagccgtggcgcccgatgcccggccggcgctgttccaggtgatgatcgcgctgcagaacgcggtgaaaaaccggctggacttcatcggcctggaagtccagccgctgccgatcgccggccataccgccaagttcgagctgttcctggcagtggacgaagccgacgaccgcctggcgctggcgctggagtacagcaccgcccgcttcgaccagccggccatgcggcaattgctgaatcacctggtgcgcctggccgccgccgcggtggcggcgccggagctgccgctgtccgaactggccatgctggacgcggacgagcgccgggctctgctggccccgccgcgcagtcctaaggcctgggacggtgccggcgatctctggcggcgcttcctgcaggcggccgacgcccatcccgagcgccccgccctgacgctgcccgcgcaatggcagcacgccggccccgacactgggctcagctacggcgcgctgcgcgaccgggcgcaagcgttggccggcagcctgcgccgcgccggcgtccgtccgggtgaaatcgtcgcgctggccggcgatcgctccggcgacttcatcgtcggcatgctggccatcctggccgccggcggcggctacatgccgctggcgcccgacctgccgccgtcccgcgtccaggaaatgctggaagattccggcgcggcgcgcctggtgttcagcgacgacgccggcgccgcgctggccggcagcttcgccgcggccttcgacgcccgcgccgccgcgaatggcgatgatggcgccgaactgcccgccatagaccccgcctcgcccgcctacgtgatgttcacctctggctccaccggccgccccaagggcgtggtggtcagccacgccaacgcgctgcatttcgtcgccaacatgccgaccacgccgggcagcggccgcgaagttttcctgcagttcgcgccgtccggcttcgacgcgtcggtgatcgagatctggagcgcgctgttgatcggcgcccggctggtgatcgccccgcccggcctgcccagcctggacgcgctggctgaattgatcgagagccggggcgtcaatgtctgctggctgaccgccggcctgttccaccagatgtgcgaggcccatccggcggcgctgtcgcggctggactacctgctgagcggcggcgacaggctgtcggtggccgcggcgcgcgcggtgctggcgcaaaacggcccggcgcgggtatacaacgcctacggcccgaccgaaaccacggtcttcgccaccctccaccgcatcctgccggccgatgtcggccccgacgcccgctcggtgccgctgggcggcgcccacggcgacgccaggctctacatcctggacagccggcgcgagccggtgccggccggcgccgccggcgagctgtacatcggcggggccggcgtctccgccggctacatcaatcgcccggacctcaccgccgaacgcttcctccccgatccgttcaacgccgcgcccggcgcccgcatgtaccgcagcggcgacctggtgcgccggcgcgccgacggtttgctggaattcatgggccgggccgaccgccaggtgaagatccgcggcttccgcatcgagcccgcggaaatcgaagcgcatctgcaggagcacccggccatctcgcaagcggcggtggagccgcaaaagcaaggcggcatccagcgcctagtggcctacgtggtggcgtccgcgccgctgagcctggacgatatccgcgatttcctggccgaacgcctgcctgaacacatgatccccggcgcgctggtggcgctggacgcgctgccgctgacccgcaacggcaagctggaccgccgcgcgctgccgcagcctgccgtggaaagctcggccggccaggagccggccagcgccgaagcgcgcctgctggcggcgatctggcgcgatgtgctgcaggcggagcgcatcggcctggacgacaacttctacgagctgggcggcgactccatcatggcgatgcaggtggcgatgcgcctgacccggcaagagtgggaactgcggccgcaggacatgctgcgccatcccaccttgcgcgcgcaaagccgcctgctgcgccgcaaggcgaaaaccctggcccggcgcgagttctcgcagccgctgccgctcacgccgatccagaactggttcttccagctgccgctcgccaaccgcaaccactggaaccaggcgctgcggttggcgctggagccggccgcggccgagcgcctggaaaccgcgctggccgcgctggagcaaacccacgacgcgttgcgcctgcgcttcagccccgatgccggcggctggcgccaactgcccgcggccgccgccagcccgcgcttgcgccgcgagcgggtcgccggcgaggaacaggccggcgaacgcatcgccgccgcccagcgcagcctggacatcgagcatggcccggtatggaccgcgctgctgctggagggcctgggcgactggccgcagctggtgctgatcgcccaccacctggtggtggacggcgtgtcctggcgcatcctgctggaagacctggcgctggcgctgcaaggccgcgcgctgacgccgccggcgctgggcctgtgcgactgggccgcccacctggcggaacagccggacgccgagccggacgccgagccggccgccgccgaaaccgctcccgccctgccgccattggaccatccgcaaggcggcaatctggaatcgcaaaccgccatcgccagcctgctgctgccgccggatgccgctacccagttgctggggccggccaacgcgccctaccgcaccgagccgaccgagctgctgctggccgccatcatgctgggcctgcgcgacgccttcggccgcgacgcgctgacggtggcgctggagcggcacggccgcgaggcggacggcatcgacctgtccggcacagtcggctggttcaccgccatcgccgcggtgcggctggatctcgccgcggcgcaaacgccgggccaggccttgctggcagtcaagcaggcggcgcgcaccgcgccgcgccggatgcgcaatggcgacggccgcgcgccggcggtggcgttcaactacctcgggcgcttcgacaacaccctgccgccgggcggcccgttccggccgctggacgccgacagcggcgtctgcaccgatcccgccggcgcgcgtccctacgcgctggaaatcgtcgccagcgtcgacgccgacggcctgcgggtggacttccgccacagcgccgaacagttcgagcgcgccaccatcgccgcctgggtggacgccgcccgcgccaatctgctggccctggccgcgctggccgacgccgaaaccgccggcggccgcgccccctgcgacttcccgctgtccggcatagccagccagcgcgagctggacgatctgctggccgagcaccagctggcggcgccggcgctggacgacctgctgcccgtcagcgcccagcagcgcggcatgctgctggaaaatctggcccaccccggccgcggcatgcacgtcgagcaattcgtcgccaccttcgccggcccgctggagccggcggcgctagaagcggcgtggagcggcctgatcgcccgccacgaaacgctgcgcagcggcttcatctggcgccatgacggcgaaccgctgcgcgtggtgcatcgccaggccgccgccggctggcagcacctggactggcgcgccgacgccggcgcggaaagccggataggcgactggctggcggtcgacgccgccgccggcttcgccggcagcgccgcgccgctgcgtttcgccaccatgcgcctggacgacgagcgctggctgttcgtctggacctatcaccacgcgctgctggacggctggagcgtggcgcggctgctggccgaagtgctggagccggccagcggcaaggccgcccccgccagcgcgcgcgaccacgcccgctggctggccagccgcgaccgcgaggccgcggcggccttctggcggcgctacctggccgacgccgccacccccagcctgcccggccgccgcgatgccgaactggagccgggcgaaggctatgccgacctgcgccagaccctggacgccacccgcgccgaaaagctggaaaccctggcgcgccgccgccgcatcaccccggcgatgctggcccagggcgcctgggcgctgacgctggcctgggcctccggccaggacgatgtggtgttcgcctccaccgtgtccggccgccccaccgaaatagaaggcagcgaggcctgggtgggcctgttcatcaacagcctgccgctgcggctgacggtgcccgccgccggcgacgcctggcgctggctggaacagctgggcgacaacgccgccgagcgctcgcagtacgaatggtgcgccggcggcgacatccacgcctggtcggggctatcgctgggccgcagcctgagcgacaccctgatcattttcgaaaactaccccaacaccccgcagcagccggttgccgagggcggcgcgcgcctggtgtcggtggccggccgcggcgcccgcacccacttcccggtcacgctgctgatcatgccgggcgacggctggcgctgcgaattcgtctgcgacaaccagtacatcccggccgaggaagcggcccgcctgctggacgccttcatccgcctgctggccgcgctggccgacgaaggcgccgcgctggacggcgtgcgcgccgccctgccgccgcagccgccgcggctgtgccgccagccggaacgcgtggtgcagccgccgcgcaccgcgctggagctggagatcgccaagctgtgggaagacctgttcgcgctcagcccgataggcgcggacgacaacttcttcctgctgggcggccattcgctgctggcgctggacctgatggcgcggctgcgcgcccgcttcggccgccgcgtgccgttcaccgccttcctggccgagcctaccgtggccggcctggcccggctgctggccggcgacgagctgcaaggcggcgtcagcctgctgccgctggccgaccagggccggccgctgtacctgatgccgggcgccagcggcaacccgctggcttacctggagctggcgcaggcgctggaggggcgctacgcgctgataggcgcgcagccggacatggtggaccgcggcgcggcgctgacgatagaagccgtggccgccgacctggctcaggctatcgaacgccgccagccgcaaggcccggtgctgctggccggccactccttcggctccgccatcgcctttgaaaccgcgcggctgctggcccgccaggggcggaccgtgggcgcgctggtgctgatcgacaccccggtgccgaacggcggcgacgaattcgccggcttcggcgagatcgactggatcgtctccatcgccgacgccgccggcagctacttcggccagcctatcgacctcgcgccggaagagctggagccgctgccgtccgacgcgcgccgcgccttgatgctggcgcgcttccaggccgccggggccttgcccgccggcgcgtcgcggcaggtgatagacgatttgctggccacctatcaaaacagcatcgcggcgttttccgcctatcgcccggcctattgggacggcgcgctcagcgtgatccgcagcgaacaggaacacggcatcgacgaccccaccctgggctggggcggactgtgccgggaaatcggcatcacggcggcggcgccgggcgaccacatctctatggtggcctccgcccacgcggcggagctggccaagcggatcgtgctgtgcgtggacagcgcgctggaagcgggacaggcgcgagacaaggaggcggcggcgacagtgtga

SEQ ID NO: 2347 - DNA, 1356 bp, Chromobacterium substugae
gtggatagacacgctgcgccaggccggcgtcgacgaccagctgatagacagcgtggcgcgcgcgatgcgcagccactaccccagttggaccgaagacaccttccccggctttctcgccaacgtcgtcgccggccgcgtcgccaaccgcttcggcctgggcgccgccagccataccgtagacgccgcctgcgccagctcgctggccgcggtgcggctggcctgccaggagctgcgcagcggcgccgccgacatcatggtcaccggcggggtggacaccgacaattccaatgtcgcctttctcagcttcagcaaaactccggcgctgtccaaaaccggcaaggtgcgctccttcgacgccgacgccgacggcaccatgatttccgaaggcgtgggcatgctggtgctcaagcggctggaagacgccgaggccgacggcgaccgcatctacggcgtgatccgcggcctgggcgcctccaccgacgccgccggcggcgccatctacgcgccgcgcagcgaaggccagatgcgcgcgctgcgcgccgcctacgccgacgccggcttcgatccgctgtcggtgggcctgatcgaagcccacgccaccggcaccgtggtcggcgacgcggtggagatcgaatcgctggaagccgtgctgggcgaggccgccgcgccgatcgcgctgggcagcgtcaaggcccagatcggccacaccaaggcggccgccggcgcggccagcctgatcaagaccgtgctggcgctctatcacaaagtgatcccggccacgctgaatgtgcaggcgcccaacgcgcgcctgaagcaggacggccccttctacctgccgcgccgcgcccggccgtggctggctcccgccaacggcccgcgccgcgccggcgtcagcgtgttcggcttcggcggcgccaatctgcacgtagcggtcgaggaataccaggacaagcaccccgcccccagccaccacgcggccgcgcccatgctgctgagcgccgacaccccggcggaactggcgcgccgctgccgcgaactggccgaccggctgcaagccggcgaccacagcgcgccgctgtggccggacgcgccgccgccagccgcggccgcccgcgtcggcctgttggcccgctcgctggacgccgcgcccgaactgctgaagagcgccgccgacatgctggacaagcggcccgaccaggacgcctggtcgctgcccaccggcgtccactaccgccgccaggcgctggcgggcgaagtggtggcggtgttcagcggccagggttcgcaaaccgtgggcatgggttcgcgcctgctgatagaccagccgcaagtccggcaatacttcgaagcctttga

SEQ ID NO: 2348 - DNA, 1137 bp, Chromobacterium substugae
atggaaccagatcaaaaacttaaagatacgctcgccatttaccgtgatcgaatttccatcctcaaaaagggatacgcgcaagaacgctaccggatagaacagctctgccgatcgtttctgggagacatcgtcacccgcgaagtcaccagcgtggatatcgccacctaccgcgaccaacgcctgacccaggtcaaccccaaaacgcagaaactactgtccaccgccacggtgcgcctggaaatgtcgctgctcagcaactgcttcgacatcgcccggatcgaatgggggctgtgcgacagcaacccggtgtccaatgtcaggaaacccaagatcccccccggccgcgaccgcaggatgacgccgcgcgaagagcggctgatcctgcgttacgcgcacgcccactccaaccccgagctgtattcaatcatcgtcatcgcgctgcaaaccgccatgcgccagggcgagatactgggcatgcgctgggaatacatcaatctgaagacgcgggtggtccacctgccggaaaccaaaaacggcagcaagcgagatgtgcccctcagcctgaaagcgcgcgacgcgctgatccgtctgggcgtgaaaagcaagggcaaggtgttttcctacagcgccgccgggttgaaatcgacctggcggctgatgaaccagacgctggatatcaaggacctgcacttccacgacgcgcgccacgaagcgatatcgcggctgtttgaactgaacagcctggacatgatggaaatctccgccatatcgggacacaaatcgctaagcatgctcaagcgctacacccacttgaaggcgcacaagctagtgagaaaactggaaggcaacaaaaacaagggcaaacaggtggtgctggaccatatggtgccctacccggccgttatcatgcggcgcaaagacacggttaccatccgcctgctggatttcgatgatctgcaggaaaccgcgccagacgaacctcttgccatccgactggcgcaagatgccttattgagaagactcatgaccagcatgcgagatgccacacccatcccgccagccgaccagtatctggacagcgtggatgagcggcacatcatcatgatcgacccgcttgcgaaccactccaccctttga

SEQ ID NO: 2349 - DNA, 264 bp, Chromobacterium substugae
atgaacagccagaatatctacaatatcgctttcggcatcgttttacgcgacctcaggaaacaaaaaggctattcacaagaagccctgggttttgaagccaatctcgcgagaaactatatatccctgatggaactgggccagcgctcccccaccctggacacgctgaccgccctttgctccgcactggacatcccattcccggccctcgccatgctgatccaagcgaagacaaccgagacacatggaaccagatcaaaaacttaa

SEQ ID NO: 2350 - DNA, 486 bp, Chromobacterium substugae
atggctaagcgtatcctgctgttgatgctactcacctggttgcctgcggcctgggccgaggcgccgccggagcatttcgatgtgaggcgcacggccaactgcgcgctggacgcgtccgaccgctttggcgtgccatacctgcttttgatggcattgaaggtgaaggagtccggcgtgcagttcagcaacccgtatgtgactgggcgcaacagcaatggcagcgtggacatcagctattggcaaatcaatgatttctggctgcccaagctggcgcgctatggcatagaccgcgcgcgattgtatgatccctgcgtcaatgcgcatgtcgcggcctggctgctgtcgacggaggtgcggcggcgcggcagctgggaggcgggcattggcgcttaccatagtccgaatccggcgcgcgccaggccgtatgccttacatgtattgaagatttgggcatccttgcggcaggaatacccggggtggggttga

SEQ ID NO: 2351 - DNA, 774 bp, Chromobacterium substugae
atgaatcaacaagaatcgcttcttccggttgagcgccatgaggaaagccaggactccgcggagtcccggctgccggtggtgctggcctttccggaggacaggccgatcattgggcgggatctggacgctttcaaggattatttcggcgccacggtggcgcaggcgttggccgcgctgggaatccagacgcatggccggtggtccaccatcgtcaagaaaaacgccgacatgccggtggacggcgccatcgccaacctggtgcgctggtacgccgcgcatccggagcgcttcccgtttggccaggtggacatgcccacgctcaggctgcgcctgtccatcaatcaggattcgttcgcgcagttgttcggccggcgcaaggtggcggtgtctcactgggagcgcaagcaggtgaagcccgagccgcaggtgcagatcatcgcgcgcgagatggatgatctgctcaaatcgtacgagcagcaggcggagcaggagcgcgacggttcgctggtggtgctgcagcggctgttgagcaagctggaggatatcgacgaagacaagaatctgcgcggcaaaagcgagattctggccgcgatccgcgaaaccttgctgatggaggagaagaatatctcggtcaagcaggaagccactacgcgcagcctggacatgctgcacgagttcatggatatcgcggcgttgaattcgtcgttgattccggcgccgccgccgcgccgcaagggcgtgcggcaaaagaaggtgccgatatccggcgaatga

SEQ ID NO: 2352 - DNA, 753 bp, Chromobacterium substugae
gtgccgctgctgctggcgctgcctttggcgccggttcgggcggaaacggtaaccgatcagcaggccgatgcgatcgtgacgcgggcggtggagtctgtcgccggcggcgcggtggcgcgcatccggccgcacagggcgttttccggctttctgcagcgtaacggcgccgccggcctgatgcaggccgcgcgcggccgccgcgacaaggcggtgttggtgctgagcggcgtgatgtacgagtcgggctgctacaagatggcgggcgcgtatttccgccacaactaccagttttcggcgttgggccatgccgagccggccgcggcgcgcgtgggtttcgaccgtctggccggaccggcgtcggcgtggtgcgtggaactgggcagcgatgactggccggcggcgccgcgctgcaaaaagccgtcaccggcggccaagggcaagcaggcgcgctgggacaagctggccgcgcaggcggaacaggcgcgcgcgcgccgcaatgcctacctgtcgtccattcgcttcaaccgctttgattatgtggcggcggtgacgtcgccgacgctggatttgtacgaccccgcgatgcagcggccggacaacgcggcttgcgccattctggcggacgatttgagcaaggcgttgttcagccgcttgcgccatgacgcgggcgatgacgcctactacctgaaacaccgccaggcgatagatgccgcccgcgaggtctggcgcaagatggacgggctggaaaaatga

SEQ ID NO: 2353 - DNA, 747 bp, Chromobacterium substugae
atgaagacattcctgctgtgctttgccggcgcgctgtcggccattgcctgcggcagcgccgccgtgctgttgtcgtctggccaggcgggcgcggacggcatcagcctgccgcaaggcggtggcggcaatggcggcggccccgccgggttttgtttcgccacgccgtttcagggcgcggtgcgggtgaccagtcccgcttcggccgcgcgcaagcatcccactttgggcactacccggccgcactacggcgacgacatcagcctgccgtccaatacgccgatttatgcgccggccgacggcgtggtggaacgagtggcgttcaatgtcaacaacgcgggcaacttcatcaatttgaagcacccgaacggttatctcacccgttatctgcatctgaattccatttcggtgaaaagcggacagcgggtgcatgctggcgatctgctcggctactcgggcatgagcggcggcaacaacaccgggcccaatctgcactgggaggcgcactacctggtgtacaagaatccgtccccgcccaaggggccgacctccatgctatgcagcggcgcggtgtcgacgtcggaccaaagcgagccgaaacagaccggcgatgaaaacaatacggtggaatggccgaaagacagcgatgcgcccgatccggtgtgggatgcctgcccgatacagccgccgccggtggcaagccagggctggcggctggacgagcctggccgtacgtctaaaccctattaa

SEQ ID NO: 2354 - DNA, 990 bp, Chromobacterium substugae
atgactatcaaacaaaagctgaattcattgccgttgaagagaaaggtgttggtcctgctgctgggcggcggcctggcgctggcgccgacgctggccctggcggacctgtccaacgacatcctgggcaagatcctgaaccaggtgacgcagatcctgcagcagcaataccagcagttcgccgcgatgatccagcaaatggacgtgatgcggcagcagggcgaggcgatgcgcgacaagatggggcaggagtccgacaagaaccgccagcagcaatgcgacatctggtgcggcaagtcgctgcccaagcccggcgaagtgccggccgacgccaacaataccggctcgcccggcgcggcgatgtcggcgcggcgcggcatgaccgcccagctgcaggcggtgaccggcaatatggccggcaatatggaccagaataccgcgatccagggctattacggcgctttggccaattggttccagagcgccacgccgcagcagaagcagcaggtgcagcagccgctgtcgttcgcgcccggcgatgtcccatccgcagaagaccgcaagctggccgattacaacgccaagctcaccatcggcctggagccggtgccgccggtgtcgtccgcccagatcaagagcaatccggccgcgcaggaatacgaggcgcgccgcatcggctacaactccgcccaactggtggcgtatgacagttaccgccagtacgacctgtcggccgaagaggtgaagacggtgtccgacgtattgctgtcgatgtcgcagcaaaccatagaaaacatgaaccccggcacggcgatgaaggcgcaggtgcagctgctggcggtgcagtccggcttgctgctcagccagtaccagtcttcgctgcggcaggagcgcctgctggcggtgatggccgccaacaacgcgcggatgtcgatgagcgaccgcctgcgcaggctgagccagagccaggcggttcagagctatgccaagtaa

SEQ ID NO: 2355 - DNA, 1587 bp, Chromobacterium substugae
gtgcagggcgtgtcggggaccgcgctggcctgcctgctgggcatgcaggtggcgccggtattgcccggtttcatcgcggtggcccgggcggaggcttccgccgcgtcttacggaccggcggccgggcagtcggccgccgagctggcgcagcgcctgcgggcgctggcgcaaaaccaggtgatggccaactatccggtgctgcgcgaggcctatgtgcagcggcagctcgccaagctgcggcaggatgcccaaaacctgccggataccgaagcgaaccaggcctatcgcgaggcggtgggcgatttctcctggatgcggccgcagctggaagacgcggccagcctcgattactacggcatgccggacgcgttggccaacgagctggtggcgcaggccaatgccgggctggtgcgccaggtgatggccaagtatccgcagcaggtgctggctgtcatggccaaccaggccatctcgctggagatgggcaagatgtttcccgcggcggccgatcaggcggcggaagcggtggtgtgggggtcgaaaaattcgatcgtgcaatatctgggcaatctggataaggaccagttcgtgcagtccatggtcaacagcgtggtggattacgccaagcagcaggccatcgattacttcaagaagtggatcaagaagatcatccaggaaaacatcatcaccaagatcacgtcggaaatcatcaagaactacccgtacatcgggccttatatcagctggtaccaaacgcagaagcagaagctcgacaacatcaagcatcggatcgaccagatcaagaaggaggccgagctttacctgaaaaagctgggcttcgacaacgcgatggagcgccagcaggaagacatgacctggggcaagcagaatctgccggcctatccgaacggcgacggctcgtccgaattcggcacctccggcggcgtgcgctctaatcagcaggtgattgagcggtacgccaggcaggagcgcggcgatttggcgcagtggtcctatgatggcgatcgccccgggacgttttacggctggatgggcagctacccggcggagcggcgggccgcggtgatgcggccgtatgtgatcgggccgcggctggggcaggacggccagctgcagccggtgggcgcggccgagcgggagaatgtgcgccgcaacgcctggctcacgctggggctggagcccaataccccgttcaccgccaagccgggctcgccggcctaccaggaagagctggcggtgcgggcgcagatggcatcggtgatgagcctgagctacggcagctatatggagggctggatggcgcaggaccgcatcacccaactggccagcaccatccagatgttcacgcccagcgtgatcagcggactcagcaccggccaggccaacggctgccgggtgatgctgaagcagctgtccaccgaggtgcagatgcaaacatcgcagtcgcagctgcggtttgagcggctgttcgccgcatcgtcgggaatgttgggaaatatcgaacgcaaggaacaactggccggtttaagccagggagcaccgatcggtgcgattaacgggcgctag

SEQ ID NO: 2356 - DNA, 2142 bp, Chromobacterium substugae
atgagcgtattgagcgagggagccaaggggattggcttcgtgtttctggaaagggtgctgggcagcgacgccttgtcgtattacggcatccataccaccggggtgaattcggttccgatgaccaccggcatggcgctggccgccgatgtcgcgctatggttcacccccttgatcacgttttacattctgggcatgggcttgatctattcctcccaggaaggcgtggtgctgggcaagcgctggtcggcggtgatcgtgccgctgcgcggcgtcggcggtttgatgttctccgcgccggtggtgccgggcggcttgtccgccatccaggtgatggtggtggggctggccctgctgggcaactacatcggcaacgaggcggccaatgtgctggctgagcggattttcctgcccagcagcggctatgtccacaccaagccagcgtctttgctgaacaacaccgacgcggcggcgacggctttcgccaccatcaccgcggcggcggtgtgcatgaatacggccagcaatctgggcgcggatggcaacccggccaaaaccaacccggcgcctggcggcggctcggcgctcggcatcggcatgcagctgtggggaatcgccaccggaaccggcggcggcggcggcggcggcggcggaaccggcatctccttgtccgacctgtgcggcggcgcgcaaaacgcccaggcgacgaggccggatgcgcagccgagttcgagcagcacgaccgatggatacccgtctggccggatggattgcggatccagctccttcgtcgggccgtgccgcaaggtggaagccgccaattcgacgctgaaggacgcgttgtcggccactctgggcaggatgggcggcgtgctggacgagcgcatcctggccacgctggcggcgacttacctgatgcagatgaacagcgccatcgacatggacatgaccgatgtcatcaaggaaaacaccaaggcggtgcagaagctgggctggcctggcttgggcaacttctatcaaaagtactcgtcggtcagcggcgagatcgacaattacatctattactccggcgagcccagcttcgactttaaagacataggcgatgaaacccgagccggcatggcgctgaacgaccagacgcggatggctttcaagcgcgcgttcaaggcgttcaacttctccgtgcagggcgtgctgtccggcgtaggcggcctgatgcaggccggcaatacggcgatcaacaacgccaacgcctccatcatgggcgaattgcaggtcaacgtggaaaaccggatcttgcgcagcctgctgttcggcgtgggcaacagcgcctacgacgtgggcgcgttcgacgcggtgcagcgcctgggcggtttgctgaacatgttcggcaccaccacgctgaacatgctggtttgcgagaagcgcagcggcagcgacaactcttgcgataagagcaccgccaatgaaagcgcgcagagcgggatggtttccaacgcggtgaaatcgatagccggcggcggcatggccgatgtcgccaccatggtggccaagtccgcggtgatggcgggcacggtgctgaccatgctgctgccctcgttgccgaccatctacttcgtgctgatgacgctggagtgggtgatctggctggtggtggccgcgctggcgtcgccgctgtggatgatcttccacatgctgccggacggcgagtcgctggtgcacagccgcgccgaaaccggctggggcttgctggcctatatcacgctgttcccgctgctggtggtgctgggcttttgcgcgtcgatgacgctgttcaacgtggcggtgccgttcgcctttgaaatgatgatgtcgatcaccggttcgaccgcggtgggcagcggcctggacttcctggtgaaaccgctgctgatggcggccgtggtgataggcgtcacctttctcaccatgggcctgatgatttccctgccgcaccgcatcgccaactggctgaacatcaacccgcagtccgacagcctgcaggaaggcaagagccagctgggcatcagcgccccgaagctgaccgatatgtccggcggcgccgccaatgtgggcgccagcggctggaagggcgcgctgagcaagggcgtgaagcccggcaagtaa

SEQ ID NO: 2357 - DNA, 804 bp, Chromobacterium substugae
atgcatgatcaagcgcatagcgcccccactcgggaaagcctggttgctgccttgcgcaagcgcgagttcagcatgcattaccagccgcagctcagttgccgcaccgccagggtcgccggcgcggaggcgttgatgcgctggcacagcgccgagcgcaatgggccggtcagtcccgccagcttcatccccctggcggagcaaagcggcttcatcgtcgagttgggtgactggagcatggccagcgctttgcggatgatggcggcgtggcgggatgaggcgcgcttgcccgccgattttcgcctggccatcaatctatcccggcggcagatcgtccctgagctgcctggcaaggtggagcggctgattgcccaggctggactggagccgtcttgcgtggagctggagatcacggagtcttatctgttccatgatttgccgacgatggtggaggtgacgcgccagttgagaaagctgggcgttcgggtggcgatagatgacttcggcaccggtttttcggtgctggagcatctgcgccatattcccgccaccaccatcaagatagattgcagctttacccggcagatgctggagatagagcgggaccacatcatcatgcgcaacttgatccgcatggtgcgcgacctgggaatggaaagcgtgtgcgaaggggtggagaccatggcccaactggaggcggtaaaggacatgggggccgactactggcagggattcctgttttcgccggctttgccgggcgcggaatttcggggcttgctggatgccccggggatggacttgcgatga

SEQ ID NO: 2358 - DNA, 246 bp, Chromobacterium substugae
gtgggcgtagtgttcaaaggctcggaaaccagctgcattggcagaatgcagcaactgcgccgacaatcgatactgggcttgccgctgccgacctgcggcgccgtgcgcgtggtgaatcatcaaggcgtcgtagcagccaccttgctggccgacgcgccgcagcagcggctggcgccgacgaaccggcaagcgctctacgccctcgaccaggacatggtggaacatttgggccacacgccccgctga

SEQ ID NO: 2359 - DNA, 924 bp, Chromobacterium substugae
atgcgcatcgacaaacgcagcgcgctcgcgctgggcggaaccaccctcgccctattggcggccttcagctggctgggcctgcagggctccgcgccggcccgcgccgccggcagcctcttcgccataggcctgctgctgggcagttttctgaacgtgctggccttccgcctgccccaaatgatggagcaagcctggcagagggaggccgcggaagcctgcggcttgccgccgcctgaacaggcgccgctcagcctgtcccacccgcattcgcactgccccggctgccgaaacacgctcaaaacctggcagctggtgccggttttcagctacctgttgctgcgcgggcgctgcgccttctgcgccagccccatcagcccgcgctatccgctggtggaactgtccgtcggcctgatcttcgccgcggtcggctggcggctgggcccgagcccggccgccctggcccacttggctctgctttatctgctgctggcattggcgctgatagatctggacagcaagctgctgcccgacagcctgacgcaaccgctgctatggcttggcctattggccaatctgctccagtctctggcgccgctgcaagatgcggtaatcggcgccatggcgggctatctgtcgatgtggctgatcgccgcggcctttcggctttgcacgggcaaagaaggactgggcatcggcgatttcaagctgatggcggcgctgggcgcctggctgggatgggaagcgttgccgctgatcatcacgataggctcgatcagcagcgcactggtcggcatcgccctgatagtcgccaagagaacgaagcgggagcagacgcagccgttcggcccctttctgatcgcaggcggcatcgtcgcgctgctctgggggaaagaaatcacccgctggtatctggcgctggcttga

SEQ ID NO: 2360 - DNA, 711 bp, Chromobacterium substugae
atgcgagaagagatgccgcttttcgacgttcccgcgccaccgagcgccaatccgctgaccattccctaccgcgcgcccgcgccgcgcaactacgccgaagcccgcgacctgctggtcaaatccagcttgcgcgcagtcgacatcgccaagctcaatctgcagaaaaagctggaagaccagccgcaacgcgcgcggcgcgccaacttcatcgcaagccaagggcggatacaggccggcctgggcttcgccaaactggccctattggcggacggcacggccaaggctccggtgacgctttactggaaaataggcgaaaaagcggtattccaggcacgcggcacccccactgccgacgtgtgcgacggcgtgcggcgcatctggatgtccgccatctggtacgacatctgggaaaagggcatcgccaaaagccaggccagcctcgacaatctgcccgccatcatgttccagtccggcgcggcgctgttcaacgaccgcaagctaggcatggcgcaagccagccagcaggttcgcgaaacgctgggcagcggcggcgagctgcggctggaaaaccgcagccaaaaaccgttctaccaattttcgctggatagcgtcctcagcaatgcctgcctgaacggaaacatgacctacaccgacaccggcgccgccttgccgctgtatggcgcgccctatcccggcctgttccgcccctga

SEQ ID NO: 2361 - DNA, 918 bp, Chromobacterium substugae
ttggctctggacgaggataggctgagcttcgaggatgagccgccggtggcgcgcaatgccagccggaccatggccgcgccggcgcatcaggatctcaagttcgacgacgagccgatggactcgccgccggccgcgcagcccaagaaagacgccaagcgcatcgccttgctggcgctgatcggcggcgtggtggtcgtgatgctgactaagcccttgtggcagaaagtgctgaatcccccgccggtggaggacccggcgccgactgcaatgcggcctatggatccggtcaagcctatggtgaacaccccgccggcccaattgacgcatcaggccgcgccggcatcgctcggcagcgccagcgtcgcgcagccgccgtccgcggcggcgccgtcgcagcctcaggcgctgctgcagcccggcgccaattcgggccaggccgccgcatcgccatcgccgttgcagcctgacgccgctgcggacgcggcggccgagccggcgctgctggcgccgtcggccaagaaaaccgcgctgagccgcgagccggcggccggcggcgatgccgacgcgtcgcagccgaaggcggcgcaggccaaggaagcggcgcagccggaaagcctagaggccaaggtggcgcggctggagaaagaggtgaagacgctgcgcgagcgcaatcgccagatggcgtcgcgcggcgcggggcaggcgcgcgcgccaaaagcgcacggcgatggcggcaaggacgccggcagcaaggtgctggggatgtcttccacctcggtctgggtgaaaaagtcgaacggcggcaccgctgaattgcgggtgggggatcatttccgcaatggcgaggtgatccagagcatagaccagcaggcgcaggtggtggaaaccgaccgcggccgctacaaggtcagtttctag

SEQ ID NO: 2362 - DNA, 738 bp, Chromobacterium substugae
atgcgtaaattcttcgcgaagatgctgctgggcagcgacacgctcaacaagctgcattccatccagcaatccgaggcgctggaggaggaagccggcaagaggtttgaagacgcgggccagatgccgcccaaggtcagctcgcccacgatcacccgcgagcagatccgttctctgatcgagatcgacatggaaatccatggcgacatcttcatcgggcgcggggtcaagatttccggccgggtgatgggcaacctgattcccaatggcgcgatcgacgattgcgaccccatcgtcatcgtcagccagggcggcgatgtctgcggcgatctgcacgcccgggtggtggtggtggccggcagcctggatggcgacatccacgccgaccacgtcttgctgatgccgacggcaaaagtgagcggcacggtcaactatcgccataccttgcggcaggacatcggctccgcgctgtctggcatggtgcggcgcgtggaggccatcgcgctgctggatcagccgccgcggccgggcgaggcggcgcgcgccgcgctgcagaacaccgcggcgggaaaggcggacgccatcccggttttgccggtagagcctgacagcgtggtggcgccgctggtgcgcgcggtgccggcggcgcaggatacggcggaaatcgaaagcctgtaccgcggcctggacgtcgcgcgtgaaaacccggcgggcgggcgcgtggttgcgctcggggcttga

SEQ ID NO: 2363 - DNA, 321 bp, Chromobacterium substugae
atggggctggctcgcgagctgccgccggaggcgctggacgacgaagaggacgcgcgctgggcgtatctgccctttttacagctggccatcgagcgcatgtgcgtgatggcgctgttggcggaggaccacgacgtggcgttcgcgccgctggatgatgccgctttgccgcgtatgcggcaggattgcggcgccgatccggtgttcgcccgcgcggtggcggactatctggcggcgttggctacgctggggtcgatgagcggacgcggcgaagacgaactgcatcggtccatcgccggcctgtatcaagggagagcgcaatga

SEQ ID NO: 2364 - DNA, 1953 bp, Chromobacterium substugae
atgatggataggcatccgcatggccgccgggcttatgcgcaagaagccgcgcagcggattcacgaacaagtggccgcgctgggcgcggagcatgtcttcgcggctccgttggccggcgcgcgccatttcaacccgctgactggaacggtttaccaaggcatcaaccacctgttgctccagtcggcgctgccggccgcgtctagcgatccgcgctggctgagctacaagcagatacagtcgctgggactggggctggcgccgggcgcgcgcgccggtctgctgcttttcgcccggccgatgcaggcgttgacagggccggcgggaccggcgctcaaaggatgctcggtgttcaacggcgcgcagattctcggtttgccgccattgtcggcgcacccggccgccgcgcatgccggcggcggcaaactgcagcaactggtgggcgccatcctgggcgagctggggctgcgcgaggaaagcggcggcgcggccgcgatctacgacccggtgggcgagatcatccgcgtgccgcaagccggctacttccgcaatatgcgggagtacaacgcggcccggctgcgcaaggcggcgcagtgggcggcgcaacacgagaagcggccgagggcggcgaagcgccggccgcggcatcacggtccggacgatccgctggaagagctgtgggcgcatatcgtctccgccctcctgatgggcatgataggtttcggcgccgcgatgccggccgaggggcggcaactgggcggagcgataccgctgttgcagcgcatgggcgaaatcgacttcatggaatggttccatggcgcgcaccaggtggagcaggtgctgggctggctcggccagctatcgcctaccttggcgcggctgatggaaatcgagcggcagttcgtgcgcggcaatctgctggagggcggcgacacgtccgccccgcaagcgcagccgtccgccgcgacgccggaggcgcagatcgcgggcggccaactggcggatgccggggaaaccgagcgggaaatggcgcgcgaagcccgccgtcatgccttgctgatggatgtcgcgctgctgacggcgccggagctggcgcatcagctggccagccacttcggcgcgcagcaggtgctggccgaaaccgacgccgccatccatgaaaaattccagcattgggcgcaaggcgcggtgatgggaggaatgttcgacggcgcggcggccaaggcgcgcgagctgttcggcatgttcctgcgcgagcgcggcgaggaggtgggccatctgctggaaaaagacggagagtcgcagcggcaggcgaggatggccgcggcgattgagatgccgtccgccggctcggcggggaagatagccgtgatcggcggcgccgaacccgcggcgccggcgcgcgagatttccatccagcctttccgcgacggcaagggcggctggctgaaagtggggcaccaggatgtgatcgaactggggctggtgcgccagatcgccgacgacgattcgcggatgacgcccagcgccgtttacctggcttttcgcgaggatgctccgcattgcgacgcccagcggctgatggacgcggtggacgcggcgggctggaagatccagtttcagcagtatgtcgaatccaaggattcgcagatccgcagctacgccagctatttcgcgcccttggtcggctatatgcccaagatcggcgacaaactcaagttggttgaaggcgtggccagcatcagcagcaagtccggcagcggcggctgggtggtcagctttgacgacgccggcaagcaaagggcgttgagcagcggccgtttctacgacttcatcgagtcggtgatcgagggagatttcctttccccgcccgcggcgggtaagcccgagcgcgcggccgcgccgcagcccaaggccggcaggccggcgctggacgacgccgcgctcggcttttag

SEQ ID NO: 2365 - DNA, 429 bp, Chromobacterium substugae
ttgttcaatctgacggtggttgccatggaagaggaactcaagaaactggagagcgacctgatcgcgatgatggatgaccgcttcatggccgtggaggattccctggccaggctggtcaatctgggcgagcagcatcagcgcaaactggtctccaatgacatgacggtgcggcgtttcctgccgcagttcggcatgtgcgtggtgatttgttccgcgctgatcgtcgttccggtcgcggccgcggcgtggtatttgcaggaaggcaaggtccagcagctgcaggcccagacgcgcgaataccagcgccaggcagtcaggtcggcggcattcgaccagctttaccaggcggcggactccggcctcaggctgcgcatgcagaatgcggtggagcaggccgccgaacaggccggcacggccggtcggcaataa

SEQ ID NO: 2366 - DNA, 2721 bp, Chromobacterium substugae
atggcggccccgatgcgtcggagtcaggttgaacgcgacgtcgttcccttttcccacaaggtgctgggttggctgcgccgccaagagccggcgtttctgaccggcctgggcgtggtctacctgctgtgcccgattttcccgctgttcacgctggctttcgccggcgcagcgatgctgatgtcgcgcaaccgggtgatagaccacccgaaggggccgttctggaaaccggtgcccggcggcgacaaaaagctggcctggacccggatggaagggccgccggacaagggcggcaaaggcgtctggtgcatgggcaacgccatggataccaaggaagagatttgggtcagcgacgacaccatgcgcgtgcacgccaccctgttcggcaccaccggcggcggcaagaccgtggcgctggaggggctgatctgccaggcgatcggccatggctcgggcgtgatcatggtggacggcaagtccgatccgaaaacctggttcgacatcgtcaccatggccaagatgtatggccgcgaggacgacctcttggtgctcaacttcatctcctccaccggtttcgagaagctggcgatcctggacgatgacgacgccggcggcgccaaggacaagatggacttgctggggcagatccactccaataccttcaaccccttcacctatggttcggccgacacgctgaccgagctggtgaccggcctgatgcggccggatggcggcggcgacggcgcgatgtggcgcggccgggccgaggcgatgatacgggcgctgatgcgcggcctggtggccatgcgcgacgccggcaagatcacgctgtcggtgcaggcgctgcgcgactacatgcggctggacaagctgggagagctggaaagcgacgagagcatccccggttacgcccgcgaacagctcaccggctatctggatgagctgccgggctttcgcgaggcgatcaacgccaaaaacaacgatcccgccgccttcgacacctactgggagcaggccagcaagcagcacggcttcctcaccatgcagttcaccgaactcttgggcctgctgtccggcacctatggccatatctgcaatgtggagtggggcgatgtcgatttccaggacgtggtctacaaccgccgcatcttgtacgtgatgctgccggcgctggaaaaggcgccgtcgtcgctggccaacctgggccggttgacggtggcgggcatcaagaacgcgctgtcggtgtcgctgaaggcccagctcaccggcagcaagcaggagatcgtcgactcgcgtcccaccaactccgacaccgcgctcctggccatcatggacgaatacggctcttacgcggtggaggggttcggcgacgtggcggcgcaggcgcgttcgctgggcgtcagcgtgatcttcgccggccaggattatccatcgttcaaaaagggttcggagatcgaggcctcgcgcatcctggccaacaccggcatgaagatcttcctgaaaaccgaagaccaggaaaccgccgacatcgccatcaagcgcgcgggccagggcgtgtatgcctgggccggaggcaagcgcaagctggaaaattccgaccggctggtggataccggcgacgccagctaccgcgaggaaaaccggctgacctatctggatctggtggacatggcggaaggccaggcctggttcatgaaccgcaatcatctgatcaagatgaataccttctatgtgcaactggacggcgcggtggcgaaggacgccaagcacaacacgctgttcccgctgggcaacgacatgtcaaaggcgctggccgccgacaagatcatgcaggatgtgatgggcgtgtccgagcctggcaagggcggcgagtcgatgctgcgcttcaagcggcgcatctttgatgatgtcgagcagctgttccgcctggccgagcagcgcgagatccctgccgacccggggtccggctggagcgcggcggagcaggcggccggcgctctggaagaggatgttttcgtgcgcatcagcgatctgcaagccgaacatggcttgttgatgcgggcggcagtggtggccgaattggccggcggcatgctggcggatgtgccgatggtggagcggatggccgagcgcgaggaggcggcgctgggcgccagaatgtcgccggatcagctggccggctatgccgacagcctgctggagcaggccgagctggagggcggagcggcgagcgatgcggaacgggagcggatgccggccgaggccaaagccggcgtagcggcgccggatgcggtcgcggaggaggaacatgcgccgttgccgctgaccggcttctccgccgcggcctttttccatgccaccgaaaccgaggccgagccggaggaagcgccgggcggcaatttcgacctggcggatctggcgggtttcttcggcgccggcggcgaagccgagccgcagagccatcaggaagaggaaggcggggtcgatccttatctgagcgaggtgctgctggagtgcgaggcgctggccgaggagcacggcttgctcaaacaggccatgcgcattgatgccgcgctggcgactctgctggggcgcggcggcgacgcggagcgggaactggacgagatggaccagcaggccggctatattctgggcagcgaggacgccgggcagttcctggagctgctgctggccgaggcggaagaagagcgcgctcaggtttag

SEQ ID NO: 2367 - DNA, 1323 bp, Chromobacterium substugae
atgcatatagaggaaaccgttagcaaccaaccggcaggcaatgggccttggagcacgctgatggccatgcgcatcggaccgctgcccttgccgctctatctatctctcgccgccattgtggtcgccgcggccatcgcgcatcgcctgccgaacgacctgatcggcggcctggcggtcatgatgttgtccggctttctgctgggcgagctaggcaagaggcttcccgtgctcaagcatatcggcggctcggccattctctgcctgtttgtcccctcggcattgctgggatacaagctgtttgaccccgacatgctgaaagcgctgaccacggcgatgaagacagccaatctgcaatacctctacattgcctgtctggtggtcggcagcattctcggcatgagccacaaggttttggtgcagggctttttgcggatgttcatcccgctgctggtgggaacgctgggcgccgtcgccgccggcatgcttgtcggcctattattcggttacaccccttggcacaccttcttctacatcatcattcccattttgggcggcggcatcggcgagggcattctgccgctctccatcggctattccgaaatgacccgaatcccgcaggctcagattgtcgccacactgattcccgcggccctgatcggcaatgtcgtcgccatcctgctggccggcctgctccacttctacggcaagaagcgcccgcgattcagcggcaatggcatgttggtcaaaaccggggaagatcgggaattgctggccgcgcagcatgaagcgccgatcaacttgagcttgatgggaagcggcttgctgctcacctgttcttttttcaccctggggtctttatttgccccgattaccggcatcccggggccgatcctgatgattatcacagccgccctggtcaaggtgagcagggtgatgccggcgcaggtggagctggggtcctaccagatgtacaagttcatgaccagcaatctgacattcgccatcctggttgggctgggcaccctcttcgtgccatggaaccagatggcggcttccgtcacccccgggtatgttctgctctgcgcggtgatcgtgctggccatggtggccagcggcttcggcatcggcttgttgctgaagatgtatccggtggagtcggccattgtcgccgcctgccatagcggcctgggcggcaccggcgacgtggcgatcctgtcggccgccaaccggatggaaatgatgcccttcgcgcaaatctcgacccgcatcggcggggcggccatgatcgttctggccacgctgctgatgaagcttctccactag

SEQ ID NO: 2368 - DNA, 639 bp, Chromobacterium substugae
atgaccgttcacacccgaatcgaagacctggccgcgccgttgccggtcagcaatctggacaccgaccagatcatgcctaagcaattcctgcgccgcatcgacaaggcgggcctggccgaaggcctgctatacgacatgcgcttcggcccggatgggaaaccccggcccgcattcgttctcaaccggccggaatacgcggcggccaggattttggtcgccggccccaatttcggctgcggctccagtcgcgaacacgcggtctggggcctgcggcaatacggcatccaggcggtgatcgctcccagcttcggcgagattttctattcgaacgcgatgaacaacagcctgatgctggtggcgctggccgaagccgatgtcgaggccattctggccgacgtctccgcgccggaaaacagcctggtcgcgatcgatgtcgcatcgatgacggtgcgaagcaggagcctgacggcgtctttctcgctgtccgagcgccatcgccggatgttcctcgaaggcctggacatgataggcgcgaccttggccatgcaagaccagatccatgctttcgccgccaagcattggcagcaacggccctggctgaaagacatcgcctccacgacaaaaaaccgtttggcgtaa

SEQ ID NO: 2369 - DNA, 1431 bp, Chromobacterium substugae
gtgaccgcattgcaaaccccaccccaaacgctttaccagaagctggtcgaaacccacacggtggcgcgtctggatacccagaacgtgctgctttacgccgacctgcacatcatgaacgagtacaccagcccgcaagccttcgccgggctggcggaagccggccgcacagtctcgcaacccggccagaacgtggcggtggtcgaccacatcatcccgacccaccccgtggcgatccgcatcatcgaggagccgaattcggcattgcaggcctcgaacctgaagaagaactgcgaccgccacggcatcccgctgttcgatgccaacgaccgctttcaaggcatagaacatgtcatcgcgccggagctgggcatgattcgtcccggcatggtcgttctctgcggagacagccacaccacgacctatggcgcgctgggggccttgggcttcggaatcggcacctcagaagtcgaacacgtattggcgacccagaccctggtgtatcgcctcgcgcaaaccatgcgcatccatgtcgccggccgcttgccgctcggcaccaccgccaaggatcttatcctgctgatcatcaaccggatcggcgcgcacggcgcgcgcggctatgtggtcgagttctgcggcgaggccattgagtcgctgacggtggaagcgcggatgacgctgtgcaatatggcggtcgaggccggcgcgcgcggcgcgctcatcgcgccggatgcgctgacgctggaatacatcgcccaccattgcccggacctggccggcgcgacgctggacgccgcgaaggtggactggcgcgccctgcgcagcgacgacggcgccccattcgaccttgagcttgaattccaggccggcgacgtcgagccctatgtgacctggggcaccagccccgaccaatccattccgatcagcggccgcatccccgtcgccgcgtcggcgccggaaggcgccgaccggctcaccatgcagcgggcgctgcgctacaccggcctgaccgaaggcgcccaactggaaggcttgcccgttcagcgcgtcttcatcggctcttgcaccaatgcccgcatcgaggacttgcgcgccgtcgcggacatcgtgcgcggacgcagcgtggcgcctacggtgcgcgccatgatcgtgccgggctcaggcgaagtgcgccgccaggccgaacaggaagggctggcgcagctgttcatcgaagccggcttcgaatggcgccaacccggctgctccctatgcctggccatgaatgacgacgtgctcaatcccggcgagcgctgcgcctccaccaccaaccgcaatttcgaaggccgccaaggccgggatgcgatcacccacctgatgagtccggccatggccgccgccgccgccgtcgccggctgcatcaccgacgttcgcaaactgggagtccaagcatga

SEQ ID NO: 2370 - DNA, 957 bp, Chromobacterium substugae
ttgaaatataaaactgtttttaacttaaatgcaaaaatgaactccatatccgacgtcgcttttttcctggaagtggtgaaggcgggcacgctgtccggcgcggcgcaagaactgggcgtatccaccgccgccgtcagccgtcgcttggccaatttggaggcgcggctcggcattcggctgttgaaccgcacgacgaggcgagcggccgtcacgcatgaaggcgagctgtatctggcggaggggaaaaagattcttggggagctggaggagttggagcaaaggctggccagcgcccaggccatcccaaaggggctgctgcgcgtcaatgcgaccttcggcttcggccgccagttcatcgccccggcgatagcggactttgtcgagctttatcccgatgtcgacgttcagttatcgttgtccgaccgcccggtcaatctgatcgaagagggattcgatgtctgcatccgcttcggcgagttgcccgacgctcgcatcacttccaggaaaatcgccagcaatcgccgcctgttatgcgcatcgccggcctatctggagcgtttcggcgcgccggtctccccgatggatctgcagcgccaccgctgcattgtgatccgggagagcgacgaaacctatggcgcgtggcaccttcactcaggcaatacgcaagccaatgtgaaggtccgcgggaccgtctcgaccaacgatggcgaggcagcggtcagctgggcattgcgggggctggggatattgctgcgctcggagtggaacgtcgcgccttatctgcgttcgggacgattgcgcgaagtgctcggcgactggcggtttccggcggccgacattcacgcggtctatccgatgaagaacaacctgtcggcgaaagtgcgggccttcgtcagccatctggataagcactttgagccatatcggcccaggggggatggcaagagcggctggtag

SEQ ID NO: 2371 - DNA, 903 bp, Chromobacterium substugae
atgtaccaacaggctgccagccatttcagcaccgtgcgcgacctgctgcgcttcgccgtcacgcgcttcaacgaagccgagctcacctacggccacggcacccacaacgcccacgacgaagcggcctacctgatcctgaccgcgctgcagctgccgatagaccagctcgacccctatctggacgccaagctgctgccgtccgaactggaagacgtgctggagctgatccgccgccgcgccgaagagcatgtgccggtggcctacctcaccaatgaggcctggcaaggcgaattcagcttctacgtggatgagcgggtgctggtgccgcgctccttcatctacgaattgctgggcgagccgctggagccgtggatcgaacacccggaactggtgcatcgcgcgctggacctgtgcaccggctccggctgcctggccatccagctggcccaccactaccccgacgccgaaatcgacgcggtggacatttctctggacgcgctggaagtggcgtcgatcaatgtcgagcattacggcctgcaggaccggatcaacctggttcacaccgatatgttcgagggcatagaagaaaaatacgacctgatcatttccaacccgccctacgtcgatgccgagtcggttgacgcgctgccggaagaatacctgcacgaaccggaaatcgcgctgggctccggcgaagacggcctggacgccacccgcgaaatcctgcgccgcgcgccggaattcctcaacgagcgcggcgtgctgatggtggaaatcggccacaaccgcgacatgctggaagaatgcttccccaccctccccttcatgtggatggagacgcaaagcggcgatggcttcgtgttcctgctgacgcgcgaagatatcgtaaccgccggcatctaa

SEQ ID NO: 2372 - DNA, 1377 bp, Chromobacterium substugae
atgaacaaactatccaaagacatcttcaaggcttatgacattcgcggcatcgtcggcaagacgctgaccgccgccgtcgcgcgccagattggccaggccgtgggttcggaagcgcttgcccgcaaagtgcgggccatcgtggtgggtcgtgacggtcgactgtccggcccggaactgtgcgaagcgctgtccgaaggcatccgcgccgccggcgtggacgtgatcgacgtcggccgcgtcgccacgccgatgctgtacttcgccgcccaccaactgggcacgctgtccggcgtgatggtcaccggcagccacaacccgcccgactacaacggcttcaagatgatgctggccggcgacaccctggccgggcaggacattcagaaactgtaccaacgcatcgtcgacggcgatctcgccgcgggcgaaggcggctaccgcaccgaagacatcgccgaagcctatttcgagcgcatcacctccgacatcaagctggagcgcccgctgaacatcgtggtggacagcggcaacggcgtggccggcgccttcggcccgctgctgtaccgccgcctgggctgcaaagtgcgcgaactattctgcgacgtggacggcaccttccccaaccaccaccccgatccggccaagccggaaaacctgaaggacgtgatcgaggcgctgcagaaaaccgacgccgaaatcggcctggccttcgacggcgacggcgaccgcctgggcgtggtcaccaaagacggcaacatcatctggccggaccgccagctgatgctgtacgccgccgacgtgctggaacgcaatcccaaggccaaggtgatcttcgacgtgaagtccacccgcctgctcaagccctggatcaagcaaaacggcggcgtgccggtgatggcgcgcaccggccacagcttcatcaaggccaagatcaaggaaaccggcgcgctgctggccggcgagatgagcggccacgtgttcttcaaggagcgctggtacggcttcgacgacggcatctacaccggcgcccgcctgctggaagtgctatcgcgcgtggaagacccgagcgagctgctgaacgcgctgcccaacgcggtatccacgccggagctgaacctgaaaatggccaaggaaggcgagaaccacgcgctgatcgccaaactgcaggaatccgccagcttcgacggcgccgaggaagtcaacacgctggacggcctgcgcgtcgaatacaaggacggcttcggcctggcccgcgcctccaacaccacgccggtgatcgtgctgcgcttcgaagccgataccgaagaagcgctggaaagaatcaagggcgacttccgccgcgtgctgggcaccgccaccagcgccaagctgccgttctaa

SEQ ID NO: 2373 - DNA, 1029 bp, Chromobacterium substugae
atgatcagcccgcaagtggccctgaaccgtctgatcgacggcaatgaactgttttacgacgaaatgctggacctgatgcgccagatcatgcgcggcgaattgagcccggcccagaccgccgcgatcctgatcggcctgcgggtcaaggtggaatcggtttcggaaatcgccgccgccgccaccgtgatgcgcgaattcgccacccacgtgccggtggccgaccgcgccaacctggtggacacctgcggcaccggcggcgacaagtcgcacacgttcaacatctccaccaccgcggccttcgtcgccgccgctgccggcgcacgcgtcgccaaacatggcggccgctcggtatcgtccagttccggcagcgccgacgtgctggaacagctgggcgtcaatctggccctcagtccggaacaggccggccgctgcatcgacgaaatcggcctgggcttcatgttcgcccccaaccaccacagcgcgatgaagcatgtcgcgccgatacgcaaggaactgggcgcgcgcaccatcttcaacatcctggggccgctgaccaacccggccgatgccgacaagcaactgatgggggtcttccaccccgacctggtgggcatccagtcccgcgtgctcaagcagctgggcagcaagcacgtgatgatcgtgcatggttgcgacggcctggacgaattgacactgtccggccccagcatggtggccgagctgaaaaacggcgagatactggaataccaggtcgagcccggcgaattcggcctgatgcgctgcgaactgaaagacctgcgcgcggacaccgcggaacaatcgcggctgcggctgctgtcggtgttggacggcgagcccggcccggcgcgcgacatcgtgttgttcaatgccggcgcggccatctataccgccgatatcgccccaagcctggccgacggtgttaccatggcgcgcgaagcgttggacagcggcaaggcgcgccagaagctggatcagctggtggcgctcagccggcaattcggcaactga

SEQ ID NO: 2374 - DNA, 390 bp, Chromobacterium substugae
atgcgcatgcggctgacgctggccttagccctgctcgcctcccccgcgtgggcgggcgcgctggacgactgcgcgcaaagcgccgccgatacgccggccgtcgcggcctgcctgcagcagcgccacgccgacgcgcaacgcctgctcgccgcgcaggaggacaaaagcctggcggcgatgcgcaagctggaccgcgccagcgacaaccgcttccacgccgcccgcgccctgctgcgcgcccggcaagcgtaccaaacctaccgccgccagcaatgcgactggctggccgccagctacgccagcggcaacggcgccgaccgcgcccgcctggcctgccagatcgacctggacacgcaaaggctggccgagcttggccgccaaggctcatag

SEQ ID NO: 2375 - DNA, 609 bp, Chromobacterium substugae
atggcaacaaaatccagcgcaatcaaggatttaaccccgatgctgttgatgatagacaactacgactccttcacttacaacctggtgcagtatttcggcgaactgggccaggacgtgagggtgttccgcaacgatgaaatctcgctgcagcagatagaagaactgcagcccaaatacctggtgatctcccccggcccctgcacccccaacgaggccggcgtgtcggtgccggccatcctgcacttcgccggcaagctgcccatcatgggcgtgtgcctgggccaccagggcataggccaggccttcggcggcaaggtgattcacgccaagcagctgatgcacggcaaggtgtcgccagtcagccatctggacaagggcatgttccgcggcctgcccaatccggtcacctgcacccgctaccattcgctggtgatagagcgcgaatcgctgcccgattgcctggaagtcaccgcctggaccgacgacggcgagatcatgggcgtgcgccacaagacgctgccgatcgagggcgtgcagttccatccggaatccatcctcaccgaacacggccaccagatgctggacaatttcctgaaggaattcgcctga

SEQ ID NO: 2376 - DNA, 123 bp, Chromobacterium substugae
atgacgcataagcgcatccatgtcaaacccgaagcagggcctcgccgcttgcggcttccttcccccagaggccggacgccccccgcgccggtaggctgcgcatgccgccgctatccggtatag

SEQ ID NO: 2377 - DNA, 1701 bp, Chromobacterium substugae
atggaaagaacgttcaccgtgctggtggcggaagacgtggaggccacccgccggttgatggggctggtgatcgaggaaatggggcatgcggtgcggtatgccgaaaacggccggcaggcggtggagcagtgccggcggcaattgcccgacatgatattgatggactgcatgatgccggtgatggatgggcaagaagcgatccgtgagatccgccggctttgcggcgaccgctggctgcccatcatcttcctcagcgcccgcagcgatgaagaggcgcacatcagcagcctggacgtgggcgccgacgactatctggtcaagccgatcaacctcaccatgctggccgccaagatccgggtgatgcagcgcatctgcgagatgcaaagccggatttcggccgactcgcaaaaactgctcaactattacaatagcaacgagcgggagcagcgtttcgccaagcacgtgctggacagcatcgtcggcagcgaggagcaggacctgcccggcgtgtgcggctggcaattgtcggccgagcaattcagcggcgacgtgctggcgcgggcgctgtcgccgaccgggcagctgtgcatcatgctggccgacagcaccggccatggcctgtcggcggcgctggcctgcttgccggcggtggacattttctacgcgatggtccggcgcggttttccccttaccgcgatggcgcgcgagatcaacgccaagctgaaccggctgctgccggtggggcgcttcgtcgccgccgccctggtcgccatcgactgggagcaagcccgcatcgaggtgtggaacggcggcatgccctgcgtggtgttcgccgccgatgacggcgcgctgctcaaggagtggaaatcgcagtttccgccgctgggcattttcggcgtggaagacttccgctgggaaagcgaaacctatttctgggagcagagcgggcagctggtgctgtgctccgacggtttgaccgaggcggaagacgcgcaaggccggcaattcggcagccgcggcgtgttgcaagcgctggcgcgggctggagaggacgcgccgctggacgcgatacggctggcggtgctggcgcacttgggcggggtcaagaaccgcgacgacatctccttgggtgtggtgcggctggaggccgacgcgagcatggcggcggagcggggcgccgagccgctggagcgcgacgacggcggcctgctgtccaactggcagatccagctggaattcaacgcggaggaattgcgccgcgatcaggcccttcccatgctgataggctggctgaaccaattgggcctgcgcggcgggcagttcaagcaggtgctgctggtggtcaccgagttgttcaacaatgcgctggaccatggcgtgctgcggctggattcgcaaatcaaggcgaaaccggacggctatgagcgctacttcgtgctgcggcgcgagcgtttgaacggcttgcgcgaaggctgggtggccttgcggatcgagcgccgccgccatgaggggcgggacgggatattcatccgcctgtgcgacagcggcgcgggtttcgatcatgtctcgctgctggagggcttgcgaagggagccgtccgaactgccgagcggccgcggcctgcccttggtgcgggccctgtgccgccagctggttttccatggctgcggcagcgaggtggtggctgaatttcccctttga

SEQ ID NO: 2378 - DNA, 510 bp, Chromobacterium substugae
atgaccccaagcctggaaaaaaacggttacatgctgaccacgctggatagcctgttcggcgccagccagagcaacagcttgtggtatttgtccttcggcctcgcctgttgcgcggtggaaatgatgcacgcggcggcggcgcgctacgacatggaccgctttgggctgattccgcgcgccacgccgcgccaggccgacctgatgatcatcgccggcacgctgaccaacaagatggcgccggccatgcgcaaggtctacgaccagatggcggagccgcgctacgtgctatcgatgggttcttgcgccaacggcggcggctattatcactacagctactcggtggtgcgcggctgcgaccgcatcgtgccggtggatgtctacgtgcctggctgcccgcctaccgccgaggcgctgctttacggcctgatgcagctgcaggccaaagtgaggcgcaacgccaccgccagcggcagggcgctgccgggcgccgccgcgaccgctccgcgctga

SEQ ID NO: 2379 - DNA, 861 bp, Chromobacterium substugae
gtgcgcatccccgccacgcccttccctctgatcggcgtgctgctggctggtcaaagccaggcggaaatcaacggccgcccgctgggctgcacgccccgatgcttcgtcagcggaccgttcagccagccgatagcgatacgcctgtcgcccggcacgcgcttcatcagcgccttgctgcgcaccgggcagctaagcaggctgttcccgctcgattgccagcgcatcgccgatcaaagctggccgcttgaggaactggcgggccgcccggcggcggatgcgctgcatgacgccctgcaagccgcgcgccagccctggcagatggcgcgcattctggaagattggctgcggcggcaggccgcgcgccgcgaggaggccaaagacggcggccccttgctgctgccgccggactggctgttcgccgacagccgcgccctggccgagcgctgcggcctgggcctgcgccaatttgagcgccgcttcctggctagctatggccagtcattgcgcgacacccgccgccaaatgcgtttcgtcagcatgatggggctgctgatctcgcgcccggacgccgccggccagctggccggattggcggcggactgcggctatttcgatcagccgcacatggcgcgcgactttcgcgcgctgtccggcctgacgccgggggatttcctgcgccgcagccatggcgaccgcaacctggaaatgagcctgatccagtatcaggaccacgagctgccgctggtgctgggcgaaggcaaccgcgacattctgctgccgcccgatgtcgtttcggtacaagccggcggcgcccgccatggctacagtggcgccatcgtcgactcggaagccatgccatga

SEQ ID NO: 2380 - DNA, 522 bp, Chromobacterium substugae
atgggcgaggccatcgccgccgaagcgaggtttccaggcattcgacgaggagcgtttatgagcgggcacggatattgggccgcggcgatcgcgctggcggcgatattgagcgtacaggctgcgtcggcagcggatgccgccgcggggcagtgccggacgttgacggatatcgagggccgctatcgttgcgccggcgagtgtgtgacgacggcggcggacggcagccgctccctggtgaaggtgtcgggcgaggaggatgcgatccgccggtttgacggctcccaatggatatatcagatcgacatcaccggctccggcggtttcgccgaaacggagatcggcgggctgagcggccatgtgctgcagacggcgacggcccatgtctcggatcagcaatatccagtgctggaggagtatgccttcgcggcggacgaccattgccgggcgaccggctacgtcaagaccgtgcgcaatccggacccggtggcgctgaaagcatgctcgctggcgtgttcgcgctag

SEQ ID NO: 2381 - DNA, 804 bp, Chromobacterium substugae
atgagcaccaccacgattgaacagctaagccggatagtccagagccaccgcgcttacacccaccccatcttccagcattgggcgcatgccgcgccggatgcggaagcctgcgccgctctattccaccagatccaggccttctgcgccgccacccgccccgggcaagcctttcccggcgcgctggaaatgctgggcttgatcagccaggcgcagttaatggcggaaatcgcgcagtccgaacaaggccacggcgccgacctcgccagaatggccggccatatcgtcaaccgcagcggcgcgcgcccgcgcttcgccgacgtcaatgaccagcagcaagtggaaaccgagctcaaggaggcatcggaccggctgctggccgaccatcccggctatgagcgcccaaccggcctgctgctgcaaacccggcgggccatggcggccttccagcgccgggcccgcagcgacttcgattccacgatgcgcaacctgggcaccgccttcgcgctggaaatcatctccaaccgcgcgttgattccaggggaaaaacaggcgctggtggacaccggccattacggcgtcaggctggaagacccggaaatgcattatctgctggaccactggggcgaatgcggcgcggagagccagcatgagaaccacgtccgcgaggccgtggccgccacgctgaccgcctccaccgcgccgctgatcctggaaggcatgctagacttcctcgatccgttggccgagatgtgggacgtgctggaccaaagcctgctgcacgcctgcgccggccacgcggcgtaa

SEQ ID NO: 2382 - DNA, 735 bp, Chromobacterium substugae
atggaacaccatacataccaccatccgcccggcaccatcgagcacgcggacatgcccgacgaatttcgggaaatcctgattcatcagatgctggccaatggcgagggcgagctcagcgccggcgatacctatgtcgactccttctatcctttggcgcctaacgccgacgaaagatacatttgcgtcaaattcgccgccgaagaagtggatcatttccgccgctttgcccggctgctggccgaaatggggatagacacctcccacatgctccgacaagacaagaaagagcgccgctttttcgccgccgaaagcatgactaccgacttcaacacctgggaagaacgcgcggctttcagctttctttgcgagctggagggccattaccagatcaaggagatggtggacagtccataccggccgctggccatcgaggcccgggagattctcaaggaggaggccatgcacttcgcccacggcgccttgctgatgcgccgggcccgcgaacaggccgactcccgccaccgcgcccagcaggcgctggacaagatgtacccgatggcgctggacatgttcggcaaatccgactcgcggcgcagccggctggcggtgaaatggggcctgagaacgtgcaccaaccatgagctgcgggaggtctaccaacgcgacatcgatcaacacatcgtccggctgggatatcgcgtccccgacgccagcgccggcagaaaatatttctag

SEQ ID NO: 2383 - DNA, 417 bp, Chromobacterium substugae
atgaaacaagacgctccgttgctgctggatgtcgcgcaagccaaaaaaatcctcgccgaatcgcctttcggcccctggtggaatttccaggtcgaggccgtctcgcccggcaaggcgattttgcgcctgccattgaaacccgagcactatcgtcccggcggcgtggcgcaaggtggcagcatgatgacgctggccgatgtggccttctggctggcgctgatgacggtggccggggtagacacgcccgccgtgacgctggagatgaaaaccaatttcctcagagcagcccgcaccgacctaagctgcgaggcggaagtcatgaccgcgggacgccgcatcctgtacggcaccgccaccataacggatagcgaagggaagatcgtttcccatcacacgctgacctatatcaacgcctga

SEQ ID NO: 2384 - DNA, 82 bp, Chromobacterium substugae
gcgagagtggcggaattggtagacgcactggatttaggttccagcgccgcaaggcgtgagagttcgagtctctcctttcgca

SEQ ID NO: 2385 - DNA, 690 bp, Chromobacterium substugae
atgcacccggattttcaaacggcctatcaatcgacccctatggcggacgcccgccataaggtcttgcgcaatacctacggcctgcttggcctgtcgatgatcccgaccgtcatgggcgccatcgtgggcacccatatgagcttcgccttcctggccggcagtcccatcatcggcatgctgctgatcatggcggtgttttacggcctggtgttcgccatcgagaaaaaccgctacagctcggccggcgtgttcctgatgctgggtttcaccttcatgatgggcgtgctgttggggcctctgctgcagttcgcgcttaaattctccaacggcgggcagctgatcatgacggccggcgcagccacgtcgctggtgttcttcgtgatggcgggcatcgcctccaccaccaagcgcgacctgtccggcctgggcaatttcctgaccgtcggcgccatcgtgctgatggtggctgtggtggccaacctgttcctgcgcatgccggcgttccagctgatgatctccgccgccttcgcgctgttcagctcgctgatgatcctatggcaggtgaaggtggtggtggacggcggcgagaacagctacatctccgctgccttgtccatctacatcagcatctacaacctgttcaccagcctgctgcaactgctgctggcttttggcggcaaccgcgactga

SEQ ID NO: 2386 - DNA, 348 bp, Chromobacterium substugae
gtgcaattcagccgcgtcaggcaatttttacgagcccgggcaggcaatttccagatcgagctgttttcatcgccatcgtctagaaacaccatcgccatcagcatcgaagccttcagcgccgacggcgtcttccaggacgcgctggagcgggagatgcaattcagcatgctggacgccgcgttcatgatcgcgcacggcaccagcgaagacttgatgatgatactcggctgctgccagcagcttgcccggagcgccctgtgcgccgcgggcgactgccccggcggctggcccgaccggcaggaagagctgaaatcggtgctgtcgctgccatggagcctggcggtttag

SEQ ID NO: 2387 - DNA, 420 bp, Chromobacterium substugae
gtgctgatcgaacagctcagcggctttctgccactgaagcagctggtagtcagggcattcctgcaccaggaagattgggaactcagcgccagggctctggtcagtgaacaccatgagcaccagcacgaagcgtggcacagccgcgtcatccagcaaaaagacgtcatccaggatttcggctgctactcaagctacatctcccgcccggaaaacacccaatggcatgaaaccattctgcggcaccaatccgaatggcatggctcgctggacatgatacgcctgatcgaatccctgaaaaaaaccaatcccgccatgagcagagacgccgtcagggctgccgaaaccctgctgaacggatggtatcgccaagccagcgaagcgctgcgggacgcaaccggccgacacgcgcaatatgcttag

SEQ ID NO: 2388 - DNA, 387 bp, Chromobacterium substugae
atgtgcacgcaaaacgcacttgaaaattaccgcctgcaatgcctggctatcagaatgctggagcaagccgcgctcgacatggccgtcaagccgcgcaaccccaacgaagccggcatcaccaagcaggagcgctacatgaggaatcaggcagccagccacaagcaagaagcggaaaaatggctgagcgacctgacggaaaaagcgaatggattcaacttcctgctgtgctccgccgtcatcggcgaccacctgaagctgaacaacctgcccaccgatgaaatcgcctcgcagatacgcaaggcggtgctgcaggcgcccagcgagatggcgctggtcttgagcaatctacgcaggaacatgatgaacgaagtcgcccccgcccagtga

SEQ ID NO: 2389 - DNA, 318 bp, Chromobacterium substugae
atgagaaaaattcaagcggtgctcaaggatattgcgcagaagaccttgctgctggccagtctgatcgacgaggcgacccgcgtcggcgtattgagccaggagcaggcggatgatctggtgcagggggtgcgcatccgggggcacttgtcgaacagtctcgaaaccatggcgtactggacggccaaggacctcaatgatcctgcgctggcggaggagttccaggaattggtgatcagcatccgagactttcttgcctgggtggatgagacggtcggcaagctgcaggcggcgctgcatgacgacagcgcggtggcgtga

SEQ ID NO: 2390 - DNA, 510 bp, Chromobacterium substugae
atgtacgatgacggtcgcgtatttctggtggctggatattgggcgaagctgaaaaaggccttcgccgccgcttctgtgtatgtgatcgcggataccgcgacgatcgcatcgagcctggcgaaacgctgcatgccgcaattcctgccggctggcgtgatgagcctcgccgaggttcgccgttatgtcgcctacatgaggcgcattgtttccggcgacgagatttgcctgatgcaggaaggcatctcgcgccagcatggcaagctgcctgatgatcaggtgtttgttgtggtcggtttttccaagaaccattcgccggatcgggatccggtggtgaatttcgttgcggcaaaaggcgaagcggaagcgacgatgctgcagcagagcgcaatgcccagcttgtccgtctccggcgtggccagcttggcgaagctgttggaactgcagtccggaatggagcgagtcgcctccggcgaaatgccggccctgaaagagcaaggtgtcattcggtaa

SEQ ID NO: 2391 - DNA, 609 bp, Chromobacterium substugae
atgcgcgagcgctttgacgagtggaaacggcaggcctttctggatggcgggccgccggcctccatgacggaaagcaatgtcgccaaattctttttgcgcgcggaagcgctcaagcagcaggacgcgctgggcgcgatgccgctgtccacgttgtttccgatgagcagcgcgccgatcaccgccctggacgcggcagcggtgcgccgcgcggcggtcgccggccataccggcctgacccgcgaagtggtggatatggcgatccgtcccgccgacgtcacgccggtggcgcccagggaaatgcagaaaatggcggccagtttgcagcaggcttcccaggccaagccggagggcgtcaacgtggaccgcaatttgctggatttcttccagatgcgcggcaatgccaagtaccgcaaggatttgatgatcaatgtggcgctggaggaggctcacggcgccaagggtttggccgagcgagtcgagcgcaggatgggggcgttgggggaggccgagcaggggttggtcaagcggttgctgaatggcgaatctccggcggatgtgatgaaggatgctcgcgcgccgaagaagcccacatcctcgctggcgatgtag

SEQ ID NO: 2392 - DNA, 600 bp, Chromobacterium substugae
ttgccggacttgtcccggcgcggttttctccggcaggccggcggcgcttttcttgcgctatccggcctgtccgcattgccggaccgctccgatgccgaggcgctggctgtcagagagcaggcgggcaatccgttcgcggccatctgggagcgcccgcgcgaggtggtcatccaccgccaggcaacgggcgagcgccatcgcatcctgttatggcatccgcagcagggctggctgcgcgatggttatgtcgaggcctgcaatctgctgcgggatgtggtggcgggagaggtgaggcagatggatttgggcttgctcaatatgctttacgcgatccagagctggtatctggccaatggcgtctacgagccgctggtggtgacctccggctatcgcaatccggcgcgcaatcgcgggatagaaggcgcggcgaagaattccatgcacacctatggcaaggcggtggacatgcgcgtgcgcgggctcagcactgcccagctgtggcagatgtcggccgccttgcgcgcgggtggggtgggttactatcccggcaaaggtttcgtgcatattgacaccggacgcgttcgttattggcaaggatag

SEQ ID NO: 2393 - DNA, 219 bp, Chromobacterium substugae
atggtggtggaagatgagttgagccagacggatttgcagcagtttttcaaatcgctcaacagcgccgcgcacgatccagatggccgcgcggtttacattcccccagcgacgcccagggccggcgcgcgcgatggcggtctggaggatgaggagatcgccaggctgttcggcgtcggcggcaatcagctgtttatatcggaacagggcgcttccgagtga

SEQ ID NO: 2394 - DNA, 387 bp, Chromobacterium substugae
atgcgttttttcggattcatcatcaaccccttgctagcgccattcaagacgctggcggcgatgcaccgctcgctcatgcctggggcgagggaaagcgggggaagcggctggacccggccggacaatcacgaagccgttcgcgtcaccgccggcaaaacctcgcggctgatctggtactgcaccgcatgctgcccgctgctggcggcgctggccttgttgaaggggctgccttatctgctggcttacaatctgatgatggcggcagccaccggcgtggtgctcgccttgcgctacgcgctgatcgcgcgccagatgcagactggcgacttggcgcagtcacgcatcggcgacgcctttcggcatggctggtggtttcccaaaagctga

SEQ ID NO: 2395 - DNA, 939 bp, Chromobacterium substugae
atgtcgtcgttccgcaatgcggcgaaaagctcgggccagccgaacggcaccccgcttgcgccagcgccttaccgatataggaagaaccacgtgatcaacgttcccatccagtccaacatccatgtcagcaaccagggcgccttcacgctgttcggcggcgtcaacgtgctggagtcgcgcgatctggcgttgcgcagcgccgaagaatacgtccgcgtcaccagcaagctgggcatcccctacgtgttcaaaggcagcttcgacaaggccaatcgctcgtccatccactcctatcgcggccccgggctggaagaaggcatgaaaatcctgcaggcggtcaaagacgccttcggcgtgcccgtcatcaccgacgtgcacgagccctggcaggcggcggcggcggccgaagtggccgatgtgctgcaactgccggccttcctggcccgccaaaccgacctggtggtggcgctggccaaaaccggccgcgtgatcaacatcaagaagccgcaattcatgagcccgccgcaaatccagaacgtggtggagaaattcgtcgaggccggcaacgagcaattgatcctgtgcgaccgcggcacctgcctgggctatgacaatctggtggtggacatgctgggcttcggcgtgatgaagaaagtgaccggcaaccgcccggtgatcttcgacgttacccacgccctgcagcaacgcgaagccggcgccgccgcatccggcggccgccgcgcccaggtggccgaactggcgcgcgccggcatggcggtggggctggccggcctgttcctggaagcgcatccggacccggcgcaagccaagtgcgacggcccgagcgcgctgccgctgcatttgctggaacctttcctcgccgacctcaaggcgctggacgacttgatcaagtcgttctcgcccctgcaggtcgactaa

SEQ ID NO: 2396 - DNA, 984 bp, Chromobacterium substugae
atgattttgaaagaaaaagcgtttaccgaagccaaggattggaaacaggcggccggcgacgccgcggaaaaggaaatggctttttatttgcggcgctattttgccgacgatcaagaggtatacgtcctcaatgatgtgaggctggaattggacggcgacgccgcgcaaatggatcatgtgctgattcatccggcgggattgaccatagtcgaaagcaagagcgtgtcgggtagattgcagatgaaggccgacgggcaatggctgcgctggttcgacgaccgctcctcgggcatggcgtcgcccatcatccaggccaggatgcagtcggaattcttgcgcaaatacctgcgcagccgcaccgcgcagcccgaggtgatagaccgcctggcgatggatgtgatcgtgtccatttccagcaagggccagttcatcccgcccaagggcatcgacgtgccggaggtgtgcaaggcggaccaggtgggcgagcgcatccgcgccaaatcgcaaggcgaggtagcgtttcccgcttcgcaccgccgcatcctgggccagtacctggccaagatgcataagccacgcgccgagccggcgccggtggagtcagccgcccccatgccagcggcagcggtggcgccggcaaagccggaagcgccggcgctgcagcatctggcttacatcggccccttgctgaaaccggccggattgttgcgcagcctgggcggcggagcggcgctgcgcaaggtgtacgccactttgtgcaagggctgccaatcgcagcggctggaattccgttacggcaaattcggttactacctgaaatgcttggattgcggcgaaaacaccgcgatccggctggattgccggcaatgcggcaagcagacccgcctgcgcaagcaggaggaatgcctgttcgtcgaatgcaaggactgcgatctatccgaagtgctgcaccgcaacgaccggccgctgcctgagttggcctga

SEQ ID NO: 2397 - DNA, 705 bp, Chromobacterium substugae
atgagcgacctgtccgccttcccgatcaccggcacatggccggccaagcatcccgaccgcctgcagctgtattcgctgccgacgccaaacggcgtcaaggtttccatcatgctggaggagatcgggctgccttacgaggcgcatctggtcagcttcgagcgcaatgagcagctgtcgccggcattcctgtcgctgaacccgaacaacaagatcccggcgatactcgatcccgatggcccgggcggcaagccgctggcgctgttcgagtccggcgccatcctgatttatctggccgacaagaccggcaagctgctgcccagcgacccggcggcgcgctatgaagccatccagtggctgatgttccagatgggcggagtggggccgatgttcggccagctgggcttcttccacaagttcgcgggcagggaatacgaggacaagcgcccgcgcgaccgctacgccgccgagtcgcgtcgtttgctgcaggtgctggaaggcaggctggacgggcgcgcctggatcatgggcgacgaatacagcatcgccgacatcgccatctggccctgggtgcgcaatctggtgggtttctacgatgcgggcgaactggtcggtttcgccgactttcccaatgtgcgatggacgctgcaggccttcgttgagcggccggcggtggcgcgcgggctggcgattccgaccagggattag

SEQ ID NO: 2398 - DNA, 2883 bp, Chromobacterium substugae
atgactgagaccgcgatcggcgcgcagatccgccggccgctgctgcagggccgccactggatagccgggcaatggctgccggccggccgcttcgacgaggccgcgcggcagcgccgcatcctggccggctggcatgccggcgccagcgcctaccgcttccccgacggcgacctgctgcgctacgccgcgccagtcgagcaactttgcgagcagctggacggctggccgctgcagctgctgggccgcgcgctgtgctccgcgccgctgaccgaagcggaataccagcaactgccgcccgccgacctgtggctggtgaccggcggacgggcgcaagcgctgaacctggccgacgccgaagcgctgcggccgggcgactggctggatgcctccgcctatgccgtcgtcgacatgtacgactgccgccacaccctgccccggcaagtggagcaggcgcccgtcaccgagcagagcctgcgccagttgttgggcggcgcggtgccgccggccagtccgcagcaactgcagtttttgcaggcgctggatcatccgcggcaggaagcctccgcgcagccggcgccgcaaagcccgtggcgcaagcgactgatcgtcgccgcggtcctggccgcctgcgtcggcctgggcgttctcatcgccgcgggcagcgacgcgcccgctccgtcatacgatgccggctcgaatgccggctcatcttccggcggcccttcccatttcttccccttgctcgcgctggcggcgctggcctaccgcttccgcgatcgccgcgccccgccgcgccaagctgcgcccgccaagcccgcaggcaaaccgggcaagggcggcgcgaccgcgcaagcgctgatccccgcccgccgcctggcggcgcaagccatgccgcaagcctggcgcgactggctggcgcgcgcggcgatgaccagccacctatcgcgcgtgctgggccgccgccaggccgcctatatgcgcgagatgctggcgatgttcgaaaccggccgcatcaacgaggctttgcgccatgccattccactgggcggcgacggcgccagcaccggccaggccttcggcacgcccaacgcccgccgcgacctgtcgctgacgccccgccacggcagcgccggcccctccatccagcttggcgacgagctgaaccagcacctgcgccagctctaccgccgcacttttgacaaactcgaccgtgaaggaaagatcgaccaggcggtgttcgtgctggccgaactgctgcaagcccacgccgaagcactggactatctggaaagacacgaacgcttcagccaggcggcggaactggcgctggcctgggacatgccggcagcgctgatcgtgcggctgatgtgcaaggccggagacctgccgcgcgccttggccgtggccaggcgcgaccacgcctttgcccacgccatcccgcaactggaaagccgctggcccgaagccacgcgccagttgcgcgaggaatgggcgcaatcgctggtggagcaaggacgctggctggaagccgcgcaagcgatctggccgctcgcgtcgcaacgcgagcgcgccgcgcagtggctggcgcaggcggaagaggccgggggcaacttggcggcggaggccctggtgcagcgcgcgctgctgctaccggacaccctgcgccggcatgaaagccggatactggcgatacgcgatggcgaaaaccaggccgccgaacgcgcggccatcgcccatgccctgctggccgccggccagcacaccccggccagccggctgctcgcccgcgccatgttcaaccattggctggtcgaccaggacaaccgtgaaggccggctcagccgccgccaactgcaaacactgctcaacatcagccaggatgggctgctgcaggcggacctgcccggaaagctgcccgctcctctccccaatccgctgcaaaatcagaaagaagtcggctggctgcgggcgccgacgctggccggcctggccatcatggacgccgccctgctggccaacggccgtctgctggtcgcgctgggagaagcgggcgcggccatcgtcgatccgcgcggcaaaatcgcgcaccgcttcccagcccccgcggacagcatcgtgctggcggacagcggccaggtagcgctggcggtgatctggcgcggcgacgcgttgcgcgtgcaccggctggacctggcgcggcgcgagcagcaggacctgggcgcggtggcgctggattgctatgcggacagtttcgacggcgtgggctgggcggtaggacaggacaggcaaatccgcgtgctggatgtggcccgcggcctgcacagcgtgctatggcaagtgggcgacctgccgggccgggtggcgcgcgtgatgcgcagcccgaactgcgagcactatgagctggcgggcgacgacggcaagatgcagctgtggcaatacagcctgccgggccggcgcctgcagtcgcgcggccacatccccgtgcacgagagcgcgaaaaatgcgacggtgatcccctcgccctggggcagctaccgctactgctggctggcggcggacaagaacggccatccatggctgggcaaccatccaccgggccagaaggaaagcttcctcgcgctgccgcctgacatggcgggcggctcgctcaacgtcacgctcggccgcggttggttggctgtggcgatgagccgggaagccgcggtgtgcacgctgctggcccgcgccggcgccgacgctcccgacatcgccttcagctggccggcgggttccaaagtgcaactgaagatgcagaacgacagctggctgatgttcgaccggcagggccgcattgtcaccatggacatggagcgctgcagcatatccatgctgactgtctcctga

SEQ ID NO: 2399 - DNA, 1875 bp, Chromobacterium substugae
atgcaactacccgacgcgctcaaaccctggcacgactgcctgagcggcttttccgccgagctcgcccccgaagtgggcgaactgctgcgccgcctcagcccggcgctgggccgcttccaggccgccatccgcggcgatgacgaagcgccgcaaggcgtggacgcgctccagcgccgcggcccatacgaacgcctgctggcttcggaatggctgctggccgacgaattgccggacgaattcctgcgccgcgccgccggcaacgaactcctgttcctcgcgcccaccccgcgcgaaagccgcgccagcagccgcattctggcgctgttccactgcggcaatctgcagcttggcgccgcccggctcgcccacctggcgctgtgcatcctgctggagcgccgcgccagcgccgccggcggcgacttcgcctggggcagcctgcaagcgcccggcgagtggcgcgaaggcgcgcaaacccacgccttgcgccaattgctggcgacccgcagctaccgcaatttcaaccaggaatgcagccagcaatggctggcggcactggaccagctggaaacccgccccggagagtgctggctgataggctatccgctgccggacaaggggctggccgcctccgccttcacccatcaagtcgacatccgccccacgctagacggcgacgcgctcgacatcgtggtgcgcgatcgcgcaggccagcgcaagctgaccctgccgctgccgccacaagccgccggccgggcgctgctggccggcaatttcgacacccagaccgaagcccggcaactggccggccgcttctcgctgcgccacgccccgctgctgtcgccggatggcagccacgtcgccgccttcctgctgggagaaaaagaaaccctgctgctgcatgtgccgaaacccggccgctcgtcgcggcagaagccgcgccgcgtgcagtggagcagcgccggcagcgcgcttggcctggccttcacccgcaagaccgtaggcgcggtcgcgcaactgggcgacacgctggccttcagccagctccccggcctgggcaaagtgcagctgccgccgcaggacatgctgcaactggcgcccggcgccgcccgcctgctggatgcggcctggctgcaacacgacaactgcgccaggctttacgcccgcgaccgcgtcggcaacctggtgttctgggtggcgcccggcaaacgcggcgtgcacagcggcccggcgccaggcaccacccatctgcagctgcgcgaagtgctggcaatgtgccagcaagatgcgcgcacgctgctgtacgttcgccatcaagccggccagctgcggctgggacgcctctgggcggaaccgccctccggctccactcgtcccgctgcggcgtcgagtcgccagggccctctggggccgctggacaatgaatggacagtgcccggcgcctgcgccgccgacagcgaagcgctgctgggcttcgctcagcccaatctgttcgcctgcgccgtccgccagccatccgccttgggcgaatgctggcggctgcacgccggccggccccatgccgccgcggccagcatcgactaccaactgccgcccggttggagcgcgctgggcctggtgcctcgcgcagatgcgtccaccgccttccagctggtgctgttccataaggcgcaaaaccaattgggcctgctctgcgacgggcgaatcctcatcctgtaccagcccatccatcccatcgccaaaatcagctacgcgccggccagcgccgccatcgcactgctgaccgagcaaagagaattgatcgtgtattccgtgaccgaacaatgcgtggccctgcgcctgcaaggccaggccgcgccgggagagcagcatgactga

SEQ ID NO: 2400 - DNA, 393 bp, Chromobacterium substugae
ttgccgccccaggccgccgtcgccttcgacgccgccgcccaacgcctgctgctgcgcctggagcgcatgtcggacgagcggcgcgcgccgctgatggccaccgctggccccggcctgctggtggtcatcggccccgaacacgcgctgccctgggtggatggcgtggaatacgcgcgcgccgacgccgacttcagccggctatggctgccggccctgtggcagcctgacgcgcccagcgaagcgctggcgcaggcgctgcaccgccgcagcccgcattggccgcaattgctgtggcgcgagcccgcccggctgattccgctgaatcggcagctgccggtcagcgccgagctgctggccgacatccgccgccaatggcggctcgcccccgcctga

SEQ ID NO: 2401 - DNA, 1131 bp, Chromobacterium substugae
ttgaatgtcaacatcatgaaatctccgtcgcaacaggccgccacacaggtgcgcgccggcatccgcaccgcaacccgtggcctggtcggcagagaccagctggccgaactgatcatgctggccgcagtggcgcaggaacacctgctggtggtcggcccgccgggcaccgccaagagcgccgtggtccgccgggtggcgcaaggcatgggcggccgctatttcgagtacctgttgggccgcttcaccgagccttccgaattattcggcccggtagatctgcgcaagctgcgcgaaggcacggtggaaaccgacaccgccggcatgctgccggaagccgacgtggtcttcctggacgagatcttcctcggctccaccgccatcctcaacaccctgctgggcgtattgaacgagcgccgtttccgccgcggccatacccagatgcgctgcccgctgcgagtgtgcgtcggcgccgccaacgcgctgccagacgacccggcgctggccgccttcggcgaccgcttcctgctgcacaccttcgtcgagccggtggccgaccatcagctggaagacctgctggccggcggctggcaggctgaggacgccgcgccggaaagcgcgatgcgtctggccgacctggatacgctgtgcgcggcggtcaagggcgtgcggatggatgcggtccgtcccttgctggccgacgccatccgccagttgcgcggcgccggcatttcgctgtccgaccgccgcatcgtcaaatcgcagcgtttgatcgccgccgccgcggcgctggccggccgcgacgaggccggcgaagccgacctgtggccgctgctgtacgtgctgcccacccaggaggcccagcaaaccgcccgcgagacgctgcgcgagcgcctggccgccagcgccaatcccacgctggccagcgcggtggaaaccgccgccgtgcagccgctgtcgcgcgtcgcccgcttgctggagtcggccgaggcctgcctggccgaccctgacggcggcgccgcggtcgaagccctgctgcgcgagatagacgccaacttcgacgccgccagcctgccggaaacgctggccaacgccagacaggagctggccgcgcgcctgacggtggccgcatga

SEQ ID NO: 2402 - DNA, 996 bp, Chromobacterium substugae
atggcagtcttgctggccggcctggctttttcttccgcggcggccatggcggctccggtggcgctggcgtattactcggactatccgggcaattacgcggcgttgacccggtactatgagaatttcaacgcggtgtcggtcgacttctacaatatcgccagcgacggcgcgatttccggcaacggcgcggcgccgccgacccaggcgctgtcctttctgcggtcccgcaaaatccccgcttacggctgcgtttccaatgtcgatggcgactggagtccggacatcgcccacgcggtgtccaccaccgcgctgaaccagtcggtggccaacttggtgaagtttgcccaggccaacggctttgccggcatcaatatcgatttcgaggcggtggcgcagggcgaccgcaaccatttcagccacttcattcaaacgctgggccgcgcgttgcatgccaagggtttgaagctgatcgtcagcgtgccggcgttttccgccaaggattacgacgaccaggccaattacggctacgacctgcaggcattgggcgcggcggccgactatctgcagatcatgacttacgacgaggcgattccggcctgggatccgggcccggtggcaggttccggctggatggaggatgacctggactacgcgacgtcgctggtgccggccgccaagatactgagcggcattccagtctacggctacgactggaagcgggctggcgacggcggcatgctgtactggaaggacacgcaggcgctgattgcccgctacggcgcgcagccgcgttacgacgcgggcagcaactcgctgaccttcagttatgccgcggccgacggcagccgccacacggtttggaccgaaaatgcccgcagcgtggcgctgaaggccggcttggtgaacgcctacggcttgggcggcgtttccacctacgcgctgggcatggagaatgccgctttctgggcggcggtgaggcagggcctgtcgcagtag

SEQ ID NO: 2403 - DNA, 1449 bp, Chromobacterium substugae
atgacgaaaacaacaatatcgattcaacgcgcgctgtgcgccgcgctgtgcgccgccgcgctggccggctgcgccgtcggccccgactacgccaaacccaagctggacatcccggccagcttcaaggaggacggccgctggaaaaccgccgaaccgcaggacgcgatgccgcgcggcgactggtggtcggtattccatgaccagacgctcaacggcctgatggacacgctgaaccggcaaagcccgaccatcgcccaggccgaggcccaataccgcgaggcccaggcgcaactgcgccaggctcaggcgggcctgttcccgtccctgtcggccaacgccgccaaaacccgcggcgtctccacgccgggcggcggcgccgccaccgcctacaacctgggcctgtcggccagctgggaagtggacctgtggggcgcggtgcggcgcgaagtggaagccggcaaggccaagcagcaggcctccgaggcccaactggcggccatccgcctcagcagccaggcgcagctcgccaccgcctacctgcagctggcggtggccgacgcccaactggccaatctgcgcgccagcgaaaaactgctggccgacaccttgcagctgacgcgcaaccagtacgccgcaggcatcgtcggcgacgacgcggtagcctcggcggaaagccaatggaaaacctcgcaggccgcgacggtggacaagcagctcacccgcgcgcagctggagcacgccatcgccgcacaactgggccaggcgccggccagcttcgcgctgccgccggccgcccaggcgccctacctgccgcagatcccggccggcctgccgtccactctgctggagcgccggcccgacatcgccgccgccgagcgcaatatggccgccgccaacgcccagatcggcatcgccaaagccgccttcttccccaccctgtcgctgggcgccagcggcggctaccgcggctccagcttcgccgactgggtcagcctgcccaaccgcatctggtcggtcggcccctctctggcgctgaccctgttcgactccggcctgcgcagcgcgcaaaccgaccaggcggtggccagctacgacgccagcgtggccagctaccgccagaccgtgctgtccgcgctgcaaggcgtggaggacaatctgtccgcccagagcttgctggagcaggaagccggcatgcaaagcgcggcgctggccgcggccaagcgggcggaagcgatcagcctgaatcagtaccaggccggcaccgtggcctatctgaacgtgctgtcggcgcaaaacacccgcatcaacgccgaaaacaatctgtggagcgtgaaaaaccggcaatacgccagcagcgtggccttgatcgccgcgctgggcggcagttgggccccgccgcgctcacacgaaaaaaaccgggcctgcgcccggttttttcatcccccttag

SEQ ID NO: 2404 - DNA, 3105 bp, Chromobacterium substugae
atgatcccgtcggcccccttcatccgccgcccggtggccaccacgctgctgacgctggccatcctgctggccggcatgctggccttcaagctgttgccggtgtcgccgctgccgcaggtggacttccccaccatctcggtgtcggccaagctgcccggcgccagcccggaaaccatggccgccacggtggccacgccgctggagcgcgcgctgggccgcatcgccggcatcaccgagatgacgtcgaccagctcgctcggctccagcaacatcacgctgcagttcgacctggaccgcgacatcaacggcgccgcgcgcgacgtgcaggcggccatcaacgccgcccattcgctgctgcccaccggcatgccgtccaatcccacctaccgcaaggtgaacccggccgacgcgcccatcatgatcctggcgctgacgtcggattcgctgactcgcggccagatgtacgacgccgccgactccatcctgggccagaagctgtcgcaggtagacggcataggcaacgtggtgatcggcggcggggcgcagccggcggtgcgggtggaaatgaacccgatgcagctgaaccactacggcatcggcatggaaaccgtgcgtgccgccatcaccagcaccaatgccaatcgccccaaaggctttctcgaaaacgaggacaagcactggcaggtgcaggccaacgaccaggccggcaaggccagcgactacctgccgctgatcgtcagctacaaaaacggcagcgcggtgcgcatctccgacgtcgccgatgtgaaggactcggtggtggatctgcgcaacgctggcatgctggccaagcagccggcggtgatgctgatcctgttccgccagcccggcgccaacatcatcgacaccgtggaccgggtgaagacgctgctgcccaagctgcaggcctccatccccgccgcgatcaagatcaacgaagtaatggaccgcacacccaccatccgcgcctcactcagcgaagtggagcgctcgctggtgatctccatcggcctggtgatcctggtggtgttcctgttcctgcgcagcggccgcgccaccgccatcccggccatcaccgtgccggtgtcgctggtcggcaccttcgcggtgatgtacctggccggcttctcgctgaacaacctcagcctgatggcgctgaccatcgccaccggcttcgtggtggatgacaccatcgtggtgctggaaaacatctcgcgccacatcgaggatggcatgaagccgttccaggcggcgctgcaaggcgcgcgcgaggtgggcttcaccgtgttatcgatgagcatctcgctgatcgcggtgttcatccccattctgctgatgggcggcatcatcggccggctgttccgcgaattcgccgtcacgctgtcggtggccatcctggtgtcgctggtggtgtcgctgaccaccacgccgatgctgtgcgcacgctggctgaaaaaccatgacgccagccgcccgcccggccgcctgttccagtggagcgagaaggtgttcgacgccatgctggacgcctaccgccgctcgctgacctgggcgctgcgccacagccggctgatgatggccattctcgccgccaccatcgcgctcaacgtgtttctgtacgtggtgatcgccaagggcttcttcccgcagcaggacaccggccgcctcaccggcatgatcaaggccgaccagagcatctccttccaggcgatgcagctgaagctgcagcgcttcatcaacgtggtcggcgccgatccggcggtggacaaggtggtgggcttcaccggcggcggccagcgcaacggcgccaatatgttcgtcagcctgaagccattgtccgaacgcaaggaaaacgccgaccaggtgatcgcgcggctgcgcaagaagctggccaaggagccaggcgcccagctgttcctgcaatcggtgcaggatatccgcatcggcggccgcgccagcaacgcgcagtaccagtacacgctgcagggcgacgacctgaacgagctgcgcgaatggacgcccaaggtgcagctggcgatgagcaagatccccttcctcgccgatctgaacagcgaccaggaggtcaagggcttgcaaacctcgctggtcttcgaccgcgacgcgatggcgcggctggggctgacccagtcgcaggtggattcggtattgaacgacgccttcggccagcgccaggtgtccaccatctacaacgcgctgaaccagtaccacgtggtgctggaagtggcgccggagtactggcaaaacccggaagcgctgcgcaacatctacctgcagacgccgggcggccagccgacgccgctgtcggccttcgccagctggaaaccgaccaacacctcgctgtcggtcaaccaccaaagccagttcgccgccaccaccatctcgttcaacctgccgccgggcatctcgctgtccgacgccaccaaggcgatagacgcggcgctggccgacaccggcctgcccagcagcatccacgccagcttccagggcacggccaagtcgttccaggcctcgctggacagccagcccatgctgatcctggccgcgctggtggcggtgtacatcgtgctgggcatgctgtacgagagcgtggtgcatccgatcaccatcctctccaccctgccctccgccggcgtcggcgcgctgctggcgctgatggccaccggcggcgaattcaacatcatcgcgctgatcggcattctgctgttgatcggcatcgtcaagaaaaacgccatcatgatgatagacttcgcgctctccgccgagcgcgagcacaagctgccgccggaggaagccattctgcaagcctgcctgctgcgcttccgccccatcatgatgaccacgctggcggcgctgttcggcgcgctgccgctggcgctgggccgcggcgacggcgccgagatgcgcacgccgctgggcatctccatcgtcggcggcctgctgctcagccagctcttgacgctgtacaccacccccatcgtttacctgtacctggaccgcttccgcctgtggtgcctgaaatggcgcggcagcctcggcaacgcgctggccggcggcggcaaggaatga

SEQ ID NO: 2405 - DNA, 3102 bp, Chromobacterium substugae
atgaatccctctcgcccgttcatcctgcggccggtggccaccaccctgttgatggtggccatcctgctgaccggcctggtttcctggcgcatgctgccggtttcggcgctgcctgaagtcgactaccccaccatccaggtggtcaccctctaccccggcgccagcccggacgtgatgacctcgtcggtcaccgcgccgctggagcggcagttcggccagatgccgggcctgtcccaaatgtcgtcggccagctccggcggcgcttcggtgatcacgctgcagttcagcctggatttgacgctggatgtggccgagcaggaagtgcaggcggccatcaacgccgccggcaacctgctgccggccgacctgcccagcccgccgatctacaacaaggtcaatccggccgacacgccgatactgaccatcgccgtcagctcgcccaccctgccgctgaccaagctggaggacatggtggacacccggctggcgcagaagctgtcgcaagtgccgggcgtgggcctggtcagcatcagcggcggccagcggcccgccgtacgcatccagagcaatcccaaggcgctggccgcgcgcggcctgacccaggaagacatccgcaccgccatcgccaacgccaacgtcaaccaggccaagggcagcttcgacggcccgctgcaggcgtccaccgtcgacggcaacgaccagctgcaatcggcggcggaatacaaaaacgtcgtcatcgcctaccagaacggcgcgccggtgcgcgtgcaagacgtggccaaggtggtggactcggcggaaaacgtgcgcctggccgcctgggccggcgctacgccggccgtcattctcaacgtgcagcgccagcccggcgccaacgtgatccaggtgaccgaccgcatcaaggcgctgctgccgcaactgaaaaccaccctgcccggctcggtcgacgtggcggtgctgagcgaccgcaccgtcaccatccgcgcctcggtcgaggatgtggagttcgaactgatgctggcgatcgcgctggtggtgatggtgatcttcgtcttcctgcgcaatgtgccggccaccatcatcccggcggtggcggtgccgctgtcgctggtgggcactttcggcgtgatgtacctgaccggcttctccatcaataacctgacgctgatggcgctgaccatcgccaccggcttcgtggtggacgacgccatcgtgatgatcgagaacatcgcccgctacatcgaagaaggcgaaaagccgatggcggcggcgctgaagggctccaagcagatcggcttcaccatcatctcgctgaccatctcgctgatcgccgtgctgattccgctgctgttcatgggcgacgtggtgggccgtctgttccgcgagttcgccatcacgctggcggtgtccatcctgatttcggccttcatttcgctgacgctgacgccgatgatgtgcgcgcgcctgctcaagcacgtgcctgaggaaaaacagggccgcttctaccacgccagcggcaagttcttcgacgacatcatcgcccgctacggcaagatgctgtcctgggtgctggaccgccagaaaaccacgctcttggtggccatcggcaccgtcgcgctgaccgcggcgctgtatgtctgggtgcccaagggcttcttcccgctgcaggacaccggttccatccagggcatcagcgaggcttcgcaatccatctccttcagcgcgatggccgatcgccaggaaaaactggcctcggcgctattgaaagacccggcggtggacagcctgtcgtcgttcatcggcgtggacggcaccaacaccacgctgaacagcggccgcctgctgatcaacctcaagcccaagggcgagcgcgacgacatccgcaccgtgctcgcgcggctgcaagcccgcgccgatgaaatgccgggcatgtcgctgtacctgcaggcagtgcaggacctgaccatagacgcgcgcgtcagccgcacccagtaccagttcacgctgcaagccaccagccagggcgacctgtccgcctgggtgcccaagctggtgcaccggctgcaacaggagccatcgctggccgacgtggcgagcgacctgcaggacaagggcctgcaagcctacgtcaacatcaaccgcgacaccgcctcgcgcctgggcgtcaccaccgccgcggtcgacaacgcgctgtacgacgccttcggccagcggctgatttccaccatcttcacccagaccaaccagtaccgcgtggtgctggaagtggacccgcagcaccagcgcgacccgctgtcgctgaaaggcatctatgtgcccaccgccagcggcgggccggtgccgctggacgcggtggcgacgatagaggaacgcccggcttcgctggccatcaaccacctgggccagttccccaccgccaccatttccttcaatctgaagcagggcgcgtcgctgggcgaggcggtggacgccatccgccaggccgaggccgacctgggactgccggccagcatggacaccaagttccaaggcgcggccatggccttccaggcgtcgctgtccaacacgctgtggctgatcctggccgccatcgtcacgatgtacatcgtgctgggcgtgctgtacgaaagctatatccacccgatcaccatcctctccactctgccctcggccggcatcggcgcgttgttggcgctgatggtgtccggcaccgacctgtcggtgatcgccatcatcggcatcattttgctgatcggcatcgtgaagaagaacgcgatcatgatgatcgacttcgcgctcgaagccgagcgcgaacagggcatgagcccgcgcgaagcgatctaccaggcctgcctgctgcgcttccgccccatcctgatgacgacgatggcggcgctcttgggcgcgctgccgctgatgctgggcggcggcatgggttcggaactgcgcgagcccttgggcatcaccatggtgggcggcctgatggtcagccaggtgctgacgctgttcaccaccccggtgatctacctggccttcgaccgcctggcgagccgtttcggccgcaaggacaagccgcagccggctgaagaggcgcaagcatga

SEQ ID NO: 2406 - DNA, 1251 bp, Chromobacterium substugae
atgtcgacccccacgtccgccaaatccaaccgcctgcctttagtcatcgcagccatcgccgtcatcggcggcggctggtggtggcaccagcacagcaagagcgccaaggatgccgccgccaacgccaagggcggcgcgccgatggcggtgggcgtgaccgccgcgcggacgctggacgccccgctgcagctgaacgcgctgggcacggtcaactccacgtataccgtcaccgtccgcagccgggtggacggccagctggacaaggtgcacttcgaagaaggccaattggtcaagcagggccagttgctggccgaactggacccacgaccctatctcgcggcgctgacccaggcccagggccagttgctgcgcgatcaggcgctgctgcagaacgcccagctggacctggcccgctaccgccagttgctggggcagaactccatctccaagcaacaggtagacacccaggacgcgctggtcaaacaatatcagggcacggtcaagctggaccagggctcggtggataacgccaagctgcagctggactacagccgcgtcaccgcgccggtggccggccgcgtcggcctgcgccaggtggatccgggcaatatcgtgcacgccagcgacgccaacggcgtggtggtgatcacccagacccagccgatcaatgtggtgttcgccatcccggaagtgagcctgtcgcaggtgttgcaggccgccgctgacaacaagcagctgaaagtggaagcctgggaccgcgacaacaagcacaagctggccgacggcgtcctgctggcgatggacaaccaactgaacaccagcaccggcaccatcaatatcaaggccaagttcgccaacgaaaaacaggcgctgttccccaatcagttcgtcaacgtcaacttgcagctgggcgtgcgcaagaacgccatcgtggtgccgaccgccgcggtgcagctgggcaaggcgggcagctatgtctacaccgtaggcagcgactccaccgtcagcatcagcaaggtcgcggtgggcccggcctccggcgacgtcaccatcatcgaatccggcctgcgcgccggccagcaggtggtgatagacggcgtggacaagctgcgcaacggcgccaaggtcaaggtgatagaccgcgccgcgcaaagccaggaagccgccgcggcggccagcgaaggcaagccgcaccgcaagcacggcgccagcggagactggggcaagcgtcacgcctcggccgccaactaa

SEQ ID NO: 2407 - DNA, 378 bp, Chromobacterium substugae
atgttctgccgcgcgggattgccccgcgccgccctggcggatcgccgggcccgaataatcaaagcggaaaagaatgacatcgttcgttcgcattgcctagcccggatgaggcaaaatatgcaaaaaacgaaaatgtcatgttcgcaaaagaaacaaactcgcccgtcacacccgctgtggcccttgcatccagctcatgccgtaccgcgccggcgacaattccgcctcacagccgctgccctccccgttccagccatctcccaggcgcggcggcgcaaccaattttgggagcggctccgcccctccgcacgcatttcttggccttgcggaacagcgccatacgcaatggacaaacctcggcgcgtccatgaaatgtaa

SEQ ID NO: 2408 - DNA, 1533 bp, Chromobacterium substugae
ttggatatggacaagaaacaagacgcgccggaactgcggcgttcgctgcaggcgcgccatctgtcgatgatcgccatcggcggctccatcggcaccggcctgttcctggcatcgggcgccacggtggccggcgccggcgccggcggggctttgctggcgtacgcgctggtgggcctgatggtgtacttcctgatgaccagcttgggcgagatggcagccttcatgccggtgtcgggttccttccaggtatacggttcgcgcttcgtcgaccccgccttcggcttcgcccaaggctggaactactggtacaactgggcggtgaccatcgcggtggagctggccgcggccgccatcatcatgcactactggtacccggcggtgcccggcgtggtgtggagcgcgggctttctggtgctgatcttcgcgctcaactatttctcggtgaagggcttcggcgaagcggagttctggtgctcgatgctgaaagtggccaccatcatcgccttcatcgtcatcggctttctgatgatcttcggcatcatgaccgaaccgcagccgcagcgcatcgcgcccggcctcggcgtgatgatgcagggccaagggcccttcgtcggcggcctggcggcctttgtcggcgtggccatggtggtgggcttctccttccagggcaccgagctgatcggcgtggccgccggcgagtccgccaatccgggccgcaccattccgcgcgcggtgcggcagatcttctggcgcatcctgatgttctacatgctgtccatcctgatcatcggtctgatcctgccttacaacgatccgctgctgttgaagaacgagatgaaggatgtcggcgccagcccgttcacgctggtgttcaaccgcgccggcctggccttcgccgccagcctgatgaacgcggtgatcctgtccgccatcttgtccgccggcaactccggcatgtacgcgtccacccgcatgctgtacgcgatggccaagaacggcatggcgccggcccgcttcggcaagctgaccgccgacggcgtgccgcgcaacgcgctgtacgccaccacgctggtggcctgcttgtgcttcctgacttcgctgttcgacagcaacgcggtatacatgtggctgctcaattcgtcgggcatgaccggcttcatcgcctggctgggcgtggccatcagccattaccgcttccgccgcgcctatgtgcggcagggctatgacctggccgatctgccgtataaggccaaatggttcccgctggggccgctgttcgccttcgccttgtgcatgctgatcatgctgggccagaactacaccgccttcaccgccgccaaggtggactggaacggcgtggtggccacttatgtcggcattccgctgttcctggcgctgtggtggggctaccgggtcaagcacaagacccgcctggtgccgctggagcaggttgacctggccgacgcccaccgcaaggcgcgggagctgcgcgaggaaggccgcggcggcaaattggctgaggctcaagcctga

SEQ ID NO: 2409 - DNA, 510 bp, Chromobacterium substugae
atgacgcctcaacaaatcgtaggcatggcggccaggctgttcgcgctgtggctggtggtgatttccttccagtcgcttggcattgccagctttctgggcgggcggcccgacagcggcgctgcggcgccattgctgtatgtgatgccgctgttgcctttgctgctggccgcttttctttggtttttcccgatgttcatcgcgcacaagctggtgccgcgcacgcatgaagccaatgcgctgaagatccccgggcgggagttgctggcggccggggcggcgattctgggcttgtgggcgctgctgcgcgccttgccgcaattgctcgcggtactgggtttgctgattgccgccgatcggccggcgctgggtttttacttcactccggaccgccgtctggatctgttgagctgcctgctggaagcggcgttcgggatattcttggtggcgcggccctggtgggtggcgcggcggatcctgccggaaggggcgccgcggacggatgcgcgatag

SEQ ID NO: 2410 - DNA, 702 bp, Chromobacterium substugae
atgccgttgctgtccatcttcctgaccaaatttctgttcgtgatggcggcgctgctgcccatcatgaatccgccgggcctggtgcccatcttcatctcgatgacggcgcgcaacacgccgcagcagcgccgctacctggcgcggcgcatcgcgctgtattgcgccttgctgctggtgggcagcatgtatgtcggcggctatgtgctgtcgtttttcggggtgtcgctgccggtggtgcagatgtccggcggcttgctgatcaccttcgccgcctggcgcatgttgaacgacacgccggccgaggccagccagccgtcgaccgagccgtcgcgcggcgacagccaggccgagctcaagcagcgcgccttttacccgctgactttcccgctgacggtggggccgggctccatctcggtcgccatcaccatcggcgccacgctcaccggcagcggcaagggcatcgtccgttacgcggtggcgccgctggcgggctccgccgccatcctggcctgcagcgtgctggtgtatctgtgctacagccacgccgacaagctgctgcgctacctgggccagaccggctcggtggtgtttctgcggctgtcggccttcattctgctgtgcctgggggtgcagatcatgtgggacggcttcggcgagctggcggcgcaatggctgcgcgacaatgccgccagcttccactga

SEQ ID NO: 2411 - DNA, 1134 bp, Chromobacterium substugae
atgagcaccagcgctttcttcatcccctcgctcaacctgatgggcgccggctgtctgcggcaggcgatagacgccatgcgcggccacggcttccgccgggcgctgatcgtcaccgaccagggcctggtcaaggccgggctggccggcaaggtggtggacatgctggctgcggcggatatcgagccgacggtcttcgacggcgtgcatcccaatcccagctgcgccaacgtcaatgccggcctggccttgctcaaggaaaaacgctgcgacgtggtggtgtcgctgggcggcggctcgccgcacgactgcgccaaggccatcgcgctggtggcggtgaatggcggcaagatccaggactacgagggcgtggacaagtcggccaagccgcaactgccgctggtggcgatcaacaccaccgccggtaccgcgtccgaaatgacgcgcttttgcatcatcaccgacgagtcgcgccatatcaagatggccatcgtcgacaagcacaccacgccgattctgtcggtcaacgatccggaaaccatggccggcatgccggccgcgctgaccgccgccaccggcatggacgcgctgacccacgcggtggaggcctatgtgtccaccatcgccacccccatcaccgatgcctgcgccttgaaggcggtggagctgatcgccggtttcctgcgccgcgcggtgaaggatggcaaggacatggaagcgcgtgagcagatggcttacgcgcaattcctggccggcatggccttcaataacgcgtccttggggtatgtgcacgcgatggcgcaccagctgggcggtttctacgacttgccgcacggcgtgtgcaacgcggtgctgctgccgcatgtgcaggctttcaatgccgaggcggccggaggccggctgggcgatgtggccgtcgcgctgggcgaggaggcgcgcagtccggaagccgccatcgcggcgataaggcggctggcggccgatgtcggcatcccggccgggctggcgcaattgggcgtgaaggacgctgatattccgttattggcgggcaatgcgctgaacgacgcctgcggtttgaccaatccgcgcaaggccagccacgaagaaatctgcgcgatcttccgcgccgcgctgtag

SEQ ID NO: 2412 - DNA, 1182 bp, Chromobacterium substugae
atgtccgacctgcaaccatcctccctgcacccggaaacgcaggccattcgagccggccgcaccgtcagtgaattcggcgaacacagccaggccctgtatctgacctccagcttcacctacgagtccgcggcccaggccgccgcgatgttcctgggcgaagtggagggctacacctattcccgtttcaccaaccccaccgtggcggctttccagcagcggctggcggcgatggagggcggcgagcgcgccatcgccaccgccaccggcatggcggcgatccaggcgatcatgatgacgctgctgaaggcgggcgaccacatcgtatcgtcgcaaagcctgttcggctccaccaccaatctgttcgccggccagctgtcgaaattcggcgtggccacccgtttcgtcgacgccagggatctggccgcctggcgcgcggcgatcacgccggaaacccggctgttgttcctggagacaccgtccaatccgctgaccgaggtggccgacgtggccgccatcgccgccatcgcccatgagcatggcgcgctgctggtggtggataacagtttctgttcgccggcgctgcagcagccgctggcgctgggcgccgacctggtgatgcattcggccaccaaattcctcgatggccatggccgggtgatgggcggcgcggtggtgggcagcgacgcgctgatcgaacaaatctatctgcatgtgcgcgcggccgggccgtcgctgtcgccgttcaacgcctggacgctgttgtcgggcatggaaaccctgcacctgcggatggaaaagcacagcgccaacgcgctggagctggcgcgctggctggagagcctgccgcaggtggagcgggtgtactaccccgggctggaaagccatccgcagcatgaattggcgcggcgccagcaaaaaagcggcggcgcggtggtgtccttcgtggtgaagggcggccgcgaggcggcctggcgggtggtcgatgccgcgcaggtgatctcccgcaccgccaatctgggggatgtgaagtccaccatcacccacccggccagcaccacgcacgcgcgggtcagccaggaggcgcgcgaccgggcgggcatcgtcgaagggctgttgcgcgtcagcgtcggtctggaaaatgtggccgaccttaaacaagatctgttgcgaggccttgactaa

SEQ ID NO: 2413 - DNA, 690 bp, Chromobacterium substugae
atgagcaagactaaaccacaagcaaatacaataaaggcactggagaacatggaggcaagccgtcccgacaccgctacccgcattctggatgttgcagaacgtctgttcgtggagcacggtttcgaggcgacttcgctgcgcatgatcacccagcaggccgaggtgaatctggccgcggtgaactatcacttcggctccaaggacgcattgttcgaatccgtgttcatgcgccggctggccccgctgctggagggctgcctgctagaactcgacaagctggaagcggaagagggcgagttgcccctggatcagctggtattgtcgttcatccgaccctgcctggcgctgtccaaggacccgtcccgcggcggcgcgatgttcgtgcgcctgctgtcgcgcacgctggtggaaaaccaccggctgctgcgcgagaccatctcccagcaatacagcgtattcgtgcaacgctataccagcgccttccagaaggcgctgccccatctggagccggagcagttggcctggcgcatgcacctcgccttcagcgtcatgttcaacgccttcgccggtaacgatgtgctgaaaatcttcacgcgcagccagatcgtcaccgcccgggatccggacatgatcgtcaaatatctggtgcctttcgtgattgccggtttggtttcgcctgtcgaaggctga

SEQ ID NO: 2414 - DNA, 2454 bp, Chromobacterium substugae
atgattgctgccattcttctgatcgcgctgctcggcgcgctggcgtatttcgccgcgccggtgctggcctggactgtgggcatcgccgcctggctcgccgcgctccagttcgttttccattgtccgccgtccgtcgccgtctgggcggtgttcgccgttgtcgccgcggtgctcaatatcgtgccgctgcgccgcgcggtgttcaccggcccggtattcggcatcttcaagaaaatcactccggcgatgtcgcagaccgaacaggaagcgatcaacgccggcaccgtatggtgggaccgcgatctgttctccggcaagccggactatcagcgcctgctgtcttttccggatccgaagctgacggctgaagagcaggccttcatcgacggcccgaccgaacagctgtgcggcatgatcgacgactggaagatcacccacgagctgaaggacctgccgccggaagtatggcagttcatcaaggacaacggcttcctgggcatgatcgtcaagaagaaatacggcggcctggagttctccaactacgcccatgccaaggtggtgaccaagatcgccacccgcggcggctccgccgccgtatcggtgatggtgcccaactcgctcggcccgggcgagctgctgcagcactacggtactgaagcgcagaaggactactatctgccgcgcctggccaagggccaggaagtgccttgcttcgcgctgaccagcccgtacgccggctccgacgccggcagcattcccgacttcggcgtggtatgccgcggctcctacacccacccgcgcaccggcgagcacttcgaaaacgtgctgggcgtgcgcgtgagctgggaaaagcgctggatcaccctggcgccggtggccaccatcttgggcctggcgttcaagatgtacgaccccgaccacctgctgggcgacaaggaagacatcggcatcacctgcgcgctggtgccgaccgagcacgccggcgtggaaatcggccgtcgccatttcccgggcggcgccgccttcatgaacggcccgacctggggcaaggacgtgttcattccgctggactggatcatcggcggccgcgatttcgccggccagggctggcgcatgctggttgagtgcctgtcggtaggccgctgcatctcgctgccggcgatgtcggtggcctgcggcaagctgactacctggaccaccggcgcctatgcccgcatccgcgaccagttcggcctgcccatcggcaagttcgaaggcgtggatgaggcgatggcccgcatcggcggcttcacctaccagatggaggcgtcgcaggatctggcgctgaccgcgctggataacggcgagaagccgtcggtgctgtccgccatcctgaagtaccacaacaccgagcgcatgcgcaaaaccctgaacgacgcgatggacgtgcatggcggcaaggcagtggtgctgggcccgcgcaactacctggcgcgcggctaccaggcgattccgatcggcatcaccgtcgaaggcgccaacatcctgacccgttcgatgatcatctacggccagggcgccatccgctgccatcccttcgtgctgcgcgaaatgaaagccgcgatggccaacgacggcgccgagttcgacaaggcgatcaccggccacatcaacttcgtgatcagcaacaaggtgcgcgccttctggctgggcctgaccggcgcctgcttcgccggcagcccgaagggcggcgtcaccgcgcgctactacaaacagaccacccgcctgtccagcgccttcgcgctgctgtccgacatggccatgttcagcctgggcggctcgctgaagttccgcgagaagctgtcggcccgcctcggcgacatgctgtccggcctgtacatcgccaccgcctgcctgaagcgcttcgagcgcgacggcgcgccgaaggaagacatcgcggtgatgagctgggcggtggaaaacgcgctgtacgacgtgcaagtggcgatggacggctttctggccaacctgcccaaccgcgcgctggcgtggattctgcgccgcatcatcttcccgtggggcctgacgttgaagccggcgtccgaccgcgtcggcaccaaggtggcgcgcgcgctgatggagcccggcgccacccgcgaccgccttacccgcggcatgtacgtgtccaaggatgaaaacgacgcggtcggcgtgctgggccacgcgctggaggccgtgctggcgaccgagccggtggagcagaagctgcgcaagctggcccgcgacggcaagttccgcaccatcaccgcccgcgagcgcctggccgaagcgctgcagaccggcctgatcacgcaagccgagttcgacgccgtcgcccgcgcccgcaagctgaagcgcgacgtgatcatggtggacgacttcgacatgaagctggagcagcatgatgacaaaatgctgcagcgcctgattttctaa

SEQ ID NO: 2415 - DNA, 378 bp, Chromobacterium substugae
atggagcagcaggagcaacggattccggtcttgcgagtcagggccctgcccaccagcaccaatgcctacggcagggtgcaggccggctggctgatgagccagatcgacatggccggcagtctggacgccgaacggctgtcgcgcggtccggtcaccacggtggcggtcaacgccttccagttcgccgcgcccatcatgctgggcgacgtggtggacatgtatgtggaacggctgcggatagggcagaagtccatcacgctgaagatttcggtggaggcggagcggatggacggctcgcacgtgcgcgtgaccgaggtgatcgccacctatgtcgctatcgaccgcgatggcaagtcgcgcctgctgggccaggattga

SEQ ID NO: 2416 - DNA, 1482 bp, Chromobacterium substugae
atgaagctcaagcatcttagcctgtccgtgatgatcatgggcactgcgctcggcctggcgtccactcaggcggctgcctcgggttatcagttcggttcgcaaagcgtctccggccagggcaccgcccatgccaacggcgcggaagccaacgatccgtccaccatcttctccaacccggccggcctgaccaggctggacggcacccagctctccactggcgtcaccctggtggtgccgcactccgaatacactgacaacggctccaagaatgtgttgggccagcccaccggcggcgacaacggcggcactttcgcgccgaaggcggtggcggcgccgaccttctacctgtccagcaagatcaacgacagaatcaccgccggcatcggcatgtacgtgccctacggcgccaagctggactacggcttcaactgggccggccgctacgcgctgaagagcatcgacctgcagtcgctgaacatcaacccgtccatcgccttcaagttggatgagcgcaattctttgggtttcggaatttcggctcagtacatggacgccaccctggagcagatggctgatgccacgtccggcctcgccatgaaggcggccgcagctggcggcatcaccggtccgtatggtccggggggggcgaccgttaccttgaccaatccggcgcagatctccgctgtaatgcgggctggcggcattggcggcgatggtctggctcacgttgagggtaatgactggggattcggctggaatatcggctacatgttccagttgaatgaaaacactcgcttcggcctggcctaccgctccactgtgaagcaatcgttgcaaggctcttctacttggacgttcaataacgtccaaggcaatgtgaccatcggcggggtgacgctgcctgccgctgtcgcggccaagcttgcgcacccggatgcttccgcgtctgtcgatgtcagcacgccggagacggcatcggccaacttcttccatcagctgaatccgaaaattgcgttgatgggcgatgtgacctgggtgcgcaactcgcgtctgcagcagatcgacatcaagcagtcgaccgttaacggcgtggtgcagggcgatctggtgttgcatcagaactggaaagatacctggcgcgtgtcggtcggctccaactaccagctgagcgatgcctggatgctgcgcggcggcttggcctgggagcagtctccggtgaagtcggatgaccagcgccatccggcgattccggatagcgaccgcatctggctgtcgctgggcgccaacttcaagatcaacaagcaaagctcgatcgatatggcgtacagtttcatcgacttcaagagcgctaacgtcaactactcggatacttgcaacccgaccggcaataacggcgcatgtaccggcaacggcggcacggtcaatggcagctacaagacctatctgcaactgctcggcctgcagtacaactaccgcttctaa

SEQ ID NO: 2417 - DNA, 2400 bp, Chromobacterium substugae
gtgtttcaacaaatcgaggaaaccatgtctcaaaccaaattcaatgtgcgcaaggtagccgtgctcggtgccggcgtgatgggggcgcagatcgccgctcatctggtaaacgccaaagtcccgaccatcctgtttgatcttccggccaaggaaggcgacaagaacggcatcgcgctgaaggccatcgacggtctgaaaaagctgaaaccctctccgctggcgggcagcgatgtggtggcccacatccagccggccaactacgacgaccatctgcacctgctgaaggattgcgacctggtgatcgaggccatcgccgagcgcatggactggaaggtggacctgtaccacaaggtggccccgcatctgggcgagcacaccatcttcgccaccaacacctccggcctgtcgatcaacaagctggccgaaggctgcccggattcggtgcgcccgcgcttctgcggcgtgcatttcttcaacccgccgcgctacatgcacctggttgaaatcattccctgcgtgacctccgacgcccacatcctggacaacctggaacgcttcctggtgtccacgctgggcaagggcgtggtacgcgcgaaagacaccccgaacttcgtcgccaaccgcatcggcgtgttctcgatgctggccaccatcgccaacgccgccaagtacggcatccgcttcgacgtggtcgacgacctgaccggcccgcgtctgggccgtccgaagtccgccaccttccgcaccgccgacgtggtgggcctggacaccttcgcccacgtggtgaagaccatgcaggacaccctgccgcaagatccgtggcacggcctgttccagactccggactggatgcagaagctgatcgccgccggcgcgctgggcgccaagaccaaggccggcatctacaagaaagacggcaagcgcatgctggtgctcgacccggccaagggcgagtatgtcggctccggcgagaagggcgacgacgcggtcaaggacatcctgaagatcgccgatccggcggagaaattccagaagctgcgcgacagcgagcatccgcaggcgcaattcctgtgggcatgtttccgcgacgtgttccactacatctcctaccacctgggcgatatcgccaattgcgcgcgcgatgtcgatttcgccatccgctggggcttcggttggagcgccggtccgttcgagacctggcaatccgccggctggcagcaagttgcgaaatggctgcaggaagacgtcaaggccggcaaggccctgaccgccgccgaactgccggcctgggtgctggagagtgatcgcgccggcgtgcatttcgccgaaggctcgttcaacgccgccgacaagaagctgattggccgctccgcgctggatgtttaccagcgtcagctggcgccggccaaggtgctgggcgaagccgtggcgccgctgggcgaaaccgtgtttgaaaacgagggcgtgcgcgccttcaccaccggcgacgatgtgctggtggtgtcgttcaagtccaaggcccacgccatcggcccggccgtgctggaaggcctgaacaccgccatcgacatcgccgaagaccgcttcaagggcctggtgatctggcagaccgaagagccgttctcggtcggcgccgacctgcagtcgatgatgccggccttcatgatgggcgattgggacgccatcgattcgatgatcggccgcttccagaccaccgccttgcgcctgcgctacagccagatcccgaccgtggccgctacccagggctatgtattcggcggcggctgcgaattcgcgatgcactgcgacaagaccgtggcggcgctggagtcctatgtcggtctggtggaagtgggcgtgggcctgctgccgggcggcggcggctgcaaggaattcgcgctgcgcgcttcgcaggaggcccgcggcgacgtgctggcggcgctgaaggactacttcatgaacatcgccaccgccaaggtcgccaccagcggcgtcgaggcgcaggagctgggcttcttccgcaagggcgatccggtggtgttcaacgcctatgagctgctgtacgtggccaagaagcaggcgctggtgctggcagaatccggctaccgtccgccgctgaaggtgaagggcttcccggtggctggccgttccggcgccgcgtcgatcaagggccaactggtgaacatgctggaaggcaacttcatcagccagcacgacttcttcatcgcttcgcagatcgccgacgtgatgactggcggcgatgtggaggccggcaccctggttaacgagcaatggattctggacctggagcgcaaggctttcatgaccctgctgaaaaactccaagacccaggaccgcatcgcgaacatgctgaccaccggcaagccgctgcgcaactaa

SEQ ID NO: 2418 - DNA, 171 bp, Chromobacterium substugae
ttgtttgctcattttcgattctcctgtcggccggctgatccaagcggtagaaatcaaccgacctatcatctggctattggccgtgcttgcgggaggattcgcagcgagcgggccgaggtcaaggcgagaagcgcagccgtacaagtggtacggcgagcatcacagccttga

SEQ ID NO: 2419 - DNA, 1203 bp, Chromobacterium substugae
atgagcaaacaagtacaagaagcttacatcgtcgccgccacccgcaccccggtgggcaaggcgccgcgcggcatgatgcgccatgtgcgcccggacgacatgctggcgcatgtgatcaccggcgcgctggcccaggtgccgaccctggacccgaaactgatttccgactgcgtggtcggctgcgccttcccggaagcggagcagggcctgaacatggcgcgcatcggcgtgctgctggccggcctgcccaacaccgtgggcggcatcaccatcaaccgctactgctcgtccggcatcaacgccgtgcagatggccgccgaccgcatccgcctgggcgaagccgacgtggtgatcgcggccggttccgaatcgatgtcgctggtgccgatgatgggcaacaaggtgtcgctgaacccggaaatcttcgccaaggacgagaactacggcatcgcctacggcatgggcctgaccgctgaaaaagtggcgcagcagtggggcgtgtcgcgcgaagaccaggacgcgttcgcggtggaatcccaccgccgcgcgctggccgccatcgacggcggcaagttcaagagcgagatcaccccgctggaagtgacttaccgcacgccgaacctggaaaccggcgaagtggtgagcaagacccgcgtgctggacaccgacgagggcccgcgccgcgaaaccacgctggaaggcctggccaagctgaaaaccgtgttcgacgccaagggttcggtcaccgccggcaactcttcgcagatgtccgacggtgccggcgcggtgatcctggtgtccgagcgcgtgctcaaggagttcaacctggtgccgctggcccgctacgtgaccttctcggtcaagggcgtgccgccggaaatcatgggcatcggtccgaaggaagccatcccggccgcgctggcccaagccggcttgaagcaggacgacctgaaatggatcgaactgaacgaagccttcgccgcccaggcgctggcggtggcgcgcgatctggagctggacatgtccaaggtcaacccgcacggcggcgcgatcgccctgggccacccgctgggcgcgaccggtgccatccgcaccgccacgctggtgcacggcatgcgcgacgccggcctgaagggccacggcatggtgacgatgtgcatcggcaccggcatgggtgccgccggcatcatcgaagtgctgtaa

SEQ ID NO: 2420 - DNA, 1092 bp, Chromobacterium substugae
atgacaaacaagacactgttccgtatcgccgcagcagcgctgctggccggcgccgcctgcgccaatgccgcctccgccgcacagcccgccaaccctcaaaccgcgcgcttcgcgccgttgtattacggccaaacgctatggatcatgctgggctcgccggttcccgatggctgggtcatcacccgcagcagcggcaaccagaacgaaatcaccgacacccacggcgcttcctacactcagcagctgtcggtcatgctgggctctccgattcccaaagactgggtggtgatccgctctaccggcaccactaacgtcatctactacagcaaaggcgcgtcgctgggaaccgaaatcgcggtaatgctgggctcgccgacgccggacggctgggtgatcgttcgcggcgacggcaaaatgaacgtgctgcataatctcaacggttccagctatggcagcgaaatcaccgtgatgctgggctctcccatccccgccgactgggtagtggtgcgcgccaatggcaacagcaatgtcatccgctacaccaagggcgcggcgccgggaacggaaatctcggtgatgctgggctcgccgataccggacggctgggcaatcgtgcgcggcgacggcaatatgaacacgctgcgcaatctgaatggctccagctatggcaacgagattaccgttatgctgggctcgcccattcccgccgactgggtagtggtgcgcgccaatggcaacagcaatgtcatccgctacaccaagggcgcggcgccgggaacggaaatctcggtgatgctgggctcgccgataccggacggctgggcaatcgtgcgcggcgacggcaatatgaacacgctgcgcaatctgaatggctccagctatggcaacgagattaccgttatgctgggctcgcccattcccgccgactgggtagtggtgcgcgccaatggcaacagcaatgtcatccgctataccaagggcgccgcgccggggacggaaatcacggtgatgctgggctcgccgattccggcaggctgggtggtggtgcgcagctccggcaatatgaacgtgatccgttacatgggacgttaa

SEQ ID NO: 2421 - DNA, 1887 bp, Chromobacterium substugae
atgaaaatagctcacaaagcgggactcatctcggcgctggtcctggccgtcaccgtgtccacgctgtcctggatccagtaccgcagcatcgccgacagcgtcaggcgcgacaagcagcaggagatcgcccaaaccggccaagtgctggcagcgcagattgaaaactggctgaacggcaagctcaaacagatagatttgatggcgcagctgatagactccggcttcagcgcggagcgcattcaggaagtgttcgaccgccctcagcacaagcaggagtttctgctgatcttcggcggactggacaccgacggcaaaagaatcaccaacgatcccaaatggaacccgccgcccgactgggacgcgcgcaaacgcccgtggtatccggtggccaagaacgccaacggcgccgcgctgaccgatccctaccccgacgccgcctccggcgagatattgatctcggcggtggccaagctcactgacaagggcgcggtcaagggcgcgtttggcggcgacctcagcctgaaaaccgtgtccgaagcgctgaacaccgtcaatttcaacggcgcggggtatgcctttttgctgtcggccgacggcaagatcatcagccaccccgacggcaagctgaacggcaaatcggtggccgacttgttcggcggacaagcgccggccttgagcaaggatctgcaagacatcgacgtgaacggcaaaaagctgatggtggccttccagccgctggacaagctgcaaaacgccaaatggctggtaggcatcgtcctggacaccgacaaggtaatggccaacgtccgctcgctgggccagcaggcgatgataggcgcggtgataggcgtaatcctgagcatgctggcgctcagcagcctgatggggcggctgatgcaggcgccgctgctgcagctgaagtcatcgctggcgcaaatcaatagcggcaacggcgatctgacgcgccggatagacgattccgccagcgatgaattcggcgaggtggcccacgaactcaacaccttcctcgcctacctgcagcaactggtcggcgacatccagcggatttcgcattcggtgcacgacagcaccgagcaaagcgccaacgaagcccgccaaagccgcaacgaggccgcccgcctgcagcaggagctggacggcctggcatcggcaatccaggaaatggccgacaccaccggggaaatcaacaataatgccagcgccgtggccgccgcggcgaagcaggcgcatgaggaaaccgatggccgggtgaaacaggtggcccaatccgcccagtccatctgcaaactggcgcagaccatggaggaaacttcgcaatcgatgggcgagctggccgccttcagcaaaaatatcgaatccatcgtccaagtgattaccggcgtggcggagcagaccaatctgctggcgctcaacgccgccatcgaggccgcgcgggcgggcgagctggggcgcggcttcgcggtggtcgccgacgaagtgcgcaagctggcgtcgcaaacccagagcgccacccaggagatacgcagcacgatagagcagctgcaacgcggggtggggcaagcgcaccagaaaatggaggaaagccgcgagcgcgccggccacaccgtggccgaggcggaacagaccagcgaaatgctgctgcgcatccaggacgtgatcgccgacatcaaccgcaaaaacagcgaaatcgccagcaccatccagcgtcaaagcggcatggcgcaggacatcagccacagcgccggcaatatccagcagataggccagcaagtggccgatgtcgccgaggtgcaattgcagcattgcaatgaaacgtcggaaaaagtcgcgcgccaggatacgctgatcagccgtttccgcatctag

SEQ ID NO: 2422 - DNA, 228 bp, Chromobacterium substugae
atgctcgactccggcaagctgacgcccgaggagtaccaaaacatggcggcggtgcttcatatccgtccgctgaatcaaaacctgggctatcccgtgcctgcccgcttcaacctgctatccggcattcaggctctgatcgggaacagcaggatgatttgccgccatgatcaagtccgcgcagaaacccacggattgcaagtgctgaaggcataccaggcccacgcctga

SEQ ID NO: 2423 - DNA, 165 bp, Chromobacterium substugae
atgctgaccccggcgctttccgcaaagccggtggcatccgcgccccgaatcgccgacgccgcgcaggcatccggatttgtccgaatgctgaccgaagcgcagtcggatgcgcccgctcccaaagcggccggcaagctgaacttggagaacctctccacggactaa

SEQ ID NO: 2424 - DNA, 360 bp, Chromobacterium substugae
atggaacccaaccgcaccccctataccctcgacctactgagcgacgagctcgacatggtgatccgcgcgctcaaatctgggcagccgaccctgtgggaagccaagcaactgacccagcgataccgggaggttttcatcgaccagactcgcgatctgctgccggcccatgagggctgtgagcaaaccgtcgccggccggctgctggtcgttcaggagctggagctggcgctcgaccgcttccgcgagattggcgtgtcgccgaaaacccggatgcgcgatgtcccatgcctggacaccgcgctgcgctactcgctggatgaggccgcagcggggcgccctggtgggatttcgttccgatga

SEQ ID NO: 2425 - DNA, 471 bp, Chromobacterium substugae
ttggcaggcgttgagctgccggacgacgtcatctgcctcggcggcgagccggagagcatcgtctccatacgctgcagaaaagtcgcctcccgcggcaccatcacgctggccggcgccggcggcaattgcgggcagatcgccgcgcccggcggcgggttgctgctggcgcagccggagagcagcagcatggcgagccagagcggcttgcagttcgagttgtccattttccagatccttttcgtaggcggccgccgtggccgcatcatctactgccgcctggtgctcgcgcgcccgggccgcctgggtggccgctgcctgctgctgggcctggctggcgcgcgccaccgcggcgtcgcgctgggcgatcacggcccgcatttcccagcccagcgccagcagggcgacgatcaccaccagcagcagcgcctcgcgccagtatttcagcagcgccagcatcagcagggctcctga

SEQ ID NO: 2426 - DNA, 435 bp, Chromobacterium substugae
atgaaaaccaacgcagaaggcatcgccctgatccagcagttcgaaggcctgcgcctgcaggcctaccaagacgtcgtcggcgtctggaccatcggctacggccacaccgggccggacgtgcgcgccggactgaccatcacccaggcgcaggccacccagctgctggcggctgacctggcacgattcgaggccggcgtcggccggctggtgagcgtgccgctgaacggcaatcagttctcggcgctggtcagctttacctacaacctgggcctgggctcgctgcagtcctccaccctgctgcggctgctgaatactggtgactacgccggcgccgctggccagttcccgcgctgggaccgcgccggtggccagcagttgcccggcctgctcaagcgccgcctggcggaacaggcactttttcaggagccctgctga

SEQ ID NO: 2427 - DNA, 195 bp, Chromobacterium substugae
atgctgaccgacgatgacggccagcttgagcccgcctacatctggggtggcgtcgccaccgctatcggccttgggttgcaggtgtactgcaccatccagggcaaaccgttcgacctgcagggctatggcatcggcgctggcgcgctgatcgccggcctgggggtgggcaaaaaaatgggagcaaaaccgcaatga

SEQ ID NO: 2428 - DNA, 615 bp, Chromobacterium substugae
atgaccgagaagcaacacctggccgtcgccggcgcgccggccaacgaacacgcccaccacgacaccctggccgaggacgtgttctatccggaccatccgccgcgcaccgagtcggccaccttccgccacaccaaggcggccggccacgccgcccggctgccgtgcgccatcagcggccacaccgagggcgccgagtaccaccacctgctctgcgagtgggcattcagcggcgccgtcgactggcgcaccgtgcgcggcgtggcgctgggcgagatcacccaactgccggtgctggacctgctgaccgatcagccgatccccggccagtttttctcggctgagcattcgctgctgtgggcgctgtgcaagctggccgaggccaagggcttcgactggcgcgccttcgacccggcgcggccggagctgttcgtcgactcgatggccaacatgctggtgctgcacagcaaattccaccgccaccgcgaccacggcatccacgaaatgagcctgccggagtggattttccaggccttcccgcgcgtgaagggcttcgtcttcacccccgacgaaatgcccgcaccgccggcattcccccacgacctcaaagccgcataa

SEQ ID NO: 2429 - DNA, 273 bp, Chromobacterium substugae
atgagccaggccgaattgatgctgacggcgctgaccggcgtgctgtcgctgttctccgccgccctgggctggtggctgatcagcctgcataaccggcatgagcggctgcgcgccgaccatgaggacctacgagtccgcgtggccgacgaatactgccggcgcgtggacctgcgcgacatggtcgacgacatgaagcaggacatccaccaagccatcgccgccctgcgcgaggacatgcgcgccagcatgagccgaatgaacgccggccgataa

SEQ ID NO: 2430 - DNA, 555 bp, Chromobacterium substugae
atgatctattacgcaaaatccaccggcgggttctacgacccggaaatccatggcgcggccatgccatcggatgcggtccaaatcaccgacgcgcagcacgaggcactattggccgggcaggccgccggacagatcatcaccagtgacagcggcggcaacccggtgctgaccgcgccgccggcgccgacgctggcccaggtgcaggcggcccaggttgcgcagcttcaggccggctgccaggcggcaatcacggccggcttcacctcctcggccctcggcgcaccgcaccagtaccccagccagcctaccgaccaggccaatctggccagtgacgtcgccgccgcgccgacggcgccagccggctggacgtccggcatctggtgcgccgccaacggcgcgtggtcgctgcagcagcacaccgcggcccaactcgcccaggtcaacgccgactgggtggcggcgcgcggcgcgctgcagcagaaatacgccaacctgatgatcaaagtccaagccgctaccaccgtcgccgcggtgcaggccatcacctggagctga

SEQ ID NO: 2431 - DNA, 1284 bp, Chromobacterium substugae
atgtaccaatacgacgatccaactgccgtttcgcaaatgccgccgccgggcgctgctggcacggccggctatttcaccgatggcaatcctgcgtccggtcagccggcaacgttgctgcgcgctgatttcatgaacacgctcatgatggagctggtgaatgcgatccaggctggcggcctagtgccgaccaagggcaaaaacaaccagcttgcccaggtgttgggcggactggcgccggttggcatcaacgtccagttcatccagaaaagcgggccggtcaagcttcccgcgcacagcttcttcgagttcaatggcaccgtagactgcacagctaccctaccggatcccactcagtccatccccgtcctggcctatttctggaatggatccacctccaaccagctgactctggcgacggccgtaggggcatttttcggtcagggcattccggcgaatggcgcgacattcaacctgcccccgggctacggcgcgctggtctgtggcgacacccacaactacatcgtactgctgtcctgctacagcaaaaatccgccggttggcgatagctccaacctcaatgccaccacgaactggacgcaaaataccctctccgccgcgatcagcgcgctgaacctggggcagtacgctaccagtaatgcgctggcgaacgctgtcgcgccgctggcgcaggcctcgcgcatcggcagcaacgcgggcgcggtcctctaccaggcggcggccacgcagccgctgtccgacatcggcaaattggtggagttgagtggcagcttcacgctgaacacgccaagtttcaacggtgtgccggctggtgccgcgatggaatacatcaacaccggcaatggcccggttacgatttccggtaatggcgcatcgtttttctataacagtgcgagcgttgcatccgtcaccttgcaatccggtcaatctgccaggtgtgttttcgacgggaccagtattgtagttaccggcggtttcggcgcggccagcattggatcgaacggatatcagaaactaccgagcggcctgatttttcagtggggggcggcgagcgtggcatctgcatctgacacgctggtaacgctccccatcgcctttccgaatcaactgggtcaggtgctgctcggggaggcgtataacctcggatcctcagtcgccatttacggtagttggtccatcaataccgccagccccaaaacgtctttctacctacgaaacagctcagcatccgggaatgccgtgtcctggttcgccatcgggaactaa

SEQ ID NO: 2432 - DNA, 597 bp, Chromobacterium substugae
atgccgctcccgaactacaccgccctggactaccagggcgcgctgcagcgcttgctgccgcgcgggcgagtgtggccgcgcgagcctgacgccgtccagtccaaggtagcgctggcgctggcgcaggtgtatggccgcacgcatgcgcgggccaacaacctgctggtggacgcgttcccggcgactgcatatgagttgctgcccgaatgggagtccacgctgggtttgccggatccagtattggggccggcgacgacgctgcagggccggcgcggccaggttgtggcgcagctgacggcggttggcggccagtctgcggcgtacttcgtgcaggtggcggcccgcctcggctacaccatcagcatcacgaattttgcgccgttccggatggggcagtcggcgatgggtggccagcttggcggcccggagtgggcgcacacctgggcggtccacgcccctcttgagacggtgatttcgtggcggatggggcaatccgcaatgggcgagccgctcaacagctgggggaatgccccgctgcagcaggttttgagccggctggtgccggcgcacgccatcctacagttcaactacgcctga

SEQ ID NO: 2433 - DNA, 1137 bp, Chromobacterium substugae
atgccctatgcaacaccaacccttaccgcgctgcgtcagcaagtcgcgcaggacattgccgccaatgtgccaggcggcgacggcctgctgcggttcagcaatctgggcgtgatggcgtccgctcaggcggccatggcgtatggccattacgactacatcgattttgtagcgaagcaatccacgccctggacggctactggcgagtttttgcagggctggggcgcgatgaagggcgtttacatcaagcctgctaccccggccgctggcgcagccacttttcccggtcaggtcaatgctcaattgccatccggtgcgctgatcacccgtggcgatgggcagcagtacatcgtcacagcggctggcgtggtaggggcgaacagctccgtgactgtgcctatctctgccgtgccggatcctattgggctggtgggggcggcaggcaattcacctgcaggtacggtgttatccctggcgcagtcgctgcccggtatccaggcgtccggggtggccgccacggcgctgactggtggcgcggacctggagggcgacgagccctatcgctcgcgagtgctatccgcttttcagtccacgccgcagggcggcgcgcagaaagactacatcacctgggccatggcggtgcccggcgtttcccgcgcctggtgcgcgccgaacggcttcgggccggggacggtggtggtgtatgtgatgctggacggcgctgagtccgccaacggcggcttcccggtcggcagcaatggcgtgtcgcagttcgaccagggcccgggcggcgtgccgcgcggcgtggtggcgacgggggatcagctgaccgttgccaatgccatcgccccccttcagccggtcacggcgctggtctatgtggtctcccccatcagcaacccggtgccattcaccatcaagggcgtgccggtggccagccaggcggcggttgcattggccattgccggcgtgtttttccagtatggccagccgggcggcagcatctccttgcagctgatctggtcggcgatcgccacggttgccggcgtgagcgacttcatcgtggtttctccgtcgggcgccgacatcaccagccccaccggctatctgccggtgctgggccctattacctggcagtga

SEQ ID NO: 2434 - DNA, 438 bp, Chromobacterium substugae
atggacatttccaccgtttgggtggccggcacgcatggcgactgggtgctggccggttctgaattgttggccggcaatgacttgcaatccgccattttgctcagcctgggcactgaccgcgaggccggcccggacgacgtcattcccgatggcagcggcgacccgcgcgggtggtgcctggatgacaccgcgcgcccgatcggctcgcgcctgtggttgctggcgcgtgccaaacagacccgggagaccgccaaccgcgcccgcgattacatcgccgaggccttgcagtggctgatcgacgacggcgtggtagccaaattcgacatcaccacgcagtgggtggcgccctccacgctgggcgcgcaggttgtgtcatacagcacggccggcgcgcgcagcgccgtgcaattcaagtgggcctggaatggagtgaactga

SEQ ID NO: 2435 - DNA, 609 bp, Chromobacterium substugae
atgattcagcagatagagcgactggcgcggcgtgtctggatgctgctgggccgcgggcgcattacggcgccggccagcgatggcggcccggtgcaggtgctgcaggtccagatgggccgcgacgagactcgcgaccacctgcgccggctggcggattacgggttcaccagccacccgccggtgggatccgacgccgtcgtgctgttcccgctgggcgaccgcaacaacggcgtggtggtggccaccaaccaccagggcagccggatgacaggtttgaagccgggtgaggtggcgattttcgataaccgcggccagtcggtgtatctcaccgccggcggcatcgtcgtcaatggcgccggcttgccgctcacggtcaacaacacccccacggtgacggtcaacgccagcgccggcgtgaagctcaacacgcccgagttggatgtgagcgggctgatcaaggccggcggcgacatcatcgacaacgccggcagcaatgcccactccatggcgcagatgcgtggcatcttcaacggccacaaccacgcggtgcaaggcgttcagggcggcagctcgaccgtcaccacgcaacagcccaaccagcaggaatag

SEQ ID NO: 2436 - DNA, 1086 bp, Chromobacterium substugae
atggatgacctcacccttgttaccaacggccagcgtatttccggttggaccaccgtcaatgttgtgcgcggaattgagcgcttcccatccggcttccagatcggcatgaccgagcactacccgaaagaatttgggcgctttttgctgaatccgggcgaccccgtccaggtgcttctgggcagcgatatcgtagtgacgggctacgtggatgatttcactcccgcactgtcctccggggcgcactccatagctgtcagcggccgcggcaaatgccaggacctggtcgactgcagccactttttcaacggctgccagatgaccaacatcaccccgctggccatggccatccagttggccacgccctatggcatcgatgtggtgtcggatgtcggcgccggcgaggtggtgccggtatggcagctgccgtggggggagaccccttacaacatcctggagcctgtggcgcgcaacagccagatgctggtctacgaaaatccggatggctcgttgaggctgtcgcaggcgatgcgggcctctgccggcgttcgctacccggtggtggcggagggggtcaacatcgagtccatcaccatgcgctggtccatggcgcagcgcttcagccagtacatcggccggagcttgccaatggacatgatgagcgacgtgggggtcggtcctgacgttgtggcagtggtgaatgaccccggcgtgccgcgactgcgcgtacgcagcatcatcgctgagacaggagacacatctgatttccagatcaccaaggcgcgtgtcaactgggaagccgtccgccgtgctggtcgcagttcacaggcaaacgtaaccgtggatagctggcgagacgaggccggcaacctgtggcagcccaacacgctggtgacgctggtggcgccgacggtgcatgtgccgcgcgcgaactggctgatttctgaggtggcctaccgccgtgacgagaccggcacgcatgccgacctgacgctgatgccgccggaggcattcgccgtccagcccgtcaacctgttcccgaccatgcgcgacgttgtcgccggcgctgcccaaggaggcaatggatga

SEQ ID NO: 2437 - DNA, 315 bp, Chromobacterium substugae
atgattggctttttgcttgtgatggtgatgtcggatggctggcaaggcggcgttgtgccgcaaggcatctataagactgccgaggactgcctgcaggccggcccccggtgggtgctccacaacaacaacatcggtcacccgtcgacgttttactgccagaaaaaggcggtgccgaagggccagcagtggagcgaagccggcatcacgccgcagatgcgcgagaaatgggccaagcagcaggcggagaagtacaagaacatcacctacaccatgccggaggacccattctcagcatctactgagccagcgcattga

SEQ ID NO: 2438 - DNA, 1443 bp, Chromobacterium substugae
atgagcttccaagacgtattgaacaccgccacccgcaccgcgggcgcactggatggcgtggtgtctgcggccggtcagctgacggatgcgctgggcctgggcggcgccaccttttgggaccagttgcggccggccagctaccgcggcatcccgttcgccgtgctggcatccgatggtgaattcggccgtcggctggctgagcacgagtacccgaaccgggatgtgctgtgggtggaggatatgggccggcgcgggcggcgcatcaacttgatcggcttcctggttggcgacgacgtcatcagtcagatgcagcagatgatcgccgcggctgagcaggaggggcgcggcgagctggtgcatcccacgctgggcacgctctacgtcagcctggggccgatgcgcgtgtccgagcgctgggaccaggggcgctacgttgagctgtcgatgcagtttgtcgagtccggcgaccgcgagtttccggacgagcagcaagacacttccagctggttatccaatctggccgacgaggccggcctgtctgttgaggcggattttgtcgccggtctcatcggccaggtcaagcaaggggtcgctgtggtgcagtcggtggtgagcactgcggcgcagtgggccagccgcatcaatcaggtagtgagcgcggccaaggggatttacaactcagtggccggcgtcgctggccagctgcagacgctggacagcttcgccaatcgctacggcgacccgcgcggcgtggccgcgcccagcacccctacgccatcgcccacgcggcgggccgtcgccgccagcgctattcaacgccaagcggtaacggcctcggcggcggcggtgtcggcggcggccggccagcttggcgcccaggctgccgccattcagccgttgccggcggccgtgtcgcaatcggtggccgccctggtcgcggcgagcgccagtcccatggacgccatcaacgcattgactgcgctcagccagctgcccatgcctcagggcgtggatacctcgcccatgggcgtggccatgaccactgcgcagcaacagacggtagcgatgatgcggcgcgcggcggtgatcggcgtttgccgcgctgtatcggcctaccagccgaccagctatgacgacgctgcctcattgaggagccgggtgtcgcagttggtagagcgggaggcggttgccgcggcagacgccgggagtatggcgagctatcaggcgttgcgtgatctgcgcaccgcggtggtggccgacctgacggcccgcggcggttcgctggcgcgcatgatgccggtctccattccgcagcccatgccgtccatggtgctggcgcagcggctctatcgcgatccgtcgcgcgcgggtgagttggcgcagcaggccggcgccatccacccgctgttcatgcctacgcagttcaatgcgctggctcagtag

SEQ ID NO: 2439 - DNA, 744 bp, Chromobacterium substugae
atgaacctggtaaccatgaatggccagcccatgaccatgagcagccgtgagatcgccgagctgtgcgagaaagagcacaagaacgtgatccgtgatatccgtgtcatgcttgatgagctggggggtggctcagatttgagccatgtccaggagagcaaggatctacgcggatatacatcctcaatcagccttcccaaagaccttaccctgacactgatcgccggctacaacgtcaggctgcgcaaacgtatcattgaccgctggatggaattggaacagaaggtggcagccccagtcctccccgacttccaagacccggtggccgcggcgcgcgcctgggccgaccagttggagggtcggcagatcgccgagcagcaaaaagtactgctggagcacaaggtcgctgaacaggcgcccaaggtgcagttccacgatgacgttgccaacaccatcaactgccagaccatggacgaagttgccaaggagttgggcacgggccgcaaccgcctctatgccttcctgagggagaaaggagtgctgatgcaaagcaatgagccctaccagcgcttcatagatcaaggctacttccgtgtgatcccctctccctggaggaagcgcggcgagcttcagatggggcagaaaaccgtggtcaccggcaaaggcatgacctacatccacaggctgatcaacaacctcgcggttgagctgcctgcaaatgatcgactggcggagaggtcagcatga

SEQ ID NO: 2440 - DNA, 240 bp, Chromobacterium substugae
atgaaatctagcacactcacctcgcctgttcaagttctggcggacagtgtcgagtccctcgacctcatcaccgtccaactggacgatctgcgcaccctgatgagcgccatcgcccgcctctctgctgacgatgccgacatccgcggcatcgcgatccacgccaaggggatcgccgggggcctgcacaacgacgcagacgtactgcgcgagcagatccaaaaccacattttggccgcgtga

SEQ ID NO: 2441 - DNA, 516 bp, Chromobacterium substugae
atgaacgaactgattgtttcgaacttcaacgacttcgtaatgctggccggcgacaagatcgtgaccgatagccggcgcgtggccaaggcctttggcaagcggcacgacaacgtgttgcgcgccgtacgccaacttgccgcagagtcgggcgcatggggtctactcaattttgaggaggccacctacctggatgaacagaacggccagcggtacgactgctaccagatgaccaaggacggattcgtgttgttggtgatgggcttcaccggccggaaggcgctggacgtcaagatcggctacatcaacgccttcaacgccatggccgaacagttgaagcgccgcgacctgggcctgtggcaacagatgcaggagctgatcgcgcgcgaagtggaatcgaaggtgcgagcctcgttcggctcgcgcctgatgctggagaggaagcgcgagatcccgaggctggagtcggagcggttcctgctggaaggtgcgatccagccctcgctgctgctgaactga

SEQ ID NO: 2442 - DNA, 165 bp, Chromobacterium substugae
atgaaaaaagctctcttgctgatcgccgccctctccctagccctcccggcagtctccttcgccggcaagcacggcggtggccactacgccggcggcaaaggctcctcgcacaagggcggccactacaagaacaaagcaacgaatgaccactatcgcaagcgctaa

SEQ ID NO: 2443 - DNA, 2169 bp, Chromobacterium substugae
atggcggcagctgacaatcaattccggatccggatcacggcgcaagaccaggctggacccatcgtccagaagctggaggcgcgactgggcaagttcgctacccggctggcgctagggaagaaagtcgacgacctgtcgaaatcccagctggagcagcgcgtcacccagcgtttcgacgggttggccaaaaaaatccagggcatcggcaccgcgctgggcagtaccgccagcaacctgtccgccccggtatccgccattgccggcggcgccatcatcgccggcatcaccgcttccgccaccagctgggccagctatggcaattccgtgctgcgcacggcgcagatgacgggtgttggcacggacgaattgcagaagctgcgcggcgccgcgaagctggcgggcgtcgaagcggagcagctcgatggcggcatcagcgcgctgggcagcaccctcaacgatgccgccaacggccggaacatggcggcgctggccatgctcaaccggctgggcatcagcatccaccgcaccaaggacggcgcggtggacacgtcggcagcgttgaaggacctggcgcaggtgatggtcagccccaagatgtcggcgcagaccaagtcaatgatcgccgggcagtttggcgttcagggcctgatgcccatgctgatggatggccgcaagaagctggaagacgacatggccaagaccaaggccatgggcgcggtgcaaaccccggagcagctgaaagcggccgaccaggccaagcgccacgaacgcgaagccgggctgggccaccagcgcgccagcaactggttgggcgatttcgtcggcccgatctacagcaagctgatggagagcgctgccaagatgctgtccgagcatccaggcgcgacgctggctggcggcgccgctgtcggcttgggcggctcgtggctgctgcggaaggggctgtccgccatcagtaaccggatgatcgaatccgtggtcaagcaggtcagccaggagctggccggcggcgcggcgaaggtcgccggccaggctgctgcatcagaggcggctgccgccgccagcgccggcgtcaaacagctcagccgcgtcacgttgccattttttggcgagttggccagccgcctgtcgctggggctggggctgctgctggagtcgccggagctgaaccgcggcgagaacgagttcgtgcgcgcgcagcagcagcgaaacggaacagcatcgagccgctggcatggcctggacatgaacggcaaggcgtttgccgacctgaaggacaaggccaaggcggcctatcagccctggtacgagtttggcgacgagaacgcgctgcagtacatgagccgttacatcaaggaaaatccgcaggccaagccgaccggttggaccgacgcggcgcaggccgcgccagcggctggccagcggctggcccaggcagcccagtcggagttgccgcaaaaggcgcagtctgccaaggcgctgccccgcggtgtccgcaacaataatcccggcaatctgcagttcgttggccaggctggcgcggtgaaagaagccggcgccggcgggcggttcgccgttttcgacacaccggaagcggggctgaacgccatggccaagcaactcaaacgctattcgaactccgggctcacctctgttcagtccatcattcagaagtgggctccaaagtcggaaaacaatactgcagcgtatgtggcggccgtcgccaagcgcatgggggttgatagcaatcagcgactgaacctgggaagcaccgatgtgatgcgctctctgatggacgccatgatcgtccgcgagaacggccacaacccttactccgcacagatgcttgatgcttctgcagcggtcggagtgaactacaaaggaaaatcgcgtgccgccggcacggtctctccaaggagtgcctcagccccctcttccgcagccactcgttcggaatcatcgtcggttgctctggatccggcgcagaagatgctgatcgaccagctgcgctcgctgcaggatgcggtggccaagctctcggatgccaaaatccacatcgcggttagcggcctgccggctggcgcgcgcgctactgcgtccggcggacaggccacggtgagcagcgcatccaagtacaactactcaatgccggagatgatctcgccgtag

SEQ ID NO: 2444 - DNA, 276 bp, Chromobacterium substugae
atgagcgaagcccaaaaaacggaagtcgccgatgagctgaccctggaactgcgcaagcccgttggactgggcgatgagcagttccacgttctggaattgcgggagccgctggtggacgagctggagaaattccacgagcagctggaaaagaaaacgccgatcttcgccacgaaattcctgatctccctggtcagcggcgttccagttgctgcaatcggccgcctgggcgcccgcgacttcaaggcggctgaggcatatctggccaattttttctga

SEQ ID NO: 2445 - DNA, 372 bp, Chromobacterium substugae
atggcagtagacaacacttacctgctcgcaggcacctgccagctgagcgtcaatggcacctcgtacatggtggccggcgatttcggttacagcccggccaaggtcaagcgggagaccaaagccggccgcgacggcgtgcacggttattcggagacgccgattcctggattcatcaaggccaagctgcgcgacagcggcaacctgaccgtggccgagctgagcacgatgaccaacgtcaccgtcaccctgcagcttgccaacggcaaaaccgtggtcggccgcaacatgtggacggtggaatccccggaagttgactcggtcgaggccgagatcgacgttcgctgggaaggcatgagcgtggaggaagcatga

SEQ ID NO: 2446 - DNA, 1497 bp, Chromobacterium substugae
atgaccattcccttcaagaccattccgcaggccctgcgcgtcgggctgttctacgcagagatggacaacagccgagccaacaccgcgcaggccagccagcgcgcgctgatcatcggccaggcgaccgccgccgccatcgtgatgggaacggtgccgaatgtgcccgtcatcagccagggcgtcgcggatgcccagaccgtgggcggccccaactccatgctggcgctgctgaccgcgtggtatcgcaaaaacgaccagttcggcgaggtgtggtatctgccgctggccgatgatcccggcgccacgccggctgccggcagcatcaccatcgccagcgcgccgacggcggcggggacgttctatctgtacgtggccggcatccgctacgccatcccggtactgccgacgcagcaaccggcgcagatcgcggcctatatcgccagcgtgctgtcggccgacgccggctgcccgctgctggccaccaacgccgccaacagcgcggtggtgacgctgacggcggtcaacaaagggccgtgcggcaacgacatcgatctgcggctgaactacctgggcccgaccggcggggaaaccatgccggccggcctgggtgttcagatcgccgccatgtccggcggcgcgacggcgcccagcttggcgacagcgctggcgaacctgggggaccagccgttcgatttcatcgtctgcccgttcaacgacaccaccagcctcaacgcgctgcagcagttcatgaacgaccagaccggccgctggagctacgccaagcaactttacggccacgtgttcaccgcgctgcgcggcacgctgggcgcgctgacgaccttcggtgtcacgcgcaacaaccagcacgaaacggtgatgggcttctacgacagcccgacgccggcgtggctgtgggccgcggctaccgccgccgccacggccgtcagcgtgcgcgccgacccggcccagccgctgcagaccgtgccgctgatcggcgtgctggcgccgccggtgcagagccgtttccagctgaccgatcgcaacaccctgctgtacgacggcatcagcaccttcacagtggcgcaggacggcaccgtggcgatcgagaacctgatcaccacctaccagaaaaacgcgttcggcaatgcggacaacagctatctggaggtggagacgatgttcaccctggcctatgtggtgcggttcctgcgcacccgggtcaccagcaagttcgcgcgcgtgaagctggccgcagacggcaccaaattcgcgccgggctccaacatcgtcaccccgtcgacaatccgcggggagttggtggccgcgtatggcgagctggagcacgccggcatcgtgcagaaaagcgccgcattcaaggctgcgctgatcgtcgaactggatgccagcaaccccggccgcgtcaatgttttgttcgcgccgacgctggtcaatcagctccgtattttcgcgctgctcaaccaattccggttgatgtaa

SEQ ID NO: 2447 - DNA, 192 bp, Chromobacterium substugae
atgtatgtcaaacccaaggctgggttcgctatccgcgaccccgacctgctcgacctattgcccgccgccggccgcgaggttcccgataccgattactggctgcgccggctccgcgatggcgatgttgagcaggtagcgctggctgtgtccgtggacgccaccgacacggccaagaaaggcggtgataaatga

SEQ ID NO: 2448 - DNA, 537 bp, Chromobacterium substugae
atgctgttccgcacccaactccgaagcgcggtggtggcggcgctgcaggcggccaacacgctggccggccagaaggtctatgtgccgcgcgacctccccaccacacctcccggcatgccgctgatcctggtgcagaccccaatggagcgcaagcagggccgtggcccgctgggcgctccccagttcttaaccacagctacggtagcggtcaatgccagggtggttggcgccagcgccggtgaggccgagtcgctgctggacaccctctgcgatcagatcgaaaacgccgtactcaccaactacaccgtgctgcgcatggtgcagcaggtgctggcggtggaaaccgagatcgaggtgactggccagcagcgtgagcatctgggcgaggcctggctgcgattcgacttcgaataccccgaggtgttcgagccttctatcaatcagccgctcatcgatgtccacggtgcggtgtcggctaccgtcggcacggcaagtgccccgccggtcgagttcgatttctccattcatcaggagtga

SEQ ID NO: 2449 - DNA, 327 bp, Chromobacterium substugae
gtgatcgactgggacgccgcagtcctcgcgccgctggagggggtgtttggcgagccggtgacgtacaccacgaccaccggccagtcgatttccatctccggcgtgttcgacgaggcataccgcgctgtcgacggattgggcgggtcgatctacacctccacctcccagccggtgctgggtatccgggcggccgcgctgccgttcccgccgcagtcaggcgacgtagtcgccatcctgcggacgggcatcgtctactcggtggcggatgttcaccctgacggccacggcgccatcaagctgatgctcaactacgtgtccggaggttga

SEQ ID NO: 2450 - DNA, 1047 bp, Chromobacterium substugae
atgcccgccaatatcctcgacatctttcatcaggatgcgttctcggccatcacgctgaccgatgcagtccagcgcaacccgtaccaaccgaacggtctgggtgagctcaacattttcgaccccaacccgatccgcaccaaagcgctggcggttgaggagcggcaaggcaagctggtgctgatcccgttcagcgagcgcggcggagaaggcacccagcgcaccaccgagaagcgcaaaatgcgatacttcgacgtgccgcggctgatgcatgacgacaccgtctacgccgaggagctgcaaggcattcgcgaattcggccaggaatccgtgctgatgcaggtgatggaagaggtggagcgccgcctttccggccccactggcctgctggcttcggtggagtacaccaaggaatacctgcggctggccgccgtgcaaggtctgtgtctgaatcccggtgatggcagcgtgctgtacaactggttcgacgaattcggaatcaagcaggcgccggaggtggggttcaatctcgccgccggcgtcgccaacaccttgcgcccgatctgcaatggcatcactcgcgcgatggcgcgcgctgcgcaaggctcgttcacctccagcacccgcgtccatgcgttgtgtggcgacggtttctacgacctgttttccaatcacccggacgtgatccgcaccttcctgaactggagcgatgcggccgagttgcggaataacggtcaagggggtgccttcgactccttcgagttcggcggcatccgctggtggaactaccgcggctcggatgacaacgccacgatcaaaatcccggacgacaaggtcaagttcttcccggttggcgcccctggcatcttccgcgaagccaacgcgcctggcgaaaccgtagactgggtcaacaccccgggcaagccggtgtacgtactgccgatcttcgataccgtgcgccgcatgtggtggaagatggagacctactcctacccgctgttcatctgcacccgtcccgaggtgttgatgtccggccgcgcggagtcctga

SEQ ID NO: 2451 - DNA, 558 bp, Chromobacterium substugae
atggtcctggccggcaccgtcttgggtcagatttcggccagcaatgccgcgccggtcgccagcgctgcggctggcgcagccaacgtcggcaacggcacgctcaccatcggcacgcagccgcaagctggtttcaccccggcgggcctgttcaccatcacgctgacggcgccgactgtgttcagcatcaccgggccgggcaatttcaacaacgtggacctgcctgtcggcaccgcgctggacgccgatggcatggtgttcactgtagcggccggcagcacgccgttcgcggttggtgattcgttcaccatcaccgtcacgtcgccgggcactgctggccagtggcgcccgctgaatccggcggcgacggatggttcgcaagtggccgccggtgtgcttttcgcctccaaagacgtgaccaccgggccgaagccggcgctggcggtcacccgcctggcggaggtgaatggttccgaactgctgtggccgcctggcatcacgcccgcgcagcaggcggtcgccatttcccaactggcgcaaccccacatcctcgtccgctga

SEQ ID NO: 2452 - DNA, 675 bp, Chromobacterium substugae
atgtcttttcttagcagcctgtcgggcaagctgtcttttgcccatctcgccggcgtgtccggctcccgcggcagtcgcgccgattccggccaggacgatgacgacgacggcaagcgcagccgccgcgccgaggacgatgatctggacgatgatgaccgcaaaaacagtcggcgcgccgaaggcgatgatccggacgacgatgacgacgacggcaagcgcagccgtcgcgccgagggcgacgatccggacgacgatgaccgcgatggcggcaaaggcaagcgcggcaagaaggccaagcgtgccgaagagccggatgcggacgaggacgaggaccgcgacaacgatccggacgccgaggacgacgaggacgaaatgcacggcaagagcgcctgcgcccgtgcccgccggcgcgaacgcgctcgctgcgccgccatcttcggcagcaaggcggccgcccgcaacccggtgttggccgccaacctggcattcaacagctcgatgacgcgcagcgaagcgctggcggtgttgcgcgatacgccggctggcgctccggctggcaacgccggtcgcgccgcgcgtaacccgcagttgggtgctaccgatggcgtgccgcccagcggcaaagctcagcaggccagcgcgtgggacaaggtcttcgccaaggcccgtcgataa

SEQ ID NO: 2453 - DNA, 864 bp, Chromobacterium substugae
atgatcaactacccacatctggctcagcggctgttcaacgtgccgctggccatcaccccgcaaaaagcggaggtggtgatggcggcgctggccgatcgcttcggcttggcgcgtctgttccatgcgaatggccgcgtggtagcgctggacgactgggatggtgatgtcggcgcgccggctgagaccaaaccatatcaggtggtcgccggcgtggccgtcatcccggtcagcggcacgctggtgcagaaactgggcaccatgcagccgtattccggcatgacgggctatgacggcatccgcgccaacctcagcctggcgctggcggatgactcggtgcatggcatcgtgttcgacatcgattcgccgggcggtgaagtggcgggctgtttcgatctggccgacgccatctacgccgcgcgtggcgagaagccgatctggtccatcctgacggaaaacgcctacagcgccgcctacgcgctggccagcgctaccgatcgcatcatcgtgccgcgcactggcggcaccggcagcgtgggcgtgatctgcatgcacgtcgacatgtccaaggcgctcggcgccgccggcgtcaacgtcaccatcatccactacggcgacaagaaggcgaacggcagcgatgtgcggccactctcctccgaggcgctggctgatttccaggctgatgtggatgagatgggcgagctgttcgtcgacaccgtcgcccgcaaccggggcatttctgcccgcgctgttcgcagcacccaggctggcaccttcatgggggccgccggcgtcaaaatcggctttgctgacgccgtgatggcgccggatgccgcattccgttccctgctggccaagctgggctaa

SEQ ID NO: 2454 - DNA, 1644 bp, Chromobacterium substugae
ttgctggggtcggatggccgcccgctgccgccggcgcgcgcttcgttcggcgactcaacggtcagaacggaaggccttccgctggctggttcatcggtgtttccgtatgacgcctccagctggtcgacgcaggaaatgggcgactggctgccgtttatccgctcgccggatgcggaaatcaaccagttccgcgaccggatggtggcacgcagccgcgatctggtgcgcaacgatggtctggcccagggcgcggtcacccgcattctggacaacaccgtcggcgtgtcgatgcgcctgtcgtcgatgccggattaccgcgcgctggccacgatgacgggtatcagggaattcgacgcggtatgggccaacgaattccagcaggtggtggaagcgttgtggcgagggtttgccgacgacatcggccgctacaacgacttgtcgcgccagttgacggtgtcgcagcagcttcgcctggggctgcggcacaagctggtagacggcgacagcttgatcgtcaactactggaagccggacagggtctatcccggcgccgctcgctatgcaacctgttacttggtggtggacccggacaggctgtccaacccgtggcagatggtggacaccaaatacctgcgcaatggggtggaaatcgacgacgacggcgtgcccatcgcctaccacatccgcaaagcccaccagaacgactggtacaacgcgatcgagtccaacgagtgggagcggatagaacgcgaggatgacgacggctgggtgcgcgtcatccacgatttcgagcgggatcgtgccgggcagaaccgcggcatcggcattttcacgtcggtgctcagccggttcaagatgctggcgcgctactacggcgtggagctacaggccgccaccatcgcctcttcgttcggcacctacatcaccagcccgttcgattccgctcaggtggaggaggcgatcaatggtagtgatgagctgtcggcataccaggaccttcgggccgatttccatgaggcgcggccggtcatgctcaacggcgcgcgcatcccgacgctggcgccgggcgaatccatcgagaccgtggccgccgcccatccgcatagtggattcggcgagttcgtccgcgccatgcaactgacgttcgccgccgcctccggcatttcggcggagcagatcacgcaggactggtcccgcaccaactactcgtcagcgcgcgccgcgctgctggagagctggaaaacgctggagcggcgccgcgccgaattcaagatcggcacggcctcgcccatgtacgccacctggctgcatgaggcgatggacaacggtgacctgccgctgccgcgcaatgcgccggatttccttgaattccggacgcaatatgcgcggtgcgaatggctcagcgtcggccgaggctgggtggatccggtcaaggagcctcaggggtccgtcttgaagatggacgccggcctatcaacgctgaagcgcgagtgcgcggagcaaggcctcgactatgaggaagccatcgatcagcgcgcgctggaagttcggaaattcaaggaagccggcctgaaactgcctgattggtatggagccccggccaccgaggcctcaacccctgaagaaagcccaaccccgcaatga

SEQ ID NO: 2455 - DNA, 255 bp, Chromobacterium substugae
gtgttcacgccgcaaaccaacaacttcaccggcatcccgcaggccacgctgcagcaatggctgacggaggcgcagctggcgctccaccggctgagtaccggcggcctgggtgagtcgtactcgtacacgcagggcgacggcaccaaatccgtaacctatacccgcgccaacctggcccagctgcagcagcacatcaactcgttgatgtacgcgctggggatgaggaggcgcaggccaatccgaccggtgttctga

SEQ ID NO: 2456 - DNA, 2040 bp, Chromobacterium substugae
gtgaccctgagggggacttcggccaaggctgagttactccgcgcgtcctttgttcgcgggtggacgccgcctcctcgcatcagcgtgccgacctgggctgacagataccgcaaactggcgcgggaggccggcagcacttccggcaactgggagaccgctacggtcgaagttgcccgcggcccgatgctcgcagtcacagagcccggcgtgcacatcatcaccacgatgtgctgtacccaattgatgaaaacggcgctgatcgagaatgtgttcggctatttcgcgcacttggacccctgccccatcttgctgctgcagcctaaggatgaagccgctgagcagttctccaaggagcggatctccccgctgatccgtgttacgccggcgctgcgcgatctgatcggctccagcaagacaagaaatgcagacgagaccctgctgtataagtcattccctggcggattcttggcgctggccggcgccggtagtcctgacaacctggctcggcgccccattcgcgttctgctgtccgacgaggtcgacaaatacccggtcacgcgcgagggcgacccaatcacgctggctgaagaacggactgcgacattcggtgtcaactggctttcagttcgagcctgctcccccactctggaggatgaaagccggatcgccgacagctatggagagtccgatcaacggcgggcttcggttgagtgcccgcattgcggcgagcgcgtattcctggactttttcaagcacgtcaactgggacaagcctgacggtcggcacgatccaaagactgcgcgaatctactgcgactgctgcggatcaggctggtctgagggtgagcgcctgcgcgcgctacgcaccacccggtggcatcagacaaggccctttgactgctgcgggcatcggcactctcctctggacttgtatgaacaggcgaagcaggccggcggagactcagtcgcagcagtctgggactggtgggatggtgaacggcacgcggtataccgcgccaagtgcccggaatgtggtgaatggggagtcgacaactcacatgcgggataccaggccagcaaactcttcagcccctggcaaaaggacaagccggccgatatcgccaggaagtacttggcggcaaaaggcgacgccgacaaagagcaggcatggtggaacacccagatgggattgccgcaccgcccacactctggcaaggaactgcgcctggagtcgctggtagcgcgctgcgaggtttggccaggcgaagtgccggacggcgttgctgttcttaccgttggcattgacgtacaggactatcggttggagatggaggtcgtaggctgggggcgcaatgaagagtcctggtccatcgactaccacgtgatcgatggggaaatgagcgagcccgaaactcagaaacaactggacgagtacctgaagcggatatggcggcgggacgatggtcgtggctttagtgcaatggccgcgtgtatcgactcgggcggccaccatacccaggcagtgtacgaattcgccaaagcccgcctcgggcgaaaagtttgggccatcaagggagagtcggcacggagtgggcaacgaaaccccgtctggccgactaaacgaccgcgatcgcgaaccaaagcgactttccgtcccattatcttgggcgtgaatgccgccaaggacaccatcagaaatcgactgcacctggaggtgccgggccctggctacatgcacttccctaccgaccgagacatcaactatttcgcccagataacagcagagcgaattgtggtgaaagaaaccggcggcgtccgctaccgggtatgggagcaaccatccggcaaggccaacgaggcgagcgattgccgagtctacgcctatggcgcgctgtgtggcttgctgcacttcggattgaaattaaaccaactttcgacatcaaccgcggtgaaagttgagcaggcagcccattcaaatgctttgcccgaagaggcgaagctgccggccgccaagcgctctctcgtccgtcgcatggcatag

SEQ ID NO: 2457 - DNA, 321 bp, Chromobacterium substugae
atgattgccggcggcgcggtgccggatcgcgactatgccgaggcgttgcgtatcaaggaaaactatctcgccctgctccgccagttggaatacgagcagaagtccgggcagctgattgaaatagaagtggccaagggggtgctttttgagtgtgcccgggcggcgcgcgatgcctggctgaactggccggcgcgcgtcggccccttggttgccgccgacctcggactcgaggccgatcgtgtaactgaggtactgaccgagcatgcgcacaagcacattcaacagctcggtgaccctgagggggacttcggccaaggctga

SEQ ID NO: 2458 - DNA, 624 bp, Chromobacterium substugae
atgcagcgcgaccagctgccattcgctacagcacaggccttgaccgtagttgccaagaccgttcaggccgccgaatccaaacagatcgccagcaagttcaagaaccccactccatttacccgcaatagtgtcggagtgcgcgcggcgcgaaagagcaatcaagaggcgatggtttttatcaaggaccaagccgctcgatatctggcaccgtatgagtccggcggcgaacacgtgctgaacagcaaagcgctactgaacccgaaggacatcaagaagaacgcttacggccagctgtcacggggcaccttggcgcgactaagagccagaccagacattttcattggcaaggtcaagactaggcgcggcatcgtcgatggcgtgtggcagcgaccagttgatccccggcgcgtgacgctacttaacggcaaacgcaagaagctgcgcggtctgaacgaagtgatggatgacaagcgcggtcacctgaaactgctgatccgattcggcgatgcgctgccggtggacatccatctgggctaccacgaactggccatcgcccaggtcaacaggcacttcaaccgcgagatggggcacgcgctggccagggccctggcgtcggctcggtag

SEQ ID NO: 2459 - DNA, 225 bp, Chromobacterium substugae
atggacctgctcgatgttacgccattcgttctgtcattcattcgcctgggcgcgctgctgctgattgcctgcgcggtcggcgccttcgcggcgttctacgtcgaccaccgcatggcgctgatggagtacccgatgcacatgcgcaagcgctaccgcaccctggcgttcgagttcagcacgctggccgttgtggtgctgggctcgctggagacgttcctgggctga

SEQ ID NO: 2460 - DNA, 201 bp, Chromobacterium substugae
atgcacatggaacacgcccgcgccgtcctcgacgcctgccacctgcgcgaaggccagcatgtgctgatggcctccgggcgcgccgccagagtaggagaaatcggacctactaccatccgcttcgattacttcgagcggctgagcaaggaagactacatcatcatcccccgccaccgcgtgccggagatggtccgggtgtag

SEQ ID NO: 2461 - DNA, 162 bp, Chromobacterium substugae
atgtctgccaaccacacctacgaacaaatcgcctccgacttccaactgtggggagagtactttgacaccgctgctgaaatgaccgaagaagagttcaatgcaatgagcaccgaagacaaggtggctctgcaagttcaagcgtttggccccgagaatgaatga

SEQ ID NO: 2462 - DNA, 489 bp, Chromobacterium substugae
atgcagttttccacggttcgcgcgctggtgggctgggcgtttcagatcgagaccaccagcatggtcaaggtgcaaaaattcggcgaggccgtggcgccggcgtttgatggcctgtcaccccacgacctcaaggcgcagtcggcgatggtcatggccaagatcagccggctgccgttcgagcagcgcgccgtgctgtgggcactgcacgtccagcgcgagaccgagatggtctacctgaccacgcacaccccgggcaagtacggctacaagaccgacctggacatcatccgcacgtgggccaccggtgaggggccaggctgccgcgatctgggcgaccggcacggcctcagccacatgacgctgcaccgctacggtaaaggcgtcgtggctcagctggagcgcatgatgaatcaggcttatgcggcgctggaagggccgatggcggaggtgctggataggctgtgctatgtggagcggaggacggcctga

SEQ ID NO: 2463 - DNA, 444 bp, Chromobacterium substugae
atgaccgcgatccgcttcaccgtacccggtacgcctgtcggcaaaggccggccgaaagtgtctacgcgcggcggcaaattcgcgcgcatgtacacccccgagaaaaccgccagctatgaggggatgatcgccctcgccgcccaggcagccatggccggccgcgcaccgctgaccggacccgcggacgtcaccatccacatggtgctgccgatcccgaccagctggagcaaacggaaacaggcagcggccctcaccaaccaggtatacccgaccaaaaagccggacgccgacaacgtggtcaaggcgctgtttgacggcatgaacggcgtggtgtgggtggatgacgtccaggcctgcgacatcgtggtgcgcaagcggtacggcgccacgccgggagtgacagtgcaggtccaggaaatccagggcgcgctgttcgcggcctga

SEQ ID NO: 2464 - DNA, 120 bp, Chromobacterium substugae
atgaaacgcatctcgacctggcgccgcgccatcgccggcgcgctactcgtcgccgctctgctggcgacctccccgctgtggctgctggctttgatccagctgaagctgggggcgcaatga

SEQ ID NO: 2465 - DNA, 558 bp, Chromobacterium substugae
gtgaacgacattttccgcagcctacgcggccgcttcggcaatgcgttcgtggacaaattccgctccggcgagcgcgtcccgaaggaccaggggctgccgtacgagggcatggacatcgggctgctggaagccatcgacgtgtgggtccatgagctgcgcaacctgtctccggccgacatccgccacgggctggagagcaaattccgctacccgcccagcgccgacgagttcgtccaggcctgctgctcccgcgattacgccccgccggccagcgacagctacgacgctctgccggcgccaacgatgagccgcgaagaagccgaggttcacatcgcccaggtgcaccaggcggccaagggcatgcagttccccagcggccacggccagcgcatggacaactggctcaagatcgccgatgaggtagcccgcggcgtgtacaagggcgggacgatcggcaagcgctacgcggccgaggccctggccaaagccggccgccccgtccccgaggccctgcaagcctacctgccgaaaacaaaccccatggaggacgcagcatga

SEQ ID NO: 2466 - DNA, 258 bp, Chromobacterium substugae
atggagcgattcatcgcccaccaccaggccgcccgctccctgcgcgcagatgacactgcctggcaagcccagtaccgcaagtggctgctggaccagcgccagttcaacgcagaccgcaaccgcgtgacggacgccaaggtccaggccgcgcagaagtccggcaacaccatccacgaccaacgcgccgccgccatggacaccatcggcgtcggccagcaatacctgaccggaggcaagcatgcagcactcgcaagttga

SEQ ID NO: 2467 - DNA, 123 bp, Chromobacterium substugae
gtggttttccggcctggagacacccaggccaagctgatggcgtacacgctgcccggcgcgcggaagctgaagccggcaacgattgagacagtggccggccggcgccggctgaaacaggtgtag

SEQ ID NO: 2468 - DNA, 420 bp, Chromobacterium substugae
atgaactggcgggacgcggcacacaagaccgtgcacagcgcgggcggctcaaaggtcatcgccgagcgcatgggcggctatgccggcgtgatccgggccaaagccaacccggatgacaactccagatggttcgacatgcaggagatggtcgagctgatgagcctgaccaacgatcacaggatgctggaggccctggcagatgagttcggctacatgctgacctcggtgcctgaggagatcgactccgccgaccgcggcctgatgcagatgatctcggacagcctcaagggacacgacggcgaggcggagaagcgccgcggcttggcccagttgaaggggcacgctggtgccgccctgcgccggaagatcaacaagctgcagtcattcctggccgacctggcccagttgaccgatgactga

SEQ ID NO: 2469 - DNA, 114 bp, Chromobacterium substugae
gtggaagccagttccgttgaagaactgataagacagatcaaggccaaaggcccggatgcggtgcttgaggtgatcaagggcttggcagataacagcgacaagttcaccaactaa

SEQ ID NO: 2470 - DNA, 756 bp, Chromobacterium substugae
atgactaaatccatcagcaatctgccggaggtcctggagctgttccagaccaagcccggctccgccgtctacctgacggccgttatgcggcgcatgctgctcaaggttcgcacgcaacaggatctgcacgccgcgctggcgatgatcaaggtcatctcggacgcgcccaccatcctggtagcgttttgcgcggacagcggcctgcagccgtccaccaccatgaacctcggctggagtgaggggtggctcagccggtatgccgcgcgggcctatcacgaggtcgaccccatcgcctccgccctacccggcgtggcggtgccctggtcgcaccacctgatcggcaaggtcagtccaaacgagaaattccgggcgtacttgcgcgattgcagccgattcggcatggactacggcatgtcctacgtcgccgaatacaacgattgccgcatcgtcctgtcgatgatcggcaagcacgtggagcaggatctggagctgcgccacaccctcgagctgctatgccccgatgtcaccgacgtcgcctaccgagttttggccggccagcgggctacttccaaattggaaaaaaatcagcaaattctgatagacctgatctgtaaccaagggcttaaaaaaaccgaggtcgcagccgccctaggcatgactaatcgtggggtcgactatcacttaaaacagctgatgaccctttacggggcgcggactgtggagcaactcatgtacagatttggtgcctgtgagtag

SEQ ID NO: 2471 - DNA, 300 bp, Chromobacterium substugae
atggcgcgaaagtggtcgcagaccaccctggcgcgcaaggtcggcgtcagccgcggaacgatttccgacttggaaaatgacaacgtacagggcacaacgcacatcctggacctcgccaaagcgctgaacctgaccccgcaatacattgaagacggcaaaggatcgcgccgcccggagcctacagcaagcgcgccgtatgtcgccgccagctcccttgaggatttggcagagaagctgctggacaaagggcctgatgaggtttggcagctaatccagctgctattaaccaccaaacgctaa

SEQ ID NO: 2472 - DNA, 126 bp, Chromobacterium substugae
gtgaccgccgccaacaatccgctctactacgccggcgacgccgcggcgctggacccggccggctgccggctggtgacgatgctgctggtgctgggcgagtgggcgttctggtgggtggggagctga

SEQ ID NO: 2473 - DNA, 252 bp, Chromobacterium substugae
atgatcgcccacgctagcgcggcgccggccgccgcacagattaccgtccacacctgccagctgcaggcggccaactccgccagctacgcgacacgccggctgtcgggttatcgcgtcgattaccagcaaccgcgcacccggcggcgcgccggcctgatcgttctggcccgcagcatgggcgaggcgctggaccgtgttgacggcctgatgcccggctacgtcatgtcgggatgggggagggcgcggaagtga

SEQ ID NO: 2474 - DNA, 117 bp, Chromobacterium substugae
atgggggagggcgcggaagtgaaagccttcatcaagaacacgctgggcggcctgctgatggtcgcccttttcttttctgcgctgacgctggcgcaaattgcggagcaactgaaatga

SEQ ID NO: 2475 - DNA, 381 bp, Chromobacterium substugae
atgagcctgcaaaacctttcctgcgcggtgctgaatgacctgtgccgccacctctccagcgctgaccgagatgagcggctggtgctggccgtcgagcatgaggccgatctgatgctctccgacatcgaatgcagccgcggcatgggcgagtcgttcatggacatgctgctgagcggcgcgccggcggagctgatgggcgagctgcatctgtacctgggccagcagctgctgcgccgggtgtttgacaggacggacctgggcccgcactacgaccagttggcgcgcgcggcgcgggcgtttgtggatgcgtcggcggcggcaacgctggatcggcgggttgagagcgacgacccggaagaggatgagagggaggcggcgtga

SEQ ID NO: 2476 - DNA, 171 bp, Chromobacterium substugae
gtgtccaggctggagcaaagcatcatccacgcccgcaataccgcagaacagcgcgaccagctgctggcggcactggagcgcgcagtggccgaggccgtggcggacgatctggacgactggttcgccaatgccaaggccgccatcgccgctgtgaaagggccggcagcatga

SEQ ID NO: 2477 - DNA, 198 bp, Chromobacterium substugae
atgagcgccaccacaaccctgtccagcatcctctacgcgcagcgccggctctccaacgagatcgagctgttcggctcgctgccgcgcacgcagcaacagctgacccctgaacagaaacgacggcgtgatgacgcctggcagcgccgaatggcgcgcgagctggcaggggaagacccgataaacgacaaggccgcctga

SEQ ID NO: 2478 - DNA, 939 bp, Chromobacterium substugae
atgaccgccacatcccgcgaggaatggctcgcgctgcgcaataccggcatcggcggcagcgacgccggcaccgtgctgaacgtgaacccgtataagaccccgctgcagctctatctggagaagcgcggcgagatcgagccggacgacatcagcgagaaggaagccgtccacttcggcaacgtgctggaagacatcgtcgcgcaggagtacagccggcgcaccggccgccgcgtcgagcgctgcaccaccacgctgcgccaccccaagcacccgttcatgctgggtaatctggaccgcctggtctgggagggcgacaagcgcccgcagcaccgcggcgagatccgcacccgccacctgctggagtgcaaaaccgcgctgggccggttcatcgacaaatcggcatgggggccggacggctccgacgaagtgccgatgacctatatggcgcagtgccagcactacctggcagtcaccgacgccgagcagatcgacctggccgtcctgctgtccgggcctgagttccgcatctacccgatcaagcgcgacgacgagctgatcaccgcaatgatcgagcaggagggcgagttttgggagcgcgtgcagagcggcagtgcgccggagatggactacgaccacgacaccacaccggacctgctggccaagctctaccccggcaccgacggcagcgagatcgtgctgccggatagcgcgctgcactggcagcaggtgctggccgaggcgaaagagcaggtcaagctgtacgacagcatcgccaccggcgccaagaaccacctgctgcacctgatgggcaatgccgctatcggcaagctgccggacggttcgcagttcacccgcaaggcgatcacccgcggtgcgtacaccgttgaccccgttacctatatcgatttccgattcaagaaagccaaggaggccgcatga

SEQ ID NO: 2479 - DNA, 1125 bp, Chromobacterium substugae
atgagcgccattatcgaacacgaaagcattaccgacgtgccggcctaccatggccaccagacgtcgaccaccgcgctggtgctggacgacggcagcatcgaccgcatgatgcgcctggcggagattatggccagtggcaaggcaacgattcctcagcatctccggaacaactccggggactgcttggcagtcgtgatgcagtccatgcagtggcggatgaacccgttcgccgtggcgcagaagacccacctcgtcaatggcacgctgggctacgaggcccaactggtggccgccgtgatcaataccagcggcgtgactacggggcgattccactttgagtggttcggcgattggaccaaggtgatcggcaagttcgatatccgcaagggggacaagggtgagtatcgcgtgcctggttggaagctcgcggacgaggaaggcctgggtgtacgagtttgggcaacgttgaagggtgaaactgaaccgcgggttctggagctgctgctcgcgcaggctcgaactcgcaattccaccctgtgggccgatgatccgaagcagcagctggcctatctgtcgcagaagcgctggtcgaggctctatgcctcggacgtgctgctgggcgtctacacgcctgatgagctggaagtcgttgcgccagaggagcgcgacattacgccgcgtgccaacagcgcgccggctgctgcggcgtcttcctcccgcgccagccagctcaagcagaagctcggcgcgaagccggtgccgaccgcgctgccggggccgagcctggacgatgttctgcgggctatcagcacagctggcggcaaggctcagatgcaggcagcgaaggagctggcgagcaagctgggcgagcaggaatacgcagtcgccgcggagcactaccagttgcgcgttgaagaactccgcgcgcaagcggcggcgcaggtgcctgcaggccaggcttcaggattcgacctcaccggcttcaagacccgcatcgccaactgcaaggacgtggacacgctggaccttctggccgacgaattcagcagcatcgctgacggcgcggatttcgaagagctgagccagatgtaccaggcgcgccgcggcgcgctggtgggggagtaa

SEQ ID NO: 2480 - DNA, 921 bp, Chromobacterium substugae
atggcctggttcaaacagctgtcgttctaccgtctggccgacaccgttgaccagtccaccctctctgcggcgctggagcggcgcccgttccagccctgcatgggcctggattggttcagcgaaggctgggtggccccggccggccacctggacgcgcctgtctacgcagaacgcggcaacctgcttctggcgctgcgccgcgaagacaaggtgctgccggcctccgtgattcgcgactatgtcgatgccaaggtggcagaagtagaggctcgggagctgcgcaaggtaggccgcaaggaaaagctggcgctgaaggagcagctgaccgacgacctgctgccgcgcgccttcgtccgcagcggccgcactctggcctacatcgacaacaaccggcagtggttgatggtggagtcggccaccgccagcaaggcagaggcactggtctccaagctgcgcgaggcgctgccgccattccccgccgcgctgccgcgaacgaagatcgccccgcatgcggctatgaccgactggctggccatcggcgaagcgcccgatggcttcgaactggacgctgacgcggtgcttcgggatagcagcgagaacggcgcgcaggtgcgggttagccgtatcgacctgactgccgatgagatccggcagcacatcgccaccggcaagcatgcctccatgctgggcctgatctggaacgacaagatccgcttccagctgaccgactcgctgcagctgaagcgcatccagttcctggacgtgctgcaggaggaagcaagccaggccggtgacgaccgcgaaagcctgttcgccgccaccttcctcttgatgagcgaagagctaggtgaactggtcagcgcgctggtggaggcgctgggcgggcttgaggagagtcaacaacacaaggaggcggcgtga

SEQ ID NO: 2481 - DNA, 441 bp, Chromobacterium substugae
atggaacacaccttcaagcacctcgtcctgtacgaggagcgccatagcgatggcgcagtcatcaccgacgaaaacggcttcaaagtcgtggaagccaacagcatggctgttttgctcgactgggacaccaagcttggcatcggccactgggcagatgatccgcgtgccagcatggaactgaccgaagagcagcaggctgccaacgcccgccgaatcgtggcctgcgtgaatgcgtgcgccggcctgcccgacgccctggtatcgcatggactggtgcctgccagccggcattcgacggtggcgcaacagcgcgatcagttgctggcggcgctggaggctgtgtgcgactcgttccagcacgtcccgctcggccctggcgcgctgcaggacctattcagagcacgcgccgccatcgcggcatgcaaggagtcggccacatga

SEQ ID NO: 2482 - DNA, 201 bp, Chromobacterium substugae
atggccgccgtgctgggcgcccagcgccgctactcggccaccatcaaggggttgggcctgcgctacctctggcagatagccgacgatgccggcaaccgagtgacgcttctggaaatcgaccagcggcacatggaggccaaggataagaaagagccgctaaccatcaagcggctgggctttgactcagtcgaaatcgtatag

SEQ ID NO: 2483 - DNA, 252 bp, Chromobacterium substugae
atgaacacccacatcagcaccatgcgctacgcgatgcaaatcgccgtactggcacagctcctggagcaacgtgagcgccagatcgagcaattggctaccgtcatcgccatcaaggacgagcaactagccacccagaatagcgcggcaatggaatatgtcgcgcgctgcgacgagctggaagcccgcaatagcgagctggcgcgccagcgcgacttgctggcgctggaggcacaagaacggagggcggcgtga

SEQ ID NO: 2484 - DNA, 132 bp, Chromobacterium substugae
gtgagctaccagacctacggcgaggactaccacgtcacgccgcggcctgatcctctgccggctgccgccggcaaggccgatgagccgcgctaccccgatgacggggtggagagcgacgggggcgagctgtag

SEQ ID NO: 2485 - DNA, 393 bp, Chromobacterium substugae
atgtctgaaatcaccaacccgtatgagcaggtggaactggcagctgaagccgccggctatctgggagcactggacgaaggaagcggcgagcgccaatggctggcagatcactgcactggagatgaattcgatccgcgcgagagctttgaagacgcggtgcgactgatttgcacgcttggcctacttgtcgaggttgatcgcggtgcaggggtggtgactgtcgtgataggcgctgatcacgttgttgaccactgcaccatgaccgagcgtttcgaccctgacgggcgtttcgacatggatgcgccggcatccccagaatatgcgctgaaactggccgtcacccgtgctgccgctgagattggcaaatgcaaggtgatggggaccgccgcatga

SEQ ID NO: 2486 - DNA, 396 bp, Chromobacterium substugae
atgcaaggtgatggggaccgccgcatgacctgcccctacgacagctggctgcccgatcagccggcaccaatgcccgccgcgcccgaactgtaccggccctccagcggccaggccggcgagtggttcatcagtgaatggtgcgcccactgcgagcgggacaagtgccagaacggcagcaaacccatggacgagtgtggccaggacgatctctgccaaatcctcggccgcaccatgttcctggacgtggacgacccggactacccgcgcgagtggatcgacgacccggagcacggcccacgctgcacggcgtttgtcgaaatcggccagccgctgccgcctgcgcgcgacacgcaaaccatcgatatgtttcagctgcccgaccagggcgaggagtga

SEQ ID NO: 2487 - DNA, 789 bp, Chromobacterium substugae
atgcagttcttcccgccgcatcagacctacgtggagccgttcgggggtgcggccggcgtgctgctgcagaagccgcgctcgtacgccgagatctacaacgacctggacggcgacgtcagcaactttttccgggtgctgcggaatcctctccagcgcgcgatgctgatcgaggccgtcaccctgacgccatatagccgcgccgagttcgaacaagcctgggaaccggccaccgatccaatcgagcgagctcggaggctgtccatccgcgcgcagatgggcttcggctccgccggcgcgaccaaagggacgaccggatttcgcattgacagccggcgcgaatatggcactgcgcagcacctttgggcgtactacccggaccaattggctaatgccggacagcggctggccggcgtgctgatcgagaatgcctcagctatcgatgttatgcaccagcacgatagcgcgcagacgctccatttcgtggacccgccgtacctacacgaaacccgcgtgcgcggagcgcaatatggccgttactaccgtcacgagttaagcgacaacgatcatcgcgagctgttgggcgtgctgctggatctggaagggtttgtggtgctaagcgggtacccgtcggacctctacgaccaggtcctagccggctgggagcggcacgtcacgggcagcaggatttctgcaggccgaggcggtgcagtccggaccgagtgcgtttggctcaaccccgcatgcagcgcggcgctacaccagaacgacctattcaaggagatagcatga

SEQ ID NO: 2488 - DNA, 480 bp, Chromobacterium substugae
atgacgcacctgacccaactggcggacgccgcgcgcgccgtcatcgcagctttcgaccgtgccggcgagctgaccgacgaactgatcagtgcgctggagctggcactgaatggagccgagctgtcgccggccaccgagcagagcggcgaggcggtggcatggatagagattcacggaagtggcgtgatatacggtgtgtatatgaacgcggcagaggatttgccgctaaacgttaggctcaatctctacacccgcccgcagcccgcgccggcggtgccggatgatggcgctgtccgcgagacgttgctaaacgtcatccgccggttaaaccagaatccgtacagcctgaccaagatcgagtgcatacgcgaggtggaggcaatgctcgccgccgcgccgcagcccctgacctgcacctgcccgtctggcgacggctcgctacgctggccgtgcccgcggcatccgccggagtcggcatga

SEQ ID NO: 2489 - DNA, 189 bp, Chromobacterium substugae
atgacgaccgccgcgctaccggccccgccggtctaccgctacacccagcgccgcgacggcgccgtcatctacgttggcccggagccgccggcacccgagcccggcaccagctgcacccggatggcgtggttggcggtgccgggcatggagtggggcggccagtgggccgatcccgagattgtgttttga

SEQ ID NO: 2490 - DNA, 144 bp, Chromobacterium substugae
ttgctggtggccaaattgcttggccatgtgaccgttgagatggtgcggcggcactatggccgttacatcacgcagccaaatggaatcgtgctgaagggggactattcaggctttggtaccgatcccgaaggcaaggcgggatga

SEQ ID NO: 2491 - DNA, 85 bp, Chromobacterium substugae
ggaggtttgggtgagtggtttaaaccagcagtcttgaaaactgccgacgggcaaccgtccgtgggttcgaatcccacagcctccg

SEQ ID NO: 2492 - DNA, 1671 bp, Chromobacterium substugae
atgctcctctcgctgaccgtaaaagacttcgtcatcgtcgacagcatcgcgctggacttcgccgccggcttcaccgtgctcaccggcgaaaccggcgccggcaagtccattctgctggacgctctgggcctgctgctaggcgatcgggccgaaggcgcgcaagtgcgcgaaggcgccgagcgcgccgaaatcaccgccgagttctccaccgaacggcgcccggaaatcgacgcctggctgcaaaccaacgaattgtccggcgacgaaggcgtgctgctgctgcgccgtctgatcgaccgcagcggccgctccaagagcttcgtcaacggccaggccgccaccctggcccagctcaagcaattgggcgaattcctggtggacatccacggccagcacgcccatcagtcgctgatgaaaagcgaaacccagcgccaattgctggacgcctacgccggttcggtcgcgctggcccgcgacgtgcacaaagcctggcaggaatggcaggctgcccgccaggcgcgcaacgacgccgagcggctgtcgcgcgaatcggaagtggagcgcgagcgcctgacctggcaaatcggcgaactgtccgacctgaatctgcagccggacgaatggaacaccctcagccaaagccacacccggctggccaactcggccgaactggtgcaaagcgcgcagctggcggtggacacgctgtccgaacaggacaacagctgcctcacccagctggcccaagtgcaaagccggctgtccaagctgtccagcctggacccgcgcctggccgacaccctgtcgctgctggactcggtggacgccgaactgcgcgaggtggtgtacagcctgcgcgactacgccagcgacatcgaccaggaccccggccagctggccgaaatggaacggcggctggagctattgatgagcgcggcgcgcaaataccgcatccagccggccgatctgggcgacaagctggccgactggcagcagcagctggccgcgctggaagccagcgtggacatcgaagcgctgagcgtggccgaagccgccagcctggcgcgctaccgcgcgcaggcggaatcgctgtccggcaagcgccgccaggccgcgcgcgaactgtccgagcgcatcggcaaggaaatgcagcggctggcgatgggcggctcccgcttcgccatcgagctgtcggcgctggccgagcccggcgcgcacggcatggaatcgatcgaatacctggtggcggccaacgccggcaccagcctgcgtccgctggccaaggtggcctcgggcggcgagctatcgcggatcagcctggccatgcaggtcgtcatcagccaggtggccagcgtgccgacgctgatcttcgacgaagtggacgtcggcatcggcggccgcgtggcggaggtgataggccacatgctgcgcgacctgggccagcgctaccaggtgctgtgcatcacccacctgccccaggtagcgtcctgcggcaagcatcactggcaggtcagcaagcgcgagcaaaagggacaggttctcagccgcatctcgccgctggacgctgaacagcgggtgctggaaatcgcccgcatgctgggcggcgcggagctgacgcaaaccacccgcgagcacgcggcggaaatgctggcctcaaacgccgccgccctctag

SEQ ID NO: 2493 - DNA, 876 bp, Chromobacterium substugae
atggaaagactgttcaaacacatctgcctggtggccagacacagcaagccgggcatcaccgcctcgctgctgcagctggccgaccacctggccgcgggcggctccaccgtgctgatagacaaggaaagcctcagcgcggaagaagccggcggccacgccctgatagaccgcaacgacatgggcaagctggccgacctgtgcatcgtgctgggcggcgacggcaccatgctgtccatcgcccgcctgctggcgccctaccgcgtgccgctggtcggcatcaaccagggcaggctgggtttcatgaccgacattccgctgcacgagatgctgacgtcgatcgacgccatcctgcacggccagttcgtgccggaagaccgcatcctgctgcaggcctcggtggtgcgcgaagacgccgaagtcgccagcgcgctggccttcaacgacgtggtgttcagccgcggcgccgtcggctcgatgatcgagttcgaaatcttcatcgacaaccagttcgtctacagccagcgctccgacggcctgatcgtctccacccccaccggctccaccgcctactcgctggcggccggcggccccatcctgcatcccacgctgcaggccatcgcgctggtgccgatctgtccgcagtcgctgtccaatcggccgattgcggtcaacgactcctgcgaggtggaattcatgctcacccgcggcctggacgcgcgcgtgcatttcgacggccagctgcactgcgacctgatggaaatggaccgggtgctgatccgccgctaccgcaatccgctgcgcatcctgcatccggaaggctacaactactacgacatgctgcgccacaagctgcactggggcgagcgcctgctgtaa

SEQ ID NO: 2494 - DNA, 669 bp, Chromobacterium substugae
atgcaaaacacgacacccaccgtattcattgtcgacgacgacccggcggtgctcgattcgctggccatgctcatcaccgcccagggcatgaaaaccgtcacatttcccaatgcgatggagtttctcgacggctaccaaggcaatcagatctgctgcctggtgctggatatccgcatgccgcagatcaccggcctggcgctgcaggagcaactgatagagcgcgacatcgccattcccatcgtattcatcaccggccacggcgacatcgagcaatgccggcgcgccttccagaccggcgcgatagacttcctcaccaaaccgatcgaccaggcgcggctgatagacagcctgcgcaagggcatacggctgagcatccagcagcatcagaaagaagaggaaacccaggaagtgatgggccagctgtcgcgcatcagcggccgcgagcgcgaagtgctggaactggtggccgacggcctgtccagcaaggaaatcgcccgcgagctggacttgtcgccgcgcaccatcgaggtccaccgcgccaacctgttcagcaagctgggcgtggattcgctggccgatctggtgcgcttctacctgaaggcgctggaagccaccggcaagaaacgcagcgaagacagttttttcaacgaagcgccgccaaaccagtag

SEQ ID NO: 2495 - DNA, 2289 bp, Chromobacterium substugae
atgccagacgtcgaagtgccccgcccgtcacctttttgcgcgatcaaaacgcatctgcagctgctgctccgcgcatcggcgcgcagcaaatggctggccgcgctgtgctggctgctgggcttcggcctgctgctggcgcacaatctgctgctggacctccgcctgcagcgccaggaattccagcaaaccgccgagctgatgctgcagaacatcagccatcggctgcgcaatagcgaactgctgcaagcggaggtcggcgacatcgtcagcagcgcccaccccggccgccaggcccgcatccgctcgctggcgctggcggcggcgcaaagccagccccagctttactacatcggctaccagccgctggtcgaccaagacgagcgcgccggcttcgaacggcagcaatcgcagctgctgggcaagccttatctgatacgcgactacctgcacgaccaacacaacaactggcgcgacgccgccgcctggcgcccggcgccgccgcggccgcgctatctgccgctcagcatggcggagcccggcctgggctcgcgggactggaatgaaatgggcctggacctgctcgacgacagcgtgctgtcttcctcgatcaaccgcgcgctgggccatacccaagcttcgtcccccaccctgcagctgaacaatggcgaactggggctagccttgttccaggcggtctatcgcgcctccccgccctctccggtgccgatgatacgcatagagcaggcggacggcgtgatcgttcaggtgctgtacctgaagccgctgctagcgttaccgccgcaactggaaaaccggtacaccctgaagctgcaacgccacgacagcggcgccgacactggcgtcgtgaccctgctgcgccaatccgacgaccagaccggcggctggcccgccgccctgctgccccggctcagccaccgcgccagcctgtccgccgccgcgctgccctacgatctggtgctgagccggcagctgcagttcgaacgcgcctcgcccggggaaatcctgctgagcgcgctgttcgccttgctgcccgcctacctgctgctggtgatcctggcgctgctggaatacaaccgccaggcgcgcgaacagatacaggacgacatcttccgcgaacgcgaatacgccagcgtcgccctgcgcggcatcggcgacgccgtgatcagcatcgacacccgacagatcatccagtacctgaaccccgccgcggaagccctgctgggcctgcccgccgcccaggtgctgcaacggcggctgcaacaggtggtgccgctgcattacgagttttcgcgcaatccggtgcaagacccggtcgaccaggccatcgccagccgccaggtggtgtacctggcgcaaaactgctacctgaagcgccacaacggcgaaaagctgctggtggaaggcgcggtggcgccgctgctgggccgcagcggccaactgataggcacggtgatcaccttccgcgacaccgcgccgatacgccgccgcatgctggccgcgctggaggccagcgagacgcggctgcgccagcacgaaatggagctggcgcgcgtcgcccgcatcaacaccatgggcgaaatggcttccggcatcgcccacgaaatcaatcagccgctatccgccatcatgagctactgccaggccggcctcagcctgctggacgacgacgagatcgacatggcgatgctgcgccgcgccctcacctcatcggtcagccaggccgaccgcgccggccgcatcatccaccggctgcgcgaattcgtcacccgcaaaaaccagcaactggtgccggtgcagttgaatcaggctgtgcacaacgcgctgtcgctgctcgactacgaactgcaggaccacgacatccacatcgagcaaaacttctcaaccgagttgccgttggtatacgctgacactatccagctggaacaagtggtgctgaacttggcgcgcaacgcggtggaagccatggaacacacccgcccctggggacggctcagcctgaccacccgccgacagggcgagcgggtgcagctcatcatcagcgacaacggcagcggcatccccccagacaagctggaccggattttcgacccgttcttcagcaccaagcccaacggcatggggctgggactggcgatttgccaaaccgcggtggaagccttcggcggcaagctgatcgccggcaacaaacccggctcgggagcggaattcatcatcgacctgccatgcggcgcacgccgcgtggcggcaccatccggagtagaagcctga

SEQ ID NO: 2496 - DNA, 531 bp, Chromobacterium substugae
atggaaaaggcaattttgggcggcggctgcttctggtgcctggacgccgcctactccggccttgacggcgtggagcgagtggtgtccggctattgcggcggccacaccgccgaccccgactacaaacaagtctgctccggccacagcggccacgtggaagtggttgaaatccatttcgaccccgcgcgcatcgactacgccaccctgctgcaagtgttcttcgccgtgcacgaccccaccacgctcaaccgccagggcaacgatgtcggcagccagtacgcgtcggccatcttctatctggacgacgggcaacgcgccatcgccgaacgcacgctgcaggaactgcgcgccgaacaagtcttcgccgaccccatcgtcacccgcgtcgaacccgcccagcgctttcatccggccgagggctaccaccagggctactacgcgcagaaccagcagcaaaactactgccaactggtgatttctcccaaactggcaaaaatacgccgccgatttgccgccctgatgcgaaactag

SEQ ID NO: 2497 - DNA, 927 bp, Chromobacterium substugae
atgcgcatctaccgcaccgaccagtttccgctgccgctgcccgcaggccatcgctttccggcagaaaaataccggctgctggccgagcaagtggcgcaattcgcgccggaacggctggaccccgcccccgccgccagccgctatgaattgctgcgcgcgcacgactcagcctatgtcgacgcagtgctgaacggctgcctggacgctcggcagcaacgcgaaatcggcctgccatggtcgatgcagctggccgagcgcagccgacgctcggtgggcgccaccatcgccgccagccgcagcgcgctgcagcaaggctgcggtgtcaacctggccggcggcacccatcacgccggccgcggacgcggcagcggcttttgcgtgttcaacgacgtcgccgtcgccgcgctgctgatgctgagcgaagggcagatccgccgcgcgctggtgatagacctggacgtgcatcagggcgacggcaccgccgccatcaccgccacagaagaccgcatcttcacgttttccatgcacggcgcgcgcaacttcccgttcgaccgcgtctccagcgatctggacatcgacctgccggacggcaccggcgacgccgaatacctggccatcctggccgatgcgctgccgcgcgtattcgccgccgcctcgcccgacctggcgtactacctggccggcgcggacccctaccgcggcgatcgcctgggccggctggccctcagccaggaagggctggcgcggcgcgaccgcctggtgatggaaacctgccgccgccacggcgccgcgctggtcgtcgccatggcgggcggatatgcggtgccgattacggataccgtgacaatccagactgaaaccgtcagactggcatgcaggatcttcggcgccggggagctggacgaaaccgtctcgccgcggcgctga

SEQ ID NO: 2498 - DNA, 216 bp, Chromobacterium substugae
atgcctgtccccggaatctaccagcactacggcaaccgccggcattaccagctgctgggcatcgcccggcattcggaaaccggtgagccgatggccgtgtaccgcgcgctttacggcgacttcacgctgtggacccgccccgccggcatgttcgacgaaaccgtggaccacgaaggacggcagatgccgcgcttttcgctgatccgggcgctgtag

SEQ ID NO: 2499 - DNA, 456 bp, Chromobacterium substugae
atggccacacaactgagcatcgccacccctgaatccgtcggcagctggctgccgctattcaccgcctacctggccttttacaaggtaagccagccgccggagcagtgcctggatttcctcagcgaacggctgcgccgccgccaggcggtggcgtttgtcgtcgcgaccgacaaccgcccgcaaggcttcgccctgatgtataccggcttttcctctttatcgctgcagccctgctggatgctgcatgatttattcgtggctccggacgcccggggccagggcttcggccggatgctgatccagcgctgccagcaatacgcccgcgacctgggaggcggagaaatcatgctgcagaccgcccacgacaatctggccgcccaaaagctgtacgaaaaccacggtttcgcgctggaccgcgattttcgcgtgtatggctggagcagccggcattcttga

SEQ ID NO: 2500 - DNA, 948 bp, Chromobacterium substugae
atgaagctggtgcttgccccgatggagggactggttgacgacgtgatgcgcgatgtgctgacccgcatcggcggcatagacatgtgcgtcaccgaattcgtgcgggtcacctcggccttgctgcccacgcgcacgttcatgcgtctggcgccggagctggagcgcgccggcaatacccgcgccggcgtgccggtgcgggtgcagctgctgggctcggacgccgcctgccttgcggaaaacggcgccaaggccgccagcctgggcgcgcccggcgttgatctgaatttcggctgtcccgcgccgactgtcaaccgccaccgcggcggcgccgtgctgctgaacgagcccgaattgctgcatgagatcgtcgccgcggtgcgccgcgcggtgccggcggctattcccgtgaccgctaaaatgcggctgggctacgaagacaagagccgcgcgctggagtgcgcgctggcgatagaaagcgccggcgctggcgaattgacggtgcatggccggaccaaggtggaaggctatcgcccgccggcgcactgggattggatcgcccgcatccgcgaaaccgtggccatcccggtgatcgccaatggcgaagtgtggacgctggacgattaccgcgccatccgcgcggaaagcggctgtgacacggtgatgatagggcgcggcctggtggcgtgtccggacctggccgcgcgcattgtcgccggcggtccggcggcgccgatggattggggcgagatgatgccctgggtgctggatttcttccgccaatgctggagcaagtcgggcgagaaccgttatccggtggccaggctgaaacagtggctgggcctgctgaagcgcacctggccggaggctgagcaattgtttgaagcgatacgccgcgagcaagagcctgaaaaaatagacaatattctgatggcaagattgggtaagtag

SEQ ID NO: 2501 - DNA, 1533 bp, Chromobacterium substugae
atggaatccacatcctcggtcggctggctggagcggctgatcccgcctgtctggtacggctcgcttacggtcttcgtcgccgctaccgccattttcgcccttatgctttgcctggcgcggccggatagccgcaagcgggtgtcgcgcaccatgctgatcacgctggcggcgttgctggtggtcaacttcagcggccagacgggcgcggggcagatggtgcgccagagcgccgtggtggtgatggggctggcgctgatccgcttgtgggcgatgctgttgttccggctgttcatgcccgcgctgcgcctgcatccgccccgcatcctcgaagacattctggtcacggtcggctatatcggctggggcctggtgctgctgcggctggcgggcttggaccttagccacatcgtcaccacttccgcggtgatcaccgcggtgctggccttctccatgcaggatacgctgggcaatatcctggccggcctatcgctgcagttcgacaactcggtggaaatcggcgagtggatcaaggtcggcgacctggtggggcgggtggtggagatcaactggcgcgccaccacggtggaaacccgcaactgggaaaccctggtaatccccaacagcgtgctgatgaagaaccacttcgccatcctgggcaagcgccatggctgcgcccagcagtggcggcgttgggtgtggttcaacatcaactgggacacgctgcccacccagatcatcaccgtggtggaaagctcgctgcgcgaggcgcagctgccgggggtggcgttgtcgcccgagcccaactgcatcctgatgggtttcgaaaacggttacagccgttacgcggtgcgttactggctgaccaatctggcggcggacgacctgaccgactccatcgtccgcactcatgtcgacgccgcgctgcgccggcacaatctgcgcatggcctcgccgttttacaatgtgctgaccatcaaggaaaacgaaaaatacatggaagcgcggatgaaaaagcatctggaggagcgggtgctggcgctgcgcaaggtggagctgctgtccagcctgaacgacgaggaaatggtggtgctggccgaccagctgaaattcacccccttcgtcaccggcgacatcatcatgcaccagggatcggtggcgcactggctttacatcatgctgtccggcgaggtggaggtgtggatcagcctggccgacggcaaccgcaagctggtggacgtgctcaaggcgggcagctttttcggcgagatggggctgatgaccggcgagtcgcgctcgggcaccgtgatcgctcgctccaatgtggagtgcctgcggctggacaaggatgcgttccaggccattctggtgtcgcgcaaggagttggcggagaccatctcttccatcctggccgaacggctggaggagcggcgcaaccggatgccggaggagttgctggacggcggcgacccggcgccgcgccgcgccgaactggtggagcgcatccgcaactttttcggcctgagcaagcattga

SEQ ID NO: 2502 - DNA, 147 bp, Chromobacterium substugae
atgggcaagcccagcaattgcatcaagatgaaattcaacgattggaaacggctgccgcgcccctaccgggcgatgatagaaggccagccgcaagtgctggtgagccggcccggccgcgactacttcatgccggtgcagtttgtctga

SEQ ID NO: 2503 - DNA, 597 bp, Chromobacterium substugae
atggaacagccaaaagacaagccgcgcggcggcaagcgcagcggcgccgggcgcaagtccgccttcggcggcgacaagaccatcgccctgcgcgtgccggagcccctgaagcccatcctgcagcaatggctggacgattaccgcagctggcgcaccgccaacagcgaggaagccagcaatttccgcacgctggggagccagttgagcgagctgtcgctgccgctgttcgccagcagcgtgccggccggctcgccggtgccggccgatgatctgaaagaagcggacatcgacctcaacgcccacttggtaaaccgccccggcgataccttcatggtgacggtgaagggcgactcgatgcagggcgccggcatccacgatggcgacctgctgctggtggagcgcagccgcgagccgcgcaacggcaaggtggtggtggccgcgctcaacggcgagctgacggtcaaaagactggaaagaagcgcgaatggcctgcggctgttgccggaaaacccggcctaccaacccatcacagtgccggaagacgcttcgttcttcatctggggcgtggtcacccgcgtcatccacaaggtggactga

SEQ ID NO: 2504 - DNA, 231 bp, Chromobacterium substugae
atgggcatagtcaagatttcggagcagatgcatgacaatctgcgcaccgccagcgaggcgttgagccgctcgatcaactcccaggccgagcactggctgcgcatcggcatgctggccgagatccatcccgacctgcgctacagcgaaatctgccagctgttgctgcgctccagccgggaaggtcaggccttggatctgcgccagcagcaagcggcggaggcgggccgatga

SEQ ID NO: 2505 - DNA, 792 bp, Chromobacterium substugae
atgagcggggtgaagatcaagacgccggccgaggtggcgaaggcgcgcgaagcgggcaagctggtggcggagctgctggcgatgataggcgagcacgtgcggcccggcgtcagcaccgaggaactggacgcgatctgccgcgagcacatcgtcaaggtgcagcgcgccatcccggccaacatcggctactacggctaccccaaaaccatctgcgcctcggtcaatcaggtggtgtgccacggcattccgtcggaaaagcagattctgcagaacggtgacatcgtcaatatcgacgtggcggtgatcaaggatggctggcacggcgacagcagccgcatgtatttcgtcggcgcgccgcggccggaggcgaagttgctggtggatacctgccatcgggcgatgtgggccggcatccgcgaagtgcggcccggcgcgacgctgggcgatgtcggccacgcgatccaggccgtcacccagcaggccggcttcagcgtggtgcgcgaatattgcggccatggcatcggcaaggtgtatcacgaggagcccgaggtgctgcattacggccggcgcggcgccgggctgcggctgcggccgggcatggtgttcaccatcgagccgatgatcaacgccggcaaggcgccgacgcgccagctggacgacggctggacggtggtgacgcaggatggctcctggtcggcgcagtgggagcatatggtggcggtgacgacgcagggctttgaagtgctgacgccgtggccggacggcgaaggcggttatccggcgcaggcttga

SEQ ID NO: 2506 - DNA, 693 bp, Chromobacterium substugae
atggcgcgcgccgaacgcctgctggacctgctgcaattgctgcgccgccatcgctatccggtgacggcggcggcgctggccgccgagctgggcatcagcgtccgcaccgtgtaccgcgatatcgccagcctgcagttgcagggcgctgacatcgccggcgagccggggctgggctaccagctgcggccgggctttttgttgccgccgctgatgttcgccgaagaagaactggaagctctggtgctgggcatgcgctgggtggcgaagcgggtcgacgcccggctggcggacgccgccggcaacgcgttggccaaggtggctgcggtgctgccggccgagctgcgctcgcaactggaagacgccgccttgctggtggggccggcgcagaccgagcccgccgccgtcgacatggcgcggctgcgcgacgccatccgccagcagcgcaagctggtgttgcgctaccgtgacgccaagggcgaggaaagccggcgagtggtgtggccgttcgcgctgggttttttcgagcaggtgcaggtgctggcggcctggtgcgagctgaggcaggattttcgccacttccgttgcgacaagatgatcagctgcgacagcccgggcgagcgctatccgcgccgccgccaggccttgctgcgggagtggcgcaagctgcatggcatcgcggaaggcgcggtgtga

SEQ ID NO: 2507 - DNA, 573 bp, Chromobacterium substugae
atgacgcgcgccatcaccctgctcacagagaatttttccgactgggaaaccgccctgatcaactccgccggccgcggctactacggctttgacgtccgcttcgccgcgccgggcggcgcggcgcttacgtcttccggcggcctgatggtgactccgcacctggcgatagagtccatttccctcgacgagctggacctattgatcgtctgcggcggcacgctgtggcgcaccggccaggcgcccgacctcacgccgctgctgacccaggcccgcgcccgcggcatcgcgctggccggcatctgcgacggcacccgcatgctggcgcaggcaggcgtgctgaacggcgtccgccatacgtccaattcggcggaaaacctggcggtgccgggttatgccggcggcgcgcattaccaggacgtgccctacgccgtcgctgaccagcgcgtcgtcaccgcgcccggcaccgctccggtcagcttcatggcagccatcctggccacattgggcataggcggagccgatctggacgcctacctcgcccagcacgccgccgaacacgccaggcccgcctaa

SEQ ID NO: 2508 - DNA, 420 bp, Chromobacterium substugae
ttgatccaagacgtccagaccgaccaggaaatcgccgactgtttcgccgtgatgcgccagttgcggccgcatctgcaagaggacggcttcgtcgccgtcgtgcgcgcgcagatggcggaaggctaccggctggcctatttgctggaagacggcgaggtggcctgcgtcgccggctaccggatccaccgcaacctgatgatgggcaaaagcctgtacgtggacgacctgtccaccgatgaatcggcgcgctcgcaaggctgcggcgccaggatgatggcgtggctgcgcgaggccgcgctggacgccggctgcgccgagatccacctggattcaggcgtgcagcgccaccgcgcgcaccgcttctacctgaaccgcaatatggacatcgtctgctaccacttttcggaacagctgcggtaa

SEQ ID NO: 2509 - DNA, 432 bp, Chromobacterium substugae
atgatccggcaagcgcagaccgatcaggaaatcgccggctgcttcgccgtgctgcgccaactgcggccgcgcctgcaagaagcgggctttatcgatgccatgcgcgaactgatggccgaaggctaccggctagcctatctgctggaggacggcgaggtggcctgcgtcgccggctaccggatcagccgcaatttgctgatgaaaaaaagcctgtacgtgggcgagctgtccaccgccgaggccgcgcgctcccgcggctgcggcgcgcggatgatggactggctgcgccaggccgcgcgcgcggaaggctgcgtcaggcttcacctcgattccggcatcgaccgccaccgcgcgcaccgcttctatctgaaccgggacatgcgcatatccagctaccacttttccgaggcgctgccgccagccgcgccttga

SEQ ID NO: 2510 - DNA, 546 bp, Chromobacterium substugae
atgctgttcaccgaaatgcccgcgctggaccaccccgacgccatgctgcgaccgctgtaccccgacgacatcctggcctggcacgattacctgaccctcccccagatctaccaacacaccagctggaacgtgcgctgctcgtccgagctggaacactatgcctggcagccggagcagttcaccgaagtcagcgcgctgcgcttcgccatcgccgacagccgcgacgaccacctgctcggcaccgccggtttccacaccgtgactccagccaacgccagcgcggaaatcgcctacgacctgtctcccgcagcccagggacgcggcatcgcccgcgccgcctgcgccagcctgctcgcctggggccatggccatcttggcctggcgcgcattcaggccaccgtgctgccggaaaacgcgcgctccatccaggtgctggaacgctgcggcttccagcgcgagggcctgctgcgcagctaccgcaaggtgcgcggaccatcgcgggacttctggatgtacagccacatagctgagggtggaaacgcatga

SEQ ID NO: 2511 - DNA, 1110 bp, Chromobacterium substugae
atgaccgaattttcttccctgctgcagcaaggcaatgcctggctgttcatccccagcgccatcctgctgggcgccctgcacggcctggagccaggccattccaaaaccatgatggccgccttcatcgtggcggtgcgcggcacggtgaaacaggccgtgctgctgggcttgtcggctaccctgtcccataccgcagtggtgtgggccgtggcgatggccgggctgtatttcggccgcaactggaatatggaaaaggccgagccctatttccagctggcttcggcggcgctgatcgtcgcggtggcgggctggatggtctggcgcacttggcgcaatctgcgcgccgaacatcaacatgggcaccgccatgcgcacccgcatgatgaaagccggatcatagacactggccacggcacggtacgattagagatattcgaagatggcgcgccgccgcgcttccgcttgcatgacgaagccaagcgcggccacggctggccggcggagcaggcctgggttgaaacggaacggccggacggcagccgccagcgcttcgcctttgtccaacgcgacggctttatcgaatccgagcaagccatccccgaaccgcaccagttcatggcccggctcagcctgggctacggccatcacagccacgactacgacgtggccttcgccgagcatggccatccggcgccggccaatgcggctgcgctggaagctttgacagatggctatcaggacccgcacgaactggcccacgccaacgacattcgccgccgcttcgccaacagcgacgtcaccaccggccagatcgtgatgttcggcctgaccggcgggctgattccctgcccagcttccatcaccgtattgctgctatgcctgcagctgaagaaagtggcgctgggcgcgacgctggtgctgtgtttcggcataggattggcgctgaccatggtggcgtccggcgtgctggccgccgtcagcgtcaagcacgtgtcccggcgctggagcggattcggcgatttcgcgcgcaaggcgccttatttctccggcggcctgatcgcgctggtgggcctgtatgtgggctgccatggctgggcggctttgccctga

SEQ ID NO: 2512 - DNA, 276 bp, Chromobacterium substugae
atggcgcatacgatacgagacaaggccaagttgctggcgcgggtgcggcgcatccaggggcaggccgccgcgttggaaaagcggctggatgcgggcgatgaggattgcggcgcggtgctgcagcaaatcgccgccattcgcggcgcggtgaacggtctgatggcggcggtgatagaaggccacctgtccgagcatctggtgaacgagccggagcaggcgcaaaggcagcgcgatctggacgcggtgctgcaggtgctcaagtcgtatctgaaatag

SEQ ID NO: 2513 - DNA, 414 bp, Chromobacterium substugae
atgctaagccccgaccatgccaaagccgaccatcaagcggtatgccgcagcgccaatgccatccgccatgtgttcggcccgcaaaatcactggccacctaccgatatcagctttgacgaaaacctggccgacctgcgccgccaccttgcggagttcgaacagcgccaggcctttgcctattgcctgctgactccggacggcaaacactatctggggtgcctgtatttgaaaccaatcaagtcccgtttggaaaacgactggcgcaagcaaagctttcaagcgcaagccttcttgtggttgagcctcggcgacaatcccttgcaagaagagcagacgctggcaacgctccagaactggctgtcccggcattggccgcttgcctccattgcccggccaggccgcgccccaggctga

SEQ ID NO: 2514 - DNA, 369 bp, Chromobacterium substugae
atgcaacaccccgacttcgtgattttgtacgtggaccagccgatgcgcagcgcagatttctattcgcggctgtttgatctgcagccgatccagctgtcgcccacctttgcgatgttcaagttcgcgtccggcatgcggctgggcttgtggtcgcgccacacggcggagcctgccgccgagatgatgggcggaggcggggaagtggtcgtgcggctggaggatttcgccgcgctggatgcttgcctcgccgattggcgcgcgcaggggctgcgcattgtgcaacccatcacggatatggattttggccgcaccttcacggcgctggacccggatagccaccggctgagagcctacgtgcggacggagtga

SEQ ID NO: 2515 - DNA, 438 bp, Chromobacterium substugae
atgctgaagaccgaattgcgcaccgtcccctcctggctgatcaagcgtgctgcgcatgcgctgacgcgccatgcagaggcgcaactgcggccgctgggcctgggcatggccagcctgccggtgctgacggcgctgaaaaacggcgaagccgccacccaggcggaactggcccgcctgctgcaggtggagcagccatcgatggcgcagacgctggccaggctggagcgcgaccagctgatcctgcgccgcccctccgccgccggcaaacgcgcgcaaatcgtggaagccaccgcgctgggacgggaacgcctggcgcaggcgattcctgcgatggcggccggcaacgccagggcgctggcgggcttcagccgcgaagaagaagcggttctggccagcttgctgcaacgcgtctgcgccaatctgggcgacgcgccctga

SEQ ID NO: 2516 - DNA, 1095 bp, Chromobacterium substugae
atgccgcttccttctggcgtcgccattgtcggcgcggggcccgccggcctgttgctggcccgcggcttgcttctgcgcggcattccgttcaccttgttcgatcgcgacgcctcggcggccagccggccgcagggcggcatgttggacctgcacccggacaccggccagcaggcgttgcgcagcgtcggcctgttcgaatccttcctgcggatcgcccgctatgaagaccagggcatgcgggtgttcgaccgggatggccgtctgttgatggaaaagggcgcggagggcggcgactgccctgaagtggaccggggaccgctgcgcgacatgctgctggatgcgttgccggctggctgcgtccgttggggccatgccttgcgcgaagcggaggcgctgccgggcggcggcttcgagctgcgcttcggcaacggcgcggcgcgccgttttgacttcgtggtcggcgccgacggcgcctggtcgcgggtgcggcccttattgtcccgcgccgagccgatctacgcaggcttggtgtaccacgaactgtccatctccgacatcgacgcggcgcatcccgagctgtccgccttggtcggccgcggcacgctggtggccaagggcggcggcaagacgctgttcgcgcagcgcaacgccaacgcgcaagtgcgggtctacgcggttttgcgccaggcgctggcggcggacggccggcgcgccgcgccggcaagcaaggcggagttgctggcggcgttcgctgattgggatagcagcctgcggcgcttgatccaggcggcagacgagccggcgcggccgtggcccatccatgcgctgccggtgggtcatcgctggaaggggcgcgacgacgtcacgctgataggcgatgccgcccatttgatggcgccggccggcgagggcgcgaacctggccttgcgggacgcttgcgacctggccgccgcgctggggcgcgacgattggcgcgcggcgttgcgcagccatgaggcgcggatgttcgcgcgggcggagcttgccgcggcgcgcgcgcagcggatgctggccgagggcgcggcgggcgatgggcggttgcgcgaggtgtcctga

SEQ ID NO: 2517 - DNA, 753 bp, Chromobacterium substugae
atgaattcactgggcaaacgctgcctgccatggctgctggccctgccctgcggcctgcaggcagcccccgccgcttcgctgccggcgcccatccaggcgctggcgcaacaaggctacgagattctggacagtttcgaagcgcccggcggcctcaccggctatgccgcgctctacctgagccggccgcaaaccgtctatctgaccccggacggccaacacgccatcgccggcgccatcaccgacgcgcgcggcgacaaatggaaccaggccgggctggaccggcagtttggcgcggcgatgctgcggcaactggaaaacagcgcctggatagcggacggcgacgccaaagcgccgcgcgcggtctacgtcttcaccgacccgaactgcccctattgcagccagttctggcgcgacgcccgcccttgggtggacgccggcaaggtgcagctgcgccacatcctggtgggcatcctggaagccgacagccccggcaaggcgatggcgctgctggccgacgccgacccggaggcggcgctcgcgcgccacgagcggcagcccggcggcggcatccagccgctggcccgcccgccgcgcgccgccgccgacaaactggccgccaatcaccaattgatggagcgcttcggcgccttctccacccccgccattttctacctcgacgcaacaggcgcgctgcgcaaggcccaaggcgcgccgtcgccggccagtctggccaagatcatgaacggcgaatag

SEQ ID NO: 2518 - DNA, 867 bp, Chromobacterium substugae
atgcaaaacttcaacgaagccgaacgcgagcagctgtaccgcgccgccatcggcccccagcggcaggaatattacctggcgcgttttctgcgattcgatagccaaggcaagcctggggccggctggcattggcccaatctgttcatcaccttcttctggctgctgtaccgcaagcagtggctgcccgcgctgatctactatctgctgcccggactcttcctgctggcgattggcctgctgtccgcgctggcgggcgccaaggccagcggcttcctttccctgctgtatctagccttcatggcaggcatgctgctgttgccgccgctctgcgcagacgccttttactaccggcgttgccaagccaagatacgcctcagcgcgcaaaaggccgggccgaatctggacgctcgcctggcgtggctggcgaaaagcggcggagtcagccggatcgcgccagccatcgccatcgtcatggccgcgttgtttggcgcgggcctgcttgccgcaaccgccatccccgcttatcagaactacgccatccgcgcccaggttgccgacgcgctgagcgccaaccagggctatcaggaagcgataggccggtattacagccagcgccgcgccttgccctcaaccctggcggacagcggctacacggccggcgcgcaacccgaatccgtgcgcgcggcagcatacgacaagcaaagcggcgcgctcaccctatctatgtcgctgccgagaaacaaggtcaacaccttggtgctcgccccggtgccggatgcccagggccgaatccgctgggtttgcagcagcaccctgccggatgccgccctgcccgacgcctgccgccggccagatgccgcgcgctag

SEQ ID NO: 2519 - DNA, 555 bp, Chromobacterium substugae
atggccaaactattctttcgctacgccgcgatgaacagcggcaaaagcacccagctgctgcaaatcgccaacaattacgagtcgatggacaagaaagtggcgctgtacaccagcgccatcgacgaccgctacggcgtgggcatgatcacctcgcggctgaacatccagcgcgagtccaacactttcgacgccggtttcgatttcctggcccacgattacggcgacaccgcctgcgtgctgatcgacgaagcgcaattcatgacgcccgagcaggcgcagcagctgcaccggctcgcccactcccgcaacattccggtgatttgcttcgggctgcgcaccgacttccagggacacccctttcccggttccgcctggctgctgtctctggccgacgacgtggaggagatcaagaccatctgccattgcggccgcaaggcgacgatgcatatccgcatcgacggcgcgggccaacgggtgaaggaaggcccgcaagtggaaatcggcggcgaagcgcgctaccgcgccgtgtgcggccgctgcttccacaaagcctga

SEQ ID NO: 2520 - DNA, 918 bp, Chromobacterium substugae
ttggccgatggccgcgccggcgccttcgcgttcgaatcggtcacgccggggcagatcatcgatttcgtcaagcgcgcgccagcggacaaggcggtggtgaccggcatgctgtcattgccgcggcaggcgcaaggcccggttcccgccgtcgtgatcctccatggcagcctcggcatcaatccgggggagtggatgtgggccaagcggatgaacgagctgggctacgccagcttcgtcgtcgacagcttctccggacggcatatcgcggagacggaaaaagaccagacgcggctgtcgatggcggcggatatcgcggacggctatgccgctttgcgcctgctggccacgcatccggcgatcgaccccaagcgcatcgccgtgatgggattttcgcgcggcggcgtcgccgcgctttattcgtcgttggagccattccgaaagggcgtcatcgatgacgatgtgcgcttcgccgcgcatgtcgcgttctaccccagctgcggcatccactatgcggcgaatcatctggatggcgcgcctgtcctgatgctgcttggcggcaaggacgactacacgcccgccgcgccttgcctcgactatgccgatgctttgaaggccaagggcgcgcaggtgacggtgaaagtgtatcccgacgcctaccatgccttcgaccggttcacgccgctgcgcgccgtttctagcgcgaccagcgccaggttgtgccatggcgaatatgacctggattcgggccggttcaccatggccggcagcgctggcgtcgtgtctggaggcgaggcgaagatcgctgcgcaggcatgcctgagccggggcgtcaccataggcggagaccccgtcgggcgcgagcaatcgccggcgctggtcgccgactttctgaagtcggtgttcgcgaaggatagatag

SEQ ID NO: 2521 - DNA, 396 bp, Chromobacterium substugae
atgagcaaactgccgttcaaccagggccaaccggccttcatcccgctctccacctttcagcgctacccggaaacggaaatggtggagcgctcccgcgccttctacgccgacatccgccgccgcaagaccgtgcgcgaattcaccagccagcccgtgccgcgcgaagtgatagaaaacgcgctgcgcgccgccggcaccgcgccctccggcgccaatcaccagccctggcatttcgccgtcgtcagcgacccggaacggaaacggcagatacgcgaaggggccgaagccgaggagcgcgaattttatacacaccgccgccgcaggaatggaaggacgctctggcgccgctgggcacggattcagacaaaccttttctggaaaccgcgccatacctga

SEQ ID NO: 2522 - DNA, 849 bp, Chromobacterium substugae
atgctcagctaccgccacgccttccacgccggcaaccacgccgacgtgctcaagcacctgatcgagatcgaactgctgaattacctgggccagaaagacaagccctactggtatatcgacacccacgccggcgccggcgcctattcgctggtggaaggctacgccaccaaaaacgccgaattcgaaagcggcattgcccggctgtggcagcgcgatgacctgcccgaagccgtgcgcggctacgtggaggtggtcaagcggatgaacccggacggcgagctgaagttctaccccggctcgccgtggtgcgcggccgatgtgatgccggaaagcgacaaattgcgcctgttcgagctacaccccaccgacgcgcagctgctgcagcaaaacttcgaaggcagcggccgccgggtgcagatccagcaggccaacggcttcgaaggcatcaaggccatcctgccgccgccgccgcgccgggcgctggtgctgatcgacccgccctatgaagacaaacgcgattaccagaacgtgaacaccgcgctgaaggaaggcctgaagcgcttcgccaccggcgtctacgcggtgtggtacccctgcctgcagcgcgcggaaatgaaggaaatgatcccggcgctgaaaaagctgccggccaagaactggctgcgcgccgaattgcacgtgcaaggcccgtccgccgacggtttcggcatgcacggcagcggcatgttcatcctgaatgcgccatggacgctgcccaagacgctgaacgaagtgctgccctacctggcgcagcatctgggccaagacgccaaagccagcttcatcctggaaaccggcggcgatctgtaa

SEQ ID NO: 2523 - DNA, 750 bp, Chromobacterium substugae
atgctgcagatactctatcgggacgatcaactgatcgccatccagaaacccgccggcctgctggtgcaccgcaccgtgctggaccgcaacgaaacccgcttcgccatccagctgctgcgcgaccagataggccaacgcgtctacccggtgcaccggctggacaagggcacctcgggcgtgctgctgttcgcgctggacaaggacgccagccgcgaaatgagctggcagttcgagcgccagcaagtggccaagcgctacctggcggtggtgcgcggccatgccgacgacgccggccatatcgaccatccgctcagccgccgcccggacgatctggagtggataggcgaaaaggtggaaaccgcgccgcagccggcccagaccgactaccgcacgctggcccgcatcgagctgccgatagcggtggagcgctaccccaccagccgctacagcctggtggagctggcgccgctgaccggccgccgccaccagctgcgccgccatctgaagcacatcgcccaccccatcatcggcgactccacccacggcaagggccgccacaaccggatgttcgccgaacagctagactgcgcgcgcatgctgctcgcctgcgtggaaatgcggctgacccaccccgtcaccggccagccgctgcggctggactgcccgctggaagagaacttctccgcgctgctgacgcgcctgggctgggccgatgccgcgcgcgccgccggaatcgaactaaccatctga

SEQ ID NO: 2524 - DNA, 1005 bp, Chromobacterium substugae
atgacaattcaattgaaacgtatcagctttgcagttgccgccgcggttctgtcggcagcggcttgcgccaaggacttcactcccgccgtgatttacgattcggccggcaagtttgacaagagcttcagcgaagccgcctacaacggcgccgagcgtttcaagaaagacttcaaggtcaactaccgcgacggccagatctcgtccgacgcgcaaaaagaacagctgctgcgcaagatggccggcagcggcgccgacgtggtggtcgccgtaggcttcaacttctcccaggccgtggaaaccgtggccaaggaattccccaaggtcaagttcaccctgatcgacgccgtggccaagggcccgaacgtgcagagcatcgtgttcaaggaacaagagggctccttcctggtgggcatggccgccgcgctgaagtccaagaccggcaaagtgggctacatcggcggcatggacatcccgatgatccgcgccttcggctgcggctacgcccagggcgccaagtacgccaacaagaacgtggctgtgctgcagaacatgaccggcaccaccccgcaggccttcaacgacccggcgcgcggcaccgaactggccaagagccaattcgaccgcggcgccgacgtgatcttcgtcgctgccggcggcaccggcatgggcgtgctgcaggccgccaagaacgccggcaagttctccatcggcgtggacagcaaccagaactacctgttcccgggctcggtgctgacctcgatggtgaaaaaagtggacgtggccgtctacaacaccttcaaggacgccaaggacggctcctggaaatccggcgtgcgcgtgctgggcctgaaggagcaagccgtggattgggcgctggacaagaacaaccgtccgcagatcacgcctgacatggaaaagaagatcgccgccgccaaggccgagatcatcagcggcaagatcaaggttgtcgattaccgcgccaacaacagctgcccggtacaataa

SEQ ID NO: 2525 - DNA, 1530 bp, Chromobacterium substugae
atgaccgagtttgccattgagctgacaggcatcaacaagagttttggcgccgtgcaggccaaccgcgacgtgacgatgagcgtgcccaagggcagcattcacggcgtcatcggcgaaaacggcgccggcaagtccacgttgatgagcatcttgtacggctattaccaagccgacagcggcaccatccgcgtgaacggcaaggatgcgcgcatccgcaacagccaggaagccatccgtttgggaatcggcatggtgcatcagcacttcatgctggtggacaccttcactgtgctggaaaacatcgtgctgggcgccgaaggcggccggctgctcaagggcggcatggacgaggcccgcgagcacctgaaggaactgaaccgcaactactcgctggaagtggacccggacgcggtggtcggcgagctgggcgtcggcctgcagcagcgggtggaaatcctcaaggcgctgtaccgcggcgccgacgtgctgatcctggacgagccgaccgcggtgctgacgccgcaggaagccgaccacctgttccacatcctgcgctcgctcaaagagcagggcaagacggtgatcctgatcacccacaagctgcgcgaagtgatggacagcaccgacaatgtcagcgtgatgcgcgccggcaccgtggtggccaacgtccgcacctgcgacgtggacaaggaaaagctggccgacctgatggtgggccgcaaggtgacgctgaaggtcgacaaggccgagcgcgcgccgggcgcggtggtgctggacgtcaagagcctgtgcctgaccgacgagcgccaggtcaagctgctggacggcctgaacttccaggtgaaggcgggcgagatcgtcggcgtggccggcgtgtccggcaacggccagtccgaattgctggaggtgctggccggcatgcgcgcgcccagcgccggcgtggtcgcctacaagggcgaagacctgctcaagctgccgtgcaagcgcgcgccgcgcgccgccgtctaccgccgcatgggcatcagccacattccggaagaccgttcgcgcgaaggcctggtgaagagcttctccacctacgagaacgccatcctcggctatcacggcgacaagacgctgaacagcggcccgctgtattcgcgcaagaagttggtggagcggacccgcgacttcatcgcccagttcgacatccgtccgggcaatccgctgctgcgcgtgggcctgctgtccggcggcaatcagcaaaaagtggtgctggcgcgcgaaatccacgccaaccccgatctgctgctgattggccagccgacgcgaggcgtcgacatcggcgcgatcgaattcatccacaagcggctgatcgagctgcgcgacgaaggcaaggccatcttgctggtgtcggtggaacttgaagaaatcctggcgctgtccgaccgcatcctggtgatggccggcggccagatcaccggcgaagtggcggccaaagacgccgacaccatttccctcggcctgctcatgggggggcacaagcattga

SEQ ID NO: 2526 - DNA, 1095 bp, Chromobacterium substugae
ttgaaattcggacaaccatccactttgccgcgttgggcgcagctgaccatcctgccggcgctcaatctgctggccgccttgctggtgacgggcttcgtcacctggatgattggcgaaaatccgtgggaatgcctgcagttgctgatacacggcgcctttggctacggcgagggcgccggctacacgctgttctacaccaccagctacattttcgccggcctggcggtggccaccgccttccacgcggggctgttcaatatcggcggcgaaggccaggcgtatctcgctggcctgggcgtgacgctggtgatgctgggcttcgaccacacgctgccgtcctatgtgctgattccgctggcggtgctggcggcgatgggcttcggcgcggcctgggcctacatcccggcctatctgcaggccaagcgcggcagccacatcgtggtcaccaccatcatgttcaacttcatcgcctattcgctgatgttgtacctgatcagccaccagttgatcgaagccggctcgcaaaacccgaccacccgccagttcgccgaaaccggctggattccgcagctgcacacgctgttctcgtcgctgccgaattcgccgctgaacctgaccttcgtgctggcgctgctggcgtcggcgctgttctacctgatcgtctggcatagccgctggggctttgaactgcgcaccgtcggcaccaacgagcacgccgccggctacgccggcatgagcgtcagccgcgtcatcatcatcgccatgtgcgtgtccggcgcgctggcaggcctgtcgtcggtgaacgatctgctgggctcctcgcatcggatgaacgtgctgttcaccaacggcgtgggcttcgtcggcatcgccgtggcgctgatgggccgcaaccacccggtgggcatcatcctgtccgcgttgctgttcggcgcgctgacccagggcggctccgacctgtcgttcgagaaaccgatgatcacccgcgagatgatcctgttcatccagggcttgatcatcctgttctgcggcgcgctggaaaatctgttcgagccgttcatcgccggcctgttcaagcgcaaggacaaaaaataa

SEQ ID NO: 2527 - DNA, 966 bp, Chromobacterium substugae
atggaaatgttcttcagtcttctcgactccaccgtccgcgtggcgacgcccctggtgctggccgcgctggcgggcatgttctccgagcgctccggcgtggtggacatcagcctggaaggcaagatgctggtggcggccttcgcttccgccgccgccgcctacgtcacccacaacccgtggctgggcctgctggccggcatcatggccgcggtgtcgatggcgatggtgcatgccttcgtctccgtcacctataacggcaaccagctgatctccggcatggcgatcaacaccgtagcttccggcatcacgccggtgctgggcctggcctggttccagcagggcggcaactcgccgcagctgccggacgaaggccgcttccacgagatcgtgctgccgttcgccgacgcgctgcgcgacgtgccggtggtgggcctggtctacagcaagctgatttccggccacagcattctggtctacctcaccgtgttcgtcgtgattccgctggtgacctgggtgctgtacaagacccgtttcggcctgcgcctgcgcgcggtgggcgaaaacccgcacgcggccgacaccgccggcatctcggtggccaaggtgcgctacaccgccttgttctggggcggcgtgctgtgcggcatggccggcacctatctgtccgtctaccagaccggcagcttcatcaaggaaatgaccgccggcaagggcttcctggcgctggcggcgctgattttcggcaaatggcgtccggtgccggcggtgatcggctgcctgctgttcgccttcgccgatgcgatccagattcgtctggaaggcgtggcgctgccggtgatcggccagattccgtcgcaagccatcgcggtgattccttacgtgctgaccgtgctgctgctggcaggcttcgtcggccgggcgctggcgccgaaggccatcggcgtgcctttcgtcaagtcgcgctaa

SEQ ID NO: 2528 - DNA, 1194 bp, Chromobacterium substugae
atgttgagctaccaacaggcgcgcgactggctgctggaacgcgccaggccgctgagcgcgcggcaaatccttcccctggcgcaaattcatggccgcgttctggcggagccggtgcgggcggcgctggacgtgccgccgcacgacaacagctcgatggatggctatgcgctgcgttgcgccgacttcgccgctgccatgccggtgtcgcagcggatcgccgccggcgcggcgccgcagccgctgcaaccgggcagcgcggcgcgcatcttcaccggcgcgccgatcccgccgggcgccgacgcggtgatcatgcaagagcaggcgcagctggacgccgacggtaaggtgagattcgccgccgcgccccgtcccggccagaacatccggctgcgcggcgaggacatcgccaacggccaggaaatcctgccggcgggccgccggctgaccgccgccgatctggggctggcggcttccatcggcctcgccgcgctgcccgtgctgcagcccttgcgggtggcggtgttcctcaccggcgacgagctggtcgagcccggccagccgctggccgccgggcagatctacaattccaaccgctactggctgctgccggcgctgcggcaactgggctgcgaaaccatagacctgggcgcggtgcgcgacgacctggacgccacccggcgcctgctgcgcgacgcggcggcggccgccgacgtggtgatcacctgcggcggcgtgtcggtgggcgaagaggatcatgtcaaggcggcggtggaggccgaaggcgagttgacgctgtggacggtggcgatcaagcccggcaagccgctggcctgcggccggatcggcgacgccgacttcatcggcctgcccggcaatccggtgtccggcttcgtcacgctgcagacgctggtgcggcctttcctgcaaaagcggatgggtttgccgttggcggagcaggcgatccagcgctatcctgcggccttcgcctggccgaagccggacgcgcggcgcagcgagtttctgcgcgtgcgcaggatgctgacggacgagggctggcagctggagctgtatccgcagcaaagctccggcgcgctgacctcctgcgcctgggccgacggcctggcctggctggaaccaggccagacggtggcgccaggcgacagcctgcgctattgggcgctggacctggcgtga

SEQ ID NO: 2529 - DNA, 342 bp, Chromobacterium substugae
gtgacgcgcatccgctttgtcggcgagagcggcgccttgcttggcgaggcggacgcgcaggcgggcgacaatctgctggacatcgcccgcctggccgacgtgccgctgcactggcgctgcggccagggcacctgcggcacctgcaaggtgaaagtgctggccggcatgggcgcgccgcagcggccggggcgcaaggagcgcaatgtgttgctgcgcgccggcgccatcagcgagcagctggcgggaatggaagagtgggaggaggctcagccttggcggctggcttgccatctggcgctggcggagagggcggattgggaagtgctgtgtcccgatgactga

SEQ ID NO: 2530 - DNA, 1092 bp, Chromobacterium substugae
atgcccgtcgccaatggttttcccaacatcagcatcctcagcgtgttccgcatcgccatcctggccctgctggtgatttcctgcatcaaggtgctgcaaccctttctcggcgccctgacctgggcggccatcatcgccatttccgcctggccgctgtacagccggctgtgcctgcgcctgaagggccgccgcaagctggccgcgctgctgatcgtgctggcgctgtccgccgcgctggccattccgatcgggctgatggcgctgacgctggccgacaccctgccccatctggccaacctggcgcacgatctgaccagcttccgcctgcccgacgccccatcctggctggtgaatctgccggtggtcggcgaaagcctgcagaagatgtggcaaggcgtgcaagccgatctgcccggctttttcgagaagattcgccccgccatcaacgatgcggcgctgtggctgctgtcaggcggcgccaacctgggcctcagcctgctggaaatcgtgctggccatcgtggtggcaggcctgctgctgatcaacggcgacaagctgtgggagctggtggagcgcatcgtggtgaagctgggcggcgaaaccgccagcgacctgccggaagtcatcgcccgcaccatacgcagcgtcaccaccggcgtggtgggcaccgcgctggcgcaaaccatactgtgcgtgatcggcctgctgatcgccggggtgcccggcgcgctggtgctgggcttcctgtgcttcatcgtcgcggtggcgcagatgccgacgctgatcgtctggctgcccgccgccggctgggtgttctacaccggccacaccggcatgggcatcttcctgctggtttggggcttcttgctgatcaacaccatagacaacgtgctcaagccgctgttgatcagccagggcgcgcagatgccgctgtcggtgattttcctcggcgtgatcggcggcctgatcgcctggggggtgatcggcctgttcatcggccccaccctgctggcggtgggcctgaccatgctgcgccactggctggagcgcgacgacaacgaggagctggcctgcgaaggcgagcagggctga

SEQ ID NO: 2531 - DNA, 1797 bp, Chromobacterium substugae
gtgcaagcatacctatattccacctaccgaaccgcctggcaatggctggcggcgctgctcgcctgtctgagcttcgccctgcccgcccacgcggtcaaccaggatgatctgctgccgccggaacaggcgttcgccgccaaggtcgcccgccatggcgaccagttggagctgacgctggatgtcgcccccggctactacctgtaccgcgaccgcatcagcatcagcagcgccccggccgacctgaccggcaagcccgcgctgccggccggccaggaaaagagcgacccttacttcggcaagcaggtcatctaccacggcaagcagaccatcgccattccgctggcggccggcgcgccggccgacttccagctgaacgtcaggctgcaaggctgcgccgaggccggcgtctgctacccgccctacacccacaagctgaaggtggggcaggcgggcggctccggcaacaagcttagcgcctggacggaggtcggcacctcgggaaaagcgtcggccggtaacagcgagttggcagccaaagggtggctgcccacactgggcacctttttgctggcgggcttgggcatggcgttcaccgcctgcatgtacccgctgctgcccatcgtttcatcgctgattgccggccagggcaccacacttacccgccgccgcggttttctgctgtccctgatctacgtgcaaggcctggcgcttacctacaccgccgtcggcgtggcggccggcctcaccggctcgctgctcaccgtctggctgcaacagccggccgtggtgctgaccgccagcgcgctgatggtggtgttcgcgctgtcgatgttcgacctgttctccatccagctccccagcagcatccagtcgcgactgaacgacgcctccaaccgcctgtccggcggcaaggccgccaccgtgttcctgatgggcgcgctgtcggctctgctgatcggcccctgcgtcgcgccgccgctggcgctggcgctgggctatatcggcagcaccggcgatgcggcgctgggcggcgcggcgctgtacgcgatggctctgggcctgggcctgccgctgatcgccatcggcaccttcggcggccatgtgctgccgcgcgccggcaactggatgaaggcggtgaaatcggccttcggcgtgctgatgctgggcctggccatctggctggccacccccttcctgccggccgcgctggtgatgctgctgtgggcggcgctgctgatcggcgccgcggtgttcctcggcgcgttcgacagcctgtccgccggcaccggcagccgcgcgcggctgggcaaggcgctcggtctgctgctgttcctgctgggcgccgcccaactggtcggcctgctctccggcgccgacaatccgcgctacccgctcaagctgatcgccgccagcaacgcggaaggcgccgcccagccgcacgccaacttccagccggtgaattccagcgccgagctggacgccaggctagccgaggccaaggccgcgggcaagccgctgctgctggacttctacgccgactggtgcatcgcctgcaaggaaatggaggccgaggtcttcccgcaagcgcaggtggcggccaagctgggccggttcacgctgctgcgcgccgacgtcaccgccaacagccccgagcatcaggcgctgctcaagcgcttcggcctgttcggcccgccgggcatcatcctgttcgacgcgcaagcggccgaacgcaaccgcgtggtgggctacaccccggcagaggcatttgcccgggagctggccaaggtggcaaactag

SEQ ID NO: 2532 - DNA, 801 bp, Chromobacterium substugae
atgcgggaaaccatacacttcgcccacgccaacagttttccggcgtcggtgtatcgcaagctgctggggcggctggccgaacgccaccacgtcggctatctcgacaccatcgggcatgatccggcctacccggtcaccgattgctggccgcggctggtggaggagagcatccgcttcatcgagtcgaactacgccggcccggtggtcggcgtcgggcattcgctgggcggctttctgatgttttacgccgccttgaagcggccggagctgttccgcgccatcatcatcatggattcgccgctgatggggccgtcgcgctccttcggcatctggctggccaagcggctgggcttcatccagcgggtgacgccgggcggcaacacgctgaagcggcgcgacaactgggcgtcggtggagatggtgcgcgattacttcgcccgcaagccggcgttcgcccgtttcgacccggagtgcctggccgactacgccgaactcggcacccaggacgacggccgcggcgggcggcggctgaaattccgcccgcaggtggagcatgacatctacgccaccttgccgcacgatttcccccgccatcgcggccggctcaaggtgccggcggcttttttagccggcgccggctccgacgtgctgggcgaatccgacctgcgcttcatgcgcaggcatttcccgatgcgggtggaaacccagcggggcagccacctgtttccgctggaacacccgctagagacggccgaccgcatcctgcagctgctggagcaactggcgccgcgccagccgtga

SEQ ID NO: 2533 - DNA, 1074 bp, Chromobacterium substugae
gtgtcggaatcactactcaagcaacaccgcgacgccatcgacgccatcgacgtcgaaatcctcaccctgctgaaccagcgcgccagccatgcccgcgagatcggcgagatcaagggcggcggcatcatctaccgtccggagcgcgaggcgcaagtgctgcgccggctcaaggatctcaaccccggtccgctgccgagcgagtccatcgcccgcctgttccgcgaagtgatgtcggaatgcctggcgctggaaaagccgctgtccatcgcctatctggggccggagggcaccttcagccagctggccacggtcaagcacttcggccatgccgcccgcgccgtcgcctgtgcttccatcgacgaagccttccgcctggtggagtcgcgcgcgctggattacgtggtggcgccggtggaaaactccaccgagggcgcggtcggccgcacgctggacctgatggtcagctcgccgctgaagatttgcggcgaagtggtgctgcgcatccatcaccatctgctgcgtagcgcggaggggtttgacggcatccgccgcgtctacgcccatgcccaggcgctggcgcaatgccacgagtggctgaacaagaacctgccggccgatgtcgaacgggtgtcggtcgccagcaatgccgaggcggcgcggctggcttcggaagatgcctccgctgccgccatcgccggccaggccgccgccgagcgttacgcgctgctgaaactggcggaaaacgtagaggacgagcccaacaacaccacccgtttcctggtgctgggcctgcaggatgtcggcgtcaccggccaggacaagacttcggtcgtggtgtccgcccccaaccgcccgggcgcggtgcaccagttgctggagccggtggccgccaatggcgtgtcgatgagcaagttcgagtcgcggccatcgcgcgcgggactgtgggactatgtgttcttcatcgacctggaaggccatcgtcaagacgagcgggtgcaaaaagcgctggctggcctgggcgagcgcacctccttcgtcaaggtgctgggctcctatccggctgcggtgttgtga

SEQ ID NO: 2534 - DNA, 591 bp, Chromobacterium substugae
atgagcgagataaaagcgatctgcctgttttgcggctccaacaagggcgccaagcccgaatacgaggccgccgcccggattttcggccgcacgctggccgagcggggcgtcacgctggtctacggcgccggcaaggtggggctgatgggcgtggctgccgacgcggcgctggaggccggcggccgtgtggtgggagtgatccccgaatttctgaaggccaaggaagtggcccatctggggctgagcgagttgcacgtcaccgagaccatgcaccagcgcaaggcgctgatggctcagttgtccgacggtttcatcgccttgcccggcggtttcggcactttcgacgagctgttcgagattttgacctgggcgcagctgtcggtgcatgacaaaccggtcggagtgttggatgcggcaggcttcttccagcctctgcaagccatggtgcgccatgcggtggaagagggcttcgtgcccccgggcaatctcgatctgttccgcatcgacgccagcctgccggccattctggactggatgcgggcttatcgcccgcaaccggtggccaagtggctggagctggcgaaaacctga

SEQ ID NO: 2535 - DNA, 621 bp, Chromobacterium substugae
atgccggccatgcgttctccgtccgccaatcgggcgactgtctggcagcgcctgcgccgcgcggccagctggccgctggtgctgctgctggccgccgtcatcgcgtttgaagagtatgcgtgggacgagcttgccgcggggctggcgtggctggccaagtggccgccgctgacgcggctggagcgctgggtggccacgcgttcgccgcgcgtggcgctggcgctgttcctgttgccggcgctggcgctgctgccggtgaaactgggcgctttgttcctgatcgagcaggggcacgcgctgttggggctgggggtgattctgctggccaagctgggcgggacggcgctggtggcgcgcttgttcgcgctgacgcgtccggccttgatgcaggtggcgtggttcgtccggctgtacgggaagttcaatgcctgccgcgattgggcgttcgagcggctgcgcagttcgctgccgtggcgttgggcccggctggcgttgcgtcgggttaggcgttggcgcggacagccgtcggcattctcgcggctggtgcgcaggctggccggcaaatggacgcatgcgcggcgttccgagggacggagcggcgcgagaggggaaaccgaatga

SEQ ID NO: 2536 - DNA, 648 bp, Chromobacterium substugae
atggcggcgggcggcctggcggattggctgtcgggcctgcagccggttgggcgtcagggcgatgcgatgacggcgctgccggagctgttgggcaagatcgccgaatgccaagcctgcgcctcgtcgttgccgcatgcgccgcgcccggtgctgcgcgcctcgacgcgttcgcgcattctgctggcggggcaggcgccgggcagccgcgtgcatcagagcggcatcccctgggacgatgccagcgggcggcgcttgcgcgagtggctgggggtggacgaggcggttttttacaatgaagactgcttcgccatcgtgccgatgggattctgttatccgggcacgggggcgaacggcgatttgccgccgcggccggaatgccggcggttatggcacccgcagttgctgccgctgttgacggatgtgaggctggtgctggcggtgggggcctatgcccaggcttatcacctgccggaccgcaaggcgacgctgacggaaacggttgccggctggcgcgaatatctgccgcgccgcatgccgctgccgcatcccagtccgcgcaaccagctatggctgagccgtcatcgctggtttgaagaagagctgttgccggaactgaaattgcgggtcgccgccgcgctggagccttga

SEQ ID NO: 2537 - DNA, 1272 bp, Chromobacterium substugae
atgaagtgtgttgatgattttcgtctaaggctgggcaagcaggagctggtccccgtcatgataggcggcatgggagtggacatttccaccgcgaccctggctttggaagccgccaggctgggtggggtcggccacatttccgatgcgatggttcccaccgtcaccgaccgccgcttcaataccaaatacgtcaagagcaagctggcccgttacaaattcaacgtcgaaaacccggacaagtcgctggtgcagttcgacctgggcctgctggaggaagccacccgcctgcatgtgggcaataccatgcagcgcaaggagggcggcggcctggtgttcatcaactgcatggaaaagctgacgatgaacgcgccgaaggaaacgctgcgggtgcgcatgcgggccgcgctggacgccggcatcgacggcatcaccctggccgcgggcctgcacttgggctctttcgccctgatcgaagaccacccccgtttccgcgacgccaagctgggcatcatcgtgtcttcgttgcgcgccttgcagctgtttctgaagaagaacggccgcagcggccggctgcctgactacgtcgtggtggaggggccgctggctggcggccacttgggcttcggcatggattgggcgcaatacgatctcgccagcattttcggcgaaatccgcgactggctgcggtccgagcagctcgatattccgctgatcccggctggcggcatcttcaccggcagcgacgccaccgcttttctggaagcgggcgccggcgcggtgcaagtcgccacccgcttcacggtcagccgcgagtgcggcctgccggagaaggtgcagcaggagtatttcaaggccagcgaggaagacatcgaggtcaaccagctgtctcccaccggctatccgatgcggatgatcaagagttgcccggccatcggcgacagcatccggccgaattgcgaagcctatggttatttgctggacgccaagggcagctgctcctacatcgacgcctatcacaaggcgcaacaagaggccgcgccgggcgccaagcgcgcgccagtatgggaaaaaacctgtctgtgcacccatatgcgcaatttcgattgctggacctgcggccattacgcttaccggctgaaagatacctcgcaccgccgggaagacggcagctatcaactgttgagcgccgagcacgtgtttcaggactaccagtacagcaaggacaacaagatcgcgctgcctccccgtgaggtgtgcctgatggtgggctga

SEQ ID NO: 2538 - DNA, 702 bp, Chromobacterium substugae
atgagcaaaatcgacaagcatgaccagcaggaagcggtttcccaaaaaatacgctatcgcttgaaacaggcgggagcgcgcttccacgccaacgacaatatcgccgccttcatcgaggagggcgaactggacgccctgcaggacgaagtgcaggccaaattggcgggcgtgctggaaagcctggtgatcgataccgagaatgaccacaatacgcgggatacggccaagcgggtggccaagatgttcgtgcgcgaggtcttccggggccgctatgcggcgatgccgtccagcaccgagtttcccaatgtcgagcgtctcaatgaattgatgatcgtcggccccatcacggtgcgcagcgcctgctcgcatcatctgtgccccatcatcggccgggtgtgggtgggcgtgatgccgaatgaaaattccaatttgatcggcttgtccaagtacgcgcgtctgatcgactgggtgatgacccggccgcagatccaggaggaggcggtgtcgcagatcgccgaattgttgatgcgcaagctgcagccggacggtttggccatcgtgatggaggccgaccacttctgcatgcactggcgcggcgtgaaggacagcaacagcaagatgaccaatagcgtgatgcgcggctctttcctcaccaaccccgatctgcgccgcgagttcctgtccctgatgcacaaaccctga

SEQ ID NO: 2539 - DNA, 423 bp, Chromobacterium substugae
atgctggttcgcctgatctattgcagccgggcgcaacaactgatagaccaggcgctggtggacgacatcttgagcgcctcgcgtaaatacaatcccgctctgggtatcaccgggctgctgtgctacagcaaggatgtttttatgcaggttgttgagggcagcagggcgcatgtcaaccgcttgtacctgaagcttgcgcgcgatccccgccatcattcgctgaccttgctgtcttttcacgagatagagcagcgcaagttcgccaactggagcatggctgaggtggcgctggacaagctgaacgcctcgctgatcctgcgccattcgccgctgccggcgctggagccgttcaccatgcccggcgccggcgcggaacgcctgctggaggatctggccgaatccggcagcatccagtaccgctga

SEQ ID NO: 2540 - DNA, 408 bp, Chromobacterium substugae
atgtcccgattccgcatcatcgccgcgctggccctgctgggcgccgcagcggcagtccaggcggcgcccgccgtcaaaaccttgccgtccggcgtcaagatcgagatcctcgccgccggcaagggcgcgacgcccaaggccagcgacaccgtcaaggtgaactaccgcggcactttcaaggacggcaaggagttcgatagctcctacaagaacggcggcccgatcagcttcccgctgaatcgcgtgattccgtgctggacccagggcgtcagcgcgctcaccgtgggcagcaaggccaagctgttctgcccggcggccaccgcttacggcagccgcggcgcgccgggcgcgatcccgccgaataccgatctgtatttcgaggtggaactgctggaaatccagaagtaa

SEQ ID NO: 2541 - DNA, 489 bp, Chromobacterium substugae
atggctgaacatctgatcgtcgaaaacggcggcaaggaagagaaataccaggcgctgctgccgcaagctcacgcgctcgtcgccggagaaaccgacctcgtcgccgcgctggccaacctgtccgccgcgctggcgatgactttcgactggctctggaccggcttctacctggtcaagggcgagcagctggtgctggggccgttccagggccccatcgcctgcacccgcatcccgcatggccgcggcgtctgcggcagcgcctgggcgcagaaccgcacgctgctggtcgacgacgtcgacgccttccccggccacatcgcctgctcgtccagcgcccgctccgaagtggtggtgcccattcgcgacgccgccggcaaagtcgtcgcggtgctggacatcgattcggaccagctctccagcttcgatcagaccgacgccgattacctggagcgcatcgtcgcgccgctggcggcgctgttccccgcctga

SEQ ID NO: 2542 - DNA, 741 bp, Chromobacterium substugae
atgacgaaaaggattgcgctggtcaccggcggcatgggcggcattggatccgccatttgcaaagcattggcagaagccggccacatcgtagtgaccacctatagcaaaccgggccgcgagcaagcctggcatgccgacatgaagggccttggcttcaacgacatccacagctaccaatgcgacgtcaccgacttcgccgcctgccaggacatcgccgcccgcatcgccaaggacatcggcccgatcagcattctggtgaacaacgccggcatcacccgcgacgccagcttcaagaagcagagcaaagacgattgggacgcggtgatccgcaccaatctggactcggtgttcaatatgaccaagccggtgctggacagcatgctggaggcgggtttcggccgcatcgtcaatatctcgtcgatcaacggccaaaagggccagttcggccagaccaactactccgccgccaaggccggcatgcatggtttcaccatggcgctggcgcaggaagtggcgaagaagggcgtgacggtcaacaccatctccccaggctacatcgccaccgaaatggtgatggcggtgccggaggacgtgcgcagcaagatcgtcgcccagattccggtgggccggctgggcaagccggaagaaatcgccgcgctggtcggcttcctctgctccgaaaacgccggcttcatcaccggcagcaatatcgccatgaatggcggccagcacatgatgtga

SEQ ID NO: 2543 - DNA, 876 bp, Chromobacterium substugae
atgacagccagcaccggacagatcatacgcagccatggccgccgtttcatcgtcgaagccgacggccgcacctacgattgcaccacccgcggcaagcgcgtcgacttcgcctgcggcgatttcgtcgacatcctgatccagaaccaggagcaggcggtgatcgagcgctcgcgcgagcgcagcagcctgctttaccgccaggatgactggaaggccaaggtgatcgccgccaacgtcagccgcatcctgttcgtcatcgccgccgtgcccagccccaacgaagagctgctgggccgctgcctgatcgccgccgaagccggcgacatcgaacccgtcatcgtggtcaacaagtgcgacctgccggaaacgccggcgctgctggcgaaattgcaactctatgtaaagcttggttaccaactggtcacattgtcggccaagcaggatttctcgccgctgctgcccttgctgcaagggcataccagcgtgctggtcgggcagtctggcatgggcaagtccacgctcaccaacgcgctgctgccggacgccaacgcgcgcatcggcgacatctccatcgcgctcgactcaggccgccacaccaccacccacgcggcgctataccacctggacgaaagcagtcacctgatcgattcgccaggcctgcaagaatttggcttaaagcacctgcaagcagcggatttaatccactatttcccggagatgcgccagtatattggccagtgtcgtttccacaactgcacgcatcgcgtagagccgaattgtgcgatcatggctgcagcagaaacaggcgccattagccggcatcggctggacttgctgcaacggctgactcaagagctagcgccggtaagattgtaa

SEQ ID NO: 2544 - DNA, 327 bp, Chromobacterium substugae
atgaatctgctggaactgtcctgcaccccgcaacacggccaaagcccgctggcggaaaacaccgtcaagcaattgctgtccggcctgccggactggcaaatcgacggcatcgagctgagcaagaccttccgcttcgccgacttccacgacaccatggccttcgtcaacgcgctggcctggatcgcccatcgcgaagaccatcatccggacatgtcggtgcactacaaccgcgcggtggtgaacttcagcacccacgacgccggcggcctcaccctcaacgacttcatctgcgcggccaaagccgaagccctgatcagccgcccatga

SEQ ID NO: 2545 - DNA, 1248 bp, Chromobacterium substugae
atgatagaggcattctccctactcttcgccatcgcgctggcggccacgctcagcctgaagctgtggctgggctggcgccacatccgccatgtcggcggcaaccgccatgccgtgcccgccgccttccgcgacaatatcacgctggagcagcataggcacgccgccgactacaccatcgccaaaacacggctcggcctgctgtcggcctgggtggacaccgcgctggcggccgccttcactttcggcggcggcctgcagtggctggccctccacagccagcagtggttcgcctccccgctgctgtccggcatggcgctgatcgtctgcatgaccgtgctcagcagcctgatatcgctgccgctcagcctgtacggcaccttcggcgtcgaagtgcgcttcggcttcaacaaaatgacgccgcggctttacctgctggaccagctgcgcggcatcggcatctccatcctgatcggcctgccgctgctggcggtagtgctgtggctgatggacatcgccgggcctgcatggtggctgtgggtgtggctggtgctgtgcctggtgcagttgctggggctggtgctgtacccgatcctgatcgcgccgctgtacaacaagttctggccattggcggacgaggcgctgaaggcgaggatagacgcgctgctcgcccgcaccggctttcgcagcaacggcgtttacgtgatggacggctcgcgccgctccagccacagcaacgcctatttcaccggcttcggcgccggcaagcgcatcgtgttctacgacacattgctggaaaagctgagccacgacgagatcgaagcggtgctggcgcacgagctgggccactacaagcgccgccacatcgccaagcgcatcgcggtggccttcacgctgtcgctgctgttcctggccctgctcggccagttgctgcacgcgccctggttctacgccggcctcggcgtcaccgcgcccagcacggcgatggcgctgctgctgttcatgatcgccattcccgccttcaccttcccgctgacgccgctgtccagccgctcgtcgcgcaagcacgaatacgaggccgatgacttcgccgccggtgaaacccgcgccgccgacctgcaaagcgcgctggtgaagctgtaccgcgacaacggcgccacgctgacgcccgaccctatccactccgccttctacgattcgcacccgcccgccgcgctgcgcatccaacacctgaaaggaagccaatcatga

SEQ ID NO: 2546 - DNA, 582 bp, Chromobacterium substugae
atgaaggaaaatggcagggttttcagactgactagtatggcacaagataccaataacctcatctggctcgacatggaaatgacgggcctgaatcctgactccgaccgcatcatcgaagtggcgatgatcgtcaccgacagccatctgaacgtggtggccgagtcgccggtgctggtggtgcaccagagcgacgccatcctggatggcatggacgactggaacaagaacacccacggcaagagcggcctgatcgagaaggtcaagaactccgctatcaacgaagccgaggccgaacaagtgctgctggcgttcatgatgcagtacgttccggagcgcggcagcccgatgtgcggcaacaccatccatcaggaccgccgcttcatggcgcgctggatgcccaagctggaggcctacttccactaccgcaatctggatgtttccacgctgaaggagctgtgcaagcgctggaagccggaggtggccaagggcgtggtgaagcgcggcaagcacgaggcgctggcggacatcctcgagtctatcgaggaaatgcgctactaccgcgagcacttcctcaagctttga

SEQ ID NO: 2547 - DNA, 1653 bp, Chromobacterium substugae
atggtcgcacatcgccacgccgacataaacgccacgccgatctgggccaagctgcaccagcatcagcgcgccacccgccacatgcatatgcgggagctgttcgacaccgaccctcagcgtttccagcgcttttcgctggagttggacggactgctgctcgactactcgaaaaaccgcatcaccgagcgcacgctggaattgctgttcgacctggcgcaggcggccgacctgaaaggctggatggagcggatgcgcgcgggcgagcgcatcaatgtcagcgaagaccgcgcggtgctgcacaccgcgctgcggctgccggcgggcgccgcattgcagctggacggccgcaacgtgacggcagaagtgcatgatgtgctggacaggctgcgccgcttcagcgacagcgtgcgcgacggcgcctggctggggttttccggccagaggatacgcgatgtggtgaatctgggcataggcggttccgacctggggccgcgggtggtgcaggagggcttggccgcctacgcgcatgccgaactcaatgtgcatttcgtgtccaatgtcgacggccagcacctggcgcgcacgctggcgcggctggatcccgccaccacgctgttcatcgtcgcctccaaatcgttcaccacgccggagacgctgctcaacgcccaggcggccaaggcctggtttctgcaggccggcagcgaggctgacatcgcgcgccatttcgtggcggtttccaccaacgagccggcggtgcgcgccttcggcatcgatccgcagcagatgttcggcttctgggactgggtgggcgggcgctattcggtgtggtccgccatcggcctgccggtgatgatggcggtgggttacgacaatttccgcgccttcctggacggcggccacgcgatggaccgccacttcttcgaggcgccgttctgcgccaacatgccggtgctgatggcgctgataggcatctggtacaacactttctaccaggcccatacccatgccatcatgccttacgaccacggcctgcgcagcctgccggcccatatccagcaactggacatggagtccaacggcaagcgggtggggcgtttcggcgaggcgctggatttcgacaccgggccggtgatctggggcgaggagggcgccaatagccagcacgctttcttccagctgctgcatcagggcacccgcttggtgccgtgcgacttcatcctgccgctgaacagccactatccggtcgccaaccagcacgaggtgctggtggccaactgcctggcgcagaccgaggcgctgatgcgcggcaaggccgaagccgaagtgatgcaggaactgagccacttgtccggcgaagaactggacatgctgctgccgcagaagctgttccccggcaatcagccgtccaacacgctggcgctggaccggctgacgccgtacagcatgggcatgctgatggcgctgtacgagcacaaggtcttcgtgcagggcgtgatctggggcatcaattccttcgatcaatggggcgtcgaatacggcaagcagctggcgcggcgcattttgcccgagttgtcgggcgcagccgccgagctgtcgcatgacagctccaccaacgggctggtcaaacatttcagggaacgtcatggcagatag

SEQ ID NO: 2548 - DNA, 501 bp, Chromobacterium substugae
atggcagatagcaaacagttggcggtcgatctggggctgctgttgtcggcgcgcggcgagagcgtggctaccgccgagtcgtgcaccggcggcttgatcgccgcggcgctgaccgatgtgcccggcagctccgcctggttcagccacggcatcgtcagctacggcaaccaggccaagcagcaattgctaggcgtgcaggccgcgtcgctgatcgaccatggcgcggtcagcgaaacggtggtgcgggagatggcgcagggcggccagacgctggcggattcggactgggcggtggcggtgtccggcatcgccgggccgggcggcggctcgccggaaaagccggtgggcctggtctggttcgcgatcgcccatccgggtgggcagaccgaggcctggcgctgcctgttcgccggcgatcgcgaggcggtcaggcggcaggcggtatgcgaggccctgtcgcagctggaaaagcgtgtccgcagccatgtccatctggcgtga

SEQ ID NO: 2549 - DNA, 750 bp, Chromobacterium substugae
atggagttttacgcatttccggcgatagccttgttgttcgtcggcatcttcacccgcgaggtgatcgcgccggcctcccgcaatacctgcgaccggcgctggctggcgttggcgtcgattctgggcgcggccacggcggcggtgacgctggctgtcggttttcttttcgccggcttgatccgtgaagtttcgctgatcccggcggcgcgcggctggccggacatcgcagtcggcgcggccagtttcctgctgaccagtttcgtcttctattggtggcaccgggcgacgcacgcttccgactggctgtggcgggtgtttcaccagctgcatcacagcccgaagcgggtggaggcgttgaccgcgctctacgcccatccgctggattccgcggcggcggtgctgatcagcgcgttttccagctatctggtgttgggcgcgacgccagcggcagccgcctgggcgctattcttcaccagcgtgttcgatctgttcctgcacagcgacctgaaaacgccgcgttggctgggatatctgttccagcggcccgaaatgcacactgtgcaccatgcctacggccaccatgcccaaaactacggcctgccggtttgggacttgctgttcggcacctggagcaatccggcggagcgggtggcgcggctgggtttcgatgacgataaggcggagcgggtgcgccacatgctgttgtttcgcgatgtccacaaaagcggcgctgacgacgccgaacgttga

SEQ ID NO: 2550 - DNA, 891 bp, Chromobacterium substugae
atggacgacccgatccggcatttcatcgaccagctggcgatagccgggcgcagcgcccacacgctgtccgcctaccgggccgacctgaatctgctggccgccatgctgcggccggcgccgctggccgccgccggcgtcaacgaattgaagcgggcgctggccaagctgcacgcccagggcctgggcagccgcaccctggcgcgccggctgtcgtcgtggcggcagttctatcactggctgcagcaaaacggcctgcgcgacgacaatcccgccgccagcctgcacgcgcccaaacgcgaccgcctgctgcccaaggccctgccggtggacagcgccgccgcactgctggaccgcatcgacggcgacgacgcgctggaagtgcgcgaccgcgccattttcgagttgatctatagttgcggactgcgcctatctgaagcggtggcgctgaatctggacgacgtcgacttcgccgaccatctgctgcgcgtgcgcggcaagggcaacaagacgcggctgacgccgataggcgccgaagcggccagctggctgaacaagtggctggcgcaaagggtggcgcaagatggcgaaagcgcgctattcaccgcccgccacgggcggcgattgggcggacggcagatcgaaaaccgcctgcgcgactgggcgatcaagaccggcgccaatcagcacgtgcacccgcacatgctgcgccactccttcgcctcgcacatgctgcagtcgtcgggcgacctgcgcgcggtgcaggaactgctgggccacgccaacctgtccagcacccagatctacaccgcgctggacttccagcacctggccaaggtctacgacaacgcccaccccagggcccgcaaaaaagtgcagcccgacgacgactga

SEQ ID NO: 2551 - DNA, 849 bp, Chromobacterium substugae
atgaacacgcgcttcaccggcaccgaacgctatatcgccaccgacgatctgatgatggccgtcaatgcctccatcgccctgcaacgcccgctgttgatcaagggcgaacccggcaccggcaagaccatgctggctgaagaggtcgccgccagcctgggccgggagctgatcgtctggccgatcaaatccaccaccaaggcccagcacggcctgtacgaatacgacgcggtgtcgcggctgcgcgactcccagctgggcggcgacaaagtgcacgacatcgccaactacatcatcaagggcaagctgtggcaagccttcgaggccgaacaggcgccggtgctgctgatagacgagatagacaaggccgacatcgagtttcccaacgacctgctgcgcgaactggaccagatggaattcttcgtccatgaaacccagcagttcgtgcgcgcgcgccagcgtcccatcatcatcatcacctccaacaacgagaaagagctgccggacgccttcctgcgccgctgcttcttccattacatccgcttccccgacgccgacaccatgcagtccatcatcgacgtgcacttccccgacatccgccagcagttggtcaagcaggcgctggaagtgttcttctccatccgcgagctgccgggcctgaagaaaaagcctaccacctccgaactgctggactggctgaagctgctgtgcggcgaaaacatcggcgccgacgagctggaaaaccgccatgcgcgcaacgcccctccgccgctggccggcgcgctgctgaaaaacgaacaggatctgcagctgttcgagcgcctgatgcagatggcccgacgccgcaactga

SEQ ID NO: 2552 - DNA, 414 bp, Chromobacterium substugae
atgagaaactacccgcccaacagcccagaggcgctggccagactcctggccatgttcatgatcaccgacggcaatatggacccgcgcgagcttgagctgctggaaaagctgcatgtctaccacctgatcaacctgccgcgcaaacagttcgcccaggtattgcgcgacttctgcgacgatgtgtcggacgaagccggcgacgatggcgcgatccgcctgctggaccgcgaaagaatcgacaacctgctgtccgaagtcagcgaccaccgcaagcgcatcctgacctgcgtgctggccatggacatcagcaagtcggacggcaccatcagcgacagcgaaatggctctgctcagctacatgatgaaaagctggggcatctctctcgacgatctcgagcgcgaattcgcccgctga

SEQ ID NO: 2553 - DNA, 429 bp, Chromobacterium substugae
atggcccgcatccagatagaactgccgccccgcttcattttcgacaccgcgctggaagtccgcatcggcgacatcaactacgccggacatcttggcaacgacgcgctgctcagactggcccaggaagccaggctgcgcctgttcaaacagctgggctacgccagcgaactggcggtggagggagccggcatcgtcatcgccgacgtcgccgcctgctaccgcgccgaggccttccacggcgaccggctgcgcttccgcatcggcgtcgcggatatcggccgccacggcctcgacctcatttatcaagcagtcgatgacaacactggcaaagaagtggcaagattgaagacaggtatcgtctttttcgactaccaggcacgcaaagtcgcccccatgccggaagcgttttccggcaagctcagccaatag

SEQ ID NO: 2554 - DNA, 450 bp, Chromobacterium substugae
atgtatcagagaatctttgtgcctgtcgacgatagcgacacttccaatatggcgctgaacgaggcgtgcaagctggcgaaggagttcgggtcgtcgatcaggctggtccacgtggtggatctggcgcagttcggctggggcgggacggagtttctggacgccaccgaattgcaaaagtcgatcaagcaagccggcgagcaggtgttgggacaggccggcgagcgcgcgagggcgctgggcgtggagccggagtgcaaaatcctggagagctggggcgacaagatcgccgcggtgttgtccgacgacgccagcgtctggggcgcggatctcttggtgatgggcacccatggtctgggcggcctgatgcacctgctgatgggcagcgtggctgaaggcgtgctgaaggtggccgacatgccggtgctgctgatccgcaaccctggcgattag

SEQ ID NO: 2555 - DNA, 324 bp, Chromobacterium substugae
atgaaactgtttgaaaaaatcccgaaccctcgggaaatccgccgcaagcttggcctgaaccagcaagaattctggagccgcatcggcgtcacccaatccggcggctcccgctacgaaagcggccgcaacatgcccaagccggtgcgcgaactgctgcgcctggtgcatgtcgagcagatcgacctgtccaaggtacgccgcgaagacttcgagatcgtcgagtacctgaaagagacccaccccgatctgtacaagagcctgcgcaaagcggttcgcaccaagatcgaagctcaggaaggcggcgccgaagccaccgccggctga

SEQ ID NO: 2556 - DNA, 1152 bp, Chromobacterium substugae
ttgctgtccgaactgatccgcttcgataccaccagccgttattccaatctgcagctgatagagtgggtgcgggaatatctggccggcttcggcctgacaagccgcctgacttataatgatgatggcagcaaggccaatttgttcgcgcgcatcggcgccgaggacctgcctttgatcgtgctgtccggccacaccgacgtggtgccggtggatgggcaggattggcattatccgccgtttgagctgaccgccggcggcgatggccgcttgtacggccgcggcagcgccgacatgaaaggcttcatcgcctgcgtgctggcccgagtgccggatttcgtcaggctggccgccgaaggcaagctggcgcagggcataggcatcgcgctgtcctacgacgaggaggtgggctgcctgggcgtggggcgcatgatagacgcgttgatcgccgatggcgtggatgtcgccggctgcctggtgggagagccgacgtcgatgaagccggtgatcgcgcacaagggcatcgcccactatcgctgcgtggtcaagggaagagcggcgcattcgtcgctgacgccgcatggcgtcaacgccatcgagttcgccgcccgcctgatcacccatatccgcaagctggcagatgccgaggccgcgtttggccaccggcagccgctgtacgacgtgccgttcaccaccatgcagactggtttggtgcgcggcggcgtcgcctgcaatatcgtgccggccgattgcgagttcatgttcgagtgccgctggttgccgggcgacgacccgcagcggttggtggcatcggtcgccgactacgccgccaccttggagcaggaaatgcaggcggtggccggcgaggcgcagattcgcatcgagccggtggtatacagccccgctttcgagtccgacccgtcgtcgtccatccggcgctacgtcgtcagcctgtgcggctgcgaaggcggcgccggcgtcgcctacaccaccgaagcgggtctgttcagccaggccggcatgccttgcgtggtgctggggccgggctcgatcgagcaggcgcaccggccggacgagtttatcgaggtggcgcagttgcaggcctgctatgattggttgggcaggctggcggacgagttgatccagcccagatag

SEQ ID NO: 2557 - DNA, 1377 bp, Chromobacterium substugae
gtggacaaatccaaatcgggtggagaggtcaagctgagggatggattcacgtccagcttcggcgtgctggcggcgacgctgggctcggcggtaggcctgggcaatatctggaagttcccgtatctgaccggcaccaatggcggcgccggttttctggtggtgtacgtgctggccacgctgctggtgggactgccggtgatgatctccgagatcatgctgggccgcaaggccaagcgcgatgcggtgaccacgttggccaaactggcgccggccgggcagccgtggtggctggtgggcgctttcggcgtgtttgccgccttcctgatcatggctttctattccgaggttgccgcctgggtgttcgcctatattttcaaggcgatcgccggcgatatcctgtccaacgatcccaaggtgacgtccggcgccttcaccgcgctgatcacgaatccggttcagtcgctgctgtggcaatggctggttctgggcctgatcggcggcattctgctgatgggcgtgtcgaaggggatcgaagcggtcaccaagaagctgatgccgctgctgttcgcgctgctgctggtgataggcgcgcgcagcctgatgttgccgggggcaagccagggcctggctttcctgttcaccccggacttctccaagatcaccgccggcgtggtgctgaccgcggtgggtctggctttcttcaagctgtccatcggcatgggcaccatgatcacctacggcagctacttccgcgacgatcaagacgtgccgctgaccaccttccgggtgatgtgcgcggatctgttcgtgtcgctgctggccggcatcgccatcttcccggcggtgttcgccttcggcttccagcctgccgctggtccgtcgctgctgttcatcaccattccagcggtgttcgccagcatgccgctgggacatctgttcatggtggtgttcttcgtgttggccgccatagccgccaccggcgcgatgctgtctatcctggaggtgccggtgtcggtggtgagcgagcgcttcggcatcagccgcgtcaaatccaccatcatcaatctgttgctgttggcgttggtgggcgcgggctgcgcgctgtccaacagcctgaccgccgatatcaaactgcacggcatgacgatgttcgacctgttcgacttcgtcacgtccaatgtgctgatgccgctgggcgggatctgcctgtgcctgttcaccggctgggtgtggggctacgaccgcttccgcgacgcgctgagcaatggcggcgcgctgaataacgcgcgtctgctgaaggcgctgttcttcgtggtgcgcttcgtgtcgccggtgctgatcctggtggtgatgctgaagggcttgaaggtgatttga

SEQ ID NO: 2558 - DNA, 279 bp, Chromobacterium substugae
atgaaaaagggaatcctgctgttctggccgtctttcatcatcgcggtggcggccaccgccgttttttactcgattttcgaccccgccgaactgaccttgcacggcaacgccctattcgccgacaagctcacagcctattcggtgttcctgctggccagctggctgttcggcgcggccaataccgccatcgtcctgctgctggaaaaaagcgcccgcgacatcaacggcttcgttgcgccgccggtagtcagcggcgacgaagacggcacgccttcctga

SEQ ID NO: 2559 - DNA, 1209 bp, Chromobacterium substugae
atgacctcttcgatcttcgccggtgtggaactggcgccgcgtgaccccattctcggtctcaacgaagcattcaatgcggacgcccgcgataccaaggtcaaccttggcgtcggcgtgtattccgacgacaacggcaagattccgctgctgggcgcggtcaaggccgccgagaaagccaggctggaagcgctgccggcgcgcggctatcagcctatcgaaggtccggcggcttacgacaaggcagtgcagaacctgctgttcggccaggatggcgagctgctcgccgccggccgcgtggtgaccgcgcaggccttgggcggtaccggcgcgttgaagatcggggcggatttcctcaagcggctgaatccggcgtccaaggtgtacatcagcgacccgtcctgggaaaaccaccgcgcgctgttcgaatcggccggtttccaggtggaaaattacccttattatgaggcggccagccgcggcgtggatttcgccgcgatgaagtcgcatctggcggcgctggacgcgggttcggtcatcgtgctgcacgcctgctgccacaaccccaccggggcggacatgtccgcggcccaatgggacgaggtagtggcggtttgccgcgagcgcggcctggtgccgttcctggacatggcttaccaaggctttgccgatggcatcgaagccgatgcgctggcggtgcgcctgtttgccgcctccggcatgcagttcctggtagccagctccttctccaagagcttctcgctgtacggcgagcgcgtgggcgcgctatcgatcgtgacggcaggcaaggacgagtccgcccgggtgctgtcgcagctgaagcgagtgatccgcaccaactactccaatccgccgatccatggcgcggccatcgtcgccgcggtgctgtccagcccggaactgcgccagcagtgggaagacgagctggcgggcatgcgcgatcgcatccgcgcgatgcgcctgcggctgctggcggcgatcaaggcgcatggcgccgcggttgacttctccttcgtcaccgctcagcgcggcatgttctcctataccggcctgagcgctgctcaggtggagcggctgcgcgctgagttcggcatctacgcggtgtccaccgggcggatttgcctggcggcgctcaatagcaagaatgtcgattacgtggcggcggcaatcgccgcggtgatccgcgattga

SEQ ID NO: 2560 - DNA, 354 bp, Chromobacterium substugae
atgactgcgacttttcctgaagtgctggttccgcaggccataactgcgggtgcttttgacgcggatgatgccgatgtccgcaataaccttggcctccttggcctgcttgatgtttattcccgcgacggcagctatcggctgaccgtttcgctggagccggtggatccggacaggcagcccagcttgtgggcgctggaagtggagatggaagtgtgcgccgacggcaaggtcgcgcgccgcgccgggcagcagctggagtattccggttcgacccctggcagccatctgcgcaagttgctggccagcggcgagctgcacggctacttgctgcaggggacggccgccgcggcttga

SEQ ID NO: 2561 - DNA, 645 bp, Chromobacterium substugae
atgagtaaaaccagaatcaagacctacgaccgcatcattcaggagagcctcaagctgttcaacgaacagggcgagcgcagcatcaccaccaaccacatcgccgcgcacctcggcatcagcccgggcaatctctactatcacttccgcaacaaggaagagatcgtctaccagatattcaccatgtatcgcgagttcatcaaccagcgactggcggtgccggaagaccgcaagatgacggtggacgatctggtcaactatctggacaccgccttcctggcgatgtggcagttccgcttcatgttctacgacctgcccggcatgctggcgcgcaatccgcagatgcagtcggagtaccaccagttcgtcaacaccgagctgaaaaacatcctcggcgagcatttccgcgaattcatccgcctgggactgctgaagatggacgaagaggacatcgagggcgtcagcatcaacatctggctggtggtgaaattctggttcgctttcgagcagacctcccgccccaaggcgccgatcaccgaggagtccggccaccgcggcgtgctgcaggtgctggcgctgctcaagccctatgtgcagccggaatacatgcacgccttccgctcgctgtacgagagacacgccgtctga

SEQ ID NO: 2562 - DNA, 846 bp, Chromobacterium substugae
atgcacaccctcctcgacctggtcgccttcctgcgggaaaactactcgcatgaaatcacccgctcgctgctgttgatcctgaccctgctgatcatccgcgtggtggtggaccggctgctggcagccaacagcggcgtgccggtcgaggagcgccgccgctggtcgatcaacacccgcaacggcctgtttctcaccggcctggcgggcataggcttcatctgggccaacgagctgcagacgctggccgtctccatgctggcattcgccgccgccctgatcctggccaccaaggagctgatcatgtgcttgtccggcggcgtggtgcggcagatgtcgaacagctacagcctgggcgatcacgtcgagatcggagccgttcgcggccgcgtggtggacatcggcctcttgtccaccaccgtgatggaaatcggccccaaccacagctcgcaccagatgacgggccgggcgctgacctttcccaacagcctgctgctgtccaccccggtgatacgcgaaaactacatgggcgagtacgtgatgcatatcgtcaacgtgccgctggcctatgaagtgccgcccgcccgcgccgagcagatgctgatgagcgcggcggaaagcgcctgcctgccgcacgtggacgtggcgcgccgccacatggaggacatggccaaacgctatctggtcgacattccatcggtggagccgcgcatttccatccagccggtcgacgaaaagcgctaccagttgatcctgcgcatcgccattccggcgcgggagcggcaacgtatcgagcaagccatcctgcatcaattcctggccgactgttaccctgtcgtccaatcgtaa

SEQ ID NO: 2563 - DNA, 1611 bp, Chromobacterium substugae
atgtccgccgaactgtcccgcattgccgaagaagtctcgcatcgccgcaccttcgccatcatctcccaccccgacgccggtaaaaccacgctgacggaaaagctgctgctgttctccggcgccatccagatggccggcacggtcaagggcaagaaaggcggcaagttcgctacttccgactggatggagatcgagaagcagcgcggcatttcggtggcttcttcggtgatgcagttcgactaccgcgatcacaccgtcaacctgctggacaccccggggcaccaggacttctccgaagacacctaccgcgtgctgaccgcggtggacagcgcgctgatggtgatcgacgccgccaagggcgtggaagagcagaccatcaagctgttgaacgtctgccgcctgcgcaacacccccatcgtcaccttcatgaacaagtgcgaccgcgaagtgcgcgacagcctggaattgctggacgaagtggaagacgtgctgaagatccgctgctcgccgatcacctggccgatcggcatgggcaagaccttccgcggcgtatacagcctgctgaacgacgcggtgatcctgttcgaggccggcgcggagaagctggtatccgacatcgaggtgatccagggcatagacaacccgcgcctggacgaactgttcccgttggaaatggaacagctgcgcatggagatcgagctggtcaagggcgcctccaatgagtggagcctggacgaattcctggccggcaccctcactccggtgtttttcggctcggcgatcaacaacttcggcgtgcgcgaaatcctcaacgcgctgatcgactgggcgccggcgccgcaagagcgcgacgccaccgttcgcagcgtggacccgaaagagggcaaattctccggcttcgtgttcaagatccaggccaatatggacccgaagcaccgcgaccgcatcgccttcctgcgcgtgtgctccggccagttcgagcgcgggatgaaaatgaagcatctgcggctgaaccgcgacatcgccgcctcctcggtggtgactttcatgtcgcacgaccgcgaaatcgtggaagaggcctacgccggcgacatcatcggcatccccaaccacggcaacatccagatcggcgacagcttctccgaaggcgaagagctggccttcaccggcattcccttcttcgcgccggaaatgttccgctcggtgcgcatcaagaacccgctgaagctgaagcaactgcaaaaaggcctgcaacaactgggcgaagaaggcgcggtgcaagtattcaagccgcatagcggcggcgatctgatcctgggcgcggtgggcgtgctgcagttcgaagtggtggccagccgcctggccgccgaatacggcgtcgacgccatcttcgaatccgccagcatctggtcggcacgctggttcacctgcgacgaccgcaagaagctggacgatttcgtcaaatcgctgcagatgaacatcgccaccgacgccggcggcaatctggcctacctggcgcccaaccgcgtcaacctgcagctgacgcaggaacgctggccggacatcgtcttccacgaaacccgcgagcacgcggtcaagctgaacgactga

SEQ ID NO: 2564 - DNA, 144 bp, Chromobacterium substugae
ttgcgcgagcttgctggccgccggcctcaagaccagcgcttcggcgctgactttgacggtctcgagcgtggactgctccgctgccagggcggcgtggctagccaggccaaaggcgatcgcggacaagcaaaatggaaagattga

SEQ ID NO: 2565 - DNA, 2085 bp, Chromobacterium substugae
ttgaggccggcggccagcaagctcgcgcaagaggaaatcgcccgcccgcaggcgaaatcgctggccgaggtgctggatgcgttgcctggcgtcaacgccggcggctcgccgcgtcccggcggacaaaccatcaacgtctggggctttggcgacgtggagcaagtgcaagtgtatctggacggagccgggcagggcttcgacaaataccagcagggcacctctttcgtcgatccggagctgctgggctcggtggaggtgatcaagggcggccattcgccgttttacggcaacggcgccttcggcggcgtggtgaaggcggaaaccaagaccgtcaatgaactgctgttgccggggcgcagcgtgggcggcttcgccaagctgggctatcaggataatggccaccgcttcagccagtcgctggcggcgtatgccggcggcgccggccagccagccgacatcctggcctatgtcacgcacagcaagggaggcgacggcacgcagccggacggcacgccttaccgcttctccggcggcgagcagcaaggcggcatgctgaagctgggctggcggcccgccgacggccatagcctgaaactcggttttgtgcgccaggacgacgagctgcgcacgccgtgggcggcccggcgcggcgacatcccggcgcccagcgcttacgatatcgccaagtacggcctggaggaggcctggctgcgcaaaaccgtgtggcgcgagcagacggtggagtcgatgaccgccgactggagctatgtcagcagcgatctgccctggctggatctgcggctcagctacgcgcagtcgcggcgcttccagcatgacacccggccggacggggtgaacagctcggccttcgattcgcagttcggcaaggaaagctgggtcagccagcgcgataaacagtgggagctgcgcaatgtggccaacctgggcgaaggctggtccagccagcaggtgacggtcggcgtcgcctggtcgcgcaaggatcgcgacgccatcgcctacatgccgagcaaggccagggatcccagttacaactacgggctgatgaacccgcgctattcgccgccgggcagcgaaaccatgcagtcggcctactgggtgcacgaatggaggccgctggacggcttcagcctgacgccgtcgctgcgttacgaccatatcgaggtgcgcggcaggcagaacctggcgcccacctacaacaatccggccaagggccacgactacagcgcgctggcgttcgccggctggtcgccgcggctggccgccagttggcgtttcctgccgcgctggacgctggacgccggctatgcccacacttggcgcgcgccgaacgccgatgaagtttacgacgtgcagacgctgggcagcaccaccgccagcagccgccagctgcggccggaaaagctgaaagcgctgaagttgggcctggcttacgacggcggcggcgtgctggccgcgggcgacaagctgtcggccagcctcgcctggttccgccaggatgtcaccgacgccatcggccagcgcatcggcccgaaccgcggcgacgcgcccggcgcgccgctgccggcggtgatcggtttttaccgcaacctgccgggttatgtgattcgcggtttcgaattcgacagccgctaccagtggcgcggcgctttcgccagtttgtctttgtcctccgtcgtcggcgagcgccgccacagcttgcgcgacccgtggggcaaggacgagccgatggtggacatcccgccgcgcaaggcggtgctgaccgccggctataccttcgcgccggcggggctgacgctgggcgcgcagggcaagttcgtccgcgcgcaggaccgggtgccgcaaaacgtcaacccggaggccgtcggctacgcctatccggcccagcatggttacgcgctggccgggttgttcgcggtgtggcagccggcgacggccgggctgaagggcatggaggtgaggctggcggtggacaatctgttcaaccgcagctaccagccttacctgaccgaaggcgcggaaggcatggggcgcgccatccgcagcagcgtgtcctggcgtttctga

SEQ ID NO: 2566 - DNA, 615 bp, Chromobacterium substugae
gtgttcaccggtatcgtccagggcgtggccgaagtggtcgccatcgaggaaaaacaggatttccgcactcatatcgtccgcttgccgcaggcgatgctgcccggcctgcagcttggcgcctccgtcgcccataacggctgttgtctgaccgtcacccaagtcgacggcgatcgggtgcatttcgacctgatgcgcgagacgctgcgcatcaccaatctgggcgagctcaagaccggcgacgcggtcaacgtcgagcgcgccgcgcgcttcggcgacgacatcggcggccacgcgatgtccggccacgtgatgggcctggctgaggtcgtcgaggtgatcgaatcccccaataaccgcacaatctggttcgagttgcccgccgggctggaaaaatacgtgttcgccaaaggctatatcggcatagacggcatcagcctcaccgtgggcgcggtggaggggcggcgcttctgcgtgcacctgattcctgaaacgctgacgcgcaccaatatcgccgcccgccggcccggcgcgcgcatcaatatcgagatagacccgcaaacccaggccatcgtcgacactgtcgagcgggtgctggcgcagcgcggccaggcatga

SEQ ID NO: 2567 - DNA, 663 bp, Chromobacterium substugae
atgattttgcgggatttgccggtggtggcgtcgtggagcggcggcaaggacagctgcctcgcgctgtggcgcgcggtccaggccggcgccaggccgcaggcgctgctgaccatgctggacgagacgggcgagcgctcccgctcgcacggggcgcggcccgaggtgctggcgttgcaggccgatgcgctgggcttgccgcagcggttggggcgcgcgagctggaatgattaccgcgaggtgttcgtcgagcggctgcgggccgccgcggcggacggcgcgcgcgcggtggtgttcggcgacatcgacctcgccgcgcatcgcgaatgggaagagggcgtctgcgccgaggcgggccttgaagcgatcctgcccttgtggcagcaagcccgcgccgatctggtgcgggaattcgtcgcggcgggcttcgtcgcccgcatcgtgatggtcaatgccgcgctggcggacgagaagtggctggggcggattgtcgacgcccggctgattgcagagatgctggccgaaggggtggatccctgcggcgaggcgggagagtttcataccctggtggtggacgggccgctgttcgcccggccgctggcgctgcgcgacggcgcggtcgcccatctgggcgactatcgcgccctggatttattgcccgcgtga

SEQ ID NO: 2568 - DNA, 1125 bp, Chromobacterium substugae
atggccatttctccgattcaagacatcatcgccgacattaaggccggcaagatggtggtgctgatggatgccgaagaccgcgagaacgagggcgacctggtgatggcggccgaattcgtcacgccggaggcgatcaatttcatggccaagcacggccgcggcctgatttgcctgacgctgagcgaagagcgttgcaagctgctgaacctgccgatgatggcgaccaacaacggcaccagcttcggcaccaacttcaccgtatcggtggaggccgctgagggcgtgaccaccggcatttccgccgctgaccgcgcccataccatccagaccgcggtggcgaggctggccaaggccagcgacttggtgcagcccggccacgtgtttccgctgaaggcgcagaacggcggcgtgctgatccgcgccggccataccgaggccggctgcgacctggcgatgctggccggcgtggagccggccggcgtgatctgcgagatcatgaacgacgacggcaccatggcgcgcttgccggagctgatcgagttcgccaagcagcacggtttgaagataggcaccatcgccgacttgatccagtaccgcagccgcaccgagtcgctggtggaaaaggtgggcgagcgtccggtggagacgccgttcggcagcttcgacctgcatgtgttccgcgacatcaccacctccgccacccatctggcgctgagcaaaggcaagatccgcgccgacaaggaaaccctggtgcgcgtgcacgagccgctgtcggtgatagacgtgctggcgccgctgtgcagccaccacagctggaccgtgcccaacgcgctggaaaccatggaggagaccggcggcggcgtgatgatcctgctgtatcgcgatgaaaccggccaggatctggccgagcgtgcgctgggtcaggaggcggcgcggcagaagtgggacagcaagactttcggcatcggcgcgcaaatgctcaaggcgctgggcgtgggcaagatgaaactgatgtccagcccggtgagcctgccgtcgatggccggcttcgagctggaagtcaccggcttctgccagcccggacattttcacgtggatggccagggcggcccaggcgtggcctaa

SEQ ID NO: 2569 - DNA, 468 bp, Chromobacterium substugae
atgcttgatgcaatccagtgtattgaacccaatttttccggcaagggcctgaaagtcggcatcgtgatggcgcgtttcaacacgccggtgtgccatggcctgcgcgacgcttgtctcgccgagctggagaagctgggcgtggccgctggcgacatcaccctggccaccgtgccgggtgcgctggaagttccgctggtgctgcaaaccatggcccagaccgagcgctttgacgcgctggtggccctgggcgcggtgatccgcggcgaaacctatcatttcgagctggtatcgaacgaatccggcgccggcgtcacccgcgtcggcctggacttcgatattccggtagccaatgccattctcaccaccgagaacgacgagcaggcggaagtccgcatgcaggagaagggggcggacgccgctcgcgtcgcggtggaaatggccaatctgcacaagacgctgcgcggctga

SEQ ID NO: 2570 - DNA, 450 bp, Chromobacterium substugae
atgaaaaccgcccgccgccgcgcccgcgaattcgccgtacaaggcatttacgagtgggaactgaaccaggaccgcccggcctcgctgatcgagaagcatctgcgcgagaacgaatacttcgccaaggccgatgaggcgctgttccgcaacatcctgtacggcgtactgaaggatgtgtccacgctgtccgcccagatcggccgctactacgagcgcgccgaggacgaagtcagcccggtggagcgcgccgtgctgctgatggccgcgctggaactgacgcaaagcccggaaaccccgtatccggtcatcatcaacgaagccatcgagatcaccaaaacctttggcggcaccgatggtcacaaattcgtcaacggcgtgctggacaagctggccgccgacgttcgcggcgacgaagtcctggcgcagaaacagcgccgcaagcaggattga

SEQ ID NO: 2571 - DNA, 951 bp, Chromobacterium substugae
atgaacgagttcgaactgatagcccgccatttccagcgtccggcgccgtcggcgctgctgggcgtcggcgacgacgccgccatcgtgcggccgacgcccggctgcgacctgcacatgtcggtggacatgctggtcgaggggcggcatttcttcgccgacgtggcgccgcgcgcgctgggccacaagacgctggcggtgaacctgtcggacatggcggcgatgggcgcgcgggcgcgctgggcgctgctgtccatcgcgctgccgaaggcggatgaggcctgggtggcggaattcgccgccggctttcacgcgctggcgctcgaacatggcgtggagctgataggcggcgacaccacttgcggtccgttgacgctgtcggtgaccgtgctgggcgaggcgccgtccgggcaggcgctgcgccgcgacgccgcgcggcccggcgacgatgtctgggtgtccggcgagctgggcctgggcgcgctggcggtgcgccagcgcctgggctggctgacggtggacgacgcggatctgctgcaaacggcgcggcagaggctggaatacccgcagccgaggctggcgctgggccgcctgctgttgcctgtcgcccatgcggcggcggacgtgtccgacggcctgatggccgacctgggccacatcctggctgcctccggcgtggcggccgaaatccaggccgacgccttgccgtccgatccccggctggaggcgctgcgcgcgcggcatctcgactgcctggctgccggcggcgacgattacgaactggtgttcaccgcgccgccgcaacggcgcgcgcaggtggaggccgccggcgcgcaatgcgcttgccgggtctcccgcatcggccgcatcgtcgaaggcagcggcggcaagcttttggacgccgccggccacccgatccctttacagaaagaaggctatgaccacttcggctga

SEQ ID NO: 2572 - DNA, 456 bp, Chromobacterium substugae
ttgagccaccccgcccatctgctgtctttcggcttcggcagcggcctgatgaagaaagctcccggcacctggggcacgctggtggcctatcccttgttcttcccgctgctggcgctgggggtggacggctggtggctgatggccttgtgcgcgccgctgttcgcgctgggagtgtacgtgtgcggcatcaccggcaaggcgctgggcgtgcacgactacggcggcatcgtctgggacgaggtggtgggcatgctgatggtgctggctttcgcgccggctagttggcagggctggctgctggccttcgcgctgtttcgcttgttcgacatcgtcaagccctggccgatccgttggttcgaccagcgcgtcggcggcggcttcggggtgatggtggatgacgtcatcgccgcgctgttcgcgctggcggcgcagtggctgatctggcgcgccttgtaa

SEQ ID NO: 2573 - DNA, 2910 bp, Chromobacterium substugae
gtgtttctgttgctgctgctggctgcggccggctggctggtgaaaaccggcaagatatcgttgccatcgttgacgagcaaactggacgggctgctgggggtggaaggccggcctgagcgttacgagccggactacttcgccgagccgcgcgagacgcctcccgcgcccgaggccgaagcggcaatggccgcgcgcagcgaagactcggtagacgcgcctgaaatcgaaacggttccgccgcagcccgaaccgccgcaagcccaggccgtgcggccagaaatccgcctgccgcgccgcgtcgcgccgccgccggaagcgccgcgcgagaccatcgtgctgccgcgtcgcccggagccgccggcgcgcgaagcgcccgtcgagctgcccaagcttgagctatcgcgcgaataccgcaagaaaacccgcctgccgccccggtcgcgggaggacgagctgccggtcatcggcctgtcggaaatgcaaagcaatatgcggcaggattttcgccgccgccagcgcgccagcggcgtggcaatgccggcaggcgagggcgagctgccggtgataggcagccatgaggtgagggagaaggtcgccagcctgcatgcccatcgccgcgcagcgcctcctgttcagccgtcgttgcccaaggtggagctggcgcccatcgttcgcgccaatttaccgccggcgggcaaacccgcgcccgcattccgcccccccgaggcggtcgcgcatccgcaagccgcggccatgattcggcctgccgccgcgccggcgatgcctgcggcggaaacggcggcgcgtccggtcgcaatgccagtcgaagcggccgagccgcctgcggcggcggcgcctatcccgccttcagagccgcttgcggcggcagctgaatccatttccgcgatggccccgcagccatggccggtactcgacagcgagacggcggcgatggccgcgtccgcgccggatgagcccgagcagacgacaactgagctgacgcgcgaggcggcgcctgtcgcggcggccgagccggcggcgcagaccgcgccggaatggcaagccgccgccgaagcggaagccgggtttgacgcggaaaccgaggttgagacagcggccgcggatgacgagcccgcgcaagccgcccgcacgccttggcgctggccgcaaacccgcgaagtgctggtgcagcaggaaaacgccaggccggccatcgtgcagcaaaccgtgctgcagagcgaagccctggccgcgccgtctctggccgccaccaccgacaagctggccgccaatcccatgccttgggtgctgatagacaaggcagccgatgcgccgccgcctgagcctagcctgcaggccgcggatgccgaagcgtccgagtcaacagccgaggcgccggcctggacggagcgcgccgcttacgacgactccatcctgccgggcttggagctgctgcgtcccgccgatgccgtcaccgtggcctgcagccaggatgagctgctggagcgcggcatcgtcatcgaagagaagtgcgccgaattcaaggtcaaggtcagcgtggtggatgcttatgccggcccggtgatcacccgttacgaggtggagccggcggtgggcgtgcgcggcaaccaggtggtgaacctgatgaaggacctgtcgcgcgcgcttggcctggcgtccatccgcgtggtggagaccattccgggcaaaacctgcatgggcctggagctgcccaaccccaagcggcagatgatacggctgtcggaaatcttcgccgccgatgtgttccagcagccggcctcgcggctgacgctggcgctgggcaaggacatcaccggcgagccggtgacgatggacctggccaaggcgccgcacctgctggtggccggcaccaccggctccggcaagtcggtgggcgtcaacgcgatgattctatcgatgttgtataaagccacgccggacgaagtgcgcttcatcatgatcgatcccaaaatgctggagttgtcggtctacaacgatattccccacttgctggcgccggtggtcacagacatgaagctggccgccaacgcgctgaactggtgcgtcggcgagatggagcgccgctaccggctgatgagctcgctgggcgtgcgcaatctggccggctacaaccagaaggtgcgcgaggcggccgaacaaggccagcgtatttcaaacccgttcagcctgactccggaaacgccggagccgctcgacaagctgcctttcatcgtggtggtggtggacgagttcgccgatctgatgatggtggccggcaagaagatcgaagagctgatcgcccgcctggcgcaaaaggcgcgcgccgccggcatccacctgattctggccacccagcggccgtcggtggacgtgatcaccggcctgatcaaggcgaatatcccgacgcggatcgccttccaggtgtccagcaagatagacagccgcaccattctggatcagatgggcgcggaaagcctgctgggccagggcgatatgctgttcctgccgcccggcaccggctatccgcagcgggtgcacggcgccttcgtcaccgatgacgaggtgcacgcggtggtcgaacacctgaagcagttcggcgagccggactatgtggaaggcctgttgaccggcgagagcgaggcggacgaggcttcggccgacgccacggccaaggcgcaggcggcgacagagtccgaccccttgtacgacgaggcagtggagatcgtgctgcgcacccgcaagccatccatctccggcgtgcagcgccatctgcgcataggctacaaccgcgccgcgcgtttgatcgaagagatggaagcggcgggcatcgtcagcgcgatggaaagcaacggcaaccgcacggtgctggtgccgcagcgcgatttctag

SEQ ID NO: 2574 - DNA, 525 bp, Chromobacterium substugae
ttgcccctgcataaccatcaaactaaaactgcaagggtgaaactgatgaaatcaatcgtaatggccgcctgcctgctgggcgtatcgtttgccgcgctggccgatggcaaatccgactgtcgcgccgccgccggcagctacctgaccggcaccgtggtgtccggcccgcagttcgcatccggccaggacctgaacggcgtggagctgtcccacacccatgtccgtctgcgcgccgaccaggacggccgcacctacgatgtggcgatggacaatgtatacgcctccggctacgacaccgcaggcgagagcgtgccctacccgctgagcaccatccaggcaggcgaccgcctgcaactgtgcggccaactctataccagcggcgtaggcatccactgggtgcatagcaactgcggcgtcaagccgaccagccgccagcccaatggctgggtcaagaagatcaacgccgacggctcggtcagcggcaactacgaagccaacaccgaatactgccagctgtggccctaa

SEQ ID NO: 2575 - DNA, 135 bp, Chromobacterium substugae
atgcaagttcttcttttcgccgcccttgtcgccgcggtcatcgctgtcgccaaattgctggccaccccggaacaagagcagccccggctggtgcccatccgcattcgccgcgacgaggcgtcccgccgccgctga

SEQ ID NO: 2576 - DNA, 1191 bp, Chromobacterium substugae
atgttcatcgacttcttctacgcgctgcgcaacgccggactgccggtcaccctgaaagaattcctcacgctgctggaagccttgcggctccatgtcgccttcggcagcctggacgatttctactatctggcgcgaaccgcgctggtcaaggacgaaaagcacttcgaccgctacgatcaggtgttcggccagcacttccgcggcttggaaatggcgctggacgacctgcagcgcgccatccccgaggaatggctgcgcaagcaggctgagaaatacctgagcgacgaggaaaagcgccggctgcaggcgctaggctgggacaagctgatggaaaccctgcgccagcggctggaggagcaaaaggagcgccatcagggcggcaacaaatggataggcacaggcggcaccagccccttcggcgctttcggctaccatccggaaggcatacggataggccagaaccagtcgcgccaccgccgagcggtcaaggtgtgggaccagcgcgaattccgcaatttcgacgaccaggtggagctgggtacccgcaacatcaagctggcgctgcgccgcctgcgcgaattcgcccgcgacggcgccgaggaagtgctggacctggacgccaccatcgccgccaccgcgcgcaaggccggcatgctggatctcaggatgcagcgcgagctgcgcaacagcgtgaaggtgctggtgctgttcgacgtcggcggctcgatggacgatcacatccgcgcctgcgaagagctgttttccgcggtgaagtcggaattcaagcatctggagtacttctacttccacaactgcgtgtacgaatcggtctggaaggacaacaaccgccgccaaagccaacgcttttccacctgggacctgatccacaccttcggcgacgattacaagctgatcttcgtcggcgacgccagcatgagcccatatgagatcgcctatcccggcggcagcgtcgagcacatgaacgaggagtcgggcgaaacctggctcaaacgcctgctggcacacttcaagcacgcggtctggttgaacccgctgggcgaggagcattggcaatacacccagtctgtggccatgctgcggcaattgatggcgcagcggatgcggccgatgacgctgggcggcctggaccaggcgatgcgggatttgaaaaaaactgccgcccgcgcttga

SEQ ID NO: 2577 - DNA, 1431 bp, Chromobacterium substugae
atggacgccatcaaaatgcccacccaagaggaaggctcgctgctcgaagcgttcggccggctcaagtcgatcgcccaggccacgccctatcccgcgctggaaatgcgccgcgcctggctgggcgcgctggagcgcctgatacaggaaaaccgcgagacgctgatcgccgcggtgaatcaggatttcggccagcgcagcgcggtggagacccgcctggcggagctgttcccctcgctggaggcgatccgccacgcccgccggcatctgaaaggctggatgaagccggagcggcgccgggtgtcgttctggttcatgccggcgagcgccagcgtgctgccgcagccgctgggcgtggtgggcgtggtggtgccgtggaactacccgctgttcctggccttcggcccgatcgtcgcggcgctggcggcgggcaaccgggtgatggtgaaaatgtccgaatacacgccggccaccggcgcgttgctgagcgagctggcgctgcgctatttcggccgcgacctgttgaccgtggtcaacggcggtccggaactgggccaggcgttcacccggctgccgttcgatcatctgttgttcaccggctccaccgcggtggggcggcacgtgatgcgcgccgcggccgacaatctgacgccggtcacgctggagctgggcggcaaatcgccggcgctggtggcgcggggggccgatctgcgccgcagcgccgaggccatcgtcgccggcaagctgatgaacgccggacaaacctgcgtggctcccgactatgtgctggtcaacgaaaaggactgcggcctgctgctggacgagatccgcgccgccgcggcgcgcgcctacccgacgctggccgacaaccccgactacagcgccatcatcaacgaccgccactaccagcgcctgcaaggctggctggaggcggcgcgccaggccggcgcccgcatcgacgcggtgaatccggccaacgaaaacctggccgcccgccgcaaattcccgctgacactggtgcagcgctgcccggacgactgcgcgctgatgcaggaggagattttcggccccattctgccgattgtcgcctacgacaagttcgacgaggcgctgagctacatcaacaagcggccgcggccgctggcgctgtatctgttcgacaacgatccgctgcgggtggagcgggtgctcaaggaaaccgtgtccggcggcgtcagcgtcaacgacaccttgctgcatgtggtgcaggacgatctgccgttcggcggcgtggggccgtcgggcatggggcattaccacgcgaaagaaggcttcctcgccttttccaagctcaagccggtgttccgccagagccggctgtccggcagccggctaacccgggcgccttacggccgcatggtcgaatggctgctcaagctgatgctgcgccgctga

SEQ ID NO: 2578 - DNA, 519 bp, Chromobacterium substugae
atgcccagccgccgtgaactgctgaaaaccggcgcgctgggcgcggcggcgctgttgttggccggctactgggccacgccgcaggccgacccgctggcgcagccgggcggcgcggccacgctatggctgcagccgcaggacgcggccatcatccgcgcgctggcgccggtgatgctgggcctggatggcctgccgctggagcaggtggcggctggggtggacagggcggtgctgggtttgccgccggcgctgcgccaggagctgcggcagctgttcgatctgctgcagaatcgctgggcgcgccgctggctggccggcatcggctcgccttgggcttcggccgcgccgcacgaactggaacgctttctgcggcgctggcgcaatagccgcttccagctgaagcgcagcgtctatcaggcgctgcaccaattgatcaacgccgcctggtacggcaaccccgccagttgggccgcgctgggctatcgcctgccggaaggcgtggtggggatgctgccttga

SEQ ID NO: 2579 - DNA, 1611 bp, Chromobacterium substugae
ttgagcggcaagatccccgatccgatccgcgccggactggccttgggctggaaagcgttcgatggcgccgcgcagggccaggatctggcttgggatgccgatgtggcgatcatcggcagcggcgcgggcggcgcggtggcggccgaggcgctgagcgcagccggtttggacgtgctgattctggaggagggcggtttttacagttccagcgatttccgcatgctggaggccaaggcctatccggagttgtatcaggagtcggcaggccgccagacggcggacaaggccatcagcattctgcaggggcgttcggtgggcggcggcaccacggtcaactggaccagcagcttccgcacgccgccggataccttgcgctggtggcaggagcgctatggcctggcgtcgctgaccccggaagccatgcggccctggtttgaaaaggcggaggccaggctgggcatcgcgccctgggacgggcagcccaacggcaacaatctggtgctggagcgcggctgccaggcgctgggcctgcgccacgccaggatacggcgcaatgtgcgcggctgctggaacctgggctattgcggcatggggtgcccgaccaatgccaagcagtctatgttggtcacctgcattccccaggcgctggagcacggcgcgcggctgttgtcgcgggcccgcgtcgatcgcttgcaggcgaatcaatccagcagccggatcgtccaggtccatggcagcttgctggcggcggacggggtcctggcgaccgggcggcgcttcgtggtgcgcgcccgccatgtggtgctggcggcgggggcgataggctctcccgccattctgttgcgcagcggtttggcggattcgtcgggccagaccggcaagcgcacctttctgcatccggtcgctttgtgcgcggcccagatgccggaattgatccagccgttcaacggcgcgccgcaaaccgtttattccgaccacttcatgcatacccaatcgctggacgggccgctgggcttcaagctggaggtgccgcccatccaccccttgctggccagcgtcacctttcccggctggggagcccggcaggcgcaactactgcggcagttgccgcatctgcacgccacgctggcgctgttgcgcgacggtttccatccggacagccagggcggcgaggtgcgtctgcgcggcgacggctcgccgctgctggattatccgttgaacgatgtgatctgggatggggtgtaccgcagctggctggcgatggccgagctgcaattcgccgccggcgccagcctggtgatgccgctgcacgagcgggccgagccagtcagctcatggcggcaggcgcgggagcagatagcggaattgccattgcaggccttgcaggccaagttggtcagcgcgcacgtaatgggcgggatggcgatgagcgatgatcccagccgcggcgtggtggacgaatacggccggcactggctgtggcgcaacctgaccatcatcgacggctcgatttttcccaccagcataggggccaatccgcagctgtccatctatgccttcgcctggcgcgccgccgacgctctgatccggcaattggggcgggagggctga

SEQ ID NO: 2580 - DNA, 354 bp, Chromobacterium substugae
atggatctgcaacaggccttgctcaaacacgtggaatgggaaacccggttcagggtggcgattttcatgcaagagcggatggatgaggacaacatcggccgcgacgactgctgcgaattgggcaagtggctgcacggccccgggcaaagccgcttcggccacctgagcgtgtaccagacttgccttagccgccacgccatcctccatctggaagccgccaagatcgccggcctggtcaaccgccagcagttcagccaggcggaacaggcgctggatgacggcgcctacgccgtggcggccagcgcggcgagcgtggccatcgaacagctgcgccaacaaaccgagccgcgctga

SEQ ID NO: 2581 - DNA, 1857 bp, Chromobacterium substugae
atgacagaacacaccgctcccgacctggaatcctcgctgcgccggctttgccaggagcccggcaaaaccgaaaccctcgccttgctggtggccgccttgcgccccggcaacggacaggcgccgcagcagtccaccgtcaatctgcaagcgttgtcttttctgctggaacatcacgccgactaccgccaggcgctgcgcctggccctgtgcacgctgctggcggaaacccgccagattccgctctacaccgaagccggcatcctggccaacgacggcttcggcactacgttgctgcaccgtctgggcgagcgcgcgctgcccatgccccacaatcccgactcgctgcgcgaccgcttcggcctgctgttcagccacaagcacgattatctgtggctggaggcggtgcccgacgccacctggcacgcgctgtggcgcgctctggcctgggacgaagcgccgcgccaggacagcgagcgccagacccgactgcaattgctggagtccgtgcaagtgctgtcggcccgcatcaccgccatcggcctggagccagagctggtgcgggtctgccccgaagtagagcgcttcgcctcgcccttcatgcacctgaacgccgaagtgcagcgttacgtggatggctaccaccaggcgctggtggacggcacgccgccgccggaagacgaaaaacaggtgctggtgctgctggagcagtgcgaagccatcctcggcaaagtgcgcaaaaacgccgcccgttacggcatttccgtcagcctcacttaccacggcctgcggctggcgcaaagcatagcccggctgcgcgcgctgctggagctgttgtcgcccgagcacgacccggcggaaaagccccagctattccgattgctggtggacttcgcccgcgccgaaaaccgcaagtacagcctgcgcgacctgttcaagtccaacaccgagctcttggcgctgcaagtcaccgagcatgccggccgccatggcgagcactacatcgccgaggaccgccgcgactgggccaagatgggcaaggcggcgatgggcgccggcttcatcgtcggcttcatggcgctgatcaagctgatgcttgcgcgcggccacctgccgctgctgtgggaaggcatcgccttcggcctgaattacgcgatcggcttcatcatcgtgcagatcctgcacctgaccatcgccaccaagcagcccgcgatgaccgcagcccgcctggcggcggcgctgcacgagcagaacggccgcaagaagcagctggaagtgctggccgacctgatcaccaaggtggtgcgcacccaattcgtcgccatcatgggcaatgtgctgctggccattcccaccgcggcgctgatcgcgctgggctggagcgcgctgttcggcgcgccggtggtggatgccgccaaggcgcaaaagctgttgcacgagatcgacccgctacacagcctggccctgccgcatgccgccatcgccgggatattcctgttcctgtccggcacgataggcaccatcctcggcctgccgctggacatccgccacatcaccttctcgtcggccaacctggccttcgccagcgtggcgctggacttccaggtgccgttgtccgcggtgctgctgggctgcgccggcgtcgccctgatcggcatgaccaaccttgcggtcagcttcttcatggcgctgtgggtggcgctgcgctcgcgcaagctgtccggcaccatgctgctgccgctggtgcccatgctggccaagcgcttcctgcggcagccgctggccttcttcctgccgccgccgtctgcgccgcaggcggaaacggaaaccgctcctccgcttgacgaatcgcgcggctga

SEQ ID NO: 2582 - DNA, 585 bp, Chromobacterium substugae
atgagcaatggttccgacagcaaaaacgacacccgcaagcgcatcctcgacctggccgaggagttgctgctgacccgcggcttcaatggtttcagctaccagcacatcagcagcgcgctgggggtgcgcaacgcggccatccattaccattttcccaagaagagcgacttgggcgtggcgctgatccagcgctatcgccgccgcttcctgcgcttcaccgaacagcaggcggactgggacgcgccgcgcaggctggaaagctatttcggcttgtcggaccagtattaccagcagcacaagcagatctgccccagcggcatactcagcaccgaattccagaccttgccggaagatatgcagcaggaggcgtccgctttcatcgacgagatgcggcagtgggcggtcgccatcgtcaggctgggacgggatgtcggcctgatgcgctatgccggcacgccggaagcggtgggcatgatgctgttttccgccttgcaaggcggtttgcagctggcgcgcatcgacgacggcgccttgccgctgctcaagcagcaggtcagggtgacgctgggcctgggcgaatcatga

SEQ ID NO: 2583 - DNA, 513 bp, Chromobacterium substugae
atggaataccgcaagaacagcatgagccggatcgccgacaaggtgggccgcctgccggtgggctggcgccgcccggtgttgtcgatgatgttcggcaagatcgtgcccttcctctccaccgccggcttgcgtttcgaggatgtcgggcacgacaagctgaccgtctccatccgcaaccgcaagaaggtgcaaaaccacatccgcggcgtgcatgcggcggcgatggccttgctggcggaaacctccaccggtttcgtggtcggcatgaacatgccggacgacaagctgatgctgctcaagtcgatgaaggtgaattacgtcaagcgttcgcagggcgatatgcgcgcggtggccagcctgacgccacagcagatccagcagatgtacgagcaggacaagggcgaggtgctggtggaggtgttggtcaccgacgactccggcgaatcgccgatcgtctgtgaaatgttgtgggcctggattcccaagaagcgtccggaggcgagcgcggcatga

SEQ ID NO: 2584 - DNA, 816 bp, Chromobacterium substugae
atgatcgacttgcaaaccctgaccgtcgaactgaacgacaaggtcgcgctgctgcgcttcaatcgcgcggacaaggccaacgcgctcaatcagcaaatgtggcaagacctgcgcagcgcgctggactgggccgatgccgagagcggcgtgcgcgcggtggtgctggccgggcacggcaagcatttctgttccggcatcgacctgtcgatgctgatgggcctgcaagcgctgattcaggatgagtgcgaaggccgcaaacgcgacaagctgcgccgggtgatcttggatctgcaggactgcgtgaccagcctggagcgctgccgcaagccggtgatcgcggccattcaaggcgcctgtctgggcggcgggctggatatcgtgctggcggcggacttccgtttcgcggccgagagcgcgatgttcggcgtgcgcgaggtggacatcggcatggtggcggacgtcgggtcgctgcagcgcctgcctcgggtggtgggcgagggcgtggcgcgcgagctggcgctgaccggccgcgacatggcggcgcgggaagcgctggatgtcggcctggtcaaccgcgtgctggcggacgccgacgccgtgctggcggcggcgctgcaaagtgccaggctgatcgccggcaagtcgccgctggcggtgcgcggcagcaaggaagtgctgaattacagccgcgaccacagcgtcgccgacggcttgcagttcgtcgcgggctggaatgcggcgatgctgatttcggaagacatccagaaggccggcatggcggcgatgctgaagcaggaagccagcttccgcgattga

SEQ ID NO: 2585 - DNA, 1194 bp, Chromobacterium substugae
atgaacaaatacgctcgcctcagcctgatcgctaccgcagccatcgccatggttgcctgcagcaagcaggagcagccggcctcgggacaggcctcctccgctccggcgcaagccgccggcggcgacgccgctgtggtcaagatcggccaggtttcgccgatgtcgggtccgatctcccacctgggcaaggacaacgaatacggcgccaagctggccatcgaggacctcaacgcccagggcgtggaaatcggcggcaagaaggtcaagttcgaactggtgtcggaagacgatcagggcgacccgaaaatcggcacccaggtcgcccagcgcctggttgacgccggcgtggccggcgtggtcggccaccttaactccggcaccaccatcccggcctccaagatctactccgacgccggcatcccgcagatctcgccgtccgccaccaacccggactacaccaagcaaggcttcaagaccaccttccgcgtgatcgccaacgacgtgcagcagggcaaggcgctgggcgaattcgccgccggcgagctgaaagccaagaagatcgccatcatcgatgaccgcaccgcctacggccagggcttggccgaccagttcgaaggcgcggtcaaggccaagggcgccgaagtggtgaaacgcgaattcaccaacaacaccgccaccgatttcaacgccatcctcacctcgatcaagtcggccaaacccgacctggtgttctacggcggcatggacgcgcaagccggcccgctggccaagcagatgcagcgcctgggcatcaaggccaagctgatgggcggcgacggctggcagaccccggaattcatcaagctcgccggcgacgcctccgacggccagtacgcgtccagctgcggcgtgtcgcgcgacaagatgccgggcttcaaggccttcgacgagaagttcaagaaggaattcaacaccgacgtgcagatctacgcgccgttcgaatacgacgcggtgatggtgctggtggatgcgatgaagcgcgccaaatcctccgaccccaaagcctacctgcctgaagtcggcaaaaccgactacagcggcgtgaccggcaagatcgccttcgacgacaagggcgacatcaagaacggcgccgtcactgtctaccaggtgaagaacggcaagtgggaagtggtgtcgaccgtgggcggcaactaa

SEQ ID NO: 2586 - DNA, 1095 bp, Chromobacterium substugae
atggccatgccccgctatctgcctgaaccggctttccgccacgactacgcgcccaagaccggcgtgctgctgatcaacctgggcacgccggacgcccccaccgcccaggcgctgcgcccctatctgaagcagtttttgtccgatccgcgcgtgatcgagattccgcgtctgccgtggtggctgatcctcaacggcgtcatcctgaacacccggcccaagcaatcggcccgcaaatacgccagcatctggaccaaggatggctcgccgctgctgacgcacactcgcagccaggccaagttgctgaaaggccagctgggcgaaatggggatgacgggactggtggtcgattacgcgatgcgctacggcaatccgtccatcgaaagcgtgataggcaagatgcgcgaacaaggtgtggaaaagctgctgctgctgccgctgtatccgcagtacgcggcctcatccagcgccaccgcgctggatgaggcgttccgcgtgctgacgcggctgcgcaatatgccggaagtgcgcaccgtgcgccatttccacgataatccgggctatatagccgcgttggctgcacaggtgcgcaagcactggcaatatggccagcagccggacaagctggtaatgagcttccacggcgtgccgcgcttcacccgcgacaagggcgacccttatcactgcgaatgccagaagaccggccggctgttggccgaggccctgcgtctcgcgcccgatcaatatgtcatcagtttccagagccgcttcggccgcaccgaatggctgaaaccctataccagcgaggtgctggaacagctgggcaaggcgaaaaccgccaaggtggatgtcatctgtcccggctttgtcggcgactgcctggaaaccctggaagaaatcgcgatggaaggcaagcaaaccttcctgagcagcggcggtggcgaatttcgctacattccctgcctgaatgaagactcgcaatggatagtctcacttgcgacaattgtaaaagacaatcttgccggctggctggaaaatccggcagaagatggccgcgcccgccaagcgcgagcgcgtgaaaaaggggcatccagctga

SEQ ID NO: 2587 - DNA, 2301 bp, Chromobacterium substugae
atgcgatttttcaagcgcaaagccgtagtcaagaataaccagacgccgctgccgccgcagctggccgccctgctgcgcgaggcatggtggctgctgatggcggtggccgcggtgtatcttgtgctggtattggccagctactctccgcaagacccttcatggtcgcatagctcttccgaccccaccgtgcgcaactacggcggcgctttcggcgcctggctgtcggacatgctgctatacatcttcggcctttccgcctggtggctggtggtgttctgcctggtggcgataggctggggctaccgccgcatggaatcgctgggtttcaagttcagcccaatcacgatggccgcggtcggcggcttcttcctgctgctgctatccagcgccagcttcgaggccatcgtgctggaaggcaaggcggtgacgctgccgctggaggccggcggcatgctcggccacttcatcggcaagggcatcgcccacggcctggggctgtccggcgcctatctgctgctgggcgtattgtctgctataggattttccctgttcactggcctctcctggctggacctgatggagcgcatcggcgcggcgctggaagacggtgccatccggctatggaatggctggcaggcgaaaaaggaccgcgaaatcggcaaggaaaccgcgcagaagcgcgaagagaaggtttccgtcgccaagaagaaaatcgaggaaaccacgccggtgcgcatcgagccgccggtgctggaggtgccagtgtcggccaaggcccaaaagccggtgcagcaatctctgttcgccgaccccaaggacgccgccctgcccggcctgactctgctggatgctgccaaggagcagcaggagccggtatcacaggacaccgtggaatacacctcgcgcctgatcgagcgcaagctggccgacttcggcgtcgacgtcaaagtgatcgccgcctacccgggtccggtgatcacccgctacgagatagagcccgcggtcggcgtcaagggcgcgcaaatcgtcaacctgatgaaggacctggcgcgcgcgctgtcgctggtttccatccgcgtggtggaaaccatacccggcaaaacctatatgggcctggagctgcccaaccccaagcgccagatcgtgcggctgaccgagatcatcggctccgacagctatcagaacatggcgtccaagctcaccatcgcctttggcaaggacatcgccggccagccagtttcggccgacctggccaagatgccgcacgtgctggtggccggcaccaccggctccggcaaatcggtggcgatcaacgcgatgatcctgtcgctgctgtacaaggccacgcccaaggaagtccgcctgatcatggtggacccgaaaatgctggaactgtcggtatacgaaggcattccgcacttgctggcgccggtggtcaccgacatgaagcaagcggccaacgcgctgaactggtgcgtcggagaaatggagcggcgctacaagctgatgtccaaattgggcgtgcgcaatctggccggcttcaaccagaagatcaaagatgcggacaagagcggcgagaagattcccaatccgttcagtttgacgccggaaacgccggagcccctcgacaccctgcctctggtggtggtggtgatagacgaattggccgacttgatgatggtggccggcaagaagatcgaagagctgatcgcccgcctagcgcaaaaggcgcgcgccgccggcattcatctgattctggctacccaacggccgtcggtggatgtgatcaccggcctgatcaaggcgaatatcccgacgcggatcgccttccaggtgtccagcaagatcgacagccgcaccatcctggaccaaatgggcgcggaagcgctgctaggccagggcgacatgctgttcctgcctcccggcaccggctaccccaaccgcgtgcacggcgccttcgtctccgacgatgaagtccatcacgtggtggaattcctgaagaccaccggcgaaccggattacatcgaaggcatcctcaccggccaggccgacggcgacgatggcgccagctccagcggcctggatggcgagtccgacgccgaggccgatccgctgtacgacgaagccgtcgccatcgtggtgaaaacccgcaaggcgtcgatctcctcggtgcagcgccatctgcgcataggctacaaccgcgccgcgcggctgatcgagcaaatggaggccgccggcctggtgtcggcgatggaaagcaacggcaaccggaccgtgctggccccggcccgagaagactga

SEQ ID NO: 2588 - DNA, 399 bp, Chromobacterium substugae
atggccgaaatcaagcaaacgtttggcggcgccggcggcgctctccaaggtgtcaacatgtcaggcagccaggtcaccttctattggggtgacgcgctagtgaatattactgtcggcagcacttcctatggcggcaacaccaaaggcctgcaatccttgacggtaaccatgcccaatgatggcgttgttattctaaaaaagatgcaggccagaaccaatcaaggctatatggttgtcagctatctggaatttgatctttccggatcgataaagaaagtcggcaacttcaacgccaactcggctacgctggaggcgatggacgggtgtcaaattacgtttaccggcatcagcagcggcgggctgattgatcgcttgcaataccggatccttccgagctaa

SEQ ID NO: 2589 - DNA, 1104 bp, Chromobacterium substugae
atgagcgagctatatattggtatgatgtccggcaccagcctggacggcgtagacgccgtgctggcgcgtttcgacgccgaaggccgcccggagttgctggcggagcacgcgctgccctatccggacgaagtgaaggcagaagtgctggcgctgcagccgcgcggcgacgacgaactgcaccgcagcgcgcggctggccaaccggctggcggaaatctacgcccgcgccgccgccgagctgctctcccgcagcggccacgcgcccgccgacatccgcgcgatagcctgccacggccagaccatacgccacgccccgcacgctggctacaccatacagctgggcaatatgtcgcggctggcggagctctccggcatcgacgtgatcgccgacttccgcagccgcgacgtggccgccggcggccatggcgcgccgctggtgcccgccttccagcaatgcgtgttctccagcgagcgcgaacgtcgggtgatcctcaacatcggcggcatcagcaatctggcgcgcctgcatccgggccgggaagccataggcttcgactgcggccccggcaatatgctgatggacgcctggtgcctgcgccacaccggccagccctacgacgacgacggccgctgggcggccagcggccgggtagatccgccgctgctgcaaagcatgctggccgaaccttatctgcgcgaggctccgcccaagagcaccggccgcgacctgttcgacgacgactggctggcccggcaactggcgcgtcagccgcaaacgctggctccggccgacgtgcaggccaccctgctggccttcagcgccagctgcatcgccgacgccatcctgcggcattgcccggacaaccaggcggtctacgtctgcggcggcggtgcgcgcaacggcgcgctgctggccgagctggcgcgcctgctagccggccagaacatcgagccggtggaggcgctcgggctgccggcccagctgatagaagccatcgccttcgcctggctgggctggcgcttcaaccagcgccaagccggaaacctgcctgccgtcaccggcgcgcaggggcctcgcgtgctgggcgcgctgcatccccgataa

SEQ ID NO: 2590 - DNA, 1335 bp, Chromobacterium substugae
atggattatcgcaaactgctacacatcccgcaaaaatgcgcgtccaagctgatcaaccaccacctcagctggctcggcgtggccgcctgcctgcccatgctgggcaccgccaccgccttcgccgtggcggtgggcgccaaggaaacccgcggcccggaggtggtgcagcaacaggtggtggaacgcctggcgctgccgaaattccaattcgccgacagccagacccgctactggcgcgatgaaagcatcaagcgcggcgacaccgtggcgcgcgtgctcaaccgcgtcggcgtgcgcgacaaggaggccaacgccttcctgtacaccagtccgctggcgaaggacctgctcaagctcaaggtgggcgccacgctgacggtgcaaaccaacgacgccggcgagctgttcggcttgcgcttcctgcaggatgacgacaacggcgaacaggtgctggtggcgctggagaagcgcgacggcaaatggcaggccagcgccgacccggtggcggccgaaagcgtggaaaccgtgcgctcgatcacactgaagagaagcgccgccgccgaattgaccgccgctcgcgtgccggcggacatccgcaaccagctgtccgaagttttcgccgatcagttcgaactctccagcctgaaacgcggcgaccgcatcaatctggtgtacgaaaccatggtgtacgccggcgcttccatcgccagcggcaatctgctggcggtgtcgatcgaacgccagggcaaactgcatcaggcgttttacttcgcccatgacagcgaaagcggcgcctactacgacgccgccggccgcccggtgaagaaaggcttcagccgccagccggtggccggcgcgcgcatcagctcgggcttcggcctgcgcatgcacccggtgctgcacgcgctgcgcatgcactccggcatagattacgccgccagcgccggcacgcccatcgtggcgccggccgacggcgagctggtgaaagtccagcgcgagaacggctacggcaacatggtgatgatccgccacaacagcaagctgtccacgctgtacgcgcacatgagcgccttcggcaagggcgtgcgcgcgggcggcaaagtcaaggctggcgacattctcggctacgtaggcagcaccggccgagccaccggcccgcatctgcacttcgaagtgaggatcaacgaccagccggtagacccggccaccaacgcgctgcaagcgccggacctgggcaagacccagctggcccagttcggcgccaagcgcgcgcagttgagcgccaggctgcagttgctgcagaatatcccggtcaacgtagcgcaggtcgactga

SEQ ID NO: 2591 - DNA, 1038 bp, Chromobacterium substugae
atggtcaaaatggcgcggatccgcaatccatctggcaagaatatgaaattaatcctgttgttaccgggcctggcctggctggacgcccatgacggcggcgaagtgagcaaggcgctgccgctgcccgcgctgcagcaaatgctgggcaaggggcggcttgagcgcaaggaacgcggcttgtcggcgtgcgtcgaacagctgtggggcgcgccgcccgccggcctggccgcgctggcggccgagcaagccggcctcgccggggacggcgaatggctgttcgccgacccggttcacctgcgggtggaccgcgaccgggcattgctggccgatgtcggcgtgatgcagatcagcctggacgaagcgcgcggcctgaccgacgcgctcaaccgccacttcggcgaagacggcttggccttccacccgcagcaagcggggcgctggctgctgaatgcgcccaagccgctgacggcgcgcttcgatccgttgtgggatgtggtgggagaggacatcaatcgccacctgccgcaaggcgagggcggcctggcctggagccgcatgctcaacgaattgcagatgctgctatacacgcagccgctcaacgacgcgcgcgaaatgcgcggcgatttgccggtcaacagcgtatggctgtggggcgagggcgcgcccgcgccctggaaggcgccggcgccggcgctgcttgccgacgacgaatcgctgcagctcttggctgcgcgcagcggcatggcggtggacgccgcgccgttcgctttcgacggcttgccgctggacggcgactgcctgctgatgctggacgcgctgcaggcggcggcgcaatatcgcgacgcctggggctggcgcgaggcgctgcaacggttggagcaggactggttcgcgccgctgcagggcgccgttcgccaaggcaagatcagcgaattgacgctgatcgccaccggccccgccggcttcgagctgacgctgaagcccgccgatttgtggaaattctggaaacgcgcgctgccattggcggcgctttactga

SEQ ID NO: 2592 - DNA, 1689 bp, Chromobacterium substugae
atgtcgcagatcgtcacccgggaagttcccgttccgttgcagcaaaccctgctgcagcaaggcctcacgccgctgcaggcgcggctgtacgccgcgcgcggcatcgccgacagcgcggagctggattacggcctcaagggcctgctgccgttccagaacctgaaaaacgccgaagcgatggccatgcgcctggccgacgccatcgccgcccgccagcgcctgctggtggtggccgactacgacgccgacggcgccaccgcctgcgcggtggcggtgaaggggctgtccgcgctgggcgcgacgatagacttcatcgtgcccaaccgctttgagtacggttacggcctgacgccggaaatcgtcgaactggcggcgcggcagcgtcctgacatcatcatcacagtcgacaacggcatcgccagcgtggccggggtggatgcggcgcgcgcgcgcggcatcgaggtgctggtgaccgatcaccacctgccgggcgacacgctgccggacgcgctgatcgtcaaccccaatcagccgggctgcgaattcccgtccaagaacctggccggcgtcggcgtgatgttctacgtgctgatggcgctgcgggtggaaatgcgccggcgcggcgtattcgacgagcgcagccagcccaatctgggcgagttgctggacctggtggcgctgggcacggtggccgacgtggtgcggctggaccgcaataaccgcacgctggtggagaacggcctcaagcgcatgcgcgccgggcggatggcgccgggcatcgccgcgctgttcaaggtggccggccgagccagctacaaggccaatactttcgacctgggcttcaccctgggaccgcggctgaacgccgccggccgcctggacgacatgagcttgggcatcgcctgcctgttgtccggcaacgagcagcaggcgacggcgctggcgcaggagctggacaagctcaaccgcgaacggcgcagcatcgagcacggcatgcaggacgaggcgctggcggcgctgtccggcatcgacgccggcaaccgctacacgctcacgctgttccgcgacgattggcaccagggagtggtcggcatcgtcgcctcgcggctgaaggaacgcttccatcgcccgaccatcgtgttcgcgcccggcgacgaaggcgaaatcaagggctccggccgctccattccgggcttccacctgcgcgacgcgctggatctggtgtacaagcgccacccggggctgatcctgaagttcggcggccacgcgatggcggcggggctgacgctggacgaggggcgcttcggcgagttccagcaggctttcgaagcggcggcgcagcaactgctggatgaaaagcagctgacgcgcaccatagaaaccgacggcagcctgccagcgcgcgaattgagcctgcaactggccgagcagctggcggcggaggtctggggccagggcttcccggtgccgtacttccacgatcaattcctggtggtgaaccagaagctggtgggcgacaagcacttgaagctgcggctggcgcgcgaggggcaggaattcgacgccatgctgttcaaccatgccgactggctgccggaccgcatccaggcggtgtaccagctgatcgccaacgagtggcagggtcgcaaggaattgcaggtctacctgcaacactgggcagaggcgtga

SEQ ID NO: 2593 - DNA, 1581 bp, Chromobacterium substugae
atggaaagcgaaatggaaatgttgatcatcggcctgctggtcggtttgatgggcggcggcgcggcctggttcgccgctcgggcgcgcgccgcgcgcgagctggcagaactcaagcagcaagccgcgcagctggatgcgcagtgcgccggcttgcgggaacagctggacgaggcgcgccgccgcgagagcgccgcggcgcaaacagcgcaggaacagagccggcaactggccgacggccagacccagctaggcgcgtatgtggcccgagcccagcgggtgccggagctggaacgccagctggacgagcgcgaaaagcagctggaggcgctgcgcggcgaattgcgcgcggcgtcgtcgcaactggcggcgcgcgaggagcaggggcgggtgctggaggcgctggaagcgcgcagcctgcagcagggccaggacatcacccgcttgaccgcccgcgagcaggaattggccaccttgctggaaagcgagcggcggcaaaaccaggagaagctggcattgctgatggatgcccgccaagcgctgtccgaccaattcaaggcgctggccggcgacattctggaagaaaaatccaaacgcttcaccgaacagaatcagcaaaacctgggcgccttgctcaatccgctgaacgagcgcatccagaatttcggcaagctggtgcaggacacttacgacaaggacagcaaggagcgcctgtcgctggaggtcgaactcaagcggctgcaggagctgaacacccggctgggcgacgatgcgacggcgctgaccaatgcgctgaccggcgccagcagcaaggcgcagggcacctggggcgagatggtgctggaaaaggtgctggaaacctcgggcttgcataaggaccgcgaataccgggtgcaggtgtccgacgtggtgcaaaccgaagacggcgccaagcgctaccagccggacgtggtgatagacctgccggaaggcaagcagctggtggtggactccaaggtgtcgctgaacgcctatgtccgttacaccgcggcggaggacgacgcggcgcgcgaggccgaactcaaggcccacatcgccgccatccgcgcccatatccgcacgctgtcggaaaagcgctatcaggatctataccagctcaacacgctggacttcgtgttcatgttcattccggtggagccagcctatttgctggcggtgcagcacgacatgagcctgttcaacgaggccttcgagcgccgcatcatgatcgtcggccccagcacgctgctggcgacgctgcgcaccgtcgccagcatctggcgctatgaataccagaaccagaacgcgcaggagatcgcgcgccagggcggggcgatgtatgacaagttcgccggtttcgtcgccaatatggaaaagttgggcaaacagctggacagcagccgcgacaccttcggcgacgcgatgcgccagctttccagcgggcgcggcaacctgatgagcagcgccgagcggctgcgcaagctgggcatccgcaacaacaagcagttggcggcgcagttgcggctggacgacgccggcgacggcgaagaggacggcgaggcctag

SEQ ID NO: 2594 - DNA, 1113 bp, Chromobacterium substugae
atgagcaagatcagggtaggtttgattttcggcggccagtcgtccgagcatgaggtttccctgcagtcggccaggaatatcctggaggcgctggatcaggacagattcgaggctttgctgatcggcatagacaagcagggccaatggcatgtcagccagcccgccgactttctactgaatgccgatgatccggcccgcatcgcgctgcgccagtcgggcgaaggcctggcgctggtgcccggccagagcgaacgccagctggtggccgccgccgacgcccatccgctggcgcagatcgacgtggcttttcccatcgtccacggctctctgggcgaagatggctcgctgcagggtttgctgaaaatggccaacatccccttcgtcggcgcgggcgtgctgggctcggccgtgtgcatggacaaggacgtggccaagcgcctgttgcgcgatgccggcctgagtgtcgcgcccttcgtcacgttgacgcggggcaaggccgagcaggccgatttcgcggccatcagcgccaagctcgggctgccgctgttcgtcaaaccggccaatcagggttcgtcggtcggggtcggcaaggcgcgcaacgaggcggagttccgcgcggccctggccgaggcgctgcgttacgatcacaaggcgctggtggagcgggcggtggttggccgcgagatcgagtgcgcggtattgggcaatgaccatccacaggccagcggctgcggcgagatcgtgctgaacgacgagttttacgcttacgacaccaagtatctgaacgagggcggcgcgcgggtggcagtgccggccgacattccggatgaagcctgccagcgcatccgccgcatcgccattcaggctttccaggcgctggagtgccgcggcatggcgcgggtggatgtattcctgaccccggacggcgaggtggtgatcaacgagttgaacaccttgcccggcttcaccaatatcagcatgtatcccaagctgtggcaggcggcgggcctctcgtacgccgaactgatcacggccttgatcgagctggcgtcggagcagggcgcgatggacgcggcgctgtgccgcagcgccggcttgcctggctctgcttaa

SEQ ID NO: 2595 - DNA, 1011 bp, Chromobacterium substugae
atgaaaatgacgtttgcgatcaagaccgcaggctgcgccgtagccgccgccctgcttgccggcccggtgctggccaaggacttcaatgtggccgtggtgtacgaccaggccggcaagttcgacaagagcttcaacgaagcggcctataccggcgccgaacgcttcaagaaagagttcaagatcaattaccgcgaaggtcagcccagcaacgatgcgcagaaggaacaagtgctgcgcaatatggcgcgcaagggcgccgatctggtagtggcggtaggcttcgcctactcccaggccatcgaaaccgtggccaaggagttccccaacaccaagttcacgctggtggattcggtagccaagggcgccaacgtgcagagcatcgccttcaaggagcaggaaggctccttcctggtgggcatggccgccgcgctgaagtccaaaaccggcaaggtaggctacctgggcggcatggacgtgccgctgatccgcgcctttggctgcggttacgcgcaaggcgcgcgttacgtgaacccgaaggctgtggtgctgcagaacatgctgggcaccacccacaccgccttcaatgacccgtcgcgcggcaacgagctggccaagagccagtacgaccgcggcgcggacgtgatcttcgccgccgcggcgctgtccaatgtcggcgtgatccaggcggccaaggcctccggcaagttctacatcggcgtggacagcaaccagaactacatgcagccgggcacggtgctgacctcgatggtcaagcgcgtggacaacgccgtgtatgaaaccatgcgcgacgccaaggacggccaatggaagcccagcgtcaagttgatgggcctgaaggaaaacggcgtggattgggcgctggacaagtacaaccgcgcgctgatcacgccggaaatggagaagaagatcgtcgccgcgcgcaaggacatcatcgccggcaagatcaaagtggtggactaccgcgccggcaacagctgcccggtgaactaa

SEQ ID NO: 2596 - DNA, 1356 bp, Chromobacterium substugae
atgaaagaccttaccgaaggcgcaatcacccgccacatcctgacgatggcggcgccgattgcgatcggcatgattttccaggcgctttattttctgatcgatctgtatttcatcggcgaactgggcgccaatgcgcttgccggcgtcggcgccgccggcaacgcggctttcctggtgctggcattgacgcaggtgctgggcgtgggcacggtggcgctgatttcgcaggcggtgggccgcaaggaccgcgccgaggcgaacctggttttcaaccagtcgctgatgctggcgctgctggtcggcctgacggtgctgttgcttggttatgccgccgcgcatgcctatatggcgtcggtgtcttccgatccggcaaccatcgccgcgggccgcacgtacctgcattggtatatgccgggactggcgctgcagttcgccctggtttccatgggttcggccttgcgcggcaccggcatcgtccagcctacgctggtggtccagctgttgagcgtcatcatcaacgccatcctggcgccggtgctgatcgccggctggctgaccggccatccgctgggcgtggccggcgccggcttggccagcacgctgtcgctggtggcggcggtggcggccttgtggttctattttcatcggcttgagcattatgtcagcgtggatcggcgcttgctggcgccgcgctggcgcgaatgggggcgtatcctggccataggcttgccggctggcggcgagtacgcgttgatgttcctgttttcggcggtcatctattgggcgatccgcgatttcggcgcggcggcgcaggcggctttcggcgccggctcgcgcctggtgcagggactgattctgccggcgatggcggtggccttcgccgccggccccatcatcggacagaatttcggcgccggccgcgccgaccgggtgcgcagctgctttggctcggcgctgttgctgatcagcgcattgatggcggcgctggccgggtgggtctactggcaggcggaaagcctgatcggctatttcgccaaggatggcgaggtagtgcgttacggcgtgcagttcttgcaactgatcagctggaacttcatcgcgcagggcgtgattttcacttgctccagcgtgttccaggggctgggcgatacccgtccggcgctgttgagctccaccgtgcgcctgcttgccttcgtcgcgccggtgatgtggctgacggcccagggcggctttgccatcgagcaggtatggtacttttcgattggcagcaccttcatccaggcgctggtcagcctgctgctgttgcggcagcagtttagccagcgtttgcgccctgcggccgcattcgcgcgctga

SEQ ID NO: 2597 - DNA, 351 bp, Chromobacterium substugae
atgaaagacccttgcgatcattacaccttcgatctgatcggcggcgtacagaaaaagccaggccgcaagccgctgggtgagcgcgcgatgacggtggccgagcgcaagcggcgcagccgcgagatgcggcgcaaccggctgcaggagttgtcggtgacggtggagttgagccgagacgcgcagaagtcgctggacaagatgatcgagtggtggggcgtcagcaagaaggaagccatcaaccgcgcgctgttgatcgcctgtcaatcccagaccggccgcaccggcaccctgttcgatttcgagctgccgccgcagggcaagaagccgtcccgccgcaagccgcaaggttga

SEQ ID NO: 2598 - DNA, 1269 bp, Chromobacterium substugae
atgacgccccaaaccgctgcccgcgcctgcggtatcgactttggcacctccaactccaccgtaggctggctgcgcccgggccaggacaccttgctgcaactggaagacggcaagatcaccttgccgtcggtggtgttcttcaattacgaggaagaccactcccgctttggccgcgaagcgctgcgcgaatacatcgacggctacgaaggccggctgatgcgctcgctgaaaagcctgctgggctccagcctgatagacagccagaccgaagtccagggcaaagccctgcccttccgccacctgctcacgctgttcatcaaggaactgaagctgcgcgccgaagccaacgccggccgcgctttcgacgaggtggtgctgggccgcccggtctatttcgtcgacgacaatccgcaagccgataagctagccgaggacacgctggccgacatcgcccgccaggtgggcttcaaggaaatttccttccagctggaacccatcgccgcggccttcgactacgaggcctcggtgcagaaggaagagctggtactgattgtcgacatcggcggcggcacctccgacttcacgctgatccgcctgtcgccggatcgccgcgcccaggcggaacgccgcgacgacatcctggccaccggcggcgtgcacatcggcggcaccgatttcgaccgccagctcagcctgcatggcgtgatgccgctgttcggcttcaagacccggttgcgcaacaacgccgaaatgccgtccagccagtatttcaatctggccacctggcacaccatcaacttcgcctacacccgcaaggcttggatggacctgcaggacgtgcaccgcgacgcggccgagccgaacaagctggaccgcctgttccgcctgatccaggaacgcgccggccattggctggcgatggaagtcgaagcggccaagatcgcgctgtccgaccaggcccagcaccgcatggcgctggacccgatcgagacgggcctgagctgcgagctcagccgcgaggatttcgaagccggcatcgcgcagatgctggacagggtagccaccaccgttagcaagcttctggccgacgcgcaactgccggccgaggcgatcgacaccgtgttcttcaccggcggctccagcggcgtgccggccttgcgcgccagcatccgcgcgctgctgcccaaggcgcatcatgtcgagggcaatctgttcggcagcatcggcagcggcctcgccatcgaggcgatgaagcgctacggttgctga

SEQ ID NO: 2599 - DNA, 1092 bp, Chromobacterium substugae
atgctgcccgacacccccccgcagacctcccgcaacgcctcgccgctgctgatccaggcgcaatccgacacccaagcggtgctggcttggttggccgagcacactagcagcgccgccaccctggccagttaccgcaaggaatcggaacgcctgctgctgtggctggccagccgcggccaaaaactggcccaggtgcggcgcgaagacgtgctggactatcaacgcttcctcgccgcgccgcacccggccgaacaatggataggcccgccccgcccgcgcagccatccgcactggaagccgttcagcaaggggctgacgccgcacagcgccgcgcatagcctgactgtgctcggcgcgatgttcagctatctgaacgacgccggctatctgaacggcaaccctttcaagctgctgcgccgccgcgcgccgcgccagaccgcggaagtggagcgttttctcgatggcgaatgctggcggcacatccaggccacgctggataggctgccgcgcgacacggcaaaggcagttcgccacgccgagcgggcgcagtggctgttcaccctgctgtacctgaccggagcccgccgcagcgaagtggccggcgccgtcgcgggcgacctcgcgcgccgccacggcaactggtggtggaacgtggtaggcaagggcggcgtgcgcgcccgcatcccgctgtcggatgagttgatggccgcctatggccattaccgccagacattgggcctgcccgccgacatcggcattggcgacgatacccccctggtctgccgcatcggcgcgaagaaccgcgcggggccgttgtcggacaaagcgatttacctgatctgcaaagaagtgttcgcccgcgccctgcaacacgcgccgaacgacgaaacccgcgcccagttggcgcgcgccagcacccactggctgcggcacaccgccgccagccaccagctggaagccggcgttcccttgctgctggtcagccagaaccttcgccatgccagcatccaaaccactcgccgctaccttcacagcgaagaagacgcccggcaccaggccagccggctgcaccgcctcaagccagaagactga

SEQ ID NO: 2600 - DNA, 1461 bp, Chromobacterium substugae
atgcaagagagcgccgccatccgccctgcccgctatctcagcgacgacgatttcaagcgctacacgccggtgcacgtggtgtgggaaatcacgctggcctgcgacctgaaatgcctacactgcggctcgcgcgcaggccaccgccgccctgatgagctgaacaccgaagaatgcctgcaggtcatagactcgctggccgcgctgggcacccgcgaaatcacgctgatcggcggcgaagcctatctgcgcaaggactgggcgcagctgatacgcgccatccgcggccacggcatgtactgcgcggtccagactggcgggcgcaacctcaatccggcccggttgcagcaggcgctggacgcggggctgaacggaatcggcgtttcgctggacgggctggcgccgctgcatgacaaggtgcgcaatgtgccgggctcgttcgacaaggccgtggacgcgctgcgccgcgccaaggctgccggcctcgccgtcagcgtcaacactcagatcggcgcggccaccatgccggacctgcccgagctgatggaaacgatcatcgacatcggcgccacccactggcagatccagctgaccgtggcgatgggcaatgcggtggacaacgaccagctgctgctgcagccctatcaattgcaggagctgatgccgctgctcgcccgcctgtacaagtctgggctggaacgcggcctcctgatgaacgtaggcaacaatatcggctattacggcccttacgagcacctgtggcgcggcttcggcgacgagcgcgtgcactggaccggctgcgccgccggccagaccgtgatggcgctggaggccgacggcaccgtcaaaggctgcccgtcgctggccacggtaggcttctccggcggcaatgtccgcgacatgacgctggctgacatctggcagcatagcgagggcatgcactttggccggctgcgctcggtcgacgacctgtggggctactgccgcggctgctactacaacgacgtctgccgcggcggctgtacttggacttcccactcgctgctgggcaagccgggcaataacccttactgccactatcgcgtgctggacctgcagaagaaaggcctgcgggagcgcatcgtcaagttgcaggacgccgcccaggcctcgttcgcggtcggccgcttcgacctgatcaccgaggagatcgccaccgggaaagtggtcagccagatcagccgcaacggacaggtgatagagctgacatggaaaaaccagggcaagcgcgcgcccgaaatcggccagccgccggctacgctgtccatctgccgcagttgcaagcaatacatccacccggaagaaaagacctgtccgcattgcgccgccgatctggcagcggccgaaagcgcctatcgacaggaagaagcgaacaggcggcaaatcgtcgaccggctgcagcgcctgctaggcatcggcgcctaa

SEQ ID NO: 2601 - DNA, 609 bp, Chromobacterium substugae
atgtcagcagcagggctgtttcatacccgcctcaccgtcgcctcgcccaacctcggcgcccccgtcctgaccctcgacctggtggtggacaccgtcagcaaaaaggttgccggcgccgcccagatcttccagagcaccaatccgccggtgcaattccacgccaatgtctggggccactacacccaggccaagctcgacaaggccaccgagcaccacatcgtgctgtcgctggaaggcagtcccagctcgcccaacagcatgatcgccgagaccttcaatctgcaaggcatcctggagcaagactggacaaaaggctacgccagctaccgtttcttctatcagggcgcatggcacagcgttgtccacgccgtggtgaccgaagacaagctggcgccgggcaagcagccgcacgccggcaaccatgcccgccaccatccggtgatgccgctgtacgccgccgcgctgcagcagtcccgcggcagcaccgatgtcgcccagctcaaggccttggccagccaggctgaggaacagctgaaacagcacgacaatattcaaaacgcgctgacccagctcaaagacgaaatcatccgtctggaaaaacagcagtaa

SEQ ID NO: 2602 - DNA, 636 bp, Chromobacterium substugae
atgtcaggcaacactcaggctcttgaaggactgtttccggtcagctacatcatcaccaccggcgcgcccggcgcccagaacctgcaactgaatctgctggtgaacagcgccggcgaaacggtgaccggcaccgcgcacatcacccaggccaccaacccgccgctggatctgcactcggacgtgcgagggcaattcacctatctgaccatcatgccgccgagcgaaggccggattctgatcaccgcgcaaggcaaccccggcggcccccactccaacgccgccgtcaacttcaagatccacctggtgctagagcacgactggaaaaaaggcgtggccaactacagctatttcaacggccagcagtgggtggaagtcgaaaacgcgccggccaagctgaacgacaagctgcaatcgcgccgccaccctgaaattccgctggaacccggcccggtcattccgtccggcggccgcgtcatcccgctctacggcgtccctatccaaagcgccatcgccagcggcgacctgacccatatgaaaaccctggccaacctggcccagcagcagctggacagcaggccgcagctggaagcggcgctggccgaactgaaggcggaaatctccaagctgggcggctaa

SEQ ID NO: 2603 - DNA, 153 bp, Chromobacterium substugae
atgccttacggcgccgccattcagcaagccatcagcgaaggcagcctgtcccagatgaagcaactccaccagcaaagcgagcagtatctgaacgatcttcgcgctcagctcaaggagctggaaaacgaaatttcccgcctggaaaggcgctaa

SEQ ID NO: 2604 - DNA, 477 bp, Chromobacterium substugae
atgatatcgccgctgtccgccccatcgccctattcggccgcgacacccgagccggacgccccggtctctctgcagcaaaggctggccgccgccgcatccgaaacgccgcagacccgcccgaccggcaagtggcccgattacgacaccgaccccaaggccatggcctttctcgcggcgttgcagcaacttccgcccgcgctttcggacgcgcaagccgacaagcaggcgcagatcgacgccatcgccaaactgctgcgcgacttccaataccccgcggacagcgcggccttcgtcacgctggaagagcaaagcgccatcctgcaacgcacgctggcccggctgggagaaacctcgccgctgcacgccccgctgatggcggtgatgctgggcaccagcaacctgcagttccagatgaaaaagtggatgcaggacgtggtgttgtcggacggcacgccgccggaattcgacgaatggtga

SEQ ID NO: 2605 - DNA, 663 bp, Chromobacterium substugae
gtgttgatccgcagccagcggcttggccaggccgcccggctcggccggctggacggccaggcgcgccagcacgcgcaagttttgctgcgcgaagcccggcgcgaagccgacgccattcggcagcaggcatgccaggaaggctaccggcagggcatgcaggaggcgctgggccaagtggcggcgcatctcgccgacagccgcgcgctggccgaacagtggcggctgcgattgggcgccgaggcccgcgccatgctgtccgccgcggtggaccaccccgacacgctgctgctgctgctggacgaatggctgcgcgcgcaggacggcgcgcgcagcgacgtgctgacgctgcagttgccgtcgcgcgccaaggcgctgcagccgcggctgatggcgctgttggcggagcactggccaggcgcgatacgcatcgactatcactccgagccgcgcttcgtcatgcgctgcgccgaccaagccgccgaattcgagccggagcaatacgtggaatcggcatcgcggcaattattgcaggccctggacggcttgcaggaggactgccgccggatcgcggccgattcgctggcgcatctgctgcgggagcgggaacgcaacccagaatcggaatccgctcccgccgccgcccggcaaggagacgctgaatga

SEQ ID NO: 2606 - DNA, 579 bp, Chromobacterium substugae
atggctgacaccggcctggggagccaggcctgtgccatcctgttcgacccgctcggctatctgcaccgcgaacgcctgagcctgccggacgagatgcgcggcggcggccagcgcgccgccgtcaacgacatgctgatcgccgcctaccggctggacaccgcctggccggcggggccgcacagccacgccacccggcaatggctgcgccactgggcgcggctgccgcaagcggcctacctgatgggctgccagctgctgcggccctcgctggccaggcagggcgcgctgctgcgcctgccgccgtgggcgcgggattttgccgccatgccgctggccgcacccgccgcgccggcgctgccccgcgcgccggatcatgccgatctgctggccgcgggctacggccagctgctggcctggagcggccagttgccgcgcgcgctggtacaaagactgccgctgctgtttccgcccgcaaccgtgctggccgccaggcccgccgcgctgcccgatcccttgctactgaccttggccttgcaacatgcccagagacatccccattccccatcgttcctgcattga

SEQ ID NO: 2607 - DNA, 756 bp, Chromobacterium substugae
atgatgcgcgccagcctgaaagccgcgctgctggcgctgctgttggccggctgccagcaaaaagacctgctcaagggcctggatcagcagcaagccaacgaagtggtggcggtgctgcagcgccacaacatagaagccgacaagaccgaccgcggcaagaccggattcagcatcgccgtggcccagcccgatttcgccgccgcggtggactggctgcgcatctacaacctgccgtcgcgcccgagggtggaggtggcgcagatgttccccgccgactcgctggtgtcgtcgccgcgcgcggaaaaggcgcggctgtactccgcgctggaacagcggttggagcagtcgctgcagaccatggacggcatactgtctgcccgggtgcatgtcagctacgacctggacggcggcgaagccggccggacagcccagcccatgcacatctccgcgctggcggtgtacgacagcgaggccgatcccgccgccatgatcaacaacatcaagcgtttcctgaaaaacagcttcgccgaagtggagtacgacaacatctccgtggtgctgtcgcgccgcggcgaagcgcagcaacagccgcccggcccgcggcgcgatgaaggccagagcggcgccgcctggtggctggcgggcttggccgccctgctggcgctggcgggcgctgccggctggttctggcatcgccgccgcccccccgcgccggcgacggcgcccgcccctgccgcgggagagtcgcatggctga

SEQ ID NO: 2608 - DNA, 303 bp, Chromobacterium substugae
atgaatcccatcggcgcctctcaactgcacgcgctggcgcaatccggcgacctcgcccgcggcgaagaccggctggtttcgctggaagagcggctgattcaggcgttttcccgctcggccgtcagcgccggcatggaaaaagacgccatcctgcaaaagctggagcagccggaaatcatcaccaacccggccgagctgttcgagctgcagcaacgcacctccaattacaacctggaggtgtcgatgatcagcaccctgtcccgcaagaccgtgggcgcggtggaaagcctgctgcgctcatga

SEQ ID NO: 2609 - DNA, 252 bp, Chromobacterium substugae
atggcaaaaatcgattttccctggagcggttatctggacgaaacctccgccaagttcgacgaaggcgtgaagaacatgcacaaacaggtggaggatgcgctggcggcgctgaaggacaagccgtccgatcccgaactgctggcgcaataccagagcaagctgtccgagtacaacctgtaccgcaacgcgcaatccaacgcggtgaaggcgttcaaggacatcgacgccgccatcatccagaacttccgttaa

SEQ ID NO: 2610 - DNA, 1170 bp, Chromobacterium substugae
atggccgtagaagacacccacaccagcgcaagcgccgccatcgtggcgcgcctgctcaacagccccctgcgcggctgcgaattcccgttgccggcaggccggaccctgttcgtggtcggccccgagccgatgctggacagcgccgcgacgctgcccgagctgcccgccgacaccctgtacgtgccgctggcgcaaggcggcgtcaatttcgaactgcaggcggcagacggccgggcttccattcgccagctgggcgagcatgcggcggacgcctatccggccgaactcaaccgggcgctgaaaatcggcgagctggagctggcgctgcggcatccggggcaagcctgggctgaggacattctgctgcatccgcaagccgccgcgccggcggccgagcgcccggaccgcgccagccgtccagcctggcctgccgcgctggccatcgttctgctggcggcgctggccggcggcgcctactggctgtgggacacgccgcaaagacaggcggcgcagctgtccgcgctgctgggacgcgacgcgcaacgcttccaggtgctgccgggtcgcgacggcgcgttctacgtcgccgccgccgacgaccgcgacgccgcctgggcgcggcaggcgctgctgcgcggcggcggcctggcccgggtcatcaatccgcggcgggaaaacgaacgcatcgaccgctggctggccgactcccggcccggcctggcctattaccggctgcagctggacgacccgcgccgcccccagctctggaccagcctgcagcgcagcgcgctgagcgcggcggacacggcggcgctcagccggcaattggcgggccagctgccttacgccgagcgggtggacatcgtcccgatggacgacgccgccgccgcgcgcgaggcggaggcggggctgacgcggcaggcgctgcccttcagccgcaacaagcaccccgacagcgtcaccttcgtgatagagggcgcgctggacgacggcgaactgcagcgcgcgcgccaattcgtggacggctactaccggcaatggggcagccgctacgtgcagttcgccacagaattgaaggacgactggctcaagggcaagtccttcaagtacggcgaccagggctacgtgaagatggaaaccggccactggtattttcccaagccactttga

SEQ ID NO: 2611 - DNA, 441 bp, Chromobacterium substugae
gtgagccgcgcctggctggccggcgccgcgctgctgtgcgcgctgcccgcccatgccgactgctgggagcaggccggccggatgttcaatatcgagcccgacctgctgtacgccatcgccgagcaggaatccggcctacggcccgacgccgccggccgcaaccgcgacggcagccgcgacctgggcctgatgcaaatcaacagcctgcacctgccgcggctgcgccagctgggcgtggacgagaagcggctgttgggcgacgcctgtctgtctgtgatcgtcggcgcctccatcctgtcggacatgatgaaacgctacggctactcctgggaggcggtgggcgcctacaacgccggcgtcggccccgaacgccgaaccttgcgcatgcgctacgcccatcaggtgtggcagcgctaccagcggctgcgcgccagccgctga

SEQ ID NO: 2612 - DNA, 1686 bp, Chromobacterium substugae
atggcgttacacaacgatggcttcatcaatcggcaattcgtctttggcgattttgtcctgcgcttcgacggcgcgctggttcaccgcgaacagcagctcagcattccgcccaaggagctggcggtgctgaccgccctgctggaagccgctggcgagctggtgagcaaggactcgctgctggaccgggtctggccggacggcgacgtcaacgaggagtcgctcacccgctgcatctacgcgttgcgccgcatcctgctggaaggcaaggacaaccgctacatcgacaccgtctatggcaagggctaccgtttctgccgtccggtggcggtggtgtcgcgcccgacgcccaacgcggaaaagtgcacgatggcggtgctgccctttcgcaccgacggccaactggacgcgctggagctgcacgcggcgctggtgcaatgcctgtcgcgctattcgccgttcggcctgatcgtgctgccggccaccatcacccgcaattgcagcgacgtcgccgacatcatgtcgctgatcgaccaactgcgccccgactactacctggccggacaagtgcgccgccatggcggcgcgtcgcaactgcagatcgagctggtgcgcgccgacggccaccagctggtgcatcacgaaagcatggagctgggtccgggccagcccatcgccgcgctccacagccggctggccagcctgctgccgcaacgcattcccggcctgcgctggaaacagggcaacgccagcgagctggattcgctggacctcgccgtggcctacctcaacagccgccaccaactgcagcgccacaccccctccagcctgcgccaggcgctgaccatgctgcaccagtgcgtcagcggcaaccccagccacgcgctgccttactgcagcctggccgagtgctacctgaccctggctcaactgggcttgttcgaccaggcgctggcgctggaggaggcgcagcaggcagtcaacaaggcgatcgcgctggaagcgggccatccgcaagccatgggcttgctggccctgctcagcagcatgcgcgcgcaaatcgcggtggccgacgctctgttcgagcaggcgcgcctgctggcgccggattcgctggacatccactactaccacgcctggcacctgtttctgtccaaccggctggagcaggcgcagcaggcggtggacgcctgtctggcgcgcgacccttcccgcatcgccgccggcatcctcaaactgtggcttacctattgccagcaccgcgtcgacgacgcggtggcgctgggcaaaagccagctctgccaatacggccaggaccacccggtgctgcagagcatgctggcgctgatgctggcggtgcaaggccagcacgcccaggcagaagagctggcggcagcggtgcgcgcctccggcgaggagtgcggcctgctggcggccaactgttgctacgtgcgccactgcagccagggcgaagccgcccggccgcagctgctggacttcctggccaaggtggacagccgccaggtccgctccggcctgctgccgctgatcctggccctacacggccgcgaggccgcgctgcaattgctgggtcaattgcaggccgagcgctacctgtggctgcgcgcctggcggcacgacccgcggctggcctcgctgtttcagcagccgctgccggaggccgcgtga

SEQ ID NO: 2613 - DNA, 141 bp, Chromobacterium substugae
ttggcccgggcgacagtttgcgatcggcgcgtcccgcatccatgcaggcggcccagcgtcaaattaacgcaggccgcgcgccgcgacttgcataaaacgcccttcgcgcccggtcgtttttcagacttttcccatttgtag

SEQ ID NO: 2614 - DNA, 372 bp, Chromobacterium substugae
atggtgaatggagtgtccggggccgccaggccgtatccgttggccgaagcgcggcaggcgtcccacggcgcggcggcgtccggcctggcccagcgctgccgcggctgcggcatgtcgccgcaagcgcggccccagccggcgatggccggcagccaggtcggcggttttcaatcttgcctggacgggctgcggcgcgatctggatggcgccggcgccatgctgcgccagctgtccggcgacgccgggcttccgtcgcgccagcaagcgcaggcggggcagttggcgcagcggctggatggcttgagccaggcgctggaacggggcaaccggctggcgttggcggccagcctgatcggcgcgcgcggcgcctga

SEQ ID NO: 2615 - DNA, 2583 bp, Chromobacterium substugae
atgctggatgcaatcggcgcgaacggcgccgccacgctgcgcgggtttcgcgcattgccggacggcgaagccgccccggcggcgaacttggggcgggcgctgcgcggcgcggccggccggccggagaggcgcgcggccatgccgcgcggggcggagatcaaactggcggatgccgaactgcgcctgcagcgccagggcatgcgcgaggtgctgcgggcgatgacggacgaagcgcgccgcctggccgagcccgcgccgcggccgcgctgggcggcgacgctgcggctggggaatgccagccatcgcctgacgtcggacagcgtggccattttgcagaacctgcgccaggcgctgcgcgaaggcagcggcgacgcgctggacatccgcgaatgcgcgaagctgtcgctgcaactggagaagctggcggaaaaattgccggccgacagcccgctgggcgagctgagccgccgcctggccttgcaggggcaggccgcctgggcgcagctggcgcgcgccgatgtcgaacggcaattgctgccgcagtttttgcgtttcgatcagccgggagcggccagcgaaaggcatctgggcgtatcggtgggcgtcggcatcggcctgggcgagggcggcctcggcgccaaggcgacggtaggcctgggcgcgaacctgagccgcggcatggataacgacgacgagggtttcgtattccagaaccgcggccatgcggtatcggttcaggccggggtgagggccggcgtcggcgcggccacgctgtcgggagcggcggaagggcggcgccaggtcacccgcttcaccgaattcaacagcgccaaggcatttgtccatctgcgggccgagcaactggggcacggttcgcgccgcgaaacgctgggcgtcagcgcccgaaccgtggtgggcgcgctgatccggctgttccgccccggacacggcaacgagctgcgccattaccaccgcttgcagcaacaggcgggcgatcagcagcagcgggtggcggtgctgctgggctggctggggcggcgcgatgcttccgccgcgctgcctggcgcgcgggtgccggtgttgccgggcggcgaatcggtggctatccgcggcgccgtcagcgcgcgcgcggcggcggtcggtttgagcgccggcgtcggcgcggcgctggagcgcatcgacatccgggccgacgcgctgacgccgttctggcagggcgtcgcggccgaagcgggcgcggcgcgcgacccagtggtggcggcgcagcggctggccggcatcgagcaaaaggcgcaggcgctgttcgaccaagtgggcgacaagccgggcgcgcggccgctcagccgtttgaccggcgggctgcggctggcggattgcccgcccgaggcgttgaagtcggccgtcggccggctggcggcggagttcgagcatttctgcgcggtggcgcggcagctggatgccggcatcggccgccgcgaaggcggcgcgcaggtggaaaaatccattctggccagctggcagggaaaaagccgcgaggacgcgctggcgaacatggcgctggcgcatgccgcgctgttgctggcggcggggcggcgggagggcgcggacgatgcccgcgcggccttgttggaagccgcgcccggcttgtacgcgccgccgattcgccatgacgccgcggcgctggccgagcgggtgagcttccgcgacaccctggctctgcagatccgcgaccgcagctacgcgctggacctgggcggcggcatcggcccgctgggggtgaaggcggaagcgtccttgaccgagcgcgaacgggttcatcccaatccggcgcgcgctggcagctacaaggatgtgcgcgtcaccttgtccggcagcctgggcgacgctggcgcgctggacaagctgaaggacgcgctgctggcgcaactggcgccgcatggcctggccgatcagctgccggcggcgttggcgggcgcgcagtcgcaattgagcgcgcagaccggcgcgggcgtcacgctgctgctgcgcttctaccagccgcaataccagcgccaggccgacttcccggccgcagccgccggctaccggctgcaactggccagggtgagcgccagcgtggacggttcggccgcgctgtccggcggcgtgccgttgcagccgggcgtgtcgctggagctgggtttgagcgccggagcgtcctcaagcgcggtgttgcatgagcgttggggcgacaacagcctgagcgcgccgatgatgcattatctacacctgcaggcggtgggcgagcccgagcgctggccggcgctgcgcgagtcgcagcgggaggcgctgtcgggcctgttccggcaactggccgacgacggcgccgccgtgcatcaagaggcggggtattttctggcgcgccagccgcaagacggcttcggcgagcgcttcttcgccgcgatgcgcgccttcgcctccggctcgggcggcttcgacgcggcaggcgcggcgctggaagccctgctgcagcggcaatacccgctgtggcaggcggacaagctgtccttccccggcctggtggagctgccgctgccggcgtga

SEQ ID NO: 2616 - DNA, 1335 bp, Chromobacterium substugae
atgcacatttccagtcttcaaccatcccgtccgttgtcttcttcgtccgcagccgatcaggcccaagctgtccgcagctttgcccaggtttacgacaaggccgacttcaagccggtgccgaatcagatccacatggtgtgggtgggttcgcaacccggccagacccagcaggactacctgcgccaatgggcggccaagaatccgggctctgaagtcaatctgtgggtggattccaagcagttcggcgcctacgccgccaaccgcgaggtgcgccagcaggtggacaagctgttccccgatgccggcgccttccaggcggaaaagctgttccgcggcctgttcagccagttggccgccacgctgggcaaggaagacggcgccttggggcgcgccgcgcagaagcaggcgctgagcgaattgaacaaggaattggcggcgccggggaatgaggcctggcgcgaggcgctgctgccgcagggcggcaaggtgaccggcgacaatgccgccgccgcgctggatgccttccgccaattggttcgcggcaacgacgagaaattcctgttggccgaccgcctgatcctggaccagaccgtcaaggcctgggaccgctgcgccgccggcgccgagcgcgacgtcgccgcgctggagcgcctgcaggccggcttcgccgacgcgcccaatgtgaaagtgcgcgacctgagccatgccggcgatatccagctgcgcaaccgcgacgcctaccagcatgaaatcatcggccgcaacggcgcgtatccggcggcgtcggacatcgcccgctatgaaattctgcacaactacggcggggtgtacgccgatatcgacctggagtgcacgcagcccttggccggcgcgttgtccgcccacccggacctgatgctggtgggtctggccgaaggcaagcgcgaggccagcggcagcgccaccccgtatttcgccaacgcgctgctggccagccaccccggcagcaagatgctggacggcttcatcgacaagatcggccgagactaccagcagatgaagggcgcggaattcgccggcgaccgttacttcagccgcgccaacaagagcaccatcgaaggcaccggccccaacgcgctgcgcggccatgtcgacgccgtgctgcgcgaagccgagggccggccggaagccgcgcgcggcgacgcgcaatcgctggcggagcgcatctggagccaggacgacacccgcaaccatgatttctgggcggcgatggactcccacttccgtttccccgacggcttggtcaacttcgaaaccgaagagcagcagcaaagcgcgaccaagggcatggcctga

SEQ ID NO: 2617 - DNA, 768 bp, Chromobacterium substugae
atgacagataacgatgtgttgaatccgctggaaacattgggcgcggccgccagtcgcggcgtggcgtcccaggaggcctggctgttgcaaccgcgggagggccgggccgcgcgcctggccctggactgggcatcgggcggcgagatgctggagctgcccgccggctggcgcggcctgctgctgctggaccggctggagctgaccgtgctggacggcggcgtgagcttccagcctatgcggctcgaggcgctgaccaagctgctgtccttcgtcgacgaggcgcgggacgccgagcagcaggccagcgaatgccgttgcgcgctgctgccgttgggcgaggacgaagtctggaccgaccgccgcggctgcgagtactggtttttgcgccaggtgctggcgccgtccgagccgttccaggcgctgttgtccttgctcaggcgcagcgaaagctactggctggtgcgcttcctgctggcgcagtccgagcgcggcgacaagctgcaagagctgggcgaacgctacggcgtgtcctactcgcactttcgccgcctgtgccgcaatgcgctgggcggcgcggccaagaccgagctgcgcgactggcggatggcccgctcgttgctggacgtggtggaggggcgggacagcctgacccaggtggcgctcaagcacggctatgcgtcgtcatcgcatttttccaatgaaatcaagggactgatcggcgtttctccgcgtgggttgtccaatatcatccagttggccaccaaatga

SEQ ID NO: 2618 - DNA, 1695 bp, Chromobacterium substugae
ttgctcgcagcctgtctgggctgcgccctgtcgttgccgccggccagcgccctggccgcgccgccggccgaacgcgccggcgaggatgccggctatgtcgccaggaaagacagcctgcgcgcctttttcgacgcgctgtcatcgcggctgaagaagccggtgatcgtcagcaagctggcggcgcgcaagcaagtcagcggcgatttcgacctttccagcccgcaggcgctgctggaaaagatgtcgcagcagctggggctgatctggtaccacgacggccaggccatctatgtttatgacgccagcgaaacccgcagcgcggtgctgtcgctgcgcaacgtgaccttgtccgctttcaacgatttcctgcgcaagtccggcctgtacgacaagcgctacccgctgcgcggcgacggccgcagcggcaccttctacgtgtccggcccgccggtgttcgtcgacctggtgagcagcgcggcggcgatgatggacaagcagagcgacggcctggacctgggccggcagaagataggcgtggtgaagctgaacaacaccttcgtcagcgaccgcaattacgagctgcgcgatcagaaaatctccatccccggcatggccacggtgatagaaaagctgctggagggcgaacagaagccggtgcgcgacgtggcggccgcgccgccggcccgccgcggcgacatcccgcccatgcccgactttccgggcgcggccgacctgaagccgccgccgtacgcggccgggctcagcctgccggaggcgctgaagcaggaagccgccgccggcgacatccgggtgatcgcctatccggacaccaacagcctgctggttaagggcaccgccgagcaggtgcgcttcatcgagagcctggcgcaggcgctggacgtggccaagcgccatgtcgagctgtcgttgtggatcatagacatgcagaaggacgacctggaccagttgggcgtcaactggagcggcagcgtcagcgtcggcaacaagctgggcgtggccttcaaccagtccggctcgctgagcacgctggacggcacccgcttcatcgcctcggtgatggcgctgtcgcgcgacaacaaggccaatgtggtgtcgcgcccggtggtgctgacccaggaaaacgtgccggccatcttcgacaacaaccgcaccttctacgccaagctggtgggcgagcgcagcgtcgatctgcagcatgtcacttacggcacgctggtcagcgtgctgccgcgcttcgccgccgacggccagatcgagatgtcgctgaacatagaagacggccgcgaaacccgcgcgccggactattcgcaggacaacaaggacgccggcctgccggaagtgggccgcacccgcatcagcaccgtggcgcgcgtgccgcagggcaaaagcctgctgataggcggctacacccgcgacgccagcgacaaggagcaagccaaagtgcccttgttgggcgacttgccgctgctgggcggcctgttccgctatcagcgcagcaaccagtccaacacggtgcgggtattcctgatccagccgcgcgagatagacgagccgctgatgccggacgccagcgatctgtcgggcggactgcccggcggcgccggcgtcgatgccgacccgctgcagcaatgggtgcgcggctatctggaccgcgaacagcggaacggcgggtag

SEQ ID NO: 2619 - DNA, 1119 bp, Chromobacterium substugae
atggaaatcaaccaccgcgcggtgttcagcataggcctgcgctcccccaagcagcaggcccggcaagaagcgcagcgcgacgccgtgcgccagagcgaggcgaggcaggccgaggcacagcaggcggcggaggacgccagcccggcggccgagctgcagcgcttcgcgcagtccagcgatgagatggcggcggcgctgacgatgttccgcaaccgccgcgactacgacaagaagcagggcggtctcgccgacagcttcgagcgggtgctggacgaagaggcgctgcccaagtcgcgccagctgctgcaagtggccaaggcgcacgggctgacggcggaagagctgctgcgccaggcgcgcgcgctgtttcccgacgacagcgacctggcgctggtgctgcgcgaactgctgcgccgccaccagctggacgaggtggaacgcaagcggctgaaggcgctgctcaagcaggtggaggagcaggccgcgccgcggccgttcaaggccggcatcaattgcgcgctgaaggcgcggctgttcggcaaggcgctggacctcagccccggcctgctgcgcgccagctaccggcaattcctggagagcgacgcctccgaggcggaaatctaccaggactgggtggccagctacggctgccagcggcgcgcggcggtgctggatttcatcgagggcgcgctgctggccgacatcgacgcgcaagaccccagctgctccgggctggagttcggccatctgttgggccggctcagccagctcaagtcgctgcgctcggccgacgcgctgttcgtcggccggatgctggccaatccgctggcgcgccgcttcaatcccgccgaagccgactggctgctgttgctgctgtcgctgctgcagcagccgcaagacgtcgacgcgctgctggccgacacggtgggcgaggccgcgctgctcagccgccacgccgatcattccgcgctgttgcaaacgctgtaccaggcctgcaaggcgttgccccccggcctgttcgccgacgaagcctggcagccggcgctgctggaggagttccgccggctggccggcgtcgcctaccgccgcgaactggcggaaaaacggcgcgaaagttaa

SEQ ID NO: 2620 - DNA, 2046 bp, Chromobacterium substugae
gtgttgaattccttgctgaacggcgcgcgcacgcggccggaactgctgatcttgctgttgatggtgatgatcatcgcgatgctgatcatcccgctgcccacctatctggtggacttcctgatcggcctgaacatcgtgctggcggtgctggtgttcatgggctcgttctatatcgaccgcatcctcagcttttccacctttccgtcggtgctgctgatcaccacactgttccgcctggcgctgtcgatcagcaccagccggctgatcctgatcgaggccgacgccggcgagatcatcgccaccttcggccagttcgtgatcggcgacagcctggcggtgggcttcgtggtgttctccatcgtcaccgtggtgcagttcatcgtcatcaccaagggctcggagcgggtggccgaagtggcggcgcgcttctcgctggacggcatgcccggcaagcagatgagcatagacgccgacctcaaggccggcatcatcgacgccgacggcgcgcgcgagcgccgcagcgtgctggagcgcgaaagccagctgtacggctctttcgacggcgcgatgaagttcatcaagggcgacgccatcgccggcatcatcatcatcttcgtcaatttcatcggcggcatcgccgtcggcatgagccagcacggcatggacctgtccaccgcgctgtccacctacaccatgctgaccataggcgacggcctggtcgcgcagattccggcgctcttgatcgccatcagcgccggcttcatcgtcacccgcgtcaacggcgacggcgacaatatgggccgcagcatcatgagccagctgctgggcaaccccttcgtgctggcggtgaccgcggtgctggcgctggcggtgggcatgctgcccggctttccgctgccggtgttcctggtgctggcggcggcgctgggcggcttgttttactacaagcggcgccaggcccgcgcggcaggcggcaagcccgctccggccgccagcggcggcgccgagccgacgccagccgcccgcgagggcggcctgggcctgatcggcaacctggacaaggtggcggcggaaaccgtgccgctgatcctgctgctgccgaaaagccggctcgccgcgctggagtcggcgcaactggccgagcgcctgcgcagccagtttttcatcgactacggcgtgcgcctgccggacatgctgctgcgcggcaacgacaagctgccggacaaccgcgtggcggtgctgatcaacgagatccgcgccgacgagttcgccatccatttcgacctgcagcgggtggtcaactactccgacgaggtggaaacgctgggcatgcagccgctgctggccgacggccaggcctgggtggcgccggccgacggcgacaagctcgccacgctgggctaccagctgcgcgccgcgccggacgagctctaccactgcctggccgcgctgctggcgcgccacgtcaacgaatacttcggcgtgcaggaaaccaaacacatgctggaccagctggaaggcaaataccccgacctgctgaaggaagtgctgcgccacgccaccgtgcagcgcatcgccgaggtgctgcagcggctgctggccgagcgcatttcggtgcgcaacatgaagctgatcatggaggcgctggcgctgtgggcgccgcgcgagaaggacgtgatcaacctggtggagcacgtgcgcggcgcgctggcgcgctacatctgccacaagttcgccagcggcggcgagttgcgcgcggtgatggtgtcggccgaagtggaagacctggtgcgcaaaggcgtgcgccaaacctcggccggcgcctttctcaacctggagccggcggcgtctgacgaactgatggacctgttcgcgctgggcctggacggcctgggcgtggcgcaccgcgacatggtgctgctggcctcggtggacgtgcgccgcttcatcaagaaactggtcgaaacccgcttccgcgagctggaagtggtgtcgttcggcgaaatcgccgacagcgtgtcggtgaacgtgctcaaaaccatctaa

SEQ ID NO: 2621 - DNA, 408 bp, Chromobacterium substugae
atgttcgcactggatatcgcccaactggtccgctcggcgctgcgggaaagcggctgcgacccggccatgctgggcgagctggacaaccactccaccatcgcgttggacctgcatgagctgcccagcatccacgtcggcgcgcaggacgccgaggtctggctgtgggcgcgcctgaccgagcacggcgaagcggcgctggcgcagcgcggcggcgacctgctgcaagagctgctgcaaggctgcgactatgcccgcggcggccaattgcagctggcgttgaacgacggcgcgctggagctgaaggcgttggtcaatccggaattcctcgccgacggcgcgcgtttttccgaggcgctgaacggcttcttcgacagcctggagcgtttttgcgagttcacgctgcgatga

SEQ ID NO: 2622 - DNA, 1290 bp, Chromobacterium substugae
atgaagccgccgcgcctgctgcgccggctggccaacccgcagcgcctgtccggccccattctggaagccgccttgcccggcgtggcgataggcgagctgtgcgacatccgccgcggctggcaggaccgcgaggtggtggcgcgcgcccaggtggtgggcttccagcgcgaacgcgcggtgctcagcctgatcggcgccgcccgcggcctgtcgcgcgaggcggtgctggcgcccagcggccgcgcgatgtcggcctgggtgggcgaggcggcgctgggcgcggtgctggacccgacagggcggatcgtcgaacgcttcgcgccggccgagggcgccggcggcgaagaacgcgccatcgacgccgacccgccgccgtattcgcagcgggtgggcatacgccagccgctggccaccggcgtgcgcgcgatagacggcttgctgacctgcggcgtcggccagcgcgtcggcatcttcgccgccgccggctgcggcaagaccatgctgatgcacatgctgatcgaacagggcgacgccgacgtgttcgtgatcggcctgatcggcgagcgcggccgcgaggtgaccgagttcgccgaatcgctgcgcgcctcgccgcggcgcgggcgctgcgtgctggtatacgcgacgtccgacttttcctcggtggaccgctgcaacgccgcgctgctggccaccacggtggcggagcatttccgcgaccagggcaagaaagtgatgctgttcgtcgattcgatgacgcgctacgcccgcgcgctgcgcgacgtggcgctggcggcgggcgagccgccggcccgccgcggctatccggcctcggtgttcgacagcctgccgcgcctcttggagcggccgggcgccacccgcggcggcagcatcaccgccttttacaccgtattgctggagagcgacgacgagccggacccgatggctgacgagatccgctccatcctggacggccacatctatctgagccgcaagctggccggccagggccattacccggcgatagacgcgctcaggagcgccagccgggtggcgggccaggtgacggacgcagaccaccggcgcagcgccgccgcggtgcgcggcctgatggccaggctggaggagctgcaggtgtttctggacctgggcgaataccggccgggcgaaaacgccgacaacgaccgggcgctggccgcgcgcgcgccgctgcagcgctggctgcgccagggcgtggacgaaagctcgccgctggcggacaccctggcgggcctgcatgcgctcgccgattga

SEQ ID NO: 2623 - DNA, 456 bp, Chromobacterium substugae
atgcgctcgccgattgagccggggccgctgttgtcgcgttgccaggccgaacagcggcgctgcgacagcgaactggcgcagctggcgcgggaggacgggcaactggaagcgcgccagcgcgatctggacggccagggcgaaggcctgcgccggctgctgctggcgcagcgcccagccggcgcggccttggaccgcggccagctgttcgcgctgctgcgcaagcaggcggtgctgcgccgccagctgcaaaacctggacttgcagcgggagcaggcgcgcgaacagcggctgcagctggcggagcggcgcgagcggcaggcggcgctgcgccgccagtggctgcgcaaggaagaaaaataccaacgctggatgcagctgcaacgccggcgccggcgcttgctgggcttgcgtcaggaagaaatcgaacaagaggagatgacgacatggcaagcgtga

SEQ ID NO: 2624 - DNA, 1026 bp, Chromobacterium substugae
atggcaagcgtgatgccgacaagcgcgccggcggcgatggcgccggcccagcaagcggaagccgagggcgtggcgggcgcgttcgcgcggcaggccggccggctggcgcgggacgaaacggggggcgagcgcgacaaggacaaggacgcgttgcctgaaaccggcgttttcgcgctgttgccgccggcgttgccgccgctcggcctgccggcgcatggccgccgcgccgccgacgctcagcccgtggcagcgggcatgaaggcggcgagcggagcggtggagaaagaggcgcgccgcgacggtggccgcgcatcgctggagcaggcgctcgccgcggcggcgaaagccgccgcccatgccggcgcggccgcgccgcagccgggcctgaaaccgcgcggcaaggaggccagcggtcccgccgcgcatggcgagggtggcctgaaggagaaggcgcagcctgcgctgcccgccgcgccgctggccgaaccgtggcggcttgggcccttgtcgcacgagcacttgcgcgcggctttgcccgccgcagccggcatgccgcccagcccgccgcagagtccgttgtctgacctgccggcagtcccgtcgcttggccggctgaaggatgagccgcacaagccggttgcggctgaagcgtcggcgcagccggccagcctgcccgccgcgccgcggaaagaggcggaagcaggtctgccgccgcgggcggaaacgcctcggccgcaaacgccgggcatggagcgccagccgccgcaaccagccgcggcgggggagccgcaagccggcctgacctatcgcttccagcgctggggcggcgagcattcggtcaatgtgcagttgccgtccgggccgggcgccgcgcagctgacgctgcagccgtccgacagcctggtgcagcagcgcctgagcgagcagtggcagcatggcgacccgcagcgctgggagctggcgcgggacggcggcgagcgccagcgccgcgacggccgccagcctgagccggaggaggacgcgtga

SEQ ID NO: 2625 - DNA, 897 bp, Chromobacterium substugae
atgttgaaactgcggcgagtggagggcgaaacgctggccttgcgccaggcggccgaaatctgggccggccagggctgggaggcggagatcgcctatccgccgcgccatggccgctggctggaagtggcggacgaggacgggcgctggcagggctggctggagccgcgcgcctggctcgagagcatggcgccggatctggcggtgctggccagcggcgccggcgcggagcggcaggccggacgcctgatcgccgccagccccgcgccgctgcattggcctatgcccgatctgccgcgcggacgggtgcgcgccggcgcggagcgggatggcggcgaactgccgcagcggccgctgttgcgagtggctacgccgcaagggccggtatggctggccagggtggaagcgccgcggcccgccgccatgccggcgaggcgtttcgactggctgtctgcgccgctggctttcggcctggggcatagccacatcagccaagccctgctgcgcagcgtgcgcggcggcgatgtgctgctggtccagcaaacggcgtccctggtggcctgccatggcaggacggtggggcgttatcaacgatccgatgaaggaatcatcatggaatggcaaatggaagaggcggcggagcgggatgagccggcgctggccgatatcgaacaattgccggtgcggctggagttcgtcttgcagcaaagccgggtgacgctggccgaattgcggcagctgtgccagggccggctgctgccgttgcaggccggcgccgagcgccaggtggaggtgcgcgccaacggcgccttgctgggccgcggcgagctggtgcaactggatgggcagctgggcgtggaagtggcgcagtggcgggacgggccggacgatgtcgaatga

SEQ ID NO: 2626 - DNA, 660 bp, Chromobacterium substugae
atgtcgaatgatatttcgctgatcgcgctgctggcgttttccacgctgctgccgttcctgatcgcgtcgggcacctgcttcatcaagttctccatcgtgttcgtgatggtgcgcaacgcgctgggcctgcagcaggtgccgtccaatatgacgctcaacggcatcgcgctgatgctgtcgatgttcgtgatgctacccgtcgcgcagcaggcttacggttattaccaggaagagcgagtcagcttcaccagcgtggagtcggtgagcaacttcgtcgaaaacggcctggacggctaccgcgcgtatctgcagaagtattccgacccggaactgacccgtttcttcgagaaggcgcaggtcgaccgcgccgagcgcgaaaccggcagcgccgcggcggacgaacagccatccatcttcgccttgctgccggcctacgcgctcagcgagatcaagagcgcgttcaagatcggtttttacctgtacctgcccttcgtggtggtggacctggtgatctccagcatcctgctggcgctggggatgatgatgatgagcccggtgacgatatcggtgccgatcaagctggtgctgttcgtggcgctggacggctggacgctgttgtccaagggcctggtgctgcaatacctggatctggcgacgtag

SEQ ID NO: 2627 - DNA, 261 bp, Chromobacterium substugae
atgaacgacctggttttcgccggcaacaaggcgctttacctggtgctgctgatgtcggcctggcccatcgtggtcgccaccgtgatcggcctgctggtcggtttgtttcaaaccgtcacccagctgcaggagcagacgctgccgttcggcatcaagctgttcggcgtcagcctgtgcctgttcctgctgtccggctggtacggtgaaaccttgctcgccttcggccgcgaggtgatgcggctggcgctggccaggggctag

SEQ ID NO: 2628 - DNA, 774 bp, Chromobacterium substugae
atgccgttcgggctgtttttcgagatccacggctgggtggccgcggcggcgctgggtttcgcccgcgtggcgccggtgtttttcatcctgcctttcctcaatagcaatgtgctgaccggggtggtgcgcacctcggtggcgatgctggtggcgctgggactgtggccgcacgcgccggaggcgctgccggccttcgacgcgctgtcgttcgccgcgctgatcgcgcgcgaggcgacggtgggcttgctgctgggctgcctgctggcctggccgttctgggtgttccacgcgctgggcagcattatagacaaccagcgcggcgcgacgctgagcagcagcatagacccggccaacggcgtggacacctcggagctggccaatctgttcaatctgttcgccgccgcggtttatctgcagggaggcggcatggcgctgatgctggatttgttccgcgaaagctaccgcttgtgcgacccgctgggcggcggcatgccggcgctggcgccgctgctgggcctgctcaatcaggtggtgtccaaatcagtggtgctggccagcccggtgatggcggcgctgctgctgaccgaggcggtgctgggactgttgtcccgcttcgcgccgcagatgaacgcctttgcggtgtcgctgacggtgaagagcgcggtggcgctgctgatcatgttgctgtatttcgcgccggtgctgccggacgcgctggcgcggctgtctttccagcccggcgccttgtccggctggctgccggccggaggctga

SEQ ID NO: 2629 - DNA, 1065 bp, Chromobacterium substugae
atgtcgaacaagaccgaacagccgacgcgcaagcggctgcgcgattcggccaagaagggccagtccttcaagagccgcgacctggtggtggcctgtctcaccctgtgcggcgtggcctatctggtgtctttcggctcgctggtggagttgatgggcgcctttcgccaggccatcgccggcggcttcagcttggacatggcgggctacgccaagacggtggcctggctggggctaaagctgctgctgcccattttcttgctgtgcgtcgccgcctcggcgctgccggccttgctgcaaagcggcttcgtgctggccagcgaggccttgaagctcaatctgtcggcgctcaatccggtcaacggcttcaaaaagctgttcagcctgcgcacggtgaaggaggcggtgaaggcgctgctctatctggccagcttcgcggcggcggtggcggtgatctggcgcaagcacaaggagctgctgttttcccagctcaacggcagcccgctggacatggccggcgtgtggcgcgagctgttgctgtcgctggtgctgacctgtctgggctgcatcgttctggtgctgctgctggacgccatcaccgagtatttcctgttcatgaaggacatgaagatggacaagcaggaagtgaagcgcgagatgaaggaacaggaaggcaatccggaaatcaagtcgcgccgccgcgaggcgcatatggaaatcctgtccgagcaggtgaagtccgacatcgagaactcgcggctgatcatcgccaaccccactcacatcgccatcggcatctacttccgcccggaagtcgtgcccatccccttcgtgtcggtgctggaaaccaaccagcgcgcgctggcggtgcgagcctacgccgagaaggtcggcgtgccggtggtgcgcgacgtgccgttggcgcggcggatcttcgccggccatcgccgctattccttcgtcagcctggaggaggtggacgaagtgctgcgcctcttggtctggctggagcaggtggagaacgccggccagccggagccggacgacaacccgccgaacgccggatga

SEQ ID NO: 2630 - DNA, 504 bp, Chromobacterium substugae
atgaacgcgaatgacaacgtcagcgacgaccgctttgcggagatggtctgggaagccgtgagcggaggcgccacgttgaaggacgtgcacgggattccgcaggacatgatggaaggcctgtacgcgcacgcttacgatttttacaacaagggacggctcgacgatgcggagacctttttccgttttctctgcatctacgatttctacaactccgattacatcatgggcctggcggcggtttgccagctgaagaaacagttccagaaagccgccgacctctacgcggtggccttcgcgctgagcaaggacgactaccggccggtgttcttcaccggccagtgccagctgttcctgcgcaaggcggccaaggccaggcagtgtttcgaactggtgtgcgagcaaagcgccgacgaggcgctgcgcgccaaggcccaggtgtatctggacactttgcaggaaaccgaaaacgggcagtcccgcgagcaggaaaaggagcaggcatga

SEQ ID NO: 2631 - DNA, 1743 bp, Chromobacterium substugae
atgagtgacgcaggcaccataggcagcgcgtatctgcgcaatcccggccttgccggcgcggctttcgacagcgtgcgcaaggacggttcctttctcgacgccgccgacaaggcgctgaaggcggtgctggccacccgggccggcgaaggtaagccgacagtgagcgagcgcgatctggccaccccggcgctgagccagcccagccccaaggcccagcgcgagctggacggcagcggcaaactgacgctgctgctgggccaactgatgacgctgctgggaaatgtctccctgtcgcagctggagagccgtctggcgacctggcgcgcgatgatggagtcgcagcaggcgatgggcaatcagctgtcgcaggaattccagcaggcggtggccgaatcgcaggccgccaccgaggccttccgcggcgccgaaggcgagtatgaaaccgccaaggcggcggccgacgccgcgcagcagaaggccgcggccgccaaggcgaagctggaggcgatgcagccggacgacccgggctatgccgacgccaaggcggccagccagcaagcggcggccgaggcgcagctggcgctgcaaaaggccggccaggcgggcgagctggcggagaaagcccgcctggtggcggtggacaaggccaagcgggcggacgagctagcgggcaaggtgcagggcgccaacgtcaacaccgacgcggcccgcaagggcgcggaagaccacctgagcaatgtcggcaagctgaccatgctgatggcgatgttctccaagctggtgggcgagaatagcgaaaacagcctgaagaacgacctggccctgttcgaagcgatgcaggaaggccggcaaaaagagatggacaagaaatccgccgagtaccaggaagaggtgcgcaaggcggaggagctcaaccgcgtcatgggatgcgtgggcaagattctgggcgcgctgctgacggtggtcagcgtcgtggccgcggctttcaccggcggcgccagcctggcgctggccgcggtgggtgtcgctttgatggtggccgacgaggtggtgaaggccaccaccggcgtgtccttcatggaagaggcgctcaagccgctgatggaaaaagtgctcaagcccttgatggagctgataggcaaggcgctgagcaaggccctggaaagcatgggggtggacaagaaaaccgccgaaatggtgggcgccatcgctggcgccatcatcgccgcggtggcgatggtggtggtgatggtggtggtggccaccgtgggcaagggcgcggccagcaagctgggcggcgcgctcagcaaattgatgggcgataccatcaagaagctggtgcccaagttgctgaaggaattggccagcaacggcggcaagctgctcagccagggcatgcagcggctgggcaacagcctgggtctgcgcaccgacgagctgtccaagcagctgatccgcaacacgctcaaccgcgtggtggtgggcggcgaggtggtcaatgccgccagccaggccggcggcggcgtggcgcagggcgtgttcatgaagaacgcgtcggaagcgttggcggatttctcgctggcgcgcgcctcgatggagcagatcgagcaatggctgaagcaggcggtggaagccttcggcagcacccagaaaatcacccaggaactgaccgcggccatgtccgccgcgctgcagcaaaacgcggaagccagccgtttcgtgctgcgccagagccacgcctga

SEQ ID NO: 2632 - DNA, 1254 bp, Chromobacterium substugae
atgatcagcctgaatcacagcagccccctcgccatttccctcccgaccggcgccgacagccccaaggcgcgcgccgccgacggcctgatttccgtcgccaccctgctgccggcgctgcgcgccagcggcgaaaccggccgcgaactggccggcgcgctggcgggccagcccgaactcgccaagccgcaaggcatgctgaagcctgaggacgccggcgcgctgcaccgctggctgagcggcaagctggacgaccgccagttcaccgccggcatcgagcagaccatgggcaagctggagttgctcatcgacaaggaattgaaagcgcgcggcgacgaggccaaggacccggccttcgacatcagcggcatgtccacccgcatggccgcgctgctggcgcaggccatcgtgctgatgtcggcgctgcgcaccgccgacagcgccctgagcagcaagctgtcgcaggtgagcttcgacgccaccaagagcaccgcggcttccatggtgcgcgagggcctgtccaatctgtccagcagcgtggcgcagggcgcgatccagttcggcgtcaccggcgtcggcgccaagaagcagctcagcggcctgtccgccgagcgcggcgcgctgaagaacaacgcgcccaagctgaacaagctgggcgacgaggcgcgcaacatccagggcgcgctgggccgccagggcagcgtcaagctgggcgcggacgccgacagcatgaaagacatcaagctggcgtcgccgcaggcgggcaaccgccagagcctggccgagatgaatgcccagccgggcgccggcgccggggtggcggacggcatggccgccgcgcgcgacggcgcggtgccgctgcaggcgagcaatcagcgtctggccagccagcatgaagccgcgctgggcagcgtcggcgacgacattccggtgaaaacccgcgccgagcaggccgcgctggaagacacccggctcaagtcgcaggccaagcagaccactggcaaggccatcatggaggcgtccaacgccgccggcggcatcgccggcggttccggccgctacgccgccacgctggagcaagccgatcaacagatcagccaggcgtccggccgggtggcctccaacgcctccgacgaggcgcgcgagcgcagccgcaaggccgacagcatcatccaggatctgctgaagaccctggaaggcgtcagccagtccaagagcgccgcgatgggcgccatcgccggcaacatccgcgcctga

SEQ ID NO: 2633 - DNA, 1041 bp, Chromobacterium substugae
atgctcgactccctgatccgcaccccgtccattccgctgtactccgccgcgcgcgcgcaaagcgaagcgccggccgccgagctgcaaaccgcgccgccgcgcggggaaagcgcgccgcttccgcccaacgccaagctgatgcaggccacgctgcagtccgccaggcagctggacgccgcgctgcagtcgcaacagcgagacgccgccgccggccggccgcccgccggcgaaacgcaggaccgcaaggccttggcgctgcaccagctggacggcaatctgcgcgggctgagcgcggccggctaccgtctggcgccggaagcggtgagcgcgatggccgccgaaaacgacgcggcgcttgacgccgcgccgcagctgctgcgagagcaggcgccgacgctggctgatcaccagatgtatccggacagcgtgttgtgggacaacatcgccaaggccatcggcggcatcaacgacaactatctgggcgtctacgagaatgtggtgggcaagtacaccgccttctaccaggcgttcagcgacatcctggccaagctgggcagcctgatttcgtccaacgacaagggcgacaaggtgacgctggaggtcggccagctggtgacgctgttggagaagctgaaaaccgatttcagcctgcccaattccgccgccatcctgtttcccaaacagggcgccaaggccaccgaggcgcaagccaagcagtgggcgagcgagctgggcctgccggacggctgcgtgaagcccttgccgggcggcggttacggggtggtgctggacctggggccgatcaccgtgatgacaacggagctgaacaagttgggtagcggcaaagtggagctggacaacgccaagttccagtcctggaaggccggtttcgacgcccaggaagaaaagctgaaaaacacgctgcagacgctgacccagaaatacagcaacgccaactcgctgttcgacaacctggtcaaggtgctcagcagcaccatcagcagctgcctggaaaccgccaagtccttcctgcagatctga

SEQ ID NO: 2634 - DNA, 2169 bp, Chromobacterium substugae
atgaccatcacattgcaacgatcgacctcctgcccggacctgtctgcggccgccgcgcgggagccggggccgcaaaccccgctggccggcaggatgcgcggcgccgccgccgcgccggcggtggggctggagggtttcaaggccgacttcgccaaccgcagcctggaggcgctgttcggccagtccagccaaccggagcggctgcgccagttgtaccagtcctccgccaatgcctatgccaagctggaaatcgccgaattcgccaaagtgttccaccggttggcgcaaagtccggatttgagcgaggaagcccgggccgcgctggacgggcaggcgcggcaatacgccgcgcagattctcaaggacggcctgggcgagcgttcggctttcgggccgtggacgccgaaaaccgccaagggctaccagctgcgcgcccggctggagcatcagctggcgcaattcgccgcgctgcggctggggggtgacgccgcccggctgggagccgatttcatgaaccgggaggtgctgcctttcgtgcggcaatacctggagcaccaactggcgggcaagctggacgaagcctgcgtgcgtgaactgaccggcgtgttcgaccgcgccgcgcatcaggctttcgaagccttgcggcaaggccgcgacgagctggtgcagctgcacgggctgggggtgggcaagctggcgcgcgatctggacacggtggcagtgctgccgctgctgatgcgcaatgtgctggcgcagctgcagccgccggccgagggaagggccgatccggccagcccggccgctgatgacggcgcggcgaagccggaggcggccggcggcgtccacatccgcatcggcgacatccatatcgacaatagccggcacatagacaacagccgccatatcgacaacagccggcgcggccgcggcgcgccgacgccgctgtccctggcgctcaagctgcggcgcgatccgggcggcgacggcaaggcgcgggccgagccggctgcatccggcaagccgccgccgccggccgccagcctggcgcgtgatgccgccgtccagacccatccggcagccgctgagcccgcgccgcccaatccggcccaggccgatggccacggtcaggcggcgccattcccggcctggcgcagctattacccggaagcggtgctgcgctccatcggttttcaaagccgggacgacgctcacccggcggcaagggcgttggtggcggacatgcgcagcgcgctaaggctggatgccgccagcgagatggacccgcattcgccgttcgccgcgctggcgcgcgcgcgcgacgcggcattgcgcgaagcgccgggcgaggcgcggcagccatatgaagcgcctgtcgatgctgcgcagtgggcggtgctgaagcaggggcttaaccggcacccgcaaagcgagcagctgcgcggccaggtgcgccggctggcgcgcttgaccaatctcgcgcgcggcgaatggccgcaagacagcgcggtgcagcggttgctgcagtgggggctggcggccatgccggctgccggacccgccccggacctgccgccggggccgcctccggacgccggcccatccatatcgacccaggatggcgcgccgttcgccggcatcgcgctgcgtggcgccgcgccgcgcctgcccgccgccgactacctgcgcggctacccgtttcgcagcgatccgcaagcgccggcgctgctgttgatgagcgcgctgcgcgaagcgctggaggcggacccggccacgccgtggccgctccggcgcgaattcgaccgcagccgcgacgagctgctgccgcgcgcgcagctggaccagcgccgggccttgcaacgcttcgccgacggcgacgccgcggtagcgcccaggctgggccaactgctgtccttgctggacgcccatccgcggcggcaggcgttggtcgatctgggcaggcggctggcgcgcgaaacggcgctgctgccgcgcggcgagccggccaacccgctggtggcgcagttgctggccggactggggctggacgccgcggaagaagcgagacggcgcgagcccgccacgccggcgtccacggtggtcctcaccgtagacggccagcatctggacgccgccgccattcgggagcgcagccgtgccgcgcgcgattga

SEQ ID NO: 2635 - DNA, 216 bp, Chromobacterium substugae
gtgctggcggtgctgggcgccagcctgggggcggaggtgggccggatccagcccgcgtcgcggctggtggacgatttgtgcgccgattcgctggagctgctcgacatggtgatgatgctgaacgacgagttcggcatcgagatcggcgtcgaggacatcgtcggcatccgcaccgtcgccgatgtcgaggccgcggtggcgcgccgcctagcctag

SEQ ID NO: 2636 - DNA, 2349 bp, Chromobacterium substugae
atgaaatccaccgcccggctggcggcgtggctggccgccgccctgctgctggaccacggccaaagcctggccagcccgttcaatccggccgagcgcgcctggctggcgcgccacccggtggtgcgctacgcgatagacccgcacggctggcccatcgaatatctggagcaaggcgagcacaagggcctgacccaggagtacctgcaacgaataggcgacatcagcggcatccgcttccaactggtgccggtgcaaaaccgcttccaggcgatgaccatgatgctgcagggcaagctggacctgctcaccgccacctcgcccaagctgattcccgcgccgttcaatcagcagatgctgttcaccgacccctatttctccggcagcaccctgctggtcacccggccggacaagcccatcgtgttcgacccggccaaactcagcggcaagaccgtcgcggtggagcaaggcgacccctacgaatacttcctgcgccagtactaccccgacatccgcatcgtgccgacggccacgccgctggccgcgttggacgcggtggcggaagaccgcgcctacgccgccgtgggcctggacgccaccttgcaggcggtgatccagcgccgttattacggcacgctgcacatcgccggcagcgtcagcgaaatgccgcggctggtatcgatggcggtcaacctgcgccagcccatgctgcgcgacatcatcgataaatcgctgggccagctcaccgccgaggacaccgacgccatcctatacacctggctgcgcaccaccgactacggcatgccgtcgtggggctccatcgcccgctactacgctttcgagctcagcgcgctggccgccggcttgctggcgctggcgctgctggcccagcgggcccgcgccgcccagcgcgccgcccagcgcagcgaggcggaaaaatcgctgtttctggcggtgatgagccatgaaatccgcacgccgatgaacgccatcctggcatcggtggagctgctgcggcgcgccgcgctgccgccgcgcgaacaagagctggcggcgctggccaacgcctcggcggtgaacctgctggagctgctggacaatgtgctggacatctccaagctggacgcgcgcaagctggcgctggagccggtggccaccgacatggcggcgctggccggcagcgtggccgccgtctaccgcccctgcgcggaaaaaaagggcttgaaactgacggtgcagttgagcggactggagcgcccgctgctgctggacccggtgcgcatgcgccagatcctgagcaatctgctgagcaacgcggtgaagttcacccaccagggcgaggtgctgctgcgagtggatctgcggctggcggaaggagaaagcggcgcgttgctggtgacagtgcaggacacgggcatcggcatcgagccggaacagcaataccggctgttttccgccttttcccaggccgacgacaccacgcgccgctacggcggctccggcctggggctggcgatctgccgccaattggtggagttgatggccggcagcatcacgctgtccagcttgccggggctaggcaccactatgaccctgcgcctgccggtggactgcctgccgcagcccgccgccaagccggcggacatcgacgccgccccgccttcgcagccggcgtcgccaagcgccgcggtcctggtagtggaagaccagccggccaaccgcttcgtcatcgcccagcaactgcgggagctgggctaccgcgccgaaatggcggaggacgcgcccgccgcgctggcgctgctggcgcgaggccagcgtttcgccatggtgctgctcgattgcgacctgcccggcatcagcggctacgagctggctcagcggctgcgcgcccatccggcgctgcagccgccgccccatctgcccatcgtcgccatttccgccaccaccggcatcgcgcaccagcaacgctgcctggaaagcggcatggacagctgcctgtccaagccgctgcggctggagcagctgcggcagatcctggcgctgtggctggaaactcccgccgcctcgccagaggaacaagccgatgctacggcctcgtccgacgccgacctgcaacggatattccgcagcagttgcggggaagacgcccagctgctggaacaggcgctgcaggcgcgcgactggccggtcgccatccaccacgcgcatcggctgggcggcgcggcgctgtccaccggccacgccgagctggccgatgccgcgcggcagatggaagccttgctgcggcagccgcaaaaggacgacgccgcgctgcgcgaacagctagcccggctgcggcaggcgctaggctag

SEQ ID NO: 2637 - DNA, 702 bp, Chromobacterium substugae
atgtccgacagcaaaatctccatcgccctgccccacccgattcgcgtcgccttgctggacgaccacctgatgatcctgcacggcctgagcggccacctggccggcgtggccggcctgcgcgtggccggcagcttcaccgccagcagccagctgatgcaggcgctggccggcgggctggcagcggaaaccgacgtggtggtgatcgactacgcgctgcgccccgacgacatcgacggcctcaacctgatccgcgcgctgcggatacgctttccgcggctgcggctgctggtgatgtccgcctactacacgcccgccacggtggcgctggccctgcgcggcggcgcccatggtttcatcggcaaggagcaggggctggacgaactggtggcggcgatccgcgcgctggcggacgggcgcgactacctcagcccggagatgtcgcgcgaattgcatgcccggctggaggcatcggacgcgccgcaaggagcaagccccaccctgctggaccaccccgacctgtcgccgcgcgagcgcgaagtgctgcgctgctgcctgcacggactgtcggtgagcgatatcgccgccaagttctcgcgcagcgtcaaaaccatcagcaaccagaagcagtcggcgttgaaaaagctgggcctgcggcgcgacaacgagctgttccagctgcagcagcgtctggaggaaaaatga

SEQ ID NO: 2638 - DNA, 2631 bp, Chromobacterium substugae
atgatctggcgcgcctgcttgctctggctgctgctggcctgctgcggctgggccggggcggccgtccctgtcgatttggccggcgcgcccgagcatgtccagccaaatgaaaaactggacatcatgcgggagccgggcaagcgcttgacgcttacccaggcgctcgcgagccccaactggcaggccgccacgctcaaacggctgacagccggcttctcttccgacacttattggctgcaagggcagcttgacaatagcggcagccagccggtgacgcgctggctttccgtcggctcgtcccggctggaggacatccgtttttatcggctgccgccgcatcatgttcaggtggagcaggccatcctggcgggcacccgcattccgctggcccagcaccccgttcccgcgctgctgtcggtgtttcccatcaccttggcgccgggtgaaagcatccgctttgtcctgcgcatccgcagtcgttccatcatcagcatttcgcctgagctatggacgcaaacggcctatcgcgccaaccaggaccgacagctggccatggaaatgctgctggtcggctccatgctcaccattgccctgtacacgctggccatgggtctggcgcgtcgggaccggatttcgctgctgctggcgggcatggcgttttgcgtcttaatggccgatctttccttccagggatatcactattactacctgatgcaaggcggcggcgatgcggttttacgcatgactggcgtgctgccctgcctggtcgtggcgtttgtgcttgccttgatgatgcgcttcatcgaagccggcggcatcgcgctctggcgctggctataccgagcatccatgtccgggctggcggtctgcgccgcgggcactgcctttggcgactacagcatgttcatttatgccttgaactggttgttggtgccctgcctgattttgatctttggcagttgcctgcaccgatggcggcaaggttcgcgcgaggccaggctgtttttcctggccttctgcctgtacagcagccgcgccattctgaaaatggccgtggggtttggcctgctgtccgaatccatgattggcggggcggaaatcatctggggcaatctgtccatcatcctgctgctgctggccgtcaacattcgccgccaacggcagttgcggctggaaaagcagcaagctcaggatgccttgctggatgctcgtttaaaagagcaggagcgtctgcaggacgcagtggacgagcgcacgcgggagttgcagggcgccttgatcgccgccggcgaagccaaccgcgccaaatcggactttctggcccgcgtcagccatgatctgcgcacgccgctcacgtccatcatcggctttgccgacctgattcaggccggcggccacagcgatgccgagcgcggcggcatcatccgccgcagcgccacccatatgctgcaaatgatcaatgatctgatcgactacgcggccggtgcctcgcctaacgcggtgaagaaagagccggtttacatccatgcgctgcttcaagcgattgcgcaggaacacgagagcctctcgatgaaaaagggcaaccgtttcctgctggaggcgggcgcggagttgcccccggtgttggagctggatggcaagcgcgtgcgccagctattgggcaatcttctggacaatgccaataagtttacccagtcgggccttatcattctcgccgtcgattaccgtcggcatcttgccgggcagcctggcaagctgtcgcttacggtgaaggactcgggctgcggcattgccgttgaggaccagcggcgcattttcgaaccgttcctgcggctgagccaggcgcgctcccagcccggcatcggccttggcctgtccatcgtcaagcaatgggtggagcgcatgggcggcgctctgcagatcgacagcgcgccgggggccggcaccgcggtcaagatcacgctgacggcgccctccttgtccgaggcggacatggacagctattgcaggccggatgcgctgggcgtgctgccgcagatagacggaaaaggcaaaacggtctggctggcggaagatacgcccgacatccgacgcttgctggccgatgagctgacgggccagggttttgccgtggacgcttcggaaaatggcttggaactgatccggaaaatgcagcgactgagctcctcgcccgatttgatactgaccgatcacatgatgcccggcgccaacggactggcggtactggccgaagcgcgccaacggctgcccggcgtgccggtggtggccatttccgcgctgccgcaaccgatagggccgcagagctacgacgccagcctgctcaaaccgatcaacctggcggaactgcgcaatactttggccagcttgttgcaactaggcggcccacctttcgccgagacgccgcccgacgctagccatgcccagcggccggatgccagccagctggaagaagcccgccggctgattagccttggcgccatgacggatctgctggattgggccgaacacattgcccaggacaacctgcgctgccaggatttcatcgagcggctgcgccaattggtcaggcaaggagagctgtcgtctttgcaggcgctttgcgaagaatag

SEQ ID NO: 2639 - DNA, 720 bp, Chromobacterium substugae
atgctgctgatggattttttgtcaaggcacggttgccgcctttacatcggcgaggatggccgggatggctatcacaaagcgcaggcagtgcagccggatgtgatcctgatggatatctccatgccgcgatgcgacgggctgaccgcctgccggttgctgaaagccaatcagcaaacctccaccattccgctgctgtttctcaccgcgtccgcactgcccaaggaacgggtggaaggcttggccgccggcgcggtggactacgtcaccaagccttttgatttcgaggaagtccggatgcgcttgtgcatccatctgcggatgaccccgccttgctcgcagccgccggccgcgccggcagataaaagcaaagaacccaaggcgggcggactggacggggtgctgtaccgctccgctcgcaagttgctgctggcggcgctggatgtcacgccggagctggccggcttggcgcaggcggtgggcaccaacacccggcggctgaaccaggcctttcgcagctgcgcgggcatgacggtgttcgatttcctgcgcgaggcccggatgaaggaggcgcggcgcttgctggtggaaaccgacctgccggtgcagtcgatcgcgcaggccaccggctatggcaacccggccaatttttccaccgcgttcaaagacaggttcggctgcccgcctaccagcctgcgccatgccggagatgcgggcgcatga

SEQ ID NO: 2640 - DNA, 1419 bp, Chromobacterium substugae
atgaagattttctccttgcgcaccaaggcgtggctgggcttggcgattggcggcgccgcgttgttgagcggtgtgatcggggccgagcaggcgtattcgcccgaaaatagcgcggtggcggtggcaggcaaggccgcaaattcctgtttgcctcaagagggatggtttccccatcggcagacgctggagccaaactccggacagttcgctgccgacgccagcaattgcgccttccatcaatggtcatggcaaatgtttctgtggctgacgcaggcgctgccagacccagatcatcaggggcagactctgccgcgtttccttacctttccggacccccgtatcctgcgaggcaagtcccagtcatcggccgacagcttcctgccggcgctgaacttgaaggatgacaggccgctagacgaatacctgcaagcggggccggatggcatgctggtcgaccagaatggccggcttgtttactactcgatgtatctgaatgatgttttcgccaacttcgtcaaagagcagggcctgaacagcgcggaacgcatccgcgatttcaatccgggcattaactatccggtaggaacattgaccttgaaggcggcttggaaggtgctgtcaagcgaggaacagaaacgcaatgacgtatcccacaagttttatacgcgaacggcggaggtatatccgcttaagaagcgcgggaagggattcgaattagaccgaacttaccctcaagaggttgtattggccttggttggcttacatgttgtcggcaccacgcggcatcacgaagaaatgatctgggcttccttcgagcatgtcgacaacgcgccggatgtcgatgccggagcgatacaagaccccaaaacgccggtttcggaccgggactggagtttttacgccaagaacacgccgctttccgcttgcaatcagaacctggcgtccagcggcaagttggagctggatgagacccgccagacattcactcccgtcacgcaggtgtgccggatgtatccgtacggcagcggtccggacaagcagccagccaacgccgccaatatcaaggcgctgaataccgcggtgcgcaataagctcgaggggccgtggaacaattatttcgaagtcggggccatctggttcgatacccagaagggtaagccgctgcaagcaaattgcaacttccagcccggcgccaaccagtgcggggtggtgctggccggatccacgaggttgtccaacgctgccatcgaaacgttcacccagtcgcagagcagcatggacaactgttttgcctgccatcagaccatgccgcattacggcggaccggggcaacaaaccctgcctgggaagaaccttagcatcagccacatcatgaacaatctgtatttcgacctgcaatcgtcgaagaagtcgaactaa

SEQ ID NO: 2641 - DNA, 2136 bp, Chromobacterium substugae
atgagcgattacattctgcgggtgcacccggccattaatatcgcgcgcgtggggagcagcgatgagttctacattgcgccagaaacacctgctggcgaaagcctgccggatagcgatctattgggtggtttgcctatcaaggccggcacggaaaatacgccgatcgacgaaagcgattttcgcgacgcgcaagggttggtcaagcggcaggcggcgcgttttcgcatcttcgcctatctaaagggcgagcatctgaatcagtatccgatgggtccgcaggctcagccggtggaagtggtgctgggtgcccggctaggcgccaaaatagtgaaggacatcatttggaccgtgcatgtggcgaacaagaagctcaacaacttcgccatcgggagcgatgggctggatggctatgacgatccagccagcgtgccgctgcgcaatggctattatcccaatctgccgcccaacttcccattgctgccgacgacgaatggctcgccgtattggcgcgaaattctgagcaacgccaagcgttgcatggatttggtgatcgatcctggcccgcgcagcatcagcgcctttcatgatcaaggcaaaaccaaggccttttcgaagcgtgaacgcgcctgttttgccgatggcaagggcaatatccagtttttggattacccgcaacattttcccgatgatgcccacccgtatctggagcagcccttggggccgatcgcctccctgggggagttgcgagtcgatgcccaagggcgcttgctcgtcaccgggggttttggccatacggcgggggtaaagctatcggcaacggggctgccaccaagcctggccaactcaaccgagaatggactgtggtttgacgatacgtcagatggcccggtcaatgcggtggtggtgttcgatgatggaagctgcgaggcccatggtgcctgggtggtgactggcgatcccggctatgcgccgcaaatccgcaatgtcgtgtccgcctgggacgatattttcgacatgtgggtgcgtgaactcgatttgatgccgagcctctaccgtggtaacgcattcaaccatggcgagtatcagccctgtttccgccatcaggtgcagcctattttccgggcggccatgttgcagcgttggggcaccaatttaccgaaccatgttgtgaatgcccatgatggggtgggcgccattcagcccacgacggatcccggcgcgatcattcaggacttggaaaaactgatccgcaatccggaaggctcgccccaggaaatgcaaacgggccggccgctgatgcccttgtctttgggcgacgctcgcaagagcttcctgacagtgacccgcagccaatatttctttttgcagtgttggcacaaacagcagttttcggccgaagacgcgatgcccttgagcgtgggagagaaactggactatgccgcgctggccaactgtttgggcggccgttacagcccgggcatcgaggtgtctttcccggtgcgggaccgcaatctgtacatccagaattggcgcgagcgcgactgcggccccttccgtatcaatcaggctcggatcgattacgccaacatcgacagcggcgagcctgtgctgcgttgcggctatgtgccgcggcaaatcggagcggtggagccgggcgatctttccaagttcatgtcggtgccttggcataccgattacaactcctgcgcagtccacctgcccaagccgaatcccatcaatgtagatggcaacggcactccataccctaacaatgtgctgttctggtcgtggccggcgcagcgcccggtgcaggtgtttcccaagtccagttgcgattacgacccggcaacgggaacctggaaattgggcaatcaggtgttttccatccgcggagtcggaaccgagacggaatacccggccagagcgggcagcttccgagagcatgcagattatatgcggcaatggaacaagaccggctttgtgatccaaggcttgcagattccatccgcgcagggaggcagctatggcggcaagctgttcctggaggtgtccagccagtggggcccggaggagggaccgccagtgcagccgtttcctacggcttccgtgccgcctgagcctgaggggaaggtttga

SEQ ID NO: 2642 - DNA, 765 bp, Chromobacterium substugae
ttgcgcggcttggcgcggcgcgacaccggtggctggctgctggatttggagagggaaggccaggcgctcctgcaacgggcggactttgtgctggatgccagcggggccgccgccgtcgtggcgagacgccttggcgtgatgcgcaacgaaatagactgcctgaacgtgtcatatgcctatttgcactgtgatgatgccatggcctttcccgcgcgctcctggctggaggcggtggaaaatggctggtggtacgcggctggcgtgccgggcggcaggatagtcgcggcttatgcgacggaccgcaaaaatcccgcaaagccgcaaggcccggtggcgtggatggcggcattgcaaagcacccgccatctatggccggtcatgctgcgcgcgcgtcccgcctccatgccgggcgcggtgcgggtggcggccgcgcccagcgccattctgagcaatgtggcgggccgggactggttggccgtgggcgatgcggcgtgcagctatgacccattgacggcgcatggcattttgaaagccttgcaagacggagaggctgcggggcgggcggtggcgaatgatttgggtggaaatccccaggccatgcacgattaccagaatggcattttcacccgcttttccgactacttgcgcttgcgaaaccgtttgtacagcgaagaggcgcgctggcggcatatggatttctgggcgcggcccttgacgcaagcggcgcggggcgctggcggcggaccgggcgcggctgtggattga

SEQ ID NO: 2643 - DNA, 1989 bp, Chromobacterium substugae
atgtccctcccagctttgtcgaaatcggagtctggcgtatttgacaagccggaattcctgactcctgatactgtggatctggatttggaagttgcgatgctgagtggaaagatacgcaatccatcggcagacaaagagggagaggcgcattttgaccgcgtcctgctgcgcggctaccgcccctggtgcgatcctggagagaatggaaagccatgccgggcatcacgggtcaccaagtcattcatcgcgcctttgatccaggcccatccgggtcaaacggttcgaatcacgctgcacaatgatctgccgcctgatccgagttgcgtttctcaaggggggagcgcgaataagccgcactgcttcaatggcaccaatttgcacactcacggcttatggatcaatccggccggcaatagcgacaatgtgctgctcgccattcaccccggggtggcttttcagtacgagtacaacatcccgttggagcatccggctggaacctactggtatcacacgcatctgcatggatcaacggcgctgcaagtgtccagcggcatggcaggtgctttaatcattcgcggcaacaggcagcctcaactggatggaaatcaggccaattccagtcagaagaattcacatgtccatggagatctagacacgttgttggtgtcaagagataaagatcagttccaggagcatacctttgtctttcagcaaatccaatatgcttgccgtggaaaagatagaaaaataaaaaccaaaaacgatgaggaaggcgggccttatcgttgtgatgatggcgatattgggcaggttgatggttacgatctgttcggtcctggtcggtgggaaaagtctggccgttataccagtataaacggagtggtgatgggcaaactccagaatgcgaaggtaggtaaggtgcagcgctggagaatgatacatggcggtgtgagagataccattgctttggaaattcggcgccgcgaacccatttccaatgaaagcgcgcagagtatttctggacttacggcggaacagactcaggactatgtcaataaagagtgcaccggcgagcccatccccttcactttggtggccgcggatggtttgactatggcgcaagccatgcagaagaagcggctagttttccagcctgggtaccgctgggacgctttgatggtttttccgcaagctggtgattattgcctaattaacaaagtaggccgctccaatattgacctggttcagccttacacaagactgctgggcatgatccatgtcaatgcagcaaatatgccagttgtgcccgatgacatcgatggcagcatcaagcgccatctgcaaaatctgttgatcaaagctgcgcaagataactaccgctccgccgtagcaaagttggtggtggcggatctgcggaatgatatgaagctaacccgctttgtgccgcatgcggatatccaggactcggaattgactggccagcagcgactggcatttaacatagacacccagtctgtgaaaggccagtcattctatcagattgatggcaagccctacgatggcggaagaatagaccgtactctcccattgggtggcgtggacgaatggacgctgacgtcggactttgccagccatccctttcacattcatgtcaatccattccaaatagtcaaaattatcaatccgaaaggtcaagatattagcgggccaatgccacaagctgatgacgacgacgatcagtatcatggcatgaaagggatgtggaaagacacgctgtggatcaagagcctgtttgacggcacttccgggggtgaaaaggatgcggcggcgggaagatacacctttatagtgcgcacccgttaccagcgttatgtcggagattttgtgctgcattgccacattttggaccatgaggatcagggcatgatgcagaatgtgcgcatcgttttgccggatgcccaaggaaatctgacagcaggccatcattag

SEQ ID NO: 2644 - DNA, 1746 bp, Chromobacterium substugae
atgagcaatttatatctggacactgccattgtcggtggtggcgcttctggcgcgtatagcgcttggcgtttgcagcaagcttatggcgaggagcgtaaaatcgccttgtttgaatacagcaaccgcattggcggacgactatatacggtgactatgccaggcctgcccaatgtcaaggcagaagtgggcggcatgcgttatattccggatcagcactatatggttgccaatctcatcggccaccttggtcttgccaccaagccctttccgatgggggagcctgcgccggtcgggtccagctgcaatatattttatttgcgcggcaagcacttccgtctgcacgaattgtccgatccggagaaggtcccttacaacctttcctggtcggagcgcggccttgggccgacgaatctgcaagtgcaagtgatgaattatatttaccccaatatgcagaatctgtcactgtgtcagcagatgcaggttaaggcgtatggcaagcacctctggcagtacggtttctgggatctgatgttccgcgctctgtccaatgaaggctatcaattcatgaaggatgcgggcggatatgatgccaatgtggcgaatgccaatgcggtgactcaattgccggcgacggaatatagcgacagcacgatatttctgaccttgaaggatggctacgatcagctgccgattcgcttggcgcaggcattcaatcatgaactcccgggcctggctcccaagggagagcggatttacatgaatcattgcctcaccgagattcatgaaaacactggcgaatatcgctacaagctggttttccgtccgaccaaggtgcagcagcatgagggcgggctgcgttctttgcttgatcatggcgccgaccccatcgttgtctatgccaagcacatcgtgcttgcgatgccgcgccgctcgcttgaactgatcaagtctgatttcttttttagcgatccttggctgaaagaaaatctgaagtcggtgctgatccaaccggcgttcaagctattcctggcctacgagcgcccctggtggcgttcgctcggcctggtggctggccgctcggtcacggacctgcccatccgccaagtctattacttcggcacggaaagcgagcaggacggcgggcagccttggctgaactccttgctgatggcgtcatacaacgacatcagcacggtgccgttttggaaggggctggaagcggggcctgcgttcaacggttatcgtccggactgcatcgaagcagacagcagcaatgttgttccgcagatggaacatgtggctaccgaggaaatggtatttgtcgcgaacaagcaagtggcggaagtgcatgcccagcagcagattccgagcccgtattccgccgtgtaccatgactggagcgacgacccctatggcggcggttggcatgagtggaaggcgaattaccggctggaccagatcatgtggcaaatgctcaagccggttgatgcgcacaatattttcatcgtcggcgaggcgtattccataggccaaggttgggttgaaggggcgctgtgcaccgcagagcagatgctggaaaagcatttccagctgaagcggccaggctggctgaaagaaggctatgagctgatgcctgtgccggagggtggctgcggcgagttgtgcggctgcatcccggccagcgccatggggtcgacgcttgaggctatcacgccgaactgtctcaagtgcgcgcaggagggctaa

SEQ ID NO: 2645 - DNA, 1686 bp, Chromobacterium substugae
atgacggcatcgactcccgcctacacggtttcaaactacatactggatcgcttgcggcagcttggcgtccagcatctgttcgaagttcccggcgactacgcatcgattttcttgaacacgctcgatgaatgtcccgccatcgagcgcatccccaacatcaatgaatcgggcgtcggttatgcaagcgatggctacgggcgtttcaagggcgcggcggcgtgcagcgttcaatatggcgtcggcaccttctcgatactgaattgttttgccggcggttttgtcgagcgcgtccccatggcgctcatcggccctagccccagcacgcaaaatcgcgagcttgcccgtactgaggggatactgttccaccacagtaccggcaatctgaacgccgatatgcgggttatggaaaatgtgaccgctgcggccgtcgccatccatgatggcgcgagcgcgccagcgttgatcgacgaggcgctgacggcgatgctcactcaccgtcgtccagtgtatatcgaggtgtggcaggatatcttcggcgtggaatgcgcgcggcccagaggcgagttgcgagcggtcgagaccgcaagcgagcctgctgcgttgcaagccatgctggatctggcgtggcaaaccataagcgatgccgcgcttccggtgttttggctgggcgttgaaatccaacgctatggcctgcaagagctggcgcagcagctggtcgatgcgagcggtctgtttttcacgaccaccagtcttggcaaaaccgtgctagacgaaagccaggcttcctttatcggcacctatgccgggccagcctcccccgcgttgacccgcgaggtgatgggcagcgccgactgcgtggtggcgctaggcgccatcatcaccgacgattacctcggcatcatggcgcaggactatgccaggatggtggagatcaacgatgaagccgcgcgcatcggctgcggccattatcaaggcgtgtatctgcgcgatttcatgcaaggcttactggcgcgatttcagcggcgggcgagcgcgcggcgctatcgcctgccgcaagtcagccccgatccgcagcccagcttgctgccgactgacgggctcacctatgaccgcttttatcatgtgctcggggattggctgattcaggagggccatatccggcaggccaagctgattctgggcgagagcaccagcttgtatgttttcggcaatctgtttggcatgccgcgggatgcctttgtcgcgcaggccgcgtggggctcgcttggccatgagacgggctgcgcgctgggcgtcgaactcgccaccggccagcgccccttggtggttgccggcgatggcggcttcatgatgatttgccaggaaatctccagcctggttcgccagcgctccaatgccgtcgtgtttgtcatgtcgaatgccggctacgccatcgagcaagctttcgtgaatctcaatgccttcacgccgcaagacaactacgcggcttttgatttgctgccgaattgggattacctcgcattggcaaaggcattcggcgcgcgcgggcatgttgttgaaactgtcgatcagctgcgcaagctgctcaagcagttggagcatatggacggggtgcccaatatcgtgcaagtgaagataccgttgaaggatctgccgccgcagctgcggcgtttggcaagcggttga

SEQ ID NO: 2646 - DNA, 1056 bp, Chromobacterium substugae
atggctgcagatatttacgcgaggatccgccaggcggcgtttgagctggtgggcgagggggtgtggcccaccgtggtggatgtgcggacccgcctgggaagcggctccaacaccaccatcaacaacacgctgaaggaatggcggcaggaatttttaggccgggtggccgcctcgtcgcggcggccggattggccgcccagcctggcggaagcttttgaacaggtgtggcagaaggcttgcgacgaagcggagcagcaattgagcgcggtccggcaggaggtggaggcggaggcagccgagctgcgcgcggcgctggatgccagccgggagcaggcgcaaaaaaccgaggccgagctgcaatcgttgcgccatgagctggaattgcgcgccgcgcggcaagtcgagctggacagccagttgcagcgggagcggctggaggtggagtcgctgcggcgtgagcggcaggaattgcggcagaccgccgagtcgcaacgccaggccctgaccgtggcgcacagggaggcggaatcccggctgctggaaatggcggaccgccacgagcagcagctgcgcgaggtgcaggaggaggcgaaccgcaaggaggcgttggcctatgaacgcctggaaggcttgcgcgttcgtctgtatcagcaggtggaagacgagcgccaggaaatgaaggggcagcagcaaaagctggagggcgcgctgctgcaggcgcggcaggacgcagccaaggtggaaaacctgtggcgcgagcgggtgctggagcgggaaagggaaaacggcggcctgcaggcccggctcgatctgcagcaacagcagggcgattcgctgcggcaggaggcgcgccagcaggagcaggcggcggaggccgcgcgggagaggctgctgggcgtgacggccgaactggccgggctgcaggcgctgcacgcgatgcggcgcgagcaatggctggagcggcttggcgcggcgctgcgcgccggcgccttgccggcggagccggaggcggtgcagccctggctggccgcgctgttggccgagcctgtccggtag

SEQ ID NO: 2647 - DNA, 627 bp, Chromobacterium substugae
gtgcaaggatatgccgttctctacctggcgttcatcatcgtgctgtttgccgctttggtttggaaaacccccgttctgcgcgaccgcgggccgttggcgccgggcgtggccgatggccagcaaaccttcagcctggcgcgcagccaactgctgtggtggacgctgtcggtggcgctggtggcgggctggctgctgatcgtcaccggcaatctgctgtcgcccacgccgcaggtgctggcgctgctcggcatcagcgccggcacttcggggctggccagcctggtgggtcagcctgatggcggcgcgcaggccgccgcgctcggcggctcccgcggctgggtgcgggatgtgctggaggacggccagggcatttcggtccaccgttaccaggccttgctggccaatgccggcatcggcctggtgttcatctacaaatcgctggagctgaaggctttctacgcgattgatccgatgtggctgggcgtgttgggcgtcagcagcgtgctgtatgtcggcatgaagtcgcgcgaaaccgcggccgtcggcgcggaggcgctgtcggcgccggcgctcatccagccgcaggcggtcaagccgggcaacacgccgccggcgctgcaggtctga

SEQ ID NO: 2648 - DNA, 729 bp, Chromobacterium substugae
atggaacctgtacgcctgtcaaaacgcatggccgagctggggctgtgttcgcgccgggaggctgacagctatatcgagcaaggctgggtcaaggtggatggcgaagtggcggtgttggggcagaaagtgctgccgcacaaccagatcgaggtcgacaagaaggcgcaggatgcccagtcggctcgcgtcaccatcttgctgaacaagccgatgggctatgtttccgggcaggcggaagacggctacgagccagcggtggtgctgatcaccccggaaaaccactgggccgaggacggcagccgcaagcgcttccaggcctcgcacctgcgcgggctggcgccggccggccggctggacatcgattcggttggcctgctggtgctgacccaggatggccgcgtggccaagcatctgatcggcgagaactcgtcggtggagaaggaatacctggtgcgggtggaaggccagctgaacgccaacggcctggccctgctcaatcatggactggagctggacggcaagaagctgctgccggccaaggtgagctggcagaacgaagatcagttgcgcttcgtgctgcgcgaaggcaagaagcggcagatccgccgcatgtgcgagatggtgggcctacgtgtggtggggctgaagcgcatctccatcggcaaggtcaagctgggcaacctgcccaccggccaatggcgctatctgcgcgacgacgaacagttctga

SEQ ID NO: 2649 - DNA, 1002 bp, Chromobacterium substugae
atgttcgaacggctgcggcgcatcctggggctggaccccgaagcccggcgcgaggctagggcgctggccggccaggtggaacaattgatagacgcttgcgacaagcgcctgcggctgctgcccggctatttcgacgcgctggcgccgggcatgcgcgtgtcgcaggcctatctgtccacgctgacggcgcaactgccgccggtgctggagctgtccttgcctggctttgcgcgcgatccgcgcctgggcctcttgttcgccggcccctccagcctgcttgcctttctggaaagtagcgaagtgctgcgcgacttctttcttcgcgcgggcaacggcgacgaagcctgggccttgctgaccatgcagcgcagcgaaaccaatcgctttggcgtggcgatggaaaacggcgagctgcgcaacgacgtggcgcaggtggtggtgagtttcgacggccaccggctgatgatgcccagccccagccaggaacgcttccggctggattcgggcgcgcacgcgctggacgtgatggtttcggtgatcgcgcgccggctaagcctgatggaacaggcgcgccagcagctggaggccgaacaggcgcgcttgcaactgcgccggctgtcgctgcaatcgagcaattgcgtggtggtggattgccagtccggtgatgagagcctgccggaaacggcggccgccgtcgatgcccggctggcggaaatcaacccgcagctggacgagttgcgcggccatgccagcctggaaggcctgctacgcacggtgcgcgaagtactggagcagccagcggattacttcagcctgcagacggtgacgttgcggctgagccggatgggcgtcaaggtggatggggatgcggaggacgccaccgagctggcgctggaggaagtggtgttgggcagaatgctgccgatccgccgggctttggtgccggtgcgcatccgccgcgacgacatcgccgaattgcgccgccagtttggcggcgattga

SEQ ID NO: 2650 - DNA, 699 bp, Chromobacterium substugae
atgatcgacctgcattactggaccacgcccaacggccacaagatcaccctattcctggaagaaaccgggctgccctaccggctgctcccggtgaacatctcccagggcgagcaattccagcctgattttctgcgcatctcgcccaacaaccgcatcccggccatcgtcgaccaggcgccggccgacggcggcgccgccatcagcctgttcgaatccggcgccatcctgttgtatctcgccgacaagaccggccgcttcatcccgcaagatttgcgcggccgcaacgacgtcctgcaatggctgttctggcagatgggcggcctggggccgatggccgggcagaaccaccatttcacccagtacgcgccggagaagctcccgtacgcgatagaccgctacgtgcgcgaaaccgcccgcctgtaccgggtgctggacacccggctgtcggatggccgcgactacatcgccggcgagtactcgatcgccgacatggcttgctacccctggatcgtgccgcatgaaaaacagcgccaggatctgaacgattttccggcgctgaaacgctggttcgaccgcatcgcggcgcggccggcggtgcagagggcctacaagctggcggaaagcgtcaacaccacccccacgctcaccgaggcctcgcgcgccattttgtttggccaggacggcaagccgcgcggctga

SEQ ID NO: 2651 - DNA, 546 bp, Chromobacterium substugae
atgagccaaacattggactcgcactcccgcttcatcagcctggtgctgcggcatcagccgcaggccatcgggctggcgctggacgagcagggatgggcgtctttggatgagctggtggccaaggcgcgcgcggcgggccgccaactgagccgggaggtggtgttggacatcgtccggaatagcgacaaacagcgcttcgccatcagcgcggacggcctgcggatcctcgccaatcaagggcattcggtgcgggtggatctggacctgacggcgcaggaggcgccgccgcggttgtttcacggcacggcgcgccgctttctcgcggctatccgcgcagagggcttgcggccggggcagcgccatcacgttcacctgtccaattcggcggaattggcggcctcggtcggcgcgcggcatggcgcgccggtggtgttgacggtggatgccgcggcgatgcagcgcgccgggctggcgttttatcagtcggcaaacggcgtatggctggccgacgcggtgccgccgcagtttctggcattcccggaatga

SEQ ID NO: 2652 - DNA, 639 bp, Chromobacterium substugae
atgtgcgtgaattttttgccgccgtcccggcgccagatgcgggaatgcttcggcgcggagatcggcgactggcagtggcgggacgaggcctggcaggattacctggcgccgattctcacccgcgacggcgtgaggctggcttcctacggtttcattcccaaacgccatcagccgctgggcgcgcggctgtccaccatgaacgcgcgcgcggaaaccataggcgaattgcgcagctaccgcgatgcctggcgccgttgccagctgtgcctggtgccgatgcaagcctttttcgagccctgctacgagcgcggtcgcgctgagcgttatcgcatcggcctggcggacggcgcgccgttcgccgtggccggcttgtggcgcgaatggcgcgaggccgacggctcgatcagcgccgccttcacgcagatcaccatcaatgcggacgagcacgcgctgatgaaccgcatgcataggccgggcgaggaaaagcgcagcctggtgatcatcgagccgtcgcagtacgacgcctggctgaattgccgcaatccggaggccgcgcgcgcctttttggcggcgtggccggcgcaggacatggccgccgaagcgcccgacttgccgagccaaggctccttgttcgactag

SEQ ID NO: 2653 - DNA, 1260 bp, Chromobacterium substugae
atgagccagtacgcgctggtggatggcaacaacttctacgccagctgcgaaagggtgtttcggcccgacctggccggcaaacccatcgtggtgctgagcaataacgacggttgcgtggtggccgccagcgcggaggcgaaggcgctgggcttgcggatgttcggcccctttttcgaaatcgccggcctttgcaagcatcacggcgtgacggtgttcagctccaactacacgctgtacggcgacatgagccggcgcatgatggccatcctggccggccacgcgcccggccaggaagtgtactcgatagacgaatgcttcctcgatctcaccggcgtggcggacgccgaggcgctggcccggcgcatgcgcggcgacgtgctgcgccgcatcggcatccccgcctgcgtcgggctggggccgagcaaaaccctggccaagctggccaaccacatcgccaagaaacaaccgcgttgggacggcgtgttttcctgggactggctgtccgcggcggacgccgacgcgatgatggccacgctgccggcgggcaaggtttggggcgtcggcccgcggctggcgggcaaactggaagttctggggatccataccgccctgcagctgaaacaggccgatccgcatcagatccgccgccagttcagcgtgacgctggaacgcaccgtggcggagctgaacggcgtcaactgcctgcggctgggcgaagtggcgccggcccggcagcaaatcctatccagccgctccttcggcgaaaaaccgcgcgacctgaacgtgctggcggccgccatcagccaccacgtcagccatgccgcggaaaagctgcgccagcagaacagcgtggccgggctggtggcggtgagcatacgcaccagccccttcctgggcgccccctacaacggctatgtcgccatgccgctggcgcagcccagcgacgataccataacgctggcgcgcgccgcgctcgccggcctgcgcgcggtctaccggcgtgggctgctttaccagaaagcgggcgtgatcctgatggaaatctcgccgcgcggcattcgccagaccgatctgtttcagcaggcgcccgacccgcgccggcaaaagctgatgcaaaccatggacgcgatcaaccgcgaatacggccgcaacagcctgcggctgggagctgaagcgctgacgaaaaactgggagatgcgccaggatcagcgctcaccttgctactccacccggctggaccagatattgcgggtcaaatga

SEQ ID NO: 2654 - DNA, 429 bp, Chromobacterium substugae
atgaacaccttccccctctctctccgcccgtcggccgccgcccgcccgcttccgctggcgctatgtccggtgcgcgccggttttccatcgccggccagcgactgcatggacgccagcatcgacctgcaggcctatctggtatccgacccgcccgccaccttcatggtgcgggtggccggcgattcgatgcgcgacgcgggcattctggaagacgacctgttggtggtggacaagggcttgccccccgtccatggcgatatcgtggtggcgacgatggacggcgaattcaccgtcaagcgcctgcatggcaaaaacggccgctggatgctgctggcggaaaacccggcctaccccgccatcgtgcccgccgccgggcaggagctgcaaatctggggggtggtgaccgcctgcgtgaggaaattccgatga

SEQ ID NO: 2655 - DNA, 2862 bp, Chromobacterium substugae
atggaagcggtgcccaaaataagcctgtcgatcgccgaattccggcgccaactgcttcaccgccggcatcggctgctgatctgcgtagccagcctggctctggttttgctgggcgctagcgtgatcgccggctggctggcgcattcggaatccattttgccggacaatgtccacatggtgatatccactgctgtctgtctggttttgtatggattgggcctggggctggcgctgtggcggccccgctggcaagcgcaccgcctgctggccgcgctgacgctggccatcgctgttctggtattgctggagcacgccagcgggcagacctggtggatagattttccgcgcctgcatgcctggaagcacgatctggtgccccacccggggcggatggcgccctccaccgcgctggcgctgctagcgctgggcgccgggctatgcctgctgcccggccacgccggctggcggcgggcagcgcgcgcctgcgccgccttcgccctgctgctgggggttctgggcgccgcggcctacttgatcagcctggagttgctgtacagctggggcacggtggcccggatggcgctgctcaccgcagccggcgtcatgatcgccagcctggggctgtactcgttgacgcgattggagccgcgccgccatttgcgctcgcaggacctggccaactcggcctctctcaccgccaccgcgctgctggtggccatttcgctcgccactggcctgctggtttaccgcatttccagcaacgcgcacgagcaaagcctgcgcacggtgatgctgtacagcgcgcggcaacgcgccgccttgctggatgcccaattcaatatcagcaacgacatcgcccgccgcctgtaccaacgcccggacatgcaggcgctgctggaggccgcaagcagcggccatgtggacgccggcgccggcgccaagctggcggcgctgaaccacatgaacctgaacggcatcgcgatacaggacagcgccggccgcacgctggtgcaggtcggctatttcgaaaaccggccgcgccagtcggtggcgctaaactcccctgccggcgcccttctgctatggaatggccactacctgtaccgcaccgtggacacctaccgcacctccggcggcagcgcgcggctgctgctggagcagcggctggacatgttcgaccgcatcgtcgccgacaccgcgcccagccgcggcctgagcggcatttactcgctgtgcggacgcgacagccgctacctgcgctgcttttcgcagtcgccgcaggacaagggcagtaccatcccgctggccggcaatatcccgcgcttcaccgtctggccggcgttctccggccaacgcggcaccctgcacaccatcgactactccggccgcaacgtgatcggcgcctacgagccggtcggcagcaccggcctggccttcagctacaagatccgggtggccgacctgatggagccgatccggcaagacctggaaaccagcgcgctgatcatgctggcgatggtgacgctgggatcgctgatcctgcgctggcgcacccatccgctgctgcatgaagtattgcagtccaaccggatggccgaattggcggcggaacgctttcgcaatgccgccgaggccaatatggacgccttcatcatcatggaggcgctgcgcggcgccggcggcgaagtggaggatttccacgtggtctacatcaacgccgaggcggagcggatgtggcacctgcgccgcgacgaagccataggccgcaggctcaagcggctgatggccgattaccggatacccaattacttcgacagctacaagaaggtgatcgaaaccggcaacgccatctccgaagaggtgcccaaggtgttcgacgcctcgcaccccgcctggatccaccatgaaatcgtccgcgccggcgatagcgtcagcgtcagcgtgcgcgacatcacacagcgcaagctggccgaactcgatctggtgctgcgcgaagcgctgctcaaaaccgtgaccgactccatccccgcgctggtggccttcgtcgaccgggaagagtgctaccgctattgcaacaaggcctatatgcggctgttcggcatcgggccggagcaaatcatttccatgcgcatgcgcgatttcctgggcgaggacgcctacgcggcggtcctgccccatgtcggcaaggcgctggccggcgaagcggtttcattcgagcaggaaatggacgtccgcggcgaaagccgctatgtggaaggccgctacatcccgcagcaacacgccgacggctcggtgtcgggcttttacgtgatgatctgggacatcacccaggcgcgggcgcgggaaatccagctgcgcagccaggtgacgcaggacgcgatgaccggcctgctcaaccgctccgccttcatggagctgctgggcgacgagatcaagcaccactacatgaagcgccaggcgctggcgctgctgtttctggacatcgaccacttcaagcaggtcaacgacaccctgggccatgccgccggcgacgaactgatccgcgaattcgcccgccgtctgcgcggcaatgtgcgcgccaccgaccacgtcgcccgcttcggcggcgacgagtttgtcatcctgctgatcggcctggacgccgagcgcaccgcggtcagcgtggtggaaaagctgctggcggcggtgcgccgggatgtcgagctcaaccggcagacgctgcgcatgtccaccagcataggcatcgccttcgcccttaccccggacatcacgccggaacgcctgctggaaatcgccgacgagagcctttaccgcgccaaggacgccggccgcgacacctaccggctgcagcgggtaggctga

SEQ ID NO: 2656 - DNA, 1407 bp, Chromobacterium substugae
atgcaagcatccaggcaaccgcaggctgggctgatcgagcgccggtcgatagatttcattcccgaagacgaacgccacgggcgggttttcagccagttcaccctgtggctggcggccaatctgcagatcaccgcggtgatgaccggcgcgctggcagtagtgctgggcggcgatgtgttctggtccatcgttggcctgctattggggcaggcgctgggcggaacggtgatggcgctgcacggcgcccaggggccgcggctgggcttgccgcagatggtggccagccgcgcccagttcggaatcaagggcgcggtgctgccgctggcgctggcctgcgtgatgtatctgggtttcaacgccaccggcatggtgctgtccggccaggcgctgggtcaattgctgagcatcagcgaccgcgccggcatcgtgttgttcgcgctgacggtgctggctgccgccgcgttgggttatcgcgccatccacaagctgggacgctacgccagcgcgctgggcctgctggcttttctgtacttgtttgtccggctggccgccggtgtcgacctgccggcgctggcattgacgcacaagcacttcgatccggccgccttcctgacggccgtgtcgctgtccgcctcgtggcagatcgctttcgcgccatatgtgtccgactattcccgttatctgccttccgccacctcgccgttctggaccgctttggcgataggcctgggctcagggctgggcgcgcagatcgccatgtcgctgggcgtgctggtggcggcggtgggcggcgcggctttccgcggccatgaagtagcgtattttgtcggcttgggggccagcggcgccatcgcctccggcctgtttttctgcgtggccttcggcaaagtcaccatttctacgctgaacgcttacggtggtttcatgtgttgcagcgccatcgcttcatccttgggcggggcgcaggcgacaatcgggcagcggcggcgctgggcgacggtggccgccatggtgttggcgtcggcgtgcatcgcgatcctagcccagcatggcttcctgtcgctgttcaaatccttcttgctgtttttgctggctttctttacgccatggagcgccatcaacttggtggatttctacctgatcgccggcggcaaggcggacgcggcggcgttggccgacccgcagggcaggtacgccggctgcgactggaccggcatgggcgtgtacctggcgggcatcctgttgcagctgcccttcatcgactgcgccttcttcaccggcccggtcgccaagctgctgggcggagcggacatttcctggctggtaggctggctggccccggcggcgctctactactggctgcgccggccacaacgccggcacgtggtgtccggcgccatgcgctga

SEQ ID NO: 2657 - DNA, 753 bp, Chromobacterium substugae
atggccaaaccgatcagcgtgatgacgtacaacatccacaaaggcatgtcgccgctgaatcggcacctgcgggtggaggacatggctgacgcgttggccgaactggcgccagacatgctgtttttgcaggaagtgcagggaaagaacctggagcgggccttgcggcaccagcgctggccggcgcagccgcagcaccattttctggccaaccggctgtcgcaccgggcggtgtatggtctgaacgccgcctatgaccacggccatcacggcaatgccttgctgacgcgcttcgcggtgcgcgagtggtgcaaccgcgacatttccgtcaatcgctttgaaagccgcggcgtgctgcagtgcgtgctgcagccggatggctggccgcagccggtggtggcgctgtgcggccatttcaatctgctggcggcggataggcgcaagcagtacctgggtttggccagctatgtgcagcaggccatcgccgaggatttgccgctgatcctggctggcgatttcaacgactggcgtggcgaggccagcgcgctgctgtaccgcgagctggggttggaagaggcgtttttgcagactcgcggcgcgcatgcgcagagttttccggcgcggatgcctatgctgacattggaccgcatctatgtgcgcggcctgaaggtggaggcggcgcgggtcttgtcgggccggccatggtcgggcttgtccgatcatctgcctttatgcgccgaaatacgcccttgctag

SEQ ID NO: 2658 - DNA, 738 bp, Chromobacterium substugae
atgattcatctgcaaaatgtctgcaagcggtttcccagccccgaaggcggctggttcgatgccgtggcggaaacctcgctgaccatccacgccggagaagtcttcggcctgatcggcttctccggcgctggcaagtccaccttgctgcgcctgatcaatctgctggagcgtccggacgccggcgcggtgatcgtcgacggccaagaccttaccagcctgtctcccaagcaattgcgcgccgcgcggcaaaacatcggcatggtgttccagcagttcaatctgctggccaaccgcaccgtggccggcaatgtggccttcccgctggagatcgccggctggagcaaggccgacatcgaaaagcgcgtggcggaatgcctggccatcgtcggcctggaagaccgcgccaaccactacccggcccagctgtccggcggccaaaagcaacgcgtcggcatcgcccgcgcgctggcgccccgtccgcacgtgatcctggccgacgagccgacctccgcgctcgaccccaaaaccacccagtccatcctggactgcttgaaggacatcaacgcccgtttcggcgtgacggtggtgatcgtcacccatgaaatgcatgtggtgcgcagcatttgccaccgcgccgcggtgctcgatcagggctgcgtggtggaagtcgtcgatgtgaacaatcaagaagtggccgccgattccgacttggcccgctctttgctggaggccgcgtaa

SEQ ID NO: 2659 - DNA, 687 bp, Chromobacterium substugae
atggatgccgcaaccctgaacgaagcgctgcaaaacctgcaatcgatggccccggaaatctggcaggccagccaggagaccggcgtgatgctgggcctggggctggcggccgccatcctgttcggcggcccgctgggcgtcgtcctgtacctgtcgcagcagggccagatgttcgccaaccgtttcgtcaacggcgtgctcagctggctggtgaacctggtgcgttccttccccttcatcatcctgatggtgtcgctggtgccgctgacccggctgatcgtcggcagcaccatcggcccggtggccgcgtcggtgccgctggccttcgccgccattccgtactttgcccgactggtggagcagacgctgcgcgagattccgcgcggcgtggtggaggcggccgaggcgatgggcgcgagcccggcgcagatcatcttcaaggtgctggtgaacgaggctcgctccgggctgatatccagcctcaccatcctgaccatcagcttcctcagctacaccgcggtggcgggcgtggtgggcggcggcggcatcggcgacctggccatccgctacggttactaccgcttccagaccgacgtgatggtggcgatggtgctgatgctggtggtgctggtgcagatcatccagctgctgggcaaccgcctggcggccaagttggacaaacgttga

SEQ ID NO: 2660 - DNA, 810 bp, Chromobacterium substugae
atgcgtagattcgtcatcaaggcagttgcagcatccgtagtgggcctggcgctggccggcaatgccctggccgccgacccggccaagaaggaaatcgtcatcggcaccaccgtcggcgacttcggcgacatggtcaagcagtcgatcaagccgcagctggaaaagcagggctattcggtcaagctggtggagttcaccgactacgtgcgccccaatctggcgctgcaggaaggctcgctggacgtgaacgtgttccagcacaagccttacctcgacaacttcgccaaggagcacaagctgtcgctgaaagaggctttccaggtgccgaccgcgccgctgggcatctatccgggcaagctgaagtcgctgaaggacgccaagccgggcgtgaccctggccgcgcctaacgatccgtccaacttcgcccgcgcgctggtgatgctgaacgacctgggctgggtgaagctgaagccgggcgtcaacccgctgaccgcctccgagcgcgacatcgccgtcaacatcaagaaagtgaagatcgttcagctggaagccgcgcagctgccgcgctcgcgcagcgatgtggacttctccgtgatcaacggcaactacgccaccagctccggcatcaagctgaccgaagcggtctaccaggaaaagagctacgcctatgtcaactggggcgtggtgcgcgcggccgacgccgccaagccgtgggccaaggacgtgatcgccgcctacaattcgccggcgttcaaggcctacaccaagcagaaattcgccggctacaagctgccgcaaggctggaactga

SEQ ID NO: 2661 - DNA, 2694 bp, Chromobacterium substugae
atgaccgataacctgttcgccaaggaaacgattcccatcagcctcgaagaggagatgcgccgttcttatctcgattacgcgatgagcgtgatcgtgggccgcgcgctgccggacgtgcgcgacggcctcaagccggtgcaccgccgcgtgctgtatgcgatgcacgagctgtccaacgactggaaccgcgcatacaagaagtcggcccgtatcgttggcgacgtgatcggtaaataccacccgcacggcgacaccgccgtgtacgacaccatcgtgcgcatggcgcaggacttttccttgcgctacccgctggtggatggccagggcaacttcggctcggtggacggcgacaacgccgccgcgatgcgttacaccgaaatccgcatggcgcgcatcgcgcatgaactgttggccgacatcgaaaaagagacggtcgacttcggccccaactacgacggctccgagcacgagccgctgatcctgccggccaaagtcccgaacctgctggtcaacggcgcctccggcatcgccgtcggcatggccaccaacattccgccgcataacctcaacgaggtggtggacgcctgcctggccttgctgggcaacagcgaactgaccatagacgagctgattgacatcattccggcgccggactttccgaccgccggcatcatctacggcaccgccggcgtcaaggaaggctaccgcaccggccgcggccgcgtgatcatgcgtgcgcgcacccataccgaacccatcggcaagggcgaccgcgaagcgatcatcgtcgacgagattccgtatcaggtgaacaaggcccgcctgctggagcgcatcagcgaattggtgcgcgacaagcagatcgagggcatctccgacctgcgcgacgagtcggacaagtccggcatgcgcgtggtgatcgaactgaagcgcggcgaaatgccggaggtggtgctgaaccacctgtacaagatgacccagctgcaggacagcttcggcatgaatatggtggcgctggtcgacggccagccgcgcctgctgaacctgaagcagatcctggttgaattcctgcgccaccgccgcgaagtggtgacccgccgcaccatcttcgaactgaagaaggcgcgcgaacgcggccacatcctggaaggcctggccgtcgcgctgtccaacgtcgacgaaatcatcgcgctgatcaaggcgtccgacgccccgccgcaggccaaggccgcgttgatggctcgcgcctggcgctcgtcgctggtggaggacatgctgtcccgcgtcgaaggcgacaaggcgcgtccggaaaacatcgatccggctttcggcctgaaggacgacggctaccacctgtccgacgtgcaggcccaggccatcctggacatgcgcctgcagcgcctgaccggcctggagcaggacaagatcgtcggcgaataccgcgagatcatggacgtgatcctcgacctgctggacatcctggccaagcctgagcgcatcagccagatcatcggcgacgagctgaccgccatcaagctgcagttcggcgacgcgcgacgctcggaaatcgagccgtacggcggcgacatcaatatcgaagacctgatcaccccgcaggacatggtggtgaccatttcgcacagcggctacatcaaggcgcagccgatcgacgactacagcgcgcagcgccgcggcggccgcggcaagcaggccgccgccaccaaggacgacgatttcatcgaaacgctgttcgtcgccaacacccacgactacgtgctgtgcttctccagccgcggccgctgctactggcgcaaggtgtacgacctgccgcagggcggccgccagagccgcggcaagccgatggtcaacgtgctgccgctggaagacggcgagaagatcaatgcgctgctgccgatcagcgagttccgcgacgatcaatacgtgttcatggccacggccgacggcacggtgaagaaaacgccgctgcgcgccttctccaagccgcgcgcggccggcatcatcgccatcaatctggacgaaggcaattatctggtcggcgtggcgctgacctgcggcaagagcgtggccggccagggagatgaggaagacgaagtggcgtccgaagacgacaccatcatcgagggcgagctgatcgaggacgcgcagtccatcgaaggcgatcaggtgatgttgttctccgacgccggcaaatcggtgcgcttcagcgaaagccaagtgcgtccgatgggccgcacctcgcgcggcgtgcgcggcatgaagctgggcgaaggccagaagctgatctcgctgctggtgaccaactccgcggaccagatggtactcaccgccagcgacggcggctacggcaagcgcacccgcgtcagcgacttccgcctgaccagccgcggcacccagggcgtgatcgcgatggacctgaccgacaagaccggcttcaagctggtggcggccagcctggtggaggaaagcgacgacatcatgctgatcaccaccggcggcgtgctgatccgcaccaaggtggcggaagtgcgcgaaaccggccgttcggcccagggcgtgcgcctgatcaatctggacgacggcgaaaagctgatcggcctggagatcgtggccgaagccgagtgcgcggatgccgaaggcgagggcgatgccgcgccggagcagggcgaagcgtaa

SEQ ID NO: 2662 - DNA, 471 bp, Chromobacterium substugae
atgatcccgactcctgccaacccgcaggtgctggaggcgatgagccagctcttcgtctccttccctcattgcgcgacgctgggcttcgagtatgtcggcaccgagggccgcaagcccacgctgaagctgtcctggcgcgaagacctggtgggcaatcccgccaccggcatcctccacggcggggtgatcacctcgctggtggatacctgcagcgccatcgccgtcaccgcgcagctgccgggggcggaaaccatcgccacgctggatctgcgcatcgattacctgaagtccgccacgccgggcaaggccatccactgcactgccggatgctaccggctggccagccagatcgccttcacccgcgcggtgtgctatcacgataatccgaccgaccccatcgcccacggcgtggccaccttcatgcgcgagtccagccggacgccgatgctgccggaggagggccgcgaatga

SEQ ID NO: 2663 - DNA, 441 bp, Chromobacterium substugae
atgagcgaattcatgcaacgcttcgccgaatggcgcgagcgcaaggcttacgccgagatcgtggacgcgctgccgtatgtcaagttgatgggagtgcagctgcgcgaggacgaacagggcgagctgcgcttcgatctgcctttcgccgagcgcaacgtcggcaataccacgctgccggcgctgcatggcggcctcataggcggcttcatggaaagcgcggcgatgatacacctgatgtggaaccgcgagtcgctggaagcgccgaagatagtggatttctctctggactacctgcgcccggggcgcccgcaaacgctgagcgcccagtgcgaaatcaccaagcagggcaaacgggtggcccacgtgctgatagaagcctggcaagacgaccgccgcaagccggtcgccgtggcccgcgcccattttctgctgagcaactga

SEQ ID NO: 2664 - DNA, 1089 bp, Chromobacterium substugae
atggccaaggtttacaacttttccgccggtcccgccgtcctgccgcaccaggtgctggccgaagcccagagcgaactgctggactggcacggctccggcatgagcgtgatggagatgagccaccgcggcaaggaattcatgagcatcatccatgacgccgagcatgatctgcgcgagttgatgcggattcccgccaattacaaggtgctgttcctgcagggcggcgcttcgctgcagttcgcgatggcgccgctgaacctgctgggcgacaaggacagcgtcgacatcgtcaacaccggccattggtccaagctggccatcaaggaggcgaagcgctacgccaaggtcaatgtggtggccagcagcgaagaccgcgacttcagcctggtgccggaagaggcgagctggcagcgcgatcccaatgccgcctacctgcactacacctccaacgaaaccatcggcggcctgcagttcccctatgtgccgggttcgctgcctggcgtgccgctgatctgcgacatgtcgtcagatttcctgtcgcgcgaggtggacgtcagccgcttcggcatgatctacgccggcgcgcagaaaaacatcggcccgtccggcctgacggtgctggtgatccgcgaagacctgctgggcaaggccagggcggacattcccaccatgatgaattaccaggtgcatgccgacgccgactcgatgtacaacacgcccggcacctacccgatctacatcgccggactggtgttcaaatggctgaaggagcaaggcggcgtcaagggcatcgccacccgcaacgaagagaaggccggcctcttgtaccatgcgatagacagcagcgaaggcttttactccagccatatcgaagcgccgttccgctccaggatgaacgtggtgttcaagctgaaggacgaggcgctggacgaaatcttcctgctggaagcgcgcaagaacggcctggcccaattgaagggccaccgcgcggtgggcggcatgcgggcgtcgatctacaatgcgatgccgatcgagggcgtgaaatcgctggtcaatttcatgcaggatttcgcgcgccagcatagctga

SEQ ID NO: 2665 - DNA, 441 bp, Chromobacterium substugae
atgatcacgctaaccggcaggaaagatctggcgctgaatcccaacgtcacgctgccaaaactggctatggcgatagccggcgggtttaaaaaagactgcccggactcgttcagcgcccaggccttgcgacaaggcaaactggacggatacgacgctttcaccatgctgatgcaatgcggcacttcgccggccacaggcgggcgcaccagcgaatcggcgctgatcaccgtcatcaagggggcgcgcgactattacaccgtgcaatgggcggagcgatccagcccctcgagcgcgccgctgcctatcgacaccgataaatggaccgcccgttaccagcttttagtcgaaccgatcaggctttgcaaccgcacgcctggcgaagcgcctccctatcccagctgcaccaacgacaagcagggaaaaaatccgccgccgccatga

SEQ ID NO: 2666 - DNA, 384 bp, Chromobacterium substugae
atgcgcgacaatcacggacatcggatccatatcgaacaacccggccggcccaggctgtatcagctggacgacttgcccggctacgaggtggtgggcgtgatcacactggccggccgcagcggcgcgctggtgcgcaaatacagcaacggcgtctacagcatggtcaattcgagcatgctgcgtccgctggatcagcggcaggtgaaaaaggcgctgggcataggcagcaatgccggcgcgccgctcaagatgcaaggcggcgcgcgccgcaatgtctatctcgacgcgcaaagcatagacatcgcgctggcgttgggcgacggcaacatcagccgaggcatccggctggcgctgcaagccagcgccgagcccaaggcgcgctaa

SEQ ID NO: 2667 - DNA, 2445 bp, Chromobacterium substugae
atggcccgtaatcaccaacccttggccggcctggttctggccggtttgctgtccccttgcctcgcggcggaaagcggctaccaaacgccgccgtcggagctggcggccatcgtcgatgcgccgcgcacgccgtcgcagtcgctcaaccctcagcgcgacaccattttgcaaatccaccgccccggcctgcccggcatcgctgacgtatcgcagccggagctgcggctggccggcttgcggctgaatcccaggatgcatgccggcagccgtttcgaattcggcacggcgctgaccctgctcactctggccgacggcaagagccgcccggtctccggcctgccggcttccccgcgcatcgccgacagccaatggtcgccggacggcaaacgggtggcgctgagcctgtggggcgacaaaggcgtggagttgtggctgctggacgtctcccaggcgcgggcgcaccggctgggcagcttccatctcaacgccagcagcggcgcgggattctcctggttgggctcgcaattgctggcgaagctgcgccccgccgagcaaggcccggcgccggagaagccgacgatcccggccggccccaacatccagcaaagcctgggtggcaagctgtcgcaaacccgcacttatcctgacctgctgaaaaccccttatgacgccgacttgctggattacgagctgaccagccagctggcgctggtggacctgaacggcaaggcaaaccgcatcggcaaacccgaccgctacctggcggtgcgcccatcgcccgaccggcaatacctgctgtcggtgcgcttgcagcgcccctactccacgctggtgccgatcagccgcttcccgcaacggatagaagtgctggacatgaagggccgcagcgtccacctagtgacacagcgcccgctgctggagcgcctgccttccggcaacgacgcggtggaaaccggcccgcgcgaagtggagtggcgcgccgacgcgccggcgtcgctgttctgggccgaagcccaggacggcggcgatccggccgcggcggccaaggtccgggatgccctgtacctgcaagcggcgccgttcaccaagccgccgctcaaactgcaggagctggccagccgtttcgccgacatccagtggggccgcgacgatctggcgctggtcagcgaatactggtggaaaactcgtgacatcaagacctggcgcatccagccgggtcgccccggccaggccgcggaattgctgaacagccgtaaatccgaagaccgttacgccgatccgggcgtgccggcgatgatcagcaacggccggggccagtcgctgctgcaaaccagcgccgacggcgacagcctctacctgctgggcgacggcgccagtccggaaggcgaccgccccttcatcgacgcattcagtctgaaaaccaagcaaagcagtcggctgtggcgctcgcaggcgccgtggttcgaacagccgctggcagtgctgagcagcggcaaggcgctgctcagccgcgagcaggtggagcagccagccaatctgtatatcaaaacattgggacagaatgacggcctgcgccagctgaccttcttcacccaccccacgccccaactcaagggcgtgcagaagcggcagctgcgctacaagcgcgcggacggcgtcgacctaaccgccaccctgtatctgccgcccggctacgacgccaagcgcgacggcccgctgccgatgctgatgtgggcctacccggctgaattcaagagcgccgaggccgccagccaggtcaccgattcgccgtaccgcttcaaccgcatcggctactggggaccggagcccttgctcgcccgcggctatgcggtgctggacgaccccaccatgccgatcgtaggcgaaggcagcaaggagccgaacgatagctacctgccgcagctgaaaatggacgcgcaggcggcggtggatgaggtggtgaggctgggcgtcgccgaccgcgaccgcatcgccatcggcggccactcctacggctccttcatgaccgccaacctgctggcgcacacccggctgttccgcgccggcatcgcccgctccggcgctttcaaccgcacgctgacgccgttcggcttccaatccgaagagcgcaacttctggcaggccaaggacgtgtaccagaccatgtcgccgttcaattacgcagaccagatcaaggacgcgctgctgatgatacacggcgaggccgacaacaatcccggcactttcccgatccagagcgagcggatgtaccaggcgctgcagggcctgggcggcactgcccgcttggtgatgctgccggcggaaagccacggttaccgcgcccgcgagtccattctgcacatgctgtgggaggaggaccgctggctggatcagtatgtcaagcacgccaagccgcgcgaagcggatagcgccgccaagccatag

SEQ ID NO: 2668 - DNA, 996 bp, Chromobacterium substugae
atgccggatcaaaacgccctgcccacccgcgtcgccaacacccgcctctacctgaccgcctgctccggcatcgtgccgccgaagcaacgccagctggcgctgccgcggctggcccaggcaggcttccagctggaaaacaccgccgcgctcgaacgcagccatcaacgcttcgccggcaccgacgcccagcggctgagcgatttgcaaaccctgctgaccgaaccgcaattgccgccgctggtcttggcggctcgaggcggctatggcgcgatgcggctgctgccgcacctagacttctcgcggctgggggcgcggctgaaggagtcccgatcctcactggtgggctacagcgatttttgcgccatccagttggcggtgctggccaagagcggcgtcggcagcttcgccggcccgatgctgggcgatttcggcgcccccagccccagcccttatgccatcaacgagttcttcagcgcgatcaccacgccgcaacgcagcctgcgcatcgcggcggcgcaaccgcagccccaaggccgcggcgaaggcattttctggggcggcaacctcagcgtgctgtccagcctggccggcacgccctatctgccggaaatccagggcggcctgctgtttttggaggatgtcggcgaacagccgtaccgggtggagcgcatgctgcagcaattgcatctggccggcgtgctgtcgcgccagaaagccattttcctcggcgacttctcgatgcaaaagcatgtcgacgtctacgatccgcattacaacttcgacgcggtggtggccgagctgcggcgcatcagcggcgtgccggtcttcaccggcgtgcctttcggccacatcgccaacaagaccacgctgccgctgggctatccggcgcgcttccattccgatggcggcggcctgagcctgcaattcttcgactaccccactctctcgccggcgggattgcagccggacgccatgctgggcacccagttggcctaa

SEQ ID NO: 2669 - DNA, 1392 bp, Chromobacterium substugae
atgtcagcttcatccatcagcagtaacgtcggcccgctggacgtccagtccattgtcagccagctggtcgccgccgattcgcagccgcttacccaaagccagcagcgcgtctccaattaccagtccgaactgagcacgctcggccaggtcagctccgccttgtccgcgctgcagaccgcggcgaccaccctgtcgtccggcacctttctgcagcaattcgccgcaacctcgtcggacagcacggtagccaatgtctccacgacctcgggcggcaccgccggctcctacgtattgaacgtgacccagctggcgcaagcccggcagctggttttcgaccagaactccaacggttcgcccatcaccaatgaaaacgcggcgctgagcggcgcgcccagttcgctgactttcaacatcggcggcaccagcagcacggtcaacctgagcaatggcggcagtccggtaacgctgtcctccatcgccagcagcatcaacggcgccggcatcggcgtgaacgcctccatcgtgcagtacaacaacaactactcgctggtgctcaactccgcccaggctggccccagcaatgcctttaccatcaccgccggcggcaccgacagcaacggcacctcgggcaacaccctcgccggactgcagcaaagcagcaccgcggccaccgagtcgaccaatgcgcaaaacgcgctgatgaccgtgaacggcgtcaacgtgtcgtccagcagcaatgccgtcagcaatgtgattaccggcgcgacggtcaatctggaaaaattgggccaggtgacggtgaacatgagccagaataccgccaacatcacctccacgctgcagaccttcgtctcggcctacaaccaggtggtgtcggcgaccaactccgccaccaccagctcgaagaccgtgggcagcacgccggccaataccgacatcagcagcgatctgaccggcctgcaggaacagctcgccgggatcctcggcactccggtggccggcgccgatccggtcaactccttcgcctacttggcgcaagtgggcatcacccagaacgccgacggcacgctggcgctgaattccaccaccttcaattcggcgctgtcgtcgaacccgggcgcggtgaccaatctgttcggcaacgcccagaacaccggcatcggcaacgtcttcaacaccgccatcaacaatctgctaggaccgaccggcttggtaaccatcgaccaaaacaacctgaattcccaggtgaccagcgaacagcaattgcaaagccagctgcaaagccagctctccaatgagcagagcagcctgctgacggaatactccaatctcaacagcgaactggcgcagatggagcaagcttccaccagcatggccaatctggtcggctga

SEQ ID NO: 2670 - DNA, 927 bp, Chromobacterium substugae
atggatatcgatcaagcaaggctgactcacctgcaacaactggaagccgagtccatccacatcatccgcgaggtggcggcggaattcgaaaacccggtgatgctttactccatcggcaaggattcggcggtgatgctgcatctagccaagaaagctttctatccgggcaagccgccgttcccgctgatgcacgtggacaccacctggaaattccgcgacatgatcgcgctgcgcgacaagcaggccaaggaaaacggctgggatctgatcatccatgtcaatcaggacggcgtggacgcaggcatcaatcccttcaccgccggtagcgccaagcacaccgacgtgatgaagaccgaaggcctgaagcaggcgctgaacaagcacaagttcgacgcggccttcggcggcgcgcgccgcgacgaggaaaaaagccgcgccaaggagcgcgtttactcttttcgcgacaagaaccaccgctgggacccgaaaaaccagcggcctgaattgtggaacatctacaacggcaagatagataagggcgagagcatccgcgtgttcccgctgtccaactggaccgagctggacatctggcaatacatctacctggaaaacatcgagatcgtgccgctgtatttcgccgccgagcggccggtggtggagcgagacggcatgctgatcatgatcgacgatgatcgcattctcgaatatctgacgccggaagaaaaagctcgcatcgaaacccgcaaggtgcgcttccgcaccctgggttgctacccgctgaccggggcggtggagtccgccgccgcctccttgcccgaagtgatacaggaaatgctgctgacgcgcacttcagagcggcagggccggctgatcgaccatgacagcgccggctcgatggaaaagaagaaaatggaagggtatttctga

SEQ ID NO: 2671 - DNA, 1437 bp, Chromobacterium substugae
atgtcgcatcaatccgaactgatttccggggacatcctggaatacctgcgccagcatgaaaacaaggacatgctgcgcttcatcacctgtggcagcgtggatgatggcaagtccacgctgatagggcgcttgctgcacgattccaagctgatcttcgaagaccagttggcagcgatagagcgcgattccaaaaaatacaacaccaccgatcagaacatcgatctagcgctgctggtcgacggcctgcaggcggagcgcgagcagggcatcaccatcgatgtcgcctaccgctatttcagcaccgacaagcgcaaattcatcatcgccgattgcccgggccacgagcagtacacccgcaatatggccaccggcgcatccaccagcaacctggccatcattctgatcgacgcgcggcgcggcgtgcagacgcagacccgccgccacagttacatcgtcagcttgctgggcatccgccacgtcatcgtcgcggtcaacaagatggacctggtggattacgacgaaagcgtgttcaaccgcatccgcgacgactacctgacttttgccgaacacctggacattcccgacatccatttcgtgccgctgtccgcgctgcgcggcgacaatgtggtcagccgcagcgaggccgctccctggtaccaggggccgaccctgatgcacctgttggaaaccatccaggtcagccatgatgtggcgctggatgcgttccggctgccggtgcagtatgtcaaccggcccaatctggacttccgcggcttctgcggcacggtggcgtctggcagcatccaccccggcgaccgcgtcgtggcgctgccttccggcaagcaaagccgggtgaaggaaatcgtcacttacggcggccaattgccgagagcctcgtcgggccaggcgatcacgctgaccctggaggatgagatcgatatctcgcgcggcgacatgctggtaagggccgacgaggcggcgcctcatgtatcgcagagtttcgacgcgcatctggtagccatgggcgaaacaccgctacggccgggcaaggagtatggtttcaaactggccggcaaatacgtgactggccgcattgagtcgatcctgcaccgcaccgatgtcaatacgctgcaaaacggcccggccgaggcgctggcgctgaacgagataggtctgtgccgcatttccctcaatagcctcgcggttttcgactcctaccgcagttgccgcggcagcggcagcctgattctgatcgatcggctgagcaatggcaccgtggccgccgggatgataggccagacagtggaaagcgctgtcgacagccagtcgccctggcaacggttcgagcaggaactgagccagttgctgcgcaagcattatccagacatgaccttggctcagttggcgcagcgcttggcagagcgcgccggagactga

SEQ ID NO: 2672 - DNA, 324 bp, Chromobacterium substugae
atgtccgaagttgccgctgctcccgccccgcaaaaacaggctcttggtccgaatcagtgcgtagtcctgggccgcatcaaagagcgccgttctcataacggctacatcttcaccaccatcatccagcctgctgcagacgaatacagcatgcccggcatcgtggaagtccgttccaagaagtcgctcggtcaggtaggcgatgatgttcgccatctgtgccagtgctctggctacacgaacaagccgttcgagagccgcgacaaggaaacgggtgaagtggttatccgccgtaccgtctccaacgttttcattgctatcgaatga

SEQ ID NO: 2673 - DNA, 246 bp, Chromobacterium substugae
atgaaattccgttccgttgccaagaagttcgccccccgcatcaatgtgaagcacgccgttttcgcgctggccgctgctccgctggccgccttcgctgacggcactggcgcgccggacgtgtccacggtcgtggccgccatcgtcgccggtggtgtagccatcgcgctgatcggcaatgccaagtcgggcgtccaggctgtgatggcgctgtggggcatgatcaagggtgctatcggccgcggctaa

SEQ ID NO: 2674 - DNA, 1335 bp, Chromobacterium substugae
atgtggcgggctacttcattattttggctttgtgcggtgcttcttggattttgttccggtagtgcgcgcgccgattccacctatcctgcccatgtcacctatacgtggtatggccagacgttcggctctatggatgccgtcgctgctgcctgcgccaatacgctgttaaatggtcagggcggtgtgtggtccggctacagctgcatttttggcggtgtcagtttgtttccgtccacgtcctacagctgcgattctgacgacagcctggacgcgaacgggcagtgccacaaagctggcccgccgcctccgccgcaatgtccctccccggatgtcatggccatcacctgcatggcgattaaagggacgcaccagaagtccggcatgatcacgcctaccagcgggccgggctgcgatacgggcggcggcagtcccgatatgcagcgctgtggcgccggctgctccatgacgacgcaaacggtcgtcacgcctaccgcctcctatatggaccacgtctataacggtgccgcgtgtacgccgggcggtggcgtctcgaatccgggcgggttcgtccccacgccgccgacgaatcaggtctgcggcaataatcaggtttacggggaaataaacggcacgcccacgtgtgtggacaacgctcaaaaaccgggcactcagccccctgagactacgtctcccgactcatgccctcagggttcggtcgcgctcatcagcccgacgactggcaagcccattgcctgcattgacccgcatgactcgtctacgccatgccccagcggtcaatactccgtctctcagggaggtagcacgatctgcatgggctcgccgtccaatcccacgccatccagcccggccggcacgggctcgtcgtctggccattctggcagttcgtccggctccagtggttccagcggctcgtctggctcctccggctctacgggctccaatggtggcaaacccggcgatggctccaaaccgcctgatagctccgctccgcagcctgagacctgcgacgacaaattcccggatggtctgaagtggatttgcgggctcggcgcgggcctctccggcccggacggctccgacaaattgacgacgcaatcgggcggggatgtttccgggatgctggacacgtccgacatgtttggcggtggcagctgcccggcggtcaatcatttggtcgttccggttggggattctaatttcacatgggatatcgattacggcccgttctgccatttcgttttgatgatgaagccggggattatcgccatcgccatgctatcggccttattcatcatatttaagcgaggagggtaa

SEQ ID NO: 2675 - DNA, 1158 bp, Chromobacterium substugae
atgatttacttggtcacggcggttcccggctccggcaaatcgttgtatacgctggattggctgcgcaagaaatccgacaacgagtctcgacaggtctactacaacaatattccgctcagcaaaacgggattggatttgttgcagtggatagaatttcctgacccgactaaatggatgcatctcccgcccggcgctattttcgtgatggatgaatgccagttctcgttcccggttcgcaaatccggcaaagacacaccggagcacatcgagaagttttcaacgcaccggcatttgggcatcgacatcgttcttattactcagcatcccggtctgctggattcattcatccgccgcttggtgggtacgcatattcatttggttcggcaattcggcgcggaacgctccacggttttgacgtggcaagagggatgtcaagagaatccgaactccaagagcgcgcaaaaggcctgccttgatcgcaggacgtttgtttttccgaaagaggtatattcgtggtacaagtccgcagaggcgcatacgcataaattccaaatgcctctgcgcctgaagcaaatgattatgtggttgattgcggtggttttcctgattgccgcgtctgtctggtatctctatcacaacatgattgccaagcctcgcgaagaggctgagcgcctccagaataaaaccaatgcttcacagccagtctctcaaacgccttcgcctcaacagtcacaaaatgcagggcagggcggcaactcgaatcagcgcattatcaaaacggctcaaacgtttctacaggatcgtcagcctcgcgtggacggcattcctgaatccgctcccgcttacgacgaattgaccacgcctaaaactttcccaaaggtcacggcgtgcgttgccagtaattcgaaatgctcttgctacaaccagcagggcggtttgattcagatggatgattaccgctgtcgctattatgtcgacaaaggctggtttgacccgtatatggacaaaggggaaatgcaggacagacagattatggcctctcggcaaaacgcctctgctcctgctgccattgctcgccaaaagccagcccgtcccgaagtgctggctatgtccagttcgaacattttccctcgcattgatcaacgaaaaggaaattga

SEQ ID NO: 2676 - DNA, 186 bp, Chromobacterium substugae
atgaacaatcagccgacgattaccttaagtcaggccattggccatttgaaggcgagtggttttcaggccaacggtatgcaggttctcgcctatatcgcctcattcaacgccgccatggagttttaccgccagcaggtaggggagaggcagagcatggacgttgccactcaggatgcttcgcaatga

SEQ ID NO: 2677 - DNA, 1305 bp, Chromobacterium substugae
atgcctgaattataccagccattcaaggcgcttcaagcgtcttgtgcgtccatcgctcagtctgagcgcctcgatgttgaccactggcacgccgccgccattcgctgccagtctctcgattctggcggccagccgctgcccctcaaattggactatttgaccctgattgccgactccctggacagcgacagcgttcaagagcagctgacccttcatcgacttcacctgacgccacgcaaggccaaattcggctatcaacgcggcgtctcggtgcacctacaggaattttgccttgatgatccggtgttcgaggtgttctggggcggcgacagccagcgcggcacgatgatgtttgatcgctccgggccactgtcggcgcttgctgccggcatcctgtgccgcatcttcggtgctgagcagtttcgcctttcgcgtgctgatgtggcgcttgatctgcaatacccggactgttatcgcgaggtgaagtcgtttctcgatcagcagttctcggattggcatataggcggtcgcggcggccagaagccggcgtatcgagagatttccgattgtgggacgggaaagggctgcactacgtatctgggctccggcgatgtccacatgctgcgcgcctacgagaaaggcaagcagcttcagcgcctggacgcgcttgactgggtgcgcgtggaagtacagctgaggccaggcaagcgcccggcgcagtttctggcttggagcgccgtcgctgccggccggtttttccagatttggcagatgacgccgtatgttcggttctcggattacttcttgtgccagcaggccggccgcatcatggctgagcagccgtcgcgcgactcggcattggaggcgaaggctaagcacttggtcacgcaatactacggcgtgatgcagcagctagttggccttcacgcgcatggcgactggtctgagcttggtaatatcattcagcgtgtgaagggtgcgcttgatgctggcagcggctctacgtggcatgtggaacaagcgcttttggatcagtctacgggtcagacgcttgtagaattttctgattctgatggttcgcataatctatattatgtcaaattgacgatacggataaaaacgacgaaaactgcacccgcaacaacaaagagccccgcccgccggggctcaataatttgcggagcccatgcaatgaaacgacgagtgttcagccctaggacgaattttgcatggaccaatggaactggcagtgttgtgatgttcaccagcgacgataaggcaactgcacgaagaatacgagcgtga

SEQ ID NO: 2678 - DNA, 501 bp, Chromobacterium substugae
ttgctgatatccgccgacgccgcagcacaggaaaccagcaacagcatcaatccattcggcaacacgcagatggaaaatcggataaaagattttcccaagctgaaggttaccgccgatatcgcctcgatcagcgatatccaccaagcctgcggcatgacgcgctggatatgggtcattggcgctttcatgcaaggctgcaccagcttcgaccaggacatgcaatgggcgcatatccgcattgcgaaattcgccgccacccgcgacctgcgccatgaagtcgcgcatacctgcggcgagtatcacggcgacgcgatgccgcgctatgtggaaaactggaaacatcgggtgaactggcaaccccgcaccgacaatcgctgctcgccgcaatacgaagcggaaacctaccagcatctttatcaggcgctgaagcaggcaggctggcagccctgcgacgaagagcacgaacgactggcccaggaccgcacccgccgcggcggctga

SEQ ID NO: 2679 - DNA, 1848 bp, Chromobacterium substugae
atgaacgacagccgccttctccacgattcgcacgaagcgccaaaagcatggcatgcgcttgccgcggaacactggctggcgccgtggataagccttgccggcccaggatatggccagaccgccgatgcggtggattccgcatggtccaacactttcgatcagatgctgcatgcccagatgtcgcgcgccacgctgggcatttccccagccagcctcgcgctggctttttacgattgggcgacacacttcgccatatcgcctggaaaatgggcgcacctggcggagaacggcactggcaagtgggccaagcttacgcattatctgccgcgcgcttgcctcgactcggcttgcgcgccctgcatcgcgcctcatgagcaggacaagcgcttcagcgacgaggcctggcagcgctggccgttcaacttgtattcgcaagcctttttgctgcagcagcaatggtggctcaacgccaccaccagcatccgcggcgtatccccccatcatgagcaggtggtgtccttcgtggcgcgccagttgctggacatgatttccccggtgaattttctggccaccaatcctctggtgcaagaggccacttttctcgaggggggacaaaatctgctgcgcggctggcgcaacctccaggaggattgggagcgccgcagggcagggctgccgccatgcggcgcggagcagttcattcccggcgaaacggtggctgccacgcccggcaaggttgtcttccgcaaccacctgatggaattgatccagtactcgccctgcacgccgcgggtgaggacgcagcccgtgctgttcatccccgcctggatcatgaagtactacatcctggacctatcgccgcgcaattccctggtgcgttatctggtagggaaaggctacaccgtattcatgatctcctggcgcaatcccggagcggaagaccgcaatctggggatggacgactacctgcgcctcggcatattggatgcgctggacgtcatcggccgaatcctgcctgattgccgggtcaacgccatcggctactgccttggcggcaccttgctggccatcaccgcagcttacctggcgcgcgagaaccattccgtcatccaatcgatcacgctgctggcggcgcaagtcgacttcaccgaggccggcgaattgacgttgttcatcgacgaaagccagatcgcctttctggaagacatcatgtgggaccatggctacctggacgccaagcaaatggccagcgcctttcagttgctgcgctccaatgatctgatttggtcgcagatggtgcaggagtatctgctgggcaagcgcgagccgctgacggacctgatggcctggaatgccgacagcacgcgcatgccgtgccgcatgcacagcgaatacctgcggcgactgtttctcgacaatgatttgtttgaagggcgctatcaggtagatggccggccggtggtgctgcacgacatccgggcgccggtgttcgtggtggccacggaaaaagaccacgtcgcgccctggcgttccgttcacaagatcaagttggcattggataccgacagccagtttctcctcgccagcggcggacacaatgcaggcattgtgagcgagccgggccatcccggcaggtattttcgcttgtcggcctgccgcagcgaagaccgctatatcgacccggacacgtggctgcaaacaaccgctccgcaaaatgggtcatggtgggaggcgtgggaggaatggttaggcaaacagtcgggcacgctgtcggcggtgcccgcgctgggttgcgcgcaatatccaccgctagaaccggcgccgggacgctatgtgctggagcgttaa

SEQ ID NO: 2680 - DNA, 1176 bp, Chromobacterium substugae
atgcaactgaatttacttgatctgcattggtggggagccggcctggcgatgttggggctcacccatgccaccatcgcttcggtcactatctttctgcaccgccaccaggcgcaccagtccttgcggctgcatccgctggccagccattttttccgtttctggctatggctgaccacaggcatgatcacccgggagtgggtcgccattcatcgcaagcaccatgccgccaccgataccctcgacgaccctcacagtccgcaatgtctcggcatctggagggtgctgctggagggcagcgagctgtaccgccgcgcggccggcgaccaggcgatgctggatcagtatggtggcggcaccccggatgactggctggagcgccggctgtacgcccgccattcccgcttaggcgtcagcctgatgctggtgatcgacctgctgttgttcggccccgtcggtctcagcgtttgggcggcgcagatgctgtggattcccattttcgcggccggcgtcatcaacggagtcggccactattggggctatcgctcatttgccaccaacgattcctctcgcaacatcttgccattggggctgctgatagggggcgaagagctgcataacaatcatcacgcctatgccacgtccgccaagttgtccatccgctggtgggaatttgatgtcggctggctgtacatccgcttgctcgcctgcctgggcttggccatggtgcgccagccgctggcgcctctgcgcctgaatccgcgcaaactccattgcgacgaaggaacgttgagcgcggtgatcgcccatcgttatctggtattgtcccgattcgaccacgccttgcggcgggtagcggcggcggaattgcgccggcttcgctttcgcctggaggcgctgcaacctgccgcaggcgtcgaggccatccgccgatggctgcgccacgccgcgcgcgagccgctgccggattgcgaacttttggagcggacactgccgctcagcatggcgctgaataccatctataccatgagagccgagctggcatcattgtgggagcgatccgccaattcgacagagcagttgtccggtcaattggaagactggtgcaagcgcgcggaaaacagcgggattgatggattgtcggagttttcgcggcaattgcgaaaatatgatttctag

SEQ ID NO: 2681 - DNA, 723 bp, Chromobacterium substugae
atgagcggcaatgatgatcccaggcgcaatggcgtgctcgccgacctgccagagctcgagtggcaaaggctggccccgcagctggagccggtggaaatgccattgggcaaggtgctgtatgagcccggctgcacgctaagccacatttacttcccgaccactgccattgtctcgctgctctacgtgatggaggatggcgcctctgcggaaatcgccgtggtcggccatgaaggcattgtcggcatcgccttgttcatgggcggagagacgacgccgagccgcgcggtggtgcaaagcgccggcacgggctaccggttgaaggcccagatcttgaaggacgaattcaatcgagcgggggcgatgatgcacctgctgctgcgctatacccaggcgctgatcacccagatggggcaaaccgccgtatgcaatcgccaccattcgctggatcagcagttatgccgctggctgttgctgagcctggatcggctgcccggcaatgagctggtcatgacgcaggagctgatcgccaatatgctgggcgttcgccgcgagggcgtcaccgaggccgcgctcaagctgcagaaagccggcttgatccactatgcgcgcggccatatcaccattgtggatagagacggactggagcgacgcacctgcgaatgctacgacgtcgtgcgaaaagagtatcaacgcttgttgaccgtgccgctggcgcggcgttga

SEQ ID NO: 2682 - DNA, 2682 bp, Chromobacterium substugae
atgccccttagcgctgaagacagtttacgcaagttcccgctggcctccggccggcaggcctgtttccactccttgccggcattggccgaactgggcgtcggcgatgtcagccgcctgccggtgtcgctgcgcatcgtgctcgagtcgctgctgcgcaatctggatgggcggcgcatcaccgaggagcatgtgcggcaactggccagctggcagccgcgggcggcgcgcagcgaggagatccccttcgtggtggcgcgcattgtgctgcaggacttcaccggcgtgccgctgctgtgcgatctggcggcgatgcgcggcgtggcggaacgcttcggcaagccggccaagctgatcgaacccctggtgccggtggacctggtggtggaccattcggtgcaggtcgatcactatcgcgaaggcaatgcgctggatctgaacatgcagctggagttccgccgcaatgccgaacgctaccgcttcatcaaatgggggatgcaggcgttcgagactttccgggtggtgccgccgggcatcggcatcgtgcatcaggtgaatctggaatatctggcgcgcggcgtgctgcgcaaggatgaggtttattacccggatacgctggtgggcaccgattcgcataccaccatgatcaacgcgctgggcgtggtcggctggggcgtgggcggcatcgaggccgaggctggcatgctggggcagccggtctatctgctgacgccggacgtggtgggagtgcatctgaccggcaggctgcgcgagggcgttaccgccaccgatctggtgctggctgtgacggagaggctgcgccaggcgcaggtggtgggcaagttcgtcgaattcttcggcgcgggcgccgccagcctgacgctgccggaccgcgccacgctggccaatatggcgccggaatacggcgccaccatgggtttctttccgccggacgaacaagcggcggcctatctcgccgccaccggccgcagcgaggaggaggtcgatgccttccgccgctattttcaggcgcagggcctgttcggcatgccgcaggccggcgcgatcgactacagccagacgctggaattggatctggccggcattgtgcccagcgtggcaggcccgaaacggccgcaagaccgcatcgcgctgccggcgctgaagtcccgcttccatgagctgctggcgcagccggcgtccagcggcggttacggcaaggccggcgccgcgccggcgtcggatggcgcgctgggacatggcgcggtgctgatcgccgccatcacctcctgcaccaacacctccaatcccggcgtgatgctggcggccggcctactggcgcaaaaggccgccgcgcgcggcctgaaggtggcgccgcgcatcaagacctcgctggcgccgggctcgcgggtggtcaccgactatctggacaaggccggcctgctgccgtccttgcagcagctgggtttccgggtggtggcttacggctgcaccacctgcatcggcaactccgggccgctggagccggcgctggaggcggaaatcgccgccaaggacctgatctgcgccgccgtgctgtccggcaaccgcaatttcgaggcgcgcatccatccggctatcaaggccaatttcctgatgagcccgccgctggtggtggcgttcgcgctggccggccgggtggacatcgacctggacagcgagcccctgggcgtggacagcgccggccggccggtgtggctgcgcgaaatctggcccagcggccaggaagtggccgccgcgctggcgcaggcgaccgatccggccacctatcgccgcctgtaccaggattttgtcgacagcaatccgctgtggagcggcatcgccgcgccgaccgggcaggtgtatggctgggaggattccagctatatcgccgagccgccgttcttccaggattttgccctgcagccggcggcggtgccccaggtgcagggcgcgcgggcgctggccatcttcggcgattcggtcaccaccgaccatatcagtccggccggttcgatcaaggcaagctccccggccgggcaatacctgcaacaacggggcatcgcgcccttggaattcaacagctacggctcgcgccgcggccaccacgaagtgatgatgcgcggcaccttcgccaatgtgcgcatccgcaatctgatgctgccgctggacgccgacggcaagccggtggagggcgggttgacgctgagccagccggatggcgcgcagcgcttcctctacgatgcggcgatggaataccagcggaccggcacgccaacactgatcttcgccggcgaggagtacggcaccggctccagccgcgactgggcagccaagggcactcgattactgggagtgaaagcggtcatcgcccgcagcttcgagcgcatccaccgctccaacctggtgggcatgggcgtgttgccgctgcaattcaccggttccgacagcgcggccggcttgaaaggcgatgaagtgttcgacttgagcgggctggaacagggcatccagccgcggcaagcggtgacgctgacggcgcggagtccggatgggcagacccggcaactgtcgttgctgctgcgcatcgacaccccggtggaggtggagtactaccgccatggcggcattctgccctatgtgttgcggcagttgctgggggcgcggtga

SEQ ID NO: 2683 - DNA, 2589 bp, Chromobacterium substugae
atgctacaagcttatcgtcagcacgttgccgagcgcgcagcgctgggcattccgcccctgccgctgtccgcgaagcaggttgaagaactggtcgaactgctgaaaaatccgcccaaaggcgaagaaagcaccctggtcgacctgattacccaccgcgtgccgccgggcgtggacgacgctgccaaggtcaaggcatccttcctggctgccgtcgccgaaggcagcgtgcagtcgccgctggtttcgcgcgaactggccaccgaactgctcggcaccatgctgggcggctacaacatcaagccgctgatcgacctgctggacgacgccgccgtcgccaagatcgccgccgccggcctgaagaaaaccctgctgatgttcgactccttccacgacgtgaaggaaaaaatggacaagggcaatgccgtggccaaggaagtggttgagtcctgggccaacgccgaatggttcaccagccgtccggaagtggccgagaagatcacagtcaccgtattcaaggtgccgggcgaaaccaataccgacgacctgtcgccggcgccggacgcctggagtcgtccggacatcccgctgcactacctggccatgctgaaaaacccgcgcccggacgccaagttcgtgccggaagaagagggcaagcgcggcccgatgcagttcatcgacgacctgaaagccaagggcaacttggtggcttacgtcggcgacgtggtcggcaccggctcctcgcgcaaatccgccaccaactcggtggtgtgggccaccggccaggacatcccttacgtgccgaacaagcgcttcggcggcgtcaccctgggcggcaagatcgcgccgatcttcttcaacacccaggaagactccggctcgctgcccattgaagtggatgtgtccaagctggaaatgggcgatgtgatcgacatctacccgtacagcggcaagatcgagaagaacggcgcgaccgtcgccgagttcaagctgaaatccgaagtgatcctggatgaagtgcgcgccggcggccgcatcaacctgatcatcggtcgcggcctgacctccaaggcgcgcgaagcgctggacctgccggcttccaccgccttccgcctgcccaagtcgccggttgattccggcaagggcttcacgctgggccagaaaatggtcggccgcgcctgtggcctgccggaaggcaagggcgtgcgtccgggcacctactgcgaaccgaagatgaccaccgtcggctcgcaggacaccaccggcccgatgacccgcgacgagctgaaggacctggcctgcctgggcttctccgccgacctggtgatgcagtcgttctgccacaccgccgcttaccccaagccggtggacgtcaagatgcacaaggagctgccgtccttcatctccacccgcggcggcgtatcgctgcgcccgggcgacggcgtgatccacagctggctgaaccgcctgctgctgccggacaccgtcggcaccggcggcgacagccacacccgcttcccgatcggcatttccttcccggccggctccggcctggtggccttcgccgccgccaccggcgtgatgccgctggacatgccggaatcggtgctggtgcgcttcaagggcaagctgcagccgggcgtcaccctgcgcgacctggtcaacgccattccgctgtacgcgatcaagcagggcctgctgaccgtggccaaggccggcaagaagaacatcttctccggccgcatcctggaaatcgaaggcctgccggatctgaaggtcgagcaagcgttcgagctgaccgacgcttccgccgagcgctccgccgccggctgcgccgtgcacctgaacaaagagcctatcgtcgagtacatgcgctccaacatcaccttgatgaaagcgatgatcgccgatggctaccaggacgcgcgcacgctggagcgccgcatcaaggcgatggaagagtggatcgccaagggccagctgctgaaggctgacgccgacgccgaatacgcggccgtgatcgagatcgacctggccgacgtgaaagagcccatcgtcgcctgcccgaacgacccggacgacgtgaagttcatgtccgaagtggccggcaccaagatcgacgaagtgttcatcggctcgtgcatgaccaatatcggccacttccgcgccgcctccaagctgctggaaggcaaggccgacatcccggtgaagctgtgggtggctccgccgaccaagatggacgccaagcaactgaccgaagaaggccactacggcgtgctgggccgcgccggcgcccggatggaaatgccaggctgctcgctgtgcatgggcaaccaggcgcaggtgcgcgaaggcgccaccgtgatgtccacttccacccgcaacttcccgaaccgtctgggcaagaactccaacgtgttcctgggctcggccgaactggcggcgatctgctccaagctgggcaagatcccgacggtggaggaatatcaggccaatatcggcatcatcaacgagaagggcgctgaagtgtaccagtacctgaacttcgaccagatcgaagaatatcaggaactggccgccagcaaagcctga

SEQ ID NO: 2684 - DNA, 864 bp, Chromobacterium substugae
ttgaactccctgcggatttttgaagccgcagcccgactggagagcttttccgccgctgccggagagctgttcgtcacccatggcgctgtgagcaaacagataaagcagctggaggactggctggggattttgctgttcgagcgcagcggcggccgcgtcaagctgaccgacgccggctggcgctacctggtgcaggtgcaagatggcctggacctgatcgccaacgccacttcgcagctgctgcagcccaataatcagcgccggctgagcatcaactccacccccactttcgccagctactggctgctgcccaggctgggcggatttcgcgcccgctttcccgacctggagctgcacctggccacatcggaccgcgacatcagccgactggacgcgccgttcgatctggccatccgccgcggcccgggagactggccgggccatatcgccaaaccctttttgaaagagtgggaactgccgctgtgcagcccggcgctgttggcgcgcataccgctgcacagcccggccgaccttaccgcccacaccctgctgcatgccgatacccggcccaccgcctggccgcgctggttgacgctggccggcgtgccggagttgaagccggccagcagcatgcatttcgacaagttctcattggctttgcaggcggctaccgatgggctgggcgtggtgctggggccgatgccgatggggcaggcgcagatagacgccggctttctggtatcgcctttgccagagccggtggtgaccgtacgcgattattgctgggtggtgccgcgcatggcggcggaagaccccaccgtgtcggcgttttgccgctggctggaaagcgaggccggcgcctag

SEQ ID NO: 2685 - DNA, 783 bp, Chromobacterium substugae
atgctctcccgcactatcgcgctgctgctgttcagcttggccgcctggtccgcccccgctcccgcgcttaccatttataccgaagactggccgcccatcaccttccagcgcaatggcgtggctgacggcatggcggtggaggtggtgcgggaaatccaatcccgcattcatgacaacagccagatcgaagtggtgccctgggcgcgcggctacaaggaactgctgactaatcctggcgtgatgctgttcaccgtcggccgcaacgaagcgcgggagaggcagatgtcgctgctggggccgatagcggtgtcgcaaacggttttgctggcgcgcaagggcgaagcggcgaaactgctggcgctgggagccggcatttaccagcgcccggtcggcgcctatcgcggcagcatcttcgccgatgccgcatccgcggctggctttgtggaagttgacttggcgccgacgccgcaggtgacgacgcagaagttgctgctgggccgctacgatatgtgggtggagggcggcttcgtggtgtcttcggtattgaaggacatccatcagccgtcggactcggtggagttggtgcgcgtgctggaatcgcttgagctctacctggcgttttcccgcggcactccggccgacgaagtcaaacgctggcaggacggctttaccgccatcaagaaggacggcgcctacaagcgcatctacaacaagtggctgccgcgcgatgccgcgcccatggacgtcaggctgataggcgtgccgcccgggccggtccgctag

SEQ ID NO: 2686 - DNA, 1008 bp, Chromobacterium substugae
atgagccgcatcaccctctcccgctttctgatcgaacagcaacgcaaggccggcacgctgccgccggaattgcgcctgctgatcgaaaccgttggccgcgcctgcaaggcgatcagctattcggtcaacaagggcgcgctggccggggtgctgggcgaagccggcaccggcaatgtgcagggcgaggcgcagaagaagctggacgtgatcgccaacgactttctgctggacgccaatgaatggggcggcagcctggcggcgatggcttccgaagagatggaactgccctaccacatccccggcgaatacccgaaaggcgaatacctgctgatgttcgatccgctggacggctcgtccaatatcgacgtcaacatctcggtaggcaccatcttctccatcctgcgctgcccggaaggcgtgacgcaacctagcgaggccgattttctgcagcccggcacccgccaggtggccgccggctacaccgtgtacggcccgcaaaccatgctggtgctgactttcggcagcggcgtccacggtttcacgctggaccgcgagcacggctccttcgtgctgacccacccggacatgcaggtgccggagcgcaccggcgaattcgccatcaacatgtccaatatgcgtcactgggaagcgccggtgcgccgttatgtggacgaactgctggctggcagcaccggcccgcgcggccgcgatttcaatatgcgctgggtagcgtcgatggtggcggaagtgcaccgcatcatcacccgcggcggcatcttcatgtatccgaaggatgcgcgcgacccgggcaaggccggcaaactgcgtctgatgtacgaaggcaacccgatggccttcgtcatcgaacaggccggcggcgcggccaccaatggcctgcagcgcatcatggacatccagccgcagaaactgcacgagcgcgtggcggtgttcctgggctccaaggaagaagtggaactggtgagccgctaccatctggagcaaaagtaa

SEQ ID NO: 2687 - DNA, 651 bp, Chromobacterium substugae
atgatttctccgcatgccgtcccagtcgatctgctgctggcctattcgtcttatctgctgggcacggccagccccgggcccagcaatctggccatcatgtccgccgccatgcacgcggggccgcgcccggcgctgatgcttgcgcttggcgtcgtttgcggctcgctgttctggggctgccttgccgctctgggcttgtcggcggtgctggccgacagcgcgatggccctgttggcgatcaaaatggccggcgggctttacctgttctggctggcgtatcgctccggccgcaccgccatcgccggtctgcgcgtgccggcgggtatgccgggcggggaagctggacggaagatgtttctgcgcggcgccgccatgcacctgaccaatcccaaggcgattttcgtctggttatccattgtcgcgctggctatgccggccggcggctcgctgcgggatgggctgtggatggtggccgggtactgggcgatagggctgctggtattcggcggctacgcggcggtgttttcgttgccgcgggtgcgggagggctttttgcgggtgagccgcttgttcgatggcgcgttgtccgtgtcgttcgcttatgccggctggcgcatgctggcatcggcgctcaagcccgcgcaggcgtga

SEQ ID NO: 2688 - DNA, 798 bp, Chromobacterium substugae
atggctattcaactgaaagacgcccaggacatcgaaaaaatgcggatcgccggccgcctggcctccgaggttctggacttcatcactccgcacatccagcccggcatcaccaccgaagcgatagacaagctgtgccatgactacatggtgcgcgagcaaggcactatcccggcgccgctgaattacgcgccggatggccacatcccctaccccaagtccatctgcacctcggtcaaccacgtcatctgccacggcatccccaacgacaagccgctgaagaacggcgacatcgtcaacctggacatcaccgtcatcaaagatggctaccacggcgataccagccggatgttctacgtcggcgaagtcagcccgcacgcacgccgtctgtgcaagatcacttacgaatgcatgtggaaaggcatcgaaaaggtcaagccgggcgtcaagctgggcgacatcggctacgcgatccagcagcacgccgaagccgccggctacagcgtggtgcaggaattctgcggccacggcatcggcaagaaattccacgaggagccgcagatcctgcactacggccgcccgggcaccgggctggaaatccaggccggcatgatcttcaccatcgagccgatgatcaaccagggcaaacgccacctgcgcatgctggccgacggctggaccgtggtcaccaaggaccgcagcctgtccgcgcagtgggaacacacggtgctggttaccgaaaccggctatgaaatcctgacccagtccgcgggcacgccggaaaagccttcgttcaaataa

SEQ ID NO: 2689 - DNA, 846 bp, Chromobacterium substugae
atgtcactgaccatcaatagcaatctggcctcgctggccggacagacccaactgagcaagacccagaagtccatccagcaatcactggcggaactgggatctggccaggcctcggtcaatgcggccaatcaggcgatctcgcagcaactgcaggctcagatcaacggcaacaatcaagcgttgaacaataccaacgacggcgtttccctggtgcaaaccgcggattcggcccttgggcaattgcaaagcaacacccagcagatccagaccctggcgatccaggccggcgacggcgccctcagcggcagcaaccgccaagcgctgcagcagcaggtagaccaattgacccaggccaactcgcagatcgtgcagagcgcccagtataacggcaccccgctgctgaccggcggcaacgccaccactttccaggtggggccgaacggcaccagttccaaccagctcaccgtgcccggcatcaatctgtcggcggcgccggcgtccggcggcctcaacagctacaacgccaacctggcggcgaccaacaccatagacatcaccacccaggccaacgcgctgacagcccagcaatccgcccagaacgacctgaatgccatcggcgcgcagcggaccacgctgggagcggtcaacaatagtttcaattcggtggtggacaatctgcagacttccaacatcagcacgcaggccgccaacagccggatcagcgatgcggattacgccgccgccagcgcgcagctggcttcgcagcagatactaggccagtcggcggccctggcgcagcggcaggccaacatcgcgccgcaagccgccttgtcactgctagggtga

SEQ ID NO: 2690 - DNA, 405 bp, Chromobacterium substugae
atgtcgatcaccccagccatcacggtttcctctctcgattacgagcgcctggccgccttgctggaaacctgcgaacaggggcaccccgttgccggacgcctggaagcggaactggagcgtgccgaggtggtggagcctgaagccatgcccgcaaacgtcattaccatgaacagccgcgcccgcatccgcctgggcgacggccaggaaaagctgctcaccctggtgtatccgcgcgaggcggatagcgaacaaggccggatttcggtgctcgcgccgatcggggcggcgctgcttggcctgtccatcggccaggacatgcaatggccgactccctccggcactacccggctgactgttctggaaatcgtttaccagccggaagctgccggcgaataccaccgctaa

SEQ ID NO: 2691 - DNA, 1101 bp, Chromobacterium substugae
atgaacacgtcagaactgaggcgccagactgtcctgatcgtggacgacacgccggagaacctcacccagctttatggcttgctgaaggatcattaccgtacccagatcgccaacagcggcgagcgggcgctgcagatcgtcgccggcgatgtcctgcccgatctggtgctgctggatgtgatgatgccgggcatcggcgggctggaagtgtgccgccggctgaaaagcgatccgcgcaccatgggaatcccggtgattttcctgacggcgatgagcgagaacgaagacgagcaagcggggttcgatgccggcgcggtcgactacatcatcaagcccatttcgccgcctatcgtcatggcgcgcgtcaccactcatctccgtctcaaggccgcttcggattttctcgaagacaaggcggcctttctgcaaagcgaggtggagcggcgcacccgcgaagtgcaggtgatccaggacgtcaccatcatggcgctggcctcgctggcggagacaagggatcacgaaaccggcaaccacctgcgccgaacccagaactacgtccgcgcgctggcgatggagctgcgcaaccaccccaaataccgcaagggactggacgacgaaaccatcatgatgttgtacaagtcggcgccattgcatgacattggcaaggttggtatcccggaccacatcctgctcaagcccggcccgctaacgccgcaggagttcgaaatcatgaaaacccacaccacgctgggccgggataccatcgcggccgcggaaaaaatgctggatacgcccagcaatttcctgcggctggccagggagatcgcccacagccatcaggaaaagtgggacggcagcgggtatccggaagggctggccggcgacgcgataccggtttccgcgcgattgatggcgctggcggatgtctacgacgcgttgatatcgcgcagaacctacaagccgccgtttcctcacagccaggcggtggacatgatacgcgagggcagcggccggcatttcgacccggagatggtgaaggccttcttgcagatcgccgacgagttccacgccatcgcgctgcgctacgccgacaattcctag

SEQ ID NO: 2692 - DNA, 3093 bp, Chromobacterium substugae
atgcagcaatcagactcggcgaacctccagagtccggaatttctctcaaccctgccgcctacgcgcggccagagcgctttggcctacagcgccatgctgatctccgcgctggtgttcgtcattacggtgccgttcgccaaaattccgctggccaaggtgtgggccttcattccggtataccagtcggcgctggccatcaacgatctggtcaccgcggtgctactgttcggccagtttgccatcttgaggctgcgctcgctgcaactgttggcgataggttatctgtataccgcgctgatggcgatggcgcactcgctgacctttcccggcttgttcgccgaacacgggctgctgggctcgggcgcgcagaccacggcctggatgtatatgttctggcatggcggcttccccgcggtagtggtggtttatgcctggatggcggacaggccgctgctggaaccgtcgccagccagagtggggcgctccatcctggcatcggttctgctgacattggtgctggtcctcaccttcctggcgttagccacatccggccacggctttctgccggtgatcatgcaaggcaaccgttatagcccgctgctgtgggtagtggtgtccagcgtctgggggatgagcctgctggcgctggtggcggtcggcctcaggcgtccgcgcagtttgctagacctgtggctgatggtggtgctgttcgcctggctgtgcgatgtcgccttgtcggccatgctcaatgccggccgtttcgatctgggcttctatgtcggccgcgtctatggcctcatggccgccagcttcgtgctgatcgtcttgttgctggaaaacggcaagctttacgccaagctggccgcttcgtcggcggaattgcgcgacgccaaacaggcggccgaagccgcaacccaagccaaatcgatgttcctggccaatatgagccatgaaatccgcacgccgatgaacgccatcatcggcatgtcctatctggcgctgaaaaccgagctgaccgaacagcagcgcaattatgtcggcaaaatccacaacgccggcacctcgctgctgggcatcatcaacgacatcctggacttttccaaggtggaggccggcaagctagacctggagtctgagccgttctggctggacgacgtgctggagagcatctcctcgctggttgctcaaaaagccgccgacaaaaacctggagctgcttttcgagatgggaaaggaagtgccgcaagggttggtgggcgacgcgttgcggctggggcagattctgaccaatctggtcaacaacgcgatcaagttcaccgagaaaggccaggtggccatcatcatcaccctggccgaccgcatcggcgacaaggttcaattgcgcttctgcgtgcacgataccggcatcggcatgacagaagagcaggtagccaagctgttccaggccttcagccaggcggatggctccaccacccgccgcttcggcggcaccggattgggcctagccatctccaggcggctggtggagctgatgggcggcacgatacaggtggagtctgcgcccgactggggtagctccttcatcttcagctcctggctcggcttgtcgcgcgctgtcgacgctcgcctcgattccttgccccacaatatcaagggcatgcgcatcctggtggtggacgacaacgccaccgcgcgcgacatcctgtctgaacagctgcgcgcgctggatttcgtggtaagcacctgcacgctgggcagcgaggccattccgctggtgcgccaggcggcgctcaaccaaccctacgacgccgttttcatcgactggatgatgccggagatggatggcatcgaaacgatcagacgcatccgcgaaatcacccgcaccgcgcacatcatcctggtgaccgccttcggccgcgatgatgtgcgcgccgatgccaaagcggcgggcagcgatgccttcctggtgaagccggtcagccagtcgtcgttgttcgacgtgctggtggaggtgttcggcggcggcgcgcggacggagtcgccgcggaaaaacgatgatttcaccagtctgaacggcctgcacctgctgctggcggaagataacgccatcaaccagcaaatcgcggtggagctgctggagggcgcgggcgccactgttacggtcgccggtaacggccagctggcgctggacaagctggagacctatggcccggaaggattcgacgcggtattgatggacgtgcagatgccggtgatggacgggatcgaggcgacgcggcggatacgcgcggacgcccgcttcgccgcgctgcccatcatcgcgatgaccgccgacgcgctggtggaagagcgggaagggtgcctgagcgctggcatggtcgaccatatcgccaaacctatcgatccccatctgatgttatccacgctgaagcgctggacccggccggtagagagtcctcccgcgcgaaagcaggaaccaaaccaagaggaacgggtcattccgcttatcgaaggcctcgacagcgccgcaggactgcggcgcgtcgcgggcaatcgggagctgtacctgcacctgctgcggcagttcgtcgctgaagaggcgggcgccgccgcgcggcttgacgaggcattggaggacggcgactatccgttggccgagcgcatcgcccacacgctgaaaggcaccaccggcagcatagggctggccggcttgcccgaaaccgcggcgaagctggagcaggcgatccgttcccgaaccgaatgcaaagaaggcgtggcgacgctgatgcggcagatggagcgcgcggtggctgcgcttaagggcgggctcgacgcgctggcgccggctcccgatcagggtgtggcgcagggaggtaaattgctgcttgagctgtcccgtctgttggctgccagcgacggggaagccttggggtatttcctgtcgcacgccgccgaagtgagggaaaccttccccggcggagactacgccgcattcgaaaaggcattgacgaatttcgacttcgccaccgccttgacatcattgcgcacggcggcaacacagcacggcatcgcccttcctgaggatgcatcatga

SEQ ID NO: 2693 - DNA, 576 bp, Chromobacterium substugae
atgcaagacatcgtggatttcgtgctggaaatcgacaagctgaagcaagtgacgcgcaagacccgggtgctgaacagcgaccgttatgaaaactcggccgagcatagctggcagatcgccctgctggcggcatccttgcagccttacgccgccgagccggtggacatcgccaaggtggtggcgatgctgctggtgcacgatatcggcgagatcgaaaccggcgacaccatcgtctacgccgaaggcggctgggaggagcgcaaggcgcaggaactggcctgcgtcacccgcattttcggcatgctgccgcccgagcagggcgggcgcttcctcgccttgtggcaggagttcgaagccggggagagcgccgaagcgcgtttcgcccacgccgccgaccgcgcgatgccggtattgctgaacctggccaacaaaggccagagctggcgggaaaacggcatccgccacgagcaggtggtcagccggatcggcccgccggtgcgccagggctgtccggcgatgtgggaatacctggaaggccggctggagaaggccagggatagcggctggctgaaatag

SEQ ID NO: 2694 - DNA, 609 bp, Chromobacterium substugae
atgctgaaggcgatgaacaaggtcggcatcgccggcccggccggcatgctggacaccatcgtggtggatgcccagggcgaagcgaccggcgtcgcggtgatctgccaccccaatccgctgcaaggcggcacgcacaccaacaaggtggtgcagactgcggccaaggccctgtcgcaactgggctatgtctgctattgccccaatctgcgcggcgtcggcgacagcgaaggcgaacacgattacggcaacggcgaggtggacgacgccatcgcggtggtcgaccatgccaaatcgcaatatccgggcttgccgctggcattggccggtttttctttcggcggcttcgtcgccgcccgtacccgcgcccgcatcgacgccgacaagctgctgctgatgggcgtggcggtgggcaaatacccgattccgacgccggaggtgcctgccgacacgctggtgatccacggcgaagaagacgaagtgattccgctggcggcggtgatggaatgggcgcggccgcaaagcctgccggtgctggtgttccccggcgcgggccattttttccacggccgcttggtgcagttggcccagatgattcaacggtgctggtga

SEQ ID NO: 2695 - DNA, 309 bp, Chromobacterium substugae
atgagctatttcgacaagcacgtattcgtctgctgcaaccagcgcgccaacggcgagggctgctgcaacaacctgggcgccagcgaactgcacgcgtacatgaaggaacagatcaaggccaagggcctgtccggcaagggcaagatccgcgtcaacaaggccggctgcctggaccgctgcaacgagggcccggtgctggtggtctacccggaggaaacctggtacaccttcgtcgacaaggacgacatcgacgagatcatcaacgagcacatggtcaacggccgcgtggtggaaaggctgaagatctga

SEQ ID NO: 2696 - DNA, 1410 bp, Chromobacterium substugae
atgacagaacagtacgagaattttgatggcgagatggccgccatccgcacgccgccgcattcgatcgaggccgaacagtcggtcatcggcggcttgctgctggacaacagcgcctgggacaagatcgccgacgtggtgtccgaggccgacttctaccgccacgaccaccggctgatctacaagcatgtcgccaaactggtggagctggggcgcccggccgacgtggtgacggtggcggaatcgctggacaagaacgaccagctcggcaatatcggcggcttggcctatctcgccacgctggcgcaaaacacgccgtcggccgccaatatccgccgttatgcggaaatcgtccgtgaacgctcggtgatgcgccagctggcgctggtgggcaccgaaatcgccgaggccgcatattcgcccatgggccgcgacgcctcgcagttgctggacgaagccgaaggcaaagtgttccagatcgccgaatccaccgccaagtccaaacagggcttcctggaaatgccgggcctgctgaaggaagtggtggagcggatcgacatgctgtacagccgcgacaacccggacgaagtgaccggcatccccaccggctttgtcgacctggacgccaaaacctccggcctgcagccgggcgacctgatcatcgtcgccggccggccgtccatgggtaaaaccgccttctcgatgaacatcgccgagcacgtggccgtggaaacccacttgccggtggcggtgttctcgatggaaatgggcggcgcgcagctggtgatgcggatgctggggtcggtgggccggctggaccagcacacgctgcgcaccggcaagctaggcgacgacgactggcagaagctcacttacgcgataggcaagctgtcggaagcgccgatgtacatcgacgaaaccccggcgctgaccgcgctggaagtgcgcgcccgcgcgcggcgcctggcgcgccagcacggcggcaagctcggcctgatcgtgatcgactacctgcaactgatgtccggctccggccgcggcgacaaccgtaccgcagaactgggcgaaatctcgcgcggcctgaagggtctggccaaagagctgcaggtaccggtgatcgcgctgtcgcagctgtcgcgggcggtggagcagcgtcccaacaagcggccgatgatgtcggacttgcgagaatccggcgccatcgagcaggacgccgacttgatcgtgttcatgtaccgcgaagagtattacagtccggacaaccaggaagtgaagggcttggccgaagccatcatcggcaaacaccgtaacggcccgaccggggcggtgcgactggccttcgtcggcaaatacgccaagttcgacaacgccgccaccgtcggcgtcagcggctgggccgacagcgactcctga

SEQ ID NO: 2697 - DNA, 1173 bp, Chromobacterium substugae
ttgcaatttgatgtgattgtcatcggcgccggcgcggccggtttgatgtgcgccgccaccgccggccagcgcggccgcaaggtgctgttgctggaccatgccgccaaactggcggaaaaaatccgcatctccggcggcgggcggtgcaacttcaccaacctttacgccaagttcgactgctacttgtcggacaacccgcatttctgccgctcggcgctagcgcaatacacgccgcaggatttcatcgccatggtggagcgccatggcatcgcgtatcacgaaaagaagctgggccagttgttttgcgacgacggcagcgagcggattatagccatgctggacgaggaatgccggcaggccggcgtggagcggcggatggagaccactatctcgcaggtggcgcgcgtcgagtcgggctacgcgctgcaaacctcgatgggcgagttgcgcgccgaatctctggtggtggccaccggcgggctgtccatcccgcagataggcgcgacgcctttcggctatcagctggccgagcagttcggcttgccgttgacgccgctgacgccggcgctggtgccgctgaccttccacgtggaggacgccgacacgttttcgccgctggcgggggtgtcgctggacgtcgaggcgcgcgccggcaagggcaagttccgcgagaacgtgctgttcacccacaagggcgtgtccggcccggccatcctgcagatatcgtcttactggcagcccggcatggagctgacgctcaatctgctgccggacgccgatgcagaagcctggctggaggaaagggcgggcagcgagcagctgatctccaacgcgctgggcgaattccattggcccaagcgcttcgccgaggcctggctggaccgcgagggcttcaacaagcggctgaaggacctggggcttaagcagcgcaaacagctggcggagagcttgcaccgctggcgggtgaagcccaacggcacccagggctacaagaaggccgaagtcacgctgggcggcgtttccaccaaggccctgtcgtccaagaccatgatggcggccgatgtgcccggcctgtttttcatcggcgaggtggtggacgtcaccggctggctgggcggctacaatttccagtgggcctggtcgtccggctacgtggccggaatgaactgctga

SEQ ID NO: 2698 - DNA, 582 bp, Chromobacterium substugae
atggaacacaaactgcctgaactgccgtacgcgctggacgccctggcgccgcacatttccaaggaaaccctggaattccactacggcaagcatcaccagacctacatcaccaacctgaacaacctgatcaagggcaccgagttcgagaacgcctccctggaagagatcgtgaagaaatcctccggcggcatcttcaacaacgccgctcaggtttggaaccacaccttctactggttcggtctggcgccgaacgcgggcggcgaaccgaccggcgcgctggccgacgccatcaaggccaagtggggttcgttcgaggaattcaagaaggccttcacccagaccgccgtcggcaccttcggttccggctgggcctggctggtgaagaacagcgacggcagcctggacctggtatccaccagcaacgccgccactccgctgactaccgacaagaagccgctcttgacctgtgacgtgtgggaacacgcgtattatatcgattaccgcaacagccgcccgaactatctggacagcttctggaagctggtgaactgggacttcgcgtccaagaacttcgccgcctga

SEQ ID NO: 2699 - DNA, 1200 bp, Chromobacterium substugae
atgacgcatctggaaaaatggctgggccgcagcgcgatggtggtggacgactcccccagccagcgcatggtggcagccggactgttgcgcgagtttggttttgccgtggtgcacgaggcggagaacggactggacgcgctgggacaattggctgtgctggcgtcggtggacctggtggtgactgacctcaacatgcccggcatggacggcgtcaagctgctggagagcatcgccaagacctgcaagggcaaggtgaagttcgtcgcggtgatgagcggcgtgccgcgcgacgtgctggatacggtgcagggggtggtggacgcgtccgagctggacctgctggcggtgtttcccaagccgctgagcctggcggaagtgcggcgggtgctggacggctgcgacccggactggcacctgtccggcgccgtcatcagcaatctcaagctcagccaggaagaggtggcgctggcgctgggcctggggcaactggtgccgtacttccagcccaagatctcgataggcgacggacgtctgttcgggatggaggcgctagtgcgctgggagcacccgcagttcggcgtgctgcagccggcggtgttcgtccatcacctggaacaggggccgctggcgctgcgcttcttttaccagttcttgcgccaggtttgcctggagttgaaccgttttctcgccgtgcagccggatctgcacgcgtcgatcaatctgccggttccgctgctcaacgacgccaatctggtggatgaaatgacctgcatcgtgcagtcatgcggactgacctgccatgccatcgtggtggaggtgacggaaacctcgctgatgtccaacctggcggcctcgctgggcacgctggcgcgcttgcggctgaatggcttcggcctggcgatggacgactacggcaccgggtactcatcgatgaagcagctgtcgcgcagcccgttcaccgaactgaaaatcgaccgcgaattcgtccacgacgcatccagcagtccgaagaagctggccattctcaccgcggccatcgccatgtgccagcgtctgcggctgtcgtcggtggcggaaggggtggagaacgaagaagactggcggcagctgtcggcgctgggttgcgatgtggcgcaggggtattacagcagccgtccgctgtcggcggaaatgttcctgcagtggatggccgagcgctga

SEQ ID NO: 2700 - DNA, 1092 bp, Chromobacterium substugae
atgagcatcgccgtcctgatcgtggatgattccgccgtagtgcgcgaagtgctggggcagatgctggccaccgcgccggacatcgaggtgataggcgcgtcgcccgaccccatcttcgcgatgaaccggatgaagctgcgctggccggacgtgatcctgctggacatcgagatgccgcggatggacggcctgactttcctgcgcaaaatcatggaggagcggccgacgccggtcatcatctgctcgtcgttgaccgaaaaaggcgcccgcatcacgctggacgcgatgtcggccggcgcggtggccatcatcaccaagcccaccatcaatttgaaatcctttctgcaggaggcggccaaggaactgatccaggaagtgcgcgacgccgccggcgcgcggatgggcgtgttcaagcgcatcgccagcagcgcggccaatcccaggggcggcgagcaaggcccggcgcccaagcttaccgccgatgtggtgctggacgcgccatcgggcctggagaaataccacgccaccgagaagatcatcgccatcggcacctccaccggcggcacccaggcgctggaatatctgctgcccaggctgcccgccacctgccccggcgtggcggtggtgcagcacatgcctgagaagttcaccgcgtctttcgccgatcgcctcaaccggctatgcaaggtggaggtgagggaggcgagaagcggcgaccggctgatttccggcgtggcgctgatcgcccccggcggcaagcatctgctgatcaagcgcagcggcgcgcaatacatggcggaggtcaaggacggcccgctggtgtcgcgccaccggccgtcggtggatgtgttgttccgctcggtggcggtgaatgccggcaaaaatgcggtgggagtgatcatgaccggcatgggcgacgacggcgcccgcggcatgcgggagatgcacgacgcgggcgcgcggacgctggcgcaggacgaggagtcctgcgtggtgttcggcatgcctaacgaggccatcagccatggcggggtggacgaggtgatgtcgctggagcgcattacccacaccttggccggaatcaggggttga

SEQ ID NO: 2701 - DNA, 831 bp, Chromobacterium substugae
gtgctaagcgatgaggaattcgcctttttccgccagttcattttccgcgaggcggggatagacctgccgccgggcaagcgctcgctggtgcagtcgcggctgtccaaacgcatccgccacttggggctggccagctactcggcctactggcagctgctgcgcagcccaagcgcgcatgccgagcgccagcgggcgatcaacctgctgtccaccaacgaaacctattttttccgcgagccccagcatttccactggctggaacgggaagcgcagcatctgcgcgatatccggccgggcatgctcagagtgtggtcggcggcctgttccaccggcgaagagccctacaccatcgccatggtgctggccgaggcgctgggtttgagcggcaactggaagatctacgccaccgacatcaacaccaaggtgctggccgccgccaagcgcgcggtgtatccgatagagcgcgcccgccgcacgccgccgcatttctggcagaaatattttctgcgcggccacgatgaatacgaaggcatggtcaaggtggcgccggaactggcgcggcgggtggatttcgccaatctcaacctgctgcattgcgacaagttccaccatggcgaattcgatattgtctttttgcgcaatgttctgatttacttcaatgagacgaccaagctgagcgtgctgtccaatctgtgcacccggatgaagcagggcggccatctgctgatcgggcattccgaatcgctgcataagctggcgctgccgctggtccaggaggaaccgtcccgctaccggctggatgcctcgcggatgagaggaggagggaaatga

SEQ ID NO: 2702 - DNA, 540 bp, Chromobacterium substugae
atgaccgagcgcgctaatccgggcgccgcgcatggcagcggcaagttccattgcgtcaccttcatcctgggcgaggatttgttcggcatccagatcaacttcatccgcgagatcatcgagctggacggcatcacccatgtgccgatgatgccgagcttcgtgcgcggcatcatcaatctgcgcggctcggtggtgccggtgatagacctgtcgatccgcttcggccgcggcctgaccgagctgaaaccgtccacctgcgtcgccattctgtcgctgccggggctggacaacggctacaacgaggtgggcatcctgctggacgcggtgtgcgaagtgctggagataccggagaccgacatcgacccatcgccgaccttcggcgtcagcatacgcggcgatttcatccagggcatcgccaccatcaacgagcgcttcgccattctgctgaatgtgcagcaggcgctgtcggtgacggagttgagcgcgatggcggagtcggtcgcccagcagcacttcaacgacgatgccgaggtggcctga

SEQ ID NO: 2703 - DNA, 1683 bp, Chromobacterium substugae
atgaactggtttcacaacctgcaagtcaggaccaagctgctgcttagtttcggcgtgcttctggcgttgttgttgacgatgggtatcgtcggttaccaagccagcgcaagagtgaatgcgggtctcgaggatttattcaccaatcagttcagcccactgatcggcatcagcaacgccagagtcgcggcgatgacgcacaaccgagcgctttatcgatatctggcagaaaccgacaaggccaaaatggatgatgccgcggcgcacatggatcaatatgacaaggagttgttccagcagatgaagttggaactaggctcgaccatggagccagaagaagctgatgccaataggcgctggcagacgcaatggcctatttatttgagcgcaagcaaggaagccatgaagctggcttatgaagacccaggcacgggggaagggcgcaaacgggcaatggagattgtgagaagcaaggcgcgacccgcttttgatattgtcgagcaatcactgacgctcgtgaaagaagtgaatgagagagtcgctgaaaagacgcatacattgggtcaggagacatatgcctccacaacgcgagtggtgatcaccctttcgatcatttcattgctcatttgcggcgcgctgtccctgctggtgacgcgcagcatcctgcgccagctgggcggcgatccatcctacgcgatgcaggtggtggcgcgggtggccgacggcgacctgtcggtgccgatcaagctgaacggcaacgacagcagcagcctgctgtactcgatcaagggcatggcgcaccggctgtccgatacgctggccgaggtcagctcgatgtccgaatcgataggcgcggcgtcggaacaggtgtcgtccaccgccagctcgctggcgcagacggcgtcggaactggcctccagcgtggaggaaaccagcgcgtcggtggaggagatggcgtccaccgtcacccagaacgccgataacgcccgcgtcaccgagggcatcgcgtcgaagtcggccgacagcgccaccgaaagcggcaaggcggtgggcgacatggtgcacgcaatgaaggaaatcgcctcgcgcatcaccgtgatcaacgacatcgccaacaaaaccgacctgctggcgatcaacgcggcgatcgaagcggcccgcgccggcgaacacggcaagggcttcgccaccgtggcggtggaagtgcgcaagctggccgaacgctcgcaggtggcggccaaggaaatcggcgatctggccgggcgctcggtcagcgtggcggagcgcgccggggtgctgctgcaggaaatgctgccggggatagaccagaccgccaccttggtgcaggaaatatcggccgcttcgcgcgagcagcgcaccggcatcgaccagatcaacaccgcggtttcgcagatcagcaccggcatgcagtcgtcggcgtcgtcggcggaggaactgagctccacctcggaagagctcagttcggcggcgatgcagctgcaggacctgatgcagcagttcaagctgcgcagcagccgccacgcgcgcaagggcatatcgctgcacatgagcggccatggcgccggcggcgcgcgcaaaacggcctcggcgccgccgcactcgatgcaggcggacgacgatgatttcgacgaaggcgtggacgacgacaagttttccaaatactga

SEQ ID NO: 2704 - DNA, 2169 bp, Chromobacterium substugae
atggatcttagcaaggccaaggcggtattcttcgaggaatcgcgcgagctgtgcgacgggctggaaacggcgctgctcgacccggtggcctatccgcccaatgccgaaacctacaacctgctgttccgcaccgcgcataccatcaaggggtcggccggcattttcggcctggacgccttggtccgcttcgcccacgtggtggaaaacgtgctggaaaggctgcgttcgggacaggtggcgctgagcgacgacctgatcggcctgctgctgtcctgcaatgaccatttgcgccggctgctggacagcgcctcgatcagcgacgatatggcgcgccaggatctgcccgaaggcgagccgctgctgctcagcctgcggcgctatcaggacggcgaggcggtcgaaaccgacgcgcagacggagggcgctgcgccgcccgcagcggccgccagcgagtccgtcgcgacgcagacgccttattggcagctgtcgctgcgcttccacgccgacaccttccgccacggcttcgatccgctgtcctttctgcgctatctggccggatgcggcaccgtgctgcaggcggagccggtgtggcgcaattggccgccgctgccgctgttcgacgccaccgagtgcttcatgggcctggatctcagcctggagtcggcggagagcccggagcgcatcgcgggcaccttcgaattcatcgccgaggacagcctgatcggcatcctgccgccgcacgcctcgctggcggatttcctggccttggcggaacgcctgggcgagccgctggacgagcagttggcgcgctggctcaggcggggagcgctgaccgaggccgaagccgcccgcattgagcgcggcgacctggggcagcccgagcccgaatccgaaaccgccgcagttctggaaggccccgcgccggcgtcaacggccgcgcagccggccggcggcgcgccaagcaagcccggccgcggcgacggccaatacatccgcatcgaggctggcaagctggaccggttgatcaaccgggtgggcgagctggtgatcgcctcgtccggcaccaagctgatcgcccaggcgcgcggcgatgccgagctgctggaatcggtggcggtgatcaacaccctggtggaaagcatacgcgacgacgcgctgaccctgcgcatggtgccggtggacgaaatcttcagccgcttcccgcgcatggtgcgcgaagtgtccaagcagctgggcaagaccatccacctggaaatcaagggcggcgacaccgaaatcgacaaatcgatggtggaaaagctgaccgacccgctgatgcacatcgtccgcaacgcggtggaccacggcctggagtcggcggacaagcgcctggccgccggcaagccgccagagggcacggtcacgctgaatgcctaccacgacgccggctcggtggtggtggaggtgaaggacgacggcggcggcatcaaccgcgaaaaggtgctggccaaggcagtggagcgcggcctggtcgccgagggccgggttctgagcgaccaggaaaccctgcagctgatcttcctgcccggcttttccaccgccgaagcggtgagcgacctgtccggccgaggcgtcggcatggacgtggtgaagcgcaatatcgaatcgctgcgcggcgagatagagattcagtcgcagccggggctgggctccaccttccggctgcggctgccgctgacgctggccatcatcgacggcttccgggtggaagtgaacgaatcggcgctggtgatgccgctggacatgatgatcgaatgcgtggacatgccgcccggcgcgatgagccagcgcgcgcgccaggttaacctgcgcggcgactggctgcccttcgtctccctgcgcgagctgttcggcctgccgccatcgggccagccggaatacatcgtgatcgtccattacggcgagcaccgcgccggcatcgtggtggaccggctgatgggtgaagtgcaggcggtgatcaagcccttgggcgagatcttcaaatcgctgcgcggcatcagcggctccaccatcctgggcaacggcaagccggcgctggtgctggacattccgcagttgatccatcacgcctgccggcgcgaacgccggttgataaaacagggcacggaagcggcgacgcactgggattag

SEQ ID NO: 2705 - DNA, 333 bp, Chromobacterium substugae
atgccgattcaagtgacgcaggatggcgaggcgatgcgggccgcaatcgacggcgaattgaccatcttcaccattgagatgctgcaggatgagctgcttggcctgctcaatcacccaagcgtgcggcttgacctatccgcagtaacggagctggatggctgcggcgcccaattgctgtgcgtgctgttggccgaggcgcggcggatggagcgcgatgtctccattgccggcagcaacgcgctggtggacgaggtgggcaattggctgggtttcgccgcagaaacaggcgccgcgcggatggagagcgcgggggagggggagcatggatcttag

SEQ ID NO: 2706 - DNA, 369 bp, Chromobacterium substugae
atgggcaaatccatcctgatagtcgacgacgcggccagcatccgcgccacggtgagcatcgcgctgaagggggccggctacgaggtgatagaggcttgcgacggcaacgacgcgctggccaagctgaacggcgctcgcgtcaatctgatcatctccgacgtcaatatgcccggcatggacggcatcaccttgctcaagcggctgaaggaaggcgccgccacccgtttcctgccggtgatcatgctgaccaccgaaggcagcgacgacaagaagatgcagggcaaggaggccggggccaaagcctggatcgtcaagcctttcgacccgctcaagctgctggacgcggtgtccaagctgatccagccataa

SEQ ID NO: 2707 - DNA, 1152 bp, Chromobacterium substugae
atgccaaaccgcaatcgttttctgatcgcctacctcatactttgcgcgctggcggcgctggcgctggtttggctgtcgccctggctgggctggctgatggccggcagcggcggcgcggcggcttgcttgctggcgggcaagcaggagtctcccatttcgccgcgagaggagcctgcctctgccagccatgccggccaggggcctgccgatgagaatctcgccttgctggaggcggtgatacaacgctggatgggcaatctgcaactggtgctggagcagtccacctccggcagcaaccaagtggccgccaccttgagcgccatcgcaggcagcctgcatgccaccatcgaggcttcgcgctcggccgccaccgatatcggcgccgacagcctggataagatggtgagcgacgccggcatgctcagccgggaaatttcccacgtgctgtcggaaatcgtcagccatcgccagttgctgatagacgaagtgtccaagctcaccactttttccgtggagctgcgcgccatggccgaagaagtgggcaatatctccaatcagaccaatctgctggcgctgaacgccagcatcgaagccgcgcgcgtcggcgaattcggccgcggcttcgcggtggtggccgacgaggtgcgcaagctgtcgcagcaatcggcgcaaaccggcatcaaaatgtcggaaaaggtggaaaccatcaacgccgcgctggagcagacccggcaatccaccaccagcctgggcgcccaggatgctgacaagggcaatggcgcgctgggcttgctggacgcctcggtgcaggacttcagcgccgccgccggccggctggccgaaatcaaccagaaaatgcagagcgacggctcgcaggtggagcgcgaactgaacgcctcgctggtcgcgctgcaataccaggaccgggtcagccagatcatccagcatgtcgccagcgacctggagcgcatgcttgagcacctgcgccagacgcgcgaggcgcgcaaaaccggctgcgagccgcccgccatcagcagccaggaatggatgaagcggctggagtcgacctataccacgctggagcaggcggcgctgcatcagggcgccggcgccaaggcgcaggcctcgcaaggcgacgtggactttttctga

SEQ ID NO: 2708 - DNA, 744 bp, Chromobacterium substugae
atgtcgagaatcgcgctggcgggcttgctgttcgcattgtgctgcgggacgccggcgcgcgccgccccggcgctggagctggtcacgctgcagtacccgccgtaccagtatcaggaaaacggcgaggtgaaggggttcgcggccgatctggtgcgcgaggctttccgcagactgaatctggcggtccatatcagcgtctacccctgggggcgctccatcgccatggtgacggacggacgcgccgacgccatcttcacgctgtaccgcacgccggaacgggaagcgctgctcgattattccaatgagacgctggcgcagcaggaggtgtcgctgttcgtgcgcaaggattcgcccatttcgtccggcggtcgcctggatgcgttgtccgcttaccgtttcggcgtggtgcgcgccgtcagctatggcgtggttttcgaccaggcggtgaagagcggccagatcaaagtgggcgaagtcgccgccagcggcgagcagaacatggacatgctgctggcgcagcgcttcgacatcctggtcagcaaccggctgggcgcgcgcgatatcttgcgccgtcgccacgaggaggccctggtgcgcgaactgtcgccgccgctggaggccattcccagctatatggctttcgcgcgcaagcgcagcctcgccgggctgcgccagcgtttcgacgccgcgctggcggcgatgaagcgggacggcagctacgcgcgcctgagcgccgcgccttga

SEQ ID NO: 2709 - DNA, 1533 bp, Chromobacterium substugae
atgtgtggaattctaggcgtggtcggtcaatccccggtcaatcagctgctgtacgatggcctgcaggtgctgcagcatcgcgggcaggacgctgccggcatcgtgaccgccaatggcaagacctttcacatgcacaagggcagcggcatggtgcgggacgtgttccgcacccgcaatatgcgctcgctgctgggcgcggcaggcatcgcccacgtgcgctatccgactgcgggttcggcctcctgcctggccgaggcgcagccgttctacgtcaattcgccgttcggcatcgtgctggcgcataacggcaacctgaccaataccgaagagctgaaagcggacatgttccgccacgacctgcgccacatcaacaccaactccgattcggaagtgctgctgaacgtgttcgcgcatgagctggcgcagcgggtcaagggccacgacctgagcgtggacgcggtgttcggcgccatcgaggcggtgcaccgccgggtgcgaggcgcctacgcggtggtggcgatgatcgccggctacggcctggtggccttccgcgaccccaacggcatccgcccgctggtgataggcgtcaacgacagcctgcccaagaccgaatacatgctggcgtccgagtcggtggcgctggactgctccggcttcacgctgctgcgcgacgtgcagccgggcgagggcgtgttcatcagcttcgacggcgaattccactcccgcccctgcgccaagcacacccgccacgcgccctgcctgttcgagtacgtgtatttcgcccgcccggactcggtgatagacggcgtgtcggtgtaccagtcgcggctgaacatgggcgagacgctggcggagaagatccgccgcgacctgccggagctggacatcgacgtggtgatcccgattcccgactccagccgccagagcgcgttgcagctggccaacgcgttgggcctgccgtatcgcgagggcttcatcaagaaccgctacatcggccgcaccttcatcatgcccggccaggcggtgcgcaagaagtcggtgcgccagaagctgaacccggtgccgctggaattcgccggccgcaacgtgctgctggtggatgactccatcgtgcgcggcaccacctccaaggaaatcgtgcagatggcgcgcgattccggtgctcggaaggtgtacttcgcctcggccgcgccggcggtgcgcttccccaacgtctacggcatcgacatgcccacccgcgccgagctgctggccaccggccgcgacgaggcggagatcgcccgcgaaatcggcgccgacgcggtgatctaccaggacctagaagccttgaaggacgcggtgcgcagcgccaatcgcgagctgcacgacttcgaaagctcctgcttcgacggcgaatacatcaccggcgacatcaccgccgcctatctggacgccatcgaatgcgcgcggctggacctgaagcagcaggaccaggcgggcagcgagcaaatgatagacctgaacctgaacgtggcggagcagaacctgatctga

SEQ ID NO: 2710 - DNA, 513 bp, Chromobacterium substugae
atgactgtgttcgactatatcgctattgccgtcatcggcggctcggtgctggtggcgctgatgcgcgggctgatcgccgaagtgctgtcgctgggctcctggctgatcgccttctggtgcgccaagcagttttcgccgctggcggcgggctttctgccggaaagcctgcccggcgagggcattcggctggtggccggcttcgtgctggtgtttttcctggtgtggctggccagcgcgctgctgcgcgtcaccctcaccggtttgctggacagcgtgggcctgggcctgatcaaccgcctgctgggcggcgtgttcggcttcgcccgcggcgtggtgctggtgacggcgctggtattgataggcggcttgagcagtttgccgcagaaaccgatgtggaggaatgcggtgctctcggtgccattcgaatcattggccttgtcattaaggccatggttgccgccgatactggcggacaacctccactacaccaccggccaggcgccggatagttaa

SEQ ID NO: 2711 - DNA, 735 bp, Chromobacterium substugae
atggcactgtccagccacgatgaactgatactgctgcgcaagcgcgcccgccgccgtctggtcggcgcgctggtgctggtttcgattgccaccgtcgtactgtggaatgtagtgggccatctgccggaacagcagatgaagcccgaatcgattgaaatcatgggcgcggcctccgccccggtgcctgcctcggcgccgctggggagcaagcataccgcgtcgggctcggcggccgaagcggcggctgcgccggccaccgagctgccggccaatctgtccaccatcaccgcgccgctgccggcggaaaaagaaacagtgaagccccaagcggcgccggcgaagccggccgtcgcccaggcggcggagcccaagcctagggaagcgaaggccgaagccaagcccaagaccgagcccaaagcggagagcaagccgcgcaaggccgacccggccgccattctggaaggccgcttcgatcccgagccgcgcccggccaaggccgaaactcacggcaaatccatcatccagctggcggcgctgtccgacccggccaaagtggacgcgctgcgcgccaaattgtccggcataggcgtcagcgcccacttctccaaggtggaaaccagcaagggcgaagtgacccgcgtgcgcgtcggcccgttcgcgagccaggcggaagcgcagagcacgctgcagaagctggcgaagtccggcatcaacggcatcatcattaacaagtag

SEQ ID NO: 2712 - DNA, 1269 bp, Chromobacterium substugae
atgaccgcaagaaagacactggacgactggctgcgctggcaggaagggctgcacctcagcgccgtcgacatggggctcgcccgggtggaaaaggtgcgccaggccatggatcttgcgccgaattgcccggtgatcatggtggccggcaccaacggcaagggttctacctgcgcgatgctgtccagcatattccgcgccgcgggattcaaggtgggcacttacacttcgccgcacatcttgcgctacaacgagcgcatcgccatcaatctgcagccggccagcgacgagcgcatcgtcgccagcttcgcggcgatagacgccgcccgcggcgagacttcgctgacgtatttcgaattcggcacgctggcggcggtgcatagcttcatcgccgagaaggtggatgtgatcatcctggaagtggggctgggcggccgcctggatgcggtcaatatcttcgagcctgccgtatccgtggtggtcagcgtcgacctggaccaccaggcgatactgggaaacaaccgcgaggacatcggcttcgagaaggctggcatctaccgggcgggcaagcccgccatctgcgccgaccccaatccgccgcagcggctgctggaccatgccgccgccatcggcgccgatctcaagctgtacgaccgcgatttcggctttacccgcatggacaatcaatggtcgttccgctgcggcggccatcagcgccacgcgctgcccatccccgccttgcgcggggcttaccagatggtcaacgcctgcgcggcgctggcggcgctggatgcgctgaaggagacgctgccggtgggcatcggcgccatcaagcagggcctggtggaggtggagtggcccgggcgtttccaggtgctgccggggcggccggcggtggtgctggatgtcggccacaatccgcacgcggtcaaggcgatgctggcggcgctgcggcagctgccttacgcggaaacccgctacgcggtgttctccatgctggcggacaaggatctggccgcggtggcggaattggcgcgcggcgaattcgaccactggctgacggcggggctggacatgccgcgcggccaaagcggcgaaaccatcgccgcggcgttgcgccaggcgggtctcgccaatgtcgaaagcttcggctctgtggcggatgcgtggtctgccgccttatctcgggccggcgacaatgatagaatcgtcgttttcggatctttccacaccgtcgccgaggtgatggaagcccggcgtcacccggtttga

SEQ ID NO: 2713 - DNA, 459 bp, Chromobacterium substugae
atgcgagaccggccgctgctgcaaccgttcgccgtcgccatgcggccgtcgcggctgtggctggcgctggtgctggcgagctggctggcctacgcgctgctgctgtcgcgctatctgccgccggcttatctgctcagcctgccggcggcgggctatttcgcctggcgcgccctgcgcgccggaggctggcggcggaacggcgcctggcagcggctggaggttgacccccagggccgcctcagcctatgcgcggccgccgagagccgggaggcgcaggtgctggacgattgcttcgtcacgccgctgctgacggtgctcaacctgcggctggagggccgccgcgtcagcctgatgctgtggccggactcggccgatgccgaatcgcgccgccagctcagggtatacctgctgtggttccatccgccgcagccatcagatacaacggaaaccacaccatga

SEQ ID NO: 2714 - DNA, 357 bp, Chromobacterium substugae
atgtacttcgtcgatcgcgccgtcgccgtcatcaaacccaagcaaccgttcctggactggctgaaccagctgccggacaccgacatgatcgatctgacgctggacagcctgcgcagcgactgcaccgccatcctgctgccggaattcgtcgagccggaagagggcgtcgcccatatcgacgaaatcagcgagcagctgttcaagatggagctcgcctcctgggacgaggacgaggcgaaatggccgaaagacctgtcgctgaaggctttctgggaatggttcgacgtggagatccattcgatggtgatggacagcgtcgacgccgacatcaccaaccacccggccaatgacctgtaa

SEQ ID NO: 2715 - DNA, 1929 bp, Chromobacterium substugae
atggccctcatcaccgtcgagaaagcttgcctggctttcggacaccacgcgctgctggacaatgtcgacttttcgctggagcccggcgaagtcatcggcctgatcggccgcaacggcgccggcaaatcctccttgctcaagagcatcgccggcgcagtgcagctggacgacggccgcatcaacatcaaaggcgacgtcaaggtggcctatgtgccgcaggagccggaattcaaccttgagcataccgtgttcgaggcggtggccgaaggcctgggcgacctgaaggcgctgctcaccgactaccaccacatcacccaccagctgacgcaggcggacgccgaccacgaacaggcgctggcgcggatggaaagcatccagcagcaactggaagcgcgagacggctggcagttcgacgcgctgatcagctcggtgctcagccacctggagttgaatcccgacgtgcgcatcggcgcgctgtccggtggctggaaaaagcgggtggcgctggcgcgcgcgctggcgtccaagcccgacgtgctgttgctggacgagccgaccaaccacctggatgtggccgccatcgaatggctggaaggcctgatcaagaattttgccggcagcgtgctcttgatcacccacgaccgccgcttcctcgacaacgtcgccagccgcatcgtcgagctggaccgcggcctgctgcgcagctatccgggcagtttcagcgcctaccagacgcgcaaggccgaagagatggcggtagaagaagagcagaaccgcatcttcgacaaattccacgcccaggaagaagtgtggatacgcaagggcatcgaggcgcgccgcactcgcaacgaaggccgcgtgcgccggctggaggccattcgccgcgaacgctcctcgcgccgcgagcgcgtgggccaggtgaatttccagctggacgccggcgagcgctccggcaagctggtggccgagctggagcacgtcagcaagggcttcggcgataaacagctgatccgcgatttcaccagccgcatcctgcgcggcgacaagatcggcctgatcgggccgaacggcgccggcaagaccacgctgctgaagctgatcctgggcgagctgcagcccgacgccggcgtggtgaaacagggctccaaactggagatcgcctatttcgaccagttccgcgagcagctggacgaagacatgagcgtggccgatgtcatcagccagggcaacgacttcgtcgagatcggcggcgccaaaaagcacgtgatgagctatctggaagacttcctgttctcgccgcagcgcgccagaagcccggtgaagtcgctgtccggcggcgagcgcaaccgcctgctgttggcgcgcctgttcacccgccccgccaatgtgctggtgctggacgagccgaccaacgacctggacatcgacaccctggagttgctggaagacgtgatcgcccagtactccggcaccgtgttcctggtcagccacgaccgcgccttcctcgacaacgtcgtcacccaggtgatcgccttcgaaggcgcgggccggctggaagaatacccgggcggctaccaggactggcaggacacccgccagcgcatggcggcgctgggcgcggcggacaagcccaaggaagccgcgccggccgctgccgccgcgccggcgcgccaggacaagcccaaggccgcgcgcggcaagctgtcctacaacgagggacgcgaactggcggccttgcctgaccagatcagcgcgctggaggcggaacaggccgagctgaaccagcgcctgctcgacccgaactgctaccgcgacaccccgcgcgaagccgtggcctggcagcagcgcatcgaggaaatcgacgagctgctgctggagaagctggcgcgctgggaagagctggaagccgcgcagcaacgcacgcgctga

SEQ ID NO: 2716 - DNA, 798 bp, Chromobacterium substugae
atggggttcacactcgcgggctggcaaggcaggcgcgtccgggcttggcgcctggccgcgtggctggcgcttgccgccgccgccgcgcacggcgcgccgctgcgcgcttgcgcctccgatatcgacttcccgcccttcgtgctgacctccggcttcgccgaaggcgcgcaaagcaccggcctcgccatcaatgtgctgcagcgggcgctgcggcgcgccggccgcgaaccggcggtggtggagcggctgccctggcgccgctgccgggagacggtggcctacggccagcgcgacatcgccatcggcgtgccgacccgggagctggacccgcggcgcttccgcgccacccaggctttcgcttccgtccacctgctctatttctattcggccaaacgccatcccgaagccccaccgctgcgcacgctggccgacctccggcgctacaccgtctgcgggctgctgggcagccgcctcgacgctttcggcatcgcgcccgagcatcaggacaccggctcgaaaaacgagcgcagcgccatcgtcaaagtcatcgaaggccgctgcgacctgttcatcgaagtcagcgaagtgatagacagcctgtccgcgcacgacgcggagctgcgcgacttgttcaacgcttccgccatccgccgcgccgccttgcccggcaacacgcccaccggcctgcatttcgaattcagccgcgcgctgaaggacgccccggcgctgcagcgctcgttcgacgccaccatccaggacctgatccgcaacggcgaaatgacgcggatgacgccctag

SEQ ID NO: 2717 - DNA, 993 bp, Chromobacterium substugae
atgagtggcaaagcagcaagatgcgcgcgtggctccgcctggctggccaagctggcggccctggccttgtccattggcctggcggcggcgccggcgatggcggcggaaatcgtctacatcgccgccaaggccgatctgccgttctgggacacggtcggcaagggcgtcagggccgcggccgaatccggcggatacacgttttcgatgctggacagcaagctcagcgcggatgcgcagctggcgaatgtgcgccaggcgatagagcggcgggcggcgggcatcgtgatttcgccgaccaacagcaaatcggcggaagacgcgctgaggctggcgaaaaaggccaacactcccatcgccatcgccgatatcggcagcaatggcggcgactacgtcagcttcgtcaagtcggacaattaccgcggcgcttacgatgtcggctcagagttggcggcggcgctgaaatcgcgcggctggactggcgccagctacggcatgatcacgatagagctgacgcgcaaaaacggccaggaccgcaccgacggcttccgcgacgcgatgaaggatgccggcttcgcgtccgaagccgcgttgcggcagatgaaggactactcggccgaggaaagttaccgctatgtcagggagattctcgcggcgaggccgaagatgcgcggatttttcatcgaaaccgatcagccggtggagggggcgatgcgggcgatacgcgaggccggcaagagcgggcaggtgctgctggtttcgttcgacgcgatgccagaggtcgcgcgtctgctgaaaagcggcgacttgatcgcggtcggcatgcagcagccttatctgatgggcagcaccgccgccggggcgctgctgtcctcgctacgcggccaccagccggcgaaggaaattctggtgcccatcctggtggccaccggccgcaacgtagaccagttgatgccgatcgcggcgcggacggtgttcggcagggcgggcaagtga

SEQ ID NO: 2718 - DNA, 651 bp, Chromobacterium substugae
atgcccgttcatgcggccgcgccgccagatcgcgcagaaatcgccaagcgccgcatgaacctgacaggagtccaagcctcgatgaaagaagatttaccgatcgaaaccggcccaagccgccgccgtttgctgcagagcgcggcattggccggcctcgctgccctgctcgccgcctgcggcaccaccccgccgcagaaaaccagccagcgcccgccctaccgccccggcaaacccggaggcgatgtctcgctctccaatctgcaggcggatggcaacggccgtgaaatcctgctgtacaccataggcttgctggatggcggttaccagttcggcggcaataacccggaagccggcctcgactgcagcggcatggtcagctacatctatcaaaacgccgtcggcatcaagctgccgcataacgccgccaagatcgccggcctcgcccggcccatcccggacagccagatgcaggtcggcgacctagtgttcttcaacaccatgagccgcccgttttcgcatatgggcatcttcatcggcgacggcaagttcgtccatgcgccgcgcaccaacagcaccatacgcgtggcccgtctggacaatgtctacttcgcgccccgctacgaaggcgcccgcaccgtattgcgcacctga

SEQ ID NO: 2719 - DNA, 831 bp, Chromobacterium substugae
atgaaactgaaattcagcaagatgcacggcctgggcaacgacttcatggtcatcgatggcgtcaggcaggccgtggcgctcacgccggagcgcatccgccaactaggcgatcgtcagatgggcataggctttgatcagctgctgctggtggaggccccgcgcgaggtcggccatgatttccgttaccgcatcttcaacaacgacggcggcgaggtcgagcaatgcggcaacggctcgcgctgcttcgtcaaattcgtctgcgacgaggggttgagcgacaagtccgggatcgcggtggaaaccgcgcgcggcgtgatccgccccgaatatctgggcgacggcatggcccgggtggacatgggcgtgccccgcttcgcgcccgtagacatccccttcatcgccgaacaggaagcgctgagctatccgcttgagctggaagacggcccatgcgtcgtcagcgtcgcctcgatgggcaacccccacgccgtgcagctggtggatgacgtggacaccgccccggtggcggccatcggcccgcaagtggaaagccacccgcgcttccccgagcgcgtcaatgccggcttcatgcagatcgtctcgcgcggcgaggtccgcctgcgcgtctacgagcgcggcgccggcgaaaccctggcctgcggcaccggcgcctgcgccgcggtggtgagcggcatccgcctgggcctgctggacgcgcgcgtgctggtccacgcccgcggcggcgacatggtgatcgaatgggccggcgctggctgcccggtgatcatgaccggccccgccgtcacggtttttcagggcgagatagaactttaa

SEQ ID NO: 2720 - DNA, 651 bp, Chromobacterium substugae
atgcacagcgaacaggttctggcttttctcgatgaacaccccgacttcctgcagcagcatgccgctcgcctcaacctgcaggccgcgccgcagaacggcgaacgggtggtgtcctttgtcgagcgccagttgctggagctcaaggaccagaatcgccaactggaagcgcagctgcagcagctggtcgagcgcgcgcagaccaacgagcgcactgtcgcacggctgcaccgcctgacgctgggcctgctggccagccgcgagctgaagccgcaaatcgaggcgctcaagcgcagcctgcaccaggagtttcagctggaccgcgtcgcgctgaggctgtggcacccggcggcggaaagcgaggccgggcattacaacgcgcagaacgacgtgcaagggctggcgcgcaatctcaccacgccctactgcggcccctatgtcaacgacgaggtgatgagctggttccccgccacccccgtgctgcagtcattcgcccaggtggcgctgcgcggatcggacggccaggctttcggcctgctggtgctcgccagcgacgatgcgcagcgcttcaccttcgacatgcatacccagtacctaagccagatcggcgaagtcctgtccgccgccctgctgggcgcgctggaggctaaatga

SEQ ID NO: 2721 - DNA, 570 bp, Chromobacterium substugae
atgacggcaacgccggtcggagtatcgctgctgctggtcgtgctgctgttcttcctgcatgcctcatggcggctgatcgccagccgcagcggcagcgccatcgcctgctttctggccgcttacgtgatgctggcggccctgctgaactgccaccccgagcctatctcgttgaccccgctgctgctgcccttcatctacgcctatgcttggctgggcatcgccgcggcgctgtgggcggcggtgatgatgcgggtgacgcgcaaggcgctgctgtttccggggcaagacaaacggctggccgcgctgttctccagccagctggctttgcatgtcggcgtgtttggcctgtcgccgtggctggattggcggccgctggccgcttacgcgatggcgccgccgcttctggccttcgtcagctacttcgcctatcgcgcgcagctgttggccatgcgccggcgggaggattgcggcgcgtcttgggtatcctggggcgccatgtgcctgttgttgccgttgatcctgatgtggctggcgcaatggctgactcccgccatcctggatctgacctga

SEQ ID NO: 2722 - DNA, 948 bp, Chromobacterium substugae
atgtctgcccgctccacctcccgcaacgcctatctcctgctggtgctgaccatgttgatgtggtccaccaatttcgtcatcgcccgcgcgctgcatagccaggtcggcccgttcacgctggccttctcgcgttggggcatcgcgctgtgctgcctgctgccgttcgcgctgccgcgtttgcgcggcaatttggcgaagctgcgcgcgcagtggcctttgctgttgctgctgggcgttttcggcataggcctgaccaataccttcgtctattgggcggtgcagaccacatcagccaccaacgccgtgatcctcaacagcgcgacgccggtgatggtgctgctgctgggttcgctgtattttcgccagcggctgagccgccgccagtggggcggcatggcggtggcgctgtccggcgccttgctgatcgtgctgaggggcgatccggcagccttgtccagcttccatttcggcggcggcgacctgctggtgctggccggcggcctgagctgggcgatttacacgctgggcctgcgcaaactcaagccgggcatagactcgctggtgctgatgagcgtgctgctggcggtgggcgagatgctgttgctgcccttgttcgccgcggaggccgccgggcgggggctgccggcgctggacggccccgcgctggccagcctgatttatctgggcgtgctgccgtcggtcgccgcctatctgatgtacaaccgcgccatcggcatggtgggcacggcgaaggcggccagtttcctgtatctgatgccggccttcggcgcgctgcaatcgatctggtttttgggcgaggagctgcacaggtaccacgctgccggcctggctgcgatcttcagcggcatcgcgctcagttcgctcacccgcagccgggcggccacggacacgcaagctacggtgcgacggcaagagccgcaaacctga

SEQ ID NO: 2723 - DNA, 801 bp, Chromobacterium substugae
ttggcgggagcgatggcgatgacaccggtgcacacttggcttggcgcgcttctggcgtgtctgttcgtcttgccggctcgggcctgcgacggcgcgccggcacccgacagcgcggccgcagtcgacgcgcccgacttgcaaggcatcgcggtgtatctgcccaaagtgctggagagcagcgattccgggcctttcgccgacctgctgaaagtcgtcggccgccattatccggccgggcggatacgcttcagcatcgagccagtcaagcgggtgtacttggacacctccgacaaaagcgtggatttccgttttcccatcatgaaaatccgcgaaggcgccgatcggggcacgccgttccagttttcccatgaaatgttgggcaaggtcagcttcgtcatctattccaacaaggaaaaaccgttcggcaaggccgacctgctgcggatggccacgctgcccaagtacgaggtggcgatacacgcgccgccggccagctgggactttcccgccagtcgggtgatcaatctggagctgtcgctgaaacagctgaacctggggcggatagacgcggtgatatgggcgcaggaggatgcggactacctggtgcgcaaggacggactcggccatatccatcgcgagcatctggacgactatccggatgtgctgttcttctcctgcaacaagcgcggcgacttcgtcaaccaagcgatgagcgcggcgatacgcgccgcccgggatagcggcgaactgcagaaggcttacgccaaggtgcatcagccttatcaggactggcagccgtga

SEQ ID NO: 2724 - DNA, 612 bp, Chromobacterium substugae
atgagtctgcgacgatggagcggcgccggcatgctgttgctggcgctggcaggctgcgcgtcgccgcaagcccgcttttacagcctggaatccgcgtccgccgcatccggcgagccggcgcaattcggcaaacgcgtgatgttggggccggtaagcctgccggcggcgctggacaggccgcaattggtgctggacgacggcggcggccggttgcggctgcaagagttcgaccgctggagcgcgccgctggaccggctgctggcgcagagcctgacgctggcggtgtcgcgccgcagcggcgtcgccagcgtctacgcctatccgcagccgacaatggacggcggcgacctgcgctacgcgctggacgtgcggcggctcagcctgcagccgggacgccaggctgcgctggaggtggtgtggcagttgcaaggcgtgtccgacggcaagctgctggccgccggcagcttcagccgcagcatcccgctggccgcccccggcgtcgacgcggcgctggccggcctgcaaagcctgctggacgccttgtccggcgaaatggcgcagccgctgcgccagcatcctgaatggtggcagccgccggccggccgctcctga

SEQ ID NO: 2725 - DNA, 1626 bp, Chromobacterium substugae
atgagcagtgaagaaccggtagaaccgcaaggccaggagccgcaactgccgcaggccgtggtgttgaagcgccgccgctgggcgccgtcactggtgtggctgatccccgtggtggccgcgctgataggcggctggctggccgcgcacgccatcatgtcgcgcgggccgaccatcaccatatcctttcagaacgccgaagggatagaggccggcaaaaccagaatcaaatacaaggatgtggaaatcggcgaggtgacggcagtggcgctgagcgccgaccgccagtccatcctggccaccgccgaactgagcaaacaggccaacgactacctcgcggcggacagccgcttctgggtggtgcggccgcgcgtctccggcggcggcgtgtcggggctgggcaccgtgctgtcgggctcctatatcggcatggacgtaggcaaaagcttggcgcgcaagaccgaattcgtcggcctggaaacgccgcccatcatcaacgccgacctgccggggcagactttcttcctgcgcgccgacaacctgggctcgctcaacaccggctcgccggtgtatttccgccgggtgccggtgggccaagtagtggggtacgaactggaccagaagggcagtttcgtgcgcgtcagcgtgttcatcaacgcgccttacgaccgtttcgtcaacgccaacagccgcttctggcacgccagcggcgtcgacgtgtcgctgagcgccaacgggctgaacgtcaacacgcagtcgctggcggcgatcgcgttgggcggcatcgcctttgaaacgccgctgtcggacaatgccgccatccctttgtccgaccgcaatttcatcctgcacgacacccgcgataaagcgttgcagaaccccgaccgcgaaatgcaggccttccgcctgcgcttccgccagtcgctgcgcggcttggctatcggcgcgccggtggacttccgcggcatcatcatcggcgaggtgacggcgataggcgtggaatacgtgccggaacgcaaggacttcgacatgacggtggacatccgcacctaccccagccggttggacagcctgtcgcacggctcgcgcatctcgcgcaagctgtcgtcgcaacagctggtggccaacggcatgcgcgcgcagttgcgctccggcagcctgatcaccggtcagctgtacgtggcgctggacttcttccgcgacgcgccgccggccaagctggtggtgcgcggcggcatcgccgagctgcccaccatcccgggcgatctggaagagctgcagcgcgtgttgcagcgcatcgccaaaaagctggacgcggtgccgttcgacagcataggccaggagatggacgcctcgctgaagtcgctgcaccagacgctggacagcatgcgcaagctgtccgacggcatcaacggcgaaatgctgccgcagacgctgaagacgctggagcagctgcagcagacgctggacgctacccggcagaccatgaaggcagactcgccgctgcagcaagacgtgcgctcggcggcgcaggaagtgaaggaaaccgcgcgcagcttccgcgcgctggcagactatctggaccgccacccggaagcgctggtgcggggcaaggaggcgcagccatga

SEQ ID NO: 2726 - DNA, 636 bp, Chromobacterium substugae
atgccaggctacggaatgaaaagcgcggcggcgcgcaacctggcgctgtgccacggctgcggcctgctatgccggctggaggccggcgccgccggcgtttgcccgcgttgcagggcgccgctgcacctgcgccggccggcggcgctgcagcgctgctgggcgctgctgctggcggccatcatcagctatttgccggccaacctgctgcccatcatggaaaccaccgcgctgaccggcgtgcagcgcgacaccatactcagcggcgtggtctatttgtggaacaacgactcctggccgctggcgctggtggtgttcaccgctagcgtgctggtgccgttgctgaagatactggccttgctgttgctgctgtgcagcgtgcaatggcgctggtcatgggcgccgcggcagcgcaccgggctgtaccggctgatagagctgatcgggccgtggtcgatgctggatattttcgtggtggcgctgatggtggccctggtgcaatggcagtcgctggctagcatcaaggccggcgccggcgcggtggctttcggcgcggtggtggtgctgaccatgctggccgcaatgagtttcgatcccagaatgatctgggatcccgtagaggaagaagatgagcagtga

SEQ ID NO: 2727 - DNA, 636 bp, Chromobacterium substugae
atggccgcagtgacgccgccgcgcgggccgctggccgcctgccatgattgcgatttgctgctgcggctgccggccgccgccgccgaccgcgcctgcatccattgcccgcgctgcggcgccttgctgcacgagcaggccgacggcgcgctgcatgccggcgcggcgctggcggtggccggcgcggtggccttcgtcatcgccaacagctacccggtgctggtcttggaaatcgccggcaaccgcaacgccgccacgctgtggcagaccgcgttggcgctgcaagggcaggggatggcggaagtggcgctgctggtgctgttcaccggcatcgtgatgccggcgctggagctggccagcatgctgtacctgctgctgcccctgcagtacggacgcgcgccgccgggctttgcggcggtgatgcggctgcggcagctggcgcggccctggtgcatggtggaggttttcctgctgggggtgctggtttcgctggtcaagctggtgcatctggcggcagtgcatcccggcatcgggctatgggcttttttcggtttgatcgtgctgatggcggcttgcgccagccgcttcaagccggtgcaactgtgggagcgctaccaggcatgccaggctacggaatga

SEQ ID NO: 2728 - DNA, 240 bp, Chromobacterium substugae
ttgcccaatgtcgggccgcgcgcggctgccgatctggaacgcctgggcatccaagagccagggcagctgcgcggccgcgatcctcatcagctttatctggagttgtgcgatagaaccggccagcggcatgatccctgcgtgctggacgtgatgctgtccatctgccattacatggacaccggcgaagctcgcagctggtggagcttcaccgcggagcgcaagcgccgatggccgcagtga

SEQ ID NO: 2729 - DNA, 765 bp, Chromobacterium substugae
atgttgttgagcttgagttttttgtgcgtgatcgctttttttgccggactggtcgacgccgctgtcggcggcgggggcttgatccagattccgggcctgttcagcgccttgccgaatgtggcgccggccaccttgttcggcaccaataagctggcgtcggcggtgggaaccttgtcggcggcgcgctcctatctgcgtcgggtgcggttgccttggcgactggtgctgccttgcgcggcgatggccttcgtgttttcgttcgccggcgcccaggtggtggcgctgatacccaaggacgtgatccggcccttggtgctgaccctgctgctgatcatggcagcgtacacgctgtggaagaaagatttcggcaagctgcacaagccggtggcgataggccggcgcgagttgctgatgggcatggcgataggcggcgccatcggtttttacgacggcctgttcggccccggcaccggcagtttcctgatgttcctgttcatccgctttttcgccttcgacttcctgcacgcctcggcggcggccaaggtcgtcaatctcaccaccaatgtggcggcgctgctgtccttcgccatcggcggccatatcctgctggcctacgcgctgccgatggcggcggccaatatggccggcgcgatggtgggcacgcgcttggcgatgaaaaagggcgccggtttcgtccgcatcttgttcttgatgctgaccagcgtgctgatctgcaagctgggttgggacattctgcgcggctga

SEQ ID NO: 2730 - DNA, 915 bp, Chromobacterium substugae
atgaagccgctatggggagtcaggatattttgcgcggtggtggagcgccgaagcttcgtcgccgccgcgcgccagctgggcacctcgcccagcagcgccacccgcgcgctgcaggcgctggaagaggaaatgggcgcggcgctgctggcccgatccagcaagcaggtggagctgaccatggccggcgaggcttattatcctatcgcccggcagatgctggacctgcagcagcaggcggaagaggaactcaatcagcaagtcgccgcgccgcgcggcctgctgcgcttctccgcgccggaaacgctggggcgcggcatcctgccgcgggtgctggcccgcctcgccgaggaaaacccggacctgcgcttcgacgtgctgtacagcgacgccacgctggagccgattcgggaaaagctggatttcgccatccgcggcgcgtttcccgcctccagcgaactgataggctatccgctatgggactaccggcgccatctatatgccagccccgcctacttggcgcgccacggcgcgccggccagcccgcgcgagctgcctgagcaccgggtgatcatccacaccgcgccgcgcgtgctgaaagcctggaacttcgtcagcgcgggcagccagatcagcctcaacctcagcgcctggcaccgcagcaactccggcaacggcgtgctggaggcgattcgcgccggcatgggcatcgggaggctgggagactggttggccgagccattggcggcaaacggcgaactggtccggctatgtcctgagtttcgcatcgtctccagccatggcgacgatccgcaaatgcacgcggtgttccccagccgcaacattccgcgcaaggctcgggtgctgctggatgcgctgcgccaagaggggcgcgccgcggcgatacccgcgccatga

SEQ ID NO: 2731 - DNA, 1842 bp, Chromobacterium substugae
atgttcgagtttgtccagaacaacaaaaccgtcattcaagtcatcctgggggctgtcgcgctgactttcgtcggcttcggcgtcagcagctacagcgacgtcaccgcagacccctatctggtcaaggtgggcagcgtcaagatatccaagcgcgatcttgatcgcgcgctggagggcaagcccagcgatccggccacccgtcaggccgctttggaggaaatgatccgcaacaagctggtcctggccgacgcccgcgatcatggcgccgccatcagcccggaccagctgcgcaaagtcatcgcctccattccgctgtttcaggacaacggccagttcagcccgcagcgctatgaggagtttctgaaaaaccgctatcgctccgccgccgatttcgaagccgaaatcagcgaggacatgctgatcaggaaccagctgacagccgtcgccggcacccagttcgtgtccaacaccgtggtgacccgcatggcggcattgctgggcgaaggccgcgtgctgcagccgctgacgctgaagccgtccgatttcgccgccgaagtgaaaaccgacgacgcggcggtcaaggcctactacgacgccaacgccaagcgcttccgcacgccggaaagcgtcaagctggattacgtggtgctgtcgcaagacgcgctggcgcaaagcgtcaaggtgtccgacgccgacgtgcagaagtatttcgatcagcacaagtcggacctcgccagcgagcagcgccgcgcctcgcacatcctgctgacggtgccgaagggcgcaaaacctgagcagaaggccaagatcaaggcggaggccgaggccattctgaaggaagtgcgcgccaatccgggcaagttcgccgaaatcgccaaggccaagtcgcaggatccgggctcggcggagaagggcggcgatttgggtctcaacgcgcgcggcatgatggtcaagccgttcgacgacgccgtgttctcgatgaagcctggccagatcagcgacctggtggaaaccgactacggcttccacatcattcgcctggatgcgatcaagacccaggggctggaagaggccagggccgccatcgtcgacaaactgcagaagcagaaagcttcggccctgttccgcgaacaagcggacaagctgaacgaagtcgcttaccagcaggccgactcgctgaagggcgtggtcgatgcgctgaagctggaagtcaaacactccgactggctgcagcgcaatcagccgggcaaggatgagctgctgggcaacgacaagttgctggcggcggtgttcagcgacgatgtgctgaagaaaaagcacaacagcgaagtcgtggatgtcggcggcggccgtctggtggtggcgcgcgtggccgagcatcagccagagcgccagcgcccggtcgcggatgtgcgcgaagacatcaggcgcgaactggttgagcgcgaaggcgccaagctggccgacaagaaaggccaggcattgctggccgagctgaaggctgggaagggcgtggacgcgcagaagtggggcgccgagcagacggtatcgcgccgcgcgtctggcggcctgccgatggccgatgcgcgcgtggtgttcagcgtggccgcagccaagctgccggggttcgccggcgtgcgccacgataccggcgagtatgtgatttaccgcgtgaacaaggtgattgcggctcccgctgtcagcgaagccgatcgcgcccagctgggcggggtgctgggagagatctccgccaataaccaattgggcagctatctgcaggcgctgcggcagaagtacccggtgacggccggcaagcagtcgctgaacgacaatagccagtaa

SEQ ID NO: 2732 - DNA, 74 bp, Chromobacterium substugae
ggagcggtagttcagttggtcagaataccggcctgtcacgccgggggtcgcgggttcgagccccgtccgctccg

SEQ ID NO: 2733 - DNA, 73 bp, Chromobacterium substugae
gggcgtttagctcagttggtagagcgtctgccttacaagcagaatgtcggcggttcgactccgtcaacgccca

SEQ ID NO: 2734 - DNA, 270 bp, Chromobacterium substugae
gtgaacaagtctgaactgattgacgccatcgcggcagaagccgacatttccaaagccgctgccgcgaaagctctggacggcatggttgctgccgttaccgacgccctgaaaaaaggcgataccgtgactctggtgggtttcggcaccttctatgtgggcgagcgcgcagagcgtagcggccgcaatccgaagaccggcgaaaccatcaagatcccggctgcacgttctccgaagttccgtgctggcaaggcactgaaagacgcgctataa

SEQ ID NO: 2735 - DNA, 1308 bp, Chromobacterium substugae
atgcaagtacagctggaaacactgagcaatcttgaacgccgcatggacatcgccctgccgatggccgccattgattcgcaaatcaccgagcgcctgaagcgcgtggcccgcagcgccaagattcaaggtttccgcccgggcaaggcgccgctgaagatcgtggagatgaactacggcgcccaggtgcgtgaagaagttatgggtgaacaggttcagcaaggcttctacaaggccgtgaccgagcagaagctgcgcgttgccggctacccgcgcttcgagccggttgccgctggcgacgacaaggaaaacttcaagttcgccgccactttcgaagtgtacccggaagtgaaggttggcgagctggcgggcaaggaaatcgagaagccggccgtcaccgtgggcgacgccgaaatcgagaagaccatcgacatcctgcgcaagcagcgcacccgctacaaccgcgttgagcgcgaagccgccgtcggcgaccgcgtgatcatcgacttcaagggcgccatcgacggcgtggccttcgaaggcggctcctccgagaacttccccttcgtgctgggccaaggccagatgctggccgaattcgaagccggcatcgtcggcgccaaagaaggcgacatcaagagcgtggaagtgagcttcccggctgattaccacggcaaggacgtggccggcaaaaccgccgtgttcgaaatcctggtgaagaacgtggccgaagccatcctgccggaagtgaacgaagagttcgccaagatgctgggcatcgccgaaggcgacgtggaaaaaatgcgcggcgaaatccgcaagaacgtcgagcgcgaagtgaagcgccgcctgcaggcccgcaccaaggaaaacgtgatgcaggcgctgatcgacgtgaccgaaatcgaactgccgaaggcgctggtcggcctggaaatcggccgtctggtcgagcaggcccgtcgcgacatgcagcaacgcggcatgaacgtcaaagacatgccgttcccgccggagctgttcaccgcccaagcggaacgccgcgtcaagctgggcctgatcctgtccgaagtggtggaagccaacaagctggaagccaagccggaacaggttcgctcgatgatcgtcgaattcgccgacagctacgaagagccggaagacgtgctggcctggtactacgagagcgccgaccgcctggaaggcccgacctcgatggtgctggaagacaacgtggttgaatttgtgctgtctcaggccaatgtagtagagaaggcgctgtccttcgacgaactgatgggcagccaagcctga

SEQ ID NO: 2736 - DNA, 327 bp, Chromobacterium substugae
atggtgcggatcgggtttcgggcgggagtcggctgtcgggcgtgtcattctgaacggatatttttcttgtcttggctggcaattcgcatgatgcggaatcatagcagatggctggccgggccgggagcggcgcggcgaaattgtccagcaatatcaaacggcaagcgaaaggccggcgcggcgcctgggcgccaaggccggtccgggcgggctggcggcgcccgccgctggcgggtcgggcggcccgcgcgggggcagacaagcgcgaggtgcgtgatatactgtgcgtttcgttgggtgcgcggtgtaactccgcgcagcgcctga

SEQ ID NO: 2737 - DNA, 5739 bp, Chromobacterium substugae
atgacacgcccgacagccgactcccgcccgaaacccgatccgcaccatggtgacgccatgaaaacaccgctgcgcccaggcctgatcgccgcctggctgctcctgcccggcctttgcgccgccgccggagtcaccaccttcagcccgcaaggcgaagtgaaggaagtcacccaggtacgcgccaccttcaacagcagcatgatcgcgctgggcaacagcgctgcgccggcgccgttcgcctggagctgcggcttgaagggcaagggccactgggtggacgacaagacctggacgctggacgtgcgcgaaacgccgccggccaatactgattgccgcttcacccccaagcctggcctgaaggacctgcagggcaacgccgtagcatcgggccaaagctaccgcttctacaccggccagcccatcatcgccgcaagctggccttcggatggccgcatcgaagaagaccaggccttcgtgctgcgcttcaacgccagcggcgtcaagcccgcggcgctgtattgccagtcgtccagcctgcccgagcgcattccggtgcgaacgctggccgcggccgaccgcgccgcgctgctcaaacacctgaaactggaaaaacaggccgccaacgtgctgaccgtgcgctgcgaccagcgcctggcgccggacagcaagctgacgctggtgcacctgcgcggcgccagcgcgccggacaagcagcaataccaggtgcggccggcctttgccgccagcatgagctgccagcgcgaaaacgccaaaggcgcctgcattccgttcaagccgatcacgctgaatttcagctcgccggtgccggccaagctggcccaggcgatccggctgtccggcggcggcgccgagcgcgcgccgcaagcggagcagcgcaacaagggcgagccggtggacaacgtcagcttcgcaccgcccttcccgccgctggcaaccctgaccctcgcgctgcccaaggacttccgcgacgaagtgggccggcagccggtcaacgccggccgcttcccgctgtcgatcaaactggccgactacccgccgctggccaagttcgcggccgcgccgttcggcatcatcgaatccggcgccgacgccgccctgcccatcacgctgcgcagcgtggagggcgacctcaacatcaagtcggtgcaactgggcgggcaggcgctgcgcctcagccgcgacgccgacatgatggcctggctggccaaggtggaacgctaccatgagagcaatctgccggccggcaaggacaagacggtggaaagccggcgcgtgtcgctgctgaacaagaaccgcgacgccgtgccgctcaagctgccggccaagcccgacggcaacggcaagtggccgttcgaggtggtgggcatcccgctgcccaagccgggcctctacgtggtggaggtgtcgtcccggctgctgggcaaatcgctgctggccgccaacaagccgatgtacgtgcgcaccgccgcgctggtcaccaacctggcggtgcatctgaaaaaatccggcgaaaacgccgcggtctgggtcaccacgctggacaagggcaagccggtgcccaatgcccgcatcaacatctacgactgcaagggcaacgcgctatggagcggcacaacaaacgcccagggcagcgcgctggccaagagcgcgctgccggccggcgattgctccgacgaagaactgtccggcctgttcgtcaccgcccgcgccaaggacgcgcagggcaacgaagacgtgtccttcgtccgctccagctggaaccgcggcatagagtcctggcgcttccccttcccgacccagggcggcgacggcccggccatcatcgcccacagcatcctggaccgcgcgctgttccgcgccggcgaaacggtgtcgatgaagcacctgctgcgggtgcaggccggcaagggcctggcgcagctgaaacccggccagctgccgcagcagctgcgcatcgtccacgacggcagcggcgacgaagtcagcctgccgctgacctggcgcaagggccgctacgccgaaagcagctacgcgctgcccaaggaggccaagctgggcgaatacacgctgtatctggaacgcaagggcactcgcggcccggccgaccaaggcaagccgtccagcccggagctggacggctactcgctgcaaagcggcagcttccgggtggaggaattccgcctgccggcgatgaccggccgcatcgccaccgccaagaacgccggcatcgccccggcgcaggtgccgctcaatgtttcgctgtcctggggcaacggcggaccggccaaaggctggccggtggaagtcagcgccatgctggccgacggctaccagcggctgaaagcctacgacgacttcagcttctcgccgccgcagcgcagccgcgaaaacagcgaggcctcgctggacggcaaggtggtgctggacaaagccgccatccagctggacggcaacggcaacggcaaggccatcgtcgacaagctgcccaagctggaccgccgctacgacctggtgaccgaagccgcctaccgcgatcccaacggcgaaacccagaccctcacccgccgcatcgcgctgtggccgtccgccgtgcaggtgggcatcagcgtggacagctggatcaccgccggccgcgccttgcagatgaaagccgtggcgctggacaccgccggcaagccgctggcgggcaaggacatcaaggtcaccctgcgcgagcatcgctacctgtccagccgcaaacggctggtgggcggcttttacgcctgggaccacaacgaggaaaccgacgacaagggcaaggtgtgcagcggcaccaccgacggccgcggcctgatctactgcgagctgagtctgaaagacgccggcgacatggagctgatcgccgaagccaaagatgagcaaggcaacgtcgcccgcagctcgcaatcggtatgggtcagccagcacgacgagctgtggttcgatgtcgacaacaacgaccgcatcgacgtgctgccggaaaaaaccagctacgcgcctggggaaaccgcccgcttccaggtgcgcatgcccttccgcaaagccaccgcctgggtggcgatagaacgcgaaggcatcctggaaacccgcgtggtggaactggaaggcaagaacccgtcgatcgaactgaagatcgcgccggactggacgccgaatgtctatgtttcggtgctggccgtgcgcggccgcatccgcgacgtgccctggtattccttcttcacctggggctggaagagcccgtcggaatggtgggacgcctactggaacgaaggcggcgactacgcgccgccgaccgcgatggtggacctgtcgcgcccggcgttcaaatacggcatcgccgaaatccaggtcggcgacgccgccaagcgcctgagcgtggaagtgacgccggccaaaaaaacttatggcatccgcgaaaccgccgacgtcgccatcaaggtgaagctgcccaacggcaagccggcgccggccggcaccgaagtggctttcgccgcggtggacgaggcgctgctggagctgcagcccaatcacagctgggagctgatgcaggcgatgtaccagcggcacagctacggcgtggaaaccgccaccgcccagctggaagtcgtgggcaagcgccactacggccgcaaatcgctgccgccgggcggcggcggcggcaaggcgccgacccgcgagctgctggataccctgcttacctggcagccccgggtgacgctggacgccaacggcagcgcccgcgtcaaggtgccgatcaacgacgccctcacccgcttccgcttggtggcggtggccgatctcggcaatgaccagttcggcaccggcgaagccggcttcaatgtgacgcaagacctgcagctgacgtccggcatcccgccgctggcgcgcgaaggcgaccagttccaggccggcgtcaccgtgcgcaacggcggcgacaagacgctgaacatcaaggtgcaagccggcgcgccgggcctgccggcgctgcccgcgcgccagctcgcgctgccggtgggcgaatcgcggctggtgagctggccggtgaccgtgcccagcgacatcaaggagctgaagtggacgttcagcgcccagcaagtggacggcaaggccgccgacaagctggcgatcagccagcggatcgacccggcggtgccggtgacggtggaacaggccacgctgcaacgggtatcgcctgagctgtccatcccggtggcgctgccgccgggcgcgctgcctggccgcggcggcatccgcgtcagcctgcaggccaagctcggcaacagcctgcccggcgtgcgccgctggttcgaggactacccctacgcctgcctggagcagcgcagctcgatcgcgctcggcctgtccgaccgcaagcgctgggatcagctgatgagcgagctgccgctgtatctggacggcaacggcctcgccgcctacttcccgctgggcgaaggcgcgccggaccgcggcagcgacgtgctgaccagctatctgctggccgtcgccggcgaagccggcatggaaatcccggaaagtccgcgcggcaagatgctggacggcctgtccgccttcgtcgagggccgcctcaaacgcgatctgcctatcaaccgccaggacgccgacgcgcgccgcctggccgcgatggacgcgctgtcgcgctacggccgcttccgcccggccatgctggacgtgctggacctcaatccgcagaagatgagcacttcgatgctggcggactggctgtcgctgctgaaccgcgcggccgacatcccgcaacgcgccgcccgcatcagcgaagcgtccaacctgctgcgcgcccgcctgacctaccagggcacccggatgggtttcagcaccgagtccggcgacaacgcctggtggctgatgggcaacggcgacgtcaacgccgccaagctgctgctggccgtccgcaagctgcccgactggcaggccgacatgccgcgcctgctgaccggcctgctcgcccgccagcaacgcggccactgggacaccaccaccgccaatatgtggggctcgctggcggtggcgcagttctcccggcagtttgagaacgcgccggtgagcggccagacccgcgcgctgctcggcaaatccagcctcagcctcgcctggccgcaggaaggcgtcaaacagctgggcctgctgccgtggccggctggcggggccagcctgcagctcaagcacgccggctccggcgcgccgtgggccaccatccaggcggaagccgccatcccgctgaaaaccgcgcgctacgccggctacagcatcaagaagacgctgacgccggtcagccagaaggtgggcggccagtaccagcccggcgacgtggtcaaggtgacgctggaaatccgcgcgcagaacgacatgagctgggtggtggtggacgacccgatcccggccggcgcggcgattcagggcagcggcctgggccgcgactccgccatcgacgccaagtccggcaacggcggcgactacgccgactacatcgagcgccgcttcgccggctaccgcgcctactacagctacgtgccacgcggcgagttcaaggtggaatacacgatgcgtttgaacaatcccggcgccttcaagctgccacccacccgggtggaggcgatgtacgcgccggaggtgttcggcatggcgccgaacggggtgttccgggtgatggacggacaatga

SEQ ID NO: 2738 - DNA, 696 bp, Chromobacterium substugae
atggacatcgaacagatcaaaaccctgctggccaaacccatcgccaaactgaccgccggcggctttcgccccacttatcaggaaacggaaagttggctgggcaaggtgtcactatttgcgcctggcgaagccattccgctcgacgatgcgggcaagccgatgctgccgctagcccagctttgcattccggctctgcctgtcatctcgccgcggcttgccgataccaggcttttgacggtattcatttccgccacgctgccagaaccattcgaagcgatgggggccaactggctcgtcagggaatatgggcatggcgatttgctgatccgccaggatttcctgcctcagggccccagcctgaaagcctttccgctgcaagcggagcgcatcgacgaggactatccgctatgggacagcggcgacattcccctggagctggagagtgagatcctccgccaggaaagagccggcaagatcgctggctattacgatttgacctgccacacctatacacacaaaattggcggttatccttcttattaccagtcgggcgtgggtcttggcgaaggttttgaatttgttttccagattgcgtccgactccaaaatccatctcaacatcatcgacaacggctgcctgatgttctggaagcacaaaaccactggccaatgggctctctactacgatttttattga

SEQ ID NO: 2739 - DNA, 2214 bp, Chromobacterium substugae
atgccgctgaacgactcatcccatcacattgcaccggccaggaagctcgcgccggccccctcggctcgccgccggccaaagctgtcgctcgtcctgctcgccctcctctccgcccccgtctgcgcgcagcccaccttcaaggaagtgaaagccgcctggcagccgtccgacgtgacgctgctggaccgccacggccaggtgctgcagcggctgagggtggacaaacaggcgcggcggcaggattgggttggcctggccgacacctcgcccgccttccgccaggcgctggtgctgtccgaggacaaacgcttctaccagcacagcggagtggactggtccggcgcggccgcggcggcctgggccaacttgtggaacacccgcacccgcggcgcgtccacgctgaccatgcagctggccggcctgctggacgatgatctgaaagccggcaagggcgggcgcagtctatggcagaagatggggcagacctggtccgccgcctggctggagcggcactggagcaaggcggagattctggaggcctatctcaatctggtggggttccgcggcgaattggtggggctgtcctcgttgtcgtccacattattcggcaaattgccggcggggctgaatctggaagagtcggcgatcgcggtggctttgatccgcgcgcccaatgccgcgccggacaaggtggcgggccgcgcctgccgcattttgcaggacatgggccgcaagcccgactgcggcgtcgtcgccgtccacaccgcgcaggcgctggccaaaagccgcgccgccaacccgctggccgaacaggacgcgccgcacttcgcgcaaaagctgctgcaaaggcaaaagctggcggccggcagccgggtggccaccacgctggacctgccgttgcagcgctatgccagcgccgcgctgcgccgccatctggccgcgctgtcgcaacgcaatgtccaggacggcgcgctggtggtgctggacaaccagagcggcgacatcctggcctgggtgggttccagcggccgcggcctgtccaatgccgcccaggtggacggcgtcacctcgctgcgccaggccggctcctcgctcaaaccctttctttaccagatggcgctgcaacagcgctacctgaccgccgcctcgctgctggacgacagcccgctggacctgcaaaccggcgccggactctatgcgccgcaaaactactcgaaagatttcaagggcctggtgccggtacgcaccgcgctggcgtcgtcattgaacatcccggcggtgcggacgatagaaatggtcacccccaacgccttccgcgaccggctggtccagctgggcttcgccagcctgaccgaagacggcgactattacggctacagcctggcgctgggcgcggccgacatccgcctgctggatctggccaacgcctatcgcacgctggccaaccagggcctggccagcccgccgcgctggacgctggccgacgccaaagcgaagccgactcggctgctggatgcggccagcagcttcatcatcgccgacatcctgtccgaccgcaccgcgcgcgcgctcaccttcgggctggaaagcgcgctgtccacccgttactggagcgcggtgaagaccggcaccagcaaggatatgcgcgacaactgggcggtgggcttctcgcgccgctacacggtggcggcctgggtgggcaacgccggcggcgagccgatgtgggacgtgtccggcatgcatggcgcggcgccgatgtggcagacggtgctggatcgcgcccagcaatcggcgccgccatcgcagcctccggcgccgccgcccggtctggcacgccagcgcgtgcgttaccagggcgatgtggccgcgccgcgcaccgagtggttcctggccggcacccagcgcgcgctgatcgtgccgcaaaagggctccgccgccgacctgacgccgggcatcgccgcgccggtggacggcagcatcttcgcgctcgacccggacattccgccggccaaccagcgcatggtgctgcgcgcgcgcggcgtcgccaagccgcagtggtggctggatggcaagaagctgggcaatggcgcggagctggcctggtttccctggccgggccggcatcggctggagttgcgcgccggcgacggcaagagcgtggagaaggtgaagttcgaggtgcgcggcgccgcggcgaagcctaagccgcgctga

SEQ ID NO: 2740 - DNA, 561 bp, Chromobacterium substugae
gtggcggccgcggcgccggctgacggcttcagcttcgcggtgggcggcaatcccgctgtccaaggccaggcggcgccgccgccggaaacgccggccgagcgccagcgcaagcagcagttgcgcaagcttggctaccagatcgaggcgcgctattaccagatgtcgctggcgcaactgcgcgagctggcgaagcaaggcaacgtgcaggccttgacgcatctggccgagcgctacctgttccagctggacggccatccgggcgagcccggctacgaggctggcttccgctaccgcgacgaagcgcgcgaggcgctgcagcaggcctacgcgctgggcaatatgcatgcggcggcgatgatttcggagagctatctgctggaaaaacagccgctggaggccgcggcctggaaccaggtggcgcgccgttcaggcgatgcgctcagcgccgactggttcctgaagaccaaggactaccaggcgctgaccgatcagcagaaggccggcgcggcgcaacgggcggatcagctgatgcaatcgctcgcgcggcgcaaaccggcatag

SEQ ID NO: 2741 - DNA, 552 bp, Chromobacterium substugae
atgacaaggaaaatcttcaacgcggcagccctggcagtggcgatcgcgggacaggcggccggcgcgctggccatgccggtcagcaacgcctacatccagtccagcgccaatgagatccgcggccagctcggctcgtactcccgcccgacggtgtatgtcgaccagtcggcctgcggcgaaggccaggccagcgcgatggcttgcggtccgtacaccatcagcgtcggcgtcggcttcctgcagcagcaggaaagcagctacggcaactacgtggccaagttcatcctggcgcacgaatggggccacaccatccagttcacccgcggcatcaaccgccagccgccgatgcaagagctgcaggcggactgcgtgggcggcaccttcgccaagtacgccgagaccaatctgcgctacccaagcttcatcgaaaacgcggtggcctccgcccgcgacgcggccgactacgccgagcacggcacgccgtcgcaacgcgactactactcgcgctacggctacgccaacggcctcaacacttgcctgaaccggatctga

SEQ ID NO: 2742 - DNA, 822 bp, Chromobacterium substugae
atgccaggtagagatttttatcatttttcagagccgcactgcgatgaatatactccagccatcaaaaacacatcgtatttttctatggagagcccaattatgactaaagccctgatcgtgatcaccggcgccagttccggcatcggcgccgccgccgccaaactgttttcccagcaaggccacccgctgctgttgctggcgcgccgcatcgaccgcctgcaggccctggatttgccggacaccctgtgccggcaggtggacgtgaccgatcgcgccgcgatgctggcggcggtggccgaggcggaggcccgcttcggtccggccgacgccatcgtcaacaacgccggcgtgatgctgctgggcgcgctggcgcggcaggacccggacgaatggcaggcgatgctggacgtcaacgtcaagggcctgctcaacggcatccacgcggtgctggccggcatgcaggcgcgcggccgcggcagcatcatcaacatcagctcgatcgccgggcggaaaacctttcccagccacgcggcctattgcggcaccaagttcgccgtgcacgccatttcggagaatttgcgcgaggaggtggcgggcagcggcgtgcgggtgatcaccattgccccgggcgcggtggagaccgagcttttgggccacaccaccgacgaggcgatcaaggcaggctaccaggagtggaagcagggcattggcggcgtgctggaggcgcaggacgtggccgaggccatcgcctacgcctatggccagccgcagcgggtatgcatccgcgagatcgtgctggcggcgaccgggcaggcggcctga

SEQ ID NO: 2743 - DNA, 858 bp, Chromobacterium substugae
atggatatccgtcaactaaaggccttcatcgcggttttcgaggaacgcagcatcacgctggccgcccagcggctgttcgtcacccagccaacgctgtcggtcaccatccgccaattggaagaggcgctgggcgcgcagctgttcgaacggctgccgcgcggcgtggaggtcagcgaggaagcccggctgctgtatccgcaggccaggcggctggtggcccaggccgaggcgctggcgcggatgttccgccagccgcacgattgcctgccgctgaccctgggcgtggacgcagatgtcggccccgggcagctggaagcatttctcgccatggccgcgcgggcctcgccggccattctgctcagcgtggaggaaggctgcgtcggcgacgccaggctggcggcggaggacagccgctgcgaggacgagctgtttgtcccgctatgggaggaaagttttgtgctggcggttacggccagacatgcgctggcggaacggcggcaggtggagatgagcgaactggccggcgccgactgggtcacctgcccggcgcacgcgtcgcatcagcgcctgctggatctgcatggcgcggtggcgccggaactggcgctggcggcacaggccggcagcctgcggctggccgcgcgcatggcggcggcgggactgggcttggcattgctgccggcctcactgctggcgggcgcggacgggcttgcgcccattccgctggccggcgccacgttgacgcgccgcgtcggcctgtgccacgcggcgcaggcgcaggagcttcccgcgctacaggcgctgctggcttgcctgccggcccaggatcacagcggcagcggcgcggacaagccgtag

SEQ ID NO: 2744 - DNA, 636 bp, Chromobacterium substugae
gtgttcaacttcagcgtatttctttccgcactgggcatttccttcagccagatcgtgggcatcggcccgcagaacgcttacgtgctgcgccagggcatcggtcgcagccatgtggtgcccatcatcctgatttgcatcgtggccgacattctgctgatcgccagcggcgtgctgggcatgggcaaggtggtggccggcattcccggttttgtcggcgtggtcgcctggggcggcgcggctttcatcctgtggctgggcttcaaatccttccgctccgccttttccgccggcgcgatgtcgctggagggcagcgtggagcgcgaccgcaagcgcgccatccgcaccattttggcggttacgttgctcaatccctatgtctggctggataccgtggtgctgataggcggcgtgtcctcggtgtacggcgagcacggcgcgctgtccttcctgctgggcagcctgtgcgcgtcggtgctgtggttcggcgccatcgggctgttcgccggcaagctggcgccgctgttccagaaaccatccagctggaaggtgctggattgcgtgatcggtctggtgatgctgttcaccgcggcgatgctgatcggcaactacggcttgtccgcgccgctgccgctgtga

SEQ ID NO: 2745 - DNA, 2379 bp, Chromobacterium substugae
atgcagacggataatatggcgctcctggcaggcatgtgccgctttatcgggatccggaccgaacacctggccgcgttgtcgcttcaggccgacgcctgtctggcgaggagcgaactgctggccaaggagctgtactggcatttgctgaagagtccgcaggaggctgagccgttgcagcggcactacggcgaggcgatggaagccctggcggcgcgcctgctgcgggagtgggaggctttgctgcgcgacccgctggacgaaggcggcgcgcgcaagctggccgagcagggcgagctgtattgccagttgggcgtgagcctgggctggctgtttggcctgtacgagcgttgccagacgcacctgctggcgagcctggcggccttgcccggcgccgccggccaagaggcgctctcccgcctgctgcgcaagcgcatcctactggaccagatgctgaaaatccacggctaccagcgcttcctgcatggcgaggccgcgcggcggcgcgggcacttccagacaatgtccagcctgtacgccaccctcagcggcgtcagtctcgcgctggcggaaagcccggaccggcgcgccttgctgcaggccgtatgcgacgtctgcgtgcgcgaagccaagttcggcatggcctggatcggcatgctggatccgacccgccgccatgtccaggtggcggcgctgtccaattgcggcatgacgccgctgaccaatgccccgaatgtctcgggcgaccccgacaatccatatggactcggccccagtggccgcgccatccgcagccgggtggtccaggtggtgaaccacgccaggcgcgacgcctcgctgcagccctggcagtcggaattgcgccgccacggcatcaacagcttgctggtggcgcctttgctggtccgcggcgaagtggtgggcaccttgtcgctgtattcgcgcgagaccgcttatttcgaccaagcgaaactggcgctgttcgatgtgatggcgcgcgagataggccgcgcgctggagcggctggacgcgctggagcgcagccaccgcgccgaaaccgaactggctttcctggcccgccacgacgcgctgaccggcctgcccaaccgcagccagatgcaggagttgatcgccaggctgctgcaagcccgcttcaacgacgggcaagtggcggtgatggccatcgcggtggagggtttccacgacatcaacgccaggctgggctatgacggcggcgacgcggtgctgtgcgagatggcgcggcggctgcgccaggccatctatccgttcggctacgtcggcagggtgggcgcgtcgcgcttcatcgcgtgctcggagcggatcgatcagctgcaatcgctggcggatgccgtgctgcagagcctgccgcggccggtggacgcgatgggggtggcagtggaaatgcgctgcagcgtcggcgcagcggtgagcagcccaggcccttgcgacgccgccgcgttgttgcggcgcgccgacttggcgctgacccgggccaaggcccagggcggcggccatttccgccattacgacgcggcgatggatgaggaaatccacaagctgcacgcgctgcgcagcgctttcgcgctggcgatagcgcgcggcgagctgatgctttactaccagcccaagatcaatctgcaaaaccaccggatagaaggcgccgaggcgttggtgcgctggacgcgcgacggccagctgatcgcgccgggggagttcttcccagcgatagaaaacaccgatcagatgcgcgagctggactggtgggtgctgcgcgaagcggtgcgccaggcttgcgagtggcgccagcaggggctgccgatgccggtgagcgtcaacctgtccgccgccaccatcaagcacgacgatttcctgcgcacgctggaagcgctgttggaggccaatccgctgccggccggcttcctggagttggaggtgctggaaagcgtcacccagcaggaggcggagcagatcacttccaagctggagcgctgccgcgacctgggcctgtcgatcgcgctggacgatttcggcaccggcgcctcgtcgctggtgcatctgcagcagttgccattcgacaccatcaagatcgatcagcgtttcgtgcgcttgttgctggaaatgccgggcaacgaagccatcatccgcagcatggtgtccttcgcccactataccgggcgcaagctggtggtggagggggtggaaagccgcgccatctggagccgcttgctggagataggctgccatgacggccagggttacggcatttcgccgccgctggccgccgccgagttgccggcgtggacccgaaattggctgcgcaagggtgcgacggcagatattaataattcttatgtatcatga

SEQ ID NO: 2746 - DNA, 930 bp, Chromobacterium substugae
gtgcttgatccccgacaattgcagactctggccgcggtggcggaaaccggcggcttcgacaaggcggcgaaaaagctgtttctgacccagtcggccgtatcccagcgcatacgccagctggaagaacagcttggccaaccggtgctgacccgcacctcgccggccgagcccaccgaggccgggcgacagctgttgcagcaccatcagcagctgatgttgatggaaaaccagctgttgaggcagctgagcccggcgccgcggcagcgcgaattcaccacgctggcggtgggcgtcaacgccgacagcctggccacctggtatctgcaggcggtggcgcctgcgctggaagaaaacgacctgctgctggacatcgtggtggacgaccaggaccacactcacgaactgatgcgcaccggccatgtgataggctgcgtcagcacccggccggtgccgatccagagcggcatccagcactatctgggcgccatgcgctaccgctgcctggccacgccggccttcgccgaacgccactttccggacggcgtcagccatgccgcgctggcgcgcgcgcccagcatcatcttcagccgcaaggacgccgtgcacgggcaattcctgctgcaggccgccggctaccagggccatttcccctgcatgacggtgcccaccgcccaaggcttcgtcgagctgacccgccaggggctggcgtattgcctgctgccggagctgatgctggacgacgacctggccagcggacggctggtggacctgtttcccggccaatggctggacatcccgctttactggcaccactggcgggtggagtcgcggctgtcgcaggcgttgaccgaagcgatgctggcctattgcggccgccacttgcgccaggacaaggacgccgcccccgccgccggcggagaatgccgctga

SEQ ID NO: 2747 - DNA, 438 bp, Chromobacterium substugae
atgaccagcaatcaacaagcacccagcaaggcacaatgggccgaactggaaaccgccgcccggcaggcggccagccaagcctacgcgccatacagcaagttttccgtcggcgccgccattctcgacggcgccggcaagatccacatcggctgcaatgtggaaaacgcctcatacagcctgggcaactgcgcggaacgcaccgcggtgtactcggcccgcgtcaaccacggcatgcgcgaggtggtggcggtctgcatctacactcccaccgcgacgcccaccccgccctgcggcgcctgccgccaggtgctgaatgagttcgggccgacgatgcgggtacgcgcgatctgcgacggcggcgacgtgatagacgccacgctggacgcgctgctgcccggagcctttggccctaaaaatctgcaggacgccgccggctga

SEQ ID NO: 2748 - DNA, 846 bp, Chromobacterium substugae
atgagccggcctgccttgcttgacagccagacgtggctgctgacggcgatgacggccggcggcgcgctggagcagggcctggcgctggcgcggtcccgctgcgggctgggcgaagacctggtggccgagccgccgcgcggcaagcggcgcgatcgcatcggcgtatatcagcatggctattgggcgcggctgctggagtgcctgcgcgccgactatccgatgctgctcgtcttgctgggccagcccttgttcgacctgctggcgcgcggctacatcgcgtcgcggccatcgcgctcgccgtcgctgcatgacttgggcgcggatttcgccgattttctggcggccagccagccagacccggacgcggcggagtgccggctgccggtggagctggcgcggctggagcgggcccatgccgagataggccgggcggaaggcgtggagggcgcgtcgccgccgccattcgacgactggctggtcctgctgggcgcggagagtccgttggccggcatggcgctgccggacagcgtgcggctgctgaaaaccagtctgccgctcctggcctgctggcatgagctgcagcgcggacagcgactggcggtgccggcattggcggaagggcgcttggcgctggcgcggcggcaatggcgagtgagcgcgcacgagctggagccgtggcaattcgagttgttgcaggctatggcgcggctgggcggcggcgaaaaggctttgtccgaggcggccgagcaagccggcgtagaggcggcctggctgcgcgcccgggccgccgcttggctgccgacggcgcaggacttggggctggtgcgccgccgcgaggcggtttga

SEQ ID NO: 2749 - DNA, 885 bp, Chromobacterium substugae
gtgaccttgccccgtttgggtttgccgaacctgggcttcggcgtcggcttgcgcaatgtgcatttccagcaccttgccgagcacggcgccggcgtcgactggttcgagatcatcagcgagaacttcatcggccaccgcggctacgcccggcacatgctggaccagctgcggcagcaggttcccatcgtcatgcatggggtgtcgctgtcgataggcggcagcgacccgctgaaccggggctatctggaacaactgcgccggctggccgatgagttgcggccggcgtggttgtccgaccacctgtgctggaccggcgtggcgtcggtcaattcccacgacctgctgccgatgccgttgaccgaggaaagctatcgccatgtgcgggaccgcgtgctgcaggtccaggactttttgggccgcccgctggtgctggaaaatcccagcagctatctgcagttttcccactccacgatgccggaatgggcgtttttgtcccggctggccgaggcatgcggctgcggcctgctgctggacgtcaacaacgtctacgtttccggctacaaccacggcttcgatccggagcactatatccgccagctgccggccgaccatatcgtgcaaatccacctggcagggccgagcgactgcggcgattgcctgatcgatacccacgaccatccggtgccggagcgcgtctggcagctctacctcttggcgcagcggctttgcggcggcgtcagcacgctgctggagtgggatgccgacattccgccgtatccggagctgctggcagaattggacaaggccaggcgcttgctggccgaatacgcgccgcaggcgctgccgggaggaaaggaaagccatgagccggcctgccttgcttga

SEQ ID NO: 2750 - DNA, 2034 bp, Chromobacterium substugae
atggaaattcctgttctcggcgccagtttgaatcgaatcaccgatcgcagcctgaacgagttggaaagcgacaagtcggcggcccgcgccatcattcaggctgcggtcagcgtggagttgttcaccatcccgctgtacatgaccaccatgtactccattcagggcacccaccagatcaacagcaagaacctggattattatcgcggccgccaatggccgggctccgcgcccgtcagccagccgcgcaacagcaacgagcgcgcgttcaatgtcattttcagcgtgttcatccaggaaatgctgcatctgcagatggcggccaacctggccacggcgatgggcgtgcagcccgacttcacgccgccgggactggtggaccagcggctgggctggatctgctacgggccgcagcagtcgatgctgccgcatatcatcgacctgcgcgataccagcacctacaacaaggtgcgggtcaatctggaggccttgaacgaaaaccagatcgaattgttccgcgctatcgagcagccggaaggcgcggcgcgggccgagctggccaggcagccgccgccggtgcaggccaagtatttcccgaaagtgcctttcgccggctggaagccggacatgggggtgcagaacctgccgctgttcggcaccataggctggatgtacgagtgcttggcccaatatgtcagcatcgaatacgccagcggcaagtcgctgtgggactacctgaccagcgcagaccagccaggggtgacggcaggggcgaattcggtacagcaggatttgttcaatgcccagggcggcggccacccgatgcgggaatttccgcagctgtcgacgctgttcgtcccggaagacttcagcggcaaagatcgctcgttcaacaaggccatcgacatgatggcggccatcaccgatcagggcgagggcgcgcagactagcctcagtcgctatcgccgcggcggcatgctgcaagaagtgaaggagccctaccgcgaggaccgcaaggcgctggaggtggactatccgtcctacgacggcgccggcaagccggtgccgtcggccgatgccgccgcgcgctgcgacagcgccgcctggacccactacgagcgtttcgccgaactgtacgcgttgctgcggcaggtggaaacctgggagcaatggcatgccaaaggcaatcgctggacggcggacatgctgaaaaatccggcgtacgacccggccatcgcgccgaagaacatcccgtctccgagccaagtggccgacgcgctgaacacgctgaagcaggacccgtcgatgttccgggtgctgagcttcgtatcggcgggcgccatcgccggcgtcaccacggtgttgaacacctactggcagaagcagcagaccacttttccatatccttccatggtgggttcgggcgaccgcgtttccttgtgctgggcggctttgggcaaggcgcccaatctggcgctgggcgtcgggcagcgcgaagccggcaagctgtaccacgcatgccagggcatgaatctggacggctcaagcggggaaacctgcgcggcgatcgaggtttaccacacctgccgcggctccaacagctgcaaggcggaaggcggctgcggctttgtgcagagcgacaagggcggcggctcctgttcggcgatgcgccgcgccgcgccgaatttgaacgcggccgccggcgcgcagtgctgcatgccgccggagccaaccccgcccacggatgccttcagcgcgccaagcgacaacaagtgcgccagcttcggcggctgcgcggtgccgatttcggcgtcgcaattgttccctagccagggcacgatgctgctgtacaaattcgtcggaccgatgcatgccagcgagccgttgccgaagacgctggatttcgccgtcggcgaatcggtatacgacaaggcctggcaagcctatcgcgaagtgatggccgccagcggcggcaaacctgccggcgatccgccgacgcctacgccgctgcgggtggccctgccgccctcgacctga

SEQ ID NO: 2751 - DNA, 1605 bp, Chromobacterium substugae
atgttgcgtatttccgaactgaaactgccgctggatcactccccggaggagttggcggctgccgttgccggctttttgaagatcgcggccggtgacgttcgcggctttaccgtgttcaagcgcagctacgacgcgcgcaagggcgtgatgagcctggtttacatcatcgacgtcgatgcggtcgatgaagacaaactgttctcccgcttcaagggcgaccgccgggtgatgcccaccccggacaccgattactactatgccggccaggcgccggccgagctgaaacagcgcccgctggtggtcggcttcggtccctgcggcattttcgccgcgctgatcctggcccagatgggcttcaagcccattgtgctggagcgcggcaaggaagtgcgtcagcgcaccaaggacacctggggcctgtggcgcaagagcgaactcaataccgaatccaacgtgcaatacggcgaaggcggcgccggcaccttctccgacggcaagctgtacagccagatcaaagacccccgccatctgggccgcaaggtgctgaccgaattcgtcaaggccggcgcgccggaggaaatcctctacttggcccgcccgcacatcggcaccttccgtctggtttccatggtggagaatatgcgtgccgaaatcatcgcgctgggcggcgagatccgctttgagcagcgggtggacgatctgatcctggatggcgaccgcgtgcgcggcgtgaagttggccgacggcggcgagattttcagcgatcacgtggtgctggcgctgggccacagcgcgcgcgacactttccagatgctggaacagcgcggcgtttatatggaagccaagccgttctccatcggcgtgcgcatcgagcatccgcaatcgctgatcgacgcggcgcgctggggcaagtacgccggccacccgattctgggcgcggcggactacaagttggtgcaccacgccagcaatggacgagcggtctacagcttctgcatgtgcccgggcggcaccgtggtggcggccacttcggaagagaagcgcgtggtcaccaacggcatgagccagtactcgcgcaacgagcgcaacgccaactccggcttcgtggtcagcatttcgccggaggtggactacccgggcggcccgctggcgggcctggatttccagcgcgaactggaaagcaaggcgtatgagctgggcggcggcgactacttcgccccggcgcaattgctgggcgacttcatggccggcaaggcgtccaccaagctgggcgaggtggagccgtcgtacaagccgggcgtgaccatgaccgacctcgcgcgcatcctgccggacttctgcgtggaggcgatgcgcgaggcgattccgcatttcgcgcgccagatccgcggctacgacctcaacgacgcggtgctgaccggactagaaacccgcaccagctcgccgctgcgcatcacccgcggcgaagacctgcagagcctgaacatcaaaggcctgttcccggcgggcgagggcgccggttacgccggcggcatcttgtcggccggcgtggacggcatcaagatcgccgaggcggtcgcgcaggcgatcctggcaggccgctga

SEQ ID NO: 2752 - DNA, 345 bp, Chromobacterium substugae
atggcccagcctgcgattgcaattcacccgcgccttggctatagcgtactgtggctccatgtgggccgcggcgccgcatgccttgcgcctgcggcatccccgtttgccgccggcgcggtgacgtggccatccaagccgcacggctccagacagtgccggctggacatcaagttgcaagtgatcggaccgctgcgattttgccgcgcccgccgcggcggcaacaaggcgacatcgccatgcgcgcggcctttgccagaaaggtcaaggcgagcgggaagttttgcaccaaggagaacctcatggatctggacatgctcacccagccggtggtgcggctggcgatag

SEQ ID NO: 2753 - DNA, 321 bp, Chromobacterium substugae
atggatctggacatgctcacccagccggtggtgcggctggcgatagaagcgttgcagcaaggcaacgaaatcatttggctggagcaattcgtccccgacgcgaccctaaccgacgacggcctgcccgccaacttccacaaattcagcgaacatgccatgggccacgagcgcttcacccgcatcgaccgcgtggaaaaccaggggctggacatctacggcgccttccacagcgaccgctggggcgacttcgacgcctgtttcaagttccgcctcgacgccaacggcaagatctgtcaattggacataggccaggcagcctga

SEQ ID NO: 2754 - DNA, 1206 bp, Chromobacterium substugae
atgcaccagatactgatcgtggatgacgatgccgtatctcagcaattcctgctgatggtgttgcgccggctcggccatgacaatatcgcggtagccaacgacggcatagacgcgctgatccagctggacgccggcgaccggttgttcgacgtgattttctgcgacctggacatgccgcggatggacggcatcgaattcgtccgccatctgggcgagcgcggctatcaaggcaagctgctgatttccagcggcttcgacgagcgcgtgctcgaatcggtagccgaactcgcgcgcctgtacgacctgtggctggccggcctgctgcccaaacccatcaaccaccagcacctgcaggcgctactgagccagccgccgcctagcatccgccgacccggcaatatcagccacccctcggaagacgatttgcgcaccggcatcgaaaaaggcgagttccgcccctttttccagccgcaagtggaaatggcgtcgggagtggtccgctcagtcgaagtgctggcgcgctggcagcacccccgtctcgggctcaccagcccgctccagttcatcgaactagcggagacttccggcctgatcacggatctcaccaagcgcctgctggacgatgccgcgcagatcgtggccaagctgccgccagatccgccgctccacatgtcgatcaacctgtcgatggcctcgctgagcgaaaccagcttggtcgccgaattcgaggccatcttgcgcaacaatggctttcccatgtcgcggctgacggtggaagtcaccgaaagcggcctgatggccaatccaacccgggcgctggaagtgctgtcgcgcctgcggctgaagggcgccggactgtcgatagacgatttcggcaccggattcgccagcatggaccgtctgtcccgcatcccgttcaccgagctgaaaatagacaaaggcttcgtcatcgacgcgctgcagaaccccaccaatatgtccatcctgcgcgccagcgccgaactggggcgccagctaggcctgaaggtggtggccgagggcgtcgcctctttcgccgaatggcaactatgccgagacctggacgtggaaatggtgcagggctcgtacatttccccgccggtcgatgcggaaagctttcgccgctggctgttgaagcaccagggaagcttcccgctgccgccggccgccgatgccggccccgcttaa

SEQ ID NO: 2755 - DNA, 513 bp, Chromobacterium substugae
atgcgtacgctgcgcgttctcctgatatcgatcccgctcctgttttccgccgcgccgcgcgctcaaggcgaagccatgctggagaagcccgccggcaaagtggtgctgaccatcagcggccagatcagcaacaaaaaccacgacaatgacgcggtgttcgacatgtccatgctcggcaagctgccgcaacacaccatcgccacccatacgccatggctgcccggcgtcagccgcttcaccggcccctacctggaggacgtgctcgccttggtcggcgccaggggcaagatgctgaaggccattgccttgaacgactacaagaccgacattccactggaagacgcctcccgcttcaatatcgtgctggccttgctgttgaacggcaaaccgatgccggtgcgcgacaaaggcccgctattcatcgtctatccctacgacagccagccggagctgcgctcggagctctattacagccgctcggcctggcaactgaaaaccctgcaggtggagtaa

SEQ ID NO: 2756 - DNA, 2199 bp, Chromobacterium substugae
atgtccgtcctcaaacggcagcgcctggattggcggatgctgatcgcgatcggcgccaccttgatctgcgtgttcatcggcgtcgcctatatccagttccgtcaatctgagatgctggccggcgcgctgcgcgaccagaacgacaacgtcacctgggcgtatttccagctggaaaccgaaggactgcgcctgcaagcggcgctgcaaaaggcgcagcgccgccgcgtcgatcccgaggagctgcagcagcgctatgacattttcgtcagccgcgtcggcatcatccgcagcggcctgtatcaaagcctgctgcaggaccagcctgagtatcggacaatgcagccgcggctggaccgcttcatccgccagggcgacgccctgctctcccgccccggcgcgctccaggatccggcggcgctggaaaggctggccagccagttggccagcctcgccgacggcctgcatgacatgtcgcttagcgccaaccaggccatggccgaacgctccgacctgcgcaaccgggcgatggagcagcacatcgccatcggcaactggctgatgggcttcgaatgggcgctggcgctgggcttcggcttcaccgtcatccgccagttgcgccaattggagaagcgccgccagacgctggaaatcctcaccgcgcggctggaggaggcgcgcaagcaagccgaagccggcagcttggccaagagcgtcttcctcgccaatatgagccatgaaatccgcaccccgctcaacggcgtgctgggcatgctgtcgctgctggccagcgaagcccccagcccggtccaggccggctatatccgcaccgcggaagagtccgccaaacacctgctgttgctgctcaacgatgtgctggacgccagcaagctggaatccggcaagctggagctggcgccggtcacctgcaatctcagctacctgctgcggcagctcgccaaactgatgagcgcgcaggcccaggccaagggcctgatgctgagcctggacatggcgaccgcgattccggaatgggtggaggtcgatcccacccggctgcggcagatcctcctcaatttgctgagcaacgccgtcaagttcaccgagcgcggcggcgtcgccatccacgcctcctgcacacctggcgcgcgcgcggaccagtgcaatctgcagctgatcgtcaccgacactggcgtaggcatgagcaaggaaacgctgtcccgactgttcaggcgtttttcacaaggggatagctccaccgcgcgccagtatggcggcagcggcctgggcttggagatctcccagagcctggccgcgctgatgggcggcgagatttcggtcaccagcgtcctggggcaaggcagctgcttccagctgagcctgcccttgaaaatcatccaggcgccgcagttgcctgaagaggcggccagcccgccgctccggctggatgatggctcgccccgccgcgtgctggtggtggatgacaacgaggtcaatcgcaaatacatccaggcgatgctggagcggatgaaccagcagccgacgatggcgggcacgggtccggaagcgctggaaatcgcaagaaagcagccgttcgacctggtgttgatggatttgcacatgccgggcatggacggcatcgagaccagccggcgcctgcgcgaggaggcgctgacgccgcgaatggccatcgtggcgctgactgccgatgccttccccgaaacgcggcaaacgacgctgcgccaagggctggacggctttctggccaaacctgtcgatggcgatcaactgctggcggcgttgcggcggcatttgccgccggccgcgccagtcgctgcgctcgacgatgcgcccgagctcgacgaaaaaaccatcgccggcttcatcgaattgctgtcgcccgccaaataccgcgaactggccacccagtttttctccaaccacgaatccacgctgcggctgctggaagccaaccggcaagcacccgaccgcgaccagttgttccatctggcccacagcctgaagggcggcgccctgaccctgggattctccggcctagcccggcgctgccaggaactggagcaggaagcccagcaggacgtctgcgcgccagagcagatcatcggccagttggcggcgcaattccgcgccacgcgggaggcctgcgtgcggcaaggctatctcgcctgcgccgccggctaa

SEQ ID NO: 2757 - DNA, 216 bp, Chromobacterium substugae
atgagccgatactgcatctggtttgtcaccgccgacgacagcgtgatgcgtcgggccgaggtcgccatcaatggcgtcatccattgccaccaggtattggaagagatcgaagcccagctggcgctggactgcggcctcagccaggtgatgatcgtcgactggaaacggttcgaggttcccgaggctgacggcggccggttggcgcgcgtcgcctga

SEQ ID NO: 2758 - DNA, 462 bp, Chromobacterium substugae
gtggtcgacgccaatacccgcgtgttgatactgggctcgctgccgggcgacgcttcgctggctgccagccagtattacgcgcatccgcgcaaccagttctggcggctgttgggcgcgctgctggggcgggagttgcacgcgctgccttacccggacaagttgtcggcgttgcagggggcaggcataggcttgtgggacgtggtggccgaggcaagccgcaagggcagcctggatgccgatctgcgcgacgtccgccgcaacgatctgagccgcttgctggatagccttcccggccttcgggcggtggccttcaatggcgcgaccgccgccaaagccgcgccgcaactggccggccgcaaggaggcttggctcgccttgccttcgtccagccccgcgcataccctggccttcgaggcaaaacttgcagtctggcggcaattggaccgatatttacattcctga

SEQ ID NO: 2759 - DNA, 588 bp, Chromobacterium substugae
atgccattgatttgtggcgtcgacgaggccggccgcgggccgctggccggcgcggtgttcgccgccgcggtcatcctggatccggccaagcccatcgccgggctggccgactccaaggtgctgagcgaggcgaagcgcgacgcattggccgcctggatcaagcgcgacgcgctggcctggtgcatcgccagcgccagcgtcgaagagatcgacaagctcaacatcctgcatgccaccatgctggcgatgacccgcgcggtggaaggcttgtcgacgcgcccggacctggcgcagatagacggcaaccgcgtgcccaagcatctgccggtgccgggcgaggccatcgtcaagggcgatgccaaggtggcggcgatctccgccgcctcgattctggccaaaaccgcccgcgacgccgagctggtggcgctggacgcgcggcacccgcagtacggtttcgcgcgccacaaggggtatcccaccgccgagcatctggccgccatcgagcgccatggcgtgctggcggaacaccgcaaaaccttcgggccggtccggtcctggctggccagccaccagggccagctattctga

SEQ ID NO: 2760 - DNA, 1173 bp, Chromobacterium substugae
atgagcgatcacttgttcaagcgcaagggggccttgaaggtcgccatggtggccggcgaggcctctggcgaccttcttgccgcccatctgatggatgcgttgcgcgcccatcgcagcgatatcgaattcgccggcatcggcggccccagaatggaagcccgcggctttcacagcatggtgccgcaggaaaagctggcggtgcggggctattccgaggtgatcaaaagcctgccggagttgctgcgcatccgccgccagctgcgcgaccgcctgttggcggaaaggccggatgtgttcatcggcgtggacgcccccgatttcaacctggcgctggaaggcgcgttgaagaagggcggcattcccaccgtgcattacgtcagcccgtcagtatgggcctggcggccggagcgggtgcagaagataggcaagtcggtgaaccacgtgctgtgcctgtttccgatggagccgccgctgtaccgccaggccggcgtgccggtgacctatgtcggccacccgctggccagcgaaatcccgcttgatcccgacaaggacgcgatgcgtgagcagttgggcgtgccgctgcaggtgccggtgttcacgctgatgcccggcagccgcaagagcgagctggaatacatggtgccggtatacttggacaccgcccgcctgctgctgcgccagtatccggacgcccagttcctggtgccgctggccacccgcgccacgctggacctgttcgagcagatgctgtaccgctacaaggcgcgcgatctgccgatccgcaagctgttcggccacgcgcagatggccaccatcgccagcgacgtggtgttggtgaccagcggcaccgccacgctggaggtggcgctgaccaagcgaccgatggtgatcagctacaagctgtcggcgttcacttaccgcctggtcaagcgcaagatcaagctgccttatgtcggcctgcccaatatcctgtgcgggcgcttcgtggtgccggagctgctgcaaggccaggctaccccgcagaagctggccgaagagatgcaacggctgtacaccgactccgcggcgcgcgcggatatggaaaaggcgttcaccgagctgcatctggccttgcgtcaggacaccgccacccgcgccgcgcgcgcggtgctggaggtggcgcgatgccattga

SEQ ID NO: 2761 - DNA, 777 bp, Chromobacterium substugae
atgactattcatccgaccgccattgtcgatcccaaggcgcagatcgccgacgatgtcgaaatcggcgcttactctatcatcggcccgaatgtcagcatcggcgccggcagctggatcggcccgcacgtggtgatcgagggccacaccagcatcggcaagaacaaccgcgtgttccagttctgctcgctgggcgctatcccgcaggatttgaaatacgcgggcgagccgacgcgtctggaaatcggcgacaacaataccatccgcgaattctgcaccttcaacaccggcacggtgcaggatggcggaatcacccgcatcggcagcgataattggatcatggcctacgtgcacatcgcgcacgattgccaggtcggcaaccacattatcctggccaataatgcgacgctggccggccatgtgcatctcggcgactgggtgttcctgggcggtttcaccagcgtgcaccagttcgtcattgtcggcgagcatgcgatgactgctttcgccagcgccgtggcgcaggatattcctgcgtacgtgacggcgcatggcaaccgcgcggtgccttccggcatcaatgccgagggcatgaagcgccgaggcttcacgccggagcagatccgccgcgtgcgcagcgcctacaagacgctgtaccgccagggcttgagctacgatgaagccaaggcagcgatcctggccgaggcggccgaagggcacgtcgagctggaggcgttcacccgcttcttcggacaatcggcgcgaggcatcatccgctaa

SEQ ID NO: 2762 - DNA, 453 bp, Chromobacterium substugae
atgagtgaacacgctgtctcgatcgatgtccgcgagatcatgcgctgcctgccgcatcgttacccgttcctgctggttgaccgcgtcaccgagctggaagccaacgtgcgcatcaaggcgctgaagaacgtcaccatcaacgagccgttcttcgtcggccatttcgaacaatatccggtgatgccgggcgtgctgatcatcgaggcgctggcgcaggccgccggcatcctggcgatcaagagccagggcgagcgctcggagaatgagttgtacttcttcgtcggcatcgacaatgcccgcttcaagcgccaggtggtgccgggcgaccaactggtgttcgaagtgacgcagatgaccgtcaagcgcggcatcggcaagtacgccgcgcgcgcgctggtggacggccaggtggcttgcgaggccgaaatcatgtgcgcccgtcgcgaggtgtga

SEQ ID NO: 2763 - DNA, 1056 bp, Chromobacterium substugae
ttgtttttgatgtcctatacacttgcttatattgttgaacagctgggcggcgaattgcgcggcgacgatctggcggtcgtcaggctggctccgctggagcgggccggttccgacgagatcgccttcgtcgcgcacgccaagctccgccgccagatgctggcgagcggcgccggcgcgctgatcgtgaccgaagctctggcagccgagctgcagggccgttcgctgatcgtggccgccgatccctacctgtatttcgcccggctggccagcctgttccacccgcaagcgcagccgcgcgccggcatccatccgcgcgcggtggtgggcgagggcgcgcgcatcgccgccagcagcgagatcgccgccaacgtcaccatcggcgaccgggtggtcatcggcgagcgctgccgcctgttgccgggcgtggtggtgggcgacgactgcgtgatcggcgacgatgtcacgctgcatcccaatgtcacggtttatcatggctgcgtgatcggcaaccgagtcggcgtgcactccggcagcgtgataggcgccgacggcttcggcctggcctgggacaaggaccactggttcaagattccgcagaccggccgcgcggtgctggaagacgatgtcgagattggcgccaacactacggtggaccgcggcgcgatggctgacaccgtgatccgcaagggcgccaagatagacaatctggtgcagattgcccacaacgtcgaaatcggcgagcataccgccatcgcgggctgcgtcggcatcgccggcagcgccaagatcggcgcgcgctgcaccgtcggcggcgcggcgatgttcgtcggccatatcgaagtggccgaccgcacccatatcggcggcggcaccctggtgtcgaagtcgatcaaggaagcgggcaattacgcctcgtcctaccctttgcaaagcatgaaggactggctgtccaacgccgtccacgtgcgtcatctggatgatttcgccaagcgcgtcaagcagcttgagcgggaactggaaacactgaaaaaatcgaaggaagaacctcatgagtga

SEQ ID NO: 2764 - DNA, 486 bp, Chromobacterium substugae
atgaaagcattgaaatggtggctcgcggttttgagcgtggctgccttgccggttcacgctgccgacttcaagctgggctacatcaacgttgagcgcatctaccgggaggcgggcgcgtccattgccatctacaagaagctggacaaggagttcgccgaccggcgcgaggcgatgaagcagatggaggcgcgcgccaaggagctggaaaccctgctgggcaaaaacagcctgcagcaggaagaccgcaagcgttacgagcgcgagtacgcgagcctggaccgcgattaccgcgccaagacgcgcgaattggcggaagattacaatcagcgccgcaatgaggagttcgccggggtcaccgagcgcgccaatcgcctggtcaaggagatcgccgcgcgcgagcaatatgatctgatcctgcaagacgcggtctacatcaatcccaagttcgatctgacgccgcaggtgttgaaagaactggacaagtag

SEQ ID NO: 2765 - DNA, 2283 bp, Chromobacterium substugae
ttgggcctgtccatggcctccgtcgccatggctgctgacccgtttgtaatcaaggatatccgcgttgaaggcctgcagcgtaccgagccgggcacggtcttcaactatttgccggtcaaggtgggagacaccttcaccgacgccaaggcgcaggagtcgatcaaggccctgttcaacaccggcttcttcaacgatgtccgggtggaaagccgcggcgacacgctgatcgtcaccgtcgccgagcgtccggtgatcacccagctgaacatcaacggcgccaaggaattcagcaaggaccagctgaagaaagcgctgaaggacaacggtttcgccgaatcgctgatcttcgaccaggcgctgctggacggcgcggtgcaggaactgaagcgccaatactatagccgcggcaagtattcggtggaaatcaccccgtcggtgaccaagctggagcgcaaccgcgtttcggtgacgctggacatcaacgagggcgtcaccgcccgcatcaaggaaatccgcatcgtcggggccaacgccttcgcccagtcgaagctgctggacgaattcagcctgaccaccggcggctggctgtcctggatcaccaaggacgatcaatactcgaagcagaagctgaccggcgatctggagaagctgaaagccttctaccagaatcagggctatatggagttcgcgatcgattcctcgcaggtgtcgatcagtccggacaagcaggaaatgtatctggtgatcaacgtgcacgagggcaagaagttcaccgtgtccgacgtgcgcctggccggcgacctgaaagtgccggaagccgagctgcgcaagctggtgctgatcaagagcggcgacaccttcgacaacgagaaagtgaccgagtcggtcaaggcgatcagcgaccgcctgggcgtcgccggctacgccttcgccaacgtcaacgtgctgccggacatcgatcacgacaaacaaaccgccgccttcaccttcttcgtggacccgggccgcaagacctacgtccgccgcgtcaacgtggccggcaacagcaagacccgcgatgaagtgatccgccgcgagctgcgccagctggagggcgcgccgtacaacgccgccgacgtcaagcgcagcaaggaaagactggagctgctgggctacttcgaagacgtcaacgtcgaaacgccggcggtgtccgacgcgccggaccaggtcgacatgaacatcagcctgaaagagcgctccaccggcagcatttccggcagtttgggctatgtgcagggcgaaggcctggtgctgggcgccagcatttcgcagagcaacatcttcggctccggcaagtacatgtcgctgagcatgtccaccggccaggtcaacaagaattactcgctgtcgttcaccgacccttacttcacgccggacggcgtgagcctgggttatgacatttatgaccgcgtctacaacccggacgccacgtcgatttcggcgtacaagaccagcacggtcggcgcggatgtgcgtttcggggtgccaatcactgaatatgatcgcatcaacttcacgctgggcgccgaaaaaaccgatatcaccacgtatgcgaacagcccgtcgcaatacatcgatttcgtcaacaaatacggcaacagcaattacaccgttctgggcacggtaggctgggcgcgggacacccgcgacagcgcgctgtggccgactcgcggcgcctccatcaaggtgaacgccgacgccggcttgcctggcggcagcatgcagtactaccggctgactcatcagcagacctggttcttcccgctgtccaaagacttcaccttgatgctgaatggcgagttgggctatgccgacggttatggcaagaccaagcagctgccgttcttccagaacttctacatgggcggcctgggctcggtgcgcggctatgataccagcagcatcggcccggtagacggcagcggcaacttcatcggcggcaaccgcaaggtggtggccaatgcggaaatcctgttccccttcccggggatgaaggataataaatcgttgcggaccagcctgttcttcgatgccggcactttgtggaacaccagctggaccccgggtccgaacgatccgcaaaccgccagcaatgccagcaacggcctgcgctattccgccggcttggccttgacttggctgtcgccgatgggaccgatgaaattcagtattgccaatccgctgaagaaagaaccgaatgacaagatccagcgcttccaattccagttgggcgcttcgttctaa

SEQ ID NO: 2766 - DNA, 1344 bp, Chromobacterium substugae
atgctgacgctcctggcttttttgttggccatcggcctgctggtgacttttcatgagcttggccattattgggtcgccaagctgtgcggcgtgaaggtgctgcgcttttccctcggtttcggctcgcccttgctgcgttttcgcccgcgcgaaaccgagtgggtggtgtgtccgatcccgctgggcggctatgtgaagatgctggacgagcgcgagggtttcgtcgcgccgtccgaacgcggccgcgccttcaacaatcagcatgtgctcaagcgcatggccattgtggcggcggggccggcggccaatctgctgctggcggtgctgctgtactggggcgtgatcgcccagggcgtgccgcagttgaagccgctgatcggcactgtgatcgggcagacgccggcggcggcggccggctttcaggaaggcgaacgcattctgagcgtagccgggcagcgggtgtccagctggcaggatgtccgcctggcgctggtggatgcggcgatgtcgggcggcgcggtgccggtggtggtgcaaaacgcttccggcgccagccgcgagcgccgcatcgacgcccaacgtttcggcgacaaggcggcgcaggccttgcagcagggcgatccgggcctgtctccggcgcgcttcctgccggtgctgggcgcgctggaggaaaacagcgtggcggcgcgggccggtctcaagaccggcgacaagctgctggcagtcaatggggtgatgctgcgcagctgggaggaatgggtgcagatcgtgcgcaacagtcccggcaaggatttggcgctgcgcatagaacgcaaggggcaggacatggaagtcaaactgcggccgatggcggtgacgcaggatgacgaggtggtggggcggatcggcgtggggccgatgcccgaccgcgcctggaacgacaagctgggcttcactctgcattacgatgcgatgggggccttgctggccgcggcgaccaagaccggcgacaccgcctggatgagcgtcaagttccttggcaatatgttgatcggccacgcttcactcgacaacctgtccggcccgctgaccatcgccaatgtcgccggccagaccgcgcgtgaaggcttgacgccgtatctggagttcctggcgctgatcagcgtcagcatcggcatattgaatctgctgcctataccggttctggatggtgggcacttgatgtattatgtcgcggagctggttagaggtaagcccgtcagcgaacgggtgcaattgctcggacagaaaattggtttcatattgctggcgtctttgatggcgttcgccatcctgaatgatttcagccggctatttgggggttaa

SEQ ID NO: 2767 - DNA, 1185 bp, Chromobacterium substugae
atgaccaaacctcagggtattgccgtgctgggggcgaccggcagcgtcggctgcagcacgctggacgtgatcgcccggcatccggagcgctatcgggtggtggcgctgagcggccatcgccagctggacaagcttttcgagcaggccagccgcttccggccggattacctggttgtggccgatgctgacgccgccgcgcaactggcgctgcgactggagcaggctggcctgccgggcgaggtgctgcatgggcctcaggcgttggaggagatcgtccgcctgcccgaggtggatgccgtgatggcggccatcgtcggcgcggccggcctgccttccgcgctggcggccgccggcgccggcaagcgcattctgttggccaacaaggaatcgctggtggtggcggggcgcttgttcatggacgcggtgcggcgcagcggcgccggcctgttgccggtcgatagcgagcacagcgcgattttccagtcgctgcccgctgactatgccggccagcctgcgctggcgggcatccgcaaaatcattctcaccgcctccggcgggccattccgcggcaagagcgcggccgagctgctggacgtgacgccggccgacgcctgccgccaccccaactggagcatggggcgcaagatatcggtcgactccgcatccttgatgaacaaggggctggaggtgatagaggcgcattggctgttcggcgtgccgccggagcagatcgaggtggtggtgcatccgcagagcgtgatccattcgatggtgcagtaccgcgacggctccgtgatcgcgcagctgggctcccccgacatgcgcacgccgatcgcctgcgcattggcgtggccggagcgcatcgacgccggcgtagaaccgctggacttcttctcgctgtccagcctgagtttcgaaaagcccgatctggcgaatttcccctgcctgcggctggccttcgacgcgctggcgatgggaggcgacgcgccggcggtgctgaacgctgccaacgaggtggcggtggacgccttcctgaacgggcggctgcgcttcgtcgacattcccaaggtggtatccgagaccttgtcgggagtggacctggccgccagcgcaagcctggacgcgctgctggcgcgggatgaggatgcgcggcgcttcgcccgcggcagggtggcggcatgctga

SEQ ID NO: 2768 - DNA, 807 bp, Chromobacterium substugae
atgctgaaaacgcgaattctgaccgcgctggcgctgctgcccttgatgctggcggcgcttttcttttttccggcccccatctgggccggcttttcctggctgatcgtcgggctggcgttgtgggagtactcccgcatggccggcatgggccggccgcagcaggcctgttacctggttctctcttcgctgctggccgccgtttgctgggccatgggctggaaggcggggccgctgctgcatggcgtggtgctggcgttctggctggcgttgatgccgtgctggctggcgcggcgctggaccatcccgggcggcgcgccggcctggctgttgggctgggtattgatgctgccggcctggtttgccttcctggagtggcgcccgcagcctagccggcacgatgctttggccctgctggcggtgatgggcctggtatgggtggcggacatcgccgcctatttttccggcaaggcgttcggcaaacgcaagctggcgccggccatcagccccggcaagagctgggagggcgtatatggcgccgtgatctgcgtggcggtttacgtcgcattggtggatcatttcggctggctggacatcaagctgccgctgtgggggctgttgttgctggccttgccgctgacggcggtgagcgtgtgcggcgatttgcttgagtcgtggttcaagcgcgccgcgggcgtcaaggacagcagccgtctgctgccaggccatggcggcgtgtacgaccgcatcgacagcctgatcgccgtgctggcggtcagcaatgccctgcgcgcgctgggcggcatgtaa

SEQ ID NO: 2769 - DNA, 732 bp, Chromobacterium substugae
atgccggaggggcgccagccgccccggcatgtggccatcatcatggatggcaacggccgctgggccaagaagcggttcctgcccagggtggccgggcacaagcgcgggctggacgccgtgcgcgaggtggtcggcgcctgcaaggaaatgggcgtcggctatctgactctgttcgcgttttccactgagaactggcgcaggccgcaggaggaagtgaccttcctgatggacttgttcctgcgcgcgctggagcacgaggtcagcaagctgcacagcaataatatccgcctgcaggtgctgggctcgcgcgagcgcttcagcgcggagctgtctgagcgcatcgcgcgcgccgaggcgaaaaccgccgacaacgacggcttggttctgaccatcgccgccgattacggcggtcgctgggatatcgtcaacgcggtgaatcaactggtcgcggaaggcgtggcgccgattaccgaagaggcgctgaccaagcgtctggccatgtcctgggcgccggagcctgatctgttcatccgcaccggcggcgagcagcgcatcagcaatttcctgctgtggcagttggcgtattcggaattgtatttcaccgatctgctttggcccgatttcgaccgcgcggcgctggagcaggcgatttcttcctattggcagcgtgaacggcgctttggtcgcaccagcgagcaattgccggaacatttgcgccgcgacacaccctga

SEQ ID NO: 2770 - DNA, 603 bp, Chromobacterium substugae
atggctgttttcgccttgtcatttgaagttttgatgggagtggacatgattaacgacgtcaagaagtcggccgaacaaaaaatgcaaaaaacactggaatcgttcaaaaacgatctgtccaaggttcgcaccggccgcgcccataccggcattctggatcatgtcatggttgattattacggcagcgacgtgccggtcaatcaagttgccaacgtcaccctgatcgacgcccgcaccatcggcgtccaggcttgggaaaaacccatggtggcgaagatcgaaaaagccatccgcgattccgatctgggcctgaatccggcttccatgggcgagatcatccgcgtgccgatgccgatgctgaccgaagagcgccgcaaggacctgatcaaggtggtgcgcgccgaggccgaaggcgcccgcgtggcggtgcgcaatgtccgccgcgattccaacaccgaattcaagaatctgctgaaggacaagtccatcaccgaggacgacgagcgccgcggccaggacgagatccagaagctgaccgacaagtacaccgccgagatcgacaaggcgctggccgcaaaagaagccgacctgctcgcagtataa

SEQ ID NO: 2771 - DNA, 768 bp, Chromobacterium substugae
gtgccgttttgcaaactgaaaaccacaaatcgccaatccgaggacatcatgagccaagttcctgcctataaacgcatcctgctgaaactttccggcgaagccctgatgggtgacgacagctatggcatcaatcgcaccaccattgagcagatcgtgggccaggtgaaggaagtggtcgagctgggcatcgaagtgggcatcgtgatcggcggcggcaatatcttccgcggcgtggctccggccgccgcgggcatggatcgcgctacggccgactacatgggcatgatggccaccgtgatgaacgcgctggcgctgaaggatgcgatgactaaggtgggcctgatcgcccgcgtgcagtcggcgctgaccatgcagcagatcgccgagccctatgtgcgcggcaaggcgatgcaatatctggaggaaggcaaagtggtgatcttcgccgccggcaccggcaaccccttcttcaccaccgacaccgccgccgccttgcgcggcatggaaatgaatgtggacatcatgctgaaggccaccaaggtcgacggcgtgtataccgatgatccgaaaaagaatcccgatgcggtccgctatcagagcgtgaccttcgacgaggccatctcgcgcaacctgaaggtgatggacgccaccgccttcgcgctgtgccgcgatcagcatctgaatatcaaggtcttcagcatcttcaagaacggcgcgctcaagcgggtcgtgcttggcgaagacgaaggcacgctggtacactgctga

SEQ ID NO: 2772 - DNA, 846 bp, Chromobacterium substugae
atggtttcggatctgcgcgtggccaccggcctcggcatgatggagtgcaagaaggctctggttgaagcggacggcgacgccgccaaggctgaagaaatcctgcgcatcaagtccggcaccaaggcctccaagatggccggtcgtctggctgccgaaggcattatcggttcccatgttgaaggcggcgtaggcgcgctggttgaagtgaactgcgaaaccgacttcgttgccaaggatccgaccttcctggctctggccgctgccgcagccaaggccgccgtcatcgccaatccggccgacgtggaagccctgtccgcggttgaaatcgacggcgtgtccgttgaggaaatccgcaaggccgccatcgccaaactgggcgagaacatgaccatccgtcgcttcgttcgctactcgaccgaaggcgctatcgccacctacttgcacggcgcgaagatcggcgtgatcgtcgactacgccggcgccgagagcgtgggcaaagacgtggccatgcatatcgccgcctccaagccgatctgtgtttccaaggatcaggtttcggccgagaccctggagcaagagcgcaagatctacaccgctcaggctgccgaatccggcaagccggccgacatcgtcgccaagatggttgaaggccgcatcaacaagttcctggctgaagtgaccctgctgggtcagccgttcgtcaagaacccggacctgaccgttgagaagctgctggccgagcagaaagcctccgtcaaggcgttcgccatgttcgtagtaggcgaaggcattgagaagaaggtagtagactacgcagcggaagttgccgccgcggccaagctgtaa

SEQ ID NO: 2773 - DNA, 732 bp, Chromobacterium substugae
atgtccaccaacgttaccatgcgtcaaatgcttgaggccggtgtccacttcggccaccaaacccgcttctggaacccgaagatggccaagtacatctttggcagccgcaacaagatccacatcatcaacctggaaaagaccctgccgctgttcgtagagtctcaggagtatgtgcgtcgcctggccgccaacaagggtaccgtgatgttcgtcggcaccaagcgtcaagcgcgtgagatcgtacgtgaagaagctgcccgttgcggcatgccgtttgttgaccaccgctggctgggcggcatgctgaccaactacaagaccgtgaagcagtcgatcaagcgtcttgaagagaagcgcgccatcctggaaggttccggcgataccggttacaacaagaaagaactgctggatctgcagcgcgaagtcgacaaactcgagcgctcgctgggcggtatcaaggatatgaagggcctgccggacgccatcttcgttatcgacaccggctaccagaagggtaccatcgtcgaagccaagaaactgggcatcccggttatcggcgttgttgacaccaacaactccccggacggcatcgattacgtaatcccgggtaacgacgactccagccgcgccatccgcctgtacgctcgcggcatcgccgacgcggtactggaaggccgcgcgcactctctgcaagagatcgtcgccgccgctgagccggcgcaagccgagtaa

SEQ ID NO: 2774 - DNA, 192 bp, Chromobacterium substugae
atgacgctgatcattgtgctgatgggctggctttacgtggtgctgatgctggcgctgacccagggcagcgtggcgggcggtctggcggtcgccttctttctgggcgtgctgccgacctggtttgtggcgtgggcgacgcgcaacaagctgcgccgccgccgcgcggcggagaaagatgccggcaaagcttga

SEQ ID NO: 2775 - DNA, 1032 bp, Chromobacterium substugae
atgcaaaccgccattacccgcctgttcgatatccggcatccgctgatttgccccggcatgagctatatcgccacgccggaattggtcgccgccgtcggcaatgccggcggcctcggcatcctggccagcggcccgctgtcggccgacgccacccgcgccgcgatccgccgcatccgcgaattgagcgaccgccccttcggcatcggcgccactctgatgatgcccggcgctgccgacaacgcccgggtggcgttggaagaacaagtccccgtcatcaactattcgctgggcaagggcgactggatagccgaagccgcccatcgctatggcggcaaggtggtcgccaccgtcaccaccgaaaaacatgctgtctcggcggaaaaaagcggcgccgacgcgctgctggtcaccggccacgaggccgccgcccacggcggcagcgccacctcgctggtgctgatccccgccatccgcaaggccagccgactgcccatcatcgcggccggcggcttcgccgacggcagcagcctggtcgccgcgttggcgctgggcgccgacgccgcggcgatgggctcgcgcctggccatgacgcgggaaagcccggtgcacgccaagaccaaggacatgatccgcgaacgcggcgtggccgacacgctgtactcgaagaatttcgacggcctgtggtgccggatgatggacaccccgaacgcccgcgcggcctgccgcaagccgctgggcctgctgccggcggcgttccgcgccagccggatggcgcggcgcatgggcatgccggtgttgaaagtggcgctgggcggcatgatcagccagccgcaggcgctgcgccagttggcgctgttcggcgcggcgaccgagtcgatacggttggcgatacaggatggcgaccacgacaaaggcgtgcagctgataggccaggcccagggcctgatagacgatgtgccgacggtggccgagctgttcgagcgcatcatgcaagaagcgcaagcctgccggcaacggctggccggctactga

SEQ ID NO: 2776 - DNA, 1200 bp, Chromobacterium substugae
atggcatggaccaaagagcagaggcaaacagttttcgcctgctatctaggctggacgctggatgcgttcgattttttcctgatggtgttcgtgctgaaggacatcgcccgcgagttcggcaccgatgtcgaggcggtcagctgggccaccatgctgacgctggcggcgcggccgataggcgcgctgatcttcggccggctggccgaccgctatggccgccgtccggtgctgatggccaatatcgtgatgtattcggtgctgggcttcgcgtcggcgttttcgcccaatttgatggtcttgctgattctgcgcacgctgttcggcgtggcgatgggtggggagtggggcgtgggctcgtcgctgaccatggagagcattccccgcgaatcgcgcggtttcgtgtccggcctgctgcaggccggctatcccagcggctacctgctggcgacgctggctttcggccagctgttcgagcacataggctggcgcggcatgttcatgctcagcctgctgccggcgctgctgacgctgtacatccgccgcaacgtgccggaaagtcccagctgggaggcggcgagggggcaggaaaagccggggctgctgcaagccatcgccgcgcaatggcgcttgtcgctgtacgccatcgtgctgatgacctgtttcaacttcttctcgcacggcacccaggacatgtaccccacttttcttagggtgcagcacaagttcgatccgcataccgtgcagaccatcgccatttgcctgaatgtgggcgccatcgtcggcgggctggcgatcgggggcttgtcggagcggatagggcgccgcaacgccatcacgctggcggcgctgttcgccttgccggtattgccgctgtgggcgttctcgtccacgccgttgatgctggccgccggggccttcctgatgcagatcgcggtgcagggcgcctggggggtgattcccgcgcacctcaatgaaatttcgccaactgcggtgcgcgccacgtttccaggcctggtctatcaactgggcaatctattggcttcggtaaacagtccgatgcaggcgcatatggccaagatgaacggcggcgattacggcctggcgatggctacggtcgccggcattgtggcgatcgccatcgcggtgttgatacgcttcagccgcgagcggcgcggcgaggatatgcgcgtgtcaggctag

SEQ ID NO: 2777 - DNA, 774 bp, Chromobacterium substugae
atgcgttgcctggcctggatcgcgtgcggtttgtgcttggccggggcggcggcgcgggcatgggcgctggatgaggtggtgctcgccaatggcgaatgggcgccgtatcagtcggcgaagctgccgcatcagggcttcgcctctcacgtggtcagcgaggcgttccgtttggccgggattcaggtgatttaccgtttttatccctgggccagggctgaggccatggtgcgaggcggcggcgtggccggctcgctggtatggtctgaaacgccgcagcggcgggcattcgcctggttcagcgatccggtgatcgtggacgacgaggtggtgttccatcttgccacccgcaagatgaagaccgagcgcatcgaggatttctacggcctgacgatggcgactttcaacggctcgcggctgggggcgtggcaggaggcgatagatgccggccgcatccgcagttacgtcgtcaaggacatcgaggccgggatgcgccagttgctgatcggcaggctggatttcattcccttgatccgctcggtgggtttcagcgtgttgcgccagcatttcactcccagggagcaggcggcgatcgtggcggagccgcatgtgttcgtgcgcgctgaatatggtgtgatgttcagccgcaaacagccgggcggcgaggccttgctgcggcgcttcaacgccgggctggccaaattgaaggcgagcgccgagtatcggcagatggcgcgtgatttcgccgcgggcaaatacgatccgcagccctattga

SEQ ID NO: 2778 - DNA, 486 bp, Chromobacterium substugae
atgaattacgatcgctactacacctgcgatttggtgaatggcgagggcgtgcgcgtcacgctcttcgtcaccggctgcgcgcatgcctgcgagggctgccacaaccgctccacctgggatcgcaaaagcgggcggccgttcactgcccaggtgcgggaggctctgctggcgcattgcgccggccatgacggcctcagcctgtccggcggcgatccgctgctgccggccaatcgcgatgaaatcctgtcgctgtgccgcgcgttcaaacaacgctatccgggcaagagcatctggctgtggactggttacgactacgaagaggtgcgggagttggagatcctgcgtttcgtcgatgtgctgatcgatggccgctaccgccgggacttgccgaccagcaagccctggcgggggtcggacaatcagcgcctgttcaggctggcgccggcgcgggggcggccgttgctgccggtgacgcagctgacgtag

SEQ ID NO: 2779 - DNA, 2136 bp, Chromobacterium substugae
gtgcaagtgagcaagcgcgacggcgcagtgacgcaattcgatatcggcaagatcgccaatgcatgccagcgggcggcggcggcggccggccatgcggcgccggccgcgttggcgttggccatcgccgccgcggtggagcgccgctgccgcgagcgctcggcgcaggggcggatcagcatcgcggcgatccagcgtttggttgaggacgaactgatgcgcgagtatcccgaagtggcgcgggtttacattcagtaccgccatgaccgcgacagcgtgcgcgcgcgcggctccgagctgcatgccaagctgatggggctggtgcacagaaccgacgaagaggccgccactgagaacgccaacaaggacgccaatgtgtttccggtgatgcgcgacctgatggccggcatcgtctccaagcagtttgccggcaacttcctgcccaaggacatcctggctgctcacaacagcggcgacatccatttccatgacctggattactcgccgttcctgccgttcaccaattgctgcctggtggatttgaaaggcatgctggagcagggcttccgcctcggcaacgcccagatcgaaagccccaggtcgataggcgtcgcctgcgccgtcaccgcccagatcatcgcccaggtggccagccaccagtacggcggcaccaccattcccaatatcgatcaggttttggcgccctatgtgctgaaaagctatcgcaaaaatctggaggtggcccgggagtacggcatcaccgagccagaacgctatgcccgcgagcgcgccgaaaaggaaacgtacgacggcatccaggcttgcgagtacgagatcaacaccctgttcagctccaatggccagcagcccttcgtcaccttctccttcggcatgggcctgggctgggaggcgcgcatcatacagcagtccatcctccgcgtgcgcatcaaggggctgggcaaagagggcgtcacgccggtttttcccaagctggtgatgttcatcgaccagggcgtcaatctgcggccggccgatccgaattacgacatcaagcagctggctttggagtgcgcgtccaaacgcatgtatccggacatcatctccgccgagctcagccgacgcatcaccggctcatcggtgccggtttcgccgatgggctgccgcagcttcctgccggcctggcgcgacgaggcgggccgggaggtgctggatggccgcaacaatctgggcgtggtcagcttgaatctaccgcgcatcgccatcgaggcgaggggcgacgcgcaggcgttctgggcgctgctggaggggcgcttgggcctatgcttgcgcgcgctgatgctgcgcatcgagcggctgcgcggcgtcaaggccaatgtcgcgccgattctgtataccgagggcgcctttggcgcgcggctgaagccggatcaagacatcatggcgctgtttcagggcggccgggcgtcgatctcgctcggctacatcggcctgcacgaagtcggcgtgctgctgttcggcgcgcatccggccgacagcgagcctgctcaggtttttctgcgccgggtggtggcccgcctgagcgaggccgctgcgcagtggaagcgcgaaaccggtttcggcttctcgctctactccacgcccagcgagtcgctgtgcaaccgtttctgcaaattggaccgggagcgcttcggcgacatcgccgaagtgaccgacaagggctattacaccaattccttccatctggatgtgttccgcaaggtcaatccgttcgagaagatagactttgaaaccggctatgccgagctggccagcggcggccatataagctatgtcgaattgccgaacatgaagcacaatctgcaggcgttggagcggatctgggattacgcgctggagagggtgccgtatttcggcagcaatacgccggtggactcctgcggcgcctgcggcttcatgggagaggcgctggccgcggcggatggattcagctgcccgcaatgcggcaatcgcgacagcgcctcgctgtcggtgacgcgccgcgtgtgcggctacctgggcagtcccaatgcgcgtccgttcaatgccggcaagcagaaggaaatgatgcgccgggtcaagcacttcggcggcgagcattga

SEQ ID NO: 2780 - DNA, 555 bp, Chromobacterium substugae
atgcactccccgcttcccgccctgctgctgaccctgccgcttgccagctacgcccacgccgccgaacaagtccagggccagggtgggcgcatcctgcattacagctccacccagacccgctccgacctggaccacgaggagcaaaaccgctaccgcaaccatcgcgaccaccagttcaacggcgccagcctggccgccgtgctgcaggcggcgcagagtgcgctgcatcagcacggctacggccagatcgaagcggaaccggattaccacgtgattcgcgcgctcaggcacgagcagctggtcagccgcggccgccaggtgctgcgcggcatcctgaagctcaagctgccgatgccgggcaagcccgaccaccagagcaccgagctgttgctgatgctgcgccccggcagccagccgcagcaggtgctggcacgcgcgcgcctggaaaccaccgtctgggacagcaacggcaactcccacaccaagctcgacagcgatccggacgactaccgccagctatacggccatatcgacgccgcgctgcgaggacgctaa

SEQ ID NO: 2781 - DNA, 1818 bp, Chromobacterium substugae
atgacccgacaaattcgtaacatcgccatcatcgcccacgttgaccacggcaagaccaccctggttgaccaactgctgcgccagtccggcactttccgcgaaaaccagcaggttgacgagcgcgtaatggacagcaacgatcttgaaaaagaacgtggcatcaccattctcgccaaaaacaccgccatcgaatacgaaggcgtgcacatcaacatcgtcgacactccgggacacgccgacttcggcggcgaagtagagcgcgtgctgggcatggtcgatggcgtgctgctgctggtggacgccgttgaaggcccgatgccgcaaacccgcttcgtgaccaagaaggcgctggccctgggcctgcgtccgatcgtggtgatcaacaaggtagaccgtccgggcgcgcgtccggactgggtggtggaccaaaccttcgacctgttcgacaagctgggcgccaccgacgagcagctggacttcccgatcatctatgcttcgggcctgaatggcttcgccaagctggaactggaagaaacctccgacaatatgcgtccgctgttcgagaccgtgctcaagcacgttccgaccccgccgggcgacgccgacgcgccgctgcagctgcagatttccgcgctggactactccacctacaccggccgcctgggcgtgggccgcgtgctgaacggccgcatcaagccgggccagcaagtggtggtgatgaaccatgaagagcaagtggcttccggccgcatcaaccaggtgctgggttaccagggtctggaccgcgtgccggtggaaggcgccgaagccggcgacatcatcatcatctccggcctggacgacatcggcatcggcgtcaccatctgcgacaaagagcagccggtaggcctgccggtgctgggcgtggacgagccgaccctgaccatggacttcatggtcaacacctcgccgctggccggcaccgaaggcaagttcgtcaccagccgccagatccgcgatcgcctgaccaaggaactgctgaccaatgtggcgctgcgcgtcgaagacaccgaagattcggacatcttccgcgtttcgggccgcggcgagctgcacctgaccatcctgctggaaaacatgcgtcgcgaaggctttgaaatggccgtcgccaaaccgcgcgtggtttacaaggaaatcgacggccagaagtgcgagccgtacgaaaacctgtccatcgacttggaagacgaccaccagggcggcgtgatggaagaaatcggccgccgccgcggcgagctgaccaatatggaatcggacggcatgggccgcacccgcctggaataccacattccggcccgcggcctgatcggcttccagtccgacttcatgaccatgacccgcggcaccggcctgatgagccacgtgttcgacgactacgcgccggtgaagccggacatgccgggccgccacaacggcgtgctgatctcgcaggaaaacggcgaagccgtcgcttacgcgctgtggaagctggaagaccgcggccgcatgttcgtgtccccgggcgaaaaactgtacgaaggcatgatcatcggcattcacagccgcgacaacgacctggtggtgaacccggtcaagggcaagcagctgaccaacgtccgcgcctccggcaccgacgaagcggttcgtctgaccaccccgatcaagctgacgctggaatcggcggtggagttcatcgacgacgacgagctggtggaaatcaccccgaaatccatccgcatccgcaagcgttacctgcaggaaaacgagcgtcgccgcatgtccaaggctgaaagcaactaa

SEQ ID NO: 2782 - DNA, 873 bp, Chromobacterium substugae
atgtacgactggaacgcattgtggcatgagcgcgaagcctaccgcaccggttacgacatccaccacggcgacgccaatatgctggccgagccgctcaaggccaagctgatccacgccgccgaaacgccggaccaggtggcggtgtacgaagacgcccaccgctacatcctggccggccacgccgacggcctgcagctgctggaagtgttcaagcacggcctgttcgacatcaccctgcgctttgtcggcgaagacgagggtcaggacgccgccgtgccttatatagagctgcatgtcgacaacctcgccaccgaggagcaggcggtatggcgcggcgaggcgcagctggatgaagaaggtcgcgtctggataggcaagcgcacgctggacgaagacgtgctgccggcgatgcccttcgacgaactgtcctttaccgaccaggccgtcttccgcgacgaactggcccgtgtctggcatgaagacctgccgcaattgcgtccgctgatcgaagcctggttccgccacgacgaactggcggcgccgcaggacgagccggcccactacggcgaccaggagcgcgtgatgcagatctgcgaccgctacgccgaaatcgtccgccgcgaacaggcggcgctgtcgcggctgttcagcgacgacgagctgcggctgatggccggcgtgatcggcagcgtgcatttcgacagcgccgcctcctgccgcggcgtctggctggccgtggaggcccgcatcatcgaagacgagctggatcagcaattccagctggacggcgaggcgctgctggccaagatgaaaggcttgagctacgcgcaggaagtggcgctgatcgaggcgctgtcgccgctgaaatcctga

SEQ ID NO: 2783 - DNA, 174 bp, Chromobacterium substugae
ttgcggcaggtttctcagggcaatcggctgagccatattgcattctccatggtgggtttcaggcgccgatcggctccttgtctggaggcgttcgggccagcggcgcgccgcgcgcgatggcgtccgcggcgcgatataaggtttagtgtgattgctcgaaatccggcggcatga

SEQ ID NO: 2784 - DNA, 1317 bp, Chromobacterium substugae
atggctcagccgattgccctgagaaacctgccgcaaagcaatatcttccgccccggcgacgtattcgtgctgttcggcgagctgttcggccgcggctacgccaatggtctggtcaaccaagcccgccaggccggcatggagatcatcggcatcaccgtcggccgccgcgacgacgacaaccgcctgcgcccgctgaacgacgaagaactggcggccgccgaggccaatctgggcggcaagatcatcaacgtgccgctgatggccggcttcgagctggacgcccccgccggcgaagccaccccgaccgagctgctgggcggcctgacgctgaaaggctggcaggacgacaagctggactgggcgcatatcgaaaaatgccgccaggtcggcgtcaagcgcttccaggacggcgtcgccgaagtgatggccaagctggacggcatgatcgccgacggccgcaacgtgttcttcgcccacaccatggccggcggcattcccaaggtcaaggtgttcctcgccatcgccaaccgcatctacaagggccgcggcgaccgcttcctgtcctcgcaggcgctgctggacagcgacctgggcaagctgatcctgcaaaacttcgacgaagtcaccgccaacaccttccagcacctgatagccggcagcgcggccttgcgtcgccgtctggaagccagcggcggccaggtgcgctacaccgcctacggttaccacggcacggaaatcctgatcgacggccgctatcagtggcagacctacaccaactacacccagggctacgccaagatgcggctggagaaggtggcgcaagccgcctgggagcaaggcgtcaaggccacggtgttcaactgcccggaaatccgcaccaattcctccgacatcttcgtcggcgtcgagctgccgctgttcgcgctgctgcgcgcgctgaagaaggaagcgccaggtgcctggaccgatagccaatggcgggactgcgccagcctgctgaaggacggccacgcgctggaaacgctgctggaaaagatagacgcgctcaacgacggcgcggtgatgcagggcttccgccgcttcgacgcctggccgatgcccaacagccccgagctggccgaggtgatgataggcacgtcggacgagctcaccgacatgcacctggaccgcaaggcgctgatcaccgaccgcctcagcgcgctggtgatcgaagccgccggcccgctgatgttcggcgaagcctcgcagccgtccggcccggtgctgtggctgaaccacgacatcatcgccagccagctcaaacagctgcacggctga

SEQ ID NO: 2785 - DNA, 996 bp, Chromobacterium substugae
atgaaaatgcaggcggtggtccagcaagggccgggcggggcggagacgatggagctggcggaatgggatcggccgcagctggcgcctggcaagctgctggtgcgggtgatggcggccggagtgaatcgggccgacatgatgcagcgcgagggccgttacgcgccgcctcccggcgctagcccgctgctgggcctggaagtggctggttgggtggaagaggcggcggaaggttcagcctttcagcccggcgacgcggtgttcggcctggttgagggcggcggctatgccgagtacgcgctgctggacgaagccttggccatcgccaagccggacgcgctgtcctgggtggaggccgccagcctgccggaggcctggatgacagcctggttcaacctggcggagaaggccggcgtcgccgcaggcgacaatgtgctggtgcacgccggtgccagcggcgtcggcgtggcggcgatccaggtggccggcttgctgggcgcgcgggctttcgccagcgccggcagcgcggaaaagctggcattctgccgcgaactgggcgccgcgcaagtattcaactatcgggaaacgccggctttcagcgagctggtcaaaagctggggcggcgcggacgcggtgctggacccggtgggcgcggcctatctggcggaaaacctgcaggccttgaatccggacggcaggctggtgaacatcgggctgatgggcggtttgaaggccgagctggatttcggccggctgctgatgaagcgcatcagcctgatcggctccacgctgcggccgcagccgcccgcggcgaaggccaggctggcggcggcgctgcgcgagcgcatcctgcccggcatcctggacggacgcttgcgcacggtggtggactgcagctttccgtggacccaggtgcgggacgcccatcgctacgtcgaggaaaaccgtaatctgggcaaggtggtgctgacgatgttctcgacgcaggccgccggctaa

SEQ ID NO: 2786 - DNA, 117 bp, Chromobacterium substugae
atgaggccggccgccgcctatctcaagtcaatgcgcgaaatattcgaatacggcgacatatgccatgagctggatcaagcaatggcgaccggctttgattacaatgccccgtcatga

SEQ ID NO: 2787 - DNA, 2436 bp, Chromobacterium substugae
atgagcgagaactgtttccattgcggcttgccggtcccgcccggcgccgatttccccatccgctaccgccagcgcgatgaggccgcctgctgcgccggctgccaggccgtggccgccaccatcataaattccggcctgtcagactactatcagcaccgcaccgagggcgcggcccgcgccgaagcgctgccgcagaatctgctggaacagatccggctgtacgattccgacgaactccagcgcggcttcgtccacattgaccgcgaccaggtgcgcgaggctgcgctgatgctggaaggcatcacctgcgccgcctgcatctggctgaacgaacagcatctgcgccggctgccgggcgtggtcggcgtcgacatcaattacagcacccagcgcgcccgcgtgcgctgggacaacagccgcgtcaagctgtccgccatcctggaggcggtggcagcgataggctaccgcgcccacccctacgatgccgagcgccaggaaaagctgcaacagaaggagcgcaagcaggcgctgagccggctatgggtggccggcttgtcgatgatgcaggtgatgatgtacgcggtgccggtctacctggcgccggacggcgacatcgcgcccgacctgctgtggctgctgcactgggccagcttcatcctcacgctgccggtgctgctgtattccgcgctgccgttctaccgcgccacctggcgcgatctgaaaagcggccgcgtcggcatggacacgccggtgaccataggcatcctcaccgctttctgcgccagcttctgggcgctgatccacaagttcgagcatggcatctatttcgattcggtatcgatgttcgtgttcctgctgctgggcggccgctacctggaatcgatcgcccgccgcaaggccggggccgccagcgaaagcctggtcaagctggtgccggccttcgcgcaccggctggacaattggcccgccagccgcgacagccatgaagccaccgtcgccagcctgcgccgcggcgacgtgatcctggtccgcccgggcgaaaccatccccgccgacggcgtggtgctggatggccaaagcgccagcgacgaggccttgctcaccggcgaaagccggcccattcccaaaaccgccggcgacgcggtgatagccggcagcgtcaacacctccagcccgctgctgctgcgggtggaggaaagcggggagtcgacccggctggccggcatcgtgcgcctgctggaccgcgcgctggcggaaaagccccggctggcggtgctggccgaccgcttcgccagctggttcgtcgccctgctgctgctggccgccgccgccagttatctggcctggcatttcttggaccccggccgcgcgctgtggatcatggtggcggtgctggtcatctcctgcccctgcgcgctgtcgctggccaccccggcggccctcaccgccgccggcggcagcctggccagcctgggcgtgctcgccactcgcggccacgcgctggaaacgctggccaaagtgaccgacgtggtgttcgacaagaccggcacccttacccacggcagcatgaagctgctggacgtcgccatcgagggcagcctcgcgccggaacaagcgctggcgttggccgccgcgctggagcacggttcggaacacccgctggcgcaggcgctgcggcaagccgccgaaggcctggccgcgccgcgcgtcgaatcgccgctcaaccacccgggccacggcgtggcaggcgtgatggccgggcgcgaatggcggctgggctccgcccccttcatcgccgcctggctgcggcagccgcagcaagacgtcgccgactggcacgccggcagcacccaggtgctgctggcgaatagcgacggcgtgcaggcccgtttcgccatcggcgacgccgtgcgcgccgacgccgccgagctggtggcgcgcctgcgccggcgcggactggccgtgcatctgctcagcggcgacggcgaacaggccgtctgcgcgctggcgcgcgagctggggctggaacgcgcgcgcgcgcgcgccacgccggaagacaagctcgcctacgtcggcgcgttgcaggacgccggccgccgcgtgctgatggtgggcgatggcgtcaacgacgcgccggtgctggcccgcgccgacgtctccatcgccatgggcggcggcactgacgtggcgcgcaccagcggcgacatggtgctgatcgcggaccaattgggcctgatagacgcgtcgctggacatcagccggcgcacgctgacggtgatacggcaaaacctgtgctgggcggcggggtataatctggtggccttgccgctggccgtgaccggccacgtcacgccctggctcgccagcctgggcatggcgctcagctcgctgctggtggccggcaatgccctgcgcctagtcaaacggaagaactga

SEQ ID NO: 2788 - DNA, 168 bp, Chromobacterium substugae
atggaaagcctctacctgctcatcccgctcagcctggtgctggccttcgtcatcggcgccatcttctggtgggccacccgctccggccagttcgacgacatggaaggcccggcccaccgcatcctgatggacgacgacaccccgcgccgggaggacgatcagcagtag

SEQ ID NO: 2789 - DNA, 126 bp, Chromobacterium substugae
ttggatggtattcacggatgcccttcgggagtgaaacagcggcaggggcgcgatggccgcagcggggcgcctggcggcgcggcggttgccgggaagctgttcgcaaaaaagagggcgattatataa

SEQ ID NO: 2790 - DNA, 1275 bp, Chromobacterium substugae
atgttgctgctggtcggcgtagcctatgctttttccacccgccgcgacgccgtcaactggcgcaccgtgctgatcggcctcgccatccagagcggcttgttcctcttgatcaactatatcccggccattcaccacggtttcgccgccttcggcgccggcttcgccaaagtgctgagcttcgccggcgaaggcgccggcttcgtcttcggcgacctggccaaacctggcggcaagctgggcttcctgttcgccttcaccgtgctgccggtgatcatcttcttctccgccttcagcgcgctgctctaccatttcggcatcctgcagcgcgtggtcgccgcgctggcctgggcaatgaagcgcagcatgcgcatttccggcccggaaagcgtggtggccgccgccaatatcttcctgggccagaccgaggcgccgctgctggtccgcccctacatccgccacatgacccgctccgagttggcctgcatcatgatcgccggcatgtcgacgctgtccggcggcgtgctggccgcctacgtcgccttcctgggcgggccggacgccgccgagcaggcgcgcttcgccacctacttgctgaccgcctcctgcatgaacgcggccggggcggtggtgttctgcaagatcatgttcccggaaaccgcccccggcgagctgtccagcaccaagctgcaggcgtccaaggaaaagagcgggggcaatttcgtcagcgcggtggtgaccggcgcgctggacggcatgaaaatggccgccgccgtggccaccatcctgctggccatcgtggcgctgatcgcgctggccaacttcctggtgaaggacggcctgggccagatgctgggcgtcaacgccgcgatccaggcctccacccacggcatgttcgacggcctgacgctgcaatacttggccggccaagccttccgggtgttcgccttcctgatgggaatcggctgggatgagacgctgggcgtcggcagcttgctggggcagaagatcgttctcaacgaattcatcgcctacctcgacctggccaagatgaaggccgccggcacgctgtcggcgccgacggtgatgatttccaccttcgcgctggccagcttctccaacctgtcgtcggtgggcatctgcgtggcgggcatcggcgcgctggcgccggagcggcagcaggagctggcgcagatcggcatgcgcgcgctgctggcctccatcctgaccggcttcatgaccgcctccagcgccggtttgtggctgtcgctattctga

SEQ ID NO: 2791 - DNA, 1317 bp, Chromobacterium substugae
gtgaaagcagatttctcctttttcgccacccggcgcttcctgcccttgttcggcacccagttcctaggcgccttcaacgacaatatgctgaaaaccgccatcgtggtgctgatcagctttcacggcctgaccctagccggcctgccgccggaaatgctggtcaatctggcggccggcatcttcatcctgcccttcttcctgttttccgccagcgccggcaaattatccgagcgttacgacaaggcgcgcatcgccaggctgatcaagctggccgagatcgccatcatgctgctggccggcgccggtttcctgtggcaatcggccgggctgctattgtcagcgctgttcctgatgggcacccactccgctttcttcggcccgatgaaatactcggtgctgccgcaatacctgcgcgaagacgaactggtcggcggcaccggcctgatcgaaatgggcaccttcctcgccatcctgctgggccagctgctgggcagcgtgctcacccacaacggctcgctgctgatcatcgccgcgctgctggtcaccgccgtgctgggctatttcagcagcaccgccatgccggcggtggcgcccggcgcgccgcatctcaagctgtcgtggaatttcctcggcgattcggtgcaactggtgggcaaggcctggcgcatccacgacgtgcgctgctccatcctgggcatttcctggttttggctgatgggcgcggtctacaccacccagctgcccaccttcacccgcatgcacctgggcggcgacgccgacgtctataccctgctgctggcgctgttctccatcggcatcggcatcggctcggtgatttgcgccaagctgtctcacggcaagctgcagctgggcatcgtgctgctgggcagcgccggcatgactgtgttcggcggcgacctggcgctgggcgcgatgcctcattaccacggcccgctggcgacgctggccgaattcatggcccgcgccagcagctggcgcagcatcgccgacgtggcgctgctgggcttcttcggcggcttcttcaccgtgccgctgtacacctggctgcaaaccggcagcccggatgagttccgctcgcaggcggtggccgccaacaacatcatcaacggcttttacatggtggcggccgccatcggcagcgtgctgatgctgaaatggttcgacagcatctcgatgctgctgctggcggtggccgcgctcaacatcctcgccaccgcgcacctggcctggtgcgcgccggacatctggcgccagcgcttcagctggatcgcgccgctgttcgccggcaaggcctga

SEQ ID NO: 2792 - DNA, 2292 bp, Chromobacterium substugae
gtgagccaaggctggccggcgaagagcgctgcgctggccggtgtcttgtggcgctggccgcgcgcgcgggccggcgcggcgcgctgccggcgcatggtggcccggcgcgaggtgcagggactgatcctgctggcgccgttgttgctcaccgtcatattgtcgcgtcatttcgacagggctgagcgggcggcgaccgagtccaatttccgccacgatgccggggcggcggccgagcaactggcgagcgcgatccagcaggatgtcgacgcgctggactcattggcgcttttcatgggcaacgcgcccaatatccgccaggatgatttctaccgtttcgccaggccgctggtggcgagccggccgctgtttcaagggataggctgggcgccgctggtgccgcaggccggccggccggcttatgaggcgaagtacggcaaggtccgcgagaagcgggccgatggccgcattgtcgccgccggcatccggcccgaatactatccggtgacctatatcgcgcccaaggaagacaatccgaaagtatggggtttcgacctgtggtcggagcccaggcggcgcgaagccatccgccgcgcgctggccagcggccaggccaggatcagcgagccgctgatcctggcccagttcaacgacgactccggcaagggggtgtcgatgatcattcctgtgcccggcgtccgcggcggcgtggtggtgggcggcatcaacgccgcccggctggcggcgcgggccctcccggcgctggctgaaaaagggatcagtctgcagctggacgatgtcggcggcggcggcacggtcagcctggtggcgccgacgcagcgagcgagtccgggaagcccgtggctgagccgcaagctggcgataggcgggcgggtctggaaggtgaccttgcgcgcgctgccgcgttacctggaggccagcggcagccatgcggcgctgctggtgttgccggccggcatggggttcacgctgctgctcggcatttacttgaacctgctgcaccggcgccgcgaggtggcggaagagttggccagccgaagcgcccgcgcgctaaggcagggcgaggagcgtttccgcatgttcgccagcatcgcctcggactggctgtgggagctggatgccgaaggacggctcagctactgttccgagcatttcagcgaattgaccggcgtgccgctgggcaagctgctaggccgccactggcgggagtggcggccggtgcgcgcgaaccgcgaccaggctgagcggctgtcgcggctgttcgccgggcgccaagaggtgcgggatttcgagctgagctaccggcggcgcgcagaggagcgctggatagccatcaacgcctgtccgctgctgagcgcggacggcgagctgtgcggctatcgcggcgtcggccgcgacatcaccgaacgcaagcggtcggagcaagagttgtacggccaccgcaatcatttgcaggagctggtcgcgcaacgcaccgccgacttgttgcaggcgaaggaggaggcggagcgggcgaatcaggccaagtcggaattcctggccaatatgtcgcatgagctgcgcacgccgctgcacggcatactcagcttcgccgagatcggcggcgacaaggtcgggcaggcgccgccggagcggatcaagcgctatttcgacaatatccatgccagcggcgccaggctgctggtcttgctgaacgatttgctggatctggccaagctggagtcggggcgcatggcgctgcaccgcgaggacgtggatctatgcgagctggtccgcctgatgacgcaggcggaagaggggcgcatggcggaggcgggcatcggcttgaagctggagttgccgccgctgccgctgctcgcctgggtggatcgcaagtccatgcagcagatattggccaatctgctgtccaatgcgatcaagttctcgccgcatggcggccggatccgcatcggtctgcagcatttcggctccatcgtcaccctgtcggtggccgatcaggggccgggggtgccggaagccgaattggagcgaattttcgacaagttcgtgcagagcagcgccaccgccaacggttccggcggcaccgggctgggtttggcgatctgccggcagatcgccctggcgcacgccggcagcatttacgcggaaaacctgccggcgggcgggatctgcttcttcgtttcgctgccggacgcggagaacagcaaaaccatggagcgcctgtcgctgctgctgggggagaaggaggctgccgcgcacggggctggcgaatga

SEQ ID NO: 2793 - DNA, 1404 bp, Chromobacterium substugae
atgaaaaccatccatatcgacgtagccgtcatcggcgccggcaccgccggcctcgccgcctaccgcgccgccaaggccggcggcgcttccgccatcgtgatcgagggcgggccttacggcaccacctgcgcccgcgtcggctgcatgccgtccaagctgctgatcgccgccgccgaggccgcccaccatgcgagccatgcagatatgttcggcgtgcatgtggatggcgaggtgcgcatcgacggccgcgaagtgatggctcgcgtcaagagcgagcgcgaccgcttcgtcggcttcgtggtgcgaagcgtggatggcattccgaccgaggacaagctgcgcggctatgcccgcttcatcgacaacaccaccttgcaggtggacgagcataccttggtacaggccaagcgcgtggtgatcgccaccggttcgtcgccggtgatcccgccgccgtttcaggccttcggcgaccgcctgatcatcaacgatgacgtgttcgattgggaagacctgccgcaaagcgtggcggtgttcggccccggcgtcatcggcctggagcttggacaggcgctgtcgcgtttgggcgtgaaggtgaaggtattcggcgcccgcggcggcgtgggacccttgagcgatccggcggtgcgcgactatgcgcgccaggcgctgggcaacgagttttacctggacccggacgccaaggtgctggaaatggccaatgatggcgacgcggcgcggatccgctatgtgagcctggacggcgcggaggtggaggagcgcttcgattatgtgttggccgccaccggccgcgcccccaatgtgcgcggcctcggtctggagaataccagcgtgctgctggatgcccgcggcgtgccgatgttcgacccggaaacgctgctgtgcgtcggcgcgccggtcttcatcgccggcgacgccaacgatatcctccccttgctgcatgaggcggccgacgaaggcgctaccgccggcggcaatgccgcgtcttacccgcaattgacggccggattgcgccgttcgcctatcgcggtggtgttttcggatccgcagatgatgatggtgggccgccgtttcgccgatctggccgacgagggtttcgtggcgggcgaggtcagcttcgaggaccaggggcgcagccgggtgatggggatcaacaaaggcctgttgcacgtatacgcggacaaggaaaccggccgcttcctgggagccgagatgataggcccgcgggcggagaatctggcgcatctattggcctggagccatcagcaacagctgacggtggcgcaaatgctgcaaatgcctttctatcacccggtgatagaagaaggcttgcgcaccgctctgcgcgacgcgaaggcgaagctggatgcgatagcgcttgcctaa

SEQ ID NO: 2794 - DNA, 903 bp, Chromobacterium substugae
ttgccggatgccggcattttaacgtcgcgggcggcgggctgcccagcgcggggcggagtcattgaaaaagacaatcaaaaatcttgcaacaatcaattagacctttttggtgctggctatcagaatgcattcatcgatagcaaacaaccaacaccccacaaggagctgaccatgctgcaaaatcgtgaaggccaacgcgtaccgaacgtcactttccgcatccgcgaaaacaacgagtggaaaaacgtgagcaccgccgaactgttcgacggcaagaccatcgccctgttctcgctgccgggcgctttcaccccgacttgctcgtccacccacctgccgcgcttcaacgaactggcgccggcattctacgccaacggcgtcgacgccatcctgtgcgtgtcggtcaacgacaccttcgtgatgaacgagtgggccaaggatcaggaagccgccaacatcgtgatgatacccgatggcaacggcgatttcaccgaaggcatgggcatgctggtggacaaggccgatctgggcttcggcaagcgcagctggcgctacgcgatgctggtgaaggacggcgtggtgcagaagatgttcatcgagccgcaagagccgggcgatccgttcaaggtgtccgacgccgacaccatgctgaattacatcaaccccaacgccaagaagcccgaccaggtcgtggtgttcaccaaggtgggctgcccgcactgcgcccgcgccaaggccgtgttggccgaaaacggctacgacttcgtcgaagtgccgctggacaacaagatccgcggcaaggcgctgggcgcggtgtccggcaagatgaccgctccgcaagtgttcatcaacggcgaactgatcggctcggcagacgaagtggaaaagcgcttcgccaagtaa

SEQ ID NO: 2795 - DNA, 408 bp, Chromobacterium substugae
atgcatatcagcggcctgcatcatctcgccatcatcgcctccgactatgcgcgctcgcgcgacttctaccaccgcgttctcgccctgcccatcgtggcggagaactggcgcgccgaccggcagtcgtggaaactggacctggccctgcccgacggcagccagatcgaactgttcagcttcccgcaaacgccggcgcgccccacccggcccgaggcctgcgggctgcgccacctggctttcgcctgcccggacatagacgcggcccgcgcgcacttgctggcccagggggtagaggcggaagcgatccgcctggacgaatacaccggctcgcgtttcttcttttgcgccgacccggaccgcttgccgatagagttttaccaggcggcgcatgccgaccgcccgacatga

SEQ ID NO: 2796 - DNA, 132 bp, Chromobacterium substugae
gtgcgcggaggccgcggtgccgagggcgaccagcaagcctgccaggagggcaggcgtgttagagatattcataagcattccgttttcgggtggattgccgccggcgcggcgctggcgccggcggttcgataa

SEQ ID NO: 2797 - DNA, 1854 bp, Chromobacterium substugae
ttgctggtcgccctcggcaccgcggcctccgcgcacgcgggcgccgacgacaccctgctggcggcccgcgacgccttccgcgccaatgaactgggcaggctggccagcctgggcggcagcctgccggacagctatccgctgaaggattacccttcctactggctggcctggaaggcgctggaaaaaaacgacgacgcccaggtgacgcgctttctcgaacaggtgccggaaggcctgatgccggagcggatacgcaacgaatgggtgaagaagctggggatgcgcgaaaactggaccgctttcgccgccgaatggaaaaagctgccggaggaaggccgcgacgaggagtccagctgttatggccaactgatggggctgtaccaggggcagaagcccgacaacctcgaccgcttcctggagggcaagccggtcccggacggctgcaaccgcctgatcgaaggcgcgtacgcccgcggactgatcaaccaggactggctgtggcgccgcgcccgcctgctgctggccggcaacttcgtcagccaggcgcgccagttggccgccgacacccagctgccgctggacaacgccgcgctcaacaagccggccaacgccaatttgtccactccgggcggccaggaagccgcgctgctggaaatcgagcgcaaagcgaaaaccgacttggacggcgccgccgccagcctgtcccgtctggaaggcaatatcgacgccgaccgcagcggcttcggctgggggcagttggcgctgctgtcggcgcgcaagcagctgtccgcccaggcgctgcaatggttcgacaaggccgatccgcgccagctcaccgccgaccaatgggaatggtgggcgcgctcggcgctgcgcctggagcaatggacgcagctggacggcatcatccgccggatgccggcggcggtcgcggcgcgcccggcatggcgctactggctgggacgctcgctgcagcagcagggcaagccggcgctggccgcgccgctgttcagccaggccagcgtcggccataactactacgcgctgctgtcgctggaggaactgggcaattcgctgtccgcctccaccaataaaaccatgcccagcgccgacgatgtcgcgcggatgaagcaggaccccgccattcgccgctcgctggccttgctgtcggtggccgaaatctacaccaagcccgaattccgcaccgacgcgcagcgcgaatggcgctgggcaatgcgcggccgcaacgatatggaactgctggccgcggcggaaatcgcccgcaaggaaggcttttacgacatggccatctacagcgccgagcgcaccaaggaagagcatgacttctcgctgcgctacctgacgccctaccgcgacatcacccagaagtacgcgcgccagctcgacatcgacgacgcctgggtctacggcctgatccgccaggaaagccgcttcatcaccatggcgcgctccggcgtcggcgcctccggcctgatgcagctgatgccggccaccgccaagtgggcggccaagaaaatcggcctcacccatttcgccgtcaacgacatcgacacaaatgtccagctgggcacctggtatctgcgctacgtgctggacaacctgtccggcaatcaggtgatggccaccgccgcctacaacgctggccccagccgcgcccgcaactggcagaccaaccgcgcgctggacggcaccatctatgccgaaaccataccgttcagcgaaacccgcgattacgtgcaaaaagtgatggccagcgccgcctactactccagcaccttcggccacgccaatatctcgctgaaaaaccgcatgggcatgatccctccgcgctga

SEQ ID NO: 2798 - DNA, 960 bp, Chromobacterium substugae
atgaaccagacaattgccccactcccgcaaaagatctgcctgataggcggcagcggattcattggccgccatctggcggcgcggctggccggggacggccaccgcatcaccgtggccagccgcaaaaccgcgctgcctgaattcctggtgctgccgtcggcgcggctggtgaacgccgacattcacgaccccgcgcagctggaggcgctgatctccggccacgacgcggtagtcagcatggtcggcatcctgcacggcagccgcgcccagttcgaaaaaaaccacgcgcgcctgcccgaagccatagtcgaagcctgccgccgccagcgcgtgccgcgcctggtgcatgtcagcgcgctgggcgcggcccaggacgctccaagcgattacctgcagaccaaggcattgggcgagctggcggtggaaggcagcgggctggactggaccattctgcgcccctcggtagtgttcggccgcgacgacgccttcctcaatctgttcgccgcgctgcagaaacggttgcccttgctgccgctggccggcgccgccagcaagatggcgccagtatgggtggaagacgtggcgcgggcggtgtgcgccagcctcggccggccgcaaaccctgcgccgcaagctggacctggccggacccgagatttacacgctggcagagctggccagactggccggccgctgcagcggccattcccgtccggtcatcgggctgcctgacagcctggccatgctgcaggccggcctgatggaacggctgcccggccccacgctgatgagccgcgacaatgtccgttcgctgcgttgggacaatatcagcgagcatccctttccgtccgggccgctgggcttcgcgcccaccccgctgtcggcgctggcgcccgcctggctatcaggccgcgacggcaatcatatcgtctcccgctaccgggaaaaggctgcgcgttaa

SEQ ID NO: 2799 - DNA, 1224 bp, Chromobacterium substugae
atggacatttatatcgtcggcggcgcggtccgcgaccgcctgctgggcctgccggtcaaggaccgcgactgggtggtggtgggcgccacgccgcagcagatgctggaccagggtttccgcccggtcggcaaggactttccggtattcctgcacccgcaaacgcaggaggagtacgcgctggcccgcaccgagcgcaagatagccaagggctaccacggcttcgtatttcacaccgatagcggcgtgacgctggagcaagacctggcgcggcgcgacctcaccatcaacgccatcgccgaagccggcgacggcagcctgatcgatccctatgacggccaggccgatctgaaggccggcattctgcgccacgtcagcgacgccttcgccgaggacccggtgcgcattttgcggctggcgcgcttcgccgcccgcttcgatttcgccgtcgcgccggaaaccatggcgctgatgcggcaaatggtggacagcggcgaagccgatgccctggtggccgagcgggtatggcaggaactggccaagggcttgatggaagacaagccttcgcggatgctgctgacgctgcgagaatgcggcgcgctcgcgcgcgtgctgccggaagtggatgccctgttcggcgtgccgcagcgcgccgactaccacccggaaatcgattgcggcgaccacaccatgcgggtgctcgattacgcggccgccgccggctacccgctggcggtgcgcttcgccgcgctcggccacgacctgggcaaggcgctgacgccgcccgaggtgctgccgcggcatatcggccacgagatcaacggcacccggccgctggccgaactgtgccgccgcctgcgcgtgcccagcgactgccgcgacctcgcccacatcaccatggtcaaccacaccaaggtgcatcaggcgcaggagttgcggcccgccaccgtgctgcggctgttcaaggacagcgacgccctgcgccggcccgaccgcttccgccagatgctggacgcctgcctcgccgacgcgcgcggcaggctgcatttcgaaaccgcggcctacccgcaaaaggactacctcgagagactgctggctgctacgctgcaaattgatgccggcgccatagccgccggctgcagcgacaaggccgcgattcccgccacgctggatgcggcccgcaccgccgtcatcgccgactgcaaggagcaatgggaggaccgctga

SEQ ID NO: 2800 - DNA, 1113 bp, Chromobacterium substugae
atggatgcgctttaccgcctgccggccatgctgatgcgcggcggcaccagcaaggggctgttcatccgcgccgactcgctgccggaagacaccgagcaatgggaagccatgctgctgcgcgccctcggcagccccgatccctacggcctgcagatggatgggctgggcaccgggctggccagcagcagcaaggtgatgatactcagcccctcgcgccgcgacgattgcgacatcgactgcctgttcggccacgcctccatcgccgacgcgcgcatcgactggtccggcaactgcggcaacctcagcgccgccgcgccgctgttcgccatgctggaaaacatggcgcgtcccgcggacggcgtcgccaccatcgccatctggcaagccaatgtcggcaagcgcatcctggccgagctggaagtcttcgacggccagccggtgtggcagggcgacttcttcatcgacggcgtgtccttccccggcgcgccgatccggctgcgcttcctcgacccctgcggcgtcagctcgggcgagctgttcccgtccggccggctgatggacgagctcaaactgcccgacggcagccacatcgaggccacgctggtggacgccggcaaccctaccgtgttcgtgcgggcgcgcgacttcggcctgagcgggcgcgagccggccggaccgatgccgctggccacgctgcgccggctggagctggcccgcgccaccgccgcagtggcgatggggctggccgaagacatcttcgccgccgaacgcgagcggccggcctttcccagaatcagcttcctgtccgccgccgccgatgccgaatgccagctcaacgcgcggctattgtcgatggacagggtgcatcatgcctattccggcaccggcgccatcgcgctggcctgcgcctgcgcggtcgacggcaccctgccggcggagctggccggcggcgcggtgcgaggcatgccgctcactttcagccacgccagcggcaagcagacgctggaagcggtgctgggccgcgcggagttggggtggtcggtcagcgaggtggtgatgacgcgcaccgccaggccgctgatgcgcggcgaggtctacatcccgccagcctga

SEQ ID NO: 2801 - DNA, 678 bp, Chromobacterium substugae
atgtcatccgctttgcatttcacaatcgacagcctgatcagctggcctccggccccggatgtcgacggccagaccagccacccgccgctggagccggtccccgccatgcagcggcggcgcatgagcccgctgtgcaaggctgccatgcatggcgcgttcggcctgggcgacggcggcgacgacattcccttggtattcgcatcgcgcttcggcgacatgtcccgctccatcgaactgttgcagcaactcagccagggcgagtcgctctcccccacccagttcagcctgtcggtgcacaacgccatcggcgcgctgcacggcatattgtccggccatgccggacagtacacggcgatcgccgccgccgaagaaaccgtggaggcggcctgctgcgaagcattggccatgctggtcgacggcgcgccggctgtgcggctggtggtttacgacgccccgcttcccgcgccataccaagacgccgcgccggctcagccgccgctcatcgcctgggcatgccggctgcgcctggccgacagcggcccgcgcttcagcctggaaagcgcgcctgccagcggcgacgccgacagccaagggctgtggccgttcctgaacagcgctgcccggcagcatacccaccattgcggccaacgcgactggcattgggcccgacatggctga

SEQ ID NO: 2802 - DNA, 750 bp, Chromobacterium substugae
atggccaccgccatcgccttctccgtgttcggactgggcggcgtgctgttctcgctgatcgtctttccgctgctgatgctgctggtgcgccgcccggcgcgccgcatcgccttgtcgcggcgcgtggtccagataagcttcgcggccttcattcaattgatgcgcgcgctgggcattctccgctaccgcatcgtcggcgccgaaaaactgcggcgccccggcctgctgatcctggccaaccaccccacgctgatagacgtggtattcctcatttcgctgctaccaaatgccgactgcatcgtcaagtcgtcgctggcgcgcaatccgttcacccgcggcccggtgcgcgcctccggctacatttgcaacgattccagcgaagggctgatcgaggactgcattcactccgtccacgacggcaacaatctggtgatcttcccggaaggcacccgcacgccgctggacggccgcttcacattgcagcgcggcgccgccaatatcgccgtccgcggccgccgcgccatcacccccgtgtccatccgctgcgaaccgcgcagcctggccaagggcgtgccctggtggcggattccgccgcggccgatgcatttcaccatcgaggtgctggacgacctgccggtcgcgccgtttctcgaggggcagagcgaagccatggctgcccgcaaactgacccgtttcctgcacgacttttaccttacgacatcgagccttcatgcaaaccctggaacttga

SEQ ID NO: 2803 - DNA, 261 bp, Chromobacterium substugae
atgcaaaccctggaacttgagatcaaaaacctgttgatcacctccttgaatctggaagacatcacccccgacgacatcgtcgccgacgccccgctgttcggcgacggcctgggcctggactccatcgacgcgctggagctgggcctcgcgctgcagaagcgctacggcatcaccctgtccccggacggcgaggaaacccgccgccatttcgccagcatcgccagcctggccggcttcgtcgccagcgcgcgcaagctgtaa

SEQ ID NO: 2804 - DNA, 252 bp, Chromobacterium substugae
atgaccaaagacgaactcttcgcgcgcctgagcgctgtgctgcaggacacttttgaaatcgaagccgacgccatccacccggaagcgcgcctgcgcgaagacctggacatcgacagcatcgacgccgtggacctgatcgtccagttccgtccgctggtgggcaaacgcctgcagccggacgtgttcaagtcggtgcgcacgctgcaagacgtagtggacgccctccacggcctgatgcaggaaaacgactga

SEQ ID NO: 2805 - DNA, 549 bp, Chromobacterium substugae
atgcccgccaccgcgctggccagcctgctgaccctgagctaccccttcctgatctatttcggccagggacgggtggagccgcgcctgctggcgggcgtgctggtcggcatcgccctgctgcgcgcgctcagcacgcgccaggcggtctggtactgggccgccgccgccacgctgctgctggcggcgttcagcatgctgggcaacggtttgctgccgctgaagctctaccccttgctggtcaatgccgtcctgctggcgatgttcgccggcagcctgcgcttcggcccgccgctgatcgaacggctggcgcggctgaccgagccggagctggacgcgcgcgccatacgctacacccgcgccgtcacccaggtctggtgcggctttttcatcgtcaacggcagcctgtcgctggctaccgcgctctgggccgacaacgccgtctggaccgcctacaacggttgcatttcctatctgctgatgggcgcgctgttcggcggcgaatggctggtgcgccagcgcgtcaaatcccgcaataccactcatggctga

SEQ ID NO: 2806 - DNA, 1668 bp, Chromobacterium substugae
atggctgatttcattcccctttcgcgactgctggccgtcggccgcggcgcaggccaccccgtcgcccgcgacggccagcggcattacagcttcgccgatttccgccaacgcgccgcgcgctggcgcgccggcctgctgcgcacgcgccagcacgtagtggccatccatctggacgacagcttcgagttcgccgccgccctgtttggcgcctggcacgcgggcaaaaccgtctgcctgcccgccgacgacctgccggccacccgcgccgcgctggccgaacgcggcatgctgctggatgcgcagccggccgacgcggacgactacgccgatttcggcgagctgtccgaagacggctgccggctgcagctgttcacctccggctccaccggcgagccgcaggcgatagacaaaggcctgcgccagctggcggcggaaaccgccatcttgtcgcggctgtgggacgacgcgctgcccgccggctgcctggtggaagccaccgtttcccatcagcacatctacggcctgctgttccgcgtgctgtggccgctggccgtcggccgccccttcgcctgccggcgccagaccttcccggaaaacctgctgcaggcgctggcaaacgagccctgcctgctggtcagcagcccggcccacctgaaacgcctgccggccagcctcgactggacaagcgcagccggcaagctggccgccgcgttttcctccggcgggccgctggacgacgccgcgctggccaacagcctggcgacgctgggacaggcgccgtgcgaaatcttcggcagcaccgagaccggcggcatcgcctggcgccgccgccagaccgacgccgcccagccgtggcagccgctgcccggcgtgcaagtgcgcctggacgacggcctgctggccatccgctcgccccatctggacgatgacggctggcatcagacccgcgacaaggcggcgccgcagggcgagggctttgtcctgctcggccgcgccgaccgcatcatcaagctggaagagaagcgcgtgtcgctggacagcgtggaggccgctctgttggccagcggcctgttcgacgccgtgcgcctggtgctgctgcccggctcccgcgacacgctgggcgtggccgcggtacccaacgccgcgggctgggagcgactggccgcgctcggccggcgcgaattcgccgcccgcctgatcaccgaactgaagcgcagcgtgatcccggaaggcctgccgcggcgctggcgctacggcttccgcctgccggtcaacgcgcagggcaagaccacccaggcgcagctgttgtcttggttcgaggcccgccgcccccacatcacgctgctgcgacgcgacgccggctacgcgctgctgtcgatagaagccgccgccgcgctgccggacttcgccggccacttccccggcttcccgctgctgcccggcgtcacccagctggactggagcgtgcgcctcgcccgcgagctgttcgacctgaccggcttcagcggcatggacaatctgaaattccagcgcatcatcgcgccggacagcacggtgcggctggagctgcgctacgacagcgacaagcgcagcgtcagcttcgcctacgattccgacggcgagccccacgccagcggcaagctgcgcttcggagccccggcatgctga

SEQ ID NO: 2807 - DNA, 735 bp, Chromobacterium substugae
atgctgatctgcgcggtagtgccggtatacaaccacggcggcgcggtgggcagcgtggtggcctccttgcgcgcgcaagcgctgccttgcgtgctggtggatgacggcagcgacgccgactgcgccgcggtgctggacgcgctggccgccgccgacgaacacgtgcggctggtgcggctgccggaaaaccgcggcaagggcggcgccatgatcgccgggctgcgcgccgcgcgcgagctgggctacagccacgcgctgcagatagacgccgacggccagcacgacagccgcgacatcccgcgcttcctggagttggcccgcgcccagccgcaagccttgatctgcggctgcccgctgtacgacgaaaacgcgcccaaaagccgccgctacggccgctacgccacccatgtctgggtatggatcaacacgctgtcgctgcagatcgccgacgcgatgtgcggcttccgcgtctacccgctggcggcgacggtgccgctgttcgaccaggcgcggctgggcctgcggatggatttcgacgtggaagtgctggtccggctgagctggcgcggcatgcgcatcgtcaacctgcccacccgcgtcagctacccgctggacggcgtgtcgcacttccagctgtggcgcgacaatctgcgcatcagccgcatgcacgccaagctgttcttcggcatgctgccgcggctgcccctgctgctggcccgcaaggcggcgcgatga

SEQ ID NO: 2808 - DNA, 933 bp, Chromobacterium substugae
atgaagccggcccgccattgggccggcatcggcgaaaacactttcgtcgccggcatcgtgctgctgttctgggttcaccgcctgctggggcgccgcctgttccgcctgtgcctgctgccggtggtggcctgctactggctggcatgcgcgccggcgcgcgcggcctcgctgcaatacctgcgccggctggagcggcactgcggcacgctgggccgccagcccggcgcgcgcgacaccttccgccatctgctgcgcttcgccgacaccatgctggacaagctgcttgccaccgccggccactacccggccgaccgggtggcgatcagcggcgccgacgtcatcatcgacggcctgcgccagcggcgcggcgtcttgatcgtcaccgcccatctcggctgcctggaactgtgccgcgcgctggccgaccgctcgcccgacgtggtggtcaacgtgctggtgcacacccgccacgcccagcgtttcaacgcgctgctcgaccggctcaatccgcagcagtcggtgcggctgctggaggtgaccgaggtcaacgccgccaccgccgtgctgctggaacagagaatcgccgccggcgaggtggtggccatcgccggcgaccgcgtgccggtcagcggcgaccgcacggtgagcgtgccgtttctgggcgaaccggcgccgttcccctgcggcccctatctgctggcccacctgctgcgctgcccgctctacctgatggcttgcctgcgccagggcgcgggctaccacttgcaattcgtgccgctggccgagtccatccgcctgccgcggcaaaaccgcgaagcggcgatcggcgaatacgccgcgcgtttttccggcgaactggcccgcctgctggccgcctcgccctacgactggttcaattttttcccgttctgggatcagaaatccaaatcatga

SEQ ID NO: 2809 - DNA, 1542 bp, Chromobacterium substugae
atgacccccaagcatcaagattctgtaatattcgatggctcctggctgtcgctggacgacatccacgccatcgccatcggcgccaagcaggcgcggctgtccgatgacccggcgttctgcgagcgcatcgaaaaaggcagccgcttcatcgaccagctgctggccgaagacggcgtggtctacggcgtcaccaccggctacggcgactcctgcaccgtggagattccgcccgccctggtgcaagaactgccgcaccacctgtacacctaccacggctgcggcgccggccgctttctcgacgcggtcgaaacccgcgcggtgctggcgacccggctggcctcgctgtgccgcggcgtctccggcgtcagcctggcgctgctgcgccagctggccgcgctgctcaagcacgacatcctgccgctgattccagccgaaggctcggtcggcgccagcggcgacctgaccccgctgtcctacgtcgccgccgcgctgtgcggcgagcgcgaagtgacgcaccgcggcgagcgctgcgccgccgccgacgcgctgaaggccgccggcctcgcgccgctgcggctgcgccccaaggaaggcctggccatcatgaacggcaccgcggtgatgaccgcgctggcctgcctcgcctggccgcgcgccgactacgcctcgcgcctgtgctcgcgcctgaccgcgatgaacgtggccgccgccgccggcaacgcccaccatttcgacgaagcgctgttcgccgtcaaaccccaccccggccagcaacgcatcgccgcgcgcatccgcgccgacctggaagccccgcgccccagccgcaacgacagccggctgcaggaccgctactcgctgcgctgcgcgccccatgtgatcggcgtgctggaagacgcgctgcccttcctgcgcggcctgatcgaaaacgagctgaacagcgccaacgacaaccccatcatcgacgccgacgaagagcgcgtgctgcacggcggccacttctacggcggccacatcgccttcgcgatggacagcctgaaaaacgcggtggccaatctggccgacctgatggaccgccagatggcgctgctggtggacacccgctacaacaacggcctgccgcgcaacctcagcggcgccagcccggagcgcgcgcctatcaaccacggcctgaaggcgctgcagatcagcgtatcggcctggaccgccgaagcgctgaagcagaccatgccggcgtcggtgttctcgcgctccaccgaatgccacaaccaggacaaggtcagcatgggcaccattgccgcccgcgacgcgctgcgcgtgctggagctgaccgaacaggtgctggctgccttgctgatcaccgcgcgccagggcgtggagctgcgcggcgaaatcgccgagctgtcgctgagccccgcgctggagcggatgcagcgggacctggccgcgcgcattccgcgcatcgccgaagaccgcgcgctggaccgcgagctgcagcaattgctcgccgccatccgcgcgcaagcctggagcctgtatgcctga

SEQ ID NO: 2810 - DNA, 417 bp, Chromobacterium substugae
atgcctgatctgtcgcacgccatagcgctggacccggccttccacgacctcgacccgatggacgtggtctggcacggcaactacgtcaaatacctggaaatcgcccgctgcgcgctgctggagaaatacggctacaactacccgcagatgcgcgactccggctatatctggcccatcgtcgacatgcggctcaaatatgtgcaatccatccgcttcggccaaaaggtcagcatcgaggcccgcatcgtcgaatgggagtgccggctgaagatcgaatacctgatccgcgacgccgccaccggccacaagatcaacaaggcctacaccgtgcaggtggcggtggacatcgccagccaggaaatgctctacctgtgcccgccggtgctgtgggaaaaactgggagtgcccgcgccgtga

SEQ ID NO: 2811 - DNA, 606 bp, Chromobacterium substugae
gtgaagaaactcgtcctgctggccggcctcgcgctgctgccgctgaccgccgccgccggcgatctgatcgccgacatcacccgcaagctggcgcagccggccgtgctgcgcggcgcgttcgagcaaagcaaggagatcgccggcttcgccaagccgctgcgctccagcggcgctttcctggtgtcgcgcgagaaaggcgtgctgtgggatacccgccagcccttcgccagcaagctcaggctgacccgcggcgagatcgtcgccacccagaacggctcagtgtcatttcagctgagcgcggccaaagagcccaccgtgcgcaccatcaacgagctgatgttcgcgttgctgggcggcaacctgaaagcgctggacggctatttccgcatcgacggcaagctgtccggccgcgcctggcagctgacgctgacgccgcgccagagcgcgctcgcccgcgtgatgcaaaaagtggagctgtccggcgaccaatacgtgcgcgccatccgcatggacgaagccaacggcgacgtcacccgcatcgtgttcagcggccagaaccccatgcccgccaagctgagcggcgaggaagaggcgcgctttgactga

SEQ ID NO: 2812 - DNA, 2334 bp, Chromobacterium substugae
ttgactgagcatctgggatccagccgtccgcaacgctggctggccgccgtctggctggccatcctgctggccgtggccggccataacggctggctgtggctgggcggccacgcgcggctggaaaccgacatcctggcgatgctgccgcaaaaccgccaggaccaggcggcccaggacgccacccgccagctggccgacgccgccgcgcgccgcgtggtggtgctggtgggcgcgcgtgactgggccgacgcccgccgcgccggcgacgcctacgccgccgccatccgcgcatccggccagccgctggcgccgcgctaccgggtgggcgcgcaggaaagcgacaactggctggacttctacgccgcctaccgcggccagctgctcggcgacgatacccgccggcaactgcggcaaaccgcgcccgccgcgctggcggaacaggccgccgccgccttgttccagccagtgggcatgcccaggctgggacgctggcaggacgatccgctgaatgtctacggccaatggctgggcgagcgcgccgcgcaaagccgggtgcgggtgcgggacgagcgcttgtcgctgtccggcgccgacatgcagtacgcgctgatcatgctggagcagcaaggcccggcgttctcggtggcggcgcagcaggcgatgctgccggcgctgcgccaagccgaggccgccgcccgccaggcggtcccgcatgcccagatcatccagggcggcgtgccgctgttcgccgccttcgccgccagcgccgccgagcgcgaagtccacaccataggactgggttccttgctgggcattctgctgctgacggtgctggccttcagcggcattcgcccgcgcatcctggtgacgctgtccatcgccgccggcctaggctgcgccatttcgctcacctcgctgctattcggcaagctgcacctgatcaccctggtgttcggcgccagcctgatcggcgtggcggaaaactacggcaacaattactacgcctatcggctgggcaagccggccggcgagcgctgggcgatgctgcgcggccagcgcgccaccatgtggctggccttcgccaccaccgccatcggctacgcgctgctggcgctggctcccttccccgggctacggcagatggcggtgttttccgtgaccggcctgttcggcgccttcgtcaccacgctgtgctgcctgcccttcgccgaccgcggcgagatgccgttcaaccgcttcgcccgcgcgctgggcggctggcgccggcgctggccgcgctggggacgcaaccgcttcagcctgctgctgggcctggcgatggccgccgcgctgctggccggcttcgccgtcctgaaaaccaatgacgacatccgcgcgctgcaaaacgcgccgcaaagcctgctgcaggaccagcgccgcatcggcgaactgatggaaatggccggcccggcgcaattctacctggtgagcggcgacagcccggagcaggtgctgcgccgcgaagaagcgctgaaaacccggctggcgccgctgatcgccgccggccagctcaagggcgtgcaggcgatttccgactgggcgccgtcgcaggcgcgccaactggcagaccggcgattgctgcaacaaacggtgttcgcgcccggcggcgtgctggcgctggcctccgcccgcctgggccagcctgccgccgccgcgccgccgcccgccgccttccagccgctgacgctgcaggcctggctggccgcgccggtgtccgaacccttgcgcgcgcaatggctgggccgcttcggccagggctacgccagcgtggtgatgctgcgcggcctggccggcccgtccatactgcccttgctggcgcggcaggccgaacccgccgccggcgtccgcttcatcgacaaggccggcgaggtgtccggcctgatgcggcactaccgccagttgatgagctgggtgatcgccgccagctacctgctggtgctggccatgctgtggcggcgcttcggccgccaggcctggcgcgcgctgctgcccacgctgctggccagcctgctgaccgtggcgctgtcggcgctgctggggcagccgctgcagctgttcaccatcctggccctgctgctgattctgggcatgggggttgattacggcgtgttcctgctggccgacgacgatccgcgcgcctttctgtcggtgacgctggccgcggccggcaccctgctctcattcggcctgctggcgctgtcgtccaccccggcgctcaccgccttcggcctgaccatgctgctgggcatcagcctgtgctggctgctcaaccccctattcaccccaaaaacataa

SEQ ID NO: 2813 - DNA, 1095 bp, Chromobacterium substugae
atggaaactggctctcaaaccctgcaagacaaaagcttctctcccgcgcgccaaagcgtgatggacgcgcgtttcgaagcgcaaaagatcgccttcggcccggtcgtgttccaatgtgtgcgcatcgcctggaagcgcggcatcctgaaagccctggccgaagccggcgagaagggcctgtccatcgccgagctggccgccgccggcgacttcaccgtctacacgctgaagctggtgctggaaacctgcctgtccgccggcgtggtggagttgcgccagggccgctacgcgctggacaagaccggcttctgcctgctgtccgaccccatcacccagatcaacctcgacttcatccatgacgtctgctaccagggcctgttcgagctggagcgttcgctggacgaggaaaaaccgcacggcctggccgcgctgggccagtgggacaccatctaccagggcctcgccacgctgccggagccggcgcgcgaaagctggctgcgcttcgaccacttctactccgacacctcgttcccggccatcctgcccgacgtgttcgccacgcgcccgcgcaagctgatggacatcggcgccaataccggcaagttcacgctggccgcgctggcgcacgacgccgaggtggagatgcacctggtcgacctgccggggcagctggcagtgatcgaaaagacgctggcggaaaaaggcctgagcgcgcgcgccaacctgcacccgatagacatgctgaacccggcgctggacttccccgccggcatggacgtgatctggatgagccagttcctgtcctgcttcagcgaggaggcgatcgccagcatcctgcgccgcgccgccgccgcgctggccgacggcggccgggtgatgatcctggacacgttgtgggaccgccagcagcacgacatcgccgcctactgcctgatcaacacctcgccctacttcaccgcgatggccagcggcaacagcaaggtataccgcgccgacgactacatccgcctgtgcgaagccgccggcctgaaactggtgcaagagcgcgacggcatcggctattgccactctctgctgcagttcgcccgcgcatga

SEQ ID NO: 2814 - DNA, 570 bp, Chromobacterium substugae
atgatccgcctgcgccgcctcctgcccctgtgcctgtgcctggttctgctggccggctgccagagcgcgcccgcgccgcagccgcgcctgccggccatcgccctgtcgccggccagcctgggcctcagcctgagcctggcccagcgcctgagcgcggcgccgctggacccgcgcgacggcacgccctcgccggcgctggacgtgcagctggaaatcgacggcgaccggctgcaattggccggcctggcgctgggacagcgcatcctgcggctgagttgggacggcaagacgctgcaaagccagcgcagccccttgctgcccgccagcgtcgacgaagcgcgcatcgtgcgcgacatccagctggcctactggccgctgccggccttgcgcgcggcgctgccggaaggctggacgctggagcagcgcggcgcgacgcgcgtgctcagccagcagggggaggaagcggtgcggatagacagccaggccgacccggcctggaccggccacagcgaattgatcaatcggcgcgaaggctatcgcctgagcatagactccgcgccactgcagtaa

SEQ ID NO: 2815 - DNA, 1188 bp, Chromobacterium substugae
atgacgaacgccgtctatctcaaccacctgggagccctgtgcagcgccggccgcggccacgccgcgctgcgcgaggcattgttcgcgccgccggcgcctattcggcggcccggcctcgcgctgcccgatggccgcgtctggcctagcgcgccctatcagcaggcgctgccggacgtggactggctgccgctgccgctgcgcagccgcaacaacgcgctgctgctggccgcgctggaggatatccgcgccgaagtggacgcggccatcgcccgcttcggccccgaccgggtgggcgtggtgctgggcaccagcacctccggcataggcgagagcgaagccgccttcgccgcgctgcggcgcgacgggcgctttcccgccggcttccatccgctgcagcaggaactgggctctcccgccgccctgctgcgccacgcgctgggcataggcggcccggcgctggtgatctccaccgcctgctcgtccggcgccaaggccctggccagcgcggcgcgcctgttgcgttccggccagtgcgacgcagtgatcgccggcggcgccgattcgttgtgccaattcaccgtggcgggcttcgccgcgctggattcggtcagcgccaccggctgcaaccccttcagccgcaaccgcgacggcatccacatcggcgaggccgcggcgctgttcctgatgagccgcgaacgcggcccggtgcggctggccggctggggagaaagcgccgacgcgcaccatatctcggcgcccgatcccagcggccgcggcgccgcggcggccatgcgccaggcgctggaacgcgccggcctcgcgccggccgacatcgactacatcaatctgcacggcaccgccacccagcagaacgacgcgatggaaagcctggcggtcagccagctgttcggcgccgccgtgccggccagttcgaccaagggcctgaccggccatacgctgggcgccgccggcgcgctggaagccgccttcgcctggctgaccctgcacggcaatccggcggcgcggctgccggtccatgtctgggacggcgcgcccgacgcggccctgccgcccctcaacctggtccgccccggccaggcggccgccacgccgccgcgccgcgcgctgagcaattctttcgcctttggcggcagcaatgcctgcctgatcctggaggccgcgcaatga

SEQ ID NO: 2816 - DNA, 459 bp, Chromobacterium substugae
atgagcgacgagctgtacgaaatcgactccctggtgccgcacgccggcgacatgtcgctgctggaccgcgtattgtccgccgacgccgacagcgtggtggccgaagtcacgccgcggctggaccagctgttttgccgcgacggcgaaatcggcagctgggtgggcatcgaatacatggcgcagaccataggcgtctgggccggtttgcgcgccaaagcccaaggccggccgcccaaggtgggcttcctgctgggcacccgccgctacaccgccgaggtatcgtccttcgcgcccgacgtgccgctgcaggtgagcgtgacccagcaattcatttccgacaacggcctgtgccagttcgactgtcatatcgacagccagggccggcgcctggccacggcccagctcaaggtgttcgagccggccgatatcgatcatttcatcaaggaatcctcgcaatga

SEQ ID NO: 2817 - DNA, 732 bp, Chromobacterium substugae
atgacagaccatgccattctggtcaccggctccagccggggcataggccgcgcgatcgccctgcgtctggcccgcgacggccatgacgtggtggtgcattgccgcagccgccgcgaagaagcggacgccgtcgccgccgaaatcgccgcgctgggccgccaggcccgcgtgctgcagttcgatgtgaccgaccgccaagccgccgccgccgcgctgctggccgacatcgaagcccacggctgctactacggcgtggtatgcaacgccggcctggcccgcgacaacaccttcgccgccatgccgccggaagactgggacctggtggtcaacaccgatctcggcagcttctacaacgtgctgcagccgctgaccatgccgctggtgcgccgccgcaagccgggccgcatcgtcacgctggcttcggtatccgcactgatgggcaaccgcggccaagtcaactacagcgccgccaaggccggcgtgatcggcgccaccaaggcgctggcggtggagctggccagccgcgccatcaccgtcaactgcgtcgcgcccggcctgatcgacaccgaaatggtggaagcgcacgtgctggatgaagcgatgaagatcatcccggcgcgccgcatgggcaagccggaggaagtggccgcgacggtgagcttcctgatgagcgaggacgccgcctacatcacgcgtcaggtgatttcggtaaacggggggatgatgggatga

SEQ ID NO: 2818 - DNA, 1233 bp, Chromobacterium substugae
atgaagcgagtcgtgattaccggcgtgggcgccctcagcccgctgggccatgattggcaaagcgtgtacgcccggctgcaagccggccgcaacgtggtgcaggtgatggagccctggggcgagtacgaaggcctgggcacccaggtcggcgcgccggtgcagccgttcgagctgcccgcccactacaatcgcaaaaccacccgcagcatgggccgggtggcgctgatggccacccgcgccaccgaaatggcgctggaacaggccggcctgctgaacgacccgctgctgggcagcggccgcatgggcatttcctacggatcgtcgtccggctgcccggccaatatgggcgatttcggccgcatgctggtcagcaagaacatcgaaggcatcaacgccaacacctacatccgcatgatggcgcacaccgcgccggtgaacatcggcgtgttcttcggcatcaccggccgcgtcatcaccacctccagcgcctgcacctcgggcagccagggcataggctacgccttcgaggcaatccagagcggccgccaggtggcgatgatagccggcggcgccgaagagctggacccgacccaggcggcggtgttcgacaccctgttcgccaccagcgtcgcccacaacgaccagccctcgctgacgccgcgcccgttcgacgccgcccgcgacggcctggtgctgggcgaaggcgcctgcagcctggtgctggaggagctggagcacgccaaggcgcggggcgccaacatcctggccgaaatcctgtccttcggcaccaatagcgacggcaagcacgtcacccatccgcaatccgccaccatggccggcgccatccgcatggcgctggacggcgcccagctcgcgccgtcggacattccctacgtcaacgcgcacggcaccgccaccgatcagggggacgtggccgagtcgcacgccacccgcgacgtgttcggcgaaaaagtcgccatctcttcgctgaagagctatatgggccacacgctgggcgcttgcggcgcgctggaagcatggatgtcgatagaaatgatgcgcgagggctggttcgcgcccacgctcaacctcaccgaggtggacccgaactgcgcgcagctggactacatcgcaggcgacggacgccggctgcaaaccgagctggtgatgagcaacaacttcgccttcggcggcatcaacacctcgttgatcttccgccgctggcgcgactga

SEQ ID NO: 2819 - DNA, 435 bp, Chromobacterium substugae
atgaaattcgccgccccgctgctggcgctggccctggtcgccggccccgccatggcccgcgacaccgtcgtgcagatcccgctggccgacgtgctgtccatgccggaagcgcaggaaaaactggatggttcggtcaagttctacctcgccggccagcatacccccgccatccagacaaaaatgggctccgatgtatccaaccagaagaccaacgcgctgaacaagtccgacgagcaagcctgccgctgggccattctgtccacgctgatctcgttccaggaatccgccaagaagcgccacgccaacgcggtggtcgacatcgtcagctattacaagaaggaagagcgccgcgataaagaaaccatcgaatgccactccggcacgatgatcgccggcgccgcgatcaagggcagctacgccaagatcggccgctga

SEQ ID NO: 2820 - DNA, 792 bp, Chromobacterium substugae
atgcattacatctccaagaccatcacctcaccccataacgacgaagtcaaggcgctggccaggctggcgcagcacagccgcgaccgccgcaaggagggcgtgatggtgctggaaggcatccacctggctgaatcctgcctgcaagctggcggcgcgctgacgcggctgtatgtcaacgaggaggctcagggccatcccgaggttcaggctttgttggcgcggctgccggctggttgcgcggtggcgacgctgccggcggcggtgatggccaaggtgacggccatggccagcgccggcgagttgctggcgctgtgcgaacggccgcggccgcccgcgccgcaggcgtccgccgccagagtgctgctggaggatattcaggatccgggcaatctgggcaccattctgcgcaccgccgcggcggcgggcgtttacgaggtgtttttgtccaagggctgcgtggacgtgttttcgcccaaggtgctgcgcgccgggatgggcgcgcacttcgcgctccgcatccacgagcacgccgacctagccgccgaattggccggctttggcgggcgcaagctggtcacgcatctggagggttccagctcgctgtacggccatgatctgagcggggcggtggctttcgtgttcggcaacgagggggcgggcgtcagcgacgagctgctggccctggcggatgcccgcatccgcatcccgatgccgggacacgcggagtccttgaacgtggcgatggcggccaccgtttgcctgttcgagcgagtgcggcagctggagcaataa

SEQ ID NO: 2821 - DNA, 1326 bp, Chromobacterium substugae
atggatctcaatgactgggccaagtccatcggcgaaaaacgctggccgatattgcccgataccctgaatcagctgaccgacgcctgcgcgcgccacagcgacctgatcaacttcaccgatctggccaatctgtgcctgtccgaccctttcctgctgctggacctgttccgggtggtgggcaattcgcgcgcgctgcagcgcaacgagagcatcccgtcggtggagcagacgctgatgctgatggggctggaggcggtggtcaaccgcttcggcaagatcgttccgctggagccgtctccaggcgtgctcgaccctgaggtctacgaggcggtgggggactggctgggccgcagccgcgtggcggcgctgctggtcaaggagtggctgtctatcatgggcgaattgaaggtcgaggactgtttcgtcgccgcgctgctgtacaacctgccggcctgcatctacatgatccagcgcaaccagctgccggacaagccgctgctgcaggaagtgtcggaggctttcgacgccgactacggccaagtgctggaggctttcgtcaagcacatgccgctgccgggcggcttcaaggcgctgataggcgcgggcgcgccgaccaagcgccgccagttgctgaagctggccatcgccaccgccaactcgctggagcagggcgtggagcgcagcacctggctggtgggcgtggacactgcggccaagatgatcaatgtgatgccggagctggcctatatggcggtggttcacgcggtgttgaacgtggcgcgccacccgcatgtgatcggctacaccttcccggcgcgggccttgctgctgctgccgccggggccgcgcaagggcgagatgaagaaggcggcggcgctgtccggcgaagaccagctggagcacgcgatccgcgaatccatccgcttcctggccaacgacctgaagttcgagcgggtgctgtactaccattacgagcacgacggccataacctcaagctgcgctatcaggtgggcgtggccggcgacagcccgctgcgcaagctgccgctggatctggagccgggcagcttcttcggcgtgttcaccagcaagccgcaaagctttcacgcgccggccgatgtcaggtcgcagctgaccaggcgttacgaggacgaatttttccagcatgtcggcgatcacgaattcgccttgatgacgctgttcggcggccacaagctcagcggcgtgttctatgtcgacaatgcccgcagcggccgcgggatagacgacgccacctaccaccgcttcaaggatctggtcacccggctgacgcagatgcagcattga

SEQ ID NO: 2822 - DNA, 741 bp, Chromobacterium substugae
atgagccggctgcgccacctgctgttgcagctcttggcctgcgtcggcgcctgggtgttcatcgcgccggcgcagcatctcgccgcctgggcagtgctgcaggggctgctggcggctttgctggccatcgttttgcgccagccgggctggcagcggctggcccacggcttgttcgtccccgcggcggtggcgatgcgccaggccggcataccgcccggctggtatctgctggcgctgctgctgacgctggcgctggggcgcaacgcgctggtcgagcgggtgccgctttaccgttccggccggcgggtggccgacagattggccagcctgttggctgcggatgccgcattgctggaggcgggctgcggcgacggccggctggcgctgcagctggcgcggctgcggcccgatctgcggctgcgcgcgctggaaaacgccgtcggcagctggctgctggcctggctgcgctggctgcgcgccggccggccggcgcggctggcggtgggttgccgcagtttctggaaggaagactgggggagctatgacgcaatctacgtgtttctttcgcccgagcccatgcctaaggtatggcgcaagttcctgtccgaagggcggccgggcagcctgctcatcagcaatactttcgaagtgccggacattcagcccgacgagcgcattccgcttggcggacccttgcaaaaagaattattgatctggcgccatccaaatggatctcaatga

SEQ ID NO: 2823 - DNA, 915 bp, Chromobacterium substugae
atggctgacgaatcgcaacgccccattatcgtcaaacgcatcaagaaaggcggccacggccatcatggcggcgcctggaagatcgcctatgccgacttcgtgacggcgatgatggcattcttcctgctgatgtggctgctgggctctgcctcggcaggcacgctgaacggcatctccgaatacttcaagaccccgctgaaggtggcgctgagcggcggcgccggcgccggcgacgccacctcggtggtcaagggcggcggcaacgacctgaccaagcaggccggccaggtgaacaaggccggcgcgcgcaaggaagacgtcatgcagaagcagcaggagcaggccaagcttgaccagctgcagcagaagatccagcagaacatcgagcacagcgagctgctgaaccagtacaagagccagttgaagctggaaatgacgccggagggcctgaaaatccagatcgtcgacgagcagaaccggccgatgttcgattccggcagctcgcgcatgctgccgcacacccgcgtgctgctgcagcagctggcgcccgacttgaaccagttgcccaaccgcatcagcatctccggccataccgacgccaagcccttcgccggcggccagggcggctatagcaattgggaactgtcggccgaccgcgccaacacagcccgccgcgagctgatcgccggcggcctgagcgaaagcaagattttgcgggtggtggggctgtcgtcggccaacccgctgatcaagagcgatgtgttcagtccggaaaaccgccgcatcaccattctggtgctgaacaaggatgccgagcagtccatcctcaacgacggcttcaagccgcagatgaaccaggaagtgatcggcggcccaggcggcggccaggacgccgcgccggccggcaatccgtga

SEQ ID NO: 2824 - DNA, 774 bp, Chromobacterium substugae
atgcaaccgttggaagtggtgatgatcgcgggcgccgccatcggcgcctttgtcgtcgccaacggcggcgcgccgctgaaagccaccatgaagacgctgcccacggtattcaagggcagcccgtacggcaaggccttctacatggatcttttctcgctgctgttcgagatcctgaccaaggtgcgcaaggaaggcctgatgtcgatcgaggccgacgtcgaaaatccggaagccagcccggtgttctccaaatatccgtcggtgatgcacgaccaccatgtggtcgaattcatttgcgactatctgcggctgatggtgggcggcaacctcaacgccttcgagatcgaaaacctgatggacgtggaaatcgagacccaccaccatgagggcgaagtgccggtcagcgcggtgaagggtctggcggacggcctgccggccttcggtatcgtggccgcggtgatgggcgtggtgcacaccatggagtcggtgggcgcgccgccgtcggagctgggcatgctgatcgcccacgcgctggtgggcaccttccttggtattttgctggcctatggttttgtcggcccgctgggcaccattctggagcacaagctgggcgagggcacccgggtctaccagaccatcaaggtgacgctgctggccagcctgaacggctacgcgccgcaggtggcggtggagttcggccgcaaggcgctgtcgtcgatggaccgtccttcgttcaaggaactggaagaccacgtcaagcaggccaagaaataa

SEQ ID NO: 2825 - DNA, 1380 bp, Chromobacterium substugae
atgcagaagcaacgtaccaccagccaatggcgcgaactggatgccgcccaccatctgcatccgtttaccgataccgcatcgctgaaccagcagggcgcgcgcgtgatgacgcgcggcgagggggtgtacctgtgggattcggacggcaacaagatcatcgacggcatggccggcctgtggtgtgtcaacgtcggctatggccgccatgattttgccgaggcggcgcgccgccagatggaagagctgcctttctacaataccttcttcaagaccacccacccggcggtggtggagctgtccagcctgctggcggaggtgactcctgccggcttcgagcgcgtgttctacaccaactcaggctccgaatcggtggacaccatgatacgcatggtgcgccgctactgggacgtgaagggcaaaccgcagaagaagacgctgatcggccgctggaacggctaccatggctccaccatcggcggcgccagcctgggcggcatgaaatacatgcacgagcagggcgacctgccgattcccggcatggcgcacatcgagcagccgtggtggtacaagcacggcaaggacatgacgccggacgaattcggtctggtggcggcgcgctggctggaggagaaaatcctggaaatcggcgccgacaaggtcgccgccttcgtcggcgagccgatccaaggcgccggcggcgtcatcatcccgccggccacctactggccggagatcgagcgaatctgccgcaagcacgacgtgctgctggtggcggacgaagtgatctgcggcttcggccgcaccggcgagtggttcggccatcagcagctgggttttcagcccgacatcttcaccaccgccaagggcctgtcttccggctatctgccgataggcgcggtgttcatcggccagcgcgtggcggaggggctgatcgagggcggcgacttcaaccacggcttcacctattcaggccacccggtgtgcgcggcggtggcgcacgccaacgtcacggcgctgcgcgacgaaggcatcgtccagcgcgtcaaggacgacatcggtccttacatgcagcagcgctggcgcgaaaccttcagccgcttcgagcatgtcgacgacgtgcgcggcgtcggcctgatccaggccttcacgctggtgaagaacaaggccacgcgcgaactgttctccgatttcggcgaggtcggcacgctgtgccgcgacatcttcttccgcaacaacctgatcatgcgcgcctgcggcgaccatatcgtgtcggcgccgccgctggtgatcagccggtccgaggtggacgagatgctggcggtggcgtcgcgctgcctggaggagttcgagcagacgatcaaggcgcgcggcttggtgtaa

SEQ ID NO: 2826 - DNA, 1335 bp, Chromobacterium substugae
atgaatcaccagatcaatgaatggctgcgagagcatcgcatcaccgaagtggagtgcatcgtgccggacatgaccggcgtggcgcgcggcaagatcgtgccgaaggacaagttcgtctccgacccggaaatgcggctgcccgaggcggtgctgatccagaccgtcaccggcgactatcccgacgacagcctgctggacctgaccgacccggacatggtgctggagcccgatccgaacacgctgcgctacgtgccgtgggcggtggaccctacggcgcagttgatctacgactgctgccgcgccgacggcacgccggtggacgtggcgccgcgcaatgtgctcaagcgcgtgctgcggctgttcgacgacatgggcctggagccggtgctggcgccggagatggagttctacctgctgtcgcccaatcccgacccggacattccgctggcggcgccggtgggccgcaccggccgggccgaattcggccgccgctcctattccatcgacgcggtcaacgagttcgatcctctgttcgaggacatctacgactactgccacgcgcagaacctggaagtggacacgctgatccacgaaatcggcaccgcgcagatggagatcaacttcctgcacggcaatccgctggagctggccgaccaggtgttcctgttcaagcgcaccgtgcgcgaggcggcgttccgccacaatatgtacgccaccttcatggccaagcctatggaaaacgaaccgggcagcgccatgcacatccaccagagcctggtggacaagaacaccggccgcaacgtgttcaccaacgaggacggcagtccgtctgagatctttttcggcttcatcgccggcctgcagaaatacattccgcagaccatgccgctgttcgccccctatgtgaactcattccgtcgtttgtctcgctacaccgcggcgccgaccaacgtcgaatggggttacgacaaccgaaccgtcggcctgcgcgtgccgcactcgtcgccggccgcgcgccgggtggaaaaccgggtgccgggcgtggacgtcaatccctacatcgcgatggccgccacgctggcctgcggctacctgggcatggtgaacaagctgcagcccagcgaaccgcgccagaccgacgcctacgaactgccttaccagtttcccaatagttcggaggagtcgctgcagcgactggccggctgcaaggagatcgccgaagtgctggggccgcgcttcgtcaagatgtacgtggcgatgaaggaaaaagagttttccgagtatttccgcgtgatcagcccgtgggagcgcaagttcctgctgttgcacgtctag

SEQ ID NO: 2827 - DNA, 753 bp, Chromobacterium substugae
atgcagcaagcgatcatcggcatacccagcgacgtgaaaatgataggcaagctgccgtttcacgcggtgggcgacaaatacatcgccgcggcggccggcggcgcgggcggcctgccgctgctgattccgtcgctgggcgacgagaagctgctgcgcgccacggtggcgctgctcgacggcgtattgctgccgggttcgccgtccaatgtggagccgcatcattatggcgggccggccagccggcagggcacgttgcacgatccgcagcgcgacgccaccacgctgccgctgatccggctgctgctggaggagggcgtgccgttgctggggatctgccgcggcttccaggagatcaacgtggcgttgggcggcgaactgcaccagcacgtgcaggagcagcccggcctgaacgaccatcgcgaggccgacagcgaggaggtcgccgagatgtacgcgccctcgcacgccgtcagcttcgtcgaaggcggcctgctggcgggctggaccggccagcgcgaggcgcgggtcaactcgctgcaccagcagggcatcaagcggctggcgccggggctggacgccgaagcgcatgccgaagacggcctggtggaggcctatcgcatccgcgaggcgcgggctttcgccttcgcggtgcaatggcatccggagtggcgctattgggaaaatccgttgtcgcaggcgatcttcagcgcctttggcgacgcctgccgcgcgaggagggctgcccggggatga

SEQ ID NO: 2828 - DNA, 1125 bp, Chromobacterium substugae
atgctgatcggcgttccgaaggagatcaaaaaccacgagtaccgggtgggcctgaccccgtccggcgtccgcgagctggtggcgaacggacacaaggtactggtgcagacccaggccggcctggccataggctttaccgacgagcagtacatccaggcgggggcgtccatcgcctccaatgcggaagaagtgttcgagcgggccgagatgatagtcaaggtgaaggagccgcagccggtggagtgccggctgctgcgccccggccaggtgctgttcacctatctgcacctggcgccggatccggagcagaccaagctgctggccgagtccgacgccatcgccgtcgcctatgaaaccgtcaccgacgagcgcggcggcctgccgctgttggcgccgatgtcggaagtggccggccgcatggcgatccaggccggcgcccacgcgctggagaaggcgcagggcggccgcggcgtgctgttgggcggcgtgccgggcgtggccccggccaaggtggtggtgataggcggcggcgtggtgggcctgaacgccgcgcggatggcgatgggcgccggcgcagacatcaccatcctggataagtcgctgacccgtctgaaagagatagacatggtgttcggcggccgcatcaagacgctgatgtccaacagcgccaatatcgacgaaagcatacgcgaggccgacctggtgataggcgcggtgctgattcccggcgcggcggcgcccaagctggtgacgcgcgcgatgctgaaaaccatgaagccgggcgcggtgctggtggatgtggcgatagatcagggcggctgtttcgagaccagccggccgaccacccaccaggacccgatctacaccgtcgacggcatcgtccattattgcgtggccaatatgccgggcggcgtggcgcgcacttccacccaggcgctgaccaacgccacgctgccgtacatgctggagctggccaacaagggctggcgccaggccctgttggacaacgcccacttgcgcaacggcctgaacatctgccgcggccgcgtcacccaccaggcggtggcgaaggatctgggctacgcctatgtcgaccccatcgaggccatcaaggccgccagctga

SEQ ID NO: 2829 - DNA, 501 bp, Chromobacterium substugae
ttgtcgcaaagagagctggccaagcgcgcgggcgtcaccaacggcaccatctcgctgatcgagcagaaccgggtaagcccttcggtcagttccctcaagaaagtgctggaagggctgccgatcacgctggcagaattcttcactttcgacgccgagccgtcgcagccgcgggtgttctaccaggcggacgagctgcccaatctcggcaacgaggacatcaacctgatgctggtgggcaccagccacgacaagcgcgacatcgccatcctgcgcgaacgctacctgcccggcgccgataccggcccggacatgctggtgcacgatggccaggaaggcggcgtcatcatccgcggcagcatagaggtgacagtgggcaatgaaagccgcgtgctggggccgggcgacgcctattacttcgacagcaagttgccgcaccgcttccgcaacgtcggcgacgacatctgcgaaatggtgagcgccagctcgccgcccacattctga

SEQ ID NO: 2830 - DNA, 393 bp, Chromobacterium substugae
atgaagctgggttacaccatcgtttacgtgccggatgtcgccgcctcgctgcgtttcttcgcccaggctttcggcttgaagcagaaatgcctgcacgaatccggcgcttacggcgagctcgacaccggagacactgtcctgtccttcgccagccacgaactggcggcgatgaatcttcccgccggccacgtgcgcgccagcgattcgacgcagccgctgggcatggaaatcggcctggtcaccgaacaggtggaggccgcgcaccggcgggcgctggaatgcggcgcgcaggaattggcagccccggcgcgcaagccgtgggggcagacggtgtcctacttgcgcagcccggacggcgcgctgatcgaactgtgcagtcccctttccgcctga

SEQ ID NO: 2831 - DNA, 1491 bp, Chromobacterium substugae
atgtcccgcagtacgcatgccgactggaaacaacttgctgcagaactgaaaatcgagggccgcgccttcatcgacggcgcctaccggcatgccgacgacgaacgccgcttcgattgcgtcaacccggccaccggcgccaagctggccgacatcgcccactgcggcgaagccgacgtcaacaaagcggtcaaggccgcgcgccgggcgttcgaatccggcgtctggtccggcctgccgccgatcaagcgcggcggcattctcaagcgcttcgccgcgctgatccgcgaacacgccgacgaactggcgctgctggaaacgctggacgccggcaaaccgatcggcgacaccaccagcgtcgacgtgccggccgccgcccattgcgtggaatggtatgccgaatcgatagacaagataggcggcgaagtggcgccggtcgatcccaagctcgttggcctggtgacgcgcgagccggtaggcgtggtggccgcggtggtgccgtggaacttccccattctgatggccagctggaaattcggcccggcgctggccgccggcaacgcggtcatcgtcaagccgtcggaaaagtcgccgctcaccgccatccgcgtggcggcgctggccaaggaggccggcattcccgacggcatcttccaggtattgcccggccccggcgaagtcggcaaggcgctggccctgcacatgggcgtcgattgcgtcgccttcaccggctccaccgcggtaggcaagctgatcgccggctacgccgcccagtccaacctgaagcgcgtatggctggaattgggcggcaagtcgcccaacatcatcttgtccgactgcccggatctcgcgcaggcggcccgcagcgcggccggcgccatcttctacaatatgggcgaagtctgcaccgccggttcgcgcgtgctggtccacagcgccatcaaggaacgcttcctcgccgaactgcaggccgccgccgcccgctactatccgggcgacccgctcgacccggccaccagcatgggagccatcgtcgacggcatccagcacaagaaagtactcggttatatcgacaaaggcgtgagcgaaggcgccagcctgctattgggcggcaaggccgcgcatgccgacaagggcctgttcatcgagccgaccgtgttcgactgcccgcgccccgatctcgccatctgccgcgaggaaatcttcgggccggtgctgtcggtgatcaccttcgacgatgtcgaggaagccatccgcatcgccaacgacaccgaatacggcctggccgccgccgtgtggaccgccaatgtcagcaccgcccatcaggtttcgcgccggctgcgcgccggcaccgtctgggtgaactgctatgacgaaggcggcgacatgaacttccccttcggcggctacaagcaatcgggcaacggccgcgacaagtccttgcacgctctggagaaatacaccgagctgaaaagcacgctgatcaagctgtaa

SEQ ID NO: 2832 - DNA, 684 bp, Chromobacterium substugae
ttggcttaccgcgccggacgcggctacgacgttgacctgatacgcgaattggcgcgccgcctgcattgccccatcgccagcgagagcgtgtttccctggatccgcaccctcaagatgctggaaatcggcgaagtggacatcgccacctccgccacccccactccggaccgtctgcaatacgcgtggatctacacctacaagcacagcaagagcatggtattgctgcgcaccgaggttcaagcccgcaccctggcggccctgccggacgaccccaagctgcgctggggcgtgatccgcggctggaagttcagcccgatgcaggaccagttgctggctgacctggccaaacgcaacaagatcgtgccggccgtcgatgaggacgatttgtacaagatgctggccgacggcgtgatcaccggcgcgctagcccacccgaccagctacgacgactggctcagaaacccgcgcatccgcaaccaggtggtcgtgctggatctgtttccggatgtcgaggcgaccgcgggcggcgtggcgctcagcaaaaagcgcttcccggaagcgtcggccgaactatggcatgcggagttgaaaaagatgtcccgcgacgggaccttgcgcgacatcttccgccgcttcctcagcgaggaaaccgcggactacctgctgcgttcgcccgttccctga

SEQ ID NO: 2833 - DNA, 798 bp, Chromobacterium substugae
atgcggcgaaacatctgcctcgcgcttgccctgctcttcgccaccgtctgccaggccgcgcccaatccagcctgtcccaacgggccgctgcgagtcgggttttacaaattcggcgcggcttaccgcatgggccagggctacgacgtggacatggtgcgcgaactggcgcgccggctgcattgccagatcgcctcggagaccgagctgccgcggctgcgcgcgctgaaaatgctggccagcggccagatagacatcggcacctccaccctggccacgccggaccggctggcttacgcctggatctacccctacaaccacaccaagaacatggtgctgctgcacccctccctcaaggaacgcacgctgcccgacctgctgaacgatccggctctgcgctggggcatggtgcgcggctatcgccacagtccggagcaggaccaattcctggggcagctggacgcgcagcgccggctggtagtggccgacgacgaagacgatctgtaccggatgctgaacgacggaatcgtgaccgcggccttcgccctgccgggcagctatggccgctggctgcgcgacccgctgctcgccaagcgcatcgccgtgctggacctgttcccggccagcacgcccatcgccagcggcatggcgctgagcaaggtgcgtttcagccggcaagcggccgagcgctggcatcaggaactgctgaaaatggaccaggacggcagcctgctcggcatattgcggcgctacatcagcgacggcgccgccaagcaaatgatgcagttgccgctagactga

SEQ ID NO: 2834 - DNA, 795 bp, Chromobacterium substugae
atgaaatggttggcagcctgcctattggcgctttgcctggcggccgcgcgggcggcgcccaacccggcctgcccgcaaggcgcgctcgccatcgcctattacgacttcggcatcgcctaccgccagggcaagggctacgaccccgaaatcatccatgagctggccaggcggctgaactgcccgatccagagcgaaaccgactaccccaggctgcgcgtgctcaagctgctggaaatcggccaggccgatatcggcacgtccacgctgatcaccccggagcgccagcgctatctatggctgctcccctaccaccacagcaagaacatggtgctgctgcaccgcggcgtgcaggccaactccctggccgagctgctgaagctgcccgacctgcgctggggcatggtgcgcggctaccggcacagtccggcgcagcagaaaatgctggacgagctgacgctgcagcacaaagtggtcgtcgcggagaacgaggacgacctgtacaaaatggtatgcaacggcgtcgtttccgcggccttcggccacaccgtcagctacgacccgtggctgcaaaaccatcaggcccagcagcaggtgacggtgcatgacttcttcccggacagcgagatcatcgccggcggcatcgcgctgagcaaggcccgcttcagccagggcgccgccgagctgtggagcgaggaagtgcgccgcatgctgcgcgacggctcgatgcgcgcgatcatgcgccgccacctgagccccgccgccgtcgagcaactgttcaaacagccgctggaatag

SEQ ID NO: 2835 - DNA, 609 bp, Chromobacterium substugae
atgaaactgctccatctcgattccagcatcctggccgacaattccgtcacccgcgaactgtccgccgtggtggccaacaccctgcgccagcgccatgacaaggtggaaaccacctaccgcgacctggcggccaacccgatcgcccacctgtccggtgaaatcgtcggcgcccgcttcaccgccgaagctgattggaccgagctgcagcgcagcgaagcggcgctgaccgaccagctgattgaagaattcttcgccgccgacgtgctggtgatcggcgcgccgatgtacaacttctctatcccgacgcagttgaagagctggatcgaccgcgtagccgcggccggccgcaccttcaagtacaccgaaaacggcccggtcggcctggtgccgaacaagaaagtggtagtggtttccggccgcggcggcgtgcacagcggcgagcaaggcagcctgatggatttccaggaagacttcctggtgaaggtgctgggcttcctgggtgtgaccgacgtggaaatcgtccgcgccgaagcgatcggcatgggcccggacaagcgcgccacctcaatccacctggccaaggaagccatcgccaagctggcgctgtga

SEQ ID NO: 2836 - DNA, 1008 bp, Chromobacterium substugae
atgcatgatctgaacgacctcatgtacttcgccaaggtggtggagcatggcggcttcatggccgccggccgcgcgctgggcatccccaagtcgcggctgtcgcggcgggtggccgaactggaacagcggctgggcgcgcgcctgctgcagcgcaccacccgccggctggcgctgaccgagatcggcagccagtactatcagcactgccaggccatgctggccgaggccgaagccgcccatgaggccatcctgcaaagcagcgccgagccgcgcgggctgatacgggtaagctgcccggagttgctggccaaaaccatgctcagcgcggtgctgccgcgctttctggcgctgcatccgcaggtgcgggtggcgctggactccaccaaccgccgggtagacctgatagaagaaagcgtggatgtcgcgctgcgggtgcgcaacgtgatagacgacagcgccagcctagtggtgcgccggctgggcaagagccgcttcatcctggtggccagcccggacttcatccgccagcatggcgagccgcaggccccggagcggctggcggcgctgccggcgctgagcatgagccggcccgacggccgcggccaatggacgctgctggacaacatcggccagagctacaccatccacctggatacgccccggctgatgaccgacgacatgatagtcctgctggaggccgccatcgccggcgtcggcgtcgcccgcgctgccggccaacgtctgccaccaggcgctggcggacggcagactcaggcacatcctgccgcaatacgactttccctggggcatcctgcacgccgcctttcccacccgccgcggcctgtcgccggcggtgcgcgcctttctcgacttcatcgcccaggagctgatcagcgacgagatggcgggcgactgggggcgcagcgacattcgcccggcatgactattgctttggcagaatggtgttcattccattccgctccgccatgttcaccatccgtccactga

SEQ ID NO: 2837 - DNA, 573 bp, Chromobacterium substugae
atggtgttcattccattccgctccgccatgttcaccatccgtccactgaccgaaaccgactccatcgacgccctcaccgccctgctgcaccgcgcctacgcgcagttgggcgcgatgggactgtcctataccgcggtgagccagagcgccgaggtgacccgccgccgcatcgccggcggccactgcctgctggcctggcaccgcgacgagctgataggcaccgtcacggtgcatcatccgctgccggcttcgtcctgcccgcagtttcgccagccggatggcgcggtgctggtgcagctggcggtggcgccggactgccaaggactgggcctgggcgagcggctgatcgccgccgccgaagcctgggcgcaagcgcagggctatcgcgccatccggctggataccgccgtggaagcccaccacctggtcagccgttatctcaggcgcggctaccgcatggaagcgccgttgcaatggccggacaagccctaccgcagcgtggtgatggaaaaacgcctggaaccgatggccggcgcggacactcctaaccgctattgcactgcaacagaatga

SEQ ID NO: 2838 - DNA, 2472 bp, Chromobacterium substugae
atgtggtcagctactgcagttcaaggcgggacactcccgttcgcacaaccgctgtttgattactggctcgatgcctgccagcgcggcgtcctgtactgggacacgctgtaccggcgcggcgccacctatctggagcattgcgaaagcggcaagccgccggtgctggtgttcgattaccgcatcatcctggacgggcgcgaattgcccgacccggccaattacgcgctggccgccatcgagccgccgcccagctgtccgcccaccgaccccgccaagcgccccttcgtcgtgatagacccgcgcgccggccatggcccgggcataggcggcttcaagatggacagcgaaatcggcatagccctgcaacagggccacccctgctacttcgtgatgttcttcccgcagccggtgcccggccagaccatagaaagcgtcagcaaggccgaaggcgtcttcctcaagcgcgtcaacgagctgcaccccgatagcgacggcaagcccttcgtcatcggcaactgccagggcggctgggcgctggccatgctggcgtcggtggcgccggacctggtcggccccatcctgctggccggatcgcccttatcctactgggccggcgtgcgcggcaagaacccgatgcgctacgccggcgggctgaacggcggcacctggaccgcatcgctggccggcgacctcggcaacggccgcttcgacggcgcgcatctggtcagcaacttcgagaagctggacccagccaataccttatggaagaagtcctacaacctctattccaaagtggacaccgaaccgcagcgctacctggatttcgagcgctggtggggcggccattacctgctgaacaaggcggaaatggaatggatcacccagaagctgttcgtcggcaacgatctggtgcacggcaaaatcgccagccatgacggcaagctgcgggtggacatgcgcaacatccgctctcccatcgtggtgttcgcctcctggggcgacaacatcacgccgccgcagcaggcgctgaactgggtggccgacctctacgacaacgtggaagacatccgcaacaacgaacagacaatcgtctactgcctgcacaacaaggtgggccacctcggcatcttcgtctccgccggcgtcgccaacaaggagcacagcgaattcgccagcgcgctggacctgatagacgtgctggcgccgggcctgtacgaagccgtcatcgaagacatcgcgcccgacgcgccgggacaggaatacatcgaaggccgctacatcatccgcttcgaagcgcgcgacgtatccgacatcctggcgctggacgacggccgcgacgacgagcacgccttcgaagtggtgaagcgggtatcggaaatcaaccagggcctgtatgaccgcttcgcctcgccgctgctgcgcgccgccggcaacgaagccggcgcccgcctgctgcgcgagttgcaccccgcccgcctggaacgcacgctgatctcgccgaaaaacccctggctgtggtggctgcccggcctcgccgcccaggtgcgcgaacagcgccgcccggcgcccctggacaatccgctgtggcaatggcaggaacagctgtccggcttcatcggccaatcgctggatcattaccgcgacctgcgcgacgccgcccaggaacagctgttccgcgccatctacgaatcgccgcagctggcgacgctggtcggcgtgcagccggcaagcgagccgcgccggcatgcgcttgcctgggaaagccgcgaactggcgcgcctgaagcgcgaggcgctggcccccagcttcgagcaaggcacgctggccgacggctttgtgcggctgttgctctatgtcagcatcggcatgggcgtggtggatgagcggccgttcaacgccatccgccgcgtgatgcgcgacgtcaggcacgaatacccgctgacgctgatgcagttgaaggacatcgtccgccaccaggtggcgctggtgcggctggacgcgccgcgcgcgctgaacggcctggcggcgctgctgcccgacgcgcatcgccgccgccaagcctggacgctggcgcgcgacctgctgacactcaacggcccgatcccggccgagcaccaggcgcggctggacgaagtggccaggacgctgcaattggacatgcccgccgcccctggccatccgactgcgccgtccattctgccccaactggaaacggcagccgcgccggcggaaatcaaggccgagaaagccagcgcctccgcgttgcagcccaaaccggcgcccgcgcgcaaacccgcggcaaaacccgccgcggaagccgccccggccgccaaacccgcccaggccgaggcaaaacccgccgccgcgcgcgcgcgcaaatctcccgccaaagccaacggccaagcccccgccgccgcgccggccaaaaccgccaagacagccacgccggccaagcgcccaggcaaggcctga

SEQ ID NO: 2839 - DNA, 615 bp, Chromobacterium substugae
atgctgaccctgatctacctgatcgccatcaccgccgaggcgatgaccggcgcgctggcggccggccgccgccacatggacatttttggcgtaagcgtcatcgccttcctcaccgccctgggcggcggcaccgtgcgcgacatcgtgctgggccgctacccgataggctggacccagcacccggaatacgtgttgctggtggtggccggcggcatcgccgcggtgctggccgcgcgcttcatgcgccatctgaaccgcctgttcctggtgctggacgcgctgggcctggtggccttcaccatcatcggctgcgatgtggcgctgggcatgcactaccatccggtgatagtggcgatggccggcatgatcaccggcatcgccggcggcatcctgcgcgacgtgctgtgcaaccgcgtgcccatcgtgtttcgccgcgagctgtacgccagcgtgtcgctgctggtggccatgctctacatgggcctcaaccagctgaacctgccgcacgactataatatcgccgccagcttcgccttcggcctggccttgcgcctgaccgcgctgtggcgcgaatggcagctgccggtattcgcctaccggcacgatcaccactaa

SEQ ID NO: 2840 - DNA, 681 bp, Chromobacterium substugae
atgcccctccgccgcctcgccatccgcgcgctggccggactattggccctgcccgccgcataccttctggcagccctgctggccggcctgctgccagtcaacaagggctggcaagcgccggcagacggcatcgccgtgtatctgcaggacagcaatggcgtgcataccagcctggcgctgccggtacagacgccgcaacaagactggaacgcgctattctctccgcgccaaactcagcggcccgagctgtccgccgcgcagccgtacctcgccatcggctggggcagccgcacctttttcctgcgcacccgcagctgggccgacctgactgccggcaatgccatcgccgcgctggcctcggacgccagcgtgctgcacgtcgaatatctgcccaagccggcagaggacgccgatacccggaaaatcctgctcacgcccggccagtacgcgaaactggcggcattcatccggcaaagcgccgcggccggcgccgatggcaaaccgctttggctgacgaatgagcgctatgatggcaacgatgccttctatcaggcccatggccgctacaccccgttcgtcacctgcaaccagtggacccgcaacgcgctggccgccgccggcgtgcgcactgccttatggtcgccgttcacccggcccttgttctggcgccttcatggctga

SEQ ID NO: 2841 - DNA, 1404 bp, Chromobacterium substugae
atgaaccttagcgccctcctcgccagcttcgcctccgccttcacccaggaccgccgccagctcaccctgcaactgggcgacggccatgtcgcggccgagcagctgctgccgcaaagcctggacggcgaggaaggcgtgtcccggccctatcgcttcaccctgacctgcctgtcgcccgacggcgccatcgaactcaagaccctgctcggccaatccgcccgcctcggcatcgccgacgccgccggcggcgaaacgatacgctgcggcgtggtgtcccaggcccggcagctgggcgccgacggcggcttcgcccgctacgcgctgaccatcgagccgccgttcgcgctgctgcgccaccgccgcacctcgcgcgtgttccaggacctgacggtgcccgacatcgtccagcagatcctgcaagagcaccaggccgccaacccggccttcgcccgcggccaggcgatcgagatcaaggtcggcccggcgcagcccagaagctactgcctgcaataccgcgaaagcgactacgacttcatcgtccgcctgctgcacgaggaaggctacgcctggcgcttcgagcatgtcgacggcgacgcgccccaggtcaagctggtggtgttcgacgacgcctacagcctgccgccggccgaagtggaacgggtgcgcttccaccgcagcgacgccaccgaagacgaggacggcctcaccgcctggcacgccagccgccagatcgtccccggcagcgtcgcgctggccagcttcgactaccagccggtgtccacccagcacagcggcgacagcagccagatcgaccagggccagggcggccaggcgctgcaatccagcctgcaggactacgacccgcagggcctgtactacgccggcgacgccgaccagctgagccactacgcccggctgcgccagcaggcgcacgacctgcaggccaaacaattcgaaggcggcggcgccgtccgcggcctcaccgccggccaatggttccgcctggacgaccacccggcgcacgagaccgacagccacgaacagcgcgaattcgtcgtcaccggccagacgctgcaagcgcgcaacaacctgcccagcgagctgacccagcaactgcgcgccctcgcccccagcctgctggccgacagcgacagccaggccgcccccttcgccagccagatccaggcccagcgccgcggcatcccgctgaccccggcctacgccggcaccgccgcggccaagcccaccagcctcggcgtgcagaccgccaccgtggtcggccccgccggcgaagaagtccacaccgacgcccagggccgcatcaaggtgcaattccactggcagcggccggacgaacaatggtcgggtgttcgtccggccgctgccagtggaattgcaccttga

SEQ ID NO: 2842 - DNA, 150 bp, Chromobacterium substugae
atggtcgggtgttcgtccggccgctgccagtggaattgcaccttgatgcggccctgggcgtcggtgtggacttcttcgccggcggggccgaccacggtggcggtctgcacgccgaggctggtgggcttggccgattcggtgccggcgtag

SEQ ID NO: 2843 - DNA, 174 bp, Chromobacterium substugae
gtgcgccaggtcagctggggatcgatgctggaagaagcgccgaccgaactgatccagggctattggtggcagatgctggcggtgaccgtggccatgtcggtgctggtgacagcgttcagcctgctggtggatgcgctgcgcgacgcgctggatccgcgcgcggtggccaagtag

SEQ ID NO: 2844 - DNA, 1704 bp, Chromobacterium substugae
atgaatcagcaaaacaccctgctgtccgtgcgcaatctgaaggtgggtttccgccaggaagacggcggccgcttcgaggcgctcaagggcgtcagcttcgacattccggcccaccgcacggtggcgctggtcggcgaatcgggctccggcaagtcggtgacgtcgatggccatcatgcagctgctgccgccgcaatccagcgagatcgatccggcgtccgaactgctgttccagggccgcaacctgctgcggctgtcgcgcggcgagctgcgcaagctgcgcggcaaggacatcgcgatgattttccaggagccgatgagctccttgaacccggtgttcagcgtcggcgagcagatcgtcgagacgctgacccttcacgccggcttgagccgttccgccgcctggaagcgcgcggtggagctgctgcgcgaagtgggcctgccggagccggaaaagcgggtgaaagcctacccgcacgaactgtccggcggccagcagcagcgggtgatgatcgccatcgccatcgcctgcgaaccgaagctgctgatcgccgacgagccgaccaccgcgctcgacgtcacgattcagaagcagatcctgcaactgatcgccgacctgcagaagaagcacggcatgtcggtgctgttcatcacccacgacctgggggtggtcggcgaattcgccgacgaagtgatcgtgatgcgccacggcgtgatccgcgagcaaggcacggtgaagcagatcttcgaaaacccgcaggacgcctacaccaaggcgctgctgtcgtgccggccgcacctggaccgccgcccggagcggctggcggtgatcgacgacttcctccagccgggcggctatgtcgaaccggccgaaaggacacgtggctacgccgccggcgacgaaatcgtgctggacgtgcaagggctgtgcaagagcttcgacatccgcgaagggctgttcggcaagcgccagttccacgcggtgaaggacgtgtcgttccagttggcgcgcggcaagacgctgggcatcgtcggcgaatccggctcgggcaagaccaccgttggcctgacgctggtgcggctgcaccaggccaccggcggcaaggccttgttccacggccaggacctgatcggcatgagcgccaaggcgttccacgcctacaagaagcggatccagatcatcttccagaacccgtacgcgtcgctgaacccgcgcttcaccgtcgagcagatcctgaccgagccgatgctgctgcacggcatcggccaggacggcgggcagcgccgcaagctggcgctggacctgctggacaaggtggggctgccggcgggcgcgctggccaagtacccgcacgagttctccggcggccagcggcagcggatcgcgatcgcgcgctgcctgaccttgaagccggaagtgctgatctgcgacgaatcggtatcggcgctggatgtgtcggtgcaggcgcaggtgctgaacctgctgcaggacctgcaggacgagtacaagctgtcctacctgttcatttcgcacgatctggcggtggtgaagcacatctcggaccaggtgctggtgatgaacaagggtcaggtggtggagcaggcggatgcggacgtgatctaccgcgagccgaaggacagctacaccaagaagctgctgggggcgatcccgcaggggtggaacgcggcgctggcgccggcctga

SEQ ID NO: 2845 - DNA, 375 bp, Chromobacterium substugae
atgagccaacccgtagtcaccgtgaaaaaccattccagccgagacgtcttcatcgaaggcgatcccaactgggatgaccagacactgctgatagacggccaggccgagagcggcgcctatccgctggggccggatcagtcggtccagttgagcgtggactggagcggccccggcaacgcctacatgctgggcgtgatcttcgccgatggccccgactacgactacggcggcgatggcttctaccagctgacgctgggccagaacgagggcagcggcctgctaggcgtcacggaaagcgacggccaggccaagatctcctacagcgtgagccagcaaacggcctggaccgtcagcctggatttcgccgacggctga

SEQ ID NO: 2846 - DNA, 660 bp, Chromobacterium substugae
atggggtggggacgtttgctggccgcgatcgcggtttgcaatctggcgtattggctggctttgctgctggcggccaggttttatggcatacgggtgcgggagcattgcgtgggcatcgggccggtgttgttcggcaatggcaagctgcagctgcgcttgctgccgatttccgcctgggtgcggatggcgctgctggctgaccgccggccggaggaggcggaacgcgtttgcctggatgccaaggccgttcccattcagctgatcgtcgccgcttccggctgcgtggcgctgctctggctgggggcttgcctgaatgagggcgcgagcctggatagttttcgcgcaggctggtcgcaactgccgttcggcgcgctgccgccatggggcgaggcgcagcattggctggccgcgctgtcggactggacggcgcagtcgggcttcctggcgatgttgccggtggtcgcggccaagatggcggtattcaatttattgcctttgccgggagcggctggcgggatcatgctgcgccttttggtcccgatgggggcgcggccggcattcgaacattccaacgtgttccggctatggatggctgcgcacctgctgtggctgttttgctggctggcggcgctggcgcttcatgtctggccatttggctga

SEQ ID NO: 2847 - DNA, 891 bp, Chromobacterium substugae
atgactctctccgtcgacgccctctccgcctttgtctacgccgccgagctcggctccttctcggccgccgccaggcggctgggcaaaagccagtccaccgtcagcgaagccatcgccaatctggaaatcgacctgggcaacctgctgttcgaccgcggcacccgcacgcccaccctcaccccggccggacggctgctgctgccgcaggcgcgccaagtcatgaatgccagccaggacatgcagcaacaggcggcgctgctgagcgcgggcgtggaaagccggctcaccatcgtgctgtccgacaccttccagtccgaaacgctggaaaacgtcgcttgtcggctggaggcgcgctacccgctgctggagctggaatgcctggccggggaacaggaagacgtgctggatctgatcttgtccgggcgcgcgcaactgggcctggtcggcgcgctggaccgctatccgccggatatccgccatcagcgccagcgcgaggccagcgagctggcgctgtacgcagcataccggcatccgctggcgggaatggaccgcatcgacgaacagcaactggccctgcatcgccagttgcggctgaatacctacaacgacaagaaccccgcccacgccggccagcggcaatggtacgcgcccagctacctgatgctgctggacatggcgcgcctgggcgtgggctgggctgaactgccgtgctggctggtgaaaagctttggcggcggcgagctgaaacagctggacgtggccggctggcccaagcggatgccggtagacctggtgtgggccgccaacaggccgctgggcgcggcggccgggtggctgctggaacaactggcgcggccggccgacgacgctcagccaaatggccagacatga

SEQ ID NO: 2848 - DNA, 450 bp, Chromobacterium substugae
atgcaagcggcaaacaagaaactgggcgagcgagtactgcatgcggtgctgtacgaggcttgcgcgatggcgttgctggtgcctttggcggcgctggttatgcaaaaggacgtgctgcacatgggcgcgctggccttgatgatgtcgacggcggccatgttgtggaacatggtgttcaacgcgctgttcgagcgcgtggagcgtctttttgggtggcggcggaccgccggcgtgcgttgcctgcacgcgctgggtttcgagggcggactggtgatattgctggtgccgctggccgcctggtggctggatagcggctactggcaggctttcctgctggatttgggcttctttgtgtttttcctgccttacacctatgtgttcaactggctgtacgaccatctgcgggagcgctttgtcgctcggcggggcttgtcggccgcagtggagtga

SEQ ID NO: 2849 - DNA, 333 bp, Chromobacterium substugae
atgaaagtctggctgttcctgatgggggccatcctgtccgaagtggtggccacttccgcgctgaaggcgtcggatggctttacccggctgtggccgtcgctgttgaccgccggcggttatctgctggctttttacctgttgtcgcagaccttgcgcgaaatcccggtgggcatcgcctacgccttgtggtccggcatcggcatcgtgctggtttcgctgatcgcctggctgctgtatggccagaagctggacgcggccgcgctggccggtatggcgctgatcatcgccggcgtggcggtgatcaatctgttttcccagtcgtccgcgcactga

SEQ ID NO: 2850 - DNA, 771 bp, Chromobacterium substugae
atggagcacgacatggcgattttggcggtatgcggagtgaagggcggctgcggcgccaccacggttgcggcggccctggccctgttgtggcagcggcagcaaaggccggtgctggcgatggacttgtgccggcaaaacctgctgcgtctgcatttcggcatggagtggcatgaggccgatggctggcggcggcggcgcgacgccggcgccgactgggcccgcgcggcgtgggaagtgggcgaccgccacctgacgctggtgccgcatggccgggtggaagaggatgtcgaccaggaagggccggaaccggaagaatggctgcgcgacgagctggcgcagctggagcggcagcccggtcaacgcacggtgctggacctgccggcgcgcggcgtggccgagcggcagcagggcctgaaagcggccagccacgcgctggtgatgctgtctgccgaccccgccgcctgcgcgttgctggatgcggtggaggcagagcttcacgccggtggcttgccggctgagcgcatctttttcgtcatcaatcatttcaatccgctgcgcaagctggacggcgacgtcgagctgctgctgcgcaagaagctggggcccaggctggcgccgctgcccatccaccgcgacgaagcggtgcgcgaggctttcgccaagcagcagccgctgttcgattacgcgccggccagccaggccgccgatgatttgcgccagctggcggtatggctgtcggttaggctggacgcggggcggagcggcgcatga

SEQ ID NO: 2851 - DNA, 2592 bp, Chromobacterium substugae
atgagcttgcggggggcggattggcgcgcgtggtgcctgcggctgggtttgctgcatccggccgacgcgccgcggctggcgtttgcgctgctggggctgttcttcgtcgcgccgacagaaggctgggcggcctggggcagggcggcgcgccgctatttcccgcaggtggatttttcccggctgcggccggccgatccgctgcgcatactgctgcagctgctttggctggcgctggtcaagccgccgcgcgcgctggggcccaggcgccaggcgcgtttgccggcgctgctgcagttcgcgcgccgcgagctggcggctgtttccgcccagcgccgccgcctcgccggctggctggagggccgctttccgcgcttgttcgatccggccagcctgcgcggctcggtggagggcatagccgaacacgcctggtggcaaagcgcggcgatccgaacgatttgctacctggcggcggcattgctgggcgtggtgctggtgacgacgccgttcgacgaatactcccaagcagtgttcaccgtggtgctgttgctgatggcgctgtgggtgcggcgcatccccggcccggtgccgacgctgattctgatggtgttctccatcgcggtgtccacccgttacatttggtggcgcaccacctccaccatcaatgacgacacctggccgaatctgatcgccggcgtgatcctgctgggcgcggaaatgtatgcctggctggtgctgctgctgggcttcttccagtcgtcgtggatgctggagcgcaaagtggtgccgctgccggccgatacttcgctgtggcccagcgtcgacgtgttcatccccatctacagcgagccgctgcgcgtgctcaagcccaccgtgttcgcggcgatgagcatggactggccggccgacaagctgcgggtgcacatcctggacgacggcacccgcgacgaaatccgcgatttcgccgcgcaaatcggcgtcggctacatcgtccgccaggagcacaagcacgccaaggccggcaacatcaatcacgcgcttggccgcaccgacggcagcttcgtcgccatcttcgactgcgaccacatccccacccgttccttcctgcagacgacgatgggcggctttctgcgcgatgagaagctggcgctggtgcagacgccgcaccacttcttctccgccgatccgttcgagcgcaatctgaacacccgcgacaaggtgcccaacgagggcgagctgttctatggccgggtgcaggacggcaacgacttgtggaatgcctccttcttctgcggttcgtgcgcggtgctgcgccgcgacgcgctgatgtcggtgggcggcatcgcggtggaaaccgttaccgaggacgcgcacacctcgctgaagatgcaccgccgcggttaccactccgcctacatcaacctggtgcaggctgcgggcctggccaccgaaagcctgtccgcccacgtcggccagcgcatccgctgggcgcgcggcatggcgcagatcttccgcagcgacaatccgctgctgggcaaggggctgacgctggggcagcgcttctgctacctcaacgcgatgatgcacttcctgtacggcatcccgcgcctggttttcctcaccgcgccgctggccttcctgctgttccacgcctacaccatctacgcgccggcgctgggcctggtgctgtacgtggtgccgcacatggtgttttcggtgatgtccaactcgcggatgcacggcgaattccgccgctccttctggggcgaggtgtacgagacggtgctggcctggtacatcacgctgcccaccacggtggcgctgctgtttcccggcctgggcaagttcaacgtcaccgccaagggcggcgtggtggaggaagaccatgtcgattggaacatcaccaaaccctatctgttcctgctggcgctgaacctgctgggcgtcggtttcggcgtctaccgaatctggagcgggccgggcaacgagatcggcaccgtgctggtgaacctgttctgggtcggctacaacacgctgctgctgggcgtggcgctgggcgtggcgcgggaattgcgccaggtgcgggtgtcgcaccgggtggaaagccgcctgccggtatcgctgcacctgcacgacggcaaggtctatccctgccatacgctggattactccgaaggcggtatggccttgcagttgcccgagggcctgcaactgaaactgcggcagaacaccgagctgacggtgtcgatgcgccgcagcggccgcagcttcgcgctgccttgccgcctggtgttttccaagggcggcaggctgagcgtgcgtttcgtcggcctgacgctggacgaggaaatggcgctggtgcaatgcacgttcggccgcgccgacgcctggctgcaaaccggcgagcgcgcgcacgagggcacgccgctgggcggcgcctgggacatctggcggatgggcggcggcagcttgtggcagctggcgcagcagttgttttcgccgctcgcggtccgcaatggccgctgggccggcttctggaattggctgggcagcctgctgccgcggcagccgcatcttcatcgggacatcaaatga

SEQ ID NO: 2852 - DNA, 2271 bp, Chromobacterium substugae
atgacaagccgcataccaagaaaaaccctgtccattctgctgtccggcctgctgctggcggcgccggcgctgagtgtcggcgccaaggaggagacggcggccgcgcagccgccggcccaggcggcgccgctggtcaccacccgcaccctcagcttcaagcagatgggcgccggctatccgctcaagatgcgcggcgacaacagcctggtcggcgtcggcttcggcagccgcggcgacgaggtgatcaccgggctgacgctgcatctgcgttacaccttctcgccggcgatgctggccgacctgtcgcacgtgcaggtgctgctcaacgacgaagtggtgaccgtgctggccttgcccaaagagcagggcggcaagccgcagcagctgaccctgccgctagacccgcgcctgctggccaatttcaaccagctcaagttccgcctgatcggccattacaccaatcgttgcgaagacgaaacccacagcagcctgtgggcggagatcagcaatgccagcgaactgcagatgacggtgcaggcgctgcctttcgtcaatgatctgagctatttcccggagccgttcttcgaccggcgcgatttctcgccgctgaagctgcccttcattttcgccgcgcggccgtcgcaaacttcgctgcaggcggcgggcgaactggcctcgtggtttggcgcccaggccggctggcgcggcgtgcgctacagcgccgcgctcaacagcttgccggcggcgcagcacgccatcgtttacgccgtcaacggccagcgtcccgacttcctcgccaagctgccgccggtgaacgcgcccaccatcgccatcgtgccgcatccggaacgccccgagcgcaagctgctgctgatcctgggccgcgacgacaaggacctcaagctggccaccgacgcgctggtgctgggccaggctggcatgagcggcagccaggtggcggtgcgcggcatcaagctggaagcgccgcgcaagccctacgacgcgcccaactgggtgcgacccgaccggccgacccggctgggcgagctggtggacaatccgcgcgacctgcaggtcaccggccagcagccggcgccggtgcgcgtctcgttccgcgtgccgggcgacctattcacctggggcagccgcggcattccgctggacctgaaattccgctacaccggccagcagcaggcgaccggctcgcgcctcaatatcggcatcaacgagctgttcgtgcaaagcctgaacctcaacgccagcggcgtgggcagcacccagaccagcctgcgcctgccggtgctggaaaacggcttgctcagcaatatcgaccgcatcctgctgccgcctttccgcgtcggcagccgcaacgagatgcagttccagtacgtgttcgccgcggagaagcagggcgagtgcgccaataacctggccgacggcaaccgcgcggcgatagacccggactccaccatcgatttcagcggctatccgcactacgcggcgctgcccaacctgggcttgttcgccacttccggcttcccgttcacccggatggccgacttgtcggacaccgcggtggtgctgccgcgccagccggcgcagcaggacatcggcgccttcctcaatgtgatgggccagatgggccagtccaccggttacccggcgctgcgctatcggctggtggacgagggcgcgctggatagcgtcaaaaaaatggacctgctgatcgtgggcaacgcccgcaacctgggcttgctcaaagcctggcgcgacaagctgcccaccacgctggacagcgccggccgcaaggtggctgagggcgaaaccaccgatctgccggccggcatgggccaagcgccgggccaggcggccggcggccgcatcaacggccaggtggacttcgccgcccagggcaagctgggcgcgatcctggcgctggaatcgccgctggccagcggccgcagcgcggtgatcgtcaccggcagcgagcccgacgcgctggcgctggcgaccggcgcgctggccgacgacggcaaggtggcgcagatgtcgggcagcgcggtgctggtgcgcggcgacaccatagacagccagcaactggggccggtgtactatgtcggcaacctgccgctgtggacttgggtgtggctgttcctgtccgcccatccgctgctgctggcagggctgtcggcgctggcggtgctgatcttcgccttcgccatcctgcgcctgttcaaggcgctggcggcgcgccgcatccgggagtcttga

SEQ ID NO: 2853 - DNA, 1128 bp, Chromobacterium substugae
gtgggcatcccgcgacgcgcgctgctggcggcgctgggcgcgctggccatttccacggcccgggccgcgccgtgcgacggctggccggcctggcaggatttccagcgccatttcgtttccgacggcggccgggtggtggaccgcggcgccgacggccagcccaccacttccgaagggcaaagctacgcgctgttcttcgcgctggccgccaacgaccggccggctttcgacaagctgctgcgctggacccgcgacaacctggccggcggcgacttcagcgcgcgcctgcccgcctggcaatggggcaagcgcccagacggccagtggggcgtgatggacgacaacagcgcgtccgattccgacctgtggatagcctacaacctgctggaagccggccggctgtggcgcgagccgcgctacaccgcgctgggcaagctgctggccttgcgcatcctgcgcgaggaggtggccgacctgccgggcctggggccgaccctgctgcccggccgctacggcttcagcaagccggggctgacccggctgaatcccagctatgtgccgccgcaactggtggcgcgcatggcgcacgccttgcctggctccggctgggcggcattgcgcggcacctcgcagcgcctgctgctggagagcgcgcctgcaggatacgcgcccgactgggcggcttaccgccagggcttttccgccgatgcggccagccaggccgccggcagctacaacgccatccgcgtctacctgtggaccggcatgctggcgcccgacgcgccgggccggacggccttgctggccaaattcaagccgatggcgcaactggtggccaaaaccgggctgccgccggaaacagtggacacccgcaacggcaaggcacagggcaccgggccgatagggttttcgatggcgctgctgccgttcctgcaagcgcaggacgagcaggcggcgctgcaggcgcagttgctgcgtgtggaggcgatgccgctgtcggagcggccggatgcctattacgaccatgtgctgacactgtttggccagggttggcagcaaggccgatatcagttcaacgcgaatggcgagctcaagccggcctgggagggcgcatgcgcggcatcctga

SEQ ID NO: 2854 - DNA, 3852 bp, Chromobacterium substugae
atgcgcggcatcctgagcgccatgttggcggtgggcttcagcggcgcgctgcatgcggcgccggcggcggtggatccggcgcaggcgctgctggagcaggccaggctatggcaatcgctgggccggccgctggaagcgcagcaggcgctggacaagctgcagcgcatccatgccgccactgcgcaggatcgcgccgaggcgctgaccctgcaggcgctggtgcaagtgcagcagcgccaggataaggacgcgcagcagacgctggccaaattgcgcaagctgtatcccggctattccggcatcgcccgcgtggagcagatgcgccgcatcatggggccggaccgcaacaagctgctgaccgcgcgctccctgttcaacagcggcaagatcgaacaggcttacgccgcattcaacgcgctgtaccaggggccgccgccggaaggcgcgctggcgctggagtactggcaattggtggcgcggctgcccaatggcggctgggcccgcagccaggccgagttgaaaaagctgatccggcaaagcccgtccaatcaccgaaaccgcctggcgctggccagcatctacctgctgcacccgccggtgccggcttccgtgctggcggacctgaaggcgctgacgcaattctccgacagccgcagcgaggcgctgggcttgtggcgccgcgcgctgcagcagtccgacctgccggatgacgcctatctcgcctatctgaaggtggagccggaggacgaattggtcagctcgcggctggcgtcgttgcaggatggccggcgcaagcggcgcgaacagctggccgacccggcttaccgcgccttgctggcggccgacaagcagctggacgccaaccagctggcggcggcggaaaaaagcttgcaattggcggccagccgctacggcaagcaggccggctatctgcaaagcctgggccggctgcgcgagaaacagggccgctacgccgacgcggtggccagctatcgccagggccaatcgcaacagccggacgacaagggctggaagcgccgcatcgccgacgcccagttggccgacctgcttgcgcgggcgcaagcggcgatgcaggcgggacaatggcaggcggcgcgcgcgcaattggaccaggccggcaaacagcagcccggcaatgtcgacgtgctgctggccgacgccgaatggcaggcggggcagaagcacgccgtccgcgcgcgccagctgtaccgccaagccttgcagagcaagctggacagcggccaggcgctggcgggcctgctgcgcacctatctggatgccggcgagtacgcgcaggcggccgagatgctgcgcgcgctgccgccgaagcagcagcgcgcgctggggacgtcctaccagtcggcccgcgccgacgtggagcgcgaactgggcgaccgcctgctggcccagggccagctgagccaggcgctgccgcatctgcaaaaggcggtggatttgcagccgcaaaacacctggaaccgctacgcgctggccaacgcctggctggcggccggcgacgcggccaagggcggcgccatcttgcgccagctggccgacgcgccggccgccagcccggaaagcctgtacgcctacgcgctgttccaggccaagcgggaagacgatcgctcggcgctgggcgccttgcagcgcatcgcgccggacgcgcgcagcgaaggcatggcggcgctgcagcgccgggtgtggctgcgggaaaccatgcgccaggccgacgcccagctggctttcggccatgcggccgaggcgcggcgcagcctgcaaaacgccgaacgtctgatgcgcggcgatccggcgcggctctccgagctggcgcaggcctggctgcgcgccggcgacgccgagcacgcgcgccagatgctgttgacgcaatatctggaacagcccggcgccgacaatgaactggcctacgccgacctgctgctggacctgggcgacgcggcggcggcggcgccgttgctggcggcttccgcccagacgcggcaggacatgaacgatgagcaaaagcgcaagctggccgatctgcaggccgcgctggcgtcggcgcaggcggacgcggcgcgggacgccggagatggcgcccgcgcgcaagccatcctgctgcaggcggccgcggcggctccgcaggacgcgcgcctgcagcgcaagctggccgattacgatatggacgccggccgctggggcagcgcgcgcgcccgcttgcggcaagtgttgagccagcagccggacgacgacgaggcgcagctccaactggtggatctctacatcaagaccggccagcgcgacctggccgtgcacggcgtggacgcgctgctgcgggacaagcccggccgcagcctggacttccgcttgcgggcgctgacgcgcctgggcgacgccggcgagacggagcggctggatcgcgaaatcgccgccttgctggcgcagggggtgaagagcccggcgctgatggggcaggcggcgcggcgcgcccggcagcaggataggccggcccaggcgctggcctggtatcgcgccggtttcgcccccgccggcaacgaagtgcagaccaccgccaacagcggcctgctgctggggcagcagccgttgcggccagtgccggccgaatcggcgcagcaggaaggcttgcacgaagactacgccgaattgctggacgcgcgcagcgtgaagatctggcaggggctggacctgacctaccgcagcgccgacaacggcacgccgggccagtcgcagatgacgatgtggcaagcgccgctgctggtggaattgccggccccgcgcgcgggcaagtacttcctgcgcgccgacgcggtcagcatcaacgccggctcgctggacaacagcctgggcaacgattacgcgctgcagcgtttcggctcggtcgccgcctgcgccgcgcagtccggcagcagcgtgcaaagctgcgccggccagtacggcgcgcaaaccgcgcaaggcgcggcgctggggctgggctacgagaacgagcattggcgggtggacgcgggcgtcacgccgcagagcttcccggtgtccaatctgatcggcggcgttcgctattccgacagcgtctccatcctgaactacaagctggaggccgcgcgccgcccggtgaccagttcgctgctcagctacgccggcgtgcgcgatccctacaccggccagacctggggcggggtggtggccacaggcgtcggcggcagcctgggctacgacaagggcggacgcttcggcgtgtggtcgaatttcgcctatcaacagctgaccggcgaaaacgtggccgataaccgcaagctgacggcgatgggcggcgtctactggcgcttgctgaaggagccgacccggcaagtgacggtgggcgtcaacagcatcaatttctggttccagaaaaacctgggcgaattcactttcggccagggcggctattacagcccgcagcgttacaactcgctgtcggtcccgctcagctacgcggcgcgcaatgagcgctggagctggctggggcgggcgtcggtttcggtgtctagcgccaacgaggcggcgtcgccgttctatcccacccggccggacctgcaggcgcaggcgggcaatccgtacgtcagcgcgagttcggggccgggctggggggtgtcgctgagcggcgcgttcgaataccagctgacctccaggctggccctgggcggcatgctggagtaccagcattcgcagtactaccagccggggcgggcgttgttctacctgcgttaccagccggacggcgcgtcgctgacgctgccgttcccggtggagccgctgcagccgtattcgagcttctga

SEQ ID NO: 2855 - DNA, 399 bp, Chromobacterium substugae
gtgaatctgctcaaaatggtgggctgttgtctggccatcgcgctgctgccgcaggcgggcatggcggcatccgtcgagctggacgccgcgcgcgcctggtactggcagcacccttaccagccggaggcgatcaaccgcctggcgctgcaactggtcaaggcaggccaaaccggcagcgccatcgtgctgctggagcgggcggcgcgcatcgcgccggaccgcgaggacatccgcgccaacttgctgcggctgcagtccggttcgcgccaggtggtggacgcgccgtgggccgggcagggcccggagccggccgatgccgcgccaagccagcccctggcagcgcccgccgccgccgaggccttgccgccgccctggcccatgcccgccgccaagccatag

SEQ ID NO: 2856 - DNA, 1614 bp, Chromobacterium substugae
atgaaatccagccaatccgccacgccggacaccgtcgcgcccgccgccccccgctctttggggctgggcacgtggagcgtctacttcatcgccaagctgctgctgtcctggcagggcacgctcaacctgcacccgctgcctaatctcgccttcgcgctggcgctgctgatcccgatctccggcaagacgcgcctgcgcctccgcgccgcgctggcgctgctggcgggcgccgcgctgctttaccacgacagctggctgccctcgccgtcgatggcgctgcagcagctgtccacgctgcaaggcttcagcttccactacctgctggatctggccgggcgcgtgctgtcgctgtccttgctgaccggcgcgctgatcctgctgtgcggctattggctgttgtcgcgctacctgcggctgggcaccatcgtgatgatttccctgctggggctgagcggacgccagctgtggcaggagcagccgcgcgcgccggccgccgcggtggccgacagcggcgcggcgactgcgggcgccgcgcccaacgccgcgcagacgccggaccagcaactggccgctttcttcaagagcgaaggccagcgcatggtgaaattccaggggccgctggccgacccgggcttcgacgtgctgatcctgcatgtctgctcgctgtcctgggacgacctgcgcgccatcggcatggaccagcacccgctgcttgggcgtttcgatttcctgttcagcaatttcaactccgccaccccgtacagcggcccggcggcgctgcgcgtgctgcgcgccagctgcggccagcccaagcacagcgagctgtaccagagcgcgcccaaggaatgctatctgtttgaagacctggcggcgctgggcttcaagaccgagctgacgatgaaccacgacggcagcttcgacgacttcctcaagcagatccgcagcgacggccggctgaaccagccgctgatctcgcagcagggcctgccggtgggcctgcgctccttcgacaacacgcccatctatagcgactacgcggtgctcaaccgctggctggagcaacgccagcaggacagcagcgcgcacgtggccacctactacaacaccatcagcctgcacgacggcaaccgcatccccagcgcgcccgggctgaacaccatggacagctacaaataccgggccaaccggctgttcgccgacctgtcccagttcatcgaccaactggaaaagagccatcgcaagatggtgctggtgctggtgccggaacacggcgccgcgctgcgcggcgacaagcagcaattcagcggcctgcgcgagatccccacgccgcacatcaccatcgtgccggcggccgtcaaggtgataggcggccaggcccaccccagccaagtccgcatcgaccagcccagcagctatctggcggtgtccaccatcctgtcgcggatgatgaccaagagcccgttcggcgccgactaccagccggccgagttcgcgcgcgacctgccgacgacgccttatgtttcggaaagcgccagctccatcgtgatgcagagcggcaagcgcttcctgttgcagcaggacggcggcgactggaccgagtacccggtgcaataa

SEQ ID NO: 2857 - DNA, 231 bp, Chromobacterium substugae
atgttcaatcccgaattgagccagttgcagtttctggtgctgctggcggcgctggcggccggcatcgccggttaccagctgcacgcccggctgctgccgcggctgcgcgagctgctgtcgcgccggatgcgccacttccaaccccacccctatctgcaacgcctgcgccagcaggatgacgcgccgctggccaagagccggcgcgccgatccgggccacaagccatcatga

SEQ ID NO: 2858 - DNA, 1608 bp, Chromobacterium substugae
atggacaccacccaaagcctgggcatagacgggattccgccgtccgccgccgccctgaacggcggggcgctttacctgatcgccgcgcccggcccggcgctggcccaggcgctgctgttcgccaacctgccctcggccggcagccagccgctgatctgcgccagccggcagcaacccgccgcgcaacaagacaccgcctggctggaccgccgcatccacgccggcaatctgcatctgctctccccgcgcaagccgcgcaaatcctccgctcagcaaatcgacgcctatctggatgagctggcgcgctgccgcaagctgctgcagcctgccggcggcggcatgaccgtggcgttggaccacgccgaagactatctgccgttgcagcagccggccctggcgcgccgcgcgctgcaggcctgcagccattgggcggcgcggcatggccatgcgctgctgttgctgctggacagcagccatctggacgccgccgcgctggccgccctcagccaactgggcagcgactgcgccggcatggtgtacgcgcagccgctgggcgacggcttctatagctggcagatcgcgcactggctgggcgccgggccggcggaaaccgccaggctgcgcacgctggagctgagcccgcgccatttgctcagcgcgcagcgcgaagccgaagaagacgccggcgacgcgaccgagggccacagccggctcgccaccgacgcgctgcaagtgctggccaccaacgcagccctcagcggcaacaccccgcccaccccgcactggcggctgttcgacgacctgccccagttgctggaagccgcccgcgaggcggtggcggccaccgtgctgctggacaccgccagcagcaagaaggaagtgctgggcaacgccgtcgcgcagttgcgccagcaatgcggcaagcgcctgaagatcgtagtgcgcgaggtaggcaaccgccggctgcgccagaacgaggaacagctgctgctgcggctgggcgccaacgcggtgctgccggcggagctgcgcttttccagcctggccagcatcgtccactcgctgcgccaggcggtgtaccagggcagaaaacatgtcgaagccgacgccctgcgcgccgccagccggcccgaggccgaccgcggctacctgccgccggcccgtttcgtcgaggtggtggccggcaccgtgcagcgcagccgcgccatcgatgtcagcaatatgttcatccgcctgcagccggcgctgggcgcgagcccggccgaactgctggcgctggggcgcttccagcgcgccggcgacctgtgcaccgccgacggcgaatacgcctacctgttcctgttcgcctgccgcgaggccgacgccgacgccgcgctgggcaacctgttccgcatgccgataggcgaagtggcccaggccgaggtgcgcagcgcggacagcgaaagcatccagctggcgctgtcgcagctgtcgcgccagtccggcttcgacaagctgccggacctcagccgccagctgtcggacgcgccgcgcccgcgcgacagccgccacgcgcacacgccgcccaccctgcaacgcgcgccgctgcggcggcacggcagccaataa

SEQ ID NO: 2859 - DNA, 921 bp, Chromobacterium substugae
gtgctgttgatcgcctacgatctgcgcaacggcggcatctccaaaaccacccgcagctttctcaacgccgccggctatctgcactggcgggtgacggtggccgacgccaaaagcagcaacgactcggtgcgtgaacaactgctgctgcaagccaccgccaaggacgtcgccggagtggcgctggtgggcgccgacagcgccggctaccacctggaactggcgttgctcaagcagatgggcaaggtcgcggtgggctggcacgccggcagcagcccgggtcccaatgcagagctgttcgccaacgtcaccaccgaccccatcgccgtggcccaaaccgcggtcagctacgccattggcagcagcaccggcccgttgggcgcagtgatcttcaccgactcccatttttccatcgccatgcgcaaggccaacgcgatgaaggacgcgctgctgcgctgcaagcgctgcaaggtgctggccatggaagacgtggacctgagcaagaccgcgcagctgatcccgcaacgagtgccgcggctggcgcagaaatacggcgcggcctggacccacacgctggccatcaacgatctgtacttcgacaacatcaactttccgctgcaccagaccgcccggccggacatcgtcaacatctcggcgggcgacggctccaattcggcgatgaaccgcatccgcgaaggcatctcgcagcaaaaggccaccgtggccgaaccttgcaaccaacaaggctggcagatggcggacgaactgaaccgcggcttcgcccgccagccgcccagcggcttcgtcagcaagcccatcctggtgacccaggacaagctgctggcccacccgcgcgacggcgacatcgaagacgaccaggcttatcgccaagcctatctcggcatctggctgaaaaaaccttga

SEQ ID NO: 2860 - DNA, 207 bp, Chromobacterium substugae
atggcggccgctttgcgccggcgggcctgcggccggggcgacggcgttcggcgcgggctccgccggctgagcggcggaagatatcaggagggaaaatgccagcagccgcggcagggcgcggcgcgacaaggcgcgcagacaaggtggggaggatgcgcgcaatcggctggccggctcggcttgggtcgtctccatgctcaaatatag

SEQ ID NO: 2861 - DNA, 1839 bp, Chromobacterium substugae
atgacacaacaccatcatctaggctgcgcctgctgctcgatgccgcatctgccttcgttgttcgacaacctccccgatcctcaacaagcgctgcaagccctggaagccgcgctcaagcaagccattccttcgcacaccccggcgcgcgcggttttctgcggcggccctatttatacggtcgccgccaatggcaatcagcgcgtggaggcactgggcatcgccgacggcgtcatcgtcgccaccggttccctgcaattggtggaaaccgcgatggaagcgcaaatgccgggacaggcctatgacaggatagacctggcgggccgcacgctgctgcccggcctcatcgatccgcatgcccatgttctgcccagcgcgctttaccggcattggctgccgctggcgcccttcaaaggccagcgcctggacccgcaatacagttacgaaagcatctcggcgcagattcgcgaggcgctctcccagtccaaattgccgaaagatgcgcaaggagaccgatgggtgctgggcttcggcgtcgatccgtcgctgatgaaggaatggatcgatatcaacgccgacctgctgaacgaattgagcgaacagacgcctatcgccctgatcaacgcatccggccacatcgcctatgccaatacgcctgccttgcgcaaggcagggttgctgaatcctgacggcagcctgccgccgagcaagggcgtgctgaccgaggaccgggtcaaggcgctgcttggggcgatgccgcccatcgtctgggcggaggccgtgctccagattccgaaggtgctgcaggatgcgtcgcagaccggcatcaccaccctgctggacgcgggagccggcgtatccggcagcaagctggaaatcgacctgctgaagctggccgcccatggggggccgctgcggatcgccgcggcgctgttcacgccggacaaggagaggatgcaacactggaaagagctccagatcacacccgatctggacaatgccaaggacaagcgcttcgcgctgaaggcgatcaagctgatatacgacggctccaaccagggcctgaccggttatcagaacgaaccctatccgtgcgccgaagcccatccggtgccggacgttccgcccacgggcctgcacaatctcgaacccggcgagctggcggaactgatccaactggccagtgatgaagaatggccgatcctgatccacgccaacggcgaccacgcgatggccgatgtgctcaacggttacgccgagtcgttggcccccgcctctgaagccgcggataagaagcgccgcctgcgcatgcgggtggagcacgcctcgctgatggacgatcgcgcaatcgccaagatggctcgcctcaaggtaagccccagcttcctgatcggccatgtcggctattggggctatgccttcaacaagaccattctgggaaatcgccgcgcgcagctgctggaccgggcgcagtccgccgttcaggccggcatgcgcgtcagcctgcattccgatcacttcgtctctcccttcggcccgctgcgcatgatggagcaggccatcttccgcacgatggaaggggcgccggccaaggagcgcgcgccgttgaatccggcggaatgcctcagccgcgagcaagcgctgcgggcagtgaccctggatgccgcgtggcagtgccatatggaccacctggtgggttcgctggagccgggcaagctggctgacctggtgattctggaccagaatccgcttgacgacgcggtgaccgacctgcgcggcataaccgtatgccagacctggctgaacggggctccagtctatcgcaatccgtcccacggctaa

SEQ ID NO: 2862 - DNA, 2952 bp, Chromobacterium substugae
atggtgtggaagctgtcggatagggcagctggcagcagcttgcgctgccggaatcgcggcgccaagctcggtgaatggctgaaaaagaggtataatcaggccatttttccattcaaaaaatcaagattaagcaccatggaacttgccaagagctatgaaccgggcgacatcgagcgtcgctggtacgatcaatgggaacaggccggctacttcaagccgagcatggacaccgccaagccgtctttcgccattcagctgccgccgcccaacgtcaccggcacgctgcacatgggccacgccttcaaccagaccatcatggacggcctcacccgctactaccggatgaagggcgacaacaccgtctggattcccggcaccgaccacgccggcatcgccacccagatcgtggtggagcgccagctggccgaccagggcctgaaccgccacgacatgggccgcgaagcgttcaccagcaagatctgggaatggaaggaaaaatccggcggcaccatcaccagccagatgcgccgcgtcggttgctcggtggattgggaccgcgaatacttcaccatggatgacacccgcgccgaggtggtgaccgaagtcttcgtccgcctgtacgagcagggcctgatctatcgcggcaagcgcctgtccaactgggacgccaagctgggcaccgccatctccgacctggaagtggtatccgaggaagaagacggccacatgtggcacatcaagtacccggtggtgggcagcgatgaatatgtcaccgtcgccaccacccgtccggaaaccctgctgggcgacgtggccgtggccatcgccccggatgacgagcgctacctgcacctggtgggcaagcagctggaactgccgctcaccggccgcaccatcccggtgatcgccgacgagtacgtggacaaggaattcggcaccggcttcgtcaagatcaccccggcgcacgatttcaacgactacgaagtgggcaagcgccatagcacccagctgatcaacgtgatgagcctggaagccaagattctggccaaggcgcaaatcttcggcttcgacggcgccgcccaaggcaccatcgagctgccggccgcctacgccggccttaccgcccaggaagcgcgcaaggcgatgctggccgatctgcaagcccagggcctgctgctggaaaccaagccgcacaagctgatggttccgcgcggcgaccgcaccggcaccgtgatcgagccgctgttgaccgaccaatggttcgtggccatgaacaaagtcgccgacggcgacgccaccggccagtccatcgccgccaaggcgatcgaggcggtggagtccggcgaagtgcgcttcgtgccggaaaactgggtcaacacttacaaccagtggatgaagaatatccaggactggtgcatctcccgccaactgtggtggggccaccagatcccggcctggtacgacgaagacggcaatatctacgtcggccgcaccgaggaagaagcccaggccaaggccggcggcaagaccctgcgccgcgaacaggacgtgctggacacctggttcagctccgccctggtgccgttctccacgctgggctggccggaagaaacgccggacctgaaagccttcctcacctccaacgtgctggtgaccggctacgaaatcatcttcttctgggtggcccggatgatcatgatgaccaagcatttcaccggcaaggtgccgttcaaggatgtctacatccacggcatggtgcgcgatcacgaaggcaagaagatgtccaagtccgagggcaacgtgattgacccggtggacctgatcgacggcatcgcgctggcgccgctggtggaaaaacgcaccaccggcctgcgccgcccggaaaaggccccggccatcgccaaggccacggaaaagctgttcccggaaggcatcccggcttacggcaccgacgcgctgcgcttcaccatggccagctacgccacgctgggccgctcggtcaacttcgacttcaagcgcgccgaaggctaccgcaacttctgcaacaagctgtggaacgccacccgcttcgtgatgatgaacgtggaaggcaaggactgcggccaggatgaaagcctgccgctggagtatagcttcgtcgaccagtggatcatcggccgcctgcaacaggccgagatcgacgtcaccaacgcgctggaaacctaccgcttcgacatcgccgcccaggtgatctacgaattcatctggaacgagtactgcgactggtacgtggaactggccaaggtgcagctgcaaaccggcaacgacgcccagcagcgcgccacccgccgcaccatcgtccgcgtgctggaagtggcgctgcgcctgactcacccgctgatgcccttcatcaccgaagagctgtggcaaaccgtggccccgttggccaacgccaagaaagcggactcgctgatgctggccccgtggccggtggccgacgagagcaagatcagcgcggcagccaacgcccgcatggacgcgttcaaggacatggtcaacgcggtgcgcaatctgcgcggcgaaatgggcatcggcccggccgtcaaggccccgctgttcatcgaaaccacagacgcgtccatcgccgacttcgtgccgtatctgaagctgctggcccgcctgaccgaaggcacgctggtgtccaagctgccggaagacgatgccccggtggcgatgtccggcgaagcgcgcctgatgctgaaggtggaagtggacaaagccgcggaaaccgcgcgtctgaccaaggagcagggcaaggtggaagccgagctggccaagctgaccgccaagctggagaagccgggttacgtcgacaaggcgccggcgcatttggtggagcgcgataaggcccagttggctgagttgaatgacaagttggagaaggttagggcgcagttagtgaaactagcttga

SEQ ID NO: 2863 - DNA, 675 bp, Chromobacterium substugae
atgacccagttggcgcactctcccatgcagcctgggctgctgtcttttcccttccttacgcacactatccgccttctgcatcgccacaacggcctgtggttcttcgccgatgacgtcgcggcggcgatcaaatgccgcagtacagcggcgctgctcagcaaactcaacagagaagaagtccgcaccctgccggtaggcgtggaggatgtggtgtgcctgtccgaaaccggcgtggccatggcgattcggcgctatcgcaagccggcggcgcggcggtttcggcgttggttggaggaggagttgctgccaactttgtggcgggagggcgaggaggcgttgacggcagatcagttggagcaggccttggcgctggcggcggaggcggcgcggcaggtgagtcgggcggtgctggatgcagtgttggagaatggcgaggcgtgctggcagcatagccgctggctggtgacgctggactatgagcgccataatcgccagaaacacccgctcggccgcatgatgggcctgaacagcgctgtttctacattggacggcttagccgagttgatcgccgtgccggacggcatgccggcgaccgataccgagctggtgaaactggccgccgcttgccatctgcggctggccgagcggatgagcctgcgcgtggcggatgagtaa

SEQ ID NO: 2864 - DNA, 1080 bp, Chromobacterium substugae
ttgattcacaacacgattccgcgctggaccattgtcacccctgtattggcctgggccgccatcgccgcgtcttcggcggccggtgggcatgcttcctatctgacgctgctggcggtgttgctggcgggaacggtattcgccgccgtgcaccatgccgaggtggtggcgcataaggtgggcgagcctttcggcacgctgatcctggcgctggcggtgacggtgattgaggtggcgctgatcatttccttcatgctgggcggaggcgaggagaagctggcgctggcgcgggacaccattttttccgccatcatgatcacctgcaacggcattctgggcatttgcctgctgctgggcggcttgcgccatcgcgagcagaacttccagcttagcggcgccaaggcggcgttgacggtgctggcggcgatttcggtgctggcgctggtgctgcccaactacggcaccagccagccggggccgttgctgtcgtcgtcgcagctggcgttcaccggcgtggtgtcgctggtgctgtatggcgctttcgtgtttgtgcaaaccattcgccaccgcgattatttcctggtggaaggcagtcatgacgaggacgagcacgcgccgccgccgtccaacaaggtggccatgctggccgtggcgatgctgctgatttgcctggtggcggtggtgaccctggccaagctgctgtcgccgtcgattgaaagctttgtggtgaacgccggcgcgccggcggcggtggtgggcatcatcattgccgccctggtgctgttgccggaggggctggccgccgccaacgcggcgcgggcggatcgggtgcagaccagcctgaacctggctttgggttcggcgctggcttccatcggcctgaccattccgacggtggcgatgattttcgtgttccggggcgagccgctgatcctgggtttggaaatcaaggaaaccatcttcctgttgctgacgctggtggcatgctccttgtcgctatcggtagggcgcaccaccattttgcagggcatcgtgcatctggtgatcttcgcctctttcgtgttctttgcgatcagcccctga

SEQ ID NO: 2865 - DNA, 1560 bp, Chromobacterium substugae
atgcgcaatcatcatcccaccccttacgacgtcatcatcgccggcgccggcccagttggactctttcttgcttgcgaacttcgcctcttcggcctttcggttctggtgctagagcaggctgcggattcacactcccctctaaagcgccttcagtttggcatgcgcggtctgtcggtgcccacccttgaagccctgcatcgccgcagcctgctggacgaaatcatcgccgcgactcaggccaacgatgcagccaagcaaacaaaggcaagcgcccattggatgcagcaaccgcgccgcgctgccggacatttcgccggcataccgttccatctcgatgacatcgacacctcgaattggcctttccatttgcctggccccgccgacactccgatggcaatcacattggaggtcttcgaaacggtcttggcacgccgtgcttccgccatgggggcgacgattctgcgcggcgtcggtgtcgatggctatcttgtttcagacgacgaggtcacggttcacgccgacggcacggtttttaacggaagctggctcatcggctgcgatggcggccgcagccaggttcgcaaggctggcggcttcgaattccttggcaccgctcccgagttcaccggctactccgtggacgcggcattagcagagccgcacacgcttcaacccggccggcactatacgccaaccggcatgtacacctatgccaagcccggcgtgatcgccatggttgaattcgacggcggcgcttgccatcgaacgcaagctctcactcaggaacacatgcaagccgtactgcgccgcgtgtccggtgccgatgcgaccctggccgatattcggcttgccactacctggaccgatcgcgcttatcaggcaagcgcatatcgccgggggcgcgtgctgcttgccggcgacgccgcgcacatccactcccccctgggcggccaggggctgaatttagggataggcgacgcgatcaacctgggctggaagctggccgcgacgatgcgcggggacgcgccggccggactgctggacagttatcagcaagagcggcacccaatcggcgcccgcgtgctcgattggtcccgcgcgcaggtggcgctgatgcgccccacgccaagcacgcgcgcgctcgcagccatcatcggcgatttgatcgaaacccgagatggcgcgacctattttgcagagcgggtatggggactgtccctgcgctacgacatggcaagccagcatccgctggcaggccgcagcgtgccggacttcgagtttgacgacgggacgaaggccggccgcctgttgcgcaatggccggggcttgctgctgcatttcgacgcagctgcgccccttctaaactggatgaagcgctggcaaggacgcgtcgactatgtcacggccacggtcaaaaacaatcttggcctgcgcgccgttctggttcggcccgacggatttgtagcctgggccagcgagacctcgcccgatgcagaggagattacgcccatcttggcgcaatggtttggcgaaccgaaagaatcaagcgatcacccgtag

SEQ ID NO: 2866 - DNA, 165 bp, Chromobacterium substugae
ttggagttgggcaagctgggcctcaagttgggcaatttcctgttctatccggttcgcttgtttttgctgactttcctgcgagctttgggacccgccctagccgccattctgcagttgctgttccagttgttgtatctgttgctccagctggctatcgaggcttga

SEQ ID NO: 2867 - DNA, 558 bp, Chromobacterium substugae
atgaatttgaaaaccttcaaagcattgcttgcagccatctctctaactatcgcatccaccgccagcgatgccgctcccatcgtcaccctttctggcccgctggccctgcaaaccagcaatggccactacctgaccgcagtgaacggcggcggcttgggcggccccaacaacggcccgagcgcagtcgcactgcattccgacgccaaaaccaagggcggatgggaaacgctctatctggtgcaactgcccaatggccgcgtcgcattccgcaccaccgccggctactatctgactgcggtgaacggcggcggcgtgggcggccccaacaccagtgccagcccttttcataccgacgccacctgggcaagcacttgggaacgcttccaactggagtttgatccggctagcaacacttacgcgctgaaaaccgccaatggcaactacgtcaccttcgtcaataatggtggcatcggcggcgccaataatgtccctgtccatagcgatgcccgcacagccaatgattgggaatcgttcacgctggtgccattgagcaattaa

SEQ ID NO: 2868 - DNA, 180 bp, Chromobacterium substugae
atgaaaattcaggaactgaaacagggtgacctgatcacccagcacatcgacaatctggttgtatcgttcgaagttttgtctatccagcagatcggccgccgcttccagataacattcagctcggcctccggcatcgccaccgccagctatcaggccgatgcgttgatcaccaccatctga

SEQ ID NO: 2869 - DNA, 354 bp, Chromobacterium substugae
atgaacaatgccatcgcctgcgccatcgccgcggccgccagcttgctagctcttgccaccaccagccaggctgcggaatggcggctgggcgacatcaagtctcaggagtgcctgaaaaactccacgctgatatccagtagtatcaagtattgtcacaattgcgtcggcaagcagggcaatctcacttcatggacgttcacgacaacctgcgacggcaagctgcaaacccgacttgcgcaatccaagatcaattgcaacactcccgctggccaagccagcgaaacggcgcagaaaaccactcacacccaacaagccgccgccaccctccccggaccggcgaccccttgcaaataa

SEQ ID NO: 2870 - DNA, 159 bp, Chromobacterium substugae
atgccgcgcggctgcggcatcgtcgaattcccagctaaggcggcaggcattctgatcttggtggatggctctctgatccgcgcattcagcaagggaatgatcggcctgctggcagccaacgggactctgccgtgcgcatcctggttcattgaaagctga

SEQ ID NO: 2871 - DNA, 681 bp, Chromobacterium substugae
atgaaaaaaattcttccgctgctggcgttggccagcctatccgcgaactcccgcgctgatgataatgaagtgttgcgccatatcgccgactgttccgacagtttttcccgttatatggccagccagccgcaatcggctgccgacaagcatttttccgtgaagaacggcgcagccgctctcaagatgaaactggtaaccgatgccgccaaggaactggaagaaaacattccgggcagttcgaccggagtgaaggatatcagtcgttacgccgatatcgataaagccattccgatttctgggcaatgggcattgagcagctactttgaagagcatgcgcgttttgccaaaaactcagatgccggcgtgaaggaaacctataactgggtttttcatctggatggcaaaaaggatatgttgctgcgcgatttcctgcgcctgaccggcaatctatcgtatagctgtgatggcaataactgtctcgcttaccagcgcatggcgaaaggcggctggcaagcggtgaagccggaacagctgaaggcaggcgaaccctatctgcaaattatggctagcaaggagggcagcaagcaattcagcatatcttgcaatttggcttcggaaggcaagcatttgccggttggcctgatcaaaacccgccgcccggattggcaactgaatttctga

SEQ ID NO: 2872 - DNA, 540 bp, Chromobacterium substugae
atgggcgcgacgcagtggagccgacagtaccagtacgacgccgccggccaactgaccggcatcgccgacagccgcaacggccaactgaattaccgctatgatccggtcggccgcctgctgcaagccgccacccccaagggcgtggagaacttcaatttcgacccggcaggcaatttgctggacaacgcccctgccgccgacggccatcaggacaacagcctgctaggcaacctgctgagccagtacgccggccgccactaccgctacgacatggagaagcgcgtcaacagcagcctcaccaagctggaatgggacagccacaaccacctctcccgcctcatcgccccggacggccagcgcaccgactaccactacgccccgcagggacgccgcatcgccaagatcagccagggccaggccacgctgtacggctgggacggcgacgtgctggtcatcgaaccctgcgtcaaagaaacggtacgctatctattcgagccaacagctgcgcacaaagggttccgcctcgcaagaagaaattga

SEQ ID NO: 2873 - DNA, 222 bp, Chromobacterium substugae
atggttgagcgcttcaatggccggatcagcgatgtgctggcgacgcaccgctgcgaatccggcaaagatctgggcgagacactgcagcgttatgtcctgctctacaatcagcatttgccgcaattggcactacagcatcggacaccgatccaggcttggcaaaagcagcggcctgatttattcaaaaagcgcgtgagcaatcgtccgggactggacatctag

SEQ ID NO: 2874 - DNA, 747 bp, Chromobacterium substugae
atggcgaaccgacaactactacgtgaaatccggctggtgcatgccgaggtcaatggtatttatggccatcggcgtattcatgccgaacttcttgcacagggcttcgcctgcgggcggcatcgcatcgcgggcctgatgcggcgaaacggtatcagggttagaacgcgtaaacattgtcgacccgtcagtggtggtcaacaccttctacccatggcgcctaatctgctgcagcgacaatttgctgctggtggcgacatcaatcagcgttgggtgtcggatatgacctatatccggaccggtgaagggtggctgtacttggcggtggtgctcgacttgtactcccgggcgatagtgggctgggccatgcatcatcgaatgcagcaagaactggtgcatgctgccctgacgatggcagtggcgcgccgccagccttcaggagaggtgattctgcattcggaccgcgggagtcagtactgtgcctttgactaccaggcattgctgaaacggcacggaatggtaccgagccactcccgcaccgggaactgctgggataatgcagcgatggagagcttcttccgttcattgaagtcggaacgtgtttatctgacccactaccggagctacgatgaggcgcgtacggatgtgtttgattacatccgcttttacaatcaccaacgacgtcattcaaccctggggtatctgaccccggttgaattcgaacgccgccgttcagagcttagtgcttaa

SEQ ID NO: 2875 - DNA, 72 bp, Chromobacterium substugae; identical to SEQ ID NO: 849

SEQ ID NO: 2876 - DNA, 123 bp, Chromobacterium substugae
ttgcttgccaagtggtttcatttccagccgtcggaaatagatggcctggaggtggcggatttcctggcatggtgcgaacgggcgactgagcaaattcggaccgaacaagaagcgtacggttaa

SEQ ID NO: 2877 - DNA, 297 bp, Chromobacterium substugae
atgagcgaaaccattcagccgcaaccagctggcagcctgatcgagagcatcacggtagaactgctggcgcccctgatgcttggcaacggctcccgcgtctcgcaactgacgctgcgtcgtccaaaagtgaaggacgtcaaactggcggcgcgttttggcgaacgccaggaagagcaggaaatcggtttggcggctttattgtccggtttggccgcggaggacatcgagaacctggatcttggcgattggcgcaaggtgcaggagtcttttcgccggatgctgggtgacaacggctga

SEQ ID NO: 2878 - DNA, 519 bp, Chromobacterium substugae
atggccgtgcaagtcaacaatatcgtcaatgccaatatctacctgggcggcaacaacctgctgggttgcgccgaagagatcaagctgccggtgctcaaggcggtgatgaaggaccacaaggcgctgggcatgttcggcaagctcaagttgccggcggggttcgaggcgctggagggcgacatcaagtggagctcgttctacctggatgccttccgcgcagtggccaaccctttgcgcgcgttgcaactgatgtgccgctccaacgtggaaagctggaatgcccagggtttgagccaggagcgcgagctggtgactttgctgacggtgtcgttccaggagtttccgttaggctcgttcaagcagcacgagcaagtcgacttccccagcaaattcaccgccacctatatcaagcagaccctggctggccaggatgtggtggaactggatgtgatgtcgaatatcttccgcgtcggcggagaggacatgctggccaattaccgcagccatatcggagcctga

SEQ ID NO: 2879 - DNA, 1428 bp, Chromobacterium substugae
atgccggctaattttctgcacggagtggaaaccatcgaagtggaaaagggcgcgcggccggtacgggtggtgaaatccgccaccatcttgctggtgggcacggctcccaagggcaagccgggcgagttgactttgtgcctgtcggagcgagatgccgcggcgtttggacgtggccatgccggcttcaccatcccgcaggcgctggctgccatttacgatcaaggcgcaggcacggttctggtgttgaacgtgctggactcctctctccacaagagcgcggtggaaaacgagaacgtcagcttcgatagctcgggccgcgcgcgcttgcgtcatcccgcggtgatgggcctggaattgaaaagcctggatggcggcaggaactacgtagccggagtcgactaccaactggatgccgatagcggggagctgtcgcgtttgaaagccggcgcgatcgccagcctggccaccgtgcgggcgaattacagctatgccgatcccgccaaggtgaccgcggccgacatcatcggcggcgtggatgccgccggccgccgcacgggcttgaaggctgccaaggacgcattcagcgcgttcggcttcctggccaagctggtgatcgcgccggcctattgcacccaggcttctgtggcggcggaaatggtggccgtggccgagcagactggcgctttcgcgctgatcgacgcgcctatcggcgtttcggtgcagcaggcgctgcaagggcgggggccgggtggcgcgatcaacttcaacgtcggcagcgagcgcgccatcctgtgctacccgcatctgaaggtgtgggatgaccaaaccaacgcgccgcggctggagccgttcagccagcgcttggccggcgtgatcgcgcgcaaggacctggacaaaggctattggtggtcgccatccaacaccggaatccagggcgtgatcggcatcgaaaggccgctgacggcattgctggatgatgccaatgccgaagtgaacctgctcaacgaagccggcatcgtcacggtgttcaatgccttcggcagcggctgggaggtttggggcaatcgctccgccgcctggccggtgttgtcgcatatcaggaatttcattccggtgcgccgtaccgccgacatcatcaacgagagtctgcgctatttcagcaagcaatacatggatcgcccgctggaccagccgttgatcgacagcctggttggcagcatcaacgcttttttccgcaaactgatcggcgacggcgccattctcggcggacattgctggttcgatcccgcgcgcaacgtcaaggaagagctggctgccggccatctgctgctgcagtacaaattcactccgccgccgcccatggaaagactgagccttgaggccgagatttccgacgagtacctgctgaatctgaaaggggagcgataa

SEQ ID NO: 2880 - DNA, 186 bp, Chromobacterium substugae
atgatctaccgctacgatggcccgccgtccggcgttacgctggccgatggccgcgaagtgatgctgttttgcgggcaagaggctgatttgcccgaggacggcgaatatacccgcgcgctgttggctcagcgctatttgcagccagcagaccgccagctcaaccaaggagagactcatgccggctaa

SEQ ID NO: 2881 - DNA, 228 bp, Chromobacterium substugae
gtgctgatgctggaaagcggtggggagttgacccgcgcgcttggccggatcgagggcaagctggacatgatagcggccagccaagtgggacagagcgagcggctggatggcttggacgctcggctgcgccaagtggagcaacaagcagcgcgcgtcggcgccatcagcggctgcgtggtcgcggtgttgactgctatcgcggcggagatgctcaagcgagcttggtag

SEQ ID NO: 2882 - DNA, 216 bp, Chromobacterium substugae
atgactgatctattcgatcaagcccaggcattggaacagcgccagcgggaggaggctttggcgcggcaggcggtgcgcatgaacctggccggcgcggccagttatagccattgccaggagtgcggcgatgatattcctgcatcgcgccgccgcgcagttcccggctgccggcgttgcctgatttgccagaaaagccatgaaaaaggttggtgctga

SEQ ID NO: 2883 - DNA, 435 bp, Chromobacterium substugae
atgaagctggaacagttgccaaacttgttgccggaaaccgtacgcctgattgccggcatgataggactgcctaatacgttgaaactggtggagaacttgggaggtaccacctttcccgtcagcaagaagcgcagcaggctgggggaggctcgttacctggctctggcagaagtggtgggagtggaggcggcagatcggctttgccagcattacggtggagacctgctttacattccgcgctgcgctagcgccttgcgtcgattgcgtgattacgccatttgcgaggcttttgatcggctcagccgcgagttgggcagcaatgccgcggtcagccagctggcccagcagcatcggctgacagaccgccgcatttgggacattttgaagcgcaccgattgcagtgacccggcggctaccgatccccgccgccactga

SEQ ID NO: 2884 - DNA, 315 bp, Chromobacterium substugae
atgaaccttgtggatgatttgggggagaaaaaaatgatagacgcgaacagtccattgcggccgctacgcaatgcggccatcgtcgcctcggcccacagagtggctgccgcggtggagagattgacccggctcggtttcaccgtgatgtgggtggagttgcttgagccgcggcaaccgacgatacgcatagagccgcatccagattgccggcggatggcgggccaaggcgatgctgcccatgacgacttctatagcagcccgaaggctggccgattcagaatcaacggctgtctggtggtctggaccgaatattaa

SEQ ID NO: 2885 - DNA, 156 bp, Chromobacterium substugae
atggtggaaactgtgctggatcaggttttacaggagcgcaacctcagactgaagtcggaaaagcgcggcgccgtggtcgcgtttctatatgactacgccagcaaaggcggcggacgggatggcatgttgatggcgctgcaagcgctggtggcatag

SEQ ID NO: 2886 - DNA, 195 bp, Chromobacterium substugae
atggcgggcggcaacaaaaatggcgcaaccctgttcaaggttgcgccattcttcatcgcgttcatccatttctttctggacgatgccggccagtggctggccgcctgggtattggcctatctcgcccatgcgcggccgggccgcgccgtggtcaaacccgctgcgcggcctgcaattcgtccagataaggcctga

SEQ ID NO: 2887 - DNA, 624 bp, Chromobacterium substugae
gtgagacagcgcgtcgccgtcatcgactttgaaaccaccggcatcacgccggggccggattgccgcgccaccgaaatcggcgtggcgatggtggaaaacggccgggtggtggaccgttttcaaagcctgatgaacgccggcgtgcgggtgccgccgatgatagaggcgctaaccggcatcagcaacgccatgctgcgcgccgcgccgccggcccacgcggtgatgcgcgacgccgccgcctttgtcggctccgctccgctggcggcgcacaacgccagcttcgaccgcaagttttgggattacgaactggcgcagctgggcctggcgcgcgggcaggatttcgcctgcacgctgctgctgtcgcgccggctgctgccgcaggcgcccaaccacaagctgggcacgctcacccgctgggccagcctgccggacaccggccgcgcccaccgcgcgctggctgatgccgaaatggccgccaacctgctgtgccacctggaagacaccctgcgcggccagttccgcctgggcgatgtgaaccacggcatgctgtgcaagctgcaaaaagtggccgcggccaaaatcaggccttatctggacgaattgcaggccgcgcagcgggtttga

SEQ ID NO: 2888 - DNA, 204 bp, Chromobacterium substugae
atgtcgaaaaagccgcaagaaaaactggatgaggaaaccctggcgttgctggcctggtgcgccgaggtggaaacccatctggtggcggccggcgccaccgaagccgaggctcaggagcatatcgaagagcaggccgaatggtataccgaccagttttttgacggcctgacgccggaagaggccgccaaggcggccttggcgtga

SEQ ID NO: 2889 - DNA, 408 bp, Chromobacterium substugae
atgtctgtttcccgctatctcgtcaaagaggatgaggtggcgttcaccgcgatgcgcgcccagggcgcgggcggccagaacgtcaacaaggtttcgtccgccatccacctgcgtttcgacattgccgcgtcgtcgctgccggagtggctgcgcgaaagattgctgggcctgaacgacacgcgcatcagcaaggagggcgtgctggtgatcaaggcgcagcagtaccgcacccaggaacaaaaccgcgccgacgcgctgctacggctgcaggcgctggtggacagcgccagccacacccccaaggcgcgccgcgccaccaagcccacttatggttctcagcagcggcggctggccggcaagtcgcagcgcggcgccatcaagtcgctgcgcggccgggtggacgactga

SEQ ID NO: 2890 - DNA, 2007 bp, Chromobacterium substugae
atgcgacaactgaccattcgccaactcatgtccataggcaccgccatcgccgtcatccccttgctgttcggcaacctgctgatatggcaggggaatgcctcgctgagacaggccgccacggcaagcggcaatgcgtcggccgccctgctgcatttcaaaaacgcccgctacaacgtggtgcagattcagcagttcttgaccgatgccgccgccaccggcgaaaccgccgacgactaccgagacgaggaaagcaactggaaacaagccctgaccgagctggataccctgtcgcaacttctgccggaactggccgccgacctgcagacgctgaaaccgcaagtcaaccacctgcacgaagaaggacgcgcgatggtggaggcctatatccggcagggccgcgaggccggcaacgccatcatgaaaaaacccggctccggctttgacgacaccactgacgcgatagacaagaaacttgaagaactgtccaagcgcatcgaacaactattcagcgcggcgaacaacgcacaggaaagcgccctgcggcaaaccgcgctgctgaacgccgccatcgcggcattggccattctgctcatactggccgccaacagctatcaatacctcagtctgcggcgcttgctgggcggcgagccggcttacgcttccgaagtggcaaaggaaatagccgacggcaacctgtccttgcaggtcgctaaccagtcgcagtcgacggacagcctgctgggctcgatgaaaacgatgacgcagaaattgacggagcacctgcggctgctggatcaggaaaccaagcaggtcggccagtcctcgtaccagatttccgaaatttccaaacacatcaccgacaactcggaacgggagcagggccactcggatgaggtgcgccaggccaccactgtgctcgaggaaaccacggaatcggtgcgcgccatcgcgcagaaagtcagccaacacgcagaccaggctcgcctcagcgccaaccagggcatggccaccatgcgcagcaatatcgaggagatgggacgcgccgtagacgaggcgcagcaggcagagggcaaaatccaggccttgagcgaggccaatcagaaaatccaggtcatcacccagaccatatccagcatcaccgagcaaaccaatctgctggcgctgaacgccgcgatagaagccgccagggcgggcgaagccggacgcggcttcgccgtggtggccgacgaggtgcgcaagctggcccaccatgccggccaggctaccgatgaaatcaccgccatcatcggcaatctgaaccagctgatagaggaaaacactcagtcggtgcagggcatcatcgagcggacccgcgccggcatgcaaaaagccgaagaagccagcaccgccatctccagcctggtgcacgacatcgacaacaatgtccatgccgcccatcagatcagcgacgccagctccacccagatgcagcgcctggacactttgcgctctacgctggccaagctgctggacaatatgtccggcaacgcgctgaaagtgcggaccaccggcgtcatcagccgcgacttgtaccgggtgacgggcaatctgagccagatcatggagaaattccgcttcgaccccaactggacgccgactgcgcgcagcaacgaacaccgccgccatccccgcgtcaacaagaacctgctggtgcaggtggacgacggcggccagaagcgcgacgccaccaccgtggacttcagcctgaccggcttgcagctgcggctgccgatgccgctgcaggccaaggccgggagcgaactgccgctcagcatccagctgccgcaagactccatcgaacgctattccaagcagcaaccactgacgctcacggccaagttgctatggacacgcaaaaccgaggaaggcgagttgtacggcttctcgttcggccgcccgaacccgcagcaactggcgcaactggaacaagccttcctattcttctgccacaacccgatctacgaataa

SEQ ID NO: 2891 - DNA, 1542 bp, Chromobacterium substugae
atgaagcgtactttactggcgttgtccctggtgctggccggcctggccccgctctcccatgccgatgtcgccgacggccacgcgctgccgcccggcatcagctggcagcagggcgacgtgccggcggctttcgccaaggcgcgcagcgaaaacaagccggtgttcctgtactggggcgcggtgtggtgcccgccgtgcaaccaggtgaaatccaccatcttcaaccggcccgacttcatcgccgccacccgccagttcgtgccggtgtatctggacggcgacagcgccaacgcccagcaactgggcgagcagttcaaggtgcgcggctacccgaccatgatcttgttccgtcccgacggcaccgaaatcacccgcctgccgggcgaggtggatcccgagcgctacctgcgcacgctacagctgggcctggtgacggtaaagccggtgaaggcgctgctggcggacgcgctggccggcaagccgctggcggcggaagattggcaactgctggccgactacgcctgggatgttgaccagggccagatcattccggagaaggacgtcaccgccacgctggcgcagctggcgcaacgggtgccggcggcgcagaccgccaccgccacccgtttgcggctgaaggcgctggcggcgctggcgggcgaaaaggagccgccgccgttcgaccacgaagacgcgcgcgcgcagctgctgcaggtgctggccgacggcaagcttagccgcgccaacgccgacatcgtgatttacgccgccagcgatgtgatcaagctcttgggcgacgacgcggccggcaagcaggcgctgcagcaggcctggggccggcagctggcggcgctggaggcggacgccacgctgtcttggggcgaccgcctgggcgccacttccgccttgctgtcgcagttcaagcagcaacaccccaagcagcctctgccggcgtcgctgctggcggacgtgcgcagccaggtggccgccgcggacaaggcgagcgccaatccctaccagcgccaggcggtcatcaccgccgccggcgaattgctggccgatgccggcctgctggacgaatcggacaagttgctgcaggcggaattgaaaacctcgcacgcgccgtactaccacatgcttattctggcctccaacgccaaggagcgcggcgacaaggccgcggcgctggcctggtatgaaaaggcctaccaggcgtcggaagggcaggccacccgcctgcagtggggcgccagctatgtcagcaacgcggtggaactggcgccgcaggacgccgatcgcatcgaaaaggccgccagcgaggtcttctccgacgcgggccgctccagcagcgccttctacgagcgcagccgccgttcgctggaaaagatcgccagccgcctgaaggcctggaaccaggaccagaagcacgcggacgaaatcggccgcctggccggccagctgaacggcgtgtgcgaaaagctgccggccggcgacgcgcaaaagccggtgtgcgatggcctggtgaaaaacctgaagtcttga

SEQ ID NO: 2892 - DNA, 180 bp, Chromobacterium substugae
atgcccgtgaagaaccgcaaacatcgaatcttgcttttgtcgtcgctgctggccctctgcttgatcggccagatcctctcttaccgcaccgtcaacctctccagcctatgcgccggcgcgatcatcggcatcctcatcgcccagctatcggcggaacttgatgccctgcgcgccgtttag

SEQ ID NO: 2893 - DNA, 417 bp, Chromobacterium substugae
atgcaggcgaggctgaaatgggtggacggcgtgtgcttcatgggcgagagcggcagcggccacgcggtggtgatggacggcgcgccggagggcggcggccgtaatctggggccgcggccgatggagctgctgctattgggaaccgctggctgcaccagctatgacgtgatcaccattctgaaaaagtcgcgccagcaggtgacggattgctgggtggagatggaggccgagcgcgccggcgccgagcccaaggtgttcaccaagatccatttccatttcgtggtgaccggcaaggaactgaagccggacgtggtggagcgggcgattaaattgtcggcggagaaatactgttccgcctccatcatgttgggcaagaccgccgacatcagccacgatttcgaactgcgcgaagcctaa

SEQ ID NO: 2894 - DNA, 1026 bp, Chromobacterium substugae
atgctggtacttggtattgaatcttcctgcgacgaaaccggcgtcgccctctacgacaccgaacagggcttgctggcgcatcaactgcacacgcagatggcgatgcatgccgaatacggcggcgtggtgcccgaactggccagccgcgaccacatccgccgcgccattccgctgaccgaagcctgcttgcaggacgccggcaagcagctggccgacctggacgccatcgcctacacccaaggcccgggcctgggcggcgcgctgctggtgggcgccagcatggccaacgcgctggccttcggcctgaacatcccggtgattccggtccaccacctcgaaggccatttgctgtcgccattgctggccgaccccaaaccgcagtttccatttctggcgctgctggtatccggcggccacacccagctgatggcggtgcgcggcgtaggtaattacgaaatcctgggcgaaacggtggacgacgccgccggcgaagccttcgacaaaaccgccaagctgctgggcctgccctaccccggcggcccgctgctgtccaaactggccgaatccggcaaccccggccgcttcacgctgccgcgcccgatgctgcactccggcaacctggacatgagcttctccggcctgaaaaccgcggtgctgacgctgacgaagcaagtggaggccgagcacggcgcaatcgacgaacaagcgcggatggacatctgccgcgccttccaggaggccatcgtcgaagtgctggtgaaaaaatcgctggctgcgatgaagcaggccggcatgaagcggctggtagtggccggcggcgtcggcgccaacaagcagctgcgcgcggcgctggacgacgccgcggcgcggcgcaaattcgaggtgttctacccgccgctggcgctgtgcaccgacaacggcgcgatgatcgccttcgccggcgcgatgcggctgaaattcgccgaaccggccggcggctacagcatcaagccgcgctgggacctctccagcctgccggcggtataa

SEQ ID NO: 2895 - DNA, 1896 bp, Chromobacterium substugae
atgatccaactgaaaaacctcaacctgcgccgcggcctgaaagaactgctggtcggcgccaatttgacgctcaaccccggctacaaggctggcctcaccggcgccaacggcgtcggcaaatccagcctgttcgccatgctgctgggcgaattgcacgccgacggcggcgacgcgctgatcccgcccaactggaccctggcccacgtggcgcaggaaaccccggcgctggagcgcagcgcgctcgattacgtgctggatggcgacaaggagctgcgttcgctggaagcccagctggccatcgcggaaggcaagcacgacggcaacgccatcggccacctgcacggcgagctggccaatatcgacgcctactccgcgcccgcgcgcgccagcaagctgctgaccggcctgggcttcgacgaagccggccagcagcgcccggtggccagcttctccggcggctggcgcatgcggctgaacctggcgcaagcgctgatgtgccgctccgacctgctactgctggacgagccgaccaaccacctggacctggaaacggtgctgtggctggaagattggctgaagagctaccccggcaccctgctgatgatctcgcacgaccgcgacttcctcgacagcgtctgcagccacatcgtggaagtggccaaccagagcctgaccctgtacaccggcaactacagccagtacgaaaccatgcgcgcggaaaaactggcgcgccagcagggcgaatacgaaaagcagcagcgccagatcgcccatctggaatcgttcatcaaccgcttcaaggccaaagccagcaaggccacccaggcgcaaagccggatcaaggcgctggaaaagctggagcgcatcgcgccggcgcacgtgtcctcgccgttcgacttccatttcgacagcccggacaacctgcccaacccgctgctgaagctggaaaaggccaacgccggctatggcgacaagatcatcctgtcccagatcagcctgtcggtggagtccggcgcgcgcatcggcctgttgggcgtcaacggcgccggcaagtccacgctggtgaagctgctgtccggcgacctggacccgctgtccggcgaacgcgtcaacgcgcaaacgctgaagataggctacttcgcccagcacacgctggaaacgctgcggccggaggaatcgccgctgcagcacatgcagcgcctggcccccactgcgcgcgaactggagctgcgcagcttcctcggcggcttcaacttccgcggcgacaacgccaccgaccccaccggcccgatgtccggcggcgagaaggcgcggctggcgctggcgatgatcgtctggcaaaaacccaacctgctgctgctggacgagccgaccaaccaccttgacctagaaatgcgccacgcgctgacgctggcgctgcaggacttcagcggcgcgctgatcgtggtatcgcacgaccgcagcctgctggagtccaccaccgacgtgttctggctggtcagcggcggcaaggtgcagccgttcgacggcgatctggaagactaccgccagtggcgcatcgcccagctggccgaaggcagccagccctccagcggcgacgcgcaaggcgtcaaccgcaaggaacagaagcgccaggaagccgaagcgcgccagcaactggccaagcagcgcaagccgctgcaaaaccgcctgagcaagctggaacaggaaatgaacaagctgagcgaggaaaagtcgcagctggaagccttcctgtcgtccagcgaggcctacgacgacgccaaccgccaaaaactggccgacagcgtcaaacgccagggcgaagtggccggccggctggaaaccgtggaagaagaatggatggacgtgcaggaacagctggaggcgatggagtaa

SEQ ID NO: 2896 - DNA, 870 bp, Chromobacterium substugae
atgagctggttgaacaagctcctgccgccgaagatcaagcgcgaaaaccgcgctgacaagccttcggcggtacccgaggggctttggagcaagtgcccggaatgtgaagcagttttgtattacaccgacctggagagcaatctgcaggtctgccccaagtgcagccaccatcatccgctgacggcgcgtcagcgcctgagcctgctgctggatgaagagggccggcgcgaaataggcgaggaagtccgccctgtggacatcctcaagttcaaggacagcaagaagtaccccgaccgccttaccgcggccaagagtgacaccggcgaagacgacgcgctggtggtgatgcagggcagcatccattcgctgccggcagtggtggccgcgtttgaattccgcttcatcggcggctccatgggctcggtggtgggcgagcgcttcgtgcgcggcgtgcaagccgcggtggaagccaaggttccgttcatctgcgtggcggcctccggcggcgcgcggatgcaggagggcctgaattcgctgatgcagatggccaagaccagcgccgcgctgcaactgctgtcagagaacaagctgccgttcatctcgctgctgaccgacccgaccatgggcggggtgtccgcctctttcgccttcctgggcgacgtggtgctggccgaacccaaggcgcgcatcggcttcgccggtgcccgcgtgatcgagcagaccgtgcgcgaaacgctgccggaaggcttccagcgcgccgagttcctgctggaaaagggcgcggtggacatggtggtggataggcgcgagctgaagcgcaagatcgccggcctgatcaccctgctgatgaaagaaccgtcggtcgcctga

SEQ ID NO: 2897 - DNA, 789 bp, Chromobacterium substugae
atgtcacgtattgccaagtgtttcgccgatcttgccggcaaaaaggcgctgatcccgtttattaccgccggcgacccgcatccggggttgacggtatcgctgatgcacggtctggtggacggcggcgccgacatcatcgagctgggcgtgccgttttccgacccgatggccgatggcccggtgatccagcgcgcgtccgagcgcgcgctcaagcacaaggtgggtttgcgccacgtgctggaaatggtggccgagttccgccgcaccaacgccgtcacgccggtggtgctgatgggttacctgaacccgctgtgcgcgatgggctatgccgaattcgcccgccgggccaaggaagcgggggtggatggcgcgctgacggtggactgtccgccggaagaagcggcagaattgcaggcggcgctggacgccgccggcctggatacggtatttctgattgcccccaccacgccgccggcgcgtgtggcggaaatcgccaaactggcgcgcggatacgtttattatgtgtccctgaagggggtgaccggcgccggacatctggacattgatgacgtagcgcgtaaaattgctgccctcagacaagaactgccgttgccgataggggtgggctttgggattcgcgacgccgcgaccgccaaggccatctcctccgccgccgacgcggtggtggtgggcagccggctggtgcaggaaatcgaggcggcgacacccgaaactgccagagagcagttaactcatctggtggccgaactgaaggccgccatccgctag

SEQ ID NO: 2898 - DNA, 1203 bp, Chromobacterium substugae
atggatcggtatgattttccggatgcgcagggccatttcggtccttatggtggcgtctatgtcgcggaaaccttaatggtggcgctggacgaattgaaggcggaatacgcccgagtcaaggccgatccgacgttctggcaggaattccatcacgaattgaagcattacgtcggccgccccagcccgatctaccatgccaagcgctggtccgagcagctgggcggcgcgcagatctacctgaagcgcgaagacctcaaccataccggcgcgcacaagatcaacaacgccatcggccaggcgctgctggccaaacgcatgggcaagaagcgcgtgatcgccgaaaccggcgccggccagcacggcgtggccaccgccaccgtggcggcgcgctacggcatggaatgcgtggtgtacatgggcgcggaagacgtgaagcgccagtcgcccaatgtgttccggatgaagctgctgggcgccaccgtggtgccggtggagtccggctccaagacgctgaaggatgcgctgaacgaagcgatgcgcgactgggtgaccaatgtcgactccaccttctacatcctgggcaccgcggccggcccgcatccttacccgatgctggtgcgcgatttcgtgtcggtgatcggcgaggaatccaagatgcagatgccggaaatcatcggccgccagcccgaccttgtggtagcctgcgtcggcggcggctccaacgccataggcatgttccatccctatatcgacgttcccggcgtgcgcatggtgggcgtggaggcgggcgggcacggcatagatagcggccgccatgccgcgccgatcaccgcgggcgccaaagtgggcgtgctgcacggcgccaaaagctacctgatgcaggacgaagacggccaggtggtggagacccattcggtgtcggcgggtctggattacccgggcgtcggcccggagcacagccatctgaaggacatcggccgcgccgaatacgtggcgatcaacgacgaggaggcgctgcaggctttccacgactgctgccatctggaaggcatcatccccgcgctggaatccagccacgcgctggcctgggccgccaagaccgcgccgaccatgagcaaggacaaggtgatcctggtcaatctgtccggccgcggcgacaaggacatcaataccgtggccggcctgtccggcatcacgctgtaa

SEQ ID NO: 2899 - DNA, 621 bp, Chromobacterium substugae
atggtcagaatcaagatatgcggcatcacccgggcggaagatggcgcggcggcggcggcgctgggcgcggatgccgtcggcctggtgttttacccccccagtccgcgcaatgtcagcctggagcaggcgcgggcggtgatcgccgctctgccgcccttcgtcagcgtggtggccttgttcgtcaatccggcgcgcgagtgggtggagcaggtgctggccgcgtgcgcggtggatgtgctgcagttccatggcgaggaagaggccgagttctgccgctctttccgccggccttacctgaaggcggtgcgggtacggcccggcatggacttgctggagtgggccggccgctatccggacgcgcgcggcttgttgaccgacgccttcgtagagggcgcgcacggcggcaccggggccacctttgactggaccctgctgccggaagcgctgccgctgccgttgatactgtccggcggcctggacgaaagcaatattgtggaagccgtgcgccgggtgaagccggcggcggtggatgtctccagcggagtggaggcgtccaaaggaatcaaagatgcggccagaatggcggcattcatatcaggagcaagacatggatcggtatga

SEQ ID NO: 2900 - DNA, 795 bp, Chromobacterium substugae
gtgggcatgagaatcgcgctgggcattgaatacgacggccgggcgtttgccggctggcagacccagccgcatggcaatacggtgcaggacaggctgaatcaggctttgagccagatcgccggcaatcaggcgataagtaccgtggcggccggccggaccgatgcgggcgtgcacgcggcgatgcaggtggtgcatttcgataccgaggccgcccggccgctgaacgcctgggtgcgcggcgtcaatgcgctgctgccgccggaaatcgcggtggtgtgggcgcgcgaagtggatgaaaccttccatgcccgcttttcggccttttcccgcagttacagctatttcctgctgagcagcccggtgcggccttgcctgttggccggcaaagtaggctggttccatcaggcgctggatgtggacgcgatgcgcgccgcggcgggcaggctgctgggccgccatgatttttccagcttccgcgcgtcggagtgccaggccaaatcgccggtcaaggatttgcagcagctggatatccacgacaacggcggcctgctgcgcttcgacctgaaagccgacgctttcctgcaccatatggtgcgcaatatcgtcggcgcgctggtgtatgtcggcaagggcgcgatggacgccgacggcatgtcggcgctgctggcggcctgcgaccgcaccagcgccccgcccaccttcatgccggacgggctgtacctgaccggggtgggctatccggaaccgttcgccttgccttcgcagtttgcggcggaacgattggctttgcggtaa

SEQ ID NO: 2901 - DNA, 2061 bp, Chromobacterium substugae
gtggactacaagcgcgacggtccgcgccgcaaggagcccgcgccggcaagcggcgacgatggcaagcgccatgtcgcctcgccagaccagggctcgcggctggacggcgcgggtttgggcgaactcaaggtcagctcgcgcttgggcgagcccttgcaggcggagctccggctgctgggcggcgtattcgataagacggaccaggtgcaggtggccattttcgccgatcccgcgcaaggagaggtggcgccggagcaactgcagcaggtggcgtccatcgcgcacaagctggatcgctccagcgatgggcggcatgtgctgcagttggcttccagcttgcccatcacggcgccgcggctggcgttccggctggaggtgagagccgccggcgtcaaggtggagaagcgctatgcgttgatgctggaaggcgcgccgacggcgcaggattccgctgccgaccacgccaagccgccatccgccgccgcgccggaaacccgcgtctaccaagtgcgcaagggcgacagcctgtcggcgatcgccgcgcgcatgcgcggccatgccgccggcgaggacgtggcgggcaagctgttgaaagataatccggacgcgtttatccgcggcgacgccaaccgtttgttggccggggccgagttgcgttacccggcgcaatggacgctgcgcggcgaaccggcccgccatgcggcggagaagggtgacgccgccggcgcggaagccaaatcgggcagcatggcgaaactgctggccgacggccggccggccggcgtggccaaggcggaagaccataagccgatgccatcggtcgcctccgtcaaaccggccgcgtcgtcgccggccgccctggcggcggaacgccggatgcgcgacatgctggcgatgcaggaccgcgcgttgaagcagaccgaggcgcgcgcgcgcgcgctggaagcgcaaatccgcaccatccagcaaaacaaggacaagaccgccgccgccatgacgccgccgatgccccctcaggccaaaccggctgtgccgccgccggctgccgttcagacgccgccggcctccgcggcccggagcgagccgccggccgggatggacaagcccaagccggcggtggtcgtcaccgcggtgaccgcatcggcgccgcgtccggccatgtcgccagccgaatccaagcgggagcaggccaaggcgccgcatgccgccgccagcagcgtggtggacgatgcgctggcggtgctgggcgatagggatgtgcaattgcgcttgggcggcgccggcgcggcgctggcgctggtggcgctgctgctgatgcgcagaaagcgggcgggcgcggcgcaagcggaggcggagaccgcggacgaggtacggcggcggcaaagacgtgccgtcctctatgctgacgctggggccgctgacctcgctgatgagcacgctgaaaaaaggcgacggcatcgatctggattcggtcgatccgatggccgaggccgaggtgtactcgcttatggccgtgatgatcaggttttgctgatcctgcgcgaagggctggagaaggagccggcgcggcaggatctgcgctataagctgctggaagtgctgtcggcgcagccggacaaggcggcgtttcttgaagaggcggcgcgctcgcgcgacatattcggcaaggacagcacccagtggatgagggtgtgcgaattgggccgcgccgcgatgccgggccatcccttgtttgaaaccgcgcaagcgccgcagtcggtggaaatgccggcggtgggcgcactggagcctgtggtcccctccgccgcggcagcggccgaaatcgccatgcctgaggaggcgcgcacgcctttgcccccgactgccgcgcccgccgtcgccgaaaccatgatcgaagccgaacgggagcccgcgccgctgcggggcgcgccagcggcgcccgagcttgaagccgaaccgcgtccggatccggagaagctggagctggccaagctttatatggagatgggcgacaaggaaaccgccgaaatcctgatccgcgaagcgcagcaaggccgctag

SEQ ID NO: 2902 - DNA, 183 bp, Chromobacterium substugae
atgtatcggccccaatcccgcccggactgccgatacgcttcccaagcctgccaacagcaaggccaaactcgccatgcgaaaatttgcgaccatcgtggacgtccccaacctatttgcttacatgttttgccccaggcccggcggatatgcccgccatctcgatccgccctggccccatcttga

SEQ ID NO: 2903 - DNA, 2172 bp, Chromobacterium substugae
ttgggcaggatccatgtccgctccaatcttggcgagttgctgaaagccgacatcgaaatgaccggagtgcagcctggcgaaatggatgccgtcagggtggggctggccagcatcgataccttccaggcgttgaatgtcgattacgcctcctcgctgtcccaattgcgcttcgcgctcagccccaatccgcgcggcgcgctgatccgcgtcagctcggtccagccgatcaccgacccctacctgcgcttcgtggtggaggccaaggcgccgtccggccgctcggtgcgcgaatacacggtgttgctggatccggccaattacaatgtcggcggcccgaacatcgtccaggatgtccccagctacgccgacagcgaccaggccggccgctaccaggcggcggccccggccaagccgcgcgtcgtcgaacccacagtgctgaaagtgaggccgggcgcgaccctgcgttcgctggcgcagagggtgaagccctggggcgcgtcgttgcggcagaccatggcggcgctagtgcaggcgaaccccgacgctttcgccgaaggcgatgtcaatcatccgaaaccgggctcgtcgctgacagtgccgtcggcgcgcaagatgaaggcgttgggcgcggcccaggtcgccagcattctgggcgatgccgccccggccgcggcttcggccggtggccagtcggcggcgccggccggcaagggcggcgacgtgctcaagctggtgccgggcgacgggagcgacaatgcgcggctgaatgacctgcagcagcagatcaacgcccgcgaaaaggccttgcaagaggcgtcggccagaatcacggcgctggaacaggagttgaaggcgatgcggggcggccagccgctgccggccaagcctgtcatggcgtcggcgcccatggcggtcgccagcgttccggcggcggctccggcggcaagcgcgcctaagccgatgcccaagcctgaaccggcgccccatccgctcaagaagccagcccctgcgcacgcggcgccgccgatgccgccgccaaacaaatcgctgctcgacaagttgctggatcatctgccgttgatcggcggcggggtgggcgtggtcgccttgctgggactgctgggcgcggtagtcatgcgcaggcgcgcggcggcgggcagcctgtcggctaccagcgccacgctggcgcgctctacggtcaccgggcatggtcccagcaccgtgggcggcagccattccttcatgagcaacttcacccaggcggcgggcgcgatcgacgcggccgaagtcgacccggtggccgaggccgaggtttatatcgcctatggccgcgaccagcaggccgaggaaatcttgaaggacgcgctgcaaaaggacccgtcccgccatgaagtcaggatgaagctgatggaggtgtacgcggcgcgtccggacacagccgctttcgagcgcctggccaaggaaatgaacgccgctttcgatggcaagggcgggttgtgggccaggacggttacgctggggcgcgcgatcgatccggacaatccgctgtaccagatggcgcccgacgcggagctggatctgtccgcgggccttggcggcggcatcgatctggatcaggagctgttcggcgaagccgcgccggatgcgccgcccgccgccgagtccgcgccggcgatggcggaggaggcggatccgctggccgccttgttcgatacgccggcgggacaagcgcccgccgccgaagaccagggcggcacgctggatttcgacctggaagcgatgctgccggcggaagccgcgcccgttgccgccgaggaaccggcgccggcaggcgaggccagcctgttggatttcgatttcaatctggacgcgccgccgcctgaggaagccaagccggccgcggaaggcgggggcgggctggagtcgttgtacgaggacatgctggccgaagcgccggccgccgaagcgcccccggccgaagagcctcccgcccaggcggagggcatgtcggtgatggacgatccgctgtcgaccaaactggatctggccaaggtttatctggacatgggcgatagagaaggcgcgcgcgaggtattgcaggatttggtgagcgaagctcagggcgcgttgaaggaggaggcgaaagcgttgctggacaagatcagcgtctga

SEQ ID NO: 2904 - DNA, 1011 bp, Chromobacterium substugae
atgtcgacatcccttcagcttgccgtagtgggcgccaccagcctggtgggccaggccattctggaactgctggccgagcgcaacttcccggctgcccgcgtgttcgcggtggatgtcgccgagcaggacggcagcaccgtctccttcggcaacctggagctggacgtgcacatggtggacgaattcaacttcgagaatgtcggcatggccatcttcgccgccggcagcgccgtttcccgcgaatacgcgccgcaggcgcgcgatgccggcgccgcggtggtggacttcagttccgccttccgcgccgacgccggcgtgccgctggtggcgccggcgatcaacgccgccgaactggaggacctgggccgcgcaccgctggtggccgtgcccaattgcaccaccacgccgctggcgctggcgctggcagccttgctgccgctgggcgtccagcgcgccagcatcgccacctaccaggcggtgtccggcagcggccaggcggcgatggaggaaatggccgaccagaccaccgcgttgttctcgcaccgcgacgccgaggtcaaggcctacgataagcgcatcgctttcaacgtgctgccgcagatcggcgagctggacgagaacggcgattcggaagaagagcgctcggtgcgcgacgagaccgcgcgcctgctggggctggcgccggaatctctggaggtgacctgcgcgcgcgtgccggtgttctttggccattcctgggcggttcaagtcgaactgcataaggagtttgatctcgagcaagtgaaaaagcgcctgcaggcggcaggattgaaagtggtgggccgcgatcagcatggcggctacgtgacgccgatggaagccaccggcaacgagctggtctgggtcagccgcctgcgcgcgcacggcaaggtggtgagcatgtggctgtcggccgacaacgtgaaggcgggcgcggccatccattgcgtgcgcatcgccgaaatcctggccggccagagcgcgctgatgtaa

SEQ ID NO: 2905 - DNA, 1113 bp, Chromobacterium substugae
gtgagagtaggctttgtaggttggcgcggcatggtcggttcggtgctgatgcagcgcatgcgcgaggaaaacgacttcgccgccatcgatgaaccggtgttcttcaccacgtccaatgtggggggcaaagcgccggatatcggtcgcgaggtgccggccttgaaggatgccggcaatatcgacgaattgaaggcgatggacgccatcgtcacctgccagggcggcgactacacctccgaagtctatggcaagctgcgcgaagccggctggaagggctattggatagacgcggcgtcctcgctgcgcatgcaggacaacgccatcatcattctcgatccggtcaaccagaacgtgattgagcagggtttggccagcggcgtgaaagactatatcggcggcaactgcaccgtttcgctgatgctgatggcgctgggcggcttgttccagaatgatctggtggagtgggccacgtcgatgacctaccaggcggcttccggggccggcgccaagaacatgcgcgaactgctgaccggcatgggcgccatccatggccaggtgggcgatctgctggccgacccggcctccgccatcctggacatcgaccgcaaggtgtcagatttcctgcgcggcgacggcttccccagccagaatttcggcgtgccgctggccggcagcctgattccgtggatagacaaggatctgggcaatggccagtccaaggaagaatggaagggcggcgcggaaaccaacaagatcctggggcgcggcgcgaatccggtgccggtggacggcttgtgcgtgcgggtgggcgcgatgcgctgccacagccaggcgttgaccatcaaattgaagcaagacgtgccgctggacgagatcgaggcgatgctggccgcggccaatccgtgggcccgcgtggtgccgaacacccgcgaggcgtcgatgcgcgatctgaccccggccgcggtcaccggcacgctgcgcaccccggtgggacgcctgcgcaagatggcgatgggcggcgagtatctatcggcgttcaccgtcggcgatcagctgctgtggggcgccgccgaaccgctgcgccgcatgctgcgtatcctgatcgagcgctga

SEQ ID NO: 2906 - DNA, 1182 bp, Chromobacterium substugae
atgtctgactacgatctgatcatcatcggcgggggcctgatcgggctatccaccgcctacaacgccgtcagcccctatggcggccatccggttctgcaaggcaacaaggtgctggtgctggagcaaagcaccttcttcaaccagttctgcagttcggccggcgcatcgcgccaattccgcttccaatacagcgaaacgtacatgacccagctggtgatggctgcggttccggagtgggagctgccgcaaagccagactgtcacccagccgattccttgcgtcggcagcctgtggtttggcgacccgaacacccccaccaccgaaggcggcatcgccccggcgatcgaaaccatgcaggccatgggagtgcccttccagtcgctgacccgcgcggaggtggaagagtggtacggcttccgcgacctgcccgccaactacagcggttttttccagagagacggcggcgtcatcaatctgccggccacgctgcgggcgatgtacaacctggcgcatgaccagggggtgcagctgaaggaagaacagaaagtcatcgatatcgaatccagcggcgggcagatcaccgtcaccaccgatgccggcgcgtatcgcggcaaaaaactggtcatcaccgccggagccttcaccaacgaagtgatcgcgccgctgggcatccagctgaatctgaccatctggaacatggtatccgcctatttccgcaagacgcgggccgacatcgactaccccacctggttcgccttccagcaacccacagccgccaacgccaatctgtactacggctttccggaaacctcctggtcgcatcccggctatatccgggtggcgccggactacccgtaccagatcatcagcgatccaagggaacgccgccctcccacgccgcaagactacgccggcacttgcgaatgggtggcccagcacatgagcggtctgtcgccggagccggaatacgcatcggcctgcatggtggcgctcgccgacgacggcaaggaattcattctggacaccctgcccggccaccccaacatcgtgctctacaccgcgggctgggccgcgaaactggtgccgctgctgggcaagatctgcgtgcagctggcgatcaacggcgccaccgactacgacatcagtccgttcagcatcggccgtcccggccttgtccgctaa

SEQ ID NO: 2907 - DNA, 1755 bp, Chromobacterium substugae
atgatcacattgaatgacattccccacagcaccggcagccaggccgacctggcagtcgatgtcgccgtggtcggcgcgggcgtgggcggcttgtacaccggctaccgtctgctaggcggcgagtacaagccgggcggcagccggcccaccagcgtgcatgtgttcgacctggccgaccggctgggcggcaggctgctgtcaatcaagctgccgggcatgaacgtgattggagagctgggcggcatgcgctacatgcgctcgcaggaaatggtgaccgccctgatcgaagacgtcttcaagctgcccaaccaggaatttcccatgggcgaaccggacgatctttacttctacctgcgctgccagcgcttcaaggccaacgcctggaccagcgctcaggcgcaaggggagaaattccacgtccgctataccttcaaactgggcgaagaaggctatagcccggaccagttgttcaacaagatagtctacgacgtgctgatggccgacccctggttcgtcgccgaattcggcgacaaggtcaaaaagatcgaccaatacacctacacgttccagctcaccagccgcgaatggaacatcgtcaagccagccctgacatacgttttccccgacagccccttccgcggcatgaaggtcaacgatatcggcttctggaacctgatcaaggaccaggtaggccaggacgcctacagcttcctggccgatggcggcggctactattccaacaccatcaactggaacgccgccgaagccttcccctatatggtgggtgacttttccagcgccgactccagctaccgcaccatcagcgacggctatgatcagatcgcctacgcgctggcgcagtccttcaccgacatgtcaggcgccaagctgtggctgggcaaccgcctggaaaccttcagccgcgcgcaggacggcagcggctaccgctacctgctgaccttctggaatgccgctggccaataccgctggaccgtcaaggccaataacatcgtgctggcgatgccgcgtcgttcgctggagctgctcgaccagcagaattttttcttcaaccgcgaaggcgcgcagcagctgcagaagaacatcgcctccgtcatcatggagccttcgttcaaactgctgatgggctttgaggagccatggtggacagaagacttcggcgcggagtccggccattccatcaccgacctgccgatgcgccagtgctactacttcggcaccgatccggccaacaaccattcgctgttcctgtccagctacaacgacatgcgcaccgtgccgttctggcaggtgctgatgcaaggccgcgacaaactgccccgctacctgggccacaccacccggctggtccgccaggagcatctggaagcgctggccaaagagccaggcgagccagcgcccatcgcgatggtggaagaagcgatgaaccaggtgcgcgaactccacggcaagggcaacgagattccgccgccctatgtcgcccgcctgcaggactggacccaagacccgtacggcggcggctaccacgcctggtgcgccgacgtgtcggtgcagaacatcatgccctatatgcgtcggcccgatcacggcgagaacatccacatcaccggcgaggcctattccgacgaccaaggctgggtggaaggcgcgctttgcgtgaccgagctgatgctgcaggagtggttcgacatggcctggccggcctggctgaaccgagactactacctgggctggtga

SEQ ID NO: 2908 - DNA, 117 bp, Chromobacterium substugae
ttgcgctttcacgagccgctgatcgtccaccgcgtcgacgatgatgcctatgtcagcgacgactatggtcgggacaatgccgggcaaacgcgcgtgttgattcaagccgcgaattga

SEQ ID NO: 2909 - DNA, 1065 bp, Chromobacterium substugae
atgaaaatcgccattctgccgggtgacggcatcgggccggaaatcatcgcgcaggccgagcgcgtgctggacgtattgcgccgcgacgggctgaagatcgaaaccgagcacgcgcccttgggcggcgccgcttacgaccagtacggcgcgccgtatccggaagccacgcagaaactggcgcgcgaggccgacgcggtgcttttgggcgcggtgggcggcccgcaatacgacaagctggagcgtccgctgcggccggaacgcggcctgttggccatccgcaaggatctgggcctgttcgccaacctgcgcccggccatcctgtatccggagctggccaacgcgtccacgctgaagcccgaggtggtggcggggctggacatcatgatcgtgcgcgaactgaccggcgacatctacttcggccagccgcgcggcatcgccgtcaacgagctgggcgagcgcgaggcttacaacaccatgcgctacagcgagagcgaagtgcgccgcatcgcccatgtcgccttcggcatcgcgatgaagcggggcaagaagctgtgttcggtggacaaggccaatgtgctggagaccaccgagttctggaaggagatcatgatagacgtggcgcgcgagtatccgcaggtggagctgtcgcacatgtatgtcgacaacgccgcgatgcagctggtgcgcaacccgaagcaattcgacgtgatggtcaccggcaatatcttcggcgacatcctgtccgacgaggcctcgatgctgaccggctccatcggcatgctgccgtcggcgtcgctggatcagaacaacaagggcctgtacgagcccagccacggctcggcgccggacatcgccgggcagaacctggccaatccgctggccaccatcctgtccgccgccatgatgctgcgctacagcttcggccaggagaccgccgcgcagcgcgtggaaaccgcagtgaagaaggtgttggcccagggttaccgcactggcgacatctacgaggccggttgcgagaaggtcagctgctccggcatgggcgacgcggtggtggcggcgatgtaa

SEQ ID NO: 2910 - DNA, 282 bp, Chromobacterium substugae
atggcctggctgcatcgccatccgctggcggctttcctgctgctgggcctgagttttttgctgttcggcgtgggcaccatcaacctggccctgctgctgcagctgaatttgaaattatggctggacgcgggctggcaggcggcaatggatggcgcgctgcgccagttgggagagctgctgctgtccggctacgccgcgatggcggcctacatcgtgttcaagtgttgcgaaaaggcgctggtggaacgtttgacctggcgcgaagaagacaaacggaaataa

SEQ ID NO: 2911 - DNA, 582 bp, Chromobacterium substugae
atgggacagcgttatctggagcttaaggattcgcatcgcgagtttattgccgggcagaaactgtttttcgtcgctaccgccatgcaggatgggcgcgtcaacatgtcgcccaagggaatggattcgctgcgggtgctggggccgaatcaagtggcctggctgaacgtcaccggcagcggcaacgagacggcctgccatgtcgaacacagcccgcgcatgactttgatgttctgcgcgttcgaaggcaagccgctgattttgcgcctgtatgggcaggcgcgggcgattcatcagggcgacccggaatgggccgattattacggcctgttcgaacccttgcccggtgcgcggcagatctttttgctggacgtggggctggcgcagtcctcttgcggcatgtcggttccttactaccaataccagggcgagcgggagcagttgaacgactgggcccggaccaaaggcgaggcgggggtgcaagactactggcgcagccggaatgtgtcgagcctggatgggctgccgaccggcattgtggaaaagagcggactggcaagcgccgatgaaacccgtcagcagtga

SEQ ID NO: 2912 - DNA, 639 bp, Chromobacterium substugae
atgaaagcattcaccactttgcagggcctggcctgtccgctggaccgcgccaacgtcgataccgacgccatcattcccaagcagttcctgaagtcgatcaagcggtcgggctttggtcccaatctgttcgacgaatggcgctacctcgaccatggcgaacccggcatggacaacagcaagcggccgctcaatccggacttcgtgctgaaccagccgcgctatcagggcgcgcaggtgctgttggcgcgggaaaacttcggctgcggctccagccgcgagcacgcgccatgggcgctggatgaccagggttttcgggtggtgatcgcgcccagctttgccgacatcttcttcaacaactgctacaagaacggcctgttgcccatcgtgctggacgccggcaccgtcgaccagctgttccgcgagtgcgaggcggcgccgggctacagcctgacggtggacctggcggcgcaaaccgtgtccaccccgtccggccaggccttcccgttcgacatcaccgagcaccgcaagcactgcctgttgggcgggctggacgaaatcggcctgaccttgcggcacgcggacgaaatcaaggctttcgaagccaagcgccgcgccgagcagccctggttgttcgcctga

SEQ ID NO: 2913 - DNA, 186 bp, Chromobacterium substugae
atgaaaaaagagattgtctggatcggcctggccttgctgctggcggcgtgcaacaccgtgcagggcatcaagaccgacgccaaggaaggcggccaggcggtgggccacggcctgcagaaggcgggccaggcaatcggcaacgcggtggaaaaaggcggcgaggcgatcaagcgcaccgccgagtaa

SEQ ID NO: 2914 - DNA, 1416 bp, Chromobacterium substugae
atgaccgcgcaaaccttgtacgacaaactgtggaacagccacctggtgcgccaggaggccgacggcaccgcgctgctgtatatcgaccgccacctggtgcacgaagtgaccagcccgcaggccttcgaaggcctgaaactggctggccgccagctgtggcgggtggattcggtggtttccaccgccgatcacaataccccgaccgaccattgggatcagggcatccaggacccgatctcgcgccagcaggtggaaactctggacgccaacatccaggcctttggcgcgctggcctacttcccgttcaaggacaagggccagggcatcgtccacgtgatggggccggagcaaggcgccacgctgccggggatgaccgtggtgtgcggcgacagccacacctccactcacggcgctttcggcgcgctggcgcacggcatcggcacttccgaggtggagcacgtgatggccacgcagtgcctggtcgccaagaagtccaagaacatgctggtgcgggtggacggcaagctgggcgcgggcgtcaccgccaaggacgtggcgctggcgatcatcggcaagatcggcaccgccggcggcaccggctacgcgatagagttcggcggcgaggcgatccgcggcctgagcatggaaggccgcatgacgctgtgcaatatggcgatcgagggcggcgcgcgctccggcctggtggcggtggacgacaagaccatcgaatacgtcaaaggccggccgtacgcgcccaagggtgaacagtgggaaccggcggtggcctactggcgcaccctgcattccgacgccggcgcgcatttcgacgcggtggtggagctggacggcgcggctatccagccgcaagtgacctggggcacttcgccggaaatggtggtggaggtggggggcaaggtgccgaacccggcccgcgagagcgacccggtgaagaaagccggcatcgagcgcgcgctggcctatatgggcttgcaggccgacaccccgattgatcagattccggtggacgtggtgttcatcggctcctgtaccaacagccgcatcgaggacctgcgcgaggccgccgcggtggccaagggccgcagcaaggccgccaacgtcaagcaggtgctggtggtgccgggatccggcctggtgaaggcgcaggccgaagccgagggcttggataaggtgttcgccgccgccggcttcgaatggcgcgagccgggttgctcgatgtgcctggcgatgaacgccgaccgcctgctgccgggcgagcgctgcgcctccacttccaaccgcaatttcgaaggccggcagggccagggcgggcgcacccatctggtgagcccggcgatggcggcggcggcggcggtggcggggcatttcgtcgacgtgcgccagtggtccgtccgataa

SEQ ID NO: 2915 - DNA, 777 bp, Chromobacterium substugae
atggaatccccgtccgccaccccgctcggcgccttcctgcgcgcccaccgcgaacggctgacgccgcagcaggccggcctgccgacgggaacgcgccgccgcgccaagggcctgcgccgcgaagaggtggcgcaattggccggcatcagccccacctggctgacctggctggagcaagggcgcaccgagtcggtatcagcccataccctcacccggctggcggccgcattgcagctgtccggcgcggaaaccgactatctgtttgatctggccgggctgaaaaaccccaaggacaagcgcgccgaagacaatccgcaggcgcgggacattctggccgaaatgctgccgcacatcgccatcccggcttatgtgttggaccgccactggcgggcggcggcctggaaccccgcggccgcggagctgttttgcggctggctgggcaagccggaggccagccgcagccagctcgacttcattttcctggcgcccgaagcgcggaccttcctcgacaactggccggagagggcgcggcgcatcgtggcggaattgcgggccgacctgggccagcagctggatgacgcggaaaccgcggacatgctggagcggctgcgccgcgacagcgcggagttcgaccgcctatggcaacagcaggatgtattggagcgcgaaggcggcgagcgcgccttccatcaccccacgctgggccagctcaacaagcggcagatcacgctcaggccggccaacgcgccggagttcaagctggtgatgctgctatga

SEQ ID NO: 2916 - DNA, 378 bp, Chromobacterium substugae
atggccatgacgccgcagcaggcgctggacagctaccagcaggctttggcgacgcatgactggcgccaggtggcgccgtggctgcatgaagacgcttgcttcgtgttttccgatggcaccttcaagggcaaggcggccgtgtgcgaggccatccgtcaaacttttgactggatacgcggcgaggattaccgcatcgcggatctgcactggactcatgcgggagagaatttcgccgcctgcgtctatgcgttttcctggcgcgggctggtcgatgggcagcccgcggaggggcgaggccgcggcagctgcgcgctgatcaaggatgggcagggctggcggctgctgcaggagcatctggggccgccagccgagtcatag

SEQ ID NO: 2917 - DNA, 1149 bp, Chromobacterium substugae
atgcagtcgttgttgccgttcgccgggttctacttcacctatttcaccttccagggcatgttcagcccgttctggggcctgtatctggagtcgctgtcgttcagcgcgctgcagatttcggtgctgatggcgctatccacgctggcgcgcatcatcgccccgggcttctggggctggctggccgacaagagcggacaacgccgcaacatcatcgtcaccacttccatcctgtccgccgccagcttttgcctggtggggctgcacaacggcttctggtggattttcgtcagcatggcggtgtcgcatttcttttgggcggcggcgctgccgctggtggaggccagcaccgcctacctgacgcgggcgcagcccggccgctacagccgggtgcgggtgtgggggtcgataggcttcgtctgtttggcgctgaccggcggctatctgctggactggctgggcatcgcggcgacgccgtggattgtctccgccttgctgataggcgtggcgctgacggcgctcaaggtgccggaggtgaagctggccagccgcggcaagccagccgggccgatctgggacacgctgaaaaagccggcggtgatcgcgctgttcgcctgctgtttcctgcaggccttcgcccatggcccgtattacactttctattctttgggcctgaagcagtttggctatgacaaggccgcggtcggcgtgctgtgggcgctgggggtggtgttcgaggtgggcgtgttcatgctgatgccgcgcatcatgcgccgcttcagcctggaggctttgatgctggcatcgctgctggcggcggtgctgcgcttcggcctgatcgccgccggcctgtcgctgccggccttggctgcggcggcgcaagcgctgcacgcgctcacctatgccttgcaccacgcgtcggcgataggcctgatcaatcgcatgttcgacgagcagcaccatggccgcgcgcaagggctgtacatcatcgcctcgttcggcctgggcggcagcggcggcgggctggtgggcgggctggtgtggccgcacggcggcgtgctgcccaccttcgccatgtccgccggcgcggcgctggccggcgttttcgtctgcctgcgctggctcaggcccaagcgacaggcatgccaatga

SEQ ID NO: 2918 - DNA, 405 bp, Chromobacterium substugae
atggcgcggccggaagagcaggacgacggcaaggtccgcctggacaaatggctgtgggcggcgcgcttcttcaagacgcgccagctggcgcacgaggcgctggagctgggccgggtgctggtgaacggcgaccgggtcaaggcgtcgcgtgtagttaaggaaggcgaccggctgtttttgcggatcaaccagctggagtacaacgtggaagtgctgcagctcgccacccagcgccggccggcgaaggaggcggtgttgatgtaccgcgaagatgcggagtcggtggctgcccgcgaagcgcgcatgctgctgctgaaggccgagcatgccagctttccgcatggcgacggccgccccaccaagaaagcgcggcgcgacatctcccgcttcaagtcgtcgttttag

SEQ ID NO: 2919 - DNA, 651 bp, Chromobacterium substugae
atggcgagtgtaaaactggctttacataccatccgcgttgaaaacatcttttgcatcggccgcaattacgccgcccacgcggccgaattgggaaacccggtggaaagcgagccgctggtgttcctcaaaccgacttcggccttgctggacgaatcctctcccattcatttgccggaatattccgacgacgtgcatcacgagtgcgaactggtggtgctgataggcaagggcggcggcgacatcgcgcccgaacaggcgctgagccatgtcgccggctacggcgtcgggctggacctgaccgcccgcgacgcgcaaagcgcggccaagagcaagggccacccgtggaccaaggcaaagggctttcgcggcgcggcctgcttgtcggcgctggtgccggcggagcgggtggccgatccgcagcggctgcaattcgaactgcgggtgaacggccagctgcgtcaggcgggcgacaccggcatgatgctgttcactgtggcgcagcagatcagctacctgtcgcgcacgtatggcctgagcgcaggcgacctgatctacaccggcacgccggaaggcgtggcgcgcatccgctccggcgacgagctggatctcagcctgcacggccaggtgtccgcgcactggaaggtggcgtga

SEQ ID NO: 2920 - DNA, 1764 bp, Chromobacterium substugae
ttgtcccagaataataccgctacgctggaagatttcttcaccggcctctccgaagccaaccagcaatggatgcagcagttcgtcaattccctgtcgctgggcgcgagcccggacagcgccgcccacccgctggccggcgcctggtcgcagctgatgaatcagaccaatcagctgttcagcctgcagtccgccctgtaccagcaacagctgaacctgtggtcgcagtttctgggcaaggcggcggacaccgcgccggaggccaaggccggcgaccgccgcttcgcctcgccggaatggaacgaacacccgttctacagctttctcaagcaaagctacctgctgacctccaagtggatgaccgagctggtcgaccagacccagatcgacgaaaacgccaaggacaagctggccttcgccacccgccagtacctggacgcgatggcgcccagcaacttcatgctgaccaaccccgacgtggtcaagcgcgccatcgaaaccaagggcgaaagcctggtggaaggcatgaagaacatgatggaggacatccagaagggccacatctcgatgtccgacgagagcaagttcgagatcggcgaaaacctggtgatcacccccggccaggtcgtgttccgcaatgagctgatcgagctgatccagtacacccccaccaccgaaaaagtctacgagaagccactgctgttcatcccgccctgcatcaacaagttctacctgatggacctgcagccggacaactccatggtgcgccacttcgtcgcccagggctaccgcgtcttcctggtgagctggcgctcggccgtggccgagatgaagcatttcacctgggaaacctatgtcgagaaaggcgtgatcgccgcggcggaagcggtgcgcaaaatcaccaagcagccgacgatgaacgcgctgggcttctgcgtcggcggcgtcatcctcagcaccgcgctgtgcgtgatgcaggccaaggggctcgactacatcgactccgccaccttcatgacctcgctgatcgaccacgccgagccgggcgagatcgcgtactacatcgatgaaagcctggtggccagccgcgaggccaagctggccgccggcggcatcatcagcggcaaggaaatcggccgcaccttcgcctcgctgcgcgccaacgacctggtgtggaactacgtggtcaacaactacctgctgggcaagacgcccacgccgttcgacctcttgtactggaacaacgacgcggtggacctgccgctgccgatgcacactttcatgctgcgccagttctatctgaacaacgcgctggtgaagccgggcgccatcaccctgtgcggcgtgccgatcgacatctcgaaaatcaatatcccggtctacatgttcgccgcgcgcgaagaccacatcgtgctgtggagctcggcctactccggcctgaaatacctgagcggcgcgccgagccgccgcttcgtgctgggcgcgtccggccacatcgccggctcgatcaaccctgtcaccaaggacaaacgcaactactgggtcaacgaacaattgcccatcagctccgacgaatggctggaaggcgcgcaaagccagccgggcagttggtggaaagattgggatgcctggctggcgccgcagtccggcaagcaagtcgccgcgcccaaggctctgggcaacaaggaattgccgccgctcttggccgcgccgggcagctatgtgctggccaaggcgatgccgagcgtgaccgccagcctgcaataa

SEQ ID NO: 2921 - DNA, 1179 bp, Chromobacterium substugae
atggaagtcgcaatcgtagcagcgcaacgcaccgcggtcggcagtttcggcggctcgctggccaagatcccggccccggaactgggcgcaaccgtgatcaaagcgctgctggagaaaaccggcgtcaaaccggaagacgtcagcgaagtgatcctgggccaggtgctgaccgccggcagcggccagaacccggcgcgccaggcgctgatcaaggccggcctgccggtcaccaccccggccaccacgctgaacgtggtatgcggctccggcctgcgcgccgtgcacctggcggcccaggccatcctggccggcgacgccgaaatcgtcatcgccggcggccaggaaagcatgtcgctgtcgccgcacatcctgccgggctcccgcgacggtttccgcatgggcaacgcccagctggtggacaccatggtcaacgacggcctgaccgacgcctacaacgcctaccatatgggcatcaccgccgagaacgtggccgccaagtacggcatcggccgcgaagagcaggacgccttcgcgctgcaatcgcagcagcgcgccgccgccgcgcagaaagccggcaagttccagaacgagatcgtcccggtgctggtgccgcagcgcaagggcgacccgctggccttcgacgccgacgagttcatcaagcatgacgccagcgcggaaggcctggccaagctgcgcgccgccttcaagaaagacggcaccgtcaccgccggcaacgcctccggcatcaacgacggcgccgcggccgtgctcttgatgtccacccaaaaggccgaccagctgggcctgaagccgctggccatcgtcaagggctacgcgctgaccggctgcgaaccggaaatcatgggcatcggcccggtatctgccacccgcaaggcgctggccaaggcgggctggaccgtcgagcaactggacctggtggaagccaacgaagccttcgccgcccaggcgctgggcgtggccaaagagctgggctggggttcggacaaggtcaacgtcaacggcggcgccatcgcgctgggccacccgatcggcgcctccggctgccgcgtgctggtgaccctgctgcacgaaatgcagcgccgcggcgccaagaagggcctggccacgctgtgcataggcggcggcatgggcgtggcgctggcggtagagcgtccgtaa

SEQ ID NO: 2922 - DNA, 552 bp, Chromobacterium substugae
atgaaagtaatcgatacgagcattccggatgtgaaaatcatcgagccgacggtcttcggcgatgagcggggcttttttttcgaaagcttcaatctgaagcggtttgaggaaggcataggccgcgcggtggatttcgtgcaggacaaccacagcaagtccgccaagggcgtgctgcgcggcctgcattatcaattgccgccttacgcccaaggcaagctggtgcgggtggtggcgggcgaggtttacgacgtggcggtggacatccgcaagtcctctcccaccttcggccagtgggtgggcgtggtgctgagcgccgagaacaagcggcagttctggattcccgaaggcttcgcccacggtttcctgacgcttagcgacgaggcggagttcgtgtacaaggccaccaactactacatgccgcaatacgaccgcggcatcttgtggtccgacgcgtcgctcggcatcgactggcccgcggcgggagagcttaacctgtcggccaaggacaaggcccagcctctgctaggcgcggcggaagtgttcctgtcctga

SEQ ID NO: 2923 - DNA, 888 bp, Chromobacterium substugae
atgacccaagcacgtaaaggcatcattctggcaggcggttccggcacccgcctgtatccggccaccctggcggtcagcaagcaattgctgcctatctacgacaagccgatgatctactatcccttgtccaccctgatgctggccggcatccgcgacatcctcatcatctcgacgccgcaggacacgccgcgcttccaattgctgctgggcgacggcagccgctgggggctcaatctgcaatatgaggtgcagcccagtccggatggcctggcgcaggccttcatcatcggcgaggcgttcctggcgggcgcgccgtcggcgctggtgctgggcgacaacatcttctacggccatgatttcgccaaattgctgaccgaggccagcagccagaccgcgggcgcgtcggtgttcgcctaccatgtgcaggacccggagcgctacggggtggtggagttcgacgccgccggcgtggcgcgttccatcgaggaaaagcctgcgctgcccaagtcgaattatgcggtgaccggcctgtatttttacgattcgcaggtggtggagatcgccaagtccatccagccctcggcgcgcggcgaattggaaatcaccgacgtcaacaatgtttacctgcagcaaggcttgctgaacgtgcaaaccatgggccgcggctacgcctggctggataccggaacgcacgaatccttgctggatgccagccagtacatcgccaccatcgagcggcggcagggcctgaaagtggcctgtctggaggagatcgcctaccgttcgggctggatagacgacgaacagatcgtgcgcctggccacgccgctgaaaaagaatggctacggccagtacctgctggccatgataggcgcgaaaaattcttga

SEQ ID NO: 2924 - DNA, 906 bp, Chromobacterium substugae
gtgttgctgactggggcggatggccaggtgggatttgaattgcgccgggcgctggctccgcttggcgaggtgacggcctgcggtcgcgcgcggatggatctggccgacgaggccgccattctcgccgtcctggacgccgccaagcccgatatcatcgtcaatcccgccgcctataccgcggtggacaaggcggaaaccgatcgggatgccgccttcgccgtcaatgccgccgcgcctggggtgctggcgcgctgggccgccgccaatggcgcgctgctgatccattattctaccgactacgtgtttgccggggacaagccggcgccgtaccgcgaagacgacgaaaccggcccgcagtcggtgtacggcgccagcaaattggctggagagcaggcggtgcgcgccgccggggcgcgccatttgatcctgcgcacctcgtgggtgttcggcgcgcatggcggcaactttctgaaaaccatgctgcggctggcgcaagagcgcgatgcgctgaaggtggtgggcgaccagttcggcgcgccgacctgcgccgccttgatcgccgacgtgacggcgcagctgattgcccgttatcatgcgcggcccgaaaatttcgcggatggcacttaccacctggcggcgcagggcgaaaccagctggcacggctatgcccagcgcgtgatccgccgggccggggagcggggattcccgctgcggctgacggcggacgctatccaggcgataggcagcgaccaatacccgttgccggccaaacggccggctaattcccggttggattgcggcaaactgatgcgcgccttctccctggggctgcccaggtgggaggatggcgtggatggcgtggtcgatcagctttacgcgttgtcgcaagccgaaggggccgtctga

SEQ ID NO: 2925 - DNA, 1068 bp, Chromobacterium substugae
atgacaattattgtgacgggcggcgcgggcttcatcggcgccaactttgttctcgactggttggccggcagcgatgagcaggttgtcaatctggatgcgctgacctacgcgggcaatctcgaaactctggcatcgctgaagcatgaccgccggcatgtgtttgcgcacggcgatatcggcgatcgggcgttggtggaccggttgctgagcgagcatcagccgcgcgcggtgatcaatttcgccgcggaaagccatgtcgatcgttccatccatggccctggcgatttcatccataccaatgtggtcggcactttcaatctgctggagagcgtgcgcggctactggaacggcctgccggaagctgccgccaaggccttccgcttcttgcacgtctccaccgacgaagtctatggcacgttgtccgaacaggagccgccgtttgcggaaacccggcgctacgaacccaacagcccgtattcggcgagcaaggccgccagcgaccacctggtgcgcgcctggcaccatacgtatggcttgccggtgctgaccaccaattgcagcaataattacggcccctatcatttccccgaaaaactgatcccgctggtcatcctcaatgcgttggcgggcaaggcgctgccgatctatggcgatggcttgcaggtgcgggactggctgtacgtgaaagaccattgcagcgcgatccgccgggtgctggaggccggcaggcccggcgaaacctacaatgtcggcggctggaacgaaaaacccaatatcgacgtggtgcggaccatctgcgcgatcctggatgaaatgcggcccaaagtcggcggcggctcctatgccgatcagatcagccatgtgcaggatcgtcccggccatgaccgccgctacgcgatcgatgcgcgcaaactggaaaaggagctgggctggaaaccggcggagacgtttgagaccggcatccgtaaaactgtgcgctggtatctggataatcaggactgggtggcaaacgtaagcagcggcgcttatcgcgaatggttggccaagcaatacgaggctcaagcatga

SEQ ID NO: 2926 - DNA, 129 bp, Chromobacterium substugae
ttgcccgcgaaccgcattatccatgcaagcgcgccgcttgactccgcccagtcggggaatggccggcgcccgacgagcctcgtcgaatgcgcggtttggcgcgcgcgccccaagtatgccatttcctga

SEQ ID NO: 2927 - DNA, 459 bp, Chromobacterium substugae
atgtctgcgaattggatagggataggcgcgctggcgaaacgttcgggcgtggcggccagcgccttgcgcttttacgaggcgaaaggcttgattcaaagtgtgggagaggcggggcagcccaggcgtttccacaaggatgtcctgcgtcgggtctccttcatccgcattgcccagacgctgggtttgagcctgcaggacatcggcgaggcgctggcggggctgccgcggcagcggacgcccaccgcggaagactgggcgcgtttgtcctcggcctggcggcctatgctgcaagcccgcatcgatacgttgtgccaattgcgtgatcaattggacagttgcataggctgcggctgcctatcgctgcgaaagtgcaaattgaataatcccgccgaccacgcggcccgtttgggcgatggcccccgtttcctgctgggcgatgcgcctgttgacacggcttga

SEQ ID NO: 2928 - DNA, 594 bp, Chromobacterium substugae
atggcccacactttgattgtctatttctcagccgaaggcagcacccaccaactggcatgcgcgatacgcgacggcgccgcggcatacggcggcgccagcctgctgcggctggagccgcggcacatcgtcgacggccgctacgcgccgcccgcgatggccgcatcggccgaatcgctgcggcgagcggatgccgtcatcttcggcagccccacctatatgggcggccccgccgctcagttcaaggcgttcgccgacgctggcagcgcatattggcgcggccagccctggaccgacaaggtcgcggccggcttcaccatcggcagcagcctgaacggcgaccaacaaggcacgctgtcctatttcgcaacgctggccgcccaacacggcatgctatggtgtggcttggaccttcccggcggcaaacatatagacgatctcaaccgcctgggctgccaactgggcctgtgcgcccactccgcggatggttcgctgcaccccgccgacctggccaccgcccgccatcttggcgcgcgggcggcccgcgtcgccgatcgcctccgccgcaacgccttgcttgaagagaacgcgccatga

SEQ ID NO: 2929 - DNA, 408 bp, Chromobacterium substugae
atgacgcctgccatccaacggatagaccacatccatgtccatgtgagcgaccgcgagcaggcggaagcctggtatcgacgcgtgctcggtttcgagcgcattccggaactggcgttctgggacgccgacggcggcccgctcaccctggccaaccgcgagcgcacagtgaagatcgcgctgttcgagcgcggcggcgccggcaaacagcccgccgtggcgcttgaggtcgaagccgacgccttccaggcctggcgccgccacttgaagcaggcgctgggtcatgcgccggagctggccgaccacgccgtttcctggtcgatctactttgccgaccccgatggcaacggctacgaaatcacctgcaacgactacgccgcgctggcgcaaagattgcgggcctgcccctga

SEQ ID NO: 2930 - DNA, 129 bp, Chromobacterium substugae
atgagcaaatcaagacacagcaccaaggaagccaagaaacaacccctgatgtcgccgaaggagaaacgcgcggccaagcatcagaaaaagcacgcgccggatggcacccccatcattgttccccactag

SEQ ID NO: 2931 - DNA, 1809 bp, Chromobacterium substugae
atgaacaccctcgcaaccccgcagctggacaccgttccgcaacgcatcgcctccttgcgcgccgccatgcgcaacgccggcgtcgacgcctgcctggtgccctcgtccgacccccatctttctgaatacctgcccaagcgctggcaggcgcgccgctggctgtcgggcttcactggttcgatgggcacgctgatcgtcaccgccgacttagccggggtctgggccgacggccgctactgggtgcaggcggaacaggagctggccggcagcggcgtgcaactgatgaagatagacacggccgccagcagccagcatctgcaatggctggccgacacgctgcaagccggccagacgctggcggtggacggcgacgtgctgggcctggccgccgccaaggcgctgcaagccgcgctggcgccgcgcggcatccagctgcgcaccgatatcgacctgatcgacgccgtcgatccgcagcgcgcgccgctgccggacgccgccgtctaccagcatgaggccgccttcgcgccgcaaagccgcgccgacaagctggcccgcgtccgcgaagccatgcgccaggccggcgccgagcgccacttcatttccacgctggacgacatcgcctggctgttcaacctgcgcggcgccgacgtcaattacaacccggtgttcatcagccacgcgctgatcgaagccgaccgcgccacgctgttcgtcgcgccgggcaaggtagacgcagccctcgccgcccagttggcggccgacggcgtccgcgtcgccgattacgccgcagccaaaccagcgctcgccgcgctggccggcggcgcgctgctgatcgacccccgccgcgtcacgctgggcctgcgccaggcggtggcggacggcgtcaaggtgatcgaggcgatcaaccccagcacgctgatgaaatcgcagaaaaccgccgccgaagccgcccatgtgcgcaaagccatggagcaggacggcgccgcgctgtgcgagttcttcgcctggttcgaagccaacgtcaaccagagccgcatcaccgagctgaccatagacgaagagatcaccgccgcgcgcgcgcgccggcccggcttcgtttcgcccagcttcggcaccatcgccggcttcaacgccaatggcgcgctgccgcactaccacgccaccccggaagcgcacagcgagatcaaaggcgacggcctgctgctgatcgactccggaggccagtacctgggcggcaccaccgacatcacccgcgtagtggcagtcggcgcgccgtccgccgcgcagaagcgcgacttcaccctggtgctgaagggcacgatggcgctgtcgatggcccacttcccgcgcggcacgctgtcgccgatgctggacgcgctggcgcgcgcgccgctgtggcagcacgatatcgacttcggccacggcaccggccacggcgtcggctatttcctcaatgtgcacgaaggccctcagagcatttcgcgcgcggtgccggagccgcatatggcgatgtgggaaggcatgatcacctcgatcgagccgggcgtgtaccgcgatggccagtggggcgtgcgcatcgaaaacctggtgctgaacgtggcgtcggaaaagaaccagttcggcgacttcctgaaattcgaaacgctgacgctgtgcccgatagaccgccgctgcatcgagcgctcgctgctgacccagccggaaatcgactggctgaacggctaccacgccgaagtgcgcgcgcggctgctgccgctggtggacggcgcggcgcgcgactggctgctggccaacaccgaagcgctgtaa

SEQ ID NO: 2932 - DNA, 942 bp, Chromobacterium substugae
gtgggcatggcctgttttgttttccagaaagcccctatgccgtttgaccgactcaacgacctgcgcctgtttctcgacgctgcccagctgggcagcttttccgccgccggccgcaagcacggcctgtctccggccgccgccagcgcctgcatccagcggatggaagccgcgctgaacgtccggctgttccagcgcaccacccggcagctgaaactgaccgaagccggcgacacctaccgcgcctattgccggcaggcgctggagctgctggaagaaggggaaagccggctgcagcaggaacagcaggcgctgagcggcgcgatccggctgtcggcgccgtccgacctgggccgcaatcggctgctggattgcctggaccgcttcggcgcggaacatccgggcgtgtatttttcgctgtcgctcgacgacaccccggtagacctgataggcgaagacgtggacctggcgatacgctacggcaagccggccgacagcagcctggtggcgcgcgagctggccgccagccgccgcgtggtctgcgccgcgccaggcctgctcgcgcgactgggcgcgccggcccatccgcggcaactggctggcctccccaccctcaccctcgccaccgggcacgggccgatgaacgaatggcgctaccgcgagcgcggcgaagcccgctccctgcggctggagcgcgcgcgccagagcaacgatggcgaggtcatccgccgctgggcggtgcaaggccacggcttcgcctacaagtcgcagctggacatcgagccggacctgcgcgccggccggctggcgactgtgctggacgactacttcaccgaacaggcgccgctgcacctgctctacccaggccagcggctgcagccggcgcgcatccgccggctgatagaccatctgctggaaacatttgccggcaccacgcaaaaatga

SEQ ID NO: 2933 - DNA, 402 bp, Chromobacterium substugae
atgacgccatcgtttctcgctacgggcaatctgctgccgctgctgcagcagatggaacagaccttgcaccagcccgccgcccgcgccgacgccgcgctgctggaacgctggctggacgacgacttccgcgaaatcggccgctccggccgccaatacgacaaagccgccatcatcgccgcgctgctgcgcgaaaatcccgatgcctccgccgcgacccactcgtccgattaccggctgaccctgctggccgaagacatcgcattgctcacctaccactcggcccatgccgggccggacggcgcgctgagcgggcacgcgctgcgcagttcgatctggaaacgggtgaacggcgcctggcggctggccttccatcagggcaccccggcgccctcaagttattga

SEQ ID NO: 2934 - DNA, 303 bp, Chromobacterium substugae
atgaccgtctggatcgccatggcgatcggcggcctcgccttctccgcgctatgccgcgacgcgagactgaaaagaaaagtctcgcggatcgtgatgatcgccgcgccattgctgttctgcctgttcgcttggcatcagggcgcgcaagcgagcgaattcgccatcttcctcccgtttctggcgctgatcaccttcctcaatctgcgcaacacccgcttctgcgacgcctgcggcgccacccaacacaaccgcggcttctcccgtccgcgccattgctcgcaatgcggcgcctccttgccctga

SEQ ID NO: 2935 - DNA, 651 bp, Chromobacterium substugae
atgagcgatggcgatatccagggccggatgttcgatgaattcgccgagctggcgcgcacggtcggcaatgcccaccgcctgctgctgctggagcatgcagcccagggcgagcggccggtggagcggctggcgcaactggcgggattgacggtggccaatgcttcgcagcacttgcagcagctgaagcgggcaggcctggtggcgtcgcggcgcgatggcaagcatgtgctttaccggctgggcgacggcccggtggtcaatctgctggatgccttgcggcagtgcgcggaacatcggcgccgcgaaatgggccgcttgtccgccggagcggatggcgcggaggcagtatcgcgcgaggcgttgctggagaggctgcgcgatggcgacgcgctgctgctggacgtgcggccggccgacgaatacgcgcaaggccatctgcccggcgcgctgaacatcccgctggagatgctgccgcagcgcttggccgaactgccggccgggctggaagtcatcgcctattgccgcgggccgttttgcgcgctttccgtccaggcggtggcggccttgcgggcaggcgggctggccgcgaggcgtttggcggatggttttcccgactggaaggcggccggcctgccggtggaaatgtcgtga

SEQ ID NO: 2936 - DNA, 504 bp, Chromobacterium substugae
atggatatcggactggaatcgctgcgttgggccgtgccgatcggcatcggcgccactttgctgatggatggctgggcctggctgcaaaaccgcctgctggccacgccctcgctagactacgcgctggtcggccgctggattggccatctggcacgcggcaagctcagccatcccagcatcgccaaggcggcgccgatacgcggcgaagcctggctgggctggagcgcgcactacctgataggcatcctcttcgccgcgctgctgctggccgttgccggcccggagtgggcgcgccgccccaccctggcgcccgccttgctgaccggcgcgctgacgctggccgcccccttcctcatcctgcagccaggcatgggcgccgggctggccgcccgcaacacgccgcagccgaatgccgcccgtctgcgcagcctgtcggcccacatgtccttcggcatcggcctgtacgcgtcggccggcatgctctgcgcgctggcgccgttttga

SEQ ID NO: 2937 - DNA, 1353 bp, Chromobacterium substugae
atgccaatcgtcgattccgagcagactgcttctcaatacagccaggacagaacaagaatgaaaaacatgtttttgctgggactgagcctagcctcagccccaatcgccagcctcgccgccgcgcaagccgaaccgcaaaccgccgaacagcaggttgaccgctacggcagccagatattccgcgacagccgggccgtcggcatggtgatggtggtggtcgacaagaaacaaaccctgcagcgcttctacggccagacccgtcccggcagccgccagaaacccgatgccgattcgctgctgcgcatcgccagcatcagcaaaaccatgaccggtgaagtgctgtcgtcattggcgctggaaaaccgcgtcaagctggacgacccgctgcaaaaatacgctccccaaggcatggcgctgccgcaagccggccaatccatcaccctgctcaacctggccacccataccagcggctttccgcgcgagatgccgggcagcaagccgcaggacacgccggtattcgtctggcccgaccagcagcagcgctggagctggctgagcgccagcaaggcccgcttcgccgccggcgagaaagcgcagtattccaatctggcgttcgatttcctggccgacgcgctggccgtggccaccggccggccttacgcggcgctgctgcgcgacaagatcaccgcgccgctgggcatgaaggacaccacgctgaacccgaccgccgcccaatgcgcgcggctgctggaaggcttcggcgccagcccctgcgtcaacaccaccgcggccagcggcagcggcggcatctactccaccccgcgcgacatgcaacgctggctgcaagacctggtctacccgcaggacgccgcgcgcaagcaactgcgcgaccagatgttccgcatgtacttcaaacgcgacgacctgcgcagcttgcgcggcatggatgtggcgggccaggctgacgaactgggcctgggctggatccggatgcaggaaaagccggacgcgccggaaatcatccagaagacggcgggcggcggcggcttcatcggctacgtcgccatcgcgcccaagcatgacgtggcggtatgggtggcgctcacccgcagcggcggcacccactaccacaatatgagcggcggcgcgaacaagctggtggcggaattaagcggctaccagcccgccgcgctggttgcgcccaagccggtcgccgcccgcaaaaccgcagctcacaaggcggtggttagcaagccggccgcccgcaaaaccgctgcccacgcaaaaccggccgcgcgcaaggcggcggccggcaaaaagactcacaagaaacacaaaccggccaatagctag

SEQ ID NO: 2938 - DNA, 975 bp, Chromobacterium substugae
atgagcaacgatttttcaatcaaccgccgccagttcctggccagcgcgtcggccggcagcgtcggcctgttgctggcgcacggcgacgcgctggcggcaaatggagcgagcaagaacatgacgcaacttgaaagcggcaaaacgggtttctggcccggagacgccagactggtgatttccatttccatgcagttcgaagccggcgcgcagccggagcgcggcgccagcgggccgttcccgccgctggacccgaaatacgccgatttgccgatgcaaagctggtacgactacggcgtgaaggagggcatcccgcgcctgctggacctgtgggaccgcaccggggtgaaggtgacttcgcacatggtgggacaggcggtggaccgcaatccgcagctggcaaaggagatcgtggcgcgaggccacgaggccgccggccatggccagacctgggagccgcagtattcgatgacgccgcagcaggagcgcgacgcctatcgcgccagcatcgccagcatcgaacgcgccaccggcacccgtccgacaggcttcaacgccttctggctgcgcggcacgcccaatacgctgggcatcctgcaggaactgggcttcgtttatcacatcgacaacgtcagccgcgacgagccgttcacggtgccggtgaacggcaagcccttcgtggtggtgccgtacacgctgcgcaacaacgacatcgtccgctacgattcgccggcgctgagcaacgaggcctacctggcggacctgaaggccgaattcgacctgctgtaccgcgaggccggccagcgtcgccggatgatgtcgatcagcacgcatgaccgcatttccggcagcccggcgcgggtcaaggtgctggaggacttcatccgctacgcgcaggggcatgacggcgttcgcttcatgcgcaaggacgagatcgcccgcttcgcgcagcgggcctctggagtgccggcgttctag

SEQ ID NO: 2939 - DNA, 708 bp, Chromobacterium substugae
atgagcctgaacgcggattttctgcggcaacgcagtgtggtggtggtgggcggcggctccggcataggccgggcggtggcgcaggaggcggccgacgccggcgcccaggtgtatgtgctggggcgttcgccgacggtcagcggcccatggcagtcgctgcgggctgatgtcaccgacagcgccagcctggacgcggccttcgccgaaatcggccgcatcgaccacctggtgctgaccgccggcgcgcgggtggggtcgcccacgctggcggcggtggagtgggcggatttcgagcggactttcaatgtgaagctgttcggcgccgtgctggcggtgcgccaggcgctgccctacctggcggccgatgcctcggtgaccttcacctctgggctgctgtcgcgcaaatacggcgccggcggcttgctgaaaagcacggtcaacgccgcgctagaggcggcggcgaagaatctggccaaggaactggcgccgcgccgcgtcaacgtggtgagccccggcgtggtggacaccgagctgtgggggccggacggcgcggaaagccgccaggcggcgatggcgcgcatcggcgcgggcctgccgctggggagggtggggcggccgcaggatctggctcaggcctatctgttcgcgatgggcaacgcctttctcaccggcgcggtgctggatgtggacggcggcggcttgctatag

SEQ ID NO: 2940 - DNA, 528 bp, Chromobacterium substugae
atgaaccgtttgccccatattctgaccgcaggcctgctggcgctgctggctggccacgcggccgccggcgaggccttgccgcagccgcagcgggtgttttccgaacgcaacggcggcgccgcggcggcggtgaagctggccgccatgcgctatgcggcgttctggaacaccggcgatccgagctatgccgagctggcgctggaccccgacttcatcgaccgcaccttgcccgccggacgccgccagggcgtggccggccccctgcaggcgtcgaacgctttccgcgcggcggtgccggatttgaaggttgaggtcacagacatgatcctggccggcgaccgggtatcgctgcgtctgcatttcaccgggcacttcaccggcaagttcggcgacgcgcaaggggccggacaggcggtggatttccaggccttcgacctgtaccgggtgaagaacggccgcatcgcggaaaactggcatctggaagacaacctgaccctgctcaagcaactgggagtggtgaagccatga

SEQ ID NO: 2941 - DNA, 168 bp, Chromobacterium substugae
gtgagcgcgaacgtcagcaccaatgcgcaggcgctggtgctgaaaaaggcgatgcaggccgattcgcaaaccgcgatgaccctgctgcagggcgcggccgagtcgtcggcgcagatccaggcgtccaatccggcgcatctgggcaataacgtggacgtgcgggcctga

SEQ ID NO: 2942 - DNA, 954 bp, Chromobacterium substugae
atgagcgcaacccgtcacaaccctctgctgattctcggctccggcccggccggctacaccgccgccgtctacgccgcgcgcgccaatctgaagccggtcctgatcaccggcatggcccagggcggccagctgatgaccaccaccgacgtggacaactggccggccgacgccgagggtgtgcagggtccggaactgatgcagcgcttccagcagcacgccgaacgcttcggcaccgaaatcctgttcgaccacatccacaccacccacctgagcgagaagccgatccgcctggtcggcgacgccggcgaatacacctgcgacgcgctgatcatcgccaccggcgcttccgcccagtacctaggcctgccgtcggaagaggccttctccggcaagggcgtgtccgcctgcgccacctgcgacggcttcttctaccgcaaccaggacgtggcggtggtaggcggcggcaacaccgccgtggaagaagcgctgtacctggccaacatcgccaagcacgtcaccctgatccatcgccgcgacaccttccgcgccgaaaagatcctggtcgacaagctgatgagccgcgtcgccgaaggcaagatcagcctgaagctgaacgccaccctcgacgaagtgctgggcgacaacaccggcgtgaccggcgtgcgcgtcaagctgaacgacggcggcagcgaagagctggcgctgaccggcgtcttcatcgccatcggccacaagcccaacaccgacatcttcaagggccagctggagatggacgccaccggctacctgatcaccaagggcggacgcgacggcaacgccaccctgaccagcatcgacggcgtattcgccgccggcgacgtgcaggaccatatctaccgccaggccgtgaccagcgccgcctccggctgccaggccgccctggatgccgagcgctacctcgacagcctgaagtaa

SEQ ID NO: 2943 - DNA, 636 bp, Chromobacterium substugae
gtgaagaccttcaaggactctttgaagggtcttcgccagacgctgcgccaggccgcccctcccccggcggccccggcgcggcccgcagcgcccgaagagccggatttcaagcaactgttccgcgacgtcaagccgctgaagcccgacggccgccatcatcccaaacccgcgaaacccagtccgcgcccgcgcaagcccagccagggccccgcgctgcacgccgccgcctgccaggaaatcctgcagcaccagataggctggttcgagccggcggcccaactgcaccaatacgcccgtcccggcatgccggccgccaccctcaagcggctgcgccagggctattggccgcaggccgcccagctcgacctgcacggactcgaccgctaccaggcgcaggacgcgctggcgttgttcctgcaccgcgcccgacagcgcggccaatgcgtgcgggtgatacatggcaagggcttcggctcgcaaggcgcgccggtgctgaaaaaaatggtgcgcagctggctgcagcaccatccggacgtgctggcgttttgcgaggcggaaagcggcatgggcggcagcggctcgctgctggtgctgctgcgccggcccagccatgcggacggccatggcgacgattga

SEQ ID NO: 2944 - DNA, 453 bp, Chromobacterium substugae
atgacaggcacaccctgccccgacttcaccctgcccggcaccgccggcgccgagtttcagcttgcctccagcgacaaaccgctggtgatctacttctaccccaaggacaacaccccaggctgcaccaacgagagcatggatttccgcgacctgcacggcgagttcgccgccgccggcgcgcagatcgtcggcatctcgcgcgacagcctgaagtcccaccataacttcaaggccaagctggaactgccgttcgaactgctgtcggatgcggaagaaaccgcctgcagcctgttcggcgtcatcaaaatgaaaaacatgtacggcaaacaagtaagaggcatcgagcgcagcaccttcgtgatagacgcccatggcaatgtggcgcgcgaatggcgcggcgtgaaggtgcccggccacgcttcggaggtgctggccttcgtcaagacgctgtaa

SEQ ID NO: 2945 - DNA, 1458 bp, Chromobacterium substugae
ttgtacccgcccggccagccggccgggcaacaacatgaacaaggggaccacatcatggccggccgcaaaaagaccaccgcgtgcaagctgtttgttttggacaccaacgtcctgttgcacgaccccacctgtctgtaccgcttcgaagaacacgatgtgttcatccccatcatcacgttggaagagctcgacacccacaagaagggcatgtccgaagtggcgcgcaacgcccgccaggccagccgcttcctcgacgacatcatcagcggccaggagctgaagatcaccgaaggcatcccgctcaagcacgccagccgcgacgccgccagcggcaggctgatcctgcagacccaggccatcaacggcaccctgccctcgtcgctgcccatgggcaaggccgacaaccagatcctcggcatcgtgatggcgctgaagagccactaccagggccgctccgtcatcctggtgtccaaggacatcaatatgcgcatcaaggcccgcgcgctgggcctggaggcggaagactacttcaacgacaaggtgctggaagacaccgacgtgctgtacaccggcacccgcgagatcgaccagaacttctgggaacgcaacagcaaggacatcaagtcgtggcaggaccacggccgcagctactaccagctgtccggatcggactgcgccaacctctacgtcaaccagctgctgtggcaggaaggcgaaaagccgttccaggcgcgggtgatcaaggtggaaggcaagaccgcggtgctggaaacgctgaaggactacagccacaacaagaacaacgtctggggcatcaccgcccgcaaccgcgagcagaacttcgcgctcaacatgctgatggaccccaatgtcgacttcgtcacgctgctgggccaggccggcaccggcaagacactgttgacgctggcggccggcttggcgatgacgctggagcagaagatctacagcgaaatcatcatgacccgcgtcaccgtgccggtgggagaggacatcggctttctgcccggcaccgaggaagaaaagatggcgccgtggatgggcgcgctggaagacaacctcgacgtgctgaacaagagcgacgacgacggcggcgactggggccgcgcggcgacgcgcgacctgatccgcagccgcatcaaggtgaaaagcctcaacttcatgcgcggccgcaccttcctcaacaagtacctgatcatcgacgaggcgcagaacctgacgccgaagcagatgaagacgctgatcacccgcgccggccctggcaccaaggtggtgtgcctgggcaacgtcagccagatcgacaccccttacctgaccgagggcagttccggcctgacctatgtggtggaccgcttcaagggctgggaccactccgcccacatcacgctgcagcgcggcgagcgctcgcggctggccgaccacgccggcgaagtcctgtaa

SEQ ID NO: 2946 - DNA, 630 bp, Chromobacterium substugae
atgacagatttgttccgtgaaatgagcgcaggcgaaagcgatggcaacgagaccatccgcggttcgaacagccctgacagcgagactctgcgcggcggcgcgggcaacgacgtgctgatcggcagcggcgacgaaaccacgctggaaggcggcaagggcgacgacacgctgcatggcggcagccgcagcaaggacacctatgtgttcaatctgggcgacggcaacgacctggtgatcgacgatcacgtgacggtggacagcagccgccagagcgagatccgcttcggcgcaggcatcgcgcaaagcgacatcgtcgcgtcgcaaagcggccaggacctgctgctgcagcacgtcaacggccacgactcgatccgggtgcaaggctggttcgactggcagcgccagcagggcacggtgaagacggtgaccttcgccgacggcggcagctggagcgcggggcagctggaccagatggcgatgaatgcggcagctggggtgccgatggcttcgcaggcgcaggcgctggtcggcgcgatggcggcgttcaacccgccggcggcgggccagatgtcgctgtcggccgactatgcgtccgaagcgccgaccttggcggcatccggctggaaataa

SEQ ID NO: 2947 - DNA, 1227 bp, Chromobacterium substugae
atgaagatcctgctgatccaccagaatttccccggccagctgcgccacatcgccgatgatctgaaaacccggcccggcatcgacctgctggcggtggggcgggacaccgcgcccggcctgcaaggcgtgcggctgctgcgctacaagccgcatcgccggcccagccgggaaacccatccctatctgatcagctacgaggacgcggtgctgcacggccaggcggtgctgcgcagcttgcagcccttggcccatcgcggctaccggcccgacgtgatcctcgcccaccccggctggggcgagacgctgttcctgaaagacctgtttccgaacgcgcggctgatccactactgcgaattcttctaccacggccagggggccgacgccgatttcgacccggaattcccgctcagcctggatggcgcggcgcggctgcgcgcccgcaatgcgctgcatctgctcaatctggaaaactgcgacgccggcatctgccccacccactggcagcacagcctgcacccggccgcttaccgcgccaagctgcgggtggcgcacgagggcatccacgccgaacggctgggcccggatccatcggcggcattgacgctgccgaacggccgcgaattgcgcgccgggcagaagatcgtcacctacgtcgcgcgcaatctggaaccctaccgcggcttccacatcttcatgcgcgcgctgccggatttattgcgggccgagcccgattgccaagtggtgatcgtcggcggcgacggcgtcagctacggcaatgcgccggccgatgccgccaactggcgggagaagctgctgcgggaaaacccggtcgacccgaaccgggtgcatttcctcggcaaggtgccgtacgaggtctaccgcaaggcgctgcaggtgtcggcggcgcacgtctatttgacctatcccttcgtgctgtcgtggagcctgctggaggcgatggccagcggctgccgcatcgtggcgtcggacaccgcgccgctgcgcgaggtgatccgcgacggcgtcaacgggcatctgaccagctttttcgaccaagaagccttgatcgggcgggtgagggaggctttgcgcgcggatgaccccgccatgcgcgcgcaggcgcggcggaccgcggcgcgctatggggtggaaccggggattgtcgcttatcgagatttgctgggcgtggggatgcgcgcggagcgaacgttttcgcatcgaacctga

SEQ ID NO: 2948 - DNA, 1422 bp, Chromobacterium substugae
atgaagcagcagattgaggcattgcgggatttcctgcgccgctaccgccaggccttcgccgaatattggtccatccgccaccagctcgaccccaagccgcgcagcgaggacgaactggccttcctgcccgcccacctggaactgaccgacagcccggtgtcgccgttgccgcgctggagcatgcgggtgatcgtcgcgttgtgtctttgcatgttcttgtgggcgctgatcggccagttggacatcgtcgccgtcgccggcggcaagaccgtcagcggcggccgcaccaagatcatccagccgctggagcccagcgtggtcaaggccatccacgtgcgcgacggccagctggtcaaggccggccagttgttgatcgagctggacgccaccgccgccggcgccgacaaccgcaaggccggcgacgcgctggaaaccgcccgcctggccgccgcccgctaccaggcgctgctggcggcgctggacaatggccggctgccgcagctggagaagctggacggcgtcgatccggccaagcaactgagcgaggaaaccctggccgtcggccagtggcgcgcctaccaggcgaagcgcgaggcgctgcaggccaccttgcgccagcgcgaggcggaactctctaccacccgccagcaggtgcgcaagctgcaaggcacggcgcggctggccgaggcgcgcgagcacgactaccaggagctgctggacaagaatttcatctccaggcacgcctatctggacaagcagcaggcgcgcatcgagcagcagggcgacctggccagccagcaaagccgcatccaggagctggccgcagccatcgccggccagcgcgaagaattgcaagcgctgaccgccaacttccgcagcgacgcgctgggcaagctgcgcgaagcgcgcgagcaggccagccaatccggcgaggaaatgaagaaaaccggccgccgccaggcgctgacccaactcaccgcgccggtgtccggcagcgtgcagcagctggccatccacaccgtcggcggcgtggtcaccgaagcgcagcccttgctggccgtggtgcccgccaacgagacgctggaagtggaagcgcagatcgagaacaaggacatcggcttcgtccggcccggccaggcggtgacggtgaaagtggaaagctttccctacacccgctacggctatctggacggcgtggtggaaaccgtcagccacgacgcgcagcaggacgaaaagcgcggtctgctgttccccgcccgcatccggctgaggcaaggccatctgctgatagacggcgcgcgcgtcaacttgagcgccggcatggcggtcagcgccgagatcaagaccggcaagcgccgggtgatcgactacttcctcagcccgctgcaggagcacatcggcgaaggcatgcgggagcgttga

SEQ ID NO: 2949 - DNA, 2145 bp, Chromobacterium substugae
atgaaataccaaagcgctcaggatgttccggagcaggttgttccgcatgatctgggtttgctgggcctggtgttgctggcccagttccatggcatcgccgccgaccccgcgcagctctcccaccagtttggccgcagcgccgaacgcttttccgaaaccgatctcctccttgccgccaagcagctggaactgaaggccaagatcgtcaagcaaccgctggagcgcatcggcctgatggccttgccggcgctcgcgctggcggtcaatggcgagcacttcatcgtcgcccgctgcgatggcgacaaggcgctgatccatgatctgaagcagggacgtcccgtggtgttgagcctggacgaactggcggcgcgctacgacggccggctgctggtggcggcatcgcgcgcgtcggcggccggcgccttggccaagttcgacttcacctggttcgtgccggccatcgtcaagtaccgcaagctgctgctggaggtgttgggcgtgtccttcgcgctgcagttgttcgcgctggtgacgccgctgttcttccaggtggtgatggacaaggtgctggtcaaccgcgctttcaacacgctggacgtgatcgccgtcggcctgctgttgttgtcggtgttcaatgtggtgttgtccgccttgcgcggccacgtgttcgcccacaccaccagccgcatcgacgtggagctgggcgcgcggctgttccgccacctgctggcgctgccgctggcctattacgaggcgcgccgcgtcggcgacacggtggcgcgggtacgcgagctggacagcatccgcaatttcctcaccggccaggcgctgaccacggtgctggacctgctgttctccttcgtgttcctggcggtgatgttctattacagcggctggctgacgctgatcgtggtgatttccttgccgtgctacgccgcctggtcggcgctgctgacgccggtgctgcgccggcggctggacgagaagttcgcccgcggcgccgacaaccagtccttcctggtggagtcggtgggcggcatcggcaccatcaagtcgatggcggtggaaccgcacatgacccggcgctgggacaagcagctggccgcctacgtggccgccggcttccgcgtgacgcggctggccaatatcggccagaacggcgtgcagctgatccagaagctggtgacagtggccaccttgtggctgggggccaagctggtgataggcggcgatctgtcggtcggccagctgatcgccttcaatatgctggccggacaagtggcggcgccggtggtgcgcctggctcagctgtggcaggacttccagcaggtgggcatctcggtggagcggctgggggacatcctcaacacccgcaccgagctgccggccagccgcgcggcgctgccgcccatccagggcaagatcgagttcgaccaggtggtgttccgctaccgccccgatggcccggagatcctgcgcaagctgagcctggagatccggccgggcgaggtgatcggcatcgtcggccgctccggttccggcaagagcacgctgaccaagctggtgcagcggctgtacgtgccggagtccggccgcgtgctggtggacggcaacgacctggcgctggccgatccggcctggctgcgccgccagatcggcgtggtgctgcaggaaaacctgctgttcaaccaaagcatacgcgacaacatcgcgctgtccgatcccggcatgccgctggacgcggtgatccgcgccgccaagctggccggcgcccatgacttcatcatggagctggcccagggctacgacaccatggtcggcgagcacggcgccagcctgtccggcggccagcgccagcgaatcgccatcgcccgcgcgctggtctgcaacccgcgcatcctgattctggacgaggccaccagcgccttggactatgagtccgagcgcgcggtgatgcagaacatgcgcgccatctgccagggccgcacggtgctgatcatcgcccaccgcctgtccaccgtgcgcggcgcccaccgcatcatcgcgatggacaagggcgtgatcgtcgaggccggcagccacgccgagctggcgcagaaaccgggcggctactacgcccacctccacagcctgcagcaaggataa

SEQ ID NO: 2950 - DNA, 861 bp, Chromobacterium substugae
atgcgtttcgccattaccctgtccgaccgcttcaagccggtgctggatgttttcctgcaggcaggctggcagcctgtcaaagtgttctgcacgccggtggaccaccgcatgcaccatcacaaggcttccctggctttcgccgagcagcgcaagctgccgctgcagctgtcgccgatgcagccgcgggatttgcaggagctggccgaacagggttgcgaggccttgctggtggccagctacaactggcgcataccggactggacgccctatctgaaatacgcggtgaatttccatccttcgccgctgcccatcgcgcgcgggccgtacccgcaggtgcgggccctgctggaagggcaccgcgaatggggcgcgacctgccacaaggtggccgcggatttcgataccggcgaggtgctggcgcaggagcggtttccattgtcggaaacggaaagccaccagacgctggacgtcaagctgcaactcgcgctttaccggctgagccggacggtggcgcacaatttcgaagcgtcatggcgcgacgccgcgccgcaggcggaggggggcagttactggccgctgtggagcgaacaggagcgcatgctcgatttcacccggccggtggccgacttgcagcgccagctgcgcgccttcggcgatttcgaatgcgcggccaccatcaacaacatcaccattttcatccaccgcgccgaaggctgggtggaaagccatggcttcgcgccgggcagcctgatttattcgcaagccgatcagttgctggtggcggcgagcgacggcatgctgctgatcagcgaatggagtctgtacgggccggatgccgcaaccggccggctgcgccgttga

SEQ ID NO: 2951 - DNA, 1356 bp, Chromobacterium substugae
gtgcggcacggcatcgatctggacaaggcacgcgcgtggcatgagcgggaaatacgcggcttcctggcgcggcacccgcgctcgctggcgctgtcggagcgggggagggcgcacttgttgttcggcgtgccgctgcactggatggacgattggccgacgccgtgctcgctgttcatcgccgaagcgcgcgacgccgcgctgaccgatgccgacggcttggaatacgtggatttctgcctgggcgacaccggcgcgatgttcggccactcgccggcgccggtggcggcggcgatcgcgcgcgaggcggcgcgcggcctgaccgccatgctgcccggcgaggacgcgttgtgggtggcggaggaattgtcccgccgcttcggcatggcggcgtggcagttcacgctgtcggccagcgacgctaaccgtttcgccatccgctgggcccgcgcgatgaccggccgcgaccagatcctggtgttcaacggctgctaccacggcacggtggacgatgtgttcgtcgacctggtcgacggcgcggcgcggccgcgcgccagcctgctgggacaggtctacccgttgaccgagcatacccgggtggcggagttcaacgacctggcggcgctggacgccgcgctggccgatggccgcgtcgcctgcgtgctggccgagccggcgatgaccaatatcggcatggtgctgcccgatcccggctactgggagcaggcgcaggccatcatccgccgccgcggcagcctgttgctgctggacgaaacccataccatcagctgtggccccggcggctatgccgccgcgcacggtttggcccccgacctgctggtgctgggcaagccgctggcaggcgggttgccggccgccgcctatggcttcagcgccgagctggcgcaaagggcgcagcaggccaagcgggccgcgccgcccggtcactccggcatcggcaccacgctgagcgccaaccggttggcctgcgcggcgatgcgggccaacctggccgaagtgatgaccgaagacaattaccggatcatgtttgagcgcgcagggaggctggcgcagggcctgcgcgaattgttcgcccgccgcgacctgccatggtgcgtgacgcagctgggggcgcgctgcgaattccagttcgcgccgcggccgccgcgcaacggcagcgaggccggcgcctggcaggacgaagagcttgagcgctgcatccacctgcacctgctcaaccgcggcctgttgatcacgccgttccacaatatgctgttgatgagcccaagcaccgccgaagccggcatcgcgcggttgctgcaggccttcgacgattggctggacgcggcccaggcttga

SEQ ID NO: 2952 - DNA, 156 bp, Chromobacterium substugae
atgccacgcgcgtgccttgtccagatcgatgccgtgccgcactgccatatccgcctcgccgtccgcgtttcacacgcccccagtatgccaaacccaggcggcgcgcgacaaaaagcccggaggggctgcgccgctccgggccaatcactgcaatga

SEQ ID NO: 2953 - DNA, 216 bp, Chromobacterium substugae
atgaaaatcgacgatttcaatgtggtggccgacctgatcggcatgaaaaagcgctcgcgcgaggcggtgtggctgatggaagtggagggcatgaccggttattccgccgcccagcagatggacatcagcgaatccaccgtatcccgcgcccacgcgcgctttgtccgcgcgatcaggcaagtgaacacgctggcggggcacctgcccctgcgctga

SEQ ID NO: 2954 - DNA, 2043 bp, Chromobacterium substugae
  modified_base (1894)..(1894): a, c, t, g, unknown or other
ttggaatatttaaaaataacaaatcacacaaatacatattgtgaatattttattttaaataaaaaccattatttgcaacactattccaatgaatttttccacccgcctcgctcggccggctcgccggccattcaacaaaaacacaaggaaacaatcatgagcatggaaaaccaagccgcgcccgacagccgcgtcatcaacgtgcgcgacagcgacagccgcaccgaaatcgataccgaccccagcctgggccgcatcgcggacatccatttccccgatacgcccgactacaccgtgcgcggcatggtgcgccagggcgacgacctgttggtccagttcggcaataaccagcagctggcgctgaagggccactacctgggcgcggaccatcaattcggcaagatgagcttccagagctatgccagctggacctacgaaatgatgacccagcgcttcggcctgagcgtcgaaggcgcgggaccgttccacttcaccgacgccggcgaaaccatcaccggcaatgatcaaaacaacgccctctacggcgaaggcggcgacgacgtgctgcgcggcggcgccggcaaggacacgctggtgggcggcgcgggcgccgatggctatgccttcgccccgggcgacggccaggacatcgtcgatgcctacagcgccggcgccggccgccaggacagcatccacatcagcgccccgctctccatcgtcgacaagctgacgcggcaaggcgacgatctgacgctcagctacaaccagaccgacagcatcacaatcaagggtttcttcctgggcgcggaccaccagatcgccagcttcaacttcttcgacgccggccaaatcagcgccttgagctacgaagaactggcgcaacgcttcccgccgcagatactgggcaccttgggcgacgacaccctggccggcaccgacggcaacgacctgctgcaaggcggcctgggcgatgatttgctcatcggcggcaagggcgacgacaccctggagggcggacctggcaaggacaccctgatcggcggccgcggcaacgatctcttcgtgctgcgcgccggcgacggccgcgacgtcatcgacgctttcgacgactccgccgaccgtctcgacaccctgctgttccaggatgtctcccccgacagcatccgcaacgtccgccgccagggcgacgacctggtgttcgaatacggcccgcagcagccgtatccgggcctgggcagccaacccgaccaggtgacgctgaaggggcacttcctcggcgccgagcaccagatcagccagatcgccttcaacgacggcacccgctggagctatgagcagctggcggccaagctgccgatcgccgtggtcggcaacgacaccagctcgcatttcaccgacgccaatgaaaccatccacggcagcggcggcgacaacgccatctacggcatgggcggcaacgacctgctgctcggcggcctgggcgacgacttgctcgacggcggcaaaggcgacgacaccctggagggcggacccggcaaggacaccctgatcggcggccgcggcaacgacctcttcgtgctgcgcgccggcgacggccgcgacgtcatcgacgctttcgacgactccgccgaccgcctcgacaccctgctgttccaggatgtctcccccgacagcatccgcaacgtccgccgccagggcgacgacctggtgttcgaatacggcccgcagcagccgtatccgggcctgggcagccaacccgaccaggtgacgctgaaggggcacttcctcggcgccgagcaccagatcagccagatcgccttcaacgacggcacccgctggagctatgagcagctggcggccaagctgccgatcgccgtggtcggcaacgacaccnctgggcgcggaccatcaattcggcaagatgagcttccagagctatgccagctggacctacgaaatgatgacccagcgcttcggcctgagcgtcgaaggcgcgggaccgttccacttcaccgacgccggcgaaaccatcaccggcaatga

SEQ ID NO: 2955 - DNA, 1371 bp, Chromobacterium substugae
gtgctgcgcggcggcgccggcaaggacacgctggtgggcggcgcgggcgccgatggctatgccttcgccccgggcgacggccaggacatcgtcgatgcctacagcgccggcgccggccgccaggacagcatccacatcagcgccccgctctccatcgtcgacaagctgacgcggcaaggcgacgatctgacgctcagctacaaccagaccgacagcatcacaatcaagggtttcttcctgggcgcggaccaccagatcgccagcttcaacttcttcgacgccggccaaatcagcgccttgagctacgaagaactggcgcaacgcttcccgccgcagatactgggcaccttgggcgacgacaccctggccggcaccgacggcaacgacctgctgcaaggcggcctgggcgatgatttgctcatcggcggcaagggcgacgacaccctggagggcggacctggcaaggacaccctgatcggcggccgcggcaacgacctcttcgtgctgcgcgccggcgacggccgcgacgtcatcgacgctttcgacgactccgccgaccgtctcgacaccctgctgttccaggatgtctcccccgacagcatccgcaacgtccgccgccagggcgacgacctggtgttcgaatacggcccgcagcagccgtatccgggcctgggcagccaacccgaccaggtgacgctgaaggggcacttcctcggcgccgagcaccagatcagccagatcgccttcaacgacggcacccgctggagcggcgacgaactcgccagccgcttcgccgtgaccatcgagggcaagggcggctcctaccgcttcggcgacgccaacgacaatgtcgtcggcagcgccggcaacgacacgatctacggcatgggcggcgacgacctgctgcagggcggcgccggcaacgatctgctgaatggcggcgacggcgacgacacgctggaaggcggcctcggccgcgacaccctggccggcggcgccggcgacgacctctacctgcatccgcgcgacagcggcgacgacctgatccgcgacaatcagggcagcaaccacctgcaactgggcgagatgagcgacagcctgtggctgtcgcgccgcggcgacaacctggaaatcagcctgccctacgcgcaaggcaaggacaaagtcaccgtggaaaactggttccgcggcgcggagcaccaactggagcggatctccagcgccgacggcaagaccttgctggccggccaggtggatgcgctggtttccgcgatggcggcgctgggcggcgacgctccgggcgccagcgccatgacgcagtcgctgcagcaggagccgctgcacgcgctggtggcctccagctggcactaa

SEQ ID NO: 2956 - DNA, 489 bp, Chromobacterium substugae
atggaagacatcgatttattgcgcctgaagctgaccagcagcctgcgcccgctgggcgtgctgtggcggcatatcgcgcaggaagcgctgaccgctcacggcgtttcggtatcgggcggctccgcgctgctgttcatcggccggctgggagaaggcgtcagccaccgcgcgctggcagacgagctgggcatggagccggcctccctggtccgcatcgtcgatcagctgagccaggccggcttgctgcgacgggaacagggtttgcaagaccgccgggtgaaaaccttgtggttcaccgacgccggccgcgaagtcacccgcaagatagaaacggaactggtggcgttgcgcgcgcgcgtgctggcgccgctcagccaggccgacctggaagccgcgctgcgggtattccaggtgctggaacaggcggcgcaaacccgcgtccccgacgacccgatgctggacccgccccatgatcgcgctgcccgctaa

SEQ ID NO: 2957 - DNA, 2031 bp, Chromobacterium substugae
atgatcgcgctgcccgctaaacgcgactggctgttctccgcccgcaccttcgccgccgcgatgctggcgctgtacatcgcgctggcgctgggcctgccgcggcccagttgggcgatgggcaccgtctacatcgtgtcccatccgctgatcggcgccacccgttccaaggcggtgtaccgcgtgttcggcaccctgctcggcgcagccgcagcggtatgggtggtgccgccgctggcaggccagcccgtgctgctgagcctggtggtcgcgctgtggtccggctccctgctctacctgtccatgctggaccacacgccgcgccactacctgctgcggctgccggcctacaccatgccgctgatcgcgctgtcggcggtgtacgcgccggaaaacgtgttcgacatcgccatcgcccgcagcgaggaaatcgccctcggcatcgtctgcgccagcgtgatggcggcgctggtgctgcccacccgggtatccgccgtgctaagccagcgcgtggacggctggctcaaggacgccgccgcctgggcgaccgacacgctgggcagcgcgccgcagccgccatccgccggccgcaatcggctggctgccgacctgctggcctttgaccaattgctcacccacctctcctacgacgccgccagccgcaacgccgagcgcaccgcgggcgagctgcgcgcgcggatgagcatgctgccgccgctgctgtcctcgctgtccggcctgcaggccgaattgcgcaacacgccgcaagggccgtcgccggcactcgcccagttgatggaggcgatggccgactggctgggctatcccgtcgacaacccctggtttctgagccaggcgcgcgcgctgcgccgccagctggacgacccgccgcctgccggcggctggccgtctttgttggaaagcacggtgcggatgcggctgaaatcgctggtcaatctgtggcaggactgcctgacgctgcgcgcgctgatttcgcgcggcgcgccgctgtgggactggcggccggcttaccgccgctgggaagtgggcgtgaaggcccgccactacgattacggcctgctcggcttcgccgccgccagcgccgcgctgggcattttcctgggttgcctggcctggatcgcgctgggctggcaggacggcgccaacgcggtggtgctgggcacggtcgcctgctgcctgttcggcgcgatggacgagccggcgccgatgctgcgcacgctgttcgtcgtcaataccgtctgcaccatgctggccggcctgctgctgttcgccgtgctaccggccgtgcatgaattcgagatgctggcgctgtgcctggctccgcccttcctcttgggcggcgcgctgatgaaccagccgcgcttcggcccggtggcgatgctgctggtggtgttcaccgccaatctgatcggcctgcagcaaagctacaacgccgacttccagtccttcctcaacagcaatctggccggcgcggccggcatcctgttcgcgctggtctggacgctggccacccgccccttcggcgcggagctgacgctgcgccgcctgatccgcgccaactggcgcgacctggcgcaaaacgccgccggccgccacggcggcgactacgagcggctgaccgcgctgatgctggaccgcctgtcgttgctggcgccgcgcctggccgccgacggcgccgactcgtccgccggcttccgcgaactgcgggtgggcttcagcgcgctggacctgcaacgcgacgagcaccgcctggccggcgccgcccaccaggcggtggacgcggcgctgcaaggcgtcagcgagcacttccgcgcctgcgccgaagccgaccgctatctcgacgcgcccggcgccttgcttggccggctggacgccgccatcgcgctgaccctggccgatgccgcgcccgccgcgcgcgaagcccgcaacgcgctggtggaaatgcgcgtatcgctattccccgacgccgcgggctgccagccggcgtcgcccgtttccggagcccagccatga

SEQ ID NO: 2958 - DNA, 201 bp, Chromobacterium substugae
atgataggcgaaatcaatttctacggggtgtacttccccagcctgctggtgatgatgctgatcgccttcgccgccagcagcctgctgtgccgcgcgctggcccgcctggacctgtaccgcgcggtgtggcaccgctcccttttcaatttcgcgctttacctgatcgtgctgggcggcacgatcgcgctgtttcacaggtga

SEQ ID NO: 2959 - DNA, 846 bp, Chromobacterium substugae
gtgctgctgaccctggccacactcgccgtcgccatcgtggtggtgcggcatatctgggtttattacaccgacgcgccgtggacgcgcgacggccatatcgccgccgacgtggtgcaggtggcgccggacgtgtccgggctgatcaccgaggtgaaggtggccgacaaccagctggtcaagaaaggccaggtgctgttcgtggtggaccgcgcgcattacgaactggcgctgcgccaggccgaagccgccctcgccgcgcagcgcgccacgctggcccaggcccgccgcgaagccgcgcgcaatcactcgctggccgacctggtggccgccgaggcccgcgaagagggcgacgccaaggtgcagctgggcgaggccacgctggccgccgccgaggccgccgtcggcgtggcccggctgaatctggagcgcaccgaggtgaaaagcccggtggacggctacctgaacgaccgcacgccgcgcgccggcgattacgccgccaacggccgcgcggcgctgtccgtcgtcgactcccattccttccacgtcgacggctatttcgaggaaaccaagctgggcggcgtagagctgaaccaggcggtggacatccagatcatgggcgaatcgcgcaagctgcgcggccacgtgcagagcatcgccgccggcatcgaaaaccgcgaccgcagcaacggcgcctcgctgctgcccaacgtcaaccccaccttcaactgggtgcggctggcgcagcgcatcccggtgcgcatcgcgctggacgaagtgccggccaatttccggctgatcgccggccgcaccgccaccgtgtcggtgcggcagggaggccgctcatga

SEQ ID NO: 2960 - DNA, 1422 bp, Chromobacterium substugae
atgaaagccgcgctgaagctgagcgcgctgagcctggccggcgcgctggccggctgcgccgccgtcggcccggattaccatctgccttcgcaagccgcgctgggcaagcccgccgccaacgccgccttccagtcggccaaccatgcggccttcgcccagcagccggtccccgccggctggtggcggctgtatgacgacgccaggctggacagcttggtggaggaagcgctgacagccaacgccgacatccgcgccgccgcggccaatctgcgcaaggcgatggcggtggaagcctcggtcaacgccgagcgcgatccccacgccagcgtgtccgccaccgtccagcgcagccaggattccggcgaggcctacctgctggagaaaaagctgccggtggccaatgtcggcgacggcggcctgcaaatcggctacgagatcgacctgttcggcaagctggcccgcgccgaggaagccgcccgcgccggcacccaggccaccgaggcggcgatggatctggcgcggaccacggtggcggcggaaaccgtgcgcgcctatgtccagggctgcgccgccggacaccagctggcggtggccaggcacgagctggatctacagaaccgcggcgtggcggtggccaaacgcatgcaatccgccggccgcggccgcgccaccgatgtggagcgcgcccaggcccaggccgacatccagcgcgccgcgctgccgcgcctgcaggcggagcaggacgccgcccgcttccgcctggccgcgctgctgggcaaggccccggccgagcggcccgccgccgtctgctcggccctgccccagttgaagcagccgctgccggtcggcgacggcgcggcgctgttgaaacgccggccggacgtgcgcgaggcggagcgcaagctcgccgccgccaccgcccgcatcggcgtggccaccgcccagctctaccccagcgtcagcctgggcgcgtcggccggcttcaccggcctgctggaacacgtgggggaagaccgcacccagcgctggagcctggggccgctgatcagctggaccatccccgacagcggggcccgcgcccgggtgaaagcggccgaagccgacgccgacgcggcgctcgcccatttcgacggcgtggtgctgaacgcgctgcgcgagacggaaaccgcgctgaccttctacgccaaggatctggagcgcaacgccgacctgcgctcggcgcgcgacaacgcccatgccgccgcgcaggacaaccgccggctgtacgcggccggacgcgcgccctacctggccagcctggacgccgaccgcgcgctggccggcaatgaatcggcgctggcggcgtcggacgcgcaagtggcgctggatcaggtcagcctgttcctggcgctgggcggcggctgggagcaggcgccgcgctga

SEQ ID NO: 2961 - DNA, 918 bp, Chromobacterium substugae
atgaaacaggaagtgatttttctcagcgaaggcctggagctggtcggccatctgtaccgtcccgccgactatcaaccggagaagcgctacccggccatcgtggtcagccatccgttcaccggcgtcaaggaacaggtggcggggcgctatgccgagcggctggcgcaggacggctatctcgcgctggcgttcgacaccgcctaccagggcgagagcgagggcctgccgcgtcatctggaaacgccccattcgcgcgcggaagggatcaagtcggcggtcagctatctgtccaacctgcctgatgtcgaccccggacgcatcggcgcgctgggcatcgccgccggcggcggctacgcggtgttcaccgcccgcaccgacccgcgcatccaggccgtggccaccgtcaacgcggtttgccaaggcagcctgctgcgcgacgggctgaacggcagccgctcgtccgaacagctgcagggcctgctagccgcggcggcggaagaccgcaccgcccaggaccgcggcgaagccgccgccacccgcagcgctctggcggaaacggcgcaagcggcggccgaacaaccgcagagcctgctgcgcgaggcctacgactactaccgcacgccgcgcggccatcatcccaacgcggaaaaccgcttcgtgctgtccgggctggacgcgctggccggcttcgacgccttcgcccgcatcgacatgctcgcccagcggccgctgctgatgatagccggcgccgacgccgacacccgctacttcagcgaacaggccatcgccgccgccaccgagccgaaggagctgtgcctgatcgcctgggcctcgcacttcgacctgtacgaccgcgagccgtgcgtggcggccgccgcagccaagcttcaagcctttttcgacctgagcctggcctag

SEQ ID NO: 2962 - DNA, 372 bp, Chromobacterium substugae
ttgcttgccatgagtgaaaaaagcaatccctgccaatcctgcggcgcgtgctgcgccagcttccgcgtatctttctattgggccgaagccgatgacggcggcggcttggtgcccagccatctcaccgaaaagctcaacgactggacccgctgcatgcgcggcacctggtccgccagcccgcgctgcgccgccttgcagggcgaggtgggcgacagcgtcggctgtggggtgtatccgctacggcccagtccctgccgcgaagtggaggccggttcggcgcaatgcctgaaggcgcgcgccagccacggcttgccggcgctgcggggagcgccggcggcggccaatgaggcggcgccgctgctggccggctag

SEQ ID NO: 2963 - DNA, 1248 bp, Chromobacterium substugae
atgagtgaaaaggcagggcgcggcgtcgccatcatcggcggcggcccggcgggcctgatggcggcggaggtgctggccgcgcgcggctgcgcggtggatgtgtacgacgcgatgccatccgtcggccgcaaattcctgctggccgggatcggcggcctcaatatcacccattccgaagcttacccggccttcgtcggccgctacggcgaccgcgctcagcagatcgagccgctgctgaaggatttcgacgccgacgcgctgcgcgcctgggtgcatggcctgggggtggaaaccttcgtcggcagctccggccgggtgttcccgcgcgagatgaaggccgcgccgttgctgcgcgcctggctcagccggctgcgcgaagccggcgtgcgcattcatgtgcgccatcgctggcagggctggaacgccgacggcagcctgaagttcgacacgccgggcggcgagctggcggcgcgcgccgacgcgacgctgctggcgctgggtggcggcagttggaagaagctgggttcggacggccgttggctgccgtggctggcggaaaagggcgtcgccaccgcgccgctggcaccgtccaattgcggtttcgacgccgcctggagcgattttttcgccgacaagttcgccggcgagccgctgaagtcggtcggcctggcttttcagggcggcgacggccgcgcattccagcgcgtcggcgagtgcgtgatcaccaagagcggcatcgagggcagcctgatctatgcctgctcggcgctgctgcgcgacgagatcgcccgcgccggctccgccacctgccacctggacctgatcccggcctgggacgaggccagggtgctagccgaagtgtcgcatccgcgcggctcgcgctccttgtccagccatctgcaaagccggctgaacctgaagggcgcgcgcgccggcatattgcgcgaatgcctggacaagaacagcttccagaatccggcggcgctggcggcggcgatcaagcgtttgcctgttacgctgaaagcggcgcggcccatcgacgaggcgatcagcaccgccggcggcgtcagctttgccgcgctggatgagaggcagatgctggccgcgctgcccggcgtgttctgcgccggcgagatgctggattgggaagcgcccaccggcggctatctgctgactgcctgcttcgccagcggccgtgcggctgggcagggcatcgccgactggctggagcggcatgcatcaaaatag

SEQ ID NO: 2964 - DNA, 1629 bp, Chromobacterium substugae
atgagaaaattttccgattggccgatctggctgcgtctgaccggcgcgatctggacctgcctggtattggcctggagcggcttgatcgcctgggaaacccaggccagccgccagatcgcggtagaacaggccaaagacctggcgcacagcatgaatgaaatgacgctggccggcctcaccggcatgatgatcaccggcaccgtcggccaacgcgacgtgttcctcgatcagatccgcgagctgtcggcagtgcgcgacctgcgggtgatacgcggcgatccggtcaaccagcagttcggccccggcaatgccggcgacaaggcgcgcgctggcgatgccctggagcgcgctgccctgcaagacggcaaaccgcgcatcgagatcgaatccacgccggaacaaggcgaacaattgcgcgtggtgtatccggcgctggcctcgcccaattatctgggcaagaactgcatgacctgccaccaggtggcggacaagaccccgctgggcgcggtcagcatgcgcatctcgctggaaaagccgtatgccgcggtggacagcttccgcacccagagcatcctgttcgcgctgctggcctcgctaccgctgctggcggtggtctacctgttcatccgccgcttcgtcacccggccgctgcaggagatgtcggccggcttggcagagctggcccagggcgaaggcgacctcacccgtcgcctgccggccgcgcacagggacgaaatcggcaccaccgccagccacttcaaccgcatgctggccacggtggccgacctggtgcgccaggtcagcgattcggccaacgcggtggcgcaatcgtcgcgcagcctctccggcggcgccaatcagctggccgccagctcccaccgccagaacagccagtcgctggccgccgccgaagcagtggaacagctggcctcgcacatcggcgaaatcgccggccaggcggagcaggtcagcaacggcgccgaagaaagcctgcagcgctcggaacagggccggcaaagcctgcgccaattgcagcaggaagtgggccaggtgcaagaagcggtgcagttgatggcccaggctgaaagcgacctggccaactccaccgccatcatcaccaccatgacccgcgaggtgcgcgaaatcgccgagcaaaccaatctgctggcgctgaacgcggcgatagaagccgcccgcgccggcgagcagggccgcggcttcgcggtggtggccgacgaggtgaggaagctggcggagaagtcggccaaatccgccagcgagatcgataccgtcaccggctcgctcaacagcaagaccgacgcggtgcgccaggcggtggccgccagcctggcgtcgctggacgccagccgccagtcggccgacagcgtggccagcgtgctggccgccggcaaccagtcggtggcggaagtgcgcggcggcctcaggcagatcgtggaagtcaccgagcagcagcgccgcaccagccagatggtcaatgagagcatagacgccatcgccgacatggcgcgcaccaacgacgccgacatccagcagacggtgggcgccgccgaggaactggaggcgctggcgcagcggctgaccgattcggtgtcgcgcttcaaagtgtga

SEQ ID NO: 2965 - DNA, 1383 bp, Chromobacterium substugae
gtgaaaccagccgctttttccaccctgcccctgcccgcccccttgctgtccaacctggacagcctgggctaccaccagatgaccgccatccaggccgccagcctgcccgccattctggaaggccgcgacctgatcgcccaggccaagaccggcagcggcaagacggctgcgttcgggctgggcctgctggccagcctcaatccgcgctggttcggcgtgcaggcgctggtgatgtgcccgacgcgcgagctggccgaccaggtggcgcaggaaatccgccgcctggcgcgcgccatcgacaacatcaaggtggtgacgctgaccggcggctcgccgatgggcccgcagatcggctcgctggagcacggcgcccatatcgtggtgggcacgccgggccggctgcaggaccacctgttccgcgaaacgctgaacctgagcggcgtgaagacgctggtgctggacgaggcggaccgcatgatagacatgggcttcatcgaggagatcgtcggcatcgtccgcgcctgtccgaaaacccgccagaccctgctgttctccgccacctacccggaagacatccgcaaggccagctcgcagttcctgagaaacccggtggaagtgaaggtggagtcgctgcacaacgccgaccacatcgaacaatggttctacaaggtgaagccggaaacccggctggagacggtcagccgcatcctgcgccatctgcgccccacttcggcgctggccttctgcaacacccgcgagcgctgcaaggaattggtgcgtgagctgcaggaacagggcttcaacgcgctgacgctgcacggagacctggaacagcgcgagcgcgaccagatcctgctgcgcttcgccaacaagagcgccaccgtgctggtggcgaccgacgtggcggcacgcggcctggacatcaaggaactggacgtggtgatcaacgtcgacgtcacccatgatccggaagtgcacatccaccgcatcggccgcaccggccgcggcgagcagcacggcctggcgctgaccctggccaccgacagcgaggccaagcgcctggtgcagatcgaaaactaccagcaggccgacctgacctgggccgacgtggaagagctgacacctgcgcccggcggcccgctgctgccgccgatggtgacgctggagatcgccggcggcaaacgcgaaaagctgcgcccgggcgacctgttgggcgcgctgaccggcgacgccggcttcgccggcagccagatcggcaagatcaatatcttcgaattcgcgagcttcgtcgcgctggaccgcgccatcgccgaacaagcgctggccaagctgtcgcaatgcaagatcaagggcaagcaattcaagatgcggctggtcggctga

SEQ ID NO: 2966 - DNA, 834 bp, Chromobacterium substugae
atgagtttgcaattgacccgcctgagcccggcgctgggcgcggtggtggaggggatagacctggcgcggccgttggacgacgagcagcgccgggcagtgaacgaggcgctgctgcgctaccaggtgctgtttttccgcggccaggacatcaccccgctgcagcagcgcaatttcgcggtgcgcttcggcgacctgcacacccacccgatctatccgcagcacccggaggcgcgcgagatcatggtgttggacaccgatgtggtggatttgcaggacaacgcgatctggcacaccgacgtcaccttcatcgaaaccccgccgctgggcggagtgctggcggcgcgcgagctgccggagctgggcggcgacacgctgtgggccagcggcatcgccgcctacgaagcgttgtcggccagcctgaaggccaggctggaaggcctgagcgcggtgcatgatttcgccaaatccttcccgctggcgcgctacggcgtcaccgacgaagaccgccgccgctgggacgagacgcggcgcaagcatccgccgatcagccacccgctggtgcgcatccacccggaaagcggccgccgggcgctgttcgtcagcgagggcttcaccgtcgcggtcaacgacctgccggaagccgagggccaggccttgctgcagttcctgttcgcccaccagtccaggccggagttttcgatacgctggcgctggcaggccggcgatgtggcgttctgggacaaccgctgcaccatccactacgcggtggacgactaccggccggcgcggcgggtgatgcaccgggcgacgatactgggcgaccggccgtactaa

SEQ ID NO: 2967 - DNA, 855 bp, Chromobacterium substugae
atgggcatgagcggcattgaaaccacggcggaggcggagttgttgtccgtttcctctcggatcgagggcagcccgaggcgggaacgcgagccctcccggctatggctgggcgttgccagcctggcattgctgctgggcggctggtggctgctggcgcacagcggctgggtgccggcgttgtttctgcccgcgccggaggcggtattgaacaagctgtttgtcgtcgccggccagggcttcatggacgccacgctgtggcagcacctggaggccagcctgcaacgcatcgcgctggcgctgatggcggcggcggcggtcggcgtgccgctgggcgcgctgatggggcgcagccggctggcacagggcttgcttgatcccatgctggaggcatatcgtccggtgccgccgctcgcctacctgccattgatcgtgatctggttcggcataggcgagctgtccaaggtgctgctgattttcctggccatcctggcgccggtggtcatcgccacccgccacggcgtggcccaagtcagccgcaaccggctgcgcgccgcgcaaagcctgggcgccagccgcgcgcagttgctgtggctggtggtgctgcccgaggcgctgccgcagatcctgaccggcatccgcattggtttgggcgcaggctggtccacgctggtggcggcggaactggtggcggccacgcgcgggctgggtttcatggtgcagtcggcggcgcagtttctggtcaccgatgtggtggtgctgggcatcctggtgatcgccgcggtggccttcgcgctggagctgggcctgcgggccttgcagcgccggctggcgccttggcatgggcaacaagactaa

SEQ ID NO: 2968 - DNA, 786 bp, Chromobacterium substugae
atggccgccctgatcgccgaccgggtgtcggtccgttatcccggccaggcgcaaccggcgctggacggggtgtcgctgaacgtggggccgggcgagctggcagtggcgctggggccgtcgggctgcggcaagaccaccttgctcaatctgttcgccggcttccagtttcccgattccggcagcgtgcgcttcggcggcgcgccggtaaccgggccgggcgcggagcgcgcggtggtgttccagcagcacgccttgctgccgtggctgaacgcgctggacaacgtcgccttcggcttgcgtctgcgcggcgtgccgcgcgccgagcgccgggagctggcacagaaggcgctggaacaggtggacctggccgaggccggcgcccgctacccctggcagctgtccggcgggcagaagcagcgcgtcggcatcgcccgcgccttggccggccgcgccggcacgctgctgatggacgagcctttcggcgcgctggacgccttcacccgcgagcagatgcaggagctgctgctcaaggtatgggcggagtccggcggcagcgtgtttctgatcacccacgacatcgaagaggcgctgttccttgccaccgagctggtgttgatgtcgccggggccgggccgcatcgtcaagacgctgcgcccgccgttcagccgccgctggcgcgccggcgacagcgcgcgggagatcaagtccgatccggaattcatcgcgctgagagaacaactgctggccgacgtgttcgcccagcgcagacaagaggcatgggcatga

SEQ ID NO: 2969 - DNA, 987 bp, Chromobacterium substugae
atggcgaaaccgcgcgcatttctcaaactgatcctttccgccgcattggccgtttcgggcgtcgctgcggcggcggatgccgtcaccgtcggctaccagaccggcatcgaccccaccaaggtgccgcaggccgacggcgcctatgagaaagccaccggcagccgcatcaactggcgcaagttcgacagcggcgccgacctgatcgccgcggtggcttcaggcgatgtggccatcggcaatatcggctccagcccgctggcggccgccgccagccgcggcctgccgatcgaaaccttcctggtggccgacgaaatcggctccgccgaggcgctggtggcgcgcaagggcagcggcatcgccaagccgcaggatctgatcggcaagaaggtggcggtgcctttcgtctccaccacccattacagcttgctggccgcgctgcaccactggggcgtggacccggccaaggtgaatatcctcaatctgcgccccggcgagatcgccgccgcctggcagcgcggcgacatcgacgccgcctacgtttgggacccggcgctgggcaagatcaagcccggcggcgcggtgctgaccagctcggccgaggtggccaagtggggggcgcccacctacgacatctgggtggtgcgcaaggacttcgccgccgcccatcccgagttcgtctcccgcttcgccaaggtgtcgctggacgccatcgccggctaccaggcgaatccgcaggccttcatcgccaacgccgccaatatcgccaagatcagccggctgaccggcgccgccgcgccggacgtggtggcggggctgaagggcaaccgcttcctcggccgcgacgaacaggccgcgctgctgcaatcgccgttcgtggcggcggtgggcaagaccgcggcctttctgaaggcgcagggcaaggtggaatcgctgcagccggattacggcccctacgtgaccaaccgcttcgtcaagacggcgcgctaa

SEQ ID NO: 2970 - DNA, 210 bp, Chromobacterium substugae
atggtctgcatagacgaggtatcggttagcgacatgttggcatctccgttttatcaaccaagagcatctgtcatcgcttacatcgacctcaaaccggtgctctactacaacggagcgggtatctaccaatggagcgatacgctggataagcaatgcctcagctactggcttacccacccagagctgccgccaggctgggagctgaactaa

SEQ ID NO: 2971 - DNA, 192 bp, Chromobacterium substugae
atggtgattgattttcagcgggcgagaagtcttagactggaaaacaaagacgactgccatgacgccatcgtgctgcttgcgggctatttcagcccagcagagatcagcaacgcagagattgagtgctacaaggttagccacgcggatatagccttgatccgcgatgccttcaagcgcgccgcgcccggctaa

SEQ ID NO: 2972 - DNA, 1617 bp, Chromobacterium substugae
atgacgattaccaagagactgctgttgaccaccgtgctggccctgctggcgatgctggccctgggcgtgcagggcttgtggaaacagcagcaggcgaacgaccgcttcgattacatgaagatcaacacttttcccagcatccacaccctggacgacgccaaggaggcgctggcggatgtgaggctgaccttggcgcgcagcgtcgcgctgtccgatccggcggccaagaaggcggagttcgccgcgctggccgatctggacaagcgttttgacgcggcgctggacaagtacgagaaggacctgatctcaaacgacgacgaccgcaagctgctgcaggtggaccgcgacgacatgaagctttaccgccagcagcgcgacaagtacctgcagctgctgcagggcagtaatgtggcggaggcggacaagctgatgaccggcgacatgtccaacgaggccaaggcgctgaaccaggcgctgatcgaccacatcgagttcaactacaagctcgccgaccaactgagcaaggacaacgacgcggcctatgccgccgcgtggtggcaatcggcgatattgatcggcctggccgtcgtgatatgcggctggctcagcggccatctgttcctcaacatccgcagcagcctggagcagacgctgagcaccatgcagtcggtgcggacttcgctggacttccgcctgcgcgcgccggtggcgaggatggacgagatcggcaagaccgccaccgccttcaatgagctgatggccaggctgcagcagagcttccaggagatccgcggcagcgtgaccgcgatggaggatgccatcgtccatatggccgactcctccggccacatcgcccatagttcggtgcagcagagcgaatcggcgtcggcgatggcggcggcggtggagcaggtgacggtcagcatcaaccacgtcgccgaccgtgcccgcgaggccaaccaccaggcgcgcgaggccggcgagatcgccgaccgcggcagccgggtggtgctgggcacggtggacggcatcagcgcggtggccgaatcggtgggcgaggcgtccgaccggataggcaagctgcgggaagacagcgtcaccatcgccacggtgctgggcgtgatcaaggacatagccgaccagaccaatcttctggcgctgaacgcggcgatcgaagcggcccgcgccggcgagatggggcgcggcttcgcggtggtggcggacgaggtgagaaagctggccgagcgcaccgccagttccaccaccgagatttccgcggtgatagacaagatgcagcaaggcacccaggcggcggtgaccggcatgcagcaggtggtggaccgggtcaaccaggaggcggagaaggcgcgcggggccagcgacgccatccagcagatcaagaccaattccgagcacagcacgctgttgatcggcgagatttccgacagcatcgtcgagcagggcagcgccagcaacaccatcgcgcagaaggtggagcagatcgcccagatggcggaagccaattccaaagcctcgtccgattcggccagttcggcgcagcagctgaaagagcaggccggccatatccagaagacggtggcgcagtaccaagtgtaa

SEQ ID NO: 2973 - DNA, 666 bp, Chromobacterium substugae
atgttcgccttcaccgaccggcagcgcctgtccgcgctggtccagctgtcgctgttccatatcgccatcatcgcttccagcaactacctggtgcagctgcctatcaccgtgttcggcttccacaccacctggggcgcgttcacctttccgttcatcttcctggccaccgacctgaccgtgcgcattttcggcgcgccgctggcccggcgcatcatcctggcggcgatggtgccggcgctgctcatctcctacctggtgtccacgctgttctaccagggcggatggcagggcatggcggcgctggagcagttcaacctgttcgtcgcccgcatcgccgccgccagcttcgccgcctacgcgctgggccagatcctggacgtgcaggtgttcaaccgcctgcgccagctcaaggcctggtgggtggcgccggccgccgcgatgttcctcggcaacatcagcgacacgctgtccttcttcttcatcgccttctacaagagcagcgacccgttcatggccgccaactgggtggagatcgccctggtggactacagcttcaaggtgctgatctgcatgctgttcttcctgcccatgtacggcgtggtgctgaaaatgatagtcaagcggctgctgcgcgccggcatcggcgaacagctgcagccggcctga

SEQ ID NO: 2974 - DNA, 399 bp, Chromobacterium substugae
atgactcaacgcagcaatctcgacatcgtccgcgccacttacgaaggcaagtcggaggacaacggccgcaacctgctggcggcgctggcgccggacgcggcgtggaccgaggcggcaggcttcccgtacgccggcacctatgtcggcccgcaggccatcgtcgaaaacgtgttccagcggctgggcagcgagtgggacggctaccgcgcggcggtggaccgctatttcgtcgacggcgacaacgtggtggcgcagggcttctaccacggcacttatcgcgctaccggcaaaagcttcagcgcgtccttcgcccatgtctacacgctgaagggcggcaagatcgtcaagttcgaacagatcgtcgacagcgccaaggtgtgggaggcgatgcggggctga

SEQ ID NO: 2975 - DNA, 189 bp, Chromobacterium substugae
gtgcgaagcctatcagagagcaggcgcgccgcggcgcgcgcgatccgcctagtatacggccggcgccgcgcgccggctgcggcggcatggaatatgaatatgccggtttggccgccggccaggcttgaattggcgcggtcttggctatatttgagaaccattcttgttttcctgaaggaagccccatga

SEQ ID NO: 2976 - DNA, 1035 bp, Chromobacterium substugae
atgatctcttccgccccgcgcctctccatgctggagctggcccccatcgtcgccggcggcgacgccgcccaggcgctgcaaaacagcgtgcggctggcgcagcacgtcgaacaactgggctacacccgcttctgggtggccgagcatcacaatatggccggcgtagccagctccgccaccgcggtgctgctgggccagatcgccgcccacacccaaagcatgcgggtcggctccggcggcatcatgctgcccaaccacgcgcccttggtggtggccgagcaattcggcacgctggccacgctgttccccggccgcatcgacctgggcctgggccgcgcgcccggcactgaccccctcaccgcccgcgcgctgcgccgcgaccgcttcgccggcgaagacttcccgcagcaagtggctgagctgcgcggctatctggcgccggcgcaggctggccagcaggtgcgcgccattcccggcatcggcaccgaggtgccgatatggattctgggctccagcctgttcggcgcgcagctggcggcgcagctgggcctgcccttcgctttcgccgcccacttcgccccggcccagctgggcgaggcgctgcaactgtatcgccacctgttccagccatccgccgccctggccaagccatacgcgatggtatgcatcccggcgctggcggccgacagcgacgaaaaagcccgccgcctcgccaccaccccgtaccagaaattcctcaacctgatccgcggcgaccgccagccgctgcccgcgccggtggacagcatggacggcctgtggaatccgcgcgaggaattctccgtgcgccacgaatggctgggcgcggcggtgttcggcggaccggcgacggtgaaggccgggctgcaaaaactgctggacgagaccggcgccgacgaaatcatgctgtcggtcgattgccacgatttctccgaccgcctgcgctgctgcgagatcgtcgccgacatcctgccgcagctgaaaaccgcgcaggccgcgcccgccgccgcgaattga

SEQ ID NO: 2977 - DNA, 690 bp, Chromobacterium substugae
atgaaatcgtatggcgcggagtttctgggcactttctggctggtgctgggcggctgcggcagcgcggtgctggcggcggcgtttcccggcctgggcataggcttcgccggggtggcgctggctttcggcctgacagtggtgacgatggcctacgcgatcggccacatttccggctgccatctgaacccggcggtgtcggtcggcctgtgggccggcgggcgctttcccgccgggcagctggcgccgtacatcgcggcgcaggtgctgggcggcatcgccgcggcggcggtgctgtacgcgatcgccagcggcgcggccggcttcgacgtggccaagggcttcgcttccaacggctacgccgagcactcgccgggcggctactcgctggcggccgcgctggtgtgcgaggtggtgatgaccctgtttttcctgctggtgatcatgggcgccaccgacaagcgcgcgccggcgggcttcgcgcctttggcgataggtctggcgctgaccttgatccacctgatcagcatcccggtcaccaatacctcggtcaacccggcgcgcagcaccggcgtggccttgttcgtcggcggctgggcggtgcagcagctgtggctgttctggctggcgccgattatcggcgcggtgctgggcgcgagggtgtaccggctgatcgccggagagtccgattaa

SEQ ID NO: 2978 - DNA, 567 bp, Chromobacterium substugae
atggaaggaatgcttgcaggcctgctcgccgcgctggctttgccgaaagtcggtttgcccgccattttcgcagtcagcctgatctccgccacgctgctgccgctgggctccgagcccgcggtgttcgcttatatcaagctcaggccagacatgttctggcaggtgatggccgtcgccacgctgggcaacaccctgggcggcatgatcgactggtggatgggctacggcgccaaggtcggattgctgcgctaccgccagcgccgcagccaccacatgcatggccattcccacgccaagccggacggacggccgccgcgcgcgcgcaagcccgcgctgaacccgcgctatttccgctggatgcgccgccgcggcgcgcccatcctgctgctatcctggctgccgggcatcggcgacccgctctgcacgctggccggctggctgcgcatcccgttctggccctgcgtctgctacatggcgatcggcaaattcctgcgttacctggcggccacctccgccctgctgtggattccggacgatttctggcgcgacctggcccaatggctttga

SEQ ID NO: 2979 - DNA, 1401 bp, Chromobacterium substugae
atggcaatcagcgttttcgacctgttcaaaatcggcatcggcccatccagctcccataccgtgggcccgatgcgcgccgcccgccaattcatcgcccgcctggagaaggatggcctgctggacgccgccacccgcgtccaatccgagatgttcggctcgctgggcgccaccggcaagggccacggcaccgatgtggcggtactgctgggcctgcagggcgaacaacctgacctggtcgacaccgacgccgtggacggcatgctggccgccatccgcgagcagcgcaagctgaagctgctgggcaagcatgagatcgacttcatcgaagccgagcacctggtgctgcacaagaagaaaacactgccctatcaccccaacggcatgatcttcgaagccttcgacgccgccggcaacagcctgtccaagcgcgcctactattcggtgggcggcggcttcgtggtggacgaggcggccatcgacgccggcttcgtcccgccgggcgtcaccgagctgaagcacccgttcaagagcgcggcggaactgctggcgctgtgccagcgccacggcaagagcatcagccagatcatgctggaaaacgaactgtcctggcgcagcgaggaagaagtgcgcgccggcctgctcaacatctggaacgtgatgcaggcctgcgtgaagcgcggctgcgagcgcgaaggcattctgcccggcggcatgaaggtgaagcgccgcgccgccgacatgcaccgcaaactgctggcgtcgccggaagccgcgatgcgcgacccgctgacggtgatggactgggtcaacctgtacgcgctggcggtgaatgaagaaaacgccgccggcggccgcgtggtgaccgccccgaccaacggcgccgccggcatcatcccggcggtgatgcactactacgcccgcttcgtgccgggcgccagcgacgatggcatcgtccgcttcctgctgaccgccggcgcgatcggcatcctgttcaagctgaacgcctccatctccggcgccgaagtcggttgccagggagaagtgggctccgcctgctcgatggcggccggcgccttgtgcgaagtgatgggcggcacgcctgagcaagtggaaaacgccgccgagatcggcatggagcataatctgggcctgacctgcgacccggtgggcggcctggtgcaagtgccctgcatcgaacgcaacgcgatggcgtcggtgaaagccatcaacgcggtgcggatggcgctgcgcggcgacggccagcatttcgtgtcgctggaccgcgtgatcaagaccatgcgcgacaccggcatggacatgagcaccaagtacaaggaaaccgcgcgcggcggcttggcgatcaacgtgatcgaagtgccggtcaacatcgtcgagtgctga

SEQ ID NO: 2980 - DNA, 534 bp, Chromobacterium substugae
gtgcacgcacttgaaatagaaacgccccgcctgcgcctgcgcccgctcctggagcgggacgacgccttcatcctggaattgctgaacgaacccgccttcctcgccaatatcggcgacaaggacgtgcgcgatctggccggcgcgcgcaactacatagaaaaaggcccgcaggccagctaccagcagcacggccatggcctgctgctggtcgaactgcaagccggcgccgttcccgtcggcatctgcggcctggtcaagcgcgacagcctgccccaccccgacatcggctacgcctttctgcagcgccactggggccgcggctacgccagcgaggccggcgccgcctgcctggctcacggccgcgagcggctgaacatagactacgtggtgggcatcaccgcgccgggcaatctgggctccatccgcgtgctggaaaagctgggcctgcaatacgaccgcacgctggcgctgcccggcatcaacggccccagcctctactacgttcccgccggccgcggcgagaaacccgcctga

SEQ ID NO: 2981 - DNA, 1881 bp, Chromobacterium substugae
atggcttggtctgtggctgatagccggagcctgtacggcatccggcattggggggctggttatttcgacgtcggagacagcggcaatatcgtcgtgcgtcccaatgtccgccagcaaaaggaaatcgatctgtaccggctggtgcacgagctgggcgccaagggactggatctgccgctgctggtgcgtttccccgacattctgcaagaccgcgtcagccggctgtgcggcgcgttcgacaaggccatcgccgagcaaggctatggcaaccgctacaccgccatctatccgatcaaggtcaaccagcaagaagcggtggtcaagagcatcatcgccacgcaggaagtttccattggtttggaagccggctccaagcctgagctgatggcggtgctggcgctggcgcccaagggctgcaccatcgtctgcaacggctacaaggaccgcgaattcatccgcctcgcgctgatcggcgagcgcctgggccaccaggtgttcatcgtcatcgagaaggaatccgaagtcgagctggtgatcgaggagtcgaagaagctcggcgtgcgccccaatctgggcctgcgcgtacgcctgtcgtcgctggcctccagcaaatggtcggacaccggcggcgagaagggcaagttcggcctgtccgccggccagctgatctccgcggtggacaagctgaccgcggccggcatggccgactgcgtgcgcctgatgcacttccacatgggttcgcagatcgccaatatcgccgactaccggctgggattccgcgaagccatccgctacttcgccgaactgcgcgcgctgggcctgccggtcgaccatgtcgacgtcggcggcggcctgggcgtcgactacgacggcacccactcgcgcaacgacagctcgatcaactacgacatggacgaatacgctcacgtgatcgtctccatgctgtcggagttctgcgccgagaacggcattccgcacccgcgcatcctgtccgaatccggccgcgcgatgaccgcgcaccacgcggtgctgctgatgaatgtcaccgatgtcgagcgcctgcctgacaccgtgtccaagatcgacaacgtggaagcgctgtcgctgccgttgcgcaagctgttggagctggccagcctcaacgatgaagagctggtcactgaaatctactaccgcgccagccattgcgtgtcggaagtgagcgacatgtacgcggaaggccggttgtcgctgaaggaaaaggcgctggctgaggaagtccacgccacgctgtgccgccgtctgcacacccagctgcaagccagccagcgttcgcagcgccaggtgtacgacgagctgaccgaccgcctggccgacaagtacttctgcaacttctcggtattccagagcctgccggacacctgggccatcgatcaggtgctgcccatcatgccgctgcaccggctggccgagcagccgacccgccgcgcggtgctgcaggacctaacctgcgactccgacggcaagctcaagcactacgtcgatcagcagagcatcgagaacagcatgtcggtgcatgaggtgaagcagggcgaagagtacctgatcgcggtgttcctggtgggcgcctaccaggaaatcctgggcgacatgcacaatctgttcggcgataccgattcggtcaacgtttacgtgcgccaaggcggcgagctggagttctccggtgtggaagagcatgacaccatcgaggacatgctgcgctacgtgcacctgtcgccggaagacctgctcaaccgctacgaagccaagacccgcgagtgtgatctcagcgccgaggagcgcagccagttcttcgccgagttctgccgcggcctgaagcagtcgtcctacctgtcggtctga

SEQ ID NO: 2982 - DNA, 996 bp, Chromobacterium substugae
atgacccaagccagccgctttctgcaacacgcgctccatcccgacgccggcgccgacgcgtcctggccgctgccttccggcctgcaggcgcgctgggttgccgccggctgcgtcgaaatagacccgggcctgccccaggccgattcggtattgctaagctgcggcgtgcacggcaacgaaaccgcccccatcgaagtggccgacgccatcctggccgacatcgccgacggcacgctggccctggattgccggctgctggtgatgttcgccaatatcgaagccattcgcgccggcgagcgctacctcggctatgacatgaaccggctgttcaacggcgcccatgccaaacacgccgacctggccgagtcccggcgcgccgccgagctggaagtcctggcaggacgcttcttcgcccaggcccgggcccgcaagctgcactacgacctgcataccgccatccgcggttcggcgttcgagaaattcgccatctacccgtacttgcacgaacgcgtccataaccgccaacagctggcctggctgcagcaaagcgggatagaggcggtgctgctgcacagccagccagccaacacgttcagctaccataccagccgccgcttcgaggccgacgccttcactctggagctgggcaaggcgcggccattcggccaaaacgatctggcgcgcttcgccggcatagatcaggcgctgcgccgcttgctgtccgcgccggccagcggcgtccccgccctccagcccgacgcgctgccgctgttccgcgccaagtacgatctggtcaagcgcagcgagcatttccgcctgcacctggccgacgacgtggagaatttcacccggctgccggacggcatgctgatcgccgaagatggcgatacccgctatctggcgaccggcggcgaagagcggatcctgttccccaatcccgcggtcaagcccggcctgcgcgccggcatcgtggtggagccggcgcggctggattga

SEQ ID NO: 2983 - DNA, 936 bp, Chromobacterium substugae
atgcgcatcagttcagcgactttataccagtccggcatagataatatgtccaacctgcaagcccagttggtgcaggtcaatatgcagatcgacaaccagaagcgggtggtgacccccgccgacgatccggtggcatccgcgcgcatcgagttgctgaatacctccagcggccagaacagccagtacaagaccaatacccagtcggtgcagtcctggctgtccttgtcggacaccaccatcaacagcgcgatcaatctgatgaacgcgatgaagagccaatcgatctacgctggcgacggctctctgtcccctacccagctgcaggcgatccagcaaacggtgaaagaggggatttccgaactgaccggctacgccaacgccaccgacggcaacggcagctatctgttcagcggcaaccaggtgaccacggtgccgttcaccgtcaacatggcatcgtcgccgccgaccgcgacctataacggcgacagcggccagcgcagcgtgcaggtggccgcgtcccgcatcatgaccatttccgatccgggcaatgccattttcggcacgcccggcaccggcggcagcgccaccggcgcgttcgactccctgatcaacctgtacaacctgttggggcagaatcccaagccggccaactatcagacccagctgaacgcgatcaccaaccagatcaccagcgccacgcagcagatgaccaccagcctggcgtcggtcggcgcgcgcgaacaggaaaacgccaatctgcaggggatgagcagcagcttggacttgcaatacaacaccagcatcggcgatttgcagaacctggacatggcgcaggcgatctccaccttcaccatgactcagacctcgctgcagtacacgcagaaaacctacgcccaggtgtcgcagctgtcgctgttcaactacatttccggctga

SEQ ID NO: 2984 - DNA, 1803 bp, Chromobacterium substugae
atggcaatcgtcggagctgatattttcggcataggcctgagtgggctgaatgcggcgcaaaacgcgttgtcggtgaccagcaacaacatctccaacgcgtccactccgggctacaacgtcgagtacatcacgcaagcgggacgccagccgcagaatgtcggcttcggcttcctggggcagggcgtggacgtcaccaacgtgctgcgcacctatagccagtatctggccggccaagtgcagagcgcgcagaccggcagcagctattacaccactcagctgcagcagttgaaccagatcaacaacatgatcggcaactccacccagagtccgaatccggcgatccagtccttcttcggcgcgatgcaaaccttgtcgcagcagccttcgtcgctgcctacccggcagaacgtgctgagcatggggcaggcgatggcggcctccatcacttcgctgaacagccagctggtgcagctgcagcaaggcgtcaacggccaggttcagaccgcggtgcaaagcatcaatgcgctggctcaacaaatcgccaatctgaacaagcagatcggcgcggccaccggcggcaacacccaggcgccgcaacccaacactctgctggatcagcgcgatcaggcattgctgcagctgaaccagatgataggcgccaccgcctcggtgcagagcgacggctcctacacggtttccatcggcagcggccagaccctggtgaccggcggcacggtgaaccagctggccacccaggccgacccgaacaatcccagcaatctgcaggtgggcttcaccaatccgaacaacaccctgaccattctgcccgacaccatcctcaacagcgggcagctgggcggcttgctgaacttccgcgacggggcgctggcgcagacgcagaaccagctgggcaccatggcgatcgatttcgccgcggcgatgaattaccagaattcgctgggagtggattacaacggccagccgggcgggcccatcttcaaggacctgtccgcctacgccagcaatccgcagtatgccgccgggcagttccaggtgacgatgggcgatcccaagctgctggccaccgcctccaacctggttgccaccggcaccgccggcaatcccagcggcgtgacgatgagcgcggtgtggtccagtctgccgggcacttacgccaccagcatcaatggcacgccgccgtcgtttccggccaccaccagccacccgtccagcggcctgaccaatatgaccatcaccgcgtcggcggcgccggtgtcgatgaccgccaccatcgccgggaccaacggcggcggaccgtacaacgtggtgccggtcaccggccagcccaacgcctacaagctgcaaaccacggcgacaccgccggtggacgtgggcataggcttccagctgtccggatcgcctgacccgggccagaccttcacggtggggccgaagccgattccggcggtcgggactgtcacgccgccgtccggcgacaacagcaatctgctgcagctgaccgcgcaacagaacatcgcgctggtgaatggacagtcgtaccagacttatttcacctctacggtcaccacggtggccaaccagacttacgcggtaggcctgcagaacacgtcggcgcagaacacgctgcaacaggctacccgggccaattccaacttgactggtgtcaatctggaccaggaggccgccaatctgatcaaataccagcagtcctatcaggcctgcagcaaggtgatccagattgcgcagagcaccttttccagcattctcaacatcatgtcctga

SEQ ID NO: 2985 - DNA, 963 bp, Chromobacterium substugae
atgaccgccaaattccaagccgtcgcgccgcaggacgcgcttagccgccagctcgcgatcgaccccagccacatgcgcagcctgaaggccaaggccagcagcgaccccaaagccgcggcgcgcgaaaccgcgtcgcagttcgaggcgctgttgatgaacaccatgctgaaaaccatgcgcgagaccaagttcgacgattcggaagagtcgaacggcatggatacctatcgcagcatggcggaccagcagatggtgcaggcgatgagcgccaacggcggcctgggcctgggcgacatgatttaccgccagatcgccaggcaatccggcttcagccccgacgaaggccagacgcacgcgttgaacagccgcccggtcgccggccagtggtcgccggttcagcccatcggccagcgcatgcagcaagcttaccgcagcgcccagggcgcatccggcgcggccgtggcggactcgccgacggctgccacgccggtcggcggcggccgcgccttcgccagcagcctgctgccgcatgcccgcgccgcggcgcagcagctgggagtggcgccggagtgcgtggtggcgcatgcggcgctggaaagcggctggggcaagcgcgccatccgcaacagcgacggctcggacagccataatcttttcggcatcaaggcgggttccgactggcagggcaagaccaccactatcatgactaccgaatacagcggcggcgtagcgcaaaagcggatggaaaccttccgttcctacgactcctacgccgatgcgttcagcgattacgccaaggtgctcaaaggctcgtcgcgctacaagaacgtgttgaaccaggggcagaacatgtacggtttcgcgcagggcctgcagtcgggcggctatgccaccgatccgcgctacgcgcgcaaactggtggatgtcgccgccagcctggcgcaacaagtggccaaaacttga

SEQ ID NO: 2986 - DNA, 1101 bp, Chromobacterium substugae
atgatgaagaaatggatcgtgctggcctgtctgttgctggcgtccctgccggccttgtcggcgcagcgcttgaaggatatcgccaatatcggcggcgtgcggcccaaccagttgataggctacggcctggtggtcggcctggacggcagtggcgacaaggtcacttcctcgccgttcaccggccaggcgatgatcaatatgctcaatcagcttggcgtgcaggtgccgcccggcaccaagatagacccgaagaacgtggcggcggtgtcgctgaccgccacgctgccggccttctccaagcgcgggcagatgatagacgtgacggcgtcgtcgataggcgacgccaagagcctgcgcggcggcactttgctgttgtcgccgctgaagggcgccgacggccagatctatgcgatggcccagggcaatgtggtggtcggcggcgcgggcgcgtccgccggcggcagctccactcagatcaaccagttgagcgtgggccgaattccggccggcgccacggtggagcgcgaggtgcaaaccgcgctgggcgacggcgaattcatccatctggagctgcaggaggcggatttcaccaccgccaaccgcgcggtgcaggcgatcaacaaaaccttcggtgccgacaccgcccgcgcggtggatggccggctgatcgaagtgagggcgccgttcgacagcaaccagcgggtgcaattcctgtcgcggatggaaaatattgccgtcgacccggcagatgtttcccctctggtcatcatcaacgcccgcaccggctccatcgtgatgaaccaggcggtgacgctgtcgtcctgcgcggtgtcgcacggcaacctgtcggtgacggtcaccaacacgccgcaagtcagccagcccaactcgctctcaggcggcaagaccacggtcaccaatcaggcggatatcgtgatcaacagcaccggcggcaaggtggtgggcctgaaggggggcgccaatctgtcgcaggtggtcaacgcgctcaatgcgctgggggcgacgccgcaagacctgatttccattctgcaggcgatgaaatcggccggctcgctgaaggcggacctgcaaatcatctga

SEQ ID NO: 2987 - DNA, 684 bp, Chromobacterium substugae
atgaaaaccaatctggtgatgctggccgtggcgctgttggcgctggcgggctgtgcggtgcaggaaccgccgctggtgcagacgccgacgacggcgaagccgcagccgcgggcgatgggcattcccgccaatggcgccattttccaggcggccagctatcggccgctgttccaggacggcatgccggtccaggtgggtgacaccttgcaggtgatgatccaggaaaactcctcgacttcggcgtccgagcagaccaccgacacccggacttcggcgctaacgtccaacatcaccgccggcgtcaagataccgttcctgccaagcggcctggccggcggcctgggcggcaccaacttcaacagctccggctcggccaacaataccggcaagggcaacaaccaggtggccaccagcttcgtcagctccatcactgtcactgtgatcgacgtgctggccaacggcaatctggaggtcagcggcgagaagcaggtgcggatcaacagcgataccgaatccatccgcctgtccggcgtggtcaatccgcgcgacatcgcgccggaccgcaccgtgtcctcgctgaagatagccgacgcgcgcgtcgaacagcagaccaagggcaacaaccgcctatacaatgagccgggttggttgtcgaagattttcatgtcgctgctgccgatctga

SEQ ID NO: 2988 - DNA, 783 bp, Chromobacterium substugae
atgatgcgcgcactgtatatcgccaagaccggcatggacgccagccagtttcagctggacgtggtgtccaacaacctggccaacgtcaacaccataggcttcaagggcagccgcggcgtgttcgaggatctgtactaccagacgctgcgccagccgggcggccagctggccaatggcaataccaatcccaccggcctgcagatcggcaccggcgcggcggcggtggcttcgtcgcgcattttcagccagggcagtccgcagcaaaccggccagccgctggatctggaaatcgacggcgacggtttcttccgcatcctgcagccggacggcaccaccgcctacacccgcaacggccagttccagcgcaactcgaacggcgacgtggtcaatccggacggcctgccgctgaatcccaacatcaatatcccggccaccgcgcagcagatcacggtgtccagcgccggggtggtgcagtacacgctggccggcgccaccgcgccgcagaccgccggcaccatccagctgacgactttcatcaatccgcagggcctgcaaagcttgggcagcaacctgtatctgcagaccgccgcttccggcgatccgcaggacggcaatccgcaaaccgacagccgcggcgcgatcaagtccggttttctggagtcgtccaacgtcaatgtgactgaagaactggtcaatatgatcactgcccagcgttcgttcgaaatgaactcgcgcgcggtgaccaccgccgaccagatgctgcagaaactgagcaatatgtaa

SEQ ID NO: 2989 - DNA, 732 bp, Chromobacterium substugae
ttgtttctggccatgaccggcgccaagcatgaaatgtggcagcaggccaccaccgccaacaacctggccaacgtcaacaccaacgccttcaaggcggacttggcggcgttccgggcgctgccggtggtgggggacggcgcgccgacgcgcacctacgtggtggacaacaccataggcttcgacgccagccagggcagcctgcagcacaccggcaacccggctgatttcgcgctgggctcgcccggctttttcgcggtgcaggggccggacgggcaggaggcttatacccgcgacggcggctatgcgctggacgccaacggcctgatgcgcacccgcaccggcctgcccatcatgggcgacggcggcccgatcacggtgccggccggctcgcaggtgcagctgggcgcggacggttcggtgctggccattccgctgtccggaaccaaccgcaccccgcagctggtgggccagatcaagatgatcaatcctggccccaaagacatgtacaagggcgaagaccggctgtatcacgtcaacggcggcggcaccgctccggccagcgccgacgtgaagctggtgccggagacgctggaatcgtccaacgtcaactcggtggacgcgctggtgcagatgatttcgcacggccgccagtacgaactcaatatcaaaatgatgcagaccgcccagcaggatgaccagcaggcggcgcaattgttgtcggtcaccagctga

SEQ ID NO: 2990 - DNA, 1239 bp, Chromobacterium substugae
atgggctttcagcaaggcttgagtggtctgaacgcagcgtccacgcagctggacaccataggcaacaacgtcgccaacgccaataccgtcggcttcaagagttcgcgtaccgaattcgccgacttgtacggcaacagcctgtacggcatgacttccaccacgccgggcatcggcactcaggtgtcggcggtgacgcagaatatgggcagcggcaatctggagactaccggccgcagcctggacttggctatcaataactctggcttcttcatcatgggcctgcccaacggcacccaggcctacagccgcaacggccagttccaggtgaacaaccagggctacatcgttagcaccgccggcaactacctgcaaggctggaccgccaacgcgcaaggcgcgatctcgcaggggccggtcggcaatctgcaactgaccaatacctccattccgccgacggccaccagcaagatgaatatggcggtgctgctgaattccgcgtccacgccgccgaccaccgcgccgatcaacaatccggcgcagccgtcgtcctacaactggaccaataaccagacggtgtatgacagcctgggcaattcgcaccagatgacgttctattactcgctgaatacgccggtggccggcgcgggcaatacctggacggtgaacgcctatgtcgacggcgcggcggcgacggcgcccagcaccttcacgctgagcttcgacaccaacggcaacctgaccaccaacacgccgttcaatgtgaccttcacgccgccttcggccaacggctccgcggcgccgcagaccgtggcggtgaatttcgcgcattccacccagatcgcgcagaacttcttcaccagcccggtgacccaggacggctccgccccgggcacgctgcagaccatcaatatttccgccaacggtttgatccaggctagcttctccaatagccagaccaaaaccatcggtcaggtggcgctcgccaacttcatcaatccgcagggcctgcaagacaccggcggcaatctgtggacgcagaccggcacctccggtccggccaccgtcaacgcgccgggctccggcaataccggcacgctgtcggccggccaggtggaggactccaacgtcaatctgaccaacgaactggtgaacatgatcaccgcgcagcgctactaccaggccaacgcgcagaccgtgaaaacccaggacaccctgattcagaccctgctgaacatctaa

SEQ ID NO: 2991 - DNA, 732 bp, Chromobacterium substugae
atggcctccgctaccagtgcaacctccccgttcaactacaactcgctgaacaaccagcccgctccgggcagcacttccgtccaggcggccaacggctcgtccaccggcagcggcaccgcggccgccagcgcccaatccctgcagaacaacttcctcaccctgctgaccgcgcagttgaacgcgcaggatccgctcaatccgatggacaacagccagttgaccagccagatggcccagatcagtcaggtctcgggcctgcagacgctgaaccagaccatgcagcagctggtgacggcgcagaactccacccagtcgctgatggcctccagcatgataggcaagaacgtgatggtggcgggcaacgccctcaccgcgccggcggcgggcaagaccgtgcaggccggcgtggtgctgagcggcccggccgcgtcggtgaccatcagcgtgctggacaagaacggcaacgtggtggattcggttccgctgaccaatccgggcgccgggctgaacactttcagctgggatggcaccgattccaataagaacccgctgccggccggcaattacacctttaccgccaaggtcacccaggccagcgccggcggcaccaccaccgccaccgcctacagcaaccagcaggtgaaggccgtgtcctgggcgcaaggcacgccgatgctggtgctgtccggcaatacgcaggttccgttgtccagtgttgcgcagatgtcctga

SEQ ID NO: 2992 - DNA, 411 bp, Chromobacterium substugae
atgtctctgtcgaatctgttcaatatctccggctcggcgctgtcggcgcagtcgatgcggctcaacgtggtggccagcaacctcgccaacgcggaaagcgccaccagctccaccggtcagccctacaagggcaggcatgtggtgttcaccgcggtgccggtggacgcggcgcagccgcaggtggccggcgtgagagtcacttcggtggttgaggatcaatcgccgccgcggctgaagtacgagccgggcaacccgctggcggacgagcgcggctatgtgaccatgcccaacgtcaatccggtggaagagatggccgacatgatcgccgcttcgcgggcctatcagaacaatgtcgaaatgatgaacaccgccaagagtctgctgcagaaaaccctgcagctgggtcagtaa

SEQ ID NO: 2993 - DNA, 414 bp, Chromobacterium substugae
atgctagacaagattgcccactatttcgatttccagcagcgcgcgctgaatctgcaggcctatcgcgccgaggtgataggcagcaacatcgccaatgcggaaaccccgtactacaaggcggtggatttcgatttcaaggcagccttgcaggcgcagcaggacaaacagggcaaactggccatggcggtgaccgatccgcgccacctcgccagcgaggccggcggcgtcaacgccaacgtgccgatgcagtaccgcaatgcggtgcagcccagcctggacggcaacacggtggacatggacgtcgagcgcggcgccttcgccgacaacgccttgcagtaccagaccacgctgaccttcctcggtaagcgcatcagcagtctgaattcggccattcaaggttccgggagtggttag

SEQ ID NO: 2994 - DNA, 798 bp, Chromobacterium substugae
atgctggctctagaacaattactgatctccctggccgagccctcgccggtccaggcccagatcatcaccaaggcgctggaggcgctgggcgccgcccagatcgaaatccacccgaacggcgaagagttgatccagcaggcgcgcgagcgcatgcccaatctggtgatcagcgcctaccacctgccggacatgaccggcagccagctggtgcagacgctgcgcgacagccatgacctgtacgacgtccctttcatcctgatctccagcgaaaccaagcaggagcggctggagtccatccgccaggccggcagtttggccatcctgcccaaaccgttcagcgaagaagagctgcacgccgccatgcaatcggtgatgagcttcatcaactgcgacagcctgggcgcggaagtggacgccgacatggcgctgatgaacgtgctgatcatcgatgacagcagcacctcgcgccaccacatccgccaggtgctggagaagctgggcttcgaacacttttgcgagagcagcggcggcgagcgggcgttgcagctgatagagcaggaggcgttccagctgatcatcaccgactatcacatgccgcagatagacggcatggagctggcgcggcgcatccgcgccagcggcacgcaggaaggcgcgcccatcctgatgatcaccagcgacagcgagcatgtcggacaggccgaactggaagacgccggcatcgccgcctgctgtagcaaacccttcgacatcgacaagctgcgcgaactggtccgccggctgctcaacgaatattag

SEQ ID NO: 2995 - DNA, 828 bp, Chromobacterium substugae
atggagtatgccgtgcagcgctacgcggccacccggccttgggccaagcgggtgggccagctatatgtccaggcagcgcaggtcgccgaggcgagggcgcagatgaaggatgtgatccggcgtgagctggagcgcgcggcgcaggtattcgagattccgcagtcggcgataggctgcgagctggcgctggccgaggcctgggggcatttcgtccgccagggccgggtggtgtcgcatttgcgggacgcgctggcgctggcgctggggcagacccggcagccgggcaatctgccggatacgctggccttgccggccgaggcgttcttcctgcatgtgccgggcgagggcggggcctttgtcgcgcaccagccggagcggcgcgccttgctgctgaccctggtgcggatgggtttcgcgccggacggcgtcaactggctgcaggccgccgatcaggtggaggtggtccgggtggagtatccgggcgagctggcgccgcaattggccgaggtgggcgagacatggcatggcctgttggcggcggtgctcaatggcctggcgatgatgacccagcccaagctggagcgggtgaagggttgggaagccggggcgccggccgaatgggtggccgccgccgggcatccgacctgcgccaagacccggcaaaaggcgcgtagccagctgctgaaagccggcttcggcgaaatcactttctgcgaggcggcggatctggctgccggagcggactattccagccagggttactggcgccggcaggcgctgggcggcgacaagggccattcgcgcctggtgtgggtggcgccgcgctga

SEQ ID NO: 2996 - DNA, 1524 bp, Chromobacterium substugae
gtgtacggcctgtcgatggccggcagcgccgcgctggccatggccgcgctattggcgctgcagtggtgggcggcggacgccgaattgtcggcgcgcgcgcagtggctggcgcggcagttggcggcagagctggcgccggccggcgcggcgctgccgagagcgggcgcggtggcgatcgatgcgcccgcctgcctgtccgcgcgcgcggcattgacatcgctggtccagcagacgccgcatgcgcgctacgcgatccgccgcctgcccgatggccgctggtgcggatcggaccaggcccgctccgacgcgctgtccggcgagcggccgctggagtgggcgcgctccggcgcgggggcggcgacgctggtgctgcgcggcggcatggcggcgctggagctggaaaccggctggctgcgggcgctgctgtcgcaagcgcgcgaggcgggagtggatctgcaggtgaggctggagggcgggcgcttgtccgccgacggcgccatcgtgcccgcgggcgggcatcccggcgaggcggcgttcccggtggcgaacctggcggcggacatggcggtggcgggaagcgtcgacgtctgggccttcgccagccgcagctgggcggcgagcctggaggcgctgctgctgtcgctgctggcgggaggcatgctggccgcgtggctgttgcgcggcgccggagtgcgcaatgccagcgattgggaaatcctggaggggatacgccaccaggagttcttcgcccattaccaacccatcgtcaccgcggccagcggcgagtgcgtcggggtggaaatgctggcgcgctggcgtcatccggtgcagggcaatgtccgttccgacttgttcatccagaccgcgatagacgccggcctgatcgtgccgctcacccgctacctgctgaagcgggtggccggcgagctgcgccaggtggtgctgccgccgggcttcatggtgggcatcaatatcgccagcgagcacttgtccatgccggagctggtcaacgattgccgcgaaatgctggacatgctgaacgaaaagcaggcggtgctggtgctggaggtgtcagagcagacgccgctgcgcgaggcgtcgggcgcgctggacgtgattcgtgagttgcgcctgctgggcgtgaagctggcgttggacgatttcggtgccggctatgccgacaaggcttatctgcagcgctggggcttcgattacctgaaggtggagaaaggcttcgtttcggcgctggggcaggagtgcctgcgcggcaatgtgctggacgggctgccgctgtcatccgaggagatgggcgtgcgggtgatcgtcaagggcgtggagacgcaggggcagcaaagctatctgaacgtgaagggtttcgagctgctgcagggcttctatttcggcaagccgatgacgctcaatcattttcgccagtggctgtattccggcattgtcgaggaccggcgccacgcccagcgccgctcgccgacggggcggcgcgcatcggaccggggcggcggctag

SEQ ID NO: 2997 - DNA, 1329 bp, Chromobacterium substugae
atgaacttttccgatctgggcatcgccccgaccatcctgcgcgctctggaagctgccggctacacctccccgacctcggttcaagccgaagccgttccggccgccatcgctggccgcgacctgctggtttccgctcaaaccggcagcggcaagaccgccgccttcctgctgcccgcgctgaccaagctgtcggaacgctccaccggcaagggccaaggcccgcgcgtgctggtgctgaccccgacccgcgaactggcgcagcaagttgagaagaacgcgctggaatatggcaaggacctgcgctggatgaagaccgcctgcctggtgggcggctcctccttcggcttccagattcgcgccctgtcccgcccgatcgatctgatcgtggccactccgggccgcctgatggaccacatgcgctctggccgcatcgacttctcccgcctggaaatgctggtgctggacgaagccgaccgcatgctggacatgggcttcatcgacgatatcgaagccatcgtcaaggctacgccggaaacccgtcaaaccgtgctgttctccgccacgctggacggcatcgtcggccgcatggctgaaaaaatgacccgcgatccgcagcgcatcgagatcgcccgcaccgaaacctcgggcggcaccatcgaagagcacctgctgtacgcggacgacctgaaccacaagcatcgcctgctggatcacatcctgaaggaatccggcttcgaccagtgcgtgatcttctccgccaccaaggcgtataccgaagagctggccgacaagctggccgaccagggctattccgccgcctgcctgcacggcgacatgccgcaaagctggcgcaaccgcaccctgaacgacctgcgccgcggccgcatcaaggtattggttgccactgacgtggccgcccgcggcatcgacgtgccgaccatcacccacgtggtgaacttcgacctgccgaagcaagctgaagactacgtgcaccgcatcggccgtaccggccgcgccggccgcgacggcaccgccatcactctggcggaagcgaaagagtcgcacaaggtgcgccgcatcgagcaatacctgaagcgttccatcaccgaaggcgtgatcgaaggcatggagccgacccgtcgtccgtccaagggcggcccgcgccgcaacggcaagccgggcggctacggcgatcgtcgcaacggcggctaccaaggccagcgtcgcgaaggcggctaccaaggccagcgtcgcgaaggcggctaccagggccaacgccgcgaaggcggctaccaaggcaaccgcggtccgcgcaccagcgcgcagtaa

SEQ ID NO: 2998 - DNA, 588 bp, Chromobacterium substugae
atgaacggatggaaaatggcggcgctggcggcggcggcgggctggagcatggctgcctcggcggggataaacgattgcggcaccacttacgcggtgatcaacagcggtttcgacatgcgcggcaccaatggctcgatcaactacatcggcgccagcacgcctaatcagctgatgatttccggcaatgtgaacggcatgcaggtgacccgctacatcgatttggtgggcttcaccgtcagcggcagctggggcaacctggccggagcggcctggccgggcggcggcatcaccagcttggtgatcaacggcaaggaaatggacatcagcggttggtcgcacctgccgggccaaggggcgggcagcgtgatgacgacggccaagatcgtgttcgccggcaatgtttccttcggctataacagcgccggggtggccaacgccaattcgcgcatcaactacctggcaccgttcccggccggcggcgcgcatgcgaacaagggcttgatgctgggcggcaccacttacagcaatggcgtgcccaatggctcgttcatgggcggctcggcgatggattgccctgcggccaagtag

SEQ ID NO: 2999 - DNA, 1692 bp, Chromobacterium substugae
atggcgctgcagtttctgttcaatcatctggggtttgaaacgtccgccgccaagcgcgcgctgctgcaggggccgggcgacgcggcggtggacagcgtgacggtgctggacgccgagcggcgtccggtgctgcgcagcccgctgcatgctttggggcgcgtggacggctggcgcgattggcactactggcaggccgatatcagcgcgctgcgggcgccgggccgctaccagctgtggctggacggcagcgcgccgccgctgctgtcggcgccgttcgaggtggcggatcggcgcttcggcacgccgttgctgtccgatctgctgcactacttcaaatcgcagcgctgcagtggcctgtacgaccaggccgaccgccaggcgcgggtggaggggacggatgagcggcgcgacgcgcgcggcggctggttcgacgcctccggcgactgctcgaaatatctcagccacctttcttacgccaaccacctgaatccgcaacagacgccgctgctggtctggagcctggtccgagcccgccgcgcgctgtcggcgcagcccaagtggtttgacgagcggatgacggacgaggcgctgcatggcgcggcctttctgctgcgcatgcaacacgaatcgggctttttctaccagacattgttcgatggctggagcaaagacgaagaccggcgcagcctgtgcgcctattccacccagcaggggctgcgctcgtccgccttccaagccggctggcgccagggcggcggcatggcggtggcggcgctggcggcggcggccggcttgtcgcgcgacggcgacgcgccgcgcgaggcgatgctggcggcggccaggcgcggcttcgtccatttgcaggagcatggcttgtcctacctggctgatggccgggaaaacctgatcgacgactattgcgcgctgttggccgcgtgcgaactgcatgccgccaccggcgacggcgattacgccgacgcggcggccgagcgagtggcttgcctgctggcgcgccagcatgaggacggctggttttggctggacgacgagcgccagttcagttattgccacgcgtccgatgccggcctgccggcgctggcgctggcgcgttatctggaaacgctgccggatggactgtacgcggcggaggcggaacggggctggcggctggtcatgcagggcgagatggcgcgcagcgccgttcaggaggggaaccccttcggctatctgcggcaatgggcgcagcggccgggccggacgccgggggcgcgcttcttcatgccgcacgacaacgccagcggctactggtggcagggagagaacgccaggctggcttcgctggcggccgcggcctgggcgggcggccggcgctggccggagctggcaccgcggctgcacggctacgcgcagtcagcgctggactggattctgggcatgaatcctttcgatacctgcatgctgcagggccatggccgcaacaacccgcattacgagcccggctactacaacgcctgcggcggggtatgcaacggcatcaccggcgcgccgggggcggagggcggcatcgccttcctgctgccggaggaaaccgacatcagccaatcgtggcgctggagcgagcaatggctgccgcacggcgcctggctgttgctggcgctggcgttgcggcagtggtttgacggcgcgcaatga

SEQ ID NO: 3000 - DNA, 1212 bp, Chromobacterium substugae
atgaaatcgcctgccgccaagccggacccgctgatggtgtccggaaccaatctggagcacgcccgttcgcacaatcgccgggcggtgctggaaaccatacgccgcaatcggcagcttacccgggcggatatcgccagaatgacggcgctgacgccgcagacggtatcgaacatcgccgccgaattgctggaggccggcgtgctgtcggccggcgagccgctgcgcgacggcgcgcgcggccagccggccattccgttgagcatcaaccccgacggcgcgtattcgataggcgtgcagctggatcaccaatcgctgatcgcggtggtggtggatctggccggccaggtgcgcgccagggtggaactggcggtgaagcggccgtcgccgggggcggcgctgcccttgatcgccgacgcggcgcaacggctgcggcgcgagtctggcctggattggagccgtttgctgggaatgggcctggtgatgccggggccgttcggcgtggagggcatgacctcggtggggccgaccacgctgcccggctgggaaaacatcgatgccgcggtgctgagcgcggcgctgggcatgccggtgctgctggagaaggatgccaccgcggcggcgataggcgagcgcctgtacggcatggccagccagctgcaaaacttcgtttacctgttcatcggcaccggcctcggcgcgggcttgtttctggatggccgcctgtacgcgggcggccgccacaacgcgggagaggtcggccacatgatcgtggtgccgggggggcgcgcctgcgagtgcggcaaccagggctgtctggagcgctacgtgtccttgcgggcgctgtacgaggcgctggggctggcggatggcgcgctggccacgcccgagcacctggcgcggcgggaagtggacgcggccggcgaggcctggctggcaagcgcggccgctcccttgcggcaggcggtgaacatcctcgaatgcctgctggacatcgacgcggtggtgatcggcggcctgctgcccccggcctggatggaggcgctggtacggcgtctggatcccttgccggtgtccacccggcaccgcggcggcgagcgcctgcggctgggcagcgccgggcgcgacgtggtggcgctgggcgccgccgccctggcgattttcgacgaattcaatccgcagtacgaggtgttgctgaaaagcggccgcggctga

SEQ ID NO: 3001 - DNA, 867 bp, Chromobacterium substugae
atgcacattccagcgaaattcctgatcggcgtcgacggcggcggcaccggcacacggacctgcgtcgccgcgcccgacggcgcggtgctggcgcaagcggaaggcccgggatcggccttgtcgctgggcgtggaaaaagcctggcgcacgatactgtccacgctggacgcggctttcgcgcgcatcggcgtcgccagccccagctaccgcgactgcgcgctgggcatcggcctgtccggcgtgcacaacagccaatgggcgcggcagtttcaggctcaatcccccggcttcgccgcgctcaagctggccaccgacggcttcaccaccttgctgggcgcgcacgccggcaaaccaggcgtgatcgtggcgctgggcaccggcagcataggcgaggcgctgtacgccgacggcagccaccgcgaggtgggcggctggggctatcccagcggcgacgaagccagcggcgcctggctgggacagcgggcggcccagctcacccagatggcgctggacggccgcagcagccacggcccgctgactcgctcggtgctggaattcgtcggcggcagctggcaaagcatgatgggctggaacggccgcgccacgccggcgcagttcgcccagctggcgccgctggtgctggccgcggcccgcaccgatccgcaagccgacgcgctgctgcggcaggcgggcgaggacgcctgggccatcgcccgcgcgctcgatccgcgctcggagctgccgacggcgctgtgcggcggcctgggacaggcgctgcgcgactggctgccgcccggtttccgccagcaactggtgccgccgcagggcgatgccacccgcggcgcgctgctgttgctgcaacgttga

SEQ ID NO: 3002 - DNA, 1263 bp, Chromobacterium substugae
atgaaaccccaccgacaggcgctggcctgcctcgccctgctggcctgcgccctcggcgcgccggcccatgccgacaaggtcaagctggaattctggaccgactcgctgaagccgcgcttcgacggctatttcgccgcggtgaagaaaacctacgaagcacagcacccggatgtggaagtgcagtgggtggacgtgttcaacgacaacttcgaaaccaagctcaacgccgccatcgccgccggcaagccgccggcgctggtcaaccacgacgtgccgcggctgttcaagtattcgcaaaaaggctcgctgatcccgctggacagcgcgctgggagccgacaagtccgcctacctgcccaacgcgctggccgacctgagcttcggcggcaagctgtacggcctgccctggtacaacaacgtcaatgtgctgacgctcaacggcgagctgttccgcaaggccggcctggatccgcgccatcccatcgccagcctggacgacgagctgcggctggccaaaatcatcaaggccaaaaccggcgtgcccggcctgctgccgcaattgggccagatagacggcatcatgctgggccagggcctgccgctgatccagaacggcaaggcggtgttcaatagcccggcgcacgccgcgctggtccgcaagttcgccgacgcctaccgggccggcgcgctggcgcgcgacagcctgttcgccgacgacaactatcaggacagcgtcaagctctacaacagcggccggctggcgatgatggaaaccgcgcccaccgccgcgcaaaaagcccgggaagacgcccgcggcatctacgccgccaccgtggtgcagccggcgccgctggggccgacccgcatcgtccagggcggttacctgttcagctgggcagtgtcccgcggcctgccggcgcgcacccagcaggaggcggtgaagttcgcccgcttcctgaccagcgacagccagcagctggccttctccaaagtgaccggcgccaccttcccttccacacagaaggcgctcgccgacagttatttcgtcaaggcctcggccgacggcggcgcgatcgaaagctcgcgcatcgaaggcgccaaggtggcgcgcaatatccgtaccctggtgctgaccggcgtcccccgggtcgccgatctgaaaaagagcctggtggacaatgtggaagccgccgtcaccggcaagaaagacgcgcagaaggcgctggacgacgccgccgccttctggaaccggcacttgcagtag

SEQ ID NO: 3003 - DNA, 867 bp, Chromobacterium substugae
atgaaatcgtcggaacgcaacgcctggctgttcctggcgccggccctgctgctgctggccgtgttcaccttctggccgctgctgttcggcggcttcatcgccttcacccgctacgacctggtgtcgccgccgcaatgggtcgggctggacaacttccgcgacctgctggacgacgcggtgttctggcaggcgatggccaactcgctgaaatacctgctggtggtgcccgccatccagctgtccggcatcgcgctggcggtgctggccaaccgcagcctgcccggcatccggctgttccgcgccgccctttacctgccggtggtcaccaccgtgtcggtggtgggcatcatgtggaactggatgtacgccgattacggcgtgctcaacagcgcgctgcactggctgaagctgttggcggcggagcgcgacatcggctttctcagcgacgacagcctggcgctgtattcggtgatgttcgtcacctggtggcgcggcctgggctattacatggtgctgtacctggccggcctgcaatcgataccggcggagatgcaggaagcggcgcggctggacggcgccaacgcctggcagcgcttctggcgcatcaccgtgcccatgctcaagcccaccattctgttttgcagcctgatctccacgctggacgcgctgaaggctttcgaagaggtgctggtgatgacgcgcggcgcgccgctcaactccacctacaccgtgctgtactacgccttccaccagggcttcaaccagctggacttcggccgcggcgccgccgccggcctgacgctggccctggtctgcctgctgctggcctggctgaatttcaaactgatccgcgccgaccaccgctga

SEQ ID NO: 3004 - DNA, 849 bp, Chromobacterium substugae
atgaccgccatcgccctgcttcgccccgccgcgcgccgccgcgcgctgcgccgcctgccccatagcctgttgctgctggcgctgtccttcgcctgctgctatcccttcatctggacgctgggcatcgccttcggcaacggcgagcaggtgttcgacttcccgcccgagctgtggccgcgcgacgccggctggcgccacttcatcgcggtgtgggacgccattccgctggggcgcttcttctgcaactcgctgtggatctccgggctgaccaccgccggcacgctggtcgtttcggcgctggccgccttcccgctggccaagctgcgctttcgcggccggcaactggtgttctacgccattctcgccaccctgctcttgcccagcgaaatcaacttcatcagcaactacgtcaccatttcgcggctggggctggacgacagccggctgggcgtggtgctgccatccttggccggcgccttcggcatttatctgatgaagcacgcgttcgaggagattcccgatgaaatcgtcgacgccgcccgcatggacggcgccggcgactggcaggtgttctggcgcatctgcctgccgctcagcctgccttacctcgccacgctgggcatcttcacgctggtgtggtcgtggaatgtctatgtctggcccagcgtggtgctgaaaacaccggaactctatcccttgtcggtgggcgtgctgtacctgaagggcgccttcgccacctccacccggatggtggcggccggcgcggtgatcgccatcgctccggtgctgctggtgttcctgtgctgccagcgcttcttcatgcgcggcatggacggcgcggtgaaatag

SEQ ID NO: 3005 - DNA, 1317 bp, Chromobacterium substugae
atggacaagcacccacccgttctgccttccgcccgcccgctgcaacgccaggattacaagaccctgagcctggccgcgctgggcggcgcgctggaattctacgacttcatcattttcgtgttcttcgccgtggtgctgggcaagctgttcttcccccccgccatgcccgactggctgagccagctgcaaaccttcggcatcttcgccgccggctatctggcgcggccgctgggcggcatcgtgatggcgcatttcggcgacctgctgggccgcaagcgggtgttcaccctcagcatcctgctgatggcgctgccgacgctggcgatgggcatgctgcccacctaccacgatatcggcatctgggcgccgctgctgctgctggcgctgcgcattctgcaaggcgcggcgataggcggcgaggtgccgggcgcctgggtgttcgtcgccgagcactcccccagccgccacaccggcttcgcctgcagcatgatcaccgccggcctcaccgccggcatcctgctgggctcgctgatcgccaccgccatcaacctggccttcaccccgcagcagatcgccggctgggcctggcgcctgcctttcctgatcggcggcgtgttcggcctggtggcgatgcagctgcgtcaatggctgcatgaaaccccggtattcgccgagctgaaagcgcgcaaggcgctgtccgaggagctgccgctgaaaacggtgctgaagaagcacaagacggcggtggcgctgtcgatgttcgccacctggttcctggccatcgccatcgtggtggccatcctgatggcgccggcctatctgcagaagcaattcaacatcctgccggtggacgcgctgcgcgccaacagcctggccatcgtggcgctgaccctgggctgcctggtcgccggcgtgctctccgaccgcatcggcagcggcctcaccttcatcggcggcagcctgctgctgggcgccagcagctacgccttttacaccgtgctggcggtggacagcagccaactctatccgctatacgcactgcaaggcttctgcgtcggcatcgtcggcgcggtgccgctggtgatggtgcgcgccttcccggcggcggtgcgcttctccgggctgtcgttttcctataacgtcgcctacgccttcgccggcggcctcaccccggtgattttgtcggtctggctgaaatacgacgcgatggcgccggcctactatctgctgctgcaatgcctgctgggcttgctggtcggcgtttacctgctggcgcggcggcgggacgccgggctggcggccggcattcaggcctga

SEQ ID NO: 3006 - DNA, 840 bp, Chromobacterium substugae
atgactgacgcgattcaaggccaagagttcatgctgctagactggatgcgccgcctgggcggtaagcgggcgccccccgcattgctggaaaaactgcgggaagaagccgcggcgatgccgttgctggccggcctgtccgccgaggaaaacggccgcctgctgcagttggccggcgagctgctgatggccaagaccatcaccgcgctggaggatatggaggtggacgacgccatgcgctgccgggcggttctgcagttggcgttgcccggcatgaacctgggaatcggggcctatggcaactggcgcgaggtcgtgctgtatccggcgcccttcgtggtgcgcagccgctggcaggacggcatggggctgacccacgagggcgagcaggtgctgatcggccaggcgcattaccaggggccgctggtgctgtcctggccggatgtcaacgagtcgccgctattggatggctggaacgtggcgctgcacgagatcgcccatcagttcgacatgctggatggcccggccaacggcgcgccgccgctgcacaaaggcatggaccgcgcgttgtggagccgggtgtggaaccaggcctaccggcagttctgccgcgaggtggaccatggcttggaaggctggctggacccgtacgccagcgagaacccggcggagttcttcgcggtgcagagcgaggcatttttcgagattccccatctgcagcggcgcgattacccggaactgtaccggcaactgagcctgttctaccggcaagacccggccgcgcggctgcccgaagtggcggaggccgacctgctgccgcccccgcccccgcctcaggcctga

SEQ ID NO: 3007 - DNA, 1206 bp, Chromobacterium substugae
atgaccgtccccatctggcacgatctggcgctgaacccgctggcggcgttcggcatattgctggccctgggcgtgataggcggccagatcgccgtgcgcgtcgcccgcttgcccgctatcaccggctacatcgtcaccggcctgctcatcggcccgtacagcctcaatctgctggaccagcagctgctgaacgaagcctcgctgttcgtgcagctggcgctgggcatcgcgctgttcgaggccggccgccgcgtcgacctgcgctggctgcggctggagaaaaccctgctggccaccaccctgctctactgcctgctggtgttcgcggcgctgtacgcgctattgagcggcaatggcttcggccccgccgccagcctgatgctggccgcgctgggcatggccacctcgcccatcgtagtgctggagatcgtgcgcgaatcgcgcgccgacggccaggtgagcgaacggctgctgaccgccaccgcgctgtccagcctgctggcgatgataggcttcgcgctggcgctgtcctacagccatttgtccgcaaaccacagcgtggaggacggcatcctgatgccgggctggctgattctgggctcggcggcgctgggcctggccgccggcctggtcaccacccagctcaaccgctggctgggcggccaccagcgcgacgcgcagcgggtgatgctgttcggcctgatcgcgctgctggtcggcctggccgacatgctgcagctgctggcgctgctggcgctattggtggccggcatgagtacccgcagcctgcgccacggctacaccgtcagcgaaccgggcatcctgtcgctcagccacgtgttcacggtggccttctttgtctccgccggcgcccacctgtcgccgcaggcgctggcctcgcattggcagctggccttgctgtgcctgatcctgcgcagcggcatcggcatgctggtgtggtggctggccgcgcgcggcaacggcctctcgcgcaagcagggcgcctggctggggctggcgctcagcccgctcaccggcggctcggcgctgctgctgggcctgggcatggtgtcgctgggcgaagccgccacctcgttcagcgccgcgctgatggccgccctgctgatcaacgaaatcgtcgcccccatcctcacccggctggcgctgcgcctggccggcgaaaccgcaggagccagccatgcttga

SEQ ID NO: 3008 - DNA, 1134 bp, Chromobacterium substugae
atgcttgaattcaaccaaagccagccgctcaccctgggcgtggagctggagctgatgatactgaaccgccgcgactacaacctgacgcgcggatccgacgacctgctgttgcaaatcaaccgcaagccgcacggcttcgacatcaagccggaaatcacccagggcatgatagagatcggcaccgccatccaccacgacgtcaaccagatgctggaagagctgctggcgatacgccaattgctggtggacagcgcccacaagctcaacctgggactggccggcggcggcgcccacccgttccagcactgggacgaccagcgcatctaccccaaggagcgctaccaactggtatccgagctgtacggctatctggccaagcagttcaccgtctacggccagcacatccacatcggctgtcccgatggcgacgccgcggtgcgactcaaccactacctggcgcgctacattccgcacttcatcgcgctgtcggcgtcatcgccgttctaccaaggcgtggacaccgccttccagacctcgcgcctgaccagcgtcaacgccttcccgctgtccggctgcatgccggtggtggacagctgggacagtttcaaccactacttccagcgcatggcctcgctgggcatcgtcgccagcatgaaggacttttactgggacatccgtcccaaaccggaatacggcacggtggaaatccgcatctgcgacaccccgctggcgatagacaccccggtgctgctggccgcctacgcccagatgctggcgcggcgctgcttcgccgaggactggcacgacatcagccccgagccctacctcacctacagctacaaccgcttccaggcttgccgcttcggcttcgacggcgtgctggtggacgcccgctccaatcgccagcaaggcctgcaggaagacctgctggacagcctgaaagcgctggacgagcacgccgaggcgctgaattgccaagcccagctggcccagctgcgccagcgcgcgctcaagcgccacagcgacagccagtggctgcgccagatccacgaccagagcggctcgctcagcgaagtggtgcgccggcaaagcgaacactggatgtacgccgggccgggagtgggcgtaaactga

SEQ ID NO: 3009 - DNA, 795 bp, Chromobacterium substugae
atgccctttcaacttccgcaacagccggcgccggcgctgcccgcgcgctggtgcgttttcgacggcagccagctgtggctgctggacaagcgcctcccctccctgccgccggaaggctgccagttgaccggcaccagctttctcggcgtgcacgaagagcacaatctgttcatggccgaactggtgggaaaccgccccgagcaaggcgaatggctgccgctgcggccggccttgatggcgctgccggcggcgcaaatccaggccgcggcgcgcgccgcccagctgcgccagttccgccacagccaccgctattgcggccattgcgcgtcaccgctgcaaaccagccgggaccaggtcggcaaacactgccccagctgcggccaagtctactatccgcgcatctcgccggcgatgatggtgctggtcaaccgcggccgcgagctgctgctggcgcgcagcccgcacttcacccccggcatgtacagcgcgctggccggcttcgtcgaacccggcgaaacgctggaggaatgcgtgcaccgcgaaacgctggaagaagtgggcatccgggtcaagaatctgcgctacgccttctcgcagtcctggccgttcccgcactcgctgatgctggccttcaccgccgagtacgacggcggtgacatccgcccgcaggaagacgaaatcgaggacgccggctggttcgacatcgacgcgctgccgacgctgcccagccccatctccatcgcccaccacctgatcgcgcatggccgcgagctgattctcaagcaggaaacttaa

SEQ ID NO: 3010 - DNA, 1299 bp, Chromobacterium substugae
ttgctcaaaaaggcgctgcacaatgccgctcgccttgcccacccccggatgaaagaagcaatcgtgaaacagaaaaccctgctgagccttgccctgacgctgagcctgccgcttgcctgcgcccacgcgcaggctgccgccatgaccgtggacagcctggatgggccggtcacccgcaatgaaatccagtccttcgtcgattacgcccagggcctgcagccaggcgcgtccaatgtcggcaatgaatgggcgcagggccgcagcggcgaaaacctgaaagccatggcgctggtttacgacatcgcccccagccagccgctgttggacaagatggtgtcgttttgcgacgcgctgctgtcggaacgcaatgacatcgcgcccgcccctacgggccagcgcgtgatctggaccggccgcatcgacccggtatggccgaacacgccggacgtcagtccgatccagaccggcggcgaacaaggcgacccggtcggccacctggccagctgcgcgcgccaaatcctgaaaaccagcgccatctacgaccaaaaggtcgccggcggcgaccccttcctcttcggcgccacttatttgcaacgcgccaagacttatctgcgcgaggccgacaagacggtcgaccagcacattctgaaatcgctgctcaagctcagcgacggcaaactgatgtacttcgccgccaacgcgccctacaagggcggacagccggtgccgtggaaccagcagatgatgttcggttacggctttctcaacctggcccaggcacatgagctgctgcgagacaatccctccctggtcaaacgctacgaccagatcctgcaggccaacctagactggttcctccagtccggcctcacccgctacaccgacaaagccggccgctccgcctacgattggggctacaccctgcccgacacctccggcgaggacaatagccatggcagcctggacaccgccggcctgtaccggctgtatcaaagcggccgctacggcctgaaagccgcgcagctggcgcccatcgccaacaccgtcctcgacgtgatgcgccttggcgaccgccactacgctggccgcctgaacggcaccaccggcgccggcaacagcaaggacaccaactacctgcgcagcggctacctgttcacctccctgttccagcccagcgcctactacaccatgatgagcgacgccggcatccaggacggcagcaccacctcccgcatcgacgccttctcccgcttcctggcggtgaaggccgcgcgcgccgccggcaaaacacagcgttaa

SEQ ID NO: 3011 - DNA, 216 bp, Chromobacterium substugae
atgaaaatcacctttgaatacacgccgttttccattgccgccttaaagggggacccgccgccgatcaagcaactgccagatggatatccggcgccggccaagggcgatgtcttcttgctgggcgacccgccgctgcggttgctggtggcggagcggcgctatcgtttccatggcggggagtggggcctgcacatcatgctggggctggacggctag

SEQ ID NO: 3012 - DNA, 129 bp, Chromobacterium substugae
atggcggtggcggaagggctttggctgatggcagggtttgatgattgttggcgcgggatggagcccgtcgccatctggcaaatgccggcgggcctgctatggttgaatttcatgacccttttggaataa

SEQ ID NO: 3013 - DNA, 393 bp, Chromobacterium substugae
ttgatcgccatcggtctggccatggccagttccgtgagccacgccgaaccggaagaccagcccctgccgggcgacttccaggccgctccggcggcaaaaccgctgcacaaatcacgtgccagccaggcagccccccgcgccgccagccacaacaaagccgcgcgcgccaagcatcacgcccccaaggccagccacggcaaactgaaacccgccaaagcccacgctcacgccaagcaccaccgccacaccggcaaaaaacacgcgaaaaagccgcatggcgcgcatcatgccgccaagaaagcccacaagccggccaaagcacacaaaaacaaacaccataaaaacaaaaagctagccaagaagcatcacgccaagcataaaaaaacgcagtga

SEQ ID NO: 3014 - DNA, 73 bp, Chromobacterium substugae
gccggtgtagctcagttggtagagcacctgacttgtaatcagggggtcgcgagttcgattcctgccgccggca

SEQ ID NO: 3015 - DNA, 681 bp, Chromobacterium substugae
ttgatcgccgccactcgcattcgttatggcgcgcgccgcatctacgtcctactgcggcgcgaaggctggcggatccatcacaagaagacctaccggatctattgcgaggaaggcttgaatctgcggcgcaagcggcccaaacggcgagtggcagcggcgcatcgccacgctcggccggccgtctccaatttgaacgcgtgctggagcatggatttcgtcgccgatcagctgttcaacggccagaaaatccgggccttaactgtggtggataattttagccgggagagcttggcgatcacggtggatttcgcactgaaagccgcggacgtggtggctacgatgcagcatgtgcaagccttgcgcgggacgccgcaacggattcaggtcgacaacggcagcgagtttatttcgttggcgctggaccagtgggcctatgagcaaggcgtcacgctggacttctcacgaccaggaaaacccacggataatgcctttatcgagtcatttaacggcagtctgcgcgatgagtgcctgaatgtgcattggtttctatcgctggacgacgcacgtgaaaagatcgagcgttggcggcaggattacaacgaattcaggccgcacagttcgctgggcgaccagaccccgagcgagttccgacttgctcaccttgaagccggaaatctctag

SEQ ID NO: 3016 - DNA, 73 bp, Chromobacterium substugae
gggggtatagctcagctgggagagcgcttgcatggcatgcaagaggtcagcggttcgatcccgcttatctcca

SEQ ID NO: 3017 - DNA, 73 bp, Chromobacterium substugae; identical to SEQ ID NO: 3016

SEQ ID NO: 3018 - DNA, 73 bp, Chromobacterium substugae
gtccctatcgtctagaggcctaggacactgccctttcacggcggcaaccggggttcgaatccccgtggggacg

SEQ ID NO: 3019 - DNA, 73 bp, Chromobacterium substugae; identical to SEQ ID NO: 3016

SEQ ID NO: 3020 - DNA, 813 bp, Chromobacterium substugae
atgcccgccgctgcggcggcgatcctggatatcgcggagaacctgaagatgaaaaaactgaatgcagtactggcgctggcgctgaccctgggcgcggccgccgcgcaggcggacgatctggcggccatccgcaaggcgggcgtgctgaagatcggcaccgagggcacatacgcgccgttcacctatcataacccggccggcgaattgaccggcttcgacgtggagctgggccaagccattgccaagcggctgggcgtgaaggcgcaattcgtcgagggcaagtgggacggcctgatcgctggtctggacgtgaagcgctacgacgtggtgatcaacgaagtggccatcaccgacgcccgcaagcagaaatacgatttctccgagccctatatcgtgtcgaaggcggtgttgatcgtccgcgacgacaaccgcgacatcaagcgcttcgaagacctgaaaggccgcaaatcggccaataccctgaccagcaacttcggcaagctggcgcagcgctacggcgccgaaatcgtgccgacccagggcttcaacgagtcggtggctttgctggagtccggccgagtggaaaccaccatcaacgacagcttgtccttcctcgacttcaagaagaagcagccggcctcccgtctgaaagtggcggccaccgaagccaatggcgacgcttccggcgtgctcctgcgcaaaggcagcccggagctgaaggcggcgatcgacaaggcgctggctggcatcaaggcggacggcagctatcagaagctgtcccacaagtacttcggcgccgacgtgtcgcattga

SEQ ID NO: 3021 - DNA, 669 bp, Chromobacterium substugae
ttgcagttgatggcggactccttgccgtcgctactttacgccggcttcgtattcaccgtgccgcttaccctgctgtcgttcgccggcggcctggcgcttggcctgctggtggcgttgatccggctgttcgggccgcgcccgctggtgctcttggtgcgcgcttattcctggctggtgcgcggcacgccgctgttggtgcagctgttcgtgatcttctacggcctgccgcgcgtcggcatcgtgttcgatccgtttccggcggccttgctcggcttcgtgctgagcgtgggagcgtacacttcggaagtgatacgcgcggcgatcgcctcggtgcccaaggcgcagtgggaggcggcgtattcgctgggcatgagctggtcgcaagcgatgcgccgcaccatcctgccgcaggcgggcagggtggcggtgccgcccttggccaattccttcatctcgctggtgaaagacacctcgctggcggcggtgctgacggtgccggaaatgttccaggcggcgcagcgcatagcggccaccacctatgagccgctgctgttgtatctggagaccgcgctgatctacctgttgttgagcacggtattgacctggctgcaggagcggctggaaaaacgttttgaccggcacgtggcgccggtgggagccgcgtcatga

SEQ ID NO: 3022 - DNA, 768 bp, Chromobacterium substugae
atgatcaagctgagccgcatcgtcaaatctttcggcgagcagaccgtgctgcatgatgtcagcctggagctggccgagggcggcgtcaccgcgttgatcggcccgtccggcagcggcaagagcacgctgctgcgctgtgccaacctgttggagacgccggatggcggcgagctgcagctcgccggcgaaaccttgcgtttcgagccgggcagaaagctgtcgcgcgacgccgtgctgcgcgtgcgccgcgtcaccggcatggtgttccagagtttccagctgtttccgcaccagacggtgctgcagaacgtgatggagggactgttgaccgtgcagcgctggccgcgcgataaggccgagcggcgcgcgcgcgagttgctggacaaagtgggcatggcgcacaaggcggatgcctggccgtccaccctgtccggcggccagcagcagcgggtggcgatcgcccgcgcgctggcgccgtcgccgcagctcttgctgtgcgacgagccgacgtcggcgctggatccggaactggcggccgaggtggtggcggtgctgcgccagctggccgcagacggcgtcaccatgctgatggccacccatgatctgcggctggcgtccagcgtcgctcgcgatgtggtgtttttggagggcgggcgcgtcgtagaggctggccccgccgcgcagattttccgccagccgcgcgaggcgcgcacggcggaatacgtgtccacgctgaccgccggcgccagggatctggtgcagatctga

SEQ ID NO: 3023 - DNA, 927 bp, Chromobacterium substugae
atggaccaatccctgaaccagttgcccggcgcgccgcggcctcggatcctggtggtggacgaccaaaccgccaacatcttgctgatacgcgaattattcaaggacgagtgcgagattttcatggcgctggacggcgaacaggcgatcgcgcaatgccaggcgctgatgccggacctgatcctgctggatctggtgatgccgggcatagacggcttcgaggtctgccgccggctaaaggaggatccgcgcacccgcgcggtgccggtgatcttcatctcggcccagcgcgaggaggccgacgaagcgcgcggcttcgagctaggcggcgtcgactacatcgtcaagccggtcaaccgcaccatcttgcgcgcccgggtccgcacccacctggcgctgaaattccagacggacctgctcaattcgatcgcgctgatggacggcctgaccggcgtggccaaccgccgcaagttcgacgaggagctgcagaccagctggctgctgtgcgccaggcagcgccaaccagtcgcgctgcttctgctggatgtggactacttcaagcgcttcaacgaccgctacggccaccaggccggggacgactgcctgcgccaggtggcgcaggcaatgcgccgcgcgctgcagcggccgcacgatctggccgcgcgctacggcggcgaggaattcgcctgcatcctgccggacaccgaccgcgaaggcgccgcgcacctggcggaaaccatcctgcaatcgatacgcgagctgggcattccgcaccaggattcggagctgggcggcgccgtgaccgccagcataggcgtcgccgtcgcccagccggagccggacaccgcgccgcagacgctgatcgaagccgccgaccgccagctctaccaggccaagcgcgccggccgcggccgcgtcagcgcggcctga

SEQ ID NO: 3024 - DNA, 3711 bp, Chromobacterium substugae
gtgatcagctggaacaagggcgcgcaggagatgttcggctaccacgccggcgaagccctcggccgctcgctatggcaattgatcgttccggaggacaaggagcgcgaagagcacgacatcctgtcccgcatcgcccgcggcgagcgcatcgcccatttccagacggtgcgccgccgcaaggatggcagcctgatcgacgtggcggtgtcggtggcgccgatctacggcgacaacggcgcggtgattggcgcggccaagacggtgcgcgacatcacccggcaaaaagcgatggaagcggagctgctggcgctgaataccaggctggaagaacaagtggcggaacgcaccttgcaactggaaggcgctcgccgcgacctgcgcacggtgctggactcggtgccctcgatgataggctactgggacaagaatctggtgaaccgggtggccaaccatgcctatcacaactggttcggcctagagcccgacagcctgcccggcacccggctgcccgacctgctgggcgaggcgtcgttctccatcagccggccgcacgtggaagcggcgctgcgcggcgaatcgctgcgcttcgaacgcaccctccccgatctggacggcaacccccgccacactctggtccattatctgcccgacgtgatggacggcgaagtgcgcggcttctactcggtggtgcacgatgtcaccgaactggttgaaggccggctgcaactggcggcggcgctgcgcgagaaccaagccttgctcggcatcatcaacgagcagctgcaatacgcggtcaccgaccccgagggacgcttcctggaagtcaacgaccgcttttgcgagatcagcggctatcgccgcgaagagctgctgggccgcaaccaccgcatgctggccgaaggcctgcacgacgagccgttctggcagggcatccgccagacgctggaccgcggcgaagcctggcacggcgaaatctgcaaccgcgcgcgcgacggctcgctgcgctgggccgataccgtgatcgtcctccagcgcgacggcgacggcgcgatcgaacgcgtgatcgcgctgcgcatcgacgccacgcgccggcgcctgatcgacgccgaagtcagccggctgagcctgctactgtccaatgtgctgagcgccgcatcggaagtttccatcatcgccaccgaccgcgacggcctgatcacggtgttcaacgccggcgcggagcggatgctgggctatgtccaggatgaaatggtgggtcgctgcacgccggcccgcttccacctggccgacgaagtcgcggcccgcgggcgcgaacttagccaacagtacggcgaagacattgccggcttccgggtattcgtccatgtgccggaatcggccggcgcggaaatccgcgaatggacctatgtgcgcaaagacggcggccacgtcgccgtctcgctggcggtcaccgcgatgcgcgacggcgacggcgccatcagcggctatgtcgggatcgccaccgacatcgccgagcggcggcgctcggaaatgcagctgcggcaagccaaacagcaggcggaacaggccaatcaggcgaaaagccgcttcctcgccaatatgagccacgaaatccgcacgccgctgaacgcggtgctgggcctgctgcagctgctgcagcgaacgccgctggacatccgccagcaggactacgtggccaagacccgcgccgcagccaattcactgctggggctgctcaacgatatcctggacttctccaagatcgaggccggcaagctgcagctggacccccaccccttcgcgctggacgacctgctgcgcgacctgggcatcatcttgtccggcagccacggcgacaaggacgtggagccggtgttcgaaatcgacccggaactgccggccgcggtgataggcgaccggctgcggctgcagcagatcctgatcaacccggccggcaacgcgatgaagttcaccgaacgcggacaggtgatcatcagcgtcgggcagatcctcagacaaggcgacgcgacgacgctgcacttcggcgtcagcgacaccggcatcggcatcgccgcggaacagctcaagcgcgtgttcgacggcttcacccaagccgaagcgtccaccgcccgccgcttcggcggcaccggactggggctggcgatcagccagcggctggcgcggctgatgggcggccaattggaagcgcagagcgaacccggccgcggcagccgcttctggctggaaatcacgctgaaaatcgccgatcccgcgccgctggtggcccccggcgggaaagcactgcgagtgctgatcgtcgacgacaacccgctggtgggagaagtgctgggccacacgctgcaggccgccggctggcatagcgactacatcgccagcggcgccgaggccgcgcgcgcgctggaggcgggccgccgctacgacgcggtgctgctggactggcgcctggccggcagcgacggcgtggaaaccgcggcccgcctgcgcgccgccggcgccggcaagccgccggtgctgatgatggtcaccgccaacggccgcgagaccctgtcgcacatcgccgacgcgccgttcgccgaactgctgaccaagccgatgacgccgcggcaactgatcgagtcggtgcaagcctgcctgagcggccgcgccgggccgccctgccagatcgccgccgagccgcgcctgcccggcatgcggctgctgctggtggaggacaacgcgctgaaccggcaggtggcgtcggagctgctcgcccttgaaggcgcgcgcgtagagctggcggaaggcgggctgagcggcgtggaaaaagccaccgcggccgacgccgattacgatgtgatcatcatggacatgcagatgccggacatagacggcctggaagcgacgcggcgcatccgcgccagcggctgcgaatcgccgatcctggcgatgaccgccaacgccagccccgccgaccgagccgaatgcctggccgccggcatggacgaccatatcggcaagccgatagacatcaatcagctggcgccgcggctgctggcgctgtgcggacgcgcgccgcggaccgaagcggcggtcgtcggcgccgcgcccgccttcgacatcgaaccggaggaagtcgtgctgcggcgtttcggccagcaggccgacaccatgcgcaacgccctgcgccgcttcatcgaggaagcggaactgctggccaatttgctgcaactgcagctggaaagcggcgacgccgcgcagcgggcggcgacgctgcactcgctcaaaggcatcgccgccacggtcggcgccgccgcgctggcccgccgtgccggcgaattggagcaatgcgcgaaaccgtcggcgccgcgcccgctggatgccgatgcttggcgcgaagccgccatggcgctgcagcagctggcaaaagacagcgtgcgccagctggcccgccgcctgcccgaaccggtcgcggctgccgcgccggccgccgcgccggcgctgtcggttcaggaatggcgcgagcggctgcaggcgatccagccactgctggagcgcggcaacctggccgccatcgacctggccaccgcgctgctgccgctggcgggagagcgcatgcggccgcaagtggaaagcctggtggcgcaggttggacgattgcaattcgcgcctgccctgcatctgctcaaaaccctgatcgaaagcgagccatga

SEQ ID NO: 3025 - DNA, 1092 bp, Chromobacterium substugae
atgacgagcaagccccacctctcctcggccgcgcgctgggcggcggccacgctgctgctggcgctggcgctgaccacgctggcctgccggcagatcgagcagcgcaatgccgaaacgttgcgccaggccgccagccagcaggcgcaacgagcgctctccgccatcgtcgagcggctgcagcgctacgcctatggcctgcgcggcgcccgcggcgcggtagtcgccgccggcgacggcccccacgctcaggaagccttccaccgctacagcctgagccgggagctgccgcgcgaatttcccggcgcgcgcggcttcggcttcgtcaggcgggtgccggaaaccgaactgaaagccttcgccgccgccatgcgcgccgccaccggcttttccgttcaccagttccagccttaccgcgccgagcacgccatcatccagttcatcgaaccgctggccgccaaccgccaggccgtcggcctggatatcgcctccgaccccgaccgccgcgccgccgcccaggaggcggtcgatagcggcgaggcgcgcatcagcgcgccggtcacgctgctgcaggcgccgcgcctcagcaaacagggctttctcatcctgatgcctatctaccgcgacatcctcacgccggccagcctggccgaacgtcgcgcgcaggcgctaggctggagctacaccccggtggtgatgcccgaagtgctggccggcctggagcaggatccgcaggacggctgggtggagctgagcgacgccaccaatccggccaatccgctcggcttcttccgcagctacgcctcaggctcggccgaagccgccgtcgccacccaatcggcgccgattttcggccgcgtctggcgcctgaccttccacgccagccccgccttcgccgacagcctgcagctgccgccaacgcggctgctcaacctgggcagcttgctgttcagcctgttctgcgccgcgctggcctatgcctggcgcagcgaaatgctgtcgcgcaagcggctgctggacgcgagaatgacctcgccaccattgtcgaaagctcgatcgacgccatcatcggcaagacgctggacggcatcgtga

SEQ ID NO: 3026 - DNA, 73 bp, Chromobacterium substugae; identical to SEQ ID NO: 3016

SEQ ID NO: 3027 - DNA, 813 bp, Chromobacterium substugae
atgtcggttggtcattacgagaattttccggtaggttcgctgctgctgccgcgccggatgcggcgggcggtgcatgcgatctatcatttcgcgcgctacgccgacgatgtggcggacgagggcgacgccgacgcggccgcgcggctggccgaactggaccggctgtccgccgatttggcgcggatcgaggccggcgcggagccgcagatcgaactgatgcggccgctggcggcggcgatcgccgcgcatgggctgccgtttcagccgtttcacgacctgctgtcggcttttcgccaggatgtggtcaagacgcgctaccagagcttcgccgagctggtcgattactgccgccgctccgccaatccggtgggaaggctgatgctggcgctgtacggcgtcgacgacgcgcgcagcctggcccagtcggacggcatctgcaccgcgctgcagttgatcaatttctggcaggacgtggcggtggattggcaaaaaggccgggtctacctgccgcaggacgacctggcgcgcttccggctggacgaaggacggatcgaggccggccagtgcgacgacgcctggcgcggcatgatgctgtaccaggtggagcgcgcccgcaagatgctgcaggccggcgcgccgctgggccgcacgctgcaggggcgcctgggactggagctgcggctgatcatcctgggcggcgagcgcatcctgaagaagctgcacgcctcgggcggcgacgtgttcaggcagcggcccaagctgaacggcctggattggatatacatgatgtggcgggcatgccgggccgtatga

SEQ ID NO: 3028 - DNA, 846 bp, Chromobacterium substugae
gtgacgcccgatcagtattgcgaggacaaggccgcggccagcggctccagtttctattacagcttccgctttctgccggccgagcggcgcagcgccatcaccgcgctgtacgccttttgccgcgaggtggacgacgcggtggacgagtgccacgacctgggcgtggcgcaggccaagctggcctggtggcgcggccaggtgggccgggcctaccagggcgaggccgatcatccggtgatgcgcgcgttgctgccgcatctgtccgccttccagctgccgcgcgagcaactggaggaaatcatcgacggcatggagatggacctgtccatggtgcgttaccagcgtttccaggacctgctgctgtattgccaccgggtggcgggcgtggtgggccagctggcggcgcgcatcttcggctatagcgacgagcgtacgttggagtatgcgcatgagttgggcgtggccttccagctgaccaacatcatccgcgacgtcggcgaggacgcgcgccgcgaccgcatctacctgccgatggaggagctgcagcgcttcaactgcccggcgatggatatcctgcattacgaggaaagcgaggcgttcaagcaattgatggccttccagatcgagcgcgccgaggagcactaccgcaaggcatgggagctgctgccggcggcggatcgcaagtcgcagcggccgggcctcttgatggccgccatctaccgcgccacgctgcgggaaatccagcaggacggcccggccaaggtgctgaaccagcgcttgtcgctgggcactggccgcaaattgtggctggcctggaaaacctggactctcggctaccggccgtga

SEQ ID NO: 3029 - DNA, 1278 bp, Chromobacterium substugae
gtgaagcccagggtggcggtggtgggggccggctgggccggcctggccgccgcggtggagctggccggagaggcggacctcaccgtgctggaagccggacgcgaacccggcggccgcgcgcgccaggtcggcacggatggcgacaggtttgacaatggtcagcacattctcttgggcgcttatgcagaatgcctgcgcctgatgcggcgggtgggggccgagcccgaaagcctgctgcgccgcctgccgctgcagtggcggcgcgagggcggggtggacatgcgctgcccgcgctggccggcgccgctgcacctggcagccggcctgctggcggcgcgcggcctgggctggtcggccaaatggcagctggcgcgggcgctgctgggtttgcgcgccgccgcttatcgcttgccccaggactgcgcggtggccgactggctgcgcgaccacggccagcaggaggaggcgctgcgcgaattctggcgtccgctggtgttgtcggcgctgaacacgccgccggagcaggcatcgatgcaggtgctggcgaccgtgctgcgagacagcttgggcgcgcgccgcgcggccagcgacctgctgctgccggcgcgccacctgtcggcgctgtttcccgagcccgcttggcgctggctggccggccagggagcggacttgcgtctgggcagccgggtgcgccggttgtcgcgggaggcgggcaggctgctggtggatggcgaggcgtacgacgccgtggtgttggccgcggctccctaccatgcggccgctttgctggacgagccgcgcttgcgggcgcagttgcaggattaccgctactgtcccatcgtcaccgtctacctgcgcttcgcggcttcgccgcgcctgccggcgccgatgatgggcgtgcgcggcggcgcggccgactggctgttcgaccgcgaggcgctgtgcggagaggccggcctggtggcggcggtgctcagcgcgccgccggcgctgccggagcaggacgaactggtgcgcgcggtgctggacgacgtgcgtcggctggcgcctcatttggaacagccgatcgaatgcaaggtgatagtggaaaaacgcgccactttcgccagcgcggtgggtttgcggcgggcaacggtccgcagcggcgcggaaggaatttatctggccggcgattgggcatgtcccgattacccggccacgctggaaggcgcggcgcgcagcggggtggccgcggcggcagcggtgatgcaggatttacgaatgaaagcacgacaatga

SEQ ID NO: 3030 - DNA, 756 bp, Chromobacterium substugae
atgaaaacagagtttgccaaagatgccctggcagggcgcgtgatcctggtgaccggcgcctcccagggaataggccgcgaggcggccctggccttggcgcgccacggcgccgcggtggtgctgctcgcgcgcagcgtcaaggggctggagaaggtctacgatgaagtggtggccaccggcgcgccggaaccggcggcggcgccgctcgacctcctgaacgcgggcgagaatgagttcggcaacctggccctgaccatccagcgcgaattcggccggcttgacggcatactccactgcgcctcgcatttttacgcgctgtcgccgctgtcgaaccagaccatagaagaatggatgaaccagtaccggatcaacaccgtggcgccgttcgcgctgacgcgcgcctgcctgccgctgctgaaggcggcgccggacgcgtcggtgctgttcgtcggcgagagccacggcctgcatccggcggcgtattggggcggcttcggcgcgtccaacgccggcctgccttatctgaccaaggtggcggccagcgagtgggagatgcacgccaatctgcgcgtcaacctgctgacgccgggaccggtcaactcgccgcagcgcaaccgcacccacccgggcgaggccaagggcgagcgcggcgagctggccgatctgatgccgcatctgctgtactggctgggcggcgacagccgcggccgcagcggcgaggtggtggagctggacctgcgcaagccgcaatcgtga

SEQ ID NO: 3031 - DNA, 540 bp, Chromobacterium substugae
atgaaagcactggttttgctgatgacgctgctggcgctggccggctgcaactgggtaggcacggtttccggcttgaccaaggattccgacaaggcggtgggcgcggcctgccgccagaccggccgctcgctggaagagtgctatctgcgcaatccggaagccgacaaggcgtcgatttacgccggctggcgcgagatgaacgaatacatggcgaagaacaagctggagacgatggcgccgccgccggaaaaaccgaccggctccagcgccgcgatgtcggccgaccggccagccagcgccgcgatgtcggggggcaagaacggcgacggccccaagccgctcaccagcgaagaggccgaccgcgccgccaagaacgacccgcaggtggaagcggtgctggcggcgatgcgcaacggcagccccagcagcgcgggcagcgccgcgcgccagtccagtggcaagggcgagccggaccagaagcgcctgctcaacatcatccaggatctgaacaagaccgatccgggccgcgcgccgggttga

SEQ ID NO: 3032 - DNA, 1362 bp, Chromobacterium substugae
atggccaaaaccaaaaccgtattcagctgcaccgagtgtggcgggcagacgcccaaatggcagggccaatgcccgcattgcaatgcctggaacaccctgaccgaagcggtgtccacgccggcggcggccggcccgcgcttccagtcgtgggcggccaatgtcaccaaggtgcagcggctgtccgaagtgcagaccgaggaaaccccgcgcgacccatccggcatcgacgagctggaccgggtgctgggcggcggcatcgtgcgcggcgcggtggtgctgatcggcggcgaccccggaatcggcaagtccacgctgctgttgcaggcgctgtcggtgataggccagcgccgcaaggtgctgtacgtgtcgggcgaggagtcggcgcagcagatcgcgctgcgcgcctcgcggctggcgctggataccagcagcgtcaacctgctggcggaaatttgcatagaaaacatcctggccaccctgaagaacgacccgccggaagtggtggtgatcgactcgatccagacgctgtacaccgagcacgtcacctcggcgccgggctcggtgtcgcaggtgcgcgaatgcgcggcgcagctgacgcggatggccaagcaaagcggcatcaccgtgctgctggtgggccacgtcaccaaggacggctcgctggccggcccgcgcgtgctggagcacatggtggacaccgtgctgtatttcgagggcgattcgcactccagccaccggatgatacgcgcgatcaagaaccgcttcggcgcggtcaacgagctgggcgtgttcgcgatgaccgaccgcggcctgaaaggcgtgtccaatccgtcggccatcttcctgtcctcgtaccgcgacgatgtcgccggctcctgcgtgctggtgacccaggaaggcacccgcccgctgctagtggaggtgcaggcgctggtggacgattgccacggcggccagcccaagcggctggcggtgggcctggagcagaaccggctgtccatgttgctggcggtgctgcaccgccacggcggcgtcgcctgtttcgaccaggatgtgttcctcaacgcggtgggcggggtgaagatcatcgagccggcggccgacctcgccatcatcctggcaatggtgtcgtcgctgcgcgacaagcccttgccggaaaagctggtggtgttcggtgaagtagggctggccggcgaagtgcggccggtggcgcgcgggcaggagcggctgaaggaagcggccaagctcggcttcacccgcgccatcgtgccgacggccaacaagccgcgccaggaaatcgagggcctgaaagtgctggcggtggaccgcctggaccaggcggtggaattctgcagggagtag

SEQ ID NO: 3033 - DNA, 561 bp, Chromobacterium substugae
atgatagacgcccaactgatagagcaggagcggccctacctgctgcgttacgcgctggcgcagctgcgcgagcgcgacgcggccgaggaggcggtgcaggaaacgctgctggcggcgctggagtcgcagaacaatttctccggcaagtccaccttgcgcacctggctcacctccatcctgcgcttcaagctgatagacggcatgcggcgcaagggcagggagaagctgttcgaatcgctggaggacgaagccgacgacggcgatttcgatggactgttcagccaggatggccactggcgcgagccggtgaaggcctggagcgggccggaatcgcagctgatttcgcggcagttctggcaggtgttcgagcaatgctcgcaggtgatgcccaagcgcaccgcgatggtgttcgtgatgcgcgaggtgatgggtatggaaatcgccgacatctgtaacaatctggagatcaccgcgaccaactgttcggtgctgctgtaccgcgcgcggatgagcctgcgcgaatgtttttccatacgctggagccgggagggcgagctatga

SEQ ID NO: 3034 - DNA, 180 bp, Chromobacterium substugae
atgaagttgagttgccgcgcggccagccggctgatatccgccggattggaccggccgttgaccacgggcgaacacctgaagctgagaatgcacctgctgctgtgcggcaattgccgccagttctcgcagcagctggccttgttgcagcaggcggcgcgccgggcggggcagggcgagtag

SEQ ID NO: 3035 - DNA, 879 bp, Chromobacterium substugae
atgctgcagaaactgcttgccgatcatgacgacgatttgccggcggcggccgaagggctgcgtctgctggcggatgcggaaccgttgagcgacgaagaactgtccagcctgagctggctgatcaaccatgtggtcggcgagtcgcagggcggctgggaagccgcctggtcgctgcagcaaaagctgctgtcgcgagccgccgcgccccggctgctgcgcagcgccgccgtggccgccggcctggggggacaggaggcggatgcccggcaactggaggcccgtttggccgaagcctgcggcgtcagcggcgaactggcgggccgcgtggtgcgtttcgccagcttgcagcacctggcggccgggcagccgccgcggcaaacggcgcaggcgctggcgccgctgctggccgagtccttgccgccggccagcgggcaggacgcggcgctggccgccgcgctcaacaatatcgtgtccgcgctattggaccatccgcagctggacgaagcggacgaggcggtggcgcaggcgatgcgccaaggcgccgatcgcgcgcatgatttgtggctgcgggccggcacttggctgaaccgcgaacgcgcgcgctatctgcaggcgctggtggaaaaccgcctgggcgacgccgaggcggctttgcgggcggccgacgccggcctggccttgatcgccgccaatggcccggaggacgtggaccgggcgtttttgctgctggagcgggcgcgcgcctgccggcggctggataggcgcggcgaggccgaggcggcgtgggaacaggcgcggaggctggcggaggctttcgatcccgctttgcgcgagtggttcgaccgccggtcccaggcgctggcggcggcgccggcctag

SEQ ID NO: 3036 - DNA, 987 bp, Chromobacterium substugae
atgcccgccaaaccgtccgccccgcccgccgcccgcttgcacccgcgcaaccgccatcagggacgctacgatttcgccgcgctgatcgcggcatttcccgggctggccgcgcatgtcggcaagaacgctttcggcgacgagtcggtggatttcgccgacccggcggcggtgagggcgctgaaccgggcgctgctcaagctgttttacgatgtcgacggctgggacattcccgccggctatctgtgcccgccgattcccggccgcgccgactacatccacgcgttggccgatctgttggcgcgcgggcacaagaccggcattccgcgcggcgccggcatccgcgcgctggatatcggcaccggcgccaacgcggtctacccgctgatcggccatgccgagtacggctggagctttgtcggcaccgatgtcggcgacgaggccctgagcaacgcccaggccattctggcggccaatcccggcatggcggcgcatatcgagctgcgccggcagacctcgccgcagtcgatattccgccatgtgctggcggccgatgaatgcttcgacctgacgctgtgcaacccgccgttccacgcctcccaggccgaagccgacgccgctgcgcggcgcaaatggcagaatctgggcaaagacggcggcaagcgttcgcccaagctcaatttcggcgggcagaaccgcgaattgtggtgcgcgggcggcgaggaagccttcgtctgccggatggtggaagagagcgcggcgctggcggagcgggtgtactggttcaccagcctggtgtccaaatcggccagcctggccgcgatccagcgcgcgctgcggcaggcgggcgcccacagcctgaccgtgccgatggcgcaggggcagaagcagagccgcctggtggcgtggaccttcatggaccggcagcggcagaacgactggcgccagcgccgctggcagccgccggcggtgcggctggcggaaggctga

SEQ ID NO: 3037 - DNA, 351 bp, Chromobacterium substugae
atgaacgccatgctggtaggagccgataccctgggcaatatccccgacgtgctgcagaactacggcatcaccatccaccgccacctgagcggccgcaacagctcgcaccagcgcaaggtggaccgcctgccggcaggcaccgacctgctgatcctgttcaccgattttctcggccacaacgtgatgcgccatttccgcgacctggccgccgaggagaagatccgcttcatcgcctgtcgccgttccgtctgcgcgctcaagcagtcgctcaccggcgccggcatgtgcgaaaacccttgcgccgcctgcccgcaacgcgccagcgaaaaggccggcaagcgcaagcgctga

SEQ ID NO: 3038 - DNA, 132 bp, Chromobacterium substugae
atggccaccggccggccaggaaaaagcggaggaaaatccttttccgacaaggcattccgcgcgcggcagcccaaagcggcggccacgcttccgcgccaggctgaggaaaaaaaccttgaaaaacgcgattga

SEQ ID NO: 3039 - DNA, 786 bp, Chromobacterium substugae
atgacggtggcggtgtgggggaggtgggcgctgtgcgcgctgctgctggcgccgctggcgcgggcgggcgacggcccgtgggcgagggcgcagcgcgatcatgccttgctgatcggcctggaggggacgtttccgccgtacagccagatgaaggacggccggctgcaaggcttcgaagtggacttcggccgggcgctggcggcgcagatgggggtggcggcgcgtttccagaccgtgctgtgggagcatatgctgaatagcctggcggccgggcggctggatgtggtgatcaaccaggtggtggcgacgcccgaacgcgccaagcgcttcgatttttccattccctatacctattccggcttgcagctggtggtgcgcaaggcggacctggcgcgtttccataacgccggcgatctggccggctcccatgtcggcgtcagttcgggttccaattacgagcaatggctgcggacccatgcgccgcaggcccacgtgcatttgtatcaggacgatccgaccaagtacgacggcctgcgccgcggcgaggtggacgccatcgtgatcaaccggctggcggcgttcaatctgtcgctgcagagcaagggcgagctggtgccggccgggcgcatgctggcgcgggaggatgcctgcgtggtggtgcgcaagggcaatccgcagctgctggccgaggtgaaccgggcgataggccatctgcagcgcgacggcaccttgcaggcactatcgcgcaaatggttcaaggccgacatcgtcagccggccgcaatag

SEQ ID NO: 3040 - DNA, 960 bp, Chromobacterium substugae
atgaaaatcgcctccgccaccgtcagccttggcagcagcttcagccagagccaatccctcagcgtcacccagaccctcgccgtgcagcaaccaatgccgcaagccgacagcgtgcagctgagcagccaggcgacccagtccagcctgctcggccatctggcctcggacaaggacgccgtctacagcttgatcgaagcgatactggagaaagccttcggcgtccacttcaagctgctgtgcctgtttccgctcaacccagaccaaacgcaagcgccggccgcagcccagcccgaagtcagcgcgcagcaggacatagattaccaggagcagcagcggctcaatttcaccgccagcgggcagatcaccacccaggacggcaagcagttgcaattctcgctgaacatgcagatgcagagcagctatcaataccacagcaaccagcgctaccagtccggcggagccgcaagccacgacccgctgatggtcaacctggctagcaacgccggcagcctggacggcgccagcgtcagcttcgacctgcaggacaacggccagatggcgagcctgcccttctccagccagggcggctggctggctctggacaagaacggcgacggcaagatcaatgacggcagcgagctgttcggcccgcagtcgggcaatggcttcgccgacctggccaagctggacagcaatcacgatggcgtgatcgacgagaacgaccccgccttcgcccagctgaagatctggactggccgcgacagcagcggcaaggaccagctgctatcgctgaaggatgtcggcatcggcgccatcctgctgcccagcgtcgacgcgccgctgacgctgcgcgccaatgccagcgaccccgccccgcaagcgcagatgcggcgcgccggcgtcttcgtcaaagacgacggcgaagccggcatgatcagccagctggacgtctacggctga

SEQ ID NO: 3041 - DNA, 150 bp, Chromobacterium substugae
gtggctggtctggtcgatctggcgctccggcaaggacttataagccggcaagcagccattggaaccattggcaataaggaaaactgcggcgtcaagtcgacggcggacaggtcgatagcagggggtgcgcccatcaggacatcgccatga

SEQ ID NO: 3042 - DNA, 1620 bp, Chromobacterium substugae
ttgattcgtcatggcctgggagagttcgcccagcggctcaaactgccgcgcgcggtggaaaaggccggcgagtggctaaatctcggcctgcccgacggcgctgccggccaacccaccgcggtgcgggtgcggctggcgttcgaggagctggggcccactttcatcaagctggggcagatcctgtccacccgggtggacgtattcccgcccgactggatagacgaattcgaaaaactgcagaaccaggtgccgcaagtgccggccgccgcggtgaagaagctgatccgcgaagcgctgggcgccgaaccggacgaactgttcgccgaattcgacatgcgcccgatcggctccgcctccatcgcccaggtgcaccacgcccggctgccggacggccgcgaagtggcggtcaagctgcgccgcccgggcatcatggaaaaggtggaggccgacctgcgcatcctggcccacctcgcccacctcttggagctggagtttcccgagctgcgccgctaccagccctccagcatcgtcgcccagttctcgcgctcgctcaggcgcgagctcgacctggcgatagaagcgcgcaatatggaccgcttcgccaaggacttcgccgacgatccgcacgtcgtcgtccccaaggtgcattggcaatacacccgggccgcggtcaatgtgcaggacttcgtcgacggcgtctccgccggcgaactggcccggctggaatcgagcgggctggacccggtgttgctggcgcaacgcggcgccgacgcggtattgaagatgatactggtcaacggcttcttccacgccgacccccaccccggcaacgtgttcttcctggccgagcaccgcatcgccttcatcgacttcggcatggtgggccgcatcagccacgtgcggcgcgacgagatcgtcgacttgctgtctgcggtggccgagcacaacgagcacgggatcatcgacgtgctggtcgagtggaccggcaacacgccggtggacatgcagaaattcgccgacgaagtgggcgaattcatgttccagtacgaacacgtgccgctgaaggggctgaacatcagccagctgatcgccgacatcatgacgctgatccgcaaccacggcatcgtgctgccgccggacatggccatgctgttcaaggcgctgatcacgctggagggcctgggccgccagctcaaccccgacttccagctggtcgcgcacatcacccccttcgtcaaggagttgatcgtcgcccgctatcatccggcggcgctgctcaagcgcggccgccagtcgctgtcggaagggctggagatgatcaccggcctgccgcgcgacctggtgcgcatcggccgcgacatgcgccacggcaaattccgcgtcaacctcgacctgcagcggctggacaacttcggcaagcagctggaccgcagcagcaaccggctgaccatgggcatcgtcaccggctgcctgatcataggctcgtccatcgtgatgacggtgaacgccggccccaagctgttcggcctgccctttttcggcttcgtcggcttcatgctggcgctgttcaacagcgtgtggctggtctggtcgatctggcgctccggcaaggacttataa

SEQ ID NO: 3043 - DNA, 738 bp, Chromobacterium substugae
atgaaattgcaactccgcttatcagcgctggcgctggcgggcttcatggtttttgcccaggccgcgccagacaaggctacaccggacaaggctcccgcagaggggaagcccgccgccgaaagcgcggcgccggacaaaccggacgaccccatctccaaatacgccgcgccccaagaggatgcggtgggcgacctgcttttgcaagcgatgagcctgctgggcgtcgcctaccgcttcggcggcaacacgcccgacgacggcctggactgcagcggcttcatccgctatgtatttcagaagtcgctgcgggtgaacctgccgcgcaccgccgccgaaatggccaaggtgggcaagtcggtggcgcgggccgaactggtgccgggcgacctggtgttcttcaacacgcgcggcttcaactattcccatgtcggcatctacatgggcaacaacaagttcatccacgcgccgcgaaccggcaagaacatcgaggtgtccaacctgacgcagagctactggagcgcgcgcttcaacggcgcgcgcagggtcaatcgtagcactgccgggcagacggcggacacttccgatgacgtcagcgtaaaaggcgcggcgaaaaaggccgcgccggcggcggaggtcaaatgccgcaagggccacaagaagtgcaaggcggaggccgcccgcggcaagtcgtcaggcaaggcggcgaagggcggcaagaagaaaaagggcaggcactga

SEQ ID NO: 3044 - DNA, 222 bp, Chromobacterium substugae
atggcattgaatatggaatttccggtgtggcgcgaccccgacggcaacgtggtggcctgcgtcgaaaaactgaaagtgatgcgcgagaacctggaggagatcgcgcagatggcgcaggacgccttcgaggacgccgtgctgatgggctgcgacgaaaaacaggtgcgcgacttcatggtggcgatgatgcagaacctggacaacccctaccgcaccgaatga

SEQ ID NO: 3045 - DNA, 1239 bp, Chromobacterium substugae
atgccatttgaagcctttatcgggctgcgttacctgcgcgccaagcgccgcaacgggttcatttccttcatttccctgatttccatcgtcggcatcgccctgggcgtggcggcgctgatcatcgtgctgtcggtgatgaacggtttccagaaggaaatccgcggccgcatcctcagcgtggcttcccatctggaagtgagcagctacgatggccgcctcggcaactggcagggcgcgcgcgacatgctggtcaagcagcctcacgtcgtggcggccgcgcccttcgtcaacagccagggcctgttcgtcgcctacggcaatgtgcgcggcggcctgctgcgcggcatcgatccggcgcaggaagacaaggtggtggacgtgggccgccacatggtggccggcaagctggaagacctgaagccgggcagcttcggcatggcgctgggcgtggagctggcgcgccagctgggcgtcggcgtcggcgacaaggtgacgctgatgacgccgcaaggcaacatcacgccggccggcatgattccgcgcaccaagcagttcaccgtgaccggcctgttcaaggtggacatgttcgaattcgacgcctcgttggcgatggtcaatctgcgcgacgcgcagctgctcgcccgcatgggcgacaccgtcagcggcgtgcggctgaagctggacgaccccatgctggcgccgcagctgaaggccgatctgcgtccgcagctgccgcagctgatggtgaccgactggaccgacaccaacgccaactatttccgcgcggtgcagatagaaaaacggatgatgaccatcatcctgacgctgatcgtcgcggtggcggcgttcaatctggtatcgacgctggtgatggtggtgaccgacaagcaggccgacatcgccatcctgcgcacgctgggcgcgtcgcccggcagcatcatgaagatcttcatgatccagggcgcggtggccggggtgctgggcacattgtccggcgccgtcggcggcgtggtgatcgcgctcaatctggacgtgatcgtgccggtgatcgagcgcatcatcggcaccaagattctgtccagcgaggtgtacatgatcgactacctgccgtccgacgtgcagtggggcgacgtgtccaccatcaccatcatttccctgttgctggccctgttcgccacgctgtaccccagctggcgcgcggcgcgcacccaaccggcggaggcgctgcgctatgagtaa

SEQ ID NO: 3046 - DNA, 687 bp, Chromobacterium substugae
atgagtaaggtattgagctgccaggggctgggcaagcgttacgaggaaggcaagctggcgctggacgtgctcagcgacgtcagcctggaagtcgccaagggcgagcacctggccatcgtcggcgcgtccggttccggcaagagcacgctgctgcatctgctgggcgggctggacagccccagccatggcacggtggaggtgctggggaaggacttgtccaagctgtccgagcaggagcgcggcaagctgcgcaatgaatcgatgggcttcgtctaccagttccaccatctgctgccggaattctcggcgctggagaacgtgatgatgccgctgttgatccgccgcatggacaagaaagaggcggcgcgccgcgccggcgacatgctggagcgggtggggctgggcaagcggctggagcacaagccgggcgagctgtccggcggcgagcgccagcgcgcggccatcgcgcgggcgctggtgaccgagcctgcctgcctgctcgccgacgagcccaccggcaatctggatgcccagaccgcgcgccaggtgttcgagctgatgctggagttgaaccggacgctgggcaccagcctgatcatcgtcacgcatgacctggacctggcggcgcgcacccagcgggtgttgcgcctgaacgaaggcaggctggcggcgcccgaatccgcctga

SEQ ID NO: 3047 - DNA, 1287 bp, Chromobacterium substugae
ttgctgttcatccgcaaggaaatgaattttttcgcgttgcttgacgcgctgcagaccgagaacggcctgatcgagctgggcctgggcgcgctgtgcgtgctggccgcctacgcgatcgcccgccgcttgttcatccactggttcgcccatcaccccgagcgctacgaccgcttcctgccctataccggcttccgcctggtgctgccggtgtcggcccagttgctggtggtgctggtgagcctggcctggagccgcttcgagcacgcgcctatgctggtgctgcacatcatcagcgcgctgctgttctggctggcggtgatccggctgtgcacggcggtggtgcgccaggcgctgccgcaaggcaagttcgagcgcaataccgaacactttctggcctcgatgttctggctgggcttcgtcagctggaccataggcttcgacgtggcggtgatggactggctggagtccatctccttccacatcggcaagacccggctggatctgctgaccatcatcaacggcctgctgtgggtgacggtgatcgtggtggtggcgctgtgggccagccgcctgcttgaagcgcgcatcatgaagctcaagcacctcgaccccaatctgcgcatcgtgttcgccaagctcacccgcaccggcctggtggtggcctcggtgctggtggcgctgccggtgatgggcatagacctgaccgtgctgtcggtgttcggcggcgcggtgggcatcggcctgggcctgggtttgcagaagatcgccagcaatttcgtgtccggcttcatcattctgctcgaccactcgatccgcatcggcgaccggctgatggtggacaaccgcgtcggctacgtcaccaagatgacttcgcgctacgtggtgctgaagggcgccgacggcaccgaggcgctgattcccaacgacgcgctgatgtcgaatacggtgatcaatcagtcgtactccgacaagaatatgtggaccagcctgccggtgcaggtggcctacggcaccgacctcgaccttgcgctgtcgctgctgaagcaggcggccgaccagccgcgggtgctgaagaacccggggccgaacgccttcgtcacgctgttcgccgacagcggcatcaacctggagctgggcttctgggtggctgatccggaaaacggcttcatggggctgaagtcggacatcaacctggccatctggcggctgttcaagcagcaccatatcgagattccgttcccgcagcgggaagtgcgcatcatcggcgacaagcccgcgcaggcgtga

SEQ ID NO: 3048 - DNA, 621 bp, Chromobacterium substugae
atgagcgcaaaacggctggccatcatcgacgacgacgaagcggtgctgcaatcgttgctgtggctgctggatggccagggctaccgcgccgacggcttcgacagcggggaggcctttctcgccgacggctgcgaggcggagtacaacggcatcattctggatctccggctgtccggcatcagcggcatcgtgttgctggagaaactggccggccggccgtactgcccgccggtgatcatgctgaccgcccacggcgacgtgccgcacgcggtggcggcgctgaagctgggcgcgctcgatttcatcgagaagccgttcgacgacgtgcacctgctggagcgcgcggcggcggcggtggcgctggacgagcagaaccgccaactgcatggccatcagcgcaaggtgtcggcggcgctggcgctgctgaccgagcgcgagcgcgaggtgatgcagctgatcctggccggcaagctgaacaagcagatcgccgaggaactgagtatcagcatgaagacggtggaagtgcaccgttcgcgggtattcgagaaaatgggcgtcaagtcggcggtggaactggcgggcatgctggcggcgccgggcgcgcagggaggcaagctctga

SEQ ID NO: 3049 - DNA, 453 bp, Chromobacterium substugae
atgggcagcaagcagccggtatcggtactggtggtgatacatagcaaggacggccaggcgctgttgatggagcgcgccgacaagcccggctactggcaatcggtgaccggcagccgcgaaggcggcgaggcgctgatcgacaccgcgcgccgcgaagtggcagaggaaaccgggctggacatcggcgccggccagctcagcgactggggcatcgtcaaccgctacgagatctacccgcattggcgccaccgctacccggacggcgtcacccacaacgacgagcacgtgttcggcctgctgcttgacgcgccgcgcgcggtgacgctggccccgcgcgaacacctggcctaccgctggctgcgttgggacgaggcggccgcgctggcgttttcgccgtccaacgccgaggcgctgcgcttgctgccgggccggctgggcctgccggaagcgtag

SEQ ID NO: 3050 - DNA, 330 bp, Chromobacterium substugae
atgacactccaccgcatcgccgccgcgctggcggccctgctgttcgcgctcgccccggccgcctggccggcgccggcgaccgtgaccatagacatttccaaattcgcgttcaaccccaaggagatcaccgtcgcgcccggcacccgcattatttggaccaaccgcgacgacaccccgcacacggtcaacagccgcgacaagatcttcgcgtcgaaggcgctggacaccgacgacaagtatgaatacaccttcgccacgcccggcgacttcaactactactgcgtggtgcacccgtatatgaccggcgccgtgcacgtgcgcaagccgtaa

SEQ ID NO: 3051 - DNA, 972 bp, Chromobacterium substugae
atgaagcaagaggaaagcaggcagcagacgacggacggagacgcgcccgacggcggacggcgcaaaaccttgtcctgtctggccgaatggtccggcgcggccatcgtctggacgatatcgggaggcatcccccacgcgctgggcgccggcaacgcggcggccgccgcggacggcaaggcgctgaccttcgtgcagatcagcgacacccacctgggctttcacaaggaagccaatccggacgtggtgggcagcctcaggcaggcgatagccgacatcaacgcgctgccgcaagcgccggccttcgtgctgcacaccggcgacgtcagccacctgtccaaaccggaggaattcgcgctggcgcgcgatatcttcaaggaaatccgcaccgaccgcgtgcatgccattcccggtgaacacgacgcgatagacgacggcgtcagcggctatctgaaattcttcgaccacgacggcaagagccgcgcctggtacagcttcgaccagggcggcgcgcacttcatcgcgctgaacaatgtgctgaatttcaatatgggccggctggcggcgctgggagaggagcaactggcctggctgaaaagcgacctggccggcgtttcgcgctccactcccatcgtggtgatggcccacattccgatgtggaccgtctacgaaccctggggctggggcaccgccgacgcggcgcaggcgctggcgctgctgcggccgttcggctcggtgaccgtgctgaatggccacatccaccaggtgctgcaaaaagtggaaggcaatatcgcgctgcacaccgcgcgctcgctggcctacccgttgcccacgcccggccaggccggcgtcggcgagcccggtccgctgaaggtgccggccggcgagctgggcaaactgctgggcacccgccaactgacggtagtgcccggcgcgcagcggctggcgatgatagacaggccgctggtccgctga

SEQ ID NO: 3052 - DNA, 1308 bp, Chromobacterium substugae
atgaacgccccgtccccgcactcgtacaagattcccacccgccgctggcgcataggctggctgctgggcgtcggcatcctggtcaattatttcgaccgcatcagcctgtcggtggccgcgccgcagctgcagcaggagtttggactcagcaacggcgagctgggcctgctgttcagcgccttcttctggagctacgcgctgctgcagattcccaccggcgtgatcctggaccgcttcggcgccacccgcatcggccgcctgggcgcgctgctatggggcgtggccgccaccctcaccgcctgcgccggcggcttcgccggcattttcgccgcccgcgtgctgctgggcgtcgccgaggcgccgggcttcccggtcagcgccaaggccaccggctactggtttccgcgccgcgagcgggcgatggccaccgccatcttcgacgccgccgccaaattctccaacgtgataggcgtgccgctggtggcgctggcggtggtgcacctgggctggcgctggggctttggcgtgtcggccatcctcagcgtgctgtacttcatcgccttctacctgctctaccgcgaccccagcgccgacgccaagctgagcgaggccgagcgccagtacatcatccagggcggcgcggccgaggaaggcgtcagccggcaagggtcgctggcaatgctgggctacctgctgcgccagcgcaaggtgtgggggctgtccatcggcttcgccgcctacggctatgtgttctacctgttcctgacctggctgcccggctacctggtgcaggcgatgcacatggacatcctgaaatcggcctggttttccgccatcccgtggctgttcgccaccgtcgccgacctgttcgtcggcggctggctgatcgacaagctgatcgcccgcggccatgacgaaacccgcgtgcgcaagacggtgctgctgtgcggcatggccatgggcatggcggtgttcggcgcgaccaccaccaccgacccctacgttgccatcatctggatcaccatcgcgctcagcggcctggccgcagccgcgccggtgggctggtcgctgccgtcgctgatcgcgccgcgcggcggcaccggcaccgtcggcggcatcatgaatttcgccaacaacatgatgggcgcggtggctcccatcgtcaccggcatcatcgtcggcgccacccactccttcgccaacgcctttctggtggccggcttcatgctggtgatcggcatcctggccttcgtgttcctgctaggccggatcgaaccgattcccgaacccggcgcgtcttcccgctaa

SEQ ID NO: 3053 - DNA, 663 bp, Chromobacterium substugae
ttggatgccgccgcgttgcgcggcgactacatatttcccgcgcccggccgaaaacttgatcccgctgcttgttatcgcagatttgttagcgctaacatccgcagacagatcgcgccggccaaaccgccggccatcatttcaaccatcaatgttagcgctaacatgaaatacggaaatatcgtggtgatgggcgtggccggctgcggcaaaagcagcgccggccggctgctggccgaggccttgaacgccagcttcatcgaaggcgacagcttccatccgccggaaaacatcgcgcggatgcgcgccggcgtcccgctcaacgacgccgaccgcgccggctggctggccaatctggccgagcggctgcgccagggccgcgccgacggcgaacgcatggtgctggcctgttcggcgttgaagcgccgctaccgcgacgtgctgcgcggcggcgaccccgacctcgccttcatccacctggccggcgagcgcgcgctgatcgccgaacgcatgcgcgagcgcagcggccacttcatgccggaaagcctgctggacagccagttcggagatctggaagcccccggcgccgacgagcgcgccatccactgcgacatccagcagccgcccgccgccttgctgcggcaaatcctgcaggcgctcgcctga

SEQ ID NO: 3054 - DNA, 1020 bp, Chromobacterium substugae
atgtcgagaaaaccgcggatccgctccggcggcggcgccaccatgcacgacgtcgcccgcgccgccggcgtcagcgccatcaccgtatcgcgggcgctgaaccagccgcagcaagtatcgccgcagctgcgcgaaaaagtgatgcaggcggtggacgcgctggcttacgtgcccagccgctccgcgcgcacgctggcctcggcgcgctctcgcaccgtgctggtgctgatcccctcgctggacaacacggtgttcctcgacacgctggccggcatcgaaagcgtgctggacgccgccggctaccagatgctgataggcaacagccattacagcgccgaacaggagctgctgctgctgcgcgcctacctgcagcaccagccggacggcgtgctgctcaccggcctgacccatgccgcgccgttcgaagatatcctgcgccggcgcgcgctgccggcggtgtacatgatggacctggccgacgatggccgctgctgcgtcggtttttcccaggaggcggccggcgccgccatcacccgccacctgctggagcggggcaagcgccgcatcggctttctgggcgcccaattggatgagcgggtgatgaagcggctggacggctaccgcgccgcgctggatgccgccggtctgcgcgacgccggcctggaatggctggacccgtcgccgtccagcatgcggatgggcgccgacatgctggacgccgcgctggcggcgcggcccgactgcgacgcgctgttctgctgcaacgacgacctggccatcggcgcgctggcgcgctgccagcaactgggcatcgccgtgccgcaacggctggcgctggccggcttcaacgatttgcagccctccgcctggtgcacgcccgccctcaccaccgtggccaccccgcgccgcgagatcggcagccatgccgcgcgccagctgctgcggatgatagacggcggcgagcccgacgctctgcagaccgatctaggcttccagctgatgctgcgccgcagcagctga

SEQ ID NO: 3055 - DNA, 618 bp, Chromobacterium substugae
atgtatctgcccaagcatttcgccgtcggcgaccgcgaggccctgctgcggctgatgagggcgcggccgctggccacgctgacgctgaacgggccggacggtttgatcgccgaccacatcccgctgctcgcgcgcgaagagggcggcgtgttgcggctgtgcggccatgtggcgcgggccaatccgctgtggcggctgttggagggcggcgcggacgcgctggccgtttttcacggcggcgacgcctacgtgacgccgtcgtggtatccggccaaggccgagcacggcaaggtggtgcccacctggaactacgcggtggcgcacgcctatggccggctgcgggcggtggaggatgcggcctggctgcgcggcctgttggacgagctgacccgcacgcatgaagccggcttcgagacgccctggaaagtggcggacgcgccggcagattacatcggcaagctgctgggggcgatcgtcggcatcgagctggaagtggcgcggctggagggcaagttcaagctcagccagaaccaggccgaagccacccgcgacagcgtgcggcgcggcctggcttcgcggggcgccgaactggcggacaggatggccgaacgccgctag

SEQ ID NO: 3056 - DNA, 861 bp, Chromobacterium substugae
ttgggcggtaaccccttgtcgcgcgaggaaatggggatggagtttctgttcgatctggatgatcccctgcaatgtctggagcagatctaccaacaactcagcccgatggtggtggccttccagccgcagcagcccggcgccaagcccggacgctgcttcggcagcggcctgctgctggactaccgcggcgagaaattcatcgtcaccgcggaagcggtgttggccgaggcctgcgtcgcccacggccagcaagtgctggcctgcgtcgacaagctgcagctgccgctgcaggatctggcctgcgccagtccgcagcacatggacatcgccgccatccacctgccgcagccctggctggagcggcacgccccgccgcatggtttcgcgctggatcacggcggcgcgcccgacccgcttgccagcgccttcaccctgctgctgggccacccggtgcgcggccccaaacccgccagccagctgaatagccatatcggcatcgtatcccgcgcctaccgcggcgacagccgccgcagccaggtgatccaccccctgttcgtcgagttcgacagccgcgacatcctcagccgcgccaagctggacaaggccggcctgcaagagtactaccagctgtgcggcgcgccggcgatcagcctgtaccactcgttccaggacgacagcaaccggctcaccgcctatctgcagggcgtggtagtggagtgggaccgcgacggcatcggcgccaccgcttccagcgccgcgctgctgccgggctttctcgacaacttcctgcagcaactgcggcgcggcgacgcccacggccgcgccgaagtcgcgtcgctgctggagaaataccgccgctag

SEQ ID NO: 3057 - DNA, 4185 bp, Chromobacterium substugae
atgccgatgagcccgcggatgaaattcatcctgcttgccgtaagcagctatgttctttttgccctggcttggattttcttcgccgatcagctgccggttggggcggaaacgggccgcttgctgccgttgccgctggtcaagggagtcgccttcgtcgcggtctccgccgtcttgctgtcgctgctgctgcgctcggtgccggcagccgaggcgccggcgtcgctgacctggctgggggccgtgtccagcggcatgaatccggaccgctggtcgggctggcgcggctatgccgcggcgctggcgcttaccgcctgcgcgttggggctgcgccagctgctgctgggcggcgacagccatcccatgctgatgctgctggccctgccggtcatcctgagcgccggcatcggcgggctggggccgggcctgctggctaccgtattggccgcgctggcggccgatctgatggcgacgccttatctgcatgatccgctgacgccctggaccgagcgcttgcagctggccttcctggtggccaacggcttggcggccagcttgttcaacgccgcgctgcggcatgcgttggcgcgggttgagctcaaccgcaggctgctggacgcggtggtgtccagcacatcggacgccatcttcgtcaaggatccgcaagggcgctacctgctggtgaaccgcgccggcctggcttttgtcggcaagagcggcaaggaggtgctgggccaggacgaccgtgaggttttcgacgcggagacggcgcgggaagtgatggccagcgaccgcgtcatcatgcagggcgggcgcgtgcagacccacgaggaattgctgacgctgcagaacggcgagaagctggtgtttctggtgaccaaggggccgatttacagcccggatggacgcctgggggggttgttcggcatttcgcgcgacatcaccgtgcacaaggcggccgaggaggcgctgcaggcgagcgaggcggcgctgcgccaggcgcagcagttggccggcatcggcaactggtcctgggacttggagacggacacgcatcgctggtcgcacgaagtttaccggctgttcggcctggacaatcgcgcgccgccgccgggctacccggcgatacagcgctatttcgtcaaggagagctggaccgtgctgtccgaagtggtggagcgctgccgcctgataggcttgggctacgactgcgatctggagctgcagaggccggacggcgccgcgtgctgggtgacggcgcgcggcgaggccaagcacggcgcggagggcaagatcgtcggcttgtacggcacggtgcaggacatcaccgaccgcaagcagatatcgatgcagctgaaggccagcgaagcgcggctgcagctggtggcggaagcgaccagcgacggcttctgggattgggacctgcgcaccgggagagtctaccgttcgccgcgctattacgaggtgaccggcacgcgggcggaggacgataccggcgatttccgctttttccggcaactggtgcacccggcggatctgcctttcgtgctgcaggcgatcgaggcccatcgccgcggcaagacgccgcgcatcgaactggagttccgcctggcgcgacaggacgacggcgtgcgctggctgcaggtgcgcggccgagcggtggaatgggacgacaagggcgcggcgctgcggttggtgggcaatttgtccgacgtcaccgagcgcaagcgggtggacgacgacctgcggctggtgctgaacgaggcgggcgacgccatctgggtgaccgacgccgacggttattacatcttcgccaatccggcggcctgccggctgacagggcacgtgctggaagagttgaagtccatgcatatccgcgacctggttgcgccggaatgcctgggcgcgctgcccgagcatctggccaagctgagcaacgggccgttccagcgttcggagtggctgctgcggctgaagcagggcggcagcatctgcgtcgacctgaccaccgggcgcttgaaggacggccgatacatggctttcggccgcgacttgaccgagcagcatcgcgccgagcaggcattgcgcagccgcgaacagcagctggcgcgggtgatagacggttcggaccagggctactgggactggaacctgaaaagcggcagctttcaggtgagcccgcgctgggaaagcatgctcggttacggtccaggcgaaatgcgcatcaccgccgagaattggtacgaccatgtccatccggaggatgtcgaacggacgcggtcgtcgatccagggcaatctgcgcggcgagctggccagccatgaggtggagatacgctgccgcacccgcggcggcgactggcgctggattctgtcgcggggccgggtggtggagcgcagcgacgagggcgaggcgctgatgatgtcgggcacccataccgacatcaccgagcgcaaagtgttcgaacagacgcagaaggaagcggcggcggtgttcgacagcagctacgagggcattctgatggtgagccgcgagggcgtgatcaccaaggtcaacagcgccttcacccgcatcaccggctacagcgccgaggaggcgataggccgcaagcccagcatgctgtcgtccggccagcagtcggccgaattctacgaggatttgtggcagtcggtgctggggcacgatttctggcgcggcgagctgtggaaccagcgcaagaacggcgagttgtacgccgaactgctgtccatttcggtggtgcgcgacgctcagggcgaagttttgcactacatcggcattttttccgacatcaccaagctcaaggcgcacgaagccgagctggaccgggtagcgcatttcgacccactcaccggcattcccaaccggcggctgctgtccgaccgcctgaaccaggccatcatccgcgccaatcgcagcggcaagtcctgcgcggtgtgcttcctcgatctggacgggttcaaggcggtgaacgaccagcacggccatgcggcgggcgaccagctgctggtggcggtgagccgccatctgaaatcgatactgcgcgccgacgacaccctggcgcggctgggcggcgacgagttcgtggtgctgctgtccgatgtcggcacgctggaggagtgcatgctggtgctggaccgcatcctgagcgcggtggccacgccggtgcgtctgggcgaggcggaggtgcgcgtgaccgccagcattggcgtcagcctgtacccgcaggacaatgtcgacgcggacacgctgctgcgccatgccgaccaggcgatgtacctggccaaggacggcggcaagaaccgttaccagctgttcgatccggaaaacgaccgcaaggcgcaatcgcatcggcagttgctggatatgctgcgccgcggcctggcccggaaggagttcgtgctgcactaccagcccaaggtgaacctgttcgacggcgaggtcatcggcgtggaggcgctgatccgctggcgccaccccaagcgcggcctgctggcgccggccgagtttctgccgcatctgcgcggcaacgagctggagctggcgttcgacctgtgggtgctggacgccgcgttggcgcaggccgccgaatgggtggggcgcggcctgaacatacgggtcagcgccaatatcagcgccagcctgctgctgcggccgaatttctgcggcgagctggaagcgatcctgggccgccaccccgcggtcccgtccggctatctggaactggaggtgctggaaagcgccgccatcaccgatgtggagcaggcgacgcgggtgatggagcgctgccgcgaactgggcgtgcgcttcgcgctggacgatttcggcaccggctatgcttcgctgacctttctgcgccgattgccagtggataccctgaaggtggacttgagcttcgtcagcgacatgctgggcaaccaggaagaccggcgcgtcgtcgaaagcgtgatccagctggcatcggccttgagccggcaggtggtcgccgagggcgtggagacgctggcgcacggcatgctgctgcgccagctgggttgccgttatgcccagggcctgggcatagcggcgccgatgccggcggacgaggtgcctggctggtgccggcagtggcgcgacgacggggcctggcagcgcttgcttgccgcggagccggcgccggaccggggttga

SEQ ID NO: 3058 - DNA, 144 bp, Chromobacterium substugae
ttgagcgcggctggcaatattggtattgaagccgcatgcgttttgcatgtatatgttggcctggcggcggatggcctgcgttccggggattgccttggcaatcgatggccgcaggccttgtttgttacagggggcggaatatga

SEQ ID NO: 3059 - DNA, 474 bp, Chromobacterium substugae
atgacggcggcgagtccgaaagcgaccatccgtctggcgcgcgcagccgatgccggcgaattggcccgcttgtaccggcagttggtggacgacccggccatccgggtgctgcccgaacgactgcaggcgctcgcggacggcgaacgggcgcaggtgctggtgtgcgaaggcgaaggccggctggcggccagcgcctggctcggtttttgcgaggacgtgatgtacggcggccaacctttcgccgtgctggaaaacatcgtggtggaccgggactggcgcggccgaggcctgggccgcgcgctgctggacgaggcgcggcggcgctgcctggctaggggatgctcgaagatcatgctgctcagctcggcgcagcgggccgacgcgcaccgttttttcctgcaggcgggctttcgcggtgacgccaagcgcggcttcgtcatgtaccggcgggatatggccgcggcgcaaacatga

SEQ ID NO: 3060 - DNA, 969 bp, Chromobacterium substugae
gtggcacgcaatatcgaaatcaaagccagggtggcggactgggcggctctggaacgcaaggtgggcggcctggcgcagccggagggcgcgctgctgcaggacgacagctttttcgcctgcggcaacggcaggctgaagctgagggtggatggggaggggcgggggcggctgattttctaccggcgcgaagacctggccggtctcaagccttcgttctttctggccagcgaaaccgccgctccggacccgctgcgcgaactgctggccgaggcgcacggcttgctgggccgggtgcgcaagcagcgcagccgctatcgcttggggcgctgcgccatccatctcgatcgagtggaaggcttgggcgacttcatcgagctggaggcggagctggccgatggcgagccggaagcggcggcgcgcgccgaaatcgaggccttgatggcggcattgggcatcgccggcgccagcctggtgcgcggcgcgtatttcgatttgcaggccgaagcggcgcgcgacgccatccgcatcgggctggagcgcgccgatcagccggaagtcgtggcgctgatcgacgagctggatgcctatcagaagcccttgtctccgccggaaagccatcatggcgtggatatcgagacgctgctgcgtcccgacgtggcgttcgccgtcgctcgcgacggcgaagggcgggcgctgggttgcggcgcggtctggtgcgcggacggcgtcggcgaattgaagcggatgttcgtgcggccggcgtggcgcggcctgggtgtggcgcggcggctgatggcgtttctggaggaccaggcaagggcgcgcggctgcgaggcgatggcgctggaaaccggcgtcctccagcatgacgccatcaccctttaccagcgcgccggctatggcttttgcgggcctttcggcgcgtaccgggaagacccgcacagcgtgttcatgcagaagccgctgtga

SEQ ID NO: 3061 - DNA, 672 bp, Chromobacterium substugae
atgaaaatcgccatgctggcgctatgctccgcgatggccctgagcctgccggcccgggccgagacgcccgcccagacggaaaacctgttcaccctgccgctggacgccttccagcaaagcaaggcgcagcccagtcaacgcgtgtatctgaaaccgggcgtggatctgaagtcctatcacgcggtgctgccggagccgctgctgttcatgcgccaagggccggacggcaactggcagctgctgcagccgggcgacgagaacgccatcgccagctatttccaccaacggctgcaggcggaactggccgccgcaggcgtgccgatcgcgctgcagccggcgccgggcgtcgcccggctgcgcgtcgccgtcaccggattgagccaggaacgtcccggcgtcgacccgatcgacctgctgccggtcaaggcggtgttcaatctggcgcggctggccgccggcaaggagccctatctgctgaagatcgccagcatggcgcagctggaggattcgcaggacgccagcctgctggccggcaccgtcaacctgcgccagaacgccaagagcaaggacaaggagcagccgctgacgctggacctgatcaaaccgctggtcgacgactggtgccggcagagcgcccgccagctggccgcccacctgggcaaggcgccctga

SEQ ID NO: 3062 - DNA, 186 bp, Chromobacterium substugae
atgacgtcccccgacggccccagtccgcgcaatctgctgcaatactggctgcacaagctcaccggctcccgcttgagcgctcatgacgaactgcatttcggccatctgcaagaagagttcgccctgaacctggcggtgatactctgcatcctcctgttgacgctgttcacctacctgcgcaactaa

SEQ ID NO: 3063 - DNA, 756 bp, Chromobacterium substugae
atggccggagatggcgcaacgccgccgcgcctggccggcggggaacgggcaatgggaaagatgaagggcgggtggctgctgctggccggcttggcgcaagcggcgccggcggcgcattaccaatcctacacgctggcggtggagccttggggcatgctggacaccgaccggggagtggggccggacttcatccgttttctggcggcgcaggccggcttcgaggtgacggcggaggccaggccttaccggcgggtgctggacggcatgcgcagcggcgagaacgccatcaatctcggcatcccttcgccggagcgcaatcgctacggcatcgccatctgcacgataggatcggtcaaggtgtcgctggtgtatctgaagtcggccgggcgcgagcaccatagcgccgccagcttctccgggctgcagataggcgaactgcgcgggagccggacgctagaggagtttgaccgcaccgtcaagcacaggccggtgttgctgagcgacatgagccagggcatgcggatgctggacgccaccgtgtgcgtgcggccgggctgcggcaatctgctggccgaagccggagtggagccggcggggctgggagagtggctgttcgccgaacagccgctggagatctacgtttcgcgcgccagcgccttgtcgcgtgacgccgccgccatgctgcgcctgcggttggcgtgcgactccgccgccggccggcaggaaatgcgccggctgctggcgccttaccgctag

SEQ ID NO: 3064 - DNA, 687 bp, Chromobacterium substugae
atgtctatcagcagcaccagcagcgactcgaacacctactggcagcagatgcaggccctgcatcagcaacgccggcaggacgtcaacaacctgacccaatcggtccagcaaggcgacatctccggcgcgcagcaggcgctggccgccttgcagcagctgaacggctccaacagcagcagcgctagcggcagccaggacttcagcgccgcgctgaacaacgccatcagcagcgcctcggcggccggctccagcaccaccgccgccagcgccgccgatccgttcgccgccgccaactccagcaccaccagcggcgctagcagctcgatatcgtcgttgctgaacaccctgggccaggatctgcaaaccggcaacatcagccaggcgcagcaggacttccagcaactgcagcaaggcctgcagcaagccggcggcacccagcaagccagcgcgggcggccaccaccatcaccaccaccatggcggcggcgaaaacggcgggcagagcggagggcagaacgagctcctgagcgcgctgggcggcacttcgcaaaccagcggcgccagcgccgccggcagcagcagcagcagcgcgaccaacacccagcaattgcaggccgcgctgagcctgtaccaagccaatgccggcagcaacgatatctccagcttgctcatgtcgctgtcggtctga

SEQ ID NO: 3065 - DNA, 609 bp, Chromobacterium substugae
atgctcggcgccctttgccggcggtggcggcgcagccgcctgcgcgatccccgctatgccggcctgttcgacggccatccggacgaactggtcagcctggactgcgaaaccaccagcctggatgtctcccgcgccgaactgctgtcgataggcgcggtcaagctgcgcggcaaccgcatcctgcacagcgaggcgctgtatctgctggtgcggcccggcatcgcccccgccggcgacaatatcgccatccacggcctgcgccgccgcgacgtcggccagggcctggcgccggaagacgcggtgcggcggctgctcgatttcatcggcgggcggcccctgctgggctattacctggaatacgacgtcgcggtgctcgacaaatacgtcaggccgctgctgggaataggcctgccgcagcgccggattgaaatctcgtcgcgctactacgactacaagctcagacagcatcccggcggccacatcgacctgcacctgtcctgcctgtaccgggagctggccattcccgaaccgccgcgccacgacgcgctgggcgatgcgctgggcgcggccatgctgtaccaggcgctgcgccaacgcggtttcggctga

SEQ ID NO: 3066 - DNA, 1806 bp, Chromobacterium substugae
atgagccgcttcgatttcagccacccgccattcgacagcctgacgcccgccgagcgcgaggcgctggaagcccgcgccgacatcgtctaccaccctgacggcgcccaggtttgcggccctggccagccgatagacgcgctctacgtggtgttgaagggcgtagtgtgcgaactggccggcgacgaggcggtggcgcgctacctcagcagcgacagcttcgacgcccgcgccgtggcggccggccagacgctccatcgcttcgtggccgaggaagaagcgttgctgcttgccttgccgcgcgacgcgctgctggcgctgaccgaaaaaaacccgcaattcggcgcctatttctacgccagcgcgtcgcagaaactgagcctgctggcgcagcgcgccggcggccgcgaactgcagaccttgcttgccgccaccgtgcgcgacgcaggctgccgccagccggtattcgtcgacgcagcggccagcatccgcgacgccgcccgcgcgatgcgggcgcagcgcagcaaatcggtgctggtgagagacggcgagcgcctgggcatcttcaccaccaccgattttcgcgacatcatcattgatggcgtcgacagcggcgagccggtgggaaggcactgcagctacaccctgctcaccatcgacatcgacgacttcctgttcaacgcgctgctgctgatgacccagcgcaatctgcgccggctggtggtcaccgaagacggccaggcggcgggcatcctggcccaggtcgacgtgctgtcctatttctccaatcactcccacctgatcgcgcagcggctggagcgcgcgcaaaacctggagcagctggccgacgcggcgcggcagatcacccggctggtcggcatcctgtccggccatggcgtgcggccgctgcagctgggacggctggtgcaggcgctcaacgcccgcctgttcgcccgcgcctggcagatgatcgcgccgccggcgctgctggaaaacagctgcctgctggcgatggggtcggaaggccgcggcgagcagttgctgaaaaccgatcaggacaacgcgctgctgctgcgcgacggtttcgcgccggacggcctggcggcctgctgcgacgccttctccgccgccctggccggcttcggctacccgccctgccccggccgggtgatggtgaacaatccgcgctggcggctgagcggcgcgcagatgcggcagcgcatcgacggctggatccacgacagcgacggcgaaaccatgatggagctggccattttttgcgacgcggaagcggtgtgcggcgacgccggcttgctggacgactgccgcagctatctgcgggacggcctgcaggacgatgccgcctttttttcgcgcttcgcccgcgccatcgggcaattcgataccccgctcgggccgttttcgcggctgcgcacccgcgaacatgacggccgcgagctgctggacctgaaaaaaggcggcatcttcccgctggtgcatggcctgcgcgcgctggcgctggagcatggcgtgcgcgaagcctccagccagcagcgggcgcgccggctggcggaggccggccaactggatccggcgctggccgacgacattctggaagcgctcgccttcctgctgcagctgaagctggaccacggcctgcgccgattggccgaagggcgcgagccggacaatcagatcgagccggccaagctgagcacgctggagcgcgacctgctcaaggacgcgctggcggtggtgaagcgcttcaagtcgcagttgcagcaccgctatcggctgggaagcttctga

SEQ ID NO: 3067 - DNA, 783 bp, Chromobacterium substugae
atgtgccagctcttgggcatgaactgcaatatccctaccgacatcctgttttcctttgaaggcttccatcgccgcggcggcctcaccgatcatcatgccgacggctggggcatcgcctttttcgagaacaagggctgccgcgtgttcctcgacgacaagccctcggtggaatcaccggtggccgacctggtgcgccgctacccgataaagtcggaaaacgtcatcgcccacatccgcaaagccacccagggcgaggtcaacctggccaatacccaccccttcatgcgcgagatgtggggccagtactggatcttcgcccacaacggcaacctggaggccttccagcccgagcccggccaacactaccgcccggtcggcaccaccgactccgagcgcgccttctgccatctgctggaaaaactgcgcgccaaatggtcggagccgccggaactggaagcgctgttcgacgaagtggcgcggctgtcagacgaaatcagcgcgagcggcgtgttcaacttcatgctgagcaacggcgaagcgctgttcacgcactgctccacccatttgcactacatcatccgccgctcgccgttcaacaccgcccacctggtggatgacgacgtcagcgtggacttcgccaccgtcaccaccccgcgcgaccaggtggcgatggtcgccacccagccgctgaccgacaacgagcactggcaggcgctgtcgccgggagaactgattctgttccgcgacggcgcgccgctgctgagccggacccgacccgcctga

SEQ ID NO: 3068 - DNA, 912 bp, Chromobacterium substugae
atggacaggctcaccgccatgcaggttttcgccgaggtggcgcaactcggcagcttcaccgccgccggcgacaagctggacatgtcccgcccgatggtcacccgctacgtcgacgaattggagcaatggctgggcgtgcgcctgctgcagcgctccacccgcaaggtcaccctcaccgacgccggcctcgcctgcctggcccgctgccagcagatgctggagctggcggccgaagtgcgggccgacgccagccagcgcgacggccagatgcgcggcctgctgcgggtgaccgccagcacctccttcggccaggcagtgctggccggcgccatcgccgaattctccgaacgccatccgcagttgcgggtggacctgcaattgggcgaccgcaccgtcaacctgatagaagaaagaatagacctcgccatccgcatcaccaatgagccagatcccggcctggtgggacggcggctgtgcgactgccgctcgctggcggtggcctcccccgcttacctcgcgcgccacggcgtcccgcgccatccgctggagcttgaagcgcaccgctgcctcagctacagcaacttcggccgcagcgagtggcgcttccagcaaggcgcggaggaagcgctgcgcgtgcgggtgagcggccgcatcagcgccaacgaggccagcgcgctgctcagcgccgcgctggccggcgccggcgtcagcctgcagcccagctacctggccgctccctacgtccgccgcggcgagctggtggcgctgctgcccggctgggagccggcggtgctggggatccacgcgctctatccttcgcgccggctgctgccgctggcgctgcgcgggctgctggacttcctggccgagcgcttcagcggcccgcaagcgccatgggaccgccagccatga

SEQ ID NO: 3069 - DNA, 861 bp, Chromobacterium substugae
atgatccgtcaaaccctgatcgccgccgccctgtccgccgccggtttcgcccatgcgggcgacctcaagctgtcggtttacaacgccgacggcaacagcttcaacgtcagctcggtgctggtgtccggcgacaaggatgccgtgctgatcgataccggcttcacccgcgccgacgcctaccgaatcgccgcccgcgtgctggacagcggcaagaacctgaaaaccatctacatcagccaggctgatccggactactacttcggcgcctcggtgctgaagcagatcttccccaaggccgagctggtggccgcgccggaagtgctggcccacatcaagggcaatgtgaagggcaaggtggcgttctggggcccgaagatgggcgccaacgcgccgcaagccaagccgctgctgccgaccgagatcaaggccgacaagatcatgctggaaggcaaggcgctggagctgcgtgacaccaagggcgtgatggcgcaccgcggctatgtgtggattccgtcgatccgcgccatcgtcggcaatgtcggcgtgtattccggcatgcatgtctggaccgcggatacccagaacgatgccgagcgcaagggctggtacaagcagctggacgacatggaagcgctgaagccggaaacggtggtgccgggccatatgatcgccggcgacaagatggacgtgtccgccatccgctacacccgcgactatctgaagacgtttgaagccaagaacgccgccacccgcaacagcggcgagctgatcgaagcgatgaagcaggcttacccgcaagcggccgaagtgtcgacgctggagctgggcgccaaggtgcgcaagggcgaaatgaagtggtaa

SEQ ID NO: 3070 - DNA, 702 bp, Chromobacterium substugae
gtggtaagcgagcgcgcgatgaaactgcattacttctacgacccgctgtgcggctggtgctacggcgcctcccccttgctgaaggccgtggcggcgctgcccggcgtcagcgtggaaatgcacgccggcggcatgatagatgagtccgaaggccgcaccgtcacgccggactggcggggctatgtgatgccgcacgacgcgcgcatcgcccagatgagcggccagcctttcggcgacgcctacttcaacggcttgctgaaggatatcggcgcgccgctggcctcggatccgccgatcgcggcgatcctggcggccggaaagctgggggccgatccgctggcgatgctggcccgcatccagcgcgcccattatctggaaggaaagcgcatcgccgaactggagacgctgagcgagctggcgcttgagcagggcctggccgcggcggacttcgctctggcctggcgcgaggcgagggcggaggcggagcggcatatcgcccagacgcgcggcctgatgagccagtgggggctgcgcggcttcccgtcggcggtgctggagcaagacggcaagctggagcggctggaattgtccggctggttcggcaagccggaacagctggccgccgaactggcgcagcggctgcccaagttggcggcatccggtgacgacgcgctgttctgcacgccggacagctgccgctga

SEQ ID NO: 3071 - DNA, 1323 bp, Chromobacterium substugae
atgcataaagggatcagcagggttttgcgcgggatgacgctggcggcggcgctggcctatggcggcttggcgctggcggcctgcccgaattgggcggaaggcaccgcctacaaggcgggcgatgtggtcagctataacaatgccaattacaccgcgctggtggcgcataccgcttatgtcggcgccaactggaacccggcggcctcgccgacgctgtggacgccgggcggcagctgctccggcggcgatcccacgccgccgaccccgccgaatcccccgacgccgcccagcccgccgccgggcaataccgcgccgttcgccaagcatgcgctgataggctactggcacaacttcgccaaccccagcggttcggccttcccgctggcgcaggtcagcggcgattgggacgtgatcgtggtggccttcgccgacgacgccggcaacggcaacgtcagcttcacgctggacccgggagccggcagcgtcgcccagttcatccaggacatccagacgcagcaggccaagggcaagaaggtggtgctgtcgctgggcgggcagaatggctcggtgacgctgaacaatgcgacccaggtgcagaatttcgtcaacagcctgtatggcatcctcacccagtacgggtttgacggcattgatctggacctggaaagcggcagcggcatcgtcgtcggcgcgccggtgatcagcaatctggtcagcgcggtgaagcagttgaaagccaaggtcggccccaacttctacctgtcgatggcacctgagcatccgtacgtgcagggcggcttcgtcgcctacggcggcaactggggcgcctatctgcctatcatcgacggcctgcgcgatgatctgtcggtgattcatgtccagtactacaacaacggcggcttgtacacgccgtattccaacggcgcgctggccgagggctcgaccgatatgctggtggcgggcagcaagatgctgatcgaaggcttcccgctaggcaacggcgcctccggcagcttcaagggcctgcggcctgaccaggtggctttcggcgtgccgtccggccgcagttcggccaactccggtttcgtcaccgccgacgccgtggccaaggcgctgagctgcctgaccgcgttgcaaggctgcggcagcgtgtcgccggcgcaggcgtatccgactttccgcggcgtgatgacgtggtcgatcaactgggaccggcacgacggctacccgttctccaagccggtggccgccagcctgcatcagctgccggcgacgcaggccaaagtgaaaaaggccgtccgcgcggtgcggacggcctggtaa

SEQ ID NO: 3072 - DNA, 729 bp, Chromobacterium substugae
atgaccatcaccgtcaacggcgttgaaatcagcgaagacatgatcgcctcgcaactggaacactacagcgacacccccagcccgcgcgacaccgccatccagcagctgatcctgcacaccctgctggtgcagcaggccaagagcgaaggcctggacgtcgccgacgagcagcaagccatccaggcgctgctggaccagaagctgcaagtcgccccgatcgacgaagccagctgccgcgaattctacgaacaatatccggaccgtttcgtcagcggcgacagcgccgtggccagccacatcctgctgcccaagggcgaaggcctggaagccggcctaatcaaggccaaggccgaaggcattctggccgaagtgcaagccgccccgtcgcgcttcgccgacctggcccgcgaacattccacctgcccgtccggccaacaaggcggcagcctgggccaattcggccgcggccagatggtgccggaattcgaacaggcggtattcagcaccgctgccggcgaaatcacgccccacctggtggaaacccagttcggctaccacatcatccaggtcaacgagcgcgccgaaggcagcaagatcggcttcgacgagatcaaggaccgcctgcagcaatacctgaccgatctggccgccaaccaagccatgcatgaatacctgaatggcctggtcggcgccgccgacatcagcggctattcgatgagcgcccagtaa

SEQ ID NO: 3073 - DNA, 783 bp, Chromobacterium substugae
atgcgtaaactcctgctgacaaccgccctcgtcgccgccttcgccggcagcgccatcgccgtggccggcccctccatcaacggccagcaaatcaccgacgcccgcatcgacgccgtcgccaaaatgatggaagcccagggccagaacgtgaccccgcaagcgcgcgaccagatcaaggaccagctggtcaccgccgaagtcctgcgtcaggaagccgtgaaaaagggtctggacaagagcccggaattcaccgccgagctggccaatatgcaagcgatggcgctggccaaccgcctggtcaaggatttcgagaaggccaacccggtcagcgacgccgacctgaaggctgaatacgacaagctggccgcctcggtgccggaaaccaagcaataccacgcccgccacatcctggtgaagaccgaagccgaagccaaggccgtgatcgaagcgctgaagaagggcaaggccttcgacaagctggccaaggaaaagtcgatcgacccgggcagcaagaacaagggcggcgatctggactggcaggaagccggcactttcgtagcgccgttctccgaagcgatgagcaagctggctaagggcgaagtcaccgccaagccggtgaaaaccgaatacggctggcacgtgatcaaactggacgacgtgcgcacccaacgcaatgtgccgtcgctggaggaaatccgtccgcagctgacccagcgcgtgatgggctcccgcatcgagaagtacgtcgccgatctgaaggccaaggcccagatccagcagtaa

SEQ ID NO: 3074 - DNA, 795 bp, Chromobacterium substugae
atgaagcattcccgtatcgccgcgctgctgctggctgccacgatcagcctgccggccgcagccgaatccatcgccgtggtcaacggcacctccatcgacaaggcggaattggacgccgccgtcgccaatgtggtgcaaagcaacggcggcaaggttcaggactcgccggaactgcgcgaacagctgaaaagctcgctgatcaaccgcgaactgatcctgcaggaagccgcccgccgcggcctggacaaacagcccgccttcgcccagcgcctgaacgaagtgcgcgccggcatgctgcgcgacgcgctgttcggcgacatcgtccagaaagccggcatcgacgacgcccagatcaaggctttctacgaccagcaggccgccaagctcgccgcagccaaggaagtggaagtccacgcctaccagatcaccctggccaacgaggcagacgcgcaaaaagtgatcgccgcgctgaagaagggcgccaaattcgaagacctggtcaaatccaagtccatcgatcccaacgccaagcaaagcggcggcgacatgaactggggcaatctgtcgcagatggaccccaagctggccgaagcgctgaagccgctctccaagggccagtacagcagcaagccgtaccagtcgcaactgggctggcacgtattcaaggttgccgacatccgcaacgcccagttgccgccgctggaacagatcaaaccgcagatcgcccgccagttgcaggaagaggcaatcgccaaggccgttgaagacttgcgcgccaagagcaagattcagtaa

SEQ ID NO: 3075 - DNA, 249 bp, Chromobacterium substugae
atgctggaagcggcgctgcagtcgctcgcgccggaacacctcgacattcaggacgacagcgccctgcacgccggccatgccggcgcccgggacggtggcggccattacacgctgaccatcgtcagcgcgcgctttgccaatctcaaccgggtgcaacgccaccggttggtctatcaaactctgggcgaactgatgaccagccgcgtccacgcgctggccatccgcgccctgaccccagaagaactctga

SEQ ID NO: 3076 - DNA, 303 bp, Chromobacterium substugae
atgctgtacgccatcatcgcgcaagacgcccccggcacccaggagcagcggctagccgcgcgccccgcccatctggcccgcctgcaggcgctgcaggatgccggccgcctgaaactggccggcccgttcccggcgattgacagcatcgaccccggcccggccggcttcaccggcagcctgatcgtggcggaattcgcctcgctggacgacgcccgcgcctgggccgccgccgacccctatgccgccgccggcgtctacgccgcggtggaagcgaagccattccgccaggtgtttcccgcatga

SEQ ID NO: 3077 - DNA, 534 bp, Chromobacterium substugae
atgaaattttttaccgacctcctccccgtcctgctgttcttcggcgcctactggctgacccgggacatgttcgtcgccaccggcgtcgccatcgccgtcaccgtgatcatggtggcatgggcctggatccggcaccgcaaggttgaaaccatgcaatggttcagcctggccctgatcgtggtgctgggcggcgccaccttgctgctgcacgacaagcatttcatcatgtggaaacccaccgtgctgtactgggcgatgggggccggcctgctgatcagcgacttcgccggcaagaacggcctgcgcatgatgatgggccagcagatcagcatgcccgatccggtatggcgcaagctgacctgggcctggggcggcttcttcgcgatgatgggcgggctcaacctgttcgtcgcctatcacttcagcgaagacgtctgggtgaatttcaaactgttcggcggcatgggcctgatgctgctgttcgtcatcgcccaaagcctgttcctggccaagtacatcgaggaaaagaaatga

SEQ ID NO: 3078 - DNA, 129 bp, Chromobacterium substugae
atgaaaatcctgctgctgttgtgcgcggtggtcgcagccggcctgtggctgtacatccggaaaacctggctggagagcgaagagcgcatccacctgtcgcattacctgcccgaccgcgaccacgtctag

SEQ ID NO: 3079 - DNA, 588 bp, Chromobacterium substugae
atgttccagttgcaggcccgcgccagcgccgaaatcgaaatccgcaagagccgcttcatcggcgtgctgctgccggcggccagccgcgccgaggccgaaagcgcgctggccgacatccgccggcagtggccggacgcgcgccattattgcgcggtgttgctgtgcgccggggattcgatgctggacgacgacggcgaaccttccggcaccgccgccaaaccgatgtataacgtattgcagcacaaggaaatcaccaatgtgcttgccgtggtggtgcgctatttcggcggcatcaagctgggtgcgggcggcctggtgagggcctacactcaagctgtcaacgccgcgctggagcaggccagcctggccgaggtggtgaagatgcgccggctgcggctggcggtggatttttcggccgaatccaggctgcggcggctgtgccaggagttggggttcgccgtgctggcgctggagtatggcgagcaggcgctgctgaccatagcgctgcccgaggcggcctgcggcgcgggcgtggcgcggctgacggacgggatgtccggcgcgatccggctgttgtcggacggctga

SEQ ID NO: 3080 - DNA, 933 bp, Chromobacterium substugae
atgacgcagaagcaatatcgtctggtgacgcgcagcgatttcgatggcctggtctgcgcggtgctgctcaacgagctcaagctgatcaacgaggtgaagttcgcccacccaaaggacatgcaggacggcaaggtggacatcagcgccgacgacatcaccaccaatctgccgtatgtggccaaggcccacctggtgttcgaccaccacctgtcggaaacgctgcgcaacgccaccgacgccgacaactacgtgatcgatgccaaggcgccgtcggcggcgcgggtggtgtacaaccactacggtggcaagaagacgtttcccggcatcagcgatgagatgatggcggcggtggacaaggccgactccgcccagttcagcgccgaggaaatcctcaatcccaagggctgggtgctgctcaactacctgatggacgcccgcaccgggctggggcgttttcgcgagttcaaggtcagcaattttcagctgatgatggatctgatcggctactgccgcaatcacggcatcgatgaaatcctgcagctgcccgacgtgatggagcgggtggcgctgtaccgcgagcacgaaacccaggccaaggagcaaatcctgcgctgttcccgggtgcacggcaacgtggtggtgctgaacctgctgcacgaggaaaccatccacccgaccaaccgcttcatgatctatgcgctgtttcccgactgcaatatctccatccacgtgatgtgggggctgaaccggcaaaacaccgtgttcgctgtcggcaagtccatcctggaccgcagcgcgcgcaccaatatcggcgcgttgatgctgcagtacggcggcggcggccatgacgcggccggcacttgccaggtgccgtcggaccgggccgaggacgtgctggacgagctgctgtcccgaatccgcggcctgggctga

SEQ ID NO: 3081 - DNA, 660 bp, Chromobacterium substugae
atgtcacgcagcttcgacgcgctattgttcgacatggacggcttgatgctggacaccgagcgcatttccaacgagacctggcgccgcgccggcgccgagctgggaatcgaaatcaaggaggaaatgctggacgcgatggtgggcctgtccttcaaggattgcgtcgatttcgtcgccgaatacctggatgacgccgaagcggcggaccggctgcagctggggtcggacaagcattaccagcacatcctgcgccacgagcctatcccgctgaaaaccggcattctggagctgctgcgctgggccgagcagcaaggcatcccgcgcgcggtcgccacctcgacccagcgcttcaaggccgatctcaaactgacccgcagcggcctggacgcctttttcgacatcaccgtcgccggcgacgaagtgccgcgcgccaagcccgcgccggatgtctaccacgcggcggctagccggctgggcgtggcgccgcaacgctgcctggtgctggaggattcccgcttaggcctgcaggccggcgtcgccgccggcgcccgggtgattctggtgccggatctgctcacccccagcgccgaagaccgcgccagcgcgctggcggtgtgcggcgacctgcaccaggcgctggagctgatccgcgcgctgtag

SEQ ID NO: 3082 - DNA, 648 bp, Chromobacterium substugae
gtgcagtcggtactgatagccaatcccaagggcggcagcggcaaatccacgctggccaccaatctggccgcttatttcgccgccagcggcaagaaggtgatgctgggagacgtagaccgccagcagacttcgctgcattggctggcgcagcgcggcgccggtctgccgggcatcgccggctgggaagtggcgcccaacgagcccaagcgtccgcccaagggcaccgaagtggtggtgctggacagtccggccagcctgcacggcaagaagctcacctcgctgctgtcgcaggtgggccacgtgatcgtcccgattcagccctcgccattcgacatgtgggccagcgaggctttcttcgagcagatgctggaggaaaaggccatccgcaagaacaaggcctatatggcggtggtgggcatgcgggtggatccgcgcacccgctcagcgcgcgaactggagcagttcctggctcgccacgacgtgccggtgctcagctggctgcgcgacacccagctgtacgtgcaggcggcggcggagggaatgtcgctgttcgacttgccggcctcgcgcaccctgcgcgaccgcgaggcctggctgcctatcctgcgctggctgggcgaagatccgagcgcctggtgcgacaagtag

SEQ ID NO: 3083 - DNA, 951 bp, Chromobacterium substugae
atgatccagaccgaactcaactacggcgacgtatacctggtgccgaagaaaaccgttgtcgacagccgcaaggagtgcgacaccggcgtgcaattcggcccgcgccgtttcgccatgccgatttacccgtcgaacatgaagtcggtggtgtcggccgaaacctgcgagttcttcgcccgccagggctggttctacaccatgcaccgcttcaatgtggacgcggtggctttcaccgccgacatgcagggcaagggcctgttcgcctccatcagcgtcggcgtcaacgacgacacctacgagcaactggccgcgctgcaagccgccggcttgtcgccggaatacatgacgcttgacatcgccaacgcctggtgcgtgaaggccgagcgcatgatcaagcacatcaagcggcacttccccgccaccttcctgatcggcggcaacgtcgccaccgccgccgccgcgcgcgacctcgaagcctggggctgcgacgcgatcaaggccggcatcgccggcggccgcgtctgcatcaccaagaacaagaccggcttccaccgcccgatgatttccacggtgcgcgactgtgtcggcgcggtgagcgtgccggtgatcgccgacggcggcatcgtcgagcatggcgacatggccaaggccatcgtgtgcggcgccgccatgatcatggccggctcgctgttcgccggctacgacgagtcggccggcgaaatcgtggaaatcggcggcaagcactacaaggaatacttcggcagcgcctcgcagttcaacaaaggcgcctacgtcaacgtggaaggcaagaagattctggtggagtacaagggcagcattcccaagctgctgcgcgagttgcaggaagacctgcaatcgtcgatcagctacgccggcggccgcaccctggccgcgctgcgcgatgtggagatgatccaggtccaccgctga

SEQ ID NO: 3084 - DNA, 465 bp, Chromobacterium substugae
atgatttactttgaagacctgcagcccggccaacgcttcctcagcccgacccacacgctgagcgaggcggaaatcatcgccttcgcccgccagttcgatccccagcctttccacatcgacccggctgcggcgaaagactccttcttcaacgggctggccgccagcggctggcacaccagcagcctctccatgcggctggtggaaggatcggcgctgggccaggcagccaacggcctgatcggcatgcagatcgaccagatgcgctggccgcagccgacccggcccggcgacacgctgcaggtggaagtggaagtgctggataagcgccgctccggcagccagcccggcttcggcgtggttaaggtgcgctggcaaacccgcaaccaacgcggcgaaaccgccatgcagctggagtgcgcgatctggctgcaatgccgcgacagccaggtgccgaccgccgactga

SEQ ID NO: 3085 - DNA, 771 bp, Chromobacterium substugae
atgcaaaacttcaagctggcccagcccgacgcggtgctgcgctaccacgaccttcccggccacggcgcgccgctgctgatgctgcacggcctcggctgcgcctcgtcgttcgactacccgcgcctcctggccgaaccggccctcgccggccgccgcgcgttgctggtggacctgctgggcttcggcttcagcgacaagcccgacgacttccgctacgacaccggctcgcaggccctggcgctcagccaatggctggagcggctggatctgcccgccgtcgacctgttcggccacagcatgggcggcagcgtcgccatcgagctggccacgctacagcctggccgcgtgcggcggctcatcgccgccgagcccaatctggacagcggcggcggcagtttcagccgcgcgctggcggcctgggacgagcgggattacatcgaacgcgggcacgccgagatcatagccgcctgccgcggcgacaatcccgcctgggccggcagcatggcggccgcttcgccgctggccgcgcaccgcgccgccgccgaactggtcaagggccgcccggtcggctggcgcgagcaattgctggcgctgaccatgccgcgctgcctgatcttcggcgcaaaatcgctgccggacccggacaccgaatggctgccgcggcacggcgtcgccatccgcatcgtcgccgacgccggccattcgctggcctgggacaatccggcgggcctggccgccgccatcgccggcgcgctggcggacccagactga

SEQ ID NO: 3086 - DNA, 567 bp, Chromobacterium substugae
atggacgatattctgcgcgacatccccgaccagatcgaaagcgaacgcctgattctgcgcagcccgcagccgggcgacggccccatcgtatattccgcagtctgcgcctcgctggaagcgctgcgcgctttcccggcctccatgccctgggcgctggaagagccgtcggtcgatatctcggaaaccttctgccgccaaagccgcgtcgattacctctcccgcaaaaccctgaccatgctgctgtttttgaaggatggcggccacttcgtcggcgccagcggactgcatgacatcaactggaaacaccggcgggcggagatcggcttctgggtccaccgcgactggcagggccagggcctggtcagcgaagccgcccgcgccatctgcgcattcgcgcggcaggaactgggcctgcgccgcatcgcctgcctggccgatgagcaaaacgtggccagccgccgcgtggcggaacgcgccggcttcacgctggagggcatcatgcgccaggagcgcatcgcgccggacggcagcctgcgcaacaccaccctgtacgcgctgaccaactga

SEQ ID NO: 3087 - DNA, 2571 bp, Chromobacterium substugae
atggcgcttgcggccgctcccctccagcactggcggcagacgctggccgacaagcgacagcaactggccgaacgctaccgcgccgagcgcaatccgcaggcctatctgcggcattacagccaggcggtggatgaagtgctggccgaactgtggcgcgaacagggcctggacgaatccgccagcctgatcgcggtgggcggctacggccgcggccagctgtttcccggctcggacgtcgacattctgatcctgctgcccgagcccaccccggcggaaaccgccgacaaggccagccggttcatcgcgctgatgtgggacatcggcctggagatcggccacagcgcgcgcacgccgggagaatgcctgcgcgaggccgccgccgacatcaccgtggaaaccaatctgctggagaaccggctggtggcgggcccggccgagccgtggcgcgccttgatggcgcggctggaggcgcagcgcgacccgctggccttcttcgaaggcaagacgctggagcagcagcagcgccacacccgccacttcggcgtcagcaacaatctggagcccaacctgaaggaaagcccgggcggcctgcgcgacctgcacaccatactgtggatcagcaaggcgaccgggctgggcgacaactgggacgcgctggtgcggcgcggcatcctcaccctggcagaagccaggctgatcaagcacagcgaagaccagctgctgaagctgcgcatcgatttgcacctgttggcgcgccgccgcgaagaccggctgatcttcgacctgcagcaacaggtggcgctggcctggggcctggctgacacgccggccaagcgcgccagcgagcagctgatgcagctctacttccgcgccgccaagacagtgaaccagctcaacggcatcctgctgcccaatctgcgcggccgcatctactgccaggtgccgcgcgtcacccagcacatcaacgactacttccactcggtcaacggcatgctgggcatccgcgaggccaatgtcttcgacaagcatccgcaggcgatactggaagccttcctcacgctgcagcgccatccggaactgtcgggcttcgcgccgcgcatgctgcgcgcgctgtggcacgcgcgcagccagatcaacgaacgtttccgccaggacgcgcgcaaccgccagaccttcatgcagatcttccgcgagcccgccggccttacccgcacgctcaggcgcatgaatctgtacggcatcctgggacaatacctgcccaacttcggccagatcgtcggccagatgcagcacgacctgttccacgtctacaccgtggacgaacacatcctgatggtggtgcgcaatctgcgccgcttcgccatcagcgcctacaaccacgagtacccgttcctgtcgcggctgatcggcgatttcgagcagccggaagtcctgtacctggccggactgttccacgacatcgccaagggccgcggcggcgaccattcgcagttgggcatggccgacgccgaaaccttctgccgccagcacggcctgtcggaggaaaacagccggctggtgagctggctggtcggccagcacctcaccatgtccagcatcgcgcagaaacaggacatctacgacccggaaaccgtgcagcgcttcgccgacctggtggaaacgccgcgccggctggccgcgctctacctgctgacggtggccgacatccgcggcaccagccccaaggtgtggaacgcctggaaggccaagttgctggaggacctgtaccacgccacctaccgggtgctgtcgcgcggcggcggcatggacatcaattccgaactggaagcccgcaaaaaccaggcgcgcgcgcaattgcggctgcacgcgatccccgacggcgccgaggccggcctgtgggcgcagctggacaccgtctacttcctgcgccacgaggccaaggaaatcgcctggcacgcccgcgcgctcaaccgccagctggcgccggcccaacccatggtgcgggcgcggctggccgacgaccacgaaggcatccaggtgctgatctactcgccagacaagcccgagctgttcgcccgcgcctgcgccttcttcggccgcaccaactacagcatcgccgacgccaaggtctacaccacccgccacggctacgcgctggacacctttcatgtcttcgtccccgagcatcacgacggcgactaccgcgacatgatcaacttcatcgaattcgagctggccgccagcctggcggaggacaagccgctgcagctgccgccgccgggccgcatcagccgccacctcaagcatttccccatcacgccgcaggtatcgatgcggcccgacgaccgggacagcgccttcgtgctgtccatcgtcgccggcgaccggccgggcctgctggcccgcatcgccaaggtgctggccgactaccggctggacgtgcagtcggccaagatcatgaccctgggcagccgcgccgaggactccttcctgatccgcggcgcggcgctgaaggacgacaagaccgcgctggcgctggaaaccgcgctgatcgccgcgctgcgcgtctga

SEQ ID NO: 3088 - DNA, 1077 bp, Chromobacterium substugae
atgaaactcattcaccgctacatcgtcagcacgctgacccagtccaccctgttcaccctgctggccctgctgggcctgtatggctttttcgacctgctgggcgaagtgcccgcgctgggcaccggcaattacaccgccggcgtgatggcgggctacgtggcgctgttgatgccgggccacgcctacgaactgatgccgctggcggtgctgatcggcggcatggtggcgatgacccagctggccagttccagcgaatacacggtcatccgcacctcaggcgtcaccctgcggcagattgccgccacgctgctcaaattcgggctgggcttcgccgtcctcaccatcctgctgggggaatttctctccccgtgggcgatgcaggaggcggaacggatgaaattgtcggccacccactcgatggtggcgcaggagtttcgctccggcatctgggtgaaggacaaccagaacttcatcaacgtgcatgaaatgctgccggacaacaccctgctcggcgtgcgcatctacacctacgaccagaatttcaaactggtgcgcacccggctggccgagaaaggcaccttcctgaagaacgagcgcagctggcagctggagaacgtcaaggaaaccgaaatcgcgcgcgaccacaccgccagcagcacctacccgctgctgaagtggaaatccatcgtcgagccggaaatcctgtccgtgctgctggtagtgccggagcaaatgtcggcgctcaatctgctcacttacatcgagcacctgaaaaagaacaagcagcagacacaacgctacgaaatcgcgctgtggagcaaactgttctatccgctggcctgcatttcgatggcgctggtggcgctggccttcaccccgcagcagcgccgccacggccagctgggcatcaagctgttcgccggcatctgcctgggcgtcagcttccacttcgtcaatcgcctgttcggccacctgggcctcctgtacgactggaacgccatcctgtcggccaccttgccgacgctgagcttcctgctggccggcatcgccatcatcgtcaaacaggaaaggcgctga

SEQ ID NO: 3089 - DNA, 1101 bp, Chromobacterium substugae
atggtttttcaaaaaagcctgacacgcgaattgactttgaccgccctgggcgttttcgtcgtgttgctggccatcatcgtctccacccaagccatcaacctgctgggccgcgccgccgaaggccagatcgccaacgaggcggtgaccgcgctgatcggcttctggacgctgggctttttcccggtactgatgattctcaccgtcttcgtcagcgtgctggtggtgctcacccgcagctggcgcgaccacgaaatggtggtgtggctgtcctccggcctgtcgctgcgcgactggatctggcccatcatgcgcttcgccctgcccttggcgatattgatcgccggcgtcaccctgttcgtcgggccgtgggccgaccagcgcagccaggactacgcggaaatcatcaaacgccgcgaggagatctccgccatttccccgggcgtgttcaaggaatcggcgtcgtcgaccaaggtttacttcattgaaaattattccggcctgcacagcgccgccaccaatattttcatgcaagacatgaccgacggcaaagtcagcaccattttcgccaagcatggctatatttcgaccaaacccgacggcgaacgggtattggtgctggaagacggccagcgttatgtcggcgaaccgggcaaagccgattatcaagtcggcgaattcaaacgctatacggccagcataggcgaaggccaggcgatcaacagcccggccagcaaccgccaatccatccccaccagccaattgctgggcagcggcaaccccgagtacaaggccgagctggcctggcggctatccatgccgatcagctgcatcatcctggcgctgctggcgctgccgctgtcctactacaatccgcgcagcggccatacctacaacctgctgttcgcgctgttggcgttcttcgtctatcagaacggcctcaccgtcgcgcgcaactggatcacgcaaggcaaaaccggcgtgtgggcggtggcggtggtccacatcctgatgctgctgctggcgttggctctgctcaagcaccgcaaccggccgcagattccgttcggccagtcgctggcgcagatgctcggtaaaaactga

SEQ ID NO: 3090 - DNA, 1566 bp, Chromobacterium substugae
atggaatttaacataaaaagcggcagcccggagaagcagcgcgtcgcctgcgtgatagtcggcgtatacgaatcccgcaagctgacctttgccgccgatctgctcgatcgcatctccaacggcttcatcagcgacgtgattcgccacggcgacatggagggcaagctgggcagcacgctggtgctgcattcggtgccgcacacgctgtgcgaccgcgtgatgctggtcggcctgggcaaggaacgcgaattccgcgccaaggaataccgcgaggcggtgcgcgcctcgatcaaggcgctgacccagacttccgccggcgaagccgtcagctacctgtccgaactcacggtgaagaagcacgatgtcgagtggatgatcgagcaggccgcggtggtcaccctggacgtgctgtaccgcttcgaccgcttcaagagcaagtccgacgagccggtgcgcgagccgcgcaagctgacgctggccgtgccgcgccgcagcgacctggccgacggcgaaaagggcctgcagcgcggcctggccatcggcagcggcatgcggttggccaaggacctgggcaatctgccgcccaatgtttgcacgccggcctatctgggcggcgaagcgctgaaaatggccgaagctttcggcgccgcggccgaggtgctggggccgaaggaaatcgccgaactcggcatgcattccttcctgtcggtagccaagggcagctctgaagaggcccgcctgatcgtgctcaagcaccagggcgccaaggacaagaacgacaagcccatcgtgctggtgggcaagggcatcaccttcgactccggcggcatttcgctgaagccgggcgagggcatggatgaaatgaagtacgacatgtgcggcgccgccaccgtgctgggcgccttccgcgccgcggtggaaatgaacctgccgctgaacctggtggccatcgtgccggcctgcgagaacatgcccaacggcaacgcggtgaagcctggcgacatcatcacctcgatgtccggccagaccatcgaagtgctgaacaccgacgccgaaggccgcctgatcctgtgcgacgcgctgacctacgccgagcgtttcggcccggccaccgtgatcgacgtcgccaccctcaccggcgcctgcgtgatcgcgctgggccatatcgccaccggcctctacagcaaccaggacagcctggcgcgcgagctattggccgccggcgaagaagtggcagaccgcgcctggcacatgccgctgtgggacgaataccaggagctgctgaagagcccgttcgccgatatggccaatatcggcggtcgtccgggcggcagcgtcaccgcggcctgcttcctgtcgcgtttcgccaaggcttacgattgggcgcacttggacatcgccggcaccgcctggaagggcggcaaggaaaagggcgccaccgcgcgcccggtgccgctcctggtgcagttcctgcaggaccgcgccgacatcgcgctgggcaatgtggtgcgcaggggccgcccgcgtcgtgagacgcctgaagtggcagaagatgaccaggattga

SEQ ID NO: 3091 - DNA, 453 bp, Chromobacterium substugae
gtgagacgcctgaagtggcagaagatgaccaggattgatttttacaccaatgtcgccgatccgcaggcttttgcctgcagattggccgataccgtgcagcgcaagcaggagcggttgctgatctggctggacagcgaacgcgaagtcgaggtgttcagcaaccgcttgtggagtttcggcgatacccgcttcgtgccgcattgccggctggaagcgccggaggcgggccagactccggtctggctgacggcccgcctgcccgacgatctggcgcatccggtactgctgaacctggggccgcagctgccctatgcaatcgaacgcttcgagcgcattcttgagatagtagggcgggatccggcctcgctggcgaccgcccgcgagcgcttccgtgcctaccgtgagcatggctgcgaagtccaacatcacgacatgagccaaacgtcatcatga

SEQ ID NO: 3092 - DNA, 2136 bp, Chromobacterium substugae
atgactgagtcgccgaaggccaatgacgcagactggaacggtctcaacctgccggttttgaccgatgtggtggaggagccggcggtgccggttctggcggaagaggcgccggccgtcgcggcggaggttcccgagttcgacttctcttccgagctggatgtgcttgccgccgagctggatggcgaggccgaactggaaatcccagagctgtcgctggccgatctgctggccgatgacgcccccgcggccgacgagtccgcctctctgggcgggctggacttcagcaacctgccttcgctggagttgagcgatgccgacggcgcggacgagtcggccgatgggctgggcttcgtgctggagccccgcgacgcgcagctgccgtctgccgcgccggccgccgaagatttgacgccgtccgagcctgtcgaggcgaaggctgcggaagcggccagcgcaagcacagcctcggcggaaccggagctgagctgggaagacgtggtggcggcatcttcacaagcggcggaatccgcattagcggagccgatggcgctggatatggcgacgccggaggagagcggcgaagccgcgccccactcggaaccgtccccaatcgcggagccgcccgcatttacttcgatatcgatagacagcctgccaagcggggtgctgggcggcggcgtgggccgcgagccggcgccggcggaaaccggcctggaatggctgtcctccctgcccaaaccggaaatcccgccggcctcccaggagcaggtgctgcaggaggccgaacgcgttctggcggatgagcgggccatgcaagatgccgggcaagcgactgcgccggaattgagcgaagccattgccgagccggaagcgccgatgccggaagaactgcctgccgctgaagcggccgcgcagccggaagccgcggcggcattcgagccggtcgaggcggagacgattgcgtccttcgacatgccggtggtcaccgacgcgcaggagcctgagccggccgaagcggcggctgcgctggaagtgggcgaggccattgccgagccggtagcgccgatgccggccgaactgcctgccgcagaagcggccgcgcagccggaagccgcggcggcattcgagccggtcgaggcggagacgattgcgtccttcgacatgccagtggtcaccgacgcgcaggagcctgagccggccgaagaggcggctgcgctggaagtgagcgaagccattgccgagccggaagcgccgatgccggaagaactgcctgccgctgaagcggccgcgcagccggaagccgcggcggcattcgagccgttcgagacggaggcgattgcgtccttcgacatgccagtggtcaccgacgcgcaggagcctgagccggccgaagcggcggctgcgctggaagtgagcgaagccattgccgagccggaagcgccgatgccggctgaactgcctgccgcagaagcggccgagcagctggaaccggtggcggcattcgagccggtcgaggcggatgtgatggagtccttcgacatgacggtggtcgccgacgcgctggagctggagcccgagccggccgaagcggcagctgcgctggaagtggcagaggccgtcatcgagcctgaagcgccgatgttggaagcgcagcttgtcgacgaagcggccgagtccggcgatgcggcgtttggcgtggtcgaggatgaggatttgcccgcattgtccggcctgctgggcgggcggagcggccatgccgcgcccgaggcggctcagccgccagctggcgacgcgtcagttttgccagctctggctgagcccagcccggttgcggtggtgaagatcgccgcgatggcggcggcgggcagcgccggccgggggccggccgctcccccgttcgatgagcaagcgctgttcaattcgctgtatgagcagatgctgccgcggatgaaggtggagctctccttgtggctgcaggaagcggtggaggttcaggccaagcagatgctgtcgggcatgatgcaccaactgaaggaagactatgaaatgctgttcggcgacgcgttgaaggaaagcctgcgccaggcgctgggcgatgtcggcgcatcgatgaaggatggagacggccatggctga

SEQ ID NO: 3093 - DNA, 552 bp, Chromobacterium substugae
atggctgaccgtttgtcggatatcgtcacccgcaccggggatgacggcagcaccgggctaggcgacggcagccgcgtggccaaggatagcgcccgcattcaggcgctgggcgacgtggacgaactcaattcggtaatgggcgtgctgctggcggagccgttgccggagccgctgccgcagtggctgagcgaagtccagcatgatctgttcgatctgggttcggaactggccgtgccgggctatcaagcgataagcgattcccacgtccaggcgctggaaggcctggtgtccttcatgaatgaggagctggggccgttgagggagttcatcctccccggcggtttgcgcagcgccgcgctggcgcaccaggcgcgctcggtctgccgccgcgcggagcgggctgtggtggcgctggcacgcgaggaagagccgtcccaggcgctgcgccgctatctgaaccgcttgtcggatttcctgtttgtgctggcgcgttatctcaaccgccagggcggggtgcccgatgtgttgtggcaggcgggccgccagcgctga

SEQ ID NO: 3094 - DNA, 1671 bp, Chromobacterium substugae
atggccagtacggtgctgttggatctgataggcggggtggcgctgttgttgtggggcttgcacatggtgcacagcggcatcgtgcgcgcttttggcgcgaacatgcgccattggctgggccgagccttgcgcaaccgcgcattggcgtttctggcggggttcggcatgactgcgctgttgcagagcagcaccgccacggcgctgatgctgacttccttttccgtttccggcatggtggagctgacgccggcgctggcagtgatgctgggggcgaatgtcggcaccacgctgatcgtgcagctgctgtcgtttcatacttcgttgttctcgccggtgctgctgattggcggcgtcatcgccttcaagcgtggatctggcactttgacccgcgatatgggaagagtggccatcggtctgggcttgatgctgctgtcgctgcatgcgttgatggaaacgctggcgccggcggaaaacgcgcctttgacgcgcgaggtgctggcggcgctcacccatgatcccatgctcaatctgttgataggcgcttttctcagctgggccgctcactccagcgtcgctaccgttctgctggtcatgtcgctgagcgcttcgcatttcatcgcgccaggcgcggcgctggctctggtattgggcgccaatctcggcagtgcgatcaatccgctgctggaagcggcctctggcggcaactccgccgcccggcgcttgccgctgggcaatctgatcaatcgcgtggcgggatgcgcgatctttctaccggcgctggggccggtggcggccttgctggctacggtcgatcccgacccctggcggcagccggccgatttccacaccgcgttcaatctgttgatggcggcgctgttcatgctgccgttgaagccgctggcgggctggctggagcgcctgctgccggagcagaaggcggtggatgacctgtccgcgccgcagtatctggatgccagcgcgctggagacgccgacggtggctctggcttgcgccgcccgcgagaccttgcatatgggcgacatcattgaagacatgctgcgcaagacgatgacggtgttgcagaccgatgatcgcaaattgatggcggacgtgtctcggctggatgatgccgttgacggcctgcatgaggcggtcaaattttatctggtgcggcttaccagcaatagcctggaggagcaggaggggcgcaaggcgatggaaatcatggccttgtcggtcaacctggagcacatcggcgacatcatagacaagaacctgatggagctggccggcaaaaaaatcaagcataagctgcagttttcccgtgagggggcggaagagctggcggcgatgcaccgtacgctgatcggcaatctcaaactggctttcagcctctttctgtcgggcgatatcggttcggcgcggcgtttgttggatgaaaaggcaaaattccgcgaactggaattggccatgtcggaaagccacctggcgaggctgcgggaagggcgattggaaagcctggaaagcagctccttgcatctggacatcctgcgcgacttcaaacgcatccattcgcacatctgcgctaccgcctaccccattcttgaggaggcgcgcgagttgcatcctaccagattaaaaccattgcccttgatcggaaccgatacttga

SEQ ID NO: 3095 - DNA, 267 bp, Chromobacterium substugae; identical to SEQ ID NO: 1290

SEQ ID NO: 3096 - DNA, 291 bp, Chromobacterium substugae
  modified_base (166)..(166): a, c, t, g, unknown or other
atgcccgccgctgcggcggcgatcctggatatcgcggagaacctgaagatgaaaaaactgaatgcagtactggcgctggcgctgaccctgggcgcggccgccgcgcaggcggacgatctggcggccatccgcaaggcgggcgtgctgaagatcggcaccgagggcngccttcgcgccgcagtaggacgtagatgcggcgcgcgccataacgaatgcgagtggcggcgatctcgcggattcgctgccgctccgcacgatcgtctcgagggtgagggcgataaaaataggtag

SEQ ID NO: 3097 - DNA, 73 bp, Chromobacterium substugae; identical to SEQ ID NO: 3016

SEQ ID NO: 3098 - DNA, 73 bp, Chromobacterium substugae; identical to SEQ ID NO: 3018

SEQ ID NO: 3099 - DNA, 73 bp, Chromobacterium substugae; identical to SEQ ID NO: 3016

SEQ ID NO: 3100 - DNA, 73 bp, Chromobacterium substugae; identical to SEQ ID NO: 3016

SEQ ID NO: 3101 - DNA, 681 bp, Chromobacterium substugae
ttgggcgcggcgttcgctcaggctgctgacggcgtcgccttgccgctggcgttgccggcgccgggcgcgggtttcgccgagcagctggccggcgtgcgcggcgaagtggagcgtttcatcgccgacggcgacgcggccgcgccgactgcgctgtctcccgaggcttggcgcgtgcagcagcagatgaaggctggccaggcgatgccggcggtgccgccggatcggcaggcttttgtcgccgaattggcgccgtatgcgcgcgaagcggccgacaggctgggcgtggcgccggatatcctggtggctcacgcggcgctggagtcgggctgggggcgcaagccgttgcgccgcgccgacggcggcgacagccataatctgttcggcatcaaggccgattcgcgctggcgcggcgaggtggcggcgtcgttgactaccgaatacctggacggcaagaggcaatcgcgggtagagccttttcgtgcctatcccgactatcgggcggccttcgccgactacgccgacctgctggcgaccaatccgcgctatcgcgccgccttgggggtgggctcggacgcgcgggccttcgccggcgcgctggcgcgcggcggctatgccaccgatccggactacgccggcaagctggcgggactggttgggcgtctgcgtggagagagtttgtag

SEQ ID NO: 3102 - DNA, 426 bp, Chromobacterium substugae
atggataggcagcaggacttgcgccggctgttcgccacggtggcggacgacctggcggcttatcccttgctgcaggcgtgtctggagcggcagttcgccgccgcgctggcgcatgacgcgcaggccttgtcggtttgcgccgacgagatcggcgcgttgtgccgacgcctggagctaagccgccgcgaacgcctgggcgcggcggagcgcttgctgccggcgggggctgagttgacgatggccgcggtcttgcgggcgttgccggagcggcagcgcgagcagggcgagcggcattggctgcggctgcgcggcatggtggccgattgccgcgaattgaatttgcgcaacggccagttgctgcagcagcgcaggctattgctgcagcgcgtgctggagggggagtcggatgtttacgcagcgcagtga

SEQ ID NO: 3103 - DNA, 258 bp, Chromobacterium substugae
atgcagatatcttccctttcctcctggcgcgccgacaaggccgcgcctgccaagaccgacgccgccgcgacggccgatgcgccggcccgtccggctcccgccgcggccgaggcgccgctggcggcggccttgcaggcgatgccggaagtcgatctggccaaggtcgacgcggtgcgcgccgcattggcgcgcggcgaagtgcgcttcgatccgcagcggctcgccggcctgatcgagcagtatcacggcggtcgttga

SEQ ID NO: 3104 - DNA, 687 bp, Chromobacterium substugae
atgaatcaagaacaagttacgcagatgttgcggcaaacgccgttgtttggtcatttggcagacgatacgctggatcgggcgctggaatgttgcgaaaccgtccgtctggctaggggcgaggccctgtacgaggagggcgacgcttcggatgcggtctacctgctgctggggggctgcatgcaggtgtatgtggcagatgccgtgggcaagaaatacgtgctgcagatggcgatgccgggcgggatgctgggcatggagtcgtttgtggacggcggcggccgcggcagcagcgcggtggccgatgaggaaagcgtgttgctgatgttctcgcgcgaggccctcagcggcctgttcgacagcgaggatggcctccccggctgcgacaaggtgcgcagcagcatcatgtgctacctggtttcgctggtgcgccacatgactacgctggcgcgcaatctggccttgctggatgtctatggcagggtgcgcatcctgatcaaccagatgctgatcgagcaggacggcgtgctgatcctgcgcaagcagttgacccagcaggaaatcgccgaccagatcggctcctcgcgcgagatggtggcgcgtatcctgaaggagctgatctacggccactatatccggatggagaaccgccgcatcgtggtgctgaagatgctgccggaaaacttctga

SEQ ID NO: 3105 - DNA, 990 bp, Chromobacterium substugae
atggccggcttgaagaaaaaggacgagcacgaaggcgcggtcatcaagcgcgtgtcgcgccgccatgaggaagaaggccacggcggcgcgtggaaagtggcgttcgccgacttcgtgctggcgctgatgtgcctgttcctggtgctgtgggtgctggccgcgcgcgatcaggaaaacctgcggcagctgttgaccacctccggcggcagcccgctgatgcagggcgacggcaagcagatcgaccacatgggcaatccgcctggcagcctgatcccgcgcgaccccatccccggcccgaccggcagccaggctgccagcaagtcggcgctgcgcgacagcgacaagcgttcggcgcaagatcagccggaaatgccgcgccgcagctacgacagcgaggccgacctgcgcaagctggccgcgcagttgtcgacaatgagccagcaggccggcctgtccagcaatctgcaaaccatcatcacgccttacggcctgcgcgtgaccctgcacgataccgatcagcagggcatgttcgagcgcggcagcgccatcgtcgaaccccgcttccgcggcctgctgcagcaaatgggcgccatgctgggcgagatcgacaaccagatcctgctggtcggccacaccgacgcggcgcagtaccacagcgccggcggcttcgccgccttgtccaattggtcgctgtccagcaaccgggcgatggcggcgcggatgcacatgctgcagggcggcctggccccggcttcggtgctgcaggtggtgggcatggccgagcgcgcgccgctcgaccgcgagcatccgctggcggcggcgaaccgccgcatcgagctgctgatcctgacttcgggccaggctcaggcggtggtggcgatgttcggctcggccgccgacggcaagaccgggctgcccggtgttgcgtccgcgctaccaaatgagaaagacttgcaaaaacttagagaaaataccatcggtatcaggtga

SEQ ID NO: 3106 - DNA, 867 bp, Chromobacterium substugae
atgcagcaactgtttggcatcctgatcgtgctggtttgtgtattcggcggcttcatgctgcatggcggcgtgctgtcggtgatctggcagccggtggagttgctgatcatttgcggcgcggcgctgggcgccatcgtgctgggcaatccgccgcatgtgctcaaggagatgggcggccagctcaagcgggtggcgacgcgcaagaagcagggcgccgaattccagcgccagcagctgctgctgatgtacgaattgctgatcaccgccagccgcggcctgaaggcgctggaccagcacgtggaggcgccgcgccagagcccgttgttcaaccgctacccgctggtgctggaaagccccaagctgctggccttcatcgtcgacaacttccgcctgatggcgatgggcaagatcaacgcccacgagctggaaggcgtgctggaccaggagctggacgcgatccacgagcagctgaaccagccgtccaagtcgctgcataagatcgccgaggcgatgccgggcttcggcatcctggcggcggtgctgggcatcgtgatggcgatgaacaccgtcgcccagggcgccagcgccggcgaaatcgccaacagcgtggcggccgccatggtgggcaccttcatcggcattttcttctgctacggcgtgctggacccgatttccaacgtgatgagccagctggtgaaggaagagctgtccaatttcgaatcggtgaaagtggtgctgaccacccacgcctccggcaagccgccgctgctggccatcgacgccggccgccgcctggtgcagctcaacaccaagcccagcttctcgcagctggagtcgtggatcaccatgctggaaggtcagggctga

SEQ ID NO: 3107 - DNA, 696 bp, Chromobacterium substugae
atgtacgccgaaagctacgcacccgctccccatgccgccgacgaaagccggcagctggccttgtacgcgccgttggtgaagcgggcggcgcgccagctggccagccaggccggcggggtgttcgaccgcgaggacatggagcagatcggcctgatggcgctgctcgattgcctgcgccgctacggcggcgagccggacgagcgcttcgccggcttcgccatgctgcgcatccgcggcgccatcctggatgagttgcggcggctggactggcggccgcgttcggtcaggcaggaggcgcaccgggtgcgcgacggcctgcgcgagctgcggcgcaagctcaggcgcgagccgtccgaggccgaggcgatgacgctgctgagcctggacgccgacgcttaccgcgaagcgctgctggcggaaaacgccgaggcgatggccagcttcgacgaattggtggcatccggcatggaattggcggcggaggattcgccggaggcgcggctggagcggcagagcgagctggcgcgcgcgctgaccgcgctgaacgagcgcgagcagcaggtgatccagctgtattacgaatttgaactgagtctcaaggagatcgccgcagtgctggagctgaccgaggcccgcatctgccagatcaacaagagcgccctgaaaaagatgcaggcctgcctgatggcggcctga

SEQ ID NO: 3108 - DNA, 438 bp, Chromobacterium substugae
atgaatagcaagactctgatcgtcgcggcgctggtcgccgcgctggcggcgagcgccggcgtcggcggctggtggtactaccagcaatccgcccatgcggcgccggccaagcccaagccgatggactaccgtttcgtcagcctggacaagatcgtggtgatgctgcgcagcgaagccggcggcgacccgcgctacatggcggtggacctggtgttccgcagcagcccggagagcgagcccaaggtcaaggagcagctgccgctgctcaagagcgtggcggtgcgcgccttgtcgcaattgtcgcgcgagcgcgccaacgcgctgggcatagacgactaccagcgcctgctggacaaggcctaccgcgcaagcgccgcgcgagagcaaaacgaattgccgttcagcgaagtgatggtcagcaagctgatcatcgaataa

SEQ ID NO: 3109 - DNA, 996 bp, Chromobacterium substugae
gtggccccgccgcaagccggcaatgccttgccggcgatggccgacgatgtcgtaggccaggcgctggatatcgacagtctgtcgctgccggccggccagccggcgcaggatttcgccagcgcgctgctggcgctgcggcaagcgccgccggcggacgctgcgcagccgcaactggcgccaagccaaggcgcgcagcctgccgcgccggcgcttgccgccgccgtggccgacgaggccaagccgagcgacggcaagcaggaccaagacgagggcggagtggctcaggtcgatgttgccgcgctcagcccggcgatgcagccgccgctggtctggccgcaattgcagccggcgccgctcccggcggtggcggcggacgcgcagccgcagccatcggagcccgcgccgcgcgccatcgcggcggcggcgccgagcttgcttgacgccaaggcgctggccgcgttgacggccgacgccgccgcgccgcgggccgacgcgcagcaaacggcgctgctggcggcgttgccgttgccggccccgcacgcggcggacaatgccaagccggcggacacgttcagcctgcaactgccggcgtcgcagccggacagctggagcggcaagctgcaggcggcgctgggcgagcgcctgcaggtgctgtccagccagaaccaggaccgcgccaccctgcgcctggacccgccggcgctgggcacgctggagatcgccatccgccatcaggccggcgcgctgacggtggagctgacggcttcgcacagcgaggtggtcaagcagctgcaaaccataggcgacagcctgcgccaggacctgggcaaccgccagtacacccaggtggcggtggaggtgaaggagggcgcgccttccggctacggccagggcggcagacagaaccgcgagcagcagccgcagcagaatccgggccgcgccttgcgcgagcagggctggcagacggcggaagcctttgagctggatcagggctga

SEQ ID NO: 3110 - DNA, 288 bp, Chromobacterium substugae
atgccgccgtttgacgccgccgcctggagccaggcgatcagccaggccgggcgcgagcaagactggcggaagctggcgcagctcgaccaggcgctgcgccggctgctgtcggagggcgagccagcgttggacgccggccagcgccgcttgctgaccgacgcctaccgcgctgcgctggattgcagccaggccgaaatcgacgcgctgcggcacaagctcgccgcgatgggccaacagcgcgaaggccagatggcctacgcgcaattcagtgaatgggaacaagcatga

SEQ ID NO: 3111 - DNA, 393 bp, Chromobacterium substugae
gtggattacgaagcctatcgcagctaccacgcggtgaacctggaagcccagacccactccgccagccaggtcgacctggtgctggtgctgttcgacggcctgctggaggaaatcgcgcgcgcgcgcggccatctgcagcaccgccgtttcgagcagaagggcgagagcatcaacaagtgcatcaatatcctcaacggcctgtccagcgcgctggacttcgacaacggcggcgaggtggtgaccagcctggcgcgcttgtacgactactgcgcgcacaagctgtaccaggccagcgtggagatggacgtggcggcgctggatgaggccgaggcgctgctggtcaagctcaagggcggctggataggcgtgcgggaccaagatgccgccgtttga

SEQ ID NO: 3112 - DNA, 1350 bp, Chromobacterium substugae
atggcgattgatttcaatgcgatgcctcccagcacctgggccgacaacctggccaagaacagcctgggcaatatgcagacccagctggacaaccagaccaaggccgccaaggcgcgcagcgacgcgctggggcagctgcaaaaggcgctgcaggactacaagaccagcctgggcacgctgaccaacaagaagagcctggtggcgatgaacgccacggcgctgcccgacggggcggccacggtcaccgccaagggcaatgcccagcccggcaactacagcctgttcgtcgagcagctggccagcgcgcagcaactggcgatgggcgatctgtccggcgccaccgcgcaggccggcgacaagttcaccgtcaaactagccggcggcgataccttcgacgtctcgatggccggggccgaccgcgacggcgacggcaagctgtctcccagcgagctggcgctggcgatcaaccgcgcgagcggcaacggcggcaaggtcaacgccatggtgctgaacaacaacggcgcgagccagctggtgctgtcctccggcaagaccggcctgaacggcgccatctcgctggacctgtcgcaagtgagcgacgccggcctgaaaaccggcctgtccgcttcgcgccagctgacccaggcgcaggacgcggtggtatggctgggcggcaaggccagcggcgtgcgcatgcagcaggcctccaataccttcgacaacatcgacggcgtcagcttcaccgtcaataaggcgatgaaggacggcgacgcgccgctgcaactggcggtcagccgcagcgacaacgacaccactgccaacgtgcaggccttcgtcgacggctacaacaagatctacaaggcgatttccgacctgtcgcagccgggcatcaacggcgccaccgccggccccttcgccgacgactccagcatccgcggcctgaaaagccagctcaacgccatcctgcgccaatcctacgacggcatcacgctgggccagctgggcatcagcgccagccgcgacggcagcctgacgctggacagcaagaagctgggcgacgcgctgaagaacacgccggacgcgctggaccgctatttcaacggcgtcggccagagcggcgcgctcaagcaaagcagcgattacctggataagtggctgaactacagcaatggcctgatcaagcagcgcaaggacagcgccgaccgcgcgcagcaggatctgaaccgccgccaggacgcactgcagcagcagtatcagcagacctaccagcgctatctggcccaattcacccaactgcagaacatgcagacccaaatgacccagaccatgggcatgctgggttacaactga

SEQ ID NO: 3113 - DNA, 438 bp, Chromobacterium substugae
atgaataccgccatccagcaactgaatttgctgctgcagctgcgcgaacgcgacagccggcagttggaaaccgagctggccggcaagcgccggctgcaggagcgctaccgccgcaatatcgcgcggctggaggagctgaacgccgccagcggcgccagcgccgccgccgggcacccggccttggcgctcaattgcgccggctacaagagccatctggcggggctgagccagtcgcagcggcaggatctgcagctggcggaagccgacgccgcggtcagccagcgccagctgctggccgcgcgccagcgtcaggagcaggcggagctgctgcgcgaccaaagcctgctggcctggcgcgacgagcaggcgcggaccgagcagaagcgcaccgacgaagccgccggccaagcctggctgcggggagcggcggggtggtga

SEQ ID NO: 3114 - DNA, 1314 bp, Chromobacterium substugae
atgctgcgccaggcgctcagccagctgtcggtgccggacgcgcctgtcgccaccgtcagcggccggctggtgggcgtgagcggcctgctgctcgagagcgtcggctgcccgctggaaaccggccagcgctgcctggtggaaaccgcctccggcggctggctgcaggcgcaggtggtgggcttcaagcgcgaagtttccttcctgatgccgttcaagaagcctgtcggcctcgccaccggcgcgcgggtgctgccggcgccggaaagcggcggcctcagcataggcgatggctggctgggccgcattgtcaacggcctgggcgagccgctggacgacaagggcaggctaggcggcgacgcgccgctggccgcgcatccgccgcagatcaacccgctcaggaaaaaaccggtcgacatgccgctggacgtcggcgtgcgtgccatcaacggcatgctgaccataggccgcggccagcgcgtcggcttgttcgccggctccggcgtcggcaagagcgtgctgctgggcatgatcacccgccataccgaggccgaagtggtggtagtggggctgataggcgagcgcggccgcgaagtgcgcgaattcgtcgagcacgcgctggggccgcagggcctggccaaggcggtgctggtggtggcgccagccgatgaatcgccgctgatgcggctgaaggccaccgagctgtgccacgccatcgccgcccatttccgcgaccagggccgcaacgtgctgctgttggtcgattcgctgacccgctacgcgatggcgcagcgcgaaatggcgctggcgctgggcgagccgccggccacccgcggctatccgccgtcggtgttcggcctgctgccgagcctggccgagagcgccggcaacggcgagaggggcgagggcagcatgagcgccatctacaccgtgctggccgaaggcgacgaccagcaagacccggtggcagacaccgcccgggccattctggacggccacatcgtattgagccgcgagctggccgaacgcggccactatccggcgatagacatctcccgctcggtcagccgctgcatgagccagctggtggacgccgagcacgccgccgccgcgcgcgagctgcgcgccgcctggggccgttaccaggaagtgcgcggcctgctgccgctgggggcctacgtgcctggcgccgatccggccaccgaccgcgcgctgcgcctgcagcccggcatcgaagcgctgctgcgccaggacgccgccgaggcggcctcgttcgcggatacgcgcggccgcttgcaggagctggcgcgcgcatga

SEQ ID NO: 3115 - DNA, 687 bp, Chromobacterium substugae
gtgaaacactggcgccccttccgtttcccgccgttgatcgacggcgcgccgctggagccgctggcggcggccgaggcgcaggcctccgccgccgacggcttccgccagggcatggacgccggctaccgcgaaggttttgacagcggcgaagccgccggccgcgacgccggctaccaggcaggcgtcgcgctgggccggcaggagggcgtggccgctgcgcgcgccgaggagctggcgcgcttctccagcctggccgagccgctggacgccgccatcgagcaattgcggcgcttgtgccgcgactatcaggccgcccagcgcgacgaggtggtggaactggtggccaaggtggcgcgccaggtgatccgctgcgagctgaccttgaagccggtgcagatcctcgatctggtggaggagacgctggccgcgctgccggccgcctcccacagccagggcgaggtggaagtgctgctcaaccccgaagaatgccagcgcatccgcgagctggcgccggagcgcgccgccaagtggcggctgctggccgattccggcctggcgccgggcgagtgccgggtgcgcggcgccgaattcgaggccgacgccggctgccagcagcggctggcgcattgcgtggacagcctgcgcgagcaactgcaggccgagccggccgcgcagggcgaggcttaa

SEQ ID NO: 3116 - DNA, 1056 bp, Chromobacterium substugae
atggacgcaagcaataatttcgcgccggaagcggcgccttacgtccccgcggcggcagccggcaacggccagatgagcgccatcgagcaggcggcggtgctgctgctgtgcatgggcgaagagccggcggcggcggtgctgcgctgcctcagccgcgaagagctgctgcaggtgacccaggcgatgagcggcatgagcggcatcaaggtggacgcggtcaagaccaccatgcagaaattcttcgacgaataccgcgagcaaagcggcgtgcacggcgccagccgcagcttcctcaagcgttcgctggagctggcgctgggcggcgacatcgccggcagcgtgctggacaccatctacggcgacgccatccgtcccaagatggcgcgtttgcagtgggtgtcgccgcaatggctggccgaccgcatcgccgccgaacacgtgcggatgcaggcggtgttcctcgccttcctgccgccggcgctggctggccaggtggtggacgccttgccggccgccagccgcgacagcgtgctggtcaacgtggcccgcctcaccgatgtggaccgcgagctgctgcaggaattggaagagctggtcaaccgctgcctggaaagcctgcacacgcaaagcaccgcggtgcagggcatgcagcagaccgccgacatcatcaaccgcctgccgggcgaccgcagccgcatgatggagctgctgcgcgcgcacgacccggaaatcgtcgacgagatcgaggtgaggatgtacgacttcttcatcctgtcgcgccagaccgaaaccgtgctgacccgcatctgcgaagacgtgtcgctggagcagtgggcgatcgcgctgaagggcgccgagcccgcggtgcgcgacgccatcacccagaccatgccgcgccgccaggcgcaaaacttcgacgccaccatgcgccgctccggcccggtgccgaaaagccgggtggaagaggcgcggcgcgagatcatggcccaggtgcggcaattggccgacggcggcgagatcgacctgcagctgttccccgaggaagtggtcgagtga

SEQ ID NO: 3117 - DNA, 1674 bp, Chromobacterium substugae
gtggtcaagcaattgcggagcggctttgccgccgtacaagaaaaaatggccggccgccgtctgctgccggcgaacgcctggcgctacctgctgccgatggtgatcctggccatcggcctgagcctggcgctgaccctgtggctgtggcgcgacgacgccagctacaagccggtgttcggcgcgcaggaaaaggtcaacagcgccgatatgatggcggcgctcgacgccgacaagactccctaccgcatccatccgcaaaccggccaggtgttggtgccggaagaccagctgggccgcgtgcgcatgcagctggcggccaagggcgtggtggcgcagctgccggccggcttggaactgctggacaagaacgacccgctgggcgtcagccaattcgtgcaggacgtgcgcttccgccgcggcctggaaggcgagctggtgcagagcatcctggcgctggacccggtgcgcgccgcccgcgtgcatctgtccttgccgcgcagcacttccttcgtcaccgccggcaccgacaagggctcggcctcggtggtggtgacgctaaagcccggccagcagctgtccagcgagcagatcgccgcggtggtcaagctggtggccggcagcgtctccacgctggacccggcgcaggtgaccctggtggaccaggccggcaatctgctgtccgcccatgtcgacctgtccgacggcggcatggtgggttccgacaacgaggcggcgcgccgcttccgcgagcaggcgctgcagaacgcgcgcgacctgctgtcgccagcgctgggtgcgggcaacttcaaggtgagcgtcaccgccgacgtcgacaatgaccgcgtcgaggaaacccgcgagaaatacggcgaggcgcccaaggtcaccaacgaggcctcgcgcgaggaaaccagcaccgagcggatggcgctgggcgtgccgggctcgctgagcaaccggccggtcaacaccgactcctccggcccggccaatgaaaagtccggcaacagcaagaacgcggtcacccgccagtacgcctacgaccgcaacatcatgaacatcaagaaggcgcgcggcacgctgcgccgcctcagcgtggcggtggtgctgaaccaggccgccgctccgagcaagaagggatggcagccggccgagctggccaatatcgacaagctgctgcgcaacggcctgggcatcagcgccgagcgcggcgacgtgctggcggtgtccacgctgaacttcgccgccccggtagcggaagaagcgttctggcagcagccggaaacctggttcgagggcgcgcgctggctgggctacgcgatcgcgctgttgctggcttacctgttgctggcccgtccgcttttgaagatcgcccgccagttggcggagcgcaagctgggcgactacgcgccgggcgaggtggacgtgacgccggaagatccgctgctggacaaccgtccgctgcgcgaggcggccggccagcgccaggccgcgctggcggccgcgccgggcgacagcccggtggtgccgctgctggaaaattacgacctgccgcccgccggttcgccggtggacgtgctggtggaccacctgaaggtgctggcggccaaggagccggagcgggtggcggaagtggtcaaacaatgggtgcagaacaatggacgcaagcaataa

SEQ ID NO: 3118 - DNA, 339 bp, Chromobacterium substugae
atggccaatctgggtttgatgatccacgccgatcgcagccaattgctgggcgagatggccaagctgggccagggcgccgcggcggccccccgtccggccgcggacgacgcgccggccgcgcaaagcttcagccaggccctggtgtcggcggtgcgcgatgtcgaccagcagaaccgcctggcctcggacaagatgaccgaggtggacagcggccagagcgacgatctggtcggcgcgatgctgatgagccaggaggccagcctgtccttctcgatgctgatgcaggtgcgcaacaaggtggtcggcgccgtcgacgacctgatcaagatgcagctgtaa

SEQ ID NO: 3119 - DNA, 843 bp, Chromobacterium substugae
atgcccaaagccaaaatcgttgcgccgcaggaaggcgcccgcctgcaggccttggatctgcgaaccctggggcgcccgatacacctgctgccactgttcgcccgcgcattgcagcaagagctgggcgacttcctggagcgggaactcaaccgccgctaccacgccgccttccgcatcactgccctgcgccaagacctgcccgccgccgacgagctgcgctggcaatggcacgcgctgggcgactggcagctgggcagccatttcgaccgcagcctgctgctgggcatcctggattaccgcttcggcgccagcgccgcgccgatcgccgaagacttgccggcggaaaccgaaaccgagcgccggctggcccgcaacctggccgaacggctgctgccgcgcctggccgccgccatcctccagctggaacaggcgccgggcgcctacggcgacaagccgcgcccgcagcccttcgccggccagcctgcctggcagctggaaatcgaactctccgacggcgacgcgccgcgcggcgcgctgcgcctgcgcctgggcgagtcagccttcgaaaccctgctgcaaaacctgtccggccagcgccgcaagctggccggcgaccgcgccccgggcagcttccgcgaccggctgacgctgcggctggacgcgcgcctgctgcagcaggagctgccgctgggcgccatcctcgacttgaagcccggttcggtgctgccggtgacgctgccgccgcaagccgaagtgtgcgtgcgcggcgcggccttgttccgcgcccacgtggcggagcgccagggcaagctgtgcctgagcggcttcgccgataccgaatga

SEQ ID NO: 3120 - DNA, 339 bp, Chromobacterium substugae
atggacctgaaacaagatttcgacctggacggcatcctggacagcctggagccggaagccgccgccgcgcccgctcccgcgccgcgcgacatgacgccctttctgcgcaagatacccgtcaagctgacgctggaagtcggcagcgccgacgtcagcctggccgacctgtgccagatcggcgcgggctcggtgatcgagctggacaagctcgccggcgagccgctggacatcaaggtgaacggcaccgtgatcggccgcgccgaagtggtggtgtccggcgaaaactacggcctgcgggtggtggaattgaacgacctggaactggacagcctggcctga

SEQ ID NO: 3121 - DNA, 747 bp, Chromobacterium substugae
atgaaacggtacaagctttacgccccgctgctggccggcctgctgctggccagcccctgcggctgggccgattcgctgaagctgctgaccgccacctccggcggcgcggcggtggacttcaccgtcaagacccagatcctgatcctgatgacggcgctgggcctgttgccggtgctggcgctgatgatgaccagcttcacccgcttcgtcatcgtgctgtcgctgctcaggcaggcgctgggcctgcagcagggcctgcccaaccgcctgatcaccggcgtggcgctgatcctgaccttgctggtgatgcggccggtggggctgcaagtatggaacgaggcgatggtgcccttcgaccaggacaagatcaccatgccgcaggcgctggagatcgcctccaagccggtcagccgcttcatgctggcgcaaaccagcaaaaccgcgctgtcccaggtggcccggctgtccggcgaaggcgacgtcgcccgcccggaggaccacgccttcaccgtcaagctggcagccttcgtgctgtccgaattgaaaacggcgttccagatcggctgcatgctgttcattcccttcctggtgatagacctggtggtgtccagcgtgctgatggcgatgggcatgatgatgctgtcgccgctggtgatctcgctgccgctgaagctgctcttgttcgtactggtggacggctggtcgctgaccgtcaacaccctggtcacgtcgatccaggcctattag

SEQ ID NO: 3122 - DNA, 273 bp, Chromobacterium substugae
atgctgactccggacatcgcggtagacatcgtcaacgacagcctgcgggtggtggtgacgctggtgacgctgctggtgctgcccagcctgatcgtcggcgtggtggtcagcctgatccaggccgccacccagatcaacgagcagacgctgtccttcctgccccggttgctgatcgtgctcttgaccatcgcgctggccggccactggatcaccggctacctgatggacttctgcgtcgccatgttccagcgcgccgccagccaggtgggctag

SEQ ID NO: 3123 - DNA, 783 bp, Chromobacterium substugae
atgagccagggcctgttcgcccagttgctgcagctgctgccggccatctggtggccgttctgccggctgatggccgccttcagcgtcgcgcccttcatcggcgacgccatggtgccgctgcgcgcccgcatcgccctggcgctgctgctggcggtggcctgcgcgcccggcatgccggcccactccccgatcgaccccttttcgctgcacggcgtcgccgccagcctggagcaggcggtgataggcttgttgttcggcttcgccttccagctgaccatgtccatcctgtcgctgctgggctttttgctgtcctcgcaaatgggcttgtcgatggcggtgatgaacgaccccggcagcggcaatacttccgacgtggtgtccaatctgctctacctgctggcggctctgctgttcttcgccatggacggccacctggtgctggtgcaggtggtgtacgccagcttccgcgcctggccgctgggcggcggcattccgcaggcggcgctgccggtgctggcgggcagcgtggcctgggtgatggccgccgcggtcgcgctggcgctgccggtagtgttcgccaccttcctggtgcaggccggattcggcatgatcaaccgggtggcgccggcgctgaacctgttttccttgggcttcccggtggtgacgctgttcggcctgtccacgctgaccctgctgatgcaggtgctgccgccgcaatacctgagcctgagcgagcagacgctgcggctattggacagcctgctggagctgggccatggctga

SEQ ID NO: 3124 - DNA, 1140 bp, Chromobacterium substugae
atggctgagacgcgccagggcgacaagaccgaaaaagccaccccgcagcggctgcgcaaggcgcgcgagcaaggccaggtgccgcgctccaaggacctggccgccgcgctgggcctgatcctggcgctgaagctgatgttctggctggcgccggactggctggatgatttccgcgagctgttcgcgctggccttcgccccgcttgccggccaaggcgcgctggagaacagctggtccaagctgttcggcggcaccttgctgctgttgctgaaaatgctggcgccgctggccgtcatcccgatcaccatgctgctgatcagcctgtttcccggcggctgggtgttcgtgctgtcccagctcagccccaagttcgagcggatgaacccgctggcccacctgtcgcggctggcctcgcccaagcacgccagcgaaatcggcaaatccatcgccaaggcgctgcttttgggctggctgctgtaccgcatcgcctcgtccgcgctgcaggacttcttcgcgctgcacggcatgccgctgctgcccacgctggccggcgcggccgacctgctcttgtcctgcctgctcaagctgtccgcggtgttcctgctgttcgcgctggccgacctgccgctgcaggtctacctgttcatgaaacagcaaaagatgagcaagcaggaaatcaaggaagaatacaagaacaccgaaggccggcccgaagtgcgccagcgcatccgccagctgcagcagcagatcgcgcagcgcggcgtgcgcaaggtcctgcccggcgccgacgtcatcatcgtcaaccccagccactacgcggtggcgctgaaatacgacgagaaccgcgccgaagcgccgttcatcatcgccaagggcgtggacgagatggcgctgtacatccgccggcaggcggaagaactggaaatcgccgtgctgccgctgccgcccctggcccgcgcggtctaccacactacacaggtcaaccagcagatccccgcgccgctgtaccgcgcggtggcccaggtgttgacttatgtcttgcaactcaaggctttccagacgggcagccgcgccaaccggccgatattgccggaactggccgtgccccaggaattgtccgatcccaagcccgcatcatga

SEQ ID NO: 3125 - DNA, 2091 bp, Chromobacterium substugae
atgaactcgctgaccaaactgctcgccgacatcggccgccacaagctggccgccccgctcttcctcttggccatcctggccatggtgatgctgcccctgccgcctctggcgctggacatgctgttcaccttcaacatcgtgctggccatcatcgtgatcctggtcagcgtgtcggcgcggcggccgctggatttctcggtgttccccaccatcatcctcgccaccacgctgatgcgcttgtcgctgaacgtggcgtcgacgcgggtggtgctgctgcacggccatgaggggacgcacgccgccggccgggtgatcgaggccttcggcaatgtggtgataggcggcaacttcgtggtcggcatggtggtgttcgtcatcctgatgatcatcaacttcatggtggtgaccaagggcgccgagcgcatctccgaagtgtcggcccgcttcacgctggacgcgctgccgggcaagcaaatggcgatcgacgccgacctcaacgccggcctgatcaaccaggagcaggcgcagcagcgccgccgcgacatcgccaccgaagccgatttctacggcgcgatggacggcgcctccaagttcgtccgcggcgacgccatcgccggcatcctgatcctgatcatcaacctgttcggcggcgtggccatcggcgcgctgatgcacaatctgtcgatgggcgacgccttccgccagtacgcgctgatgaccataggcgacggcctggtggcgcagattccggcgttgctgctgtcgtccgccgccgccatcatcgtcacccgcatcagcgacgacggcgacatgcagcagcaggtgggcagccagatgctggcctcgccggtggtgctgatgagcgcggccggcatgatgctggtgctggccatcatccccggcatgccgtggccgactttcctcggcttcgccgcgctgctggcctatgtggcctggcgcatgcacgcgcgccggccggtcgccgccagcgcgctcaaccagaccgcgatcaaggcggcgctgcagggcgaggcggaaatcgagctggaatggagcactctgccctattccgatgtgctgggcatcacgctgggctaccggctggtggccctgctggaccaaggccagggcgcgccgctgctcaaacgcgtcaagggcgtgcgccagagcctgtccgagcagatgggcctgttgctgccgatggtgagcctgcgcgacgacctcaggctcaagccttcgcaatacgcgatccagctgtccggcaacaccgtggccgaggccgaagtctacgccgaccggctgatggccattccttcgccggaagtttacggcgacatcgacggcattcccggcatcgacccggccttcaacatgccggtcacctggatcgcccaagccgacaagagcaaggcgctgggcctgggctaccaggtggtggattgcgccagcgtgatggccacccacctgaacaaggtgatgcgcgagcacctgtccgagctgttccgccacgacgacgtggcggcgctgggcgagcggctgaccgcgctgtcgcccaagctgggcgcggcgctggccgccgcgctgccgccggtgcagcaattgaaggtctatcgccagctgttgcaggaccacgtatcgctgaaggacatcgtgccggtggccagcgcgctcttggaagccagcgaaaccaccaaggatccgatcatgctggcggccgaggtgcgctgcgcgctgaagcgccagatcgtgcaggccatcgccggcccgcgcgacgagatccgcgccttcaatctgtcggcggaactggaaaacctgctgctggcggcgctgagccaggcgcagcaaaccggcaagccgcagctggacagcttcccgatcgaccccaacgtgctgcagcagctgcaggccaatatgccggtggtgcgcgatcagatgaaacagatgggccagccgccggtgctgctggtgatgccgcagatccgcccgctgctggcgcgctacggccggctgttcgctcccggcctcaacgtgctgtcctacaacgaagtgccggaaaaccgccaggtcagcctgaccggcactttaggctga

SEQ ID NO: 3126 - DNA, 129 bp, Chromobacterium substugae
ttgcgccggatcacgatatccggcgcggctccctcgctttgcgccaagcggcatccccgcgtaaaagcttgccgcacggtcttttccgcgtgccgactatacgcgcagggtagaatctttctcggataa

SEQ ID NO: 3127 - DNA, 864 bp, Chromobacterium substugae
atggcaaacctgaaaaccgccaaccagatcatctgcgacaatatacgcatccagctggagcaattccgctggccggaagcgcaacaggccggcctgatcgagcagatcctcggcctgagcacctcgcaggcctaccgcaagctcaacggcagcagcccgtggcagctgtcccaggtggaaaggctggcgcagtacctgaacgtgccgacttccaacctgctggtcgaccacagccagcagcacagccagactccggtggacaatgagctgatcccggccatcctgcatctgaacaatcaaagcggcgaagcccattgctggatccagctcggcgaaccgctggccgacgactcctgcgcgccgctgctgctggccaagcgccttcacgactgctggcatgtattccccggcacccagttcgacgccgaggacggctacgaggtcacctacctgaccatccgcccgcccaaacgcgccaacaccaagcgcctgctggtggcggtgctggacgacaatgacgctgatctgctgtccgccatcctggtgcagcaaggcctgttctccctgccctaccaccacccgaaagatttgctggaagcgctgccgcgcgaggatttcgatgccttcgtgctggactgggtgctgggcgagccgaccagctgcatggacgtgatcgaggcgatccgccgccacaaccccaatgtccccatcgtggtgctgaccggctacgcgctggagcatgagagcgagctgtccaaagccttgcagatgcgcggcgtctactacatcggcaagccgacgcccggctccatcctggcgctgcagatcaagaacatggtcaccaacgggctggagcacgcataa

SEQ ID NO: 3128 - DNA, 1620 bp, Chromobacterium substugae
atgagtaaagctttttacatcacggcggctccggttggcgccgtgcccaagtatctggacccgcaagagccaaaattcattcctggcctgttgctggataatctggttcccaacgatgcgctgcctgaagcgctgcaattgttgaaacgcgaagggtgggaatccgtagccgccggcggctggctattgcaggacggctatgagcaagcggcgagccgagaagatatctgcgcgcttagcgcgactcagcaggcgcaaagcatcaaggcgctgctggccgcgggatggcggctggacaatggcgtctggcggccgcagccctccggccatgccgcctccgcccgccgcctgccccgcgcgctgttcgatctcttgccctcacaggcgctggttcgccaattggtgcaacaattgaccacgcatggctgggagtgcgatgagcgaggcgatctggtttggacgcatccgcgtctgagcagctatctcccgccggaaatggcggcggaaatcgaggcgcaatcgtccgaggccgcctcccgcttcctcgcttgcgggtggcatgcgagcgaggccggcatgtggcaaccgggcaaggcgcgcagcccgcacctgccgatcaccgcggagcgcatcgtcgcagaatcgctgcactgcgcgcgcgaaggcgccgcggtcatccacctgcatacgcgcgatctcgcagaccaggccaagctgacgatccccggcctgggcgcgccgatcagcgccggccagcaacgcaatcaaatcgtgctggaccaatacgagaacatcgtgccggccctgcgcctgtccgccccctcggtcctgctgaatttgtccaccagcgctcgcggcgaccgcgcggcttcgcaaagcgccttgcggcgcgcccacctgaagcactatgccggctacgcggcgccggagatcgcctccctcagcccaggccccgtggttttccagaccggcggcggctatgacaatccgaatggttttcttcaggcgcagctcgagcatttccaacatgccggcgttcgtccggaaatcgaagtgttcaaccacatcatcaccgaaaacgcggtcaccttataccgccagcctctgctggccagcggggcgccggtcttgttcatgctggtggccggcgtggaccagcataggcgcgatccggtcagcggcgaaatggatgacgactcgctgatcgacaccgcttcccgcaaacagatacaggcgtttctgcagcagcaggacaccgtcgccgccgccaagcttgccgcggaatgtttgcgtcccaccgtcaagcaattgcgccagcatttccgcgactgccggatttccttgctgctgccgggcgcgttgcatgccatcctggtcgacgtcgccgtcgctctggacctggatggcatccgcgtcggccttgaagatgggttgaacctgatcgatccccaagcgcccggcggcattcgcaaggcccgcagcgccgaacaggtgaaagccttgcgcgaagagcttgagcggcgcggccatcatgtgatgagcgcggaggaagtccgccgcgacctggccatgccgcggcaaacggcgcgcgccgcccaggcggaagcggcggaagcttaa

SEQ ID NO: 3129 - DNA, 1707 bp, Chromobacterium substugae
gtgcaggcgccgtggtggctggtcgcctcgctgctgttgctgttgctggccgccggctggaatttctaccggatggaccgcgccagcgaagcgctgataggcaacggcaagagcgagcagcaatattggactgtcgcccaactgcacgtggagctggagcggacgcgcgccgagctgatcggctacgcggccgatgaaaagcaatttcccgacttgcagcagcagctgcaggtgttgcaaagccgttaccaggtgttcgaggcgccggacagcgtgctggtgcaccggctgctcagccgggtcagcggtttcgacgcgctggtcggcgcgctgggcccgttgctgggcgacaaggcctggccgcatctgacgcaggcgcaggcgcgcaagatggtggtgcgcatcgacgcattgcggccggtgctggccaatttcgcggtgcagacccgcgaggccgaagtgacggcgcgggtggcgcgcagcagcgcgctggccagccagcgctcgcagatgctgattctgcagctggtgctgtgcggcggcatctgcggcgtgctgctgatgctgatgcgctaccgcgaggtcagcgatctggccaaggcgcgccagtcgctgctggagcaggagaggctggcgcaccaggccacggtggcgctggagctggatcgcaccactttcctcggcacgctggggcacgagatacgctcgccgctgcaatcgatgcagatgtgcctggaactggtggagccggcggtgtcgccgcacggcccggcgcagctggcgctcaagcgcctgaaggcgggtatggcccagctgacctcccaggtgcacgacatcatggacgtgtcggcgatcaagaacatgcagctgcgcctcaatccgggacgggtgcggctggccggcgcgctgcgcaccgtggtcgacgtgatgcagcccttggccgacgccaaggggctggcgctgcgctatgagagcgagggactgccggagatggtgctgatggacgagatccgcctgcgccagatcgtcggcaacctggtgtccaacgcgatacgctacaccgatcagggcgcggtggcggtgaaggcgcgcggccagatgtgccaggagcatctcgaattgtggctgcagatcagcgatagcggcatcggcatcgccgaggaggacaagcagcgggtgttccagccgttcagccaggggcgcaaccgccgtccgggcagcagcggcctgggcctgtccatcgtcaaggagctggtgcggctgttcggcggcagcatcgagctggaaagcgcggtcggcgtcggcagcgtcttcaccgtgcggttgccgctgcgggaagtgcaggaggcgagcgccagccgcagcctgctgctggtagacgacgacgaggtgatccgggcatcggtggcgcagttgctggcgcaggacggttttcagatcgcctgcgcgtccacgctgagccaggcggccgactgcctggcccggcagcgtttcgacatcctgctgttggacatgcaattgggcgaggatagcggctaccggctggcggagctggcgcgcaagcagccgcagcggccgctgatgctggcgatgagcgccgaccccgaggaattcgccgatgtgcgcgccgcctggttcgccgcccggctggacaagcccttcgacggcgacaccctcagggcggcgctggccgacctgcctttgtga

SEQ ID NO: 3130 - DNA, 453 bp, Chromobacterium substugae
ttgagcgcctgcgttttggccgattcggacccggtggtgctgacggtgtccggcaagatagggcggttcaccgacgccaagcgcggcgtctaccagtttcgcgacagcgacctggcccgcctgcggcagatgagtttcaccacggccaccagctggacgccgtcggtgactttcagcggtcctctggtgcgggacatcctggccaaggtggaggccaaaggcgccacggtgagggtgctggcgatcaactattaccgttacgacatttccgtggcggagctggtgcgcggcaaggtggtgctggcgcggcgcatcgacaacaagccgtttgacgtcgctcactacgggccgctgtggctgatgtatccgctgccggacatgcccgacgccgacaaggggccgccgctggacgccaagctggtgtggcaggtggaagcgatggaggtgatgtga

SEQ ID NO: 3131 - DNA, 858 bp, Chromobacterium substugae
atgctgagcctgtacaccaatatcgccgcactgaacaccaagtccaacatgaactccacccagaacgcgctgtcgacttcgatgacgcgtctgggcaccggccagcgcatcaactccgcgatggacgacgccgccggcctgcagatcgccacccgtctggacgcgcaaagccgcggcatgaccgtagcgatgaagaacgcccaaaacggcatctccatgatgcagaccgcggaaggcgcgctgaacgaagtgaccaacatcctgcaacggatgaaggacctgtccaccgaaggcgccaacggcaccgccaccgccaacgacaagactgcgatgcagtccgagtacgacgcgctgggcaaggaactgaacaacatcgtcagcaacaccactttcggcggcgagaagctgctggccaagaccggcggcaagctggccgcggcggtgaacttccagatcggcgccagctcttccgaagtgatgtccaccgacgtatccacccagatcaccgggctggataccgcgctgcaagccgcttccgcccagtacaagactccgagcgccactgccggcggcgaaatcggttcggccgccacgattgacctgctgaataccgctctggacagcgtcggcgccgtgcgctccgccctgggcgccaactccaaccgtctggaccacgtggtcaacaacctgaacaacgtgaacaacaacacgctggcagccaagggccgcatcatggacaccgactacgccagcgaaagctccaccatgaccgccaagcagatgctgatgcaagccagcacctcgatgctgaagcaaagcggcagcatgaacagcctggccatgtccttgctgcagtaa

SEQ ID NO: 3132 - DNA, 1266 bp, Chromobacterium substugae
atgaacgctcaatcgaatccctttctgtttgaaagcgcggcgctcactcaccttcccaactacggcgtcgtcaagaccacccagttggccggctatctgtcggtcggcgacgccgccggcggctggctgtatttctgcttcagcgaagccagcgccaaccctgcccaggcgccgctgctgctgtgggtcaacagccacccgcgggacagcgcgccggccagcctgttcgacgagcacggcccctatctgctggacggcaacggccgcgtctacggcaatccgttcagctggcaccaccatgtcaattacctggtcatcgatcagccgctgggccgcggcctgtcgttttcgattcacccgcgctacctgccggaaagccacgacgaggcctgccagcagctgtaccacgcgctgcaggaattcctgttgcgctggcccgcctaccgccagcaggatttctacctgttcggcagcggcgcggccggccacaccatcgcgcgcctggccaactgcatcctggacggcaacggctgcggccagccggaaatccggctgaaggggctgggcctgggcaatgggcaggtgtcgccgaaaatccagctgcccagccacatcgaatacgcccgtcagcaccggctgatcaatgccgaggaagaaaaacgcgcgctggaaatgctggcggacttccacgacgcccacgcctcgccgataccgctgcggcgcagccaggccagccgcagcgcgcgggaaatcgaggactacatccagcaatgctcggggcgcgacaagcacgatatccgccatccgccgggcgatggccgccagcgcgtggacgagtacctggccaagccttccgcccatcaggcgctgcacatcgatccgcgttcgcgcaacgagctgcagccggcgccgcagcaactgagcgaggcggcatggctggacgactcctcccacttgttcccccgcttgctggatcagctcaaggtgctgctctatcacggcgaatgctgcatggaaggcaattacctgggcatggacgcctggctgaacacgctgctgtggcagcaggcgccggacttccgcgaacagaaacgccagccctggcggccatacgggctgccggccggcctgatccgccgccaccggcgcttgtcgcaggtcatcatccagaacgccgggttgcgggtggcgcgcgaccagcccgccatcgcgctggcgatgctgaagaactttcttggcgaggaaacggacgacgccgagccctga

SEQ ID NO: 3133 - DNA, 1017 bp, Chromobacterium substugae
atgagcagcttcaaacgcctcaccatagacgatatcgccgcgctggccggcgtatcgcgcactaccgccagcatggtgctcaacggccatgccggccgctaccgcatctcccaagccacggtggaccgggtggaagcggtggcgcgcgagcaccacttcaatccctcgcaacaggcgcgcagcctgcgcagccggcgcagcagcagcataggcctggtgattcccgatctgaccaactccacccacgcggcgctggcgcaggcgctggaaaacggctgccgcgcgctgggctaccagctgttgatggtgaccagcgacgaggacccggaacgggaaagcgccggcatcggccaactggcggcgcgccaggtggacggcatgatcgtggtgccgtgcagcggcgacgccggccgctaccagccgtggacccggcgcttgccgctggttttcgccgaccgccatattcccggcagcggcatcccatccacggtcaccgacgccgccgacagcgtggccagattgctggcgccgctgctggagcgtgatgtggccgagctggcctatttcggcggccagcccgacctgtcggccagccgcgaacgcctggcgggctatcaccaggcgttgcgggcgcaaggcatggcgccgcagccaggctgggtggcggagcgcgacttccagcgcgaatccggctatcggctgatggctgactggcatcagcgccacggccgttatccgcaggccttgttcaccgcctccatcaccctgctggaaggcgtgttgtccttcatccgcgaacgccaccgcatgcgcgaggcgccgcgctacctgctcactttcgacgatcatcccttgctggactgcctgccgctggcggtggacgccatccgccaggacagtcaggcgctggccgacgccagcctgcgccaaacgctggcattgctgcatggcgagcctttgccggcggccgatatccgcattccggccagcctgaacctgcggcgcttggccggttaa

SEQ ID NO: 3134 - DNA, 933 bp, Chromobacterium substugae
atgaaacgcattctcaccccgttgatggccggcatgctggcgttcggcatcgccgcctgctccaagcaggggcccggcgcaagcggcggcgaagccagcgcgccggcggccgccggcaaggccaccgtcggcctggcggtgtccacgctcaacaatcccttcttcgtggcgctgcgcgacggcgcggccgccgaagccggcaaggaaggcatcaacctgatcaccgtggacgcccaggacgatccggccaagcagcaggccagcgtggaagacctgatccagaaaaaagtgggcgtgatcctgatcaaccccaccgattccgccgcggtggccaatgtggtgaaggaggcgaccgccaagggcatcaaggtggtgtcgctggaccgcagcgtcaacggcgcggaagtcagctcccacatcgcctccgacaacatcgccggcggcatgatggccggccagtacctgctgggcaagctgggcggcaagggccgcatcgtcgaactggaaggcatcgccggctcttccgccgcccgcgagcgcggcgaaggcttccaccacgtggtggacaagaaggcgggcgtggagctgctggccaagcagccggccgatttcgaccgcgccaagggcttgtcggtgatggagaacatcatccagggcaacaaggacatccagggcgtgtttgcgcacaatgacgaaatggcgctgggcgcgctgaaggcgatccaggcggccggcctgaagaacgtggtggtggtcggcttcgacgccaccccggacgcggtggcttcggtcaaggccggcacgctgtcggccacggtgcagcagcagccggcgctgatcggccagtacggcgtgcagaccgccaagcggctgctggacggccagaaggtggacaagttcatcccggtgccgctcaatctggtcaagcaataa

SEQ ID NO: 3135 - DNA, 939 bp, Chromobacterium substugae
atgaccccgcaacaaaaagccaatctgcaacgcctgggccccttcatcgcgctggtgctggtggccatcggcctgtccgtgatgagcccggactttctcaccgtcaacaacctgctgaacgtgatgcgccaggtgtcgatcaacgcgctgatcgccttcggcatgacgctggtgatcctgctgggcggcatcgatctgtcggtgggctccatcctggcgctgtcgtcggtgttgacggccagcttgctgcaagccggcgtcgaccctatgctggcgaccttgctgggcatcctggccggcgcggcgatgggcctgttcaacggcctggtgatcagcaagggcaaggtggcgccgttcatcgccacgttggcgacgatgaccattctgcgcggcctggcgctggtgttttccaacggcagcccgatcaccggcttcgacagcgaactgttctcgatgctgggcggcggctacatcgccggcctggtgccggtgccggtggcgtggatgctgatcctgttcgccggcttctggttcctgctgaagaaaaccgtgttcggccgccacctgtacgccaccggcggcaacgaggaggcggcgcggctgtccggcgtcaaggtcgacaggatcaagttgtgggtgtacaccgcttccggcgcgatgtcggcgatggccggcgtggtgctgacctcgcgcctcaattcggcgcagcccaccgccggcgccggctacgagttggacgccatcgccgcggtggtgctgggcggcaccagcctgaccggcggccgcggctggatcttcggcaccctgatcggcgcgctactgatcggcgtgctcaacaacggcctgaatctgctgggggtgtcgtcgttctaccagcaggtgatcaagggcgcggtgatcctgctggcggtgctgctggaccgcagcggcaagaaatga

SEQ ID NO: 3136 - DNA, 1509 bp, Chromobacterium substugae
atgcaagtgaccatgcgcggcatccgcaaggccttcgggccggtgacggtgctggaaaatgtggaattcacgctgcgcggcggcgagatccacgcgttgatgggcgaaaacggcgccggcaagtcgacgctgatgaagatactcagcggcgtgcaccgcgccgatgccggcgagattctgctggacggccgccaggccgagctgcgcgacaccgcggcggcggaagcggccggcatcgccatcattcaccaggaattgaacctgatcccgcaactgtcggtgatggaaaacctgtttctcggccgcgagccgtcgcgcttcggcctgatcgactacggccgcatgcggcgcgaggcgagggcgcagctgtcggcgctgggcgccgagggcatcgaccccgagcaagaggccggcagcctgtccatcggccagcagcagatggtggaaatcgccaaggcgctggcgctgaacgcccgcgtgctgatcatggacgagccgacggcggcgctgaccgagcgcgagatcgacgcgctgttcgcgctgatggcgcaactgaaggcgaacggcgtggccatagtctacgtctcgcaccggatggaggagatcttccgcatttgcgaccgcatcagcgtgttgcgcgacggctgcttcgtcggcgagcgcgagatcgccggcaccgatttcgacgaggtggtgcggatgatggtgggccgcgagatcggcgaccgctatcccaagcgtgaagccgttccgggcgcggtgcggctgaaggtggaaaacctggccgacgagaacatgatcgccggtatccgtttcgaggtgcgcgccggcgaggtgctgggcatcgccgggctgatgggctcgggccgcagcgacatcctgaagacgctgttcggcgccaagcgccgcaccgccggccgcgtcgagctggatggcgaggaattgaaagtggccgcgccgggcgacgccatcgccgccggcctcggcttcgtgccggaagaccgcaagagcaagggcctggtgctgggcatgtcgctgcgcgaaaacgccacgctggtgcatttggaccagtacgcgcgcctgggcgtggtgcaggctgccgacgagaagcgggcggtggacggcttgatcgcgcagctgcgcatccgcgcccgcgacgccgagctggacgtcaagtccttgtccggcggcaaccagcagaaggtggtgttcgccaaatggctggccaatccgcccaaggtgctgctgctggacgagccgacgcgcggcgtcgatgtcggcggcaaggccgagatctaccacatcgtcaaccagctggccgccgccggcgccgccatcgtgatggtgtcgtccgaattgccggaagtgctggcgctgagcaaccgcatcctggtgctgcacgaaggccggcaggccggcatcttcgacgccgccggctgcacgcaggaaatcttgatggcggccgcgaccggcggcgccgttcccaccgaaatcaggaaacaagcatga

SEQ ID NO: 3137 - DNA, 399 bp, Chromobacterium substugae
atgaagaagcatggccatttgaaccgcgacatcgcccgcatcctggccggcatgggccataccgacagcctggtgatcgccgactgcggcctgccgattccgcccggcgtggagtgcgtcgatctggcgttgcggctgggagagccgggttttgccgcggtgctggacagcgttctggccgacttccagtgcgagcgggcggtatttgccatagaatgccgtcagcataaccaggcggtgcaagacaaggccgaggaaatggcgcagtccggcgtggcgctggatttcgtcagccacgaggaattcaagcagcgctgccaggcggcgcgggcggtgatccgcactggcgaatgcgcgccgtacgccaacgtgatcctgcactccggcgtgattttctga

SEQ ID NO: 3138 - DNA, 891 bp, Chromobacterium substugae
atgactcgggtgctggtggtcggcagtatcaatatggatctggtggtgacagccaagcgcatgccgcagctgggtgaaaccctgctgggcgacggcttcgccacctacccgggcggcaagggcgccaaccaggcggtggccgccgcgcggctgggcgccagcgtggcgctgctgggctgcgtcggcgacgacgctttcggccgcgagctgcttgcccacctggcaagcgagggcgtggattgccgccgcgtgcgaagcgtggctggctccaccggcatcgccgccatcactgtcagcggcggcgacaacgccatcctggtggcgcccggcgtcaatcaccagttgacgcccgcggatctggacgccgccgaacaggccttcatcgacgccgatgtggtgttgacccagctggagattccgctggcgacggtgcgccgcgccgccgaactggccgcccgccacaagaagccgctgctgttgaaccctgcgccggcggtgccgctgccggaagagctgctgcagcgggtggctttgctgaccccgaacgagcacgaattcctgaccatgctggcccagcctgacgccgattggcgcgcgctgctggccgagcgccccggcaagctggtgatgacccatggcgagcatggcgcctatttcgcgctggcccgcggccagttgcgccatcagccgggttttgaggtcaaggcggtggacagcaccggcgccggcgataccttcaacggcgcgctggcggcgtttttgccgctggggctggaagaggcggtgcgccgcgccgccgccgcgggcgccttgtcggtcactcgtccgggcgcgcagggaggcatgccgacgctggccgagctggacgcttttctggaggcgcgggcatga

SEQ ID NO: 3139 - DNA, 744 bp, Chromobacterium substugae
atggactggcaacaactgttcgatctttactggagcgcggcgaagtggcaggtcaatctgctggtggtgggcaatctgctgggcgggctttgcctgggcagcctgctgggctatgagcgctggtacaacggccgcgccgccggcatgcgcacctacggcctggtctgcatggcgtccgccgcggccatcaccatcatcggctacgccggctactggtacggcggcgccgcgccggccgccgcgccgccggacatgacccgggtggcgcaaggcgtgctgaccggtatcggttttctcggcgccggcatgatcatgaaggaaggcctgagcatcagcggcctgacctccgccgcctcggtgtggatgtcgtcggtgataggcatcctgatcggcgtcggcttctacgccgcggccatcgcgctgacgctgatgtgcatgatcttcgtcaccgtggtcaaccgcatagaaaacgtgctgccgcgccgggtcagcctgttcgtcaccgtgcggctgcgcccggagcacaactggacggtggaggcgctgtccgaccggctgacgcctttcggcctgcaactgcacgacgaaagcatcagcatcaaggccggccccgactgtaccgagtggaatttcatgatttcggcgcagaaccgccgcaccttcatcaacgtggtggacctggcgcgcgacatcatggccgccgaccacatcctggagttggatgtgcagccggcgcgcaactaa

SEQ ID NO: 3140 - DNA, 1164 bp, Chromobacterium substugae
atgtcgcaacacacattctctccggacgagaacgtccactgcagccccaaggactggtatcggatggccagcgaaaagccgggcttcatccacgacgaggcccaggcggcggcgatagagcggctggacagcctgtggcaccagctggtggatttcaaatccaaacgcaaccgtttcctcggccgcagcctgcgcagcccgcaagtgccgcgcggcctgtatttctggggcggggtggggcgcggcaagagcttcctgatggacgccttctacgcctgcgtgccgtatcgccgcaagcgccgcatccatttccacaacttcatggccgaaacccatcgcgagctgcgcaagctggccggcagcccggacccgttgctggcttacgccgaccagatcgccagggccacccggctgctgtgcttcgatgaattccacgtgtccgacatcgccgacgcgatgatgctggggaggctgctgtcggcgttgctggagcgcggcgtggtggtggtgaccacctccaattacgagccggacggcctgtacccgaacggcttgcaacggcagaacttcctgccgacgatagagttgatcaagcgcgagctggacgtgctcaacgtggatggcggcaacgattaccggctgcgcgagctgacgcgcgagccgctgttcatggtgccggccgacgccgacagcgagcgccggatggcgcagctgttcaagcgcgtcgccaccggcgccgagctgccgcaaaaatccatccaggtgctgggccgcgagatcgcggtgaagcggatgtcgcccggcgtgatctggttcgacttcgccgcgctgtgcgatggcccgcgcgcgcagaccgactacctggaaatcgccagcgaataccacacggtgttcttgtccggcattcccaggctcacggccaagcaggcctcggtggcgcgccgcttcacctggctggtggacgtgttctacgacaatcgcgtcaagttgatcgcctcggccgccgccgcgccggaggagatctacaccgacggcgtgcaggccggggaattcttccgcaccgccagccgcctgaccgagatgcagtcgaagagctatctggagctgccgcaccagtcgatggcgcaaagccacgaccagccgccgccgggcgtggcgctgtaa

SEQ ID NO: 3141 - DNA, 783 bp, Chromobacterium substugae
atgagcgttgcgaaaacgggcgccaggctgtgggccggcctgctgctggcctgcgccggcgcgcaggctcaggcggcgccgcgcgatctgtatttcgtcacccagctgtttccccccttcattaccgatagcgccgatggcaagctggatggcgctttgatcgccattctgcgcgaggcctgccggcgggcggactggaactgcaaggtgcaggcgatggtgtggaagcgcgctttgctcaccgtcggccagggcggcgccgacggcctggtgctggcgcaggacgcgccggagcggcgggcggtgatggagttgtccaagccggtgctggccagcagctacggcctctacgtgcagtccggcagcgcgctgcgctaccgccagcccggcgatctggccggcaagaccatggcggtgtatggcccgtcattgtcgcaggccagtagcgagcggctggtccagggcgtgtccggcgtcagcctggcggtggagctggacccggaaacggtgctgcgcaagttggcggcgggccgctacggcgcggacgcggtggcgttctccaatgacgacgtagcccgctactggatcaagcgcgacggcttggggaatgtgcgcaagctggccgaggtgaagccgctggcctatctttacggcttcacccgcagccggttgaagcccggcatgctggaaaccttcaaccgcgtgctggacgacatgtgccgcgacggcagcctggcgcggctggccgcgccgtccggcatccggctggcgacttgccgctga

SEQ ID NO: 3142 - DNA, 885 bp, Chromobacterium substugae
gtgtacaagcatctggaagatttcgtcggcggcacgccgctggtccgtctcaagcgcctgccgggcgacaacggcaatgtgattctgctgaagctggaaggcaacaatccggccgggtcggtgaaagaccggccggcgctgtcgatgatccgccgcgccgagcggcgcggcgacatccggcccggcgacactttgatcgagcccaccagcggcaacaccggcatcgcgctggcgatggcggcggcgatgatgggctaccgcatggtgctgatcatgccggagaactccagcgccgagcgggtgcaggcgatgcgcgcctacggcgcggaagtgatcctgacgccggccgcgggttcgatgccggcggcgatagacttggcgcgcagcatggaggcggcaggcgagggccgcatcctcgaccagttctccaacccggacaatccgctggcgcattatgaaaccaccggcccggaaatctgggagcagaccggcggcaagatcacccacttcgtttccagcatgggcaccaccggcaccatcatgggcaccggccgtttcctgaaggaaagaaatcctgccatccgcatcatcggcgtccacccggagccgggcagccagatcgccggcatccgcaaatgggaagacccgtatgtgcccaagatctgcgatttcgagcgcatagacgagattcagcatgtcaaccagcaggacgcggaagacaccgcccgcctgctggcgcggcgcgagggcattctggccgggccgtcgtccggcggcgcgctggcggtggcgctgcggctggacgcgcagttgaccggcgcggtgatcgtgtcggtggtatgcgatcgcggcgaccgttacctgtccaccggtttgtttggctga

SEQ ID NO: 3143 - DNA, 1635 bp, Chromobacterium substugae
atgcatgaaatctggacccagcagtatttcccggccggcggccccgcgctgtcggcattgatggccgcgctgcccatcgtctttttcttcgtcgcgctggcggtgctgcggctgaaggggcacgtcgccggcaccttgacggtgctgatcgcgctggcggtggccatattgttttacggcatgcccgccaagatggcgctggcggcggcggccttcggcttcggctatggcttgtggcccatcgcctggatcatcatcgccgcggtgttcctgtacaagatcaccgtcaagaccgggcagttcgacatcatccgcgcttcggtgttgtcggtgaccgaggaccagcggctgcagatgctgctggtgggcttctccttcggcgcctttctggaaggcgcggccggtttcggcgcgccggtggccatcaccgccgcgctgctggtggggttgggcttcaatccgctgtacgcggccgggctgtgcttgatcgccaacaccgcgccggtggcgttcggcgcgatggggataccgatcatcgtcgccgggcaggtgaccgggctggatccgttcctgatcggcgccaaggccggccatcagctgcccatcctgtcggtgatcgtgccgttctggctggtgatgatgatggatggcctcaagggcgtgcgccagacctggcccgccatcctggtggccggcgtctcgttcgccgtcacccagtttttcacgtccaactatatcgggccggagctgccggacatcacttcggccctggtcagcctggtgtgcctgacgctgttcctgaaggtatggcagccaagtgaaatcttcacgttcgacggccgccgcgcgccgtccgcgcgccaggccagcggcttcagcctgggccaggtcatccgcgcctggagcccgtttctgatcctgaccgcgttggtgacggtgtggagcgtcaaaccgttcaaggccatgttcgccaagggcggcgcgctggaaggctggatctggaagctgcatgtgccggggctggacaagctagtgttgaagacggcgcccatcgtcgcgcatgacacgccttacgaggcgctgtataagttcgacatcgtctccgctgtcggcagcgccatcttcctggccgcgctgctgtccatggccttgttgaaattccgtccggccgaaggcgcgcgcgccttcgccgagaccctggccgagctgcgccggccgatattgtcgataggcatggtgctggccttcgccttcgtcgccaactattcgggcatgtccagcacgctggcgctgtgtctggccggcaccggccaggcttttccgttcttctcgccgtttttgggttggctgggcgtgttcctgaccggctccgacacctcgtctaacgcgctgttctcggccctgcaggcggccaccgcgcaccagctgggcgtgtcggatgtgctcctggtggcggctaataccaccggcggcgtcaccggtaagatgatctcgccgcagtcgatcgcggtcgcctgcgcggcggtggggctgataggcagggaagcggatctgttccgcttcacgctgaagcacagcctgatcttctgcagcttcgtcggcgccatgacctggctgatggcgcatatggggtag

SEQ ID NO: 3144 - DNA, 2820 bp, Chromobacterium substugae
atgacgcccgcccacgccgattttctgcaggatttgcgccaaacgatgccgccggcgcgcattttcaccgacccattgtccacgctggcctacggcaccgacgccagcttctaccgcctgcggccgcaaatcgtcgcccgggtggaagacgagggcgaggtggcggcgctgctgcggctggccagattgcaccgcgtcgccgtcaccttccgcgccgccggcaccagcctgtccggccaggcggtcagcgattcggtgctggcggtgctgggcgatggcttcaaccgcggccaggtgctggacggcggcgcgcgcatccggctggggcccggcataataggcgcgcacgccaacgcgctgctggcgccgttcggccgcaagatcggccccgatccggcgtcgatcaacaccgccaagataggcggcatcgccgccaacaactccagtggcatgtgctgcggcacccgcgacaacagctaccacaccctgcaggcgatccggctgctgctgctcgacggcgccgcgctggataccgccgatccggccagcgtggcggccttccgcgaatcgcacgccgatctgctcgatggcttggcgcagctgtcgcgccagctggccggcgatccgcagctggccgagcgggtgcgccgcaagtatcggctgaagaacaccactggctacggcatcaacgcgctgctggacttcgccgatccggtggagatgctggcgcacttgatgatcggctccgaaggcaccttgggttttatttccgagatcacttttcataccgtggccgagcatccgcacaaggcgtcggcgctggtgctgttcgacgatctggatcgctgctgccgcgcggtgtcggcgctgagcgcggcgcgcgacgctagcggcgtgtcggcggtggagctgatagacagccgcagcatccgcgcggtgcagggcaagccgggactgccggatttcctgtatcagccggtggggctggacagcgcttgtctactgatcgagctgcgggcggagagcgaagccaggttggacgaatgttcggtccagatagagatgctgctggccggtttccagcccaaagtctccagcggcttcagccgcgacgcgcgcgagtgcgagacctactgggctttgcgcaaggggttgttccccgcggtgggcgcagcccggccgttggggaccacggtggtgatagaggacgtggcctttcccatccatcaactggccgatggcgtggccaggctgaccgccctgttcgacaagcacggctacgacgaggcgctgctgttcggccacgcgctggacggcaatctgcatttcgtgttcgcgcccggcttcgaaagcccggccgaggtggcgcgctacgatgctttcatgcaggacgtcagcgacttggtggccggcgaatacgacggctccttgaaggccgagcacggcaccggccgcaatgtggcgcccttcgtgcggcaggagtggggcgacgccgtctggaacatcatgcgccgcatcaaggcgctgttcgatccggaaggcctgctcaatcccggcgtgatcatcaccgacaacgacaggctgcatctggagaacctgaagccgatgccggccgcggacgatctggtcgaccgctgcaccgaatgcggcttttgcgagccggcctgtccgtcgcacgggctgacgctgagcccgcgccagcgcatcgtcgcctggcggcgcatccgtcagttggaacgcgacggcgagggggcggaagaactggcggccttgcaagccggctaccgctaccgcgccgtcgatacttgcgccgccaccggcatgtgcgccacgcgttgtcctgtgggaatcaacaccggcctgctgatgaaaaaattgcagggcccgagccggcgtcccgccttggccggcttcgccgcccgccacatgcagctgatgacggcggcggcgaggaccggtttgaagctggcgcatgtcgcgggaacgcagcgcttgaacgcattgacgcgccgccggccaggcgagcgcaagatcattccgctgatcccagcggccttgccgcgcgccgccgcgctgctgccgaagccgggaggcgagggcgagccggtggcgttgttcgtcagctgcgtcaaccgaacgctggcggaaggcgagggcggcgagtccgtcgcggcgcatacgatcaatctgctgcgccgcgccggtttcgcgccggtctatccgcccggccatgacggactgtgctgcggccagccgttcgcctcggccaatgccgcggacgcattggccatcagtcaggcatcgttgaatgacgccttgctgcaggcgagcgggcagggccgccatccggtttatctcgacaacagtccgtgcgcggcgcgggtcaaacaggcgcaggccgagggcttgctggacccgcgcttgcagctgttcgacgccgccggttttctggcggaaaaagttctgccgcggctgagcatcgtccggcgcctgccgcaactggcgctgcatattccctgcagcgcgacggcgatgggcgcggctggaagcttgaaacaactggccgccagctgctgcgatgagctgaccgtgccggatatcgcctgctgcggcttcgccggcgacaagggcttcaccgcgccggaactgaacgcccacagcctgaggagactgaagccggctttgccggaagcctgccgccacggcgtgtcgatgagccgcacctgccagatcggtctgaccgagcatggcgggattccctatgccagcatcgaggcgttgctggatttctgcaccacccccatcaacggcccgtcatga

SEQ ID NO: 3145 - DNA, 1458 bp, Chromobacterium substugae
atgagcgagagcaagatcaccgtttacccgtcgcgcgccttcaaggacaacgccagactggcgctgacggatggcaagctgcggcaaagcctgcgcggatcgatggactttttgatggccaagcggttggcggagtttccggacgaggcggagctgtccgcactgcgcaccctgggcgagggcatacgccagcgctgcctgtcccggctgccggatttgctggagcagctggaggacaagctcgcggcaaatggcgtgaaggtgcactgggcggaaacggccgaggaggcgaaccgcatcatccacggcatcgtcgccgcccgtcagggcaagctgatggtcaagggcaagtccatggtcagcgaggaggtggagctcaatcattacctggcggaccaaggcgtagaggcggtggagagcgatatgggcgagtacatcgtccagctggcgggcgagaaacccacccacatcatcatgccggccatccacaagaccaagcaggacatcgccaaactgttccatgaacagttgccggacacgccgtataccgaggatgtggacgcgctgatccagatcggccgccgcgtgctgcgccgcaagtttctggacgccgacgtcggcctgtccggcgtcaacttcgccgtggccgaaaccggcacgctgtgcctagtggaaaacgagggcaacggccgaatgtgcaccaccgtgccggacgtgcacgtcgccattaccggcatagaaaaggtggtggaaaagctggaagacgtggtgccgctgtacagcctgttgacccgttccgccatcggccagcccatcaccacgtatttcaatatgatcagcggcccaaggaagccgggcgagaaggacggcccacgcgaggtgcacctggtgctgctggacaacggtcgcagccaggcctatgccgacgagcagctgcgcaagacgctgcaatgcatacgctgcggcgcctgcatgaaccattgtccggtctacacccgcatcggcggccacgcctacggcaccacctatccggggccgataggcgagatcatctcgccgcacctgatggggctggaaaacacccgcgacctccctactgcgtccagcctgtgcggcgcctgcggcgaggtgtgcccggtgcgcatccccattccggaaatgctgatgcgactgcgcgaggaaagccagcggccggccggcgagcgggtggcgcatccgctgcgcggccagggcgcggcggccagcggcgcggaacggatggcctgggccggatggcggctggtcaacgcctcgcccaatctgtaccggatgttcggctgggcggcgacgcggctgcgcaagcacgcgcccaagaaccagctgggctggacgcaaaaccacctgccgttgacgcctgctcccaaaacgctgcatgagctgctgcgcgaacgcgaggcgaacaaggggaaatccgcatga

SEQ ID NO: 3146 - DNA, 699 bp, Chromobacterium substugae
atgagcgcccgcgcctccatcttgcaaaagctgcgcgccgcgccgcggcaggagcgcgcgcggccggatttggccggccatttccagcatttcgcggccaaggacgatgaaatcgcccgcctgcgccattgggcggcgatgatgcgttcggtgaaaaccgacattctgtggacgcgcgaggcggagtgggacgccgccctggccgactggctggccgtgcatccgcaagactcgctgctgctgtcggacacgccgcatggccgccggctggcgcgcaggctggagggcgtggacgaagcgccgcacatcgtctggttcgaccgcgaagtcgatggctggaaggcggagctgttcgacatcgctgccggcttcactgtcgcgcgctgcggcatagccgccaccggcaccctggcgctgtggccggacgaggccgagccgcgcaccatgagcttggtgccgcccttgcacatcgccttgttcgacgccgccacgctgtacccggacttttattcggcgctgcagggcgaaaactggtccgccggcatgcccaccaacgctttgctgatttccgggccgtcgaaaaccgccgacatccagcaaaccttggcctacggcgcccatggcccgcgcgacctgctggtgttggcgctgctgccgccgcatatcgccatccatgacgtggaaggagacgggcgatga

SEQ ID NO: 3147 - DNA, 744 bp, Chromobacterium substugae
atgaagacgcctgccgacgtttacctgttcggcacctgtctgctcgacctattcctgccggaagctggcctagacgccatcgccctgctggaaggcctgggcgtgcgggtgcatttcccccaggcccagagctgctgcggccagccggcctataccagcggccattccaaggaggcgctggcggtggcgcgcgcgcagctgggctgttttcccgaggactggccggtggtggtgccgtccggctcctgcggcggcatgatccagcaccattggcccaagttgttcgccggcgaggcggacgagatggaggcctgcgccatcgccgggcgggtggtggagttttccgatttcctgctcaaccatctggactggcagccgcaagacttgggcccgcccaccaaggtggcggtgcatacctcctgttcggcgcggcgcgagatgaacgtgcacaagagcagctgggcgctggtcgataggctgcaaaacgtcgagcgcgtggtgcaagaccatgaagccgaatgttgcggttttggcggcactttctccatcaagcatccggacatcgccggcgcgatggtggcggacaaggcccagtccttgcaggacagcggcgcggtggagttcgtcaccgccgacggcggctgcctgctcaatatcaacggcaagctgggacagtgcggcagcggcttccagggccgccatctggccagctttctgctggagcgcaccgggggcaagcgatga

SEQ ID NO: 3148 - DNA, 387 bp, Chromobacterium substugae
ttgaatcaatatttccacaataatggaaatatggaaactttaaccgccgccgaacgcctggccgccctgggacatgagtcccggctatcgatctaccgtctgctagtcgaagccggccaacagggcatgatcgccagcgccattgccgacaagctgagcctgcccgccgccacgctgtcgttccatctgtcgcatctgagccgcgtccagctggtccggagcgagcgcgaaagccgcttcatccgctatttcgccgaattcgacaccatggacgccctgctcggcttcctcacccgcaattgctgccagggccagccctgcctgccaagcgcgtccgcctgttcgccgcgaaacgcggcgagcgcgaaaggagaagaccaatcatga

SEQ ID NO: 3149 - DNA, 414 bp, Chromobacterium substugae
atgagccggctgaaaaccgtattggtgctgtgcaccggcaattcctgccgttcgcagatgggcgaagccatcctcaaccatgagctggcgggcctggcgcgcgcgctgtccgccggcaccgcgccgcagcccaaggtcgccgacggcgccatcgaggctttgcgcctggccggcctgcccaccggcgatctttatcccaagccagtggaagcggtgatgcacgaggagatcgacctggtggtcagcgtctgcgacaacgccagggaaagctgcccggtgtttccccggccggtcaaacgcatccatgtcggtttccacgatccgcacggcgagcccttggacagtttcatccgcgtgcgcgacgacatccgcgaacggctggtgccggccgtccgcgaagccttgggcatctga

SEQ ID NO: 3150 - DNA, 1095 bp, Chromobacterium substugae
atggctacccgtcaacacgcggctgcaacgccagccgcccaaagcgccgccatgggccggttcgaacgctatctgacagtgtgggtgctgctctgcatcgcggccggcatcgccgcgggccaattggcgcccggcctgttccatgccataagccggctggagatcgcccgcgtcaacctgccggtgggcgcgctgatctgggtgatgatcatcccgatgctgatgaaggtggacttcggcgcgctgcatcagcttaagcagcacgcgcgcggcatcgccgtcaccctgctgatcaactggctggtcaagccgttctcgatggcgctgctgggctggctgttcatccgccagctattcgctccctggctgcccgccgaacagctggacagctatgtcgccggcctgatcttgctggccgccgcgccctgcaccgccatggtgttcgtctggagccggctgagcggcggcgacccgctgttcacgctgtcgcaggtggcgctgaacgacgccatcatgctgttcgccttcgcgcctattgtcggcctgctgctgggcatctcggccatcgccgtgccgtgggacacgctgctggcctcggtcgtcctttacatcctgatccccgtcatcctggcgcagctgtggcgcaaggcgctgctggccaggggccaggctgccttcgacgcagccatggccagcataggcccatggtcgatggcggcgctgctggcgacgctggtgctgttgttcgccttccagggcgaagccatcctgcgccagccgctggtgatcgcgctattggcagtacccatcctgatccaggtgtttttcaactcggcgctggcttactggctgaacaagaaagccggcgagcagcactgcgtagcctgcccgtcggcgctgataggcgcatccaatttcttcgagctggcggtcgccgccgccatcagcctgtttggcttccactccggcgcggcgctcgccaccgtggtcggcgtgctggtggaagtccccgccatgctgctggtggtgaaggcggtgaaggcgagcaagggctggtatgagggcgcgtccggccagcgccgcgatgagcgatga

SEQ ID NO: 3151 - DNA, 771 bp, Chromobacterium substugae
atggcctatccgaaagtctccctgcccaagctgtccgacgtcatcgtccagcagctggaaaaacgcatactcgacggcgtgctcaaacccggcgaccgcctgccgccggagcggcagctggccgaggaattcggcgtgtcgcggccgtcgctgcgcgaggcgatccagcaactggcgtcgcgcgggctgctgtccagccgccagggcggcggcacctgggtgaccgacagactggaaaccgccttctccgacccctgggagaaactgctgggccagcacgaggaactgcgcggcgacctgctggagtttcgccgcgtgctggaaggcacggtggcgcgctgcgccgccagccgcgccacccaggccgacctggagcggctgcagcgctgcgtggaccggctgcagcaagcctatcgcggcggcgatctggccgagcaggcccaagccgacgtggaattccaccaggcggtggcggaggcctcgcacaacgcgctgttcgcccacctgtccggcagcctgctggcgatgctgcatcgccacgtgaaggacaatatcgccaacctgttcgcggtcggcgaagtggcggaggcgctgcgcggccagcacctggccatctggcaggcgatacgcgacggccggccggacgaggcccaactggctgccgaacgccacctggacttcgtctccgacaccctgcagaaccagcgccagcaggccgagcgcgacgcgcgcgcgcggatgcggctggcgcaggacgacgccgggcgctaa

SEQ ID NO: 3152 - DNA, 1023 bp, Chromobacterium substugae
ttgcagaacaaggacaaacacatgactatcgtcgttaccggcgccgccggcttcatcggctccaacctggtcaagggactgaaccagcgcggcatcaccgacatcatcgccgtcgacaatctttccagcggcgacaaattccataatctggtcgattgcgaaatcagccactacctcgacaagcacgaattcctgcacctgctgctggatggcgaatacgagggcgagttgaccgccatcctgcaccagggcgcctgctcggacacgatgaatcacgacggcaagtacatgatggacaacaactatcagtacacgctggcgctgttcgactactgtcagcacgaggaaatccagttcctgttcgcctccagcgccgccacttacggcaagggcaccgtgttcaaggaagagcgccagtacgagggcccgctcaatgtctacggctattccaaattcctgttcgaccaggtgctgcgccagcgcatgaaggaaggcctggcttcgcaggcggtgggtttccgctacttcaacgtctatggcccgcaggagcagcacaagggccggatggcttctgtcgccttccaccatttcaaccagtaccgcgagcacggcaaggtcaagctgttcggcggctgggacggctggggcgacggcatgcaaagccgcgatttcgtgtcggtggaggatgtggtcaaggtcaacctgtacttcctggacaatccgggcaagagcggcatctacaatctgggcagcggccgctctcagccgttcaacgacgtggccgaagccgccgtcaacgcctgccgccgccatgaaggcaagccggcgctgaccttggccgagatgatctcccaaggcatcgtcgagtacattccgttcccggacgcgctgaaaggcaagtaccagagcttcacccaggccgacatcggcaagctgcgcgaggcgggctacaccgcgccgatgctatcggtcggcgaaggcgtggaccgttacgtggattggctgatcagccgccagggctga

SEQ ID NO: 3153 - DNA, 588 bp, Chromobacterium substugae
atggcgacactgacgccggcgcaagtcgaggccgtgctggaattctggtttggcgggtccgacgatgccagcctggccgcgccgcgcgaggcgtggttccgccgcgacgaggctttcgacgcggccatccgccagcggttcgcgcccttgtgccggcaattggccgatggcgagctggagatggccgacggcgatgcccgcgccgcgctggcctggctgctggcggccgaccagtttccgcgcaatctgtttcgcggcgaggcgcgggctttcgcttgcgacgcggcggcgcgccagggcgcgccgcgcgcgctggagcaggggctggatggcggcttgccggcggtggcgcggatctttctttatcttcctttcgagcacagcgagtcgctggccgatcaggaactgtcgctgcggctgttcgaggcgctggacgccgaggccggcggcaattacctggattacgcgcggcgccatcatcaggtgatcgcgcgcttcggccgctttccgcaccgcaatgccgccttgggccgcagcagcagcgccgcggagctggaatatctcgccgcgccgggcgcggggttctga

SEQ ID NO: 3154 - DNA, 954 bp, Chromobacterium substugae
atgcaagagctggagctggatgccgtcaggctggcggaaagcctggcgcgcgcgcgggtgctggtggtgggcgatgtgatgctggaccgttactggttcggcgatgtgtcgcgcatttctccagaggcgccggtgccggtggccaagataggccgcagcgaggagcgcgccggcggcgcggccaacgtggcgcgcaatatcgccggcctgggcgggaaggcgaccattttgtcggtggtcggcgacgacgaggcggccggtgtgctggagcggctgctgcgcgatgacggcatcgccacctcgttcaagcgcgacgccaagatcgccaccacggtcaagctgcgggtggtggccaggcagcagcaactgatccgcctggacttcgaagattcgcccagtcacgagatactggccgacaaactgcaggaattctcggctatcgtcgccgatcacgacgtggtgattctgtccgactacggcaagggcggcctgacccatgtggcgcggatgatcgagctggcgcgcgccgccggcaagccggtgctgatcgaccccaagggcgacgattacagcaagtacgccggcgccacgctgctgacgccgaatcgcagcgagttcagccaggtggcgggctcctggcgcgacgaggatgtattggtgcgcaaggcgcagaaactgcgcgaggaattgaatctggacgcgctgctggtgacgcgcagcgaagagggcatgacgctgttccgcgccgacggcgcgctgcatcagcctactttcgcccgcgaggtgtatgacgtgtccggcgccggcgacacggtgatcggcacgctgggcctggcgctggccgccgggcaaagcctgccggtggcgatgagcctggccaatgccgccgccggcgtggtggtcggcaagctgggcaccgcggtctgctcgcagcaggagctgttcgcgctttga

SEQ ID NO: 3155 - DNA, 1320 bp, Chromobacterium substugae
atgaaagtcactgtcattggttccggctatgtcggcctggtcaccggcacctgcttggcggaaaccggctaccaggtgtgctgcctggacgtggacccgcgcaagatcgaaattctgcaaaacggcggcatccccattttcgagcctggcctggaagagatggtgaaacgcaacgtggccgccggccgcctgcatttcaccaccgacgtggccgagtcggtcgctttcggcgaggtgcagttcatcgccgtcggcacgccgccggatgaggacggctccgccgacctgcaatacgtgctgggcgcggcgcgcaatatcgcccgccacatggcggattaccgggtggtggtggacaagtccacggtgccggtcggcaccgccgacaaggtgcgcgcggcgatagcggaagaactggccgcgcgcggcgcggcgctgccgttcagcgtggtgtcgaatccggaattcctgaaggaaggcgcggcgatcgacgacttcatgcggccggaccgggtggtgataggcgtggacgacgagcgcgccgccgagatcatgcgccggctgtacaagccgttccagcgcaaccacgagcgcgtgctgctgatggacgtgcgctcggccgaactgaccaagtacgccgccaacgcgatgttggccacccgcatttccttcatgaacgagttggccaatctggccgagaccatgggcgccgacatcgagcaggtgcggctgggcatgggctcggatccgcgcatcggctatcagttcctgtatcccggcgtcggctacggcggctcctgcttccccaaggacgtcaaggcgctggtgcagaccggcaaggagcacggccatacgttgcgcgtgctgaccgcggtggaagaggccaacgatatccagaagctgcggttggtggacaaggtggtgggccgcttcggcagcgatctggccggccgccgcttcgcgttgtggggcctggcgttcaagcccaataccgacgatatgcgcgaagcgccgagccgggtgattgtggacgaactgactcggcggggcgccgaagtggtggctttcgatccggtggccacccacgaagccagccgcgtgatgggcggcaatgcgcggctgcgcttcgccgacgatatgatggcggcgctggaaggcgccgacgccttgctgatcgtgacggagtggaaaatgttccgggcgccggatttcgacgcgatcaaggccagcctgaagcagccattgattttcgacggccgcaatatgtacgacccgtcatggctgcgcgagcagggcttcgattacctggccattggccgataa

SEQ ID NO: 3156 - DNA, 744 bp, Chromobacterium substugae
atgaaccctttgatcgcagctgcggatgcgcggatcgattcgccggtgttggtggcgctggatttcgacaacgccgccaaggcgctggatttcgccagccggcttgacccgtccgaatgccggctgaaagtgggcaaggagctgttcacctccagcggccgcaatctggtggaaaccctgagcgcgcgcggcttccaggtgttcctggacatgaagttccacgatattcccaacacggtcgcccacgcctgcaaggcggcggccgacgccggcgtgtggatggtcaatgtgcacgcctcgggcggccgccgcatgatggaagccgcgcgcgaagcgctggccggctacagccagcgcccgctgctgatcgcggtgacggtgctgaccagcatggatgcgtccgacctcgcggaaatcggcatcgccgtgtcgccggaagagcatgtgcgccgcctggcgacgctgacccgcgattgcggcctggacggcgtggtgtgctccgcgcaggaggcttcgatgctgaagcaggcgctgggccaggatttcaagctggtgacgccgggcatccgcctggccgaaagcggcaatgacgaccagcgccgcgtgatgacgccgctggcggcgctgcaagccggcgccgactacctggtgatcggccgctccatcaccggctccgccgatccgctggccacgctgcgccagatcaatcaagacattcagcaataccggaatcagaagccatga

SEQ ID NO: 3157 - DNA, 1158 bp, Chromobacterium substugae
ttggaactcgatttgtggtggctgctgctgtttccagcctttttcggcctgggctggtttgcggcccgggtggatatgcgcaccgtgctgaagcaggcgaaagcggtgccgatttcgtattttcgcggcctggacgcgctggttgacgacaagaccgacgtcgccgcgcaggctttgtccgaggtggcgcgccagcagggcgcggcgctggaattgcagcatgtgctgggcaagctctaccgcaagcgcggcgagaacgaccgcgccatccgcctgcaccagcagatgctggactcgtccgatctgcccggcgagcaccgcgatctggtgcgcaacgagctggcgcaggatttccgcaaggcgggcttggtcgatcgcgccgaggaaatcctgctgaagctgctggacggcaatatggcgctggcggcgcggcggcagctgctcgacatctaccagcaggaccgcgactggaaaaaggcgattgaaaccgcccgcgagctgcgcagcgacgcgcattccttccagcatgaagtggcgcagttctattgcgaactggcgcagggcgagctgtaccaatcccattacgagcaggcgcgccagtatgtggcggaggcgatcgccgccaaccgcaagtgcgtgcgcgccagcctgatcctcggcgacatcgaattcgccgaaggccatgtcgaagcggcgatggcggcctggcagggcatagagaagcagaactacgaatacctggcgatggcggccgagcgtctgttcgacgcctatgagaaactgggcaagccgtcggagggcatcgccctgctgcgcggctaccagcgcactttcccgcagttggaactgaccgacctgctgtaccagaaaatcgccacttacgagggcgaggcgcgcgcgctggaaggcgtgcgcgaggcggtgcacgcgcgtcccagcctgtccggcgtctaccggatgatagaggcgcagatggacgagctgtcgccggagggccggatggacgccgaggtggcgcgcgcgctgatactcaaacattcccagcgtttgagcgtgcatcgctgcaaatgctgcaatttccgctcgcgggccttcttctggcattgccccgcctgcggcgaatgggaaagcttcaccgccaaccgttcggaagcctga

SEQ ID NO: 3158 - DNA, 282 bp, Chromobacterium substugae
ttgcgtatcgtcgaactggccctgttgttgctgctggtcgcggtcaccgtgcagaacagccacgcggtcgaattcaaactgttcttcggccaatcttggtcggcgccgttcatcgtcttcctgttgctgttcttcgtcgccggcgcggtggtaggcctgctggccactttcagcttctacctgagaacccgccgcgagctttcgcaactgaagaaagagctgcgcaatcgcccgcctgccagcaaggttgtcagcgatcccagcgacgccatcgccgattga

SEQ ID NO: 3159 - DNA, 315 bp, Chromobacterium substugae
atgaccaaatctgagctgatcgcgcggctgtccgagagactcgccgagcgcaattctcagttggtctacaaagatgctgagttggccgtcaagaccattctggatgcgatggccaacaacctggctcagggaagccggatcgaaatccgcggcttcggtagcttcgatttgaactaccgtccgccgcgcgtcggccgcaatcctaagtcgggcaccagcgtctcggttcctgagaaatacgtgcctcatttcaaggctggcaaggaactgcgggagcgcgtggatctgtccctgttggagcagacccaggcctga

SEQ ID NO: 3160 - DNA, 1680 bp, Chromobacterium substugae
atggaaaacttcgctcaactgttcgaggaaagcctcaccctgcacgatatgcgcgtgggcgaagtgatcactgctgaagtcgtggcagttgattccaactttgtaaccgtgaacgcaggcctcaagtccgagtccctgattccggctgaagaattcaagaacgaccaaggcgtcgttgaagtcgccatcggcgacttcgtcaccgtcgccatcgacgcgctggaaaacggcttcggcgagaccaagctgtcccgcgaaaaagccaagcgcatggctgcctgggttgagctggaagaagctctggaagccggcaccatcctgtccggcctgatcagcggcaaggtcaagggcggcctgaccgtcatggtcaacggcatccgcgccttcctgccgggctctctggttgacgtgcgtccggtgaaagacaccaccccgtacgaaaacaagcagatcgagttcaaggttatcaagctggatcgcaagcgcaacaacgtcgtggtttcccgccgctccgtgctggaagaaaccctgggcgaagagcgcaaggctctgctggaaaccctgaaagagggcgcagtcatcaagggtatcgtcaagaacatcaccgactacggtgcgttcgtcgacctgggcggcatcgatggcctgctgcacatcaccgacctggcatggcgccgcgtgaagcacccgtccgaagttctggcggttggcgatgaagtggaagccaaggtactgaagttcgaccaagagaagaaccgcgtatccctgggcctgaagcaactgggcgaagatccgtgggtgggcctgtcccgccgctacccgtccggcacccgtctgttcggcaaggtgaccaacctgaccgactacggcgcgttcgttgaaatcgaacaaggcatcgaaggtctggtgcacgtgtccgaaatggactggaccaacaagaacgtacacccgtccaaggtagttcaagttggcgacgaagtggaagtcatgatcctggaaatcgacgaagaccgtcgtcgcatctccctgggcatgaagcagtgcctggcaaacccgtggaacgagttcgccgacaacttccacaagggcgacaagctgaagggcgcgatcaagtccatcaccgacttcggcgtgttcgttggtctgccgggcggcatcgatggcctggttcacctgtccgacctgtcctggaacgaagctggcgaagaagccgtgcgcaagttcaagaagggcgacgaggttgaagccgttgttctgtccatcgacgtggaaaaagaacgcatctccctgggcatcaagcaactggaaggcgatccgttcaacaacttcgttgcgatgaacgacaagggcgccctggtcaagggcaccgtgaagtccgttgacgccaagggcgccgtaatcgctctggataccgatgttgagggctacctgcgcgcttccgagctgtcccgcgaccgcgtggaagatgctcgctccgtcctgaaggatggcgaagaagtggaagccgtgatcgttgccgttgaccgcaagtcgcgcaacatcagcctgtcgatcaaggccaaggacgctcaggaagagaatgccgcgatgaagaacctgtccaccgttgacagcgcttccgccggcaccaccaacctgggtgccctgctgaaggcaaaactgtccggttccaacgagtaa

SEQ ID NO: 3161 - DNA, 669 bp, Chromobacterium substugae
atgacagttccggtgattaccatcgacgggccttccgcttccggcaagggcacggtggccgccctggtggcctcgcgccttgatttccactacctcgactccggctcgctgtatcggctgctggcgctgcacgcccgccgccatggcatcgcctgggacgacgaagcggcgctggccggcgccgcgatcgtcctgccggtggagttctccgacggcgcggtgtggctggaaggcaacgatgtcagcctggatatccgcgccgaggaaatcggcatcggcgcgtccaaggtgggggcgctgcctgaagtccgcgccgcgctattgcagcgccagcgcgattttcgcttggcgccgggcctggtgaccgacggccgcgacatgggatcggtggtgtttccggacgccatgttgaagatattcctgaccgccagcgccgaggagcgcgccgagcgccgctataagcagttgatcggcaagggggaatctgctaacctccccagaattatgcaggacattatcgatcgggacgcgcgcgatgccgcccggccggtagcgccgctgcgccaggagccggacgcctttttgctcgataccacggagctgaccatagaccaggcggtcgacaaggtcctcgggtggtttgaggaaagacaggtttccggccattga

SEQ ID NO: 3162 - DNA, 213 bp, Chromobacterium substugae
ttgttccatattgacggggcgcgctttattttcgggtgcgtatcgcgggttggacgaaagggtgagcggacactgtacccgccgccgccgcctgcgcgcaatcgccggccgcgcgagaacggcggcatccgctcccctgcaaggcgccggcttgcgctacaatgcgcggttttaccggcttctttcggcgcgccgacggagccggtggcttga

SEQ ID NO: 3163 - DNA, 1290 bp, Chromobacterium substugae
atggaacaactgcacctgctcccctgccctcgcctcgccggcgccgtcaagctgcccggctccaagagcatctccaaccgcaccctgctgctggccgcgctgtccggcggcagcacgctggtgcgcgacctgctggattcggacgacatccgccacatgctgggcgcgctgaagctgctgggcgtgaaaatagagcagcagggcgacagccgcgacttccgcgtgcacggcgccggcggcgctttcccggtgaaaaacgccgagctgttcctcggcaacgccggcaccgccttccggccgctgaccgccgcgctggcgctgatgggcggccactaccagctgtccggcgtgccgcgcatgcacgagcgcccgatcggcgacctcgtcgacgcgctcaacgccgccggcgcccgcatcgcctatctgggccagcccggcttcccgccgctggccatctccccggccgacgtgcgctgcgcccagcccatccaggtgaagggcaatgtctccagccagttcctcaccgccttgctgatggcgctgccgctgaccggcggccaggccgagatcgaagtggtgggagagctgatctccaagccttacattgaaatcacgctgaatctgatggcgcgcttcggcgtgcgcgtcgaacgcgacggctggcagcgcttcgtgattcccggcggccagcactacatctcgcccggcgaagtctatgtcgaaggcgacgcctccagcgcgtcctacttcctggcggccggcgcgctggccggcggcccggtgcgggtggaaggcgtcggcaacgccagcattcagggcgatgtgcgcttcgccgaggcgctggaattgatgggcgcgacggtgagccgcggcgacaactggatcgaggcccgcgccgagggcaagctcaaggcgatagacctcgactgcaaccacattccggacgcggcgatgacgctggcggtggcggcattggccgccgacggcaccaccacgctgcgcaacatcgccagctggcgggtgaaggaaaccgaccggctgtcggcgatggcgaccgaattgcgcaaggtcggcgccgtagtcgaggaaggcccggactatctccgcgtcaccccgccggccgagctgacgccgaacgccgaaatcgacacctacgacgaccaccggatggcgatgtgcttctcgctggtttcgctgctgggcgcgccggtggtgatcaacgaccccgactgcgtggccaagaccttccccggctacttccaggcgctggccgcgctgcaggcgcaataa

SEQ ID NO: 3164 - DNA, 447 bp, Chromobacterium substugae
atgagcgacctgttccggatgcgccgcgatttcatgcggcgcttcgacatcccctccccctcccatcccgaatatcagcccgaacagctggcgatgtggcagaccatgctggacgaagagctggacgagctcaaacaggcgctggcggattatcgcgagctgccggcgcaatcgcccgaacagcaactgcgcagccgcgccgaactcgccgccgaggccgtggacgtgctcaatgttgtgtgcggcctgctgctgtcgcagggcctgccgctggaggcgatgtgcgaggcgatacacgacgccaatctgcgcaaatgcgtggacggcaaggtggtgcgccgcgccgacggcaaggtgctgaagccggaaggctggcggccggcggacaagctggaagtgatccgccaggcgcaggaccgcaacaatacgtcgcaatctttgtcctga

SEQ ID NO: 3165 - DNA, 546 bp, Chromobacterium substugae
atgctgcgcaattcctcgcaaagctacggccgcgtcgcccgcgcgctgcactggctgtgcgctctggcggtgatcgccgcgctggtcttcatcgaactcaaaggcaacttccccaagggcgatccggtccgcggcggcctgagctacgcccacatccaggccggcctgatcgtcctgctgctggtcgtgcccagactggcctggcggctgggcaatccgccgcccggcatcactccccgccccagcccgctgatgaagctgctggcccatgccggccactgggcgctgtacgcgctgatgctggcgctgcccatcctgggcatcgccttcatccaggccaggggcggcgaagtggccctgttcggcctggcgctgccagccatgctggcgccggatccggccttcggccgccagctgaaggacgcgcatgagctgctgggcaacgtgctgctgtggctgagcatcctgcacgccgccgccgccgtctggcatcatcgcttcgtcaaagacgatacgctgacccgcctgatcggcccgctacgctga

SEQ ID NO: 3166 - DNA, 990 bp, Chromobacterium substugae
atgacgaccagtatcaaggatgtcgcgcggttggccggcgtgtcggtggccactgtgtcgcgggttttgggcaacgggccggtgagtccggcgttgcgcgccaaggtggaagaagccatcgccggcagcggctatcggcccaacctgtcggcgcggcgcctgcgctcgcaatccagcctgaccgtcggcctgatcgtgtccgatatctgcaaccctttcttcaccgcggtggggcgggcggtggaggacgccgcctatcgcgccggcatgcgggtgatcctgtgcaataccgacgaaaacccggagaaggaagcgatgtatctgcggctgatgcaggaggagagggtgagcggggtgatcctggccgccacccgcgcgaccgcggcgcggctggacatcgcggcgctgggtttcccggtggtgatggtggaccgcgccggccccggcggcggcgacgcggtgctgctggacaatgccgcggccgcggggcaactggtggcgcatctgctggagcagggttatcgccgcatcggcggattgttcggcaataccagcagcaccggggccgagcggcatgccggtttcgccgccgcgctggcgcgggccgggctggccgcggacgcgcgcttcgccgcgcccagcgcggcggcggccgagcaggcggtggcggcctggctgcgggaggacgatccgccgcaggcgctgatcgccagcaacggcttgttgctattgggcgcggtcaaggcggcgcgggcgctcggcgtcgcggtgccgcggcagctggcgctggcgggtttcgacaacgacagctggaccgaattggcggaaccggggatgacggtgatcgagcagccggtggacgccatcggccgcgaggcgatggcgatgctgctggaacgcttgcggcagccggagcggccgccgcgcaaggtggtgctgtccggccggctggtggccagaggctccagccggcgcgcggaatcagcgtag

SEQ ID NO: 3167 - DNA, 123 bp, Chromobacterium substugae
ttgattttcgccatgctgcgcctagttagcgtgacgcgcaagcgcttgaaaatccagcaacagcatgctgcattgcaatatccatactttattggcacgaatgaattgacagaaaaaatgtaa

SEQ ID NO: 3168 - DNA, 2502 bp, Chromobacterium substugae
gtgtccgatgccctgctcaatccccaactgatacgcctgggctgccggcccgccgacaaggacgccgccatccgcgaagccggcgcgctgctggaggcagccggctgcatcgccccggactatatagacagcctgctgcggcgcgaggcggtggccaacacctacctgggcaacggcatcgccattccgcacggcatggccgaagaccgcgcccaggtgctgcgcaccggcgtcgccatcctgcagattccggacgggctggaatggaaccccggccagcgcatccacctgctgtgcgcgatcgccgcccgctccgacgaccacctggtgatgctgcgccagctgacccggctgctgcaggacgaagcccggctgctgccgctgttcaccaccaccgacagcgccgacctgctggcagcgctggcccagccggaagcgccgctgccgcccgacgccgaagcgcacgacctggatctgtgcgaggaatggcggctggactaccccaacggcctgcacgcccgccccgccgcgctgtgggtggaggcggcgcgccgcagcccggcgcaattgcaggtgcgccacggcagccaggccgccgacgccaaaaacctgatcgcgctgctgcagctcggcctgcgccagggcgcgctgctgacggtttccgcgcgcgggccgcaagccgccgacgggctcaaacaactgctgcgggcgatgcgcgaagccagcctggccgagcagaccgccgccgccatcgccgcccagcgcgccgcggcgcaacggccgcgcgccggctggcagccgtcgggccagccggtttcgctgcccggcatcgccgccagccccggcctcgccatcggcaccgtgcgcgtgctggccggcgaacagctgcgcatcgtcgaccgcccggtcagcctggccgaaggcggcgaccgcctgcacgaagcgctggccgccacccgccgccggctggcggcgctggccgacgccactcaggccacgctgggcgccgccgaagccggcattttccgcgcccaagccgaactattgaacgacaccgacctgatcaccctcagctgccaactgatggtggccggccatggcgtggagtggtcttggcaccaggcggtggagcggctggcggaaaagatctcggcattgggcaacccactgctggccgcccgcgccgccgacctgcgcgacgtcggccggcgggtgctgctagagctggacccatcgctgcaaggcaacgcgccgggagagttcggccccgacaccatcctgctggccgccgacctggcgccgtcggacaccgccagtctggatctctcccgcgtcaagggcctggccaccgcccacggcggccccaccgcccacaccgccatcctggcgcgcacgctgggcctgccggcgctggtggccgccggtccggcgctgctcgacgtggccgacggcagcccggcgatcctggacggcgacgccggccggctctacctgaacccgagcgagcacaatctcgcctccgcccgcgactggcaacaacgccagcgcgaggcgcagcaacaacagcagcaggcctgcctgcagcccggccagaccgccgacggccgccgcgtggaaatcgccgccaacctcaaccggccggaacaggtcgccggcgcgctgaacaacggcgcggaaggcgtcggcctgatgcgcaccgaattcctgtttctggagcgcgacgccgcgccggacgaagaagagcaataccagacctacctggccatgcagcaggcgctgcagggccggccgctgatcgtgcgcgcgctggacatcggcggcgacaaacaggtgccctacctgaacctgccggtcgaggacaaccccttcctcggcgtgcgcggcgcgcggctgctgctgcgccggcgcgagctgctggagccgcagctgcgcgcgctgtaccgcgccgccaaggccggcaagcccttgtccatcatgtttccgatgatcagctcgctgaaggagatcacccggctcaagggctggtgcgagggcgtgcgcaaggaattggacgcgccgccggtgccgataggcatcatggtggaagtgccggccgccgcgctgctggccgaccagctggcgccctatgtcgacttcttctccatcggcaccaacgacctcacccaatacgcgctggcgatggaccgccagcacccggagctggccgccgaagccgacagcctccaccccgccgtgctgcggctgatccgccagacggtgcgaggcgcggccgcgcaccagcgctgggtgggcgtgtgcggcggcagcgccggcgacccgctgggcgccgcggtactggccggcctgggcgtggacgagttgtcgatgagccccagcgacatcccggcggtcaaagccatgctgcgccgccacgactacgcgcggctgcaagcgctggcggaacaggcgctgtcctgcgacagcgccgaggaagtgcgccagctgctggaggcactggcatga

SEQ ID NO: 3169 - DNA, 957 bp, Chromobacterium substugae
atgagccccgccctgcacaccatcacgctgaacccggcgctggaccagaccgtcaccctggatgaactgctgcccggcggcgtcaacctggcgcgcgccgcccaattgaacgccggcggcaagggcatcaacgtggccagctgcctggccgactggggcctgccggccaccgtccacggcctgctgggccgcgacaacagcggggcgttcgagcaactgttcgccgccaagcgcatccacgaccgcatgctgcgcctgcccggcgacagccgggtcaacatcaagctggccgacctcaaatccggccgcaccaccgacatcaacctgcccggcctggccgccgccgaggccgacctgcaggcgctggccgcccggctggcagagctgcgcgccggcgacagcgcggcgctggccggcagcctgccgcccagcttgccgccggacgccctggcccggctgtgccgccagttgaaacggcaaggcgtgtgggtgcttctggacagcagcgggccggcattggcctcggcgctggccaatccgcccgaggcgctgcccgactgcatcaagccgaaccgggaagaactggcgcaatgggccggccgcgagctggccgcgctgccggatgtggcgcgctgcgcgcaaggcctgcagcggcggggcatcgcccaggtggtggtgtcgctcggcgaacagggcgccatgctggtcgacgccgactgcgcgcggctggccagcctgccgccgcagcggccgctgagcacggtgggcgccggcgacgcgctggtggcgggactgatggccgcccgccagcaagggctggccggcggcgacgcgctcaggctggcagtggctttcgccgccgccaagctgcaaagcgtcggcccgcacctacccgccgccgaacagatacgccaactggcggacgcggtccgcctgcaagacctggccgcggcctga

SEQ ID NO: 3170 - DNA, 1668 bp, Chromobacterium substugae
atgagcatcgtcgccatcatccgctccggcgagcgcagcacccaggcgcgcctggccgccgaagcgctgcgcctggccgcccagcggcggcagctgccgatagacatcgagatagacggccagccggcgttgagcgccggccagatcgccgccgccggccatgtgctgctgataggcgaagaggacgacgcccgcctgggccggcgcgccgcgcgccgcgccacgctggacgcggtgctggccgacccggccggccagcttcaggtgcaggaagccggccgcgccctgcgcatcgtcgccgtcaccagctgtcccaccggcatcgcccacaccttcatggcggccgaggggctggtccagggcgccaaggcgctgggccacgcgattcgggtggaaacccagggctcggtcggcgcgcaagacgcgctgagcgatgccgagatcgccgccgccgacctggtcatcatcgccgccgacacccaggtggcggtggagcgcttcgccggcaagcggctgttcaagagcggcaccaaggccgccatcggcgacggcaaggcgctgatccgccacgccatcgaagaggcgcagccatgggcaggcgccagcccggccgccgccgaagccgccaatcaggaaaaagccaaggacgggccctaccgtcacctgatgaccggcgtgtccttcatgctgcccttcgtcaccgccggcggcattttgatcgcgctcgccttcgcgctgggcggcatctacgccttcgacgacgcgcacaagggcacgctggcctggtcgctgttccagatcggcgcgaaatccgccttcgcgctgatggtgccgatcctggccggctacatcgcctactccatcgccgaccgtcccggcatcgcccccggcatggtgggcggcatgctggccgccagcctgggctcgggctttctcggcggcatcgccgccggcttcatcgccggctacggcacccgcgaattgaaccgccggatcaagctgggccagcatctggacggcctgaagccggtgttgatcctgccggtgctgggttccctgctgaccggcctcttgatgatctacgtggtgggccagccggtggccgccgtgctggcggcgctgaccgaggcgctcaagggcatgcaaggcagcagcgcgctggccctgggcgcgctgctgggcgcgatgatggctttcgacatgggcggcccggtcaacaaggcggcctacgccttcgccaccggcctgatcgccagccaggtatacacgccgatggcggcagtgatggcggccggcatgacgccgccgctgggcctggcgctggccacccgcttgttccgcaaccgcttcagcgccgacgagcgcgaagccggcaaggccgccggcgtgctgggcctggccttcatcagcgagggcgcgataccgtttgccgcgcgcgacccgctgcgggtgatcccggcgctgatggccggctcggcgctggccggcgccatctcgatgaccatgggcgtgcagctgaaagtgccgcacggcggcgtgttcgtgctgcccattcccaacgcggtggaacatctgggcggctatctgatcgccctggcagccggcaccgccgtcaccgccttgctgttgggcctgctgaagaagccgctgccgcaaaccgccggctga

SEQ ID NO: 3171 - DNA, 1878 bp, Chromobacterium substugae
atgtccattacccgccgcgacttcctcaacggtttcgcgctgacggtggctgccgggctcacaccgctggaaatcctccgtgccgcgccccgtcagatcagcgccagctactacccgccttcgctcaccggcctgcgcggcaatcacgacggctccttcgaaaacgcccacaagctgggccgcgcccaccacgcctattcgctctccggcgccaaggtggaggagcattacgacctggtggtggtcggcggcggcatcagcggcctttccgccgcccactactaccgcaagaagcacccgcaggccaaggtgctgatcctggacaaccacgacgacttcggcggccacgccaagcgcaacgagttcaaggtcggcgatcgcctggtgctgggctacggcggcaccgaatcgctgcagtcgcccaagcacgtgttcagcaaggaagcgctggcgctgatgaaagagctgaccgtcgacatcgatggcctggccagccacttccaccgcaatttctaccccgacctcaagctgtcgcgcggcgtgttcttcaataaggaagacttcggcgccgacaaggtggtgggcggcgacccctatctgcaggtggcggacgacatcgaccccaagcgcctgaacgcgcggccgatccgcgacttcatcaatgattttccgatgccgaagaaggaccgcgacgcgttgatcgccctgcacaccagccagcgcgactacctgggcgacatgcccaaggccaagcgcgaggcttatctcgccaagatcagctacagcacctacctgtcccgccacgtcggcctgagcgccaccgcgatccgcttcttccagtcgcgcagcaacgacttccaggcggtgggcatcgacggcctgccggcgctggacgcgcgcaatctggacctgccgggcttccacggcgtggcgggcctgggcaagatcagcgccgaggcggaagccgaactgcgcgacccctacatctaccacttcccggacggcaacgcctccatcgcccgcctgctggtgcgcaagatgattccgcaagcggcgccgggcaaggacatgaacgacatcgtgctggcccgcttcgactacagcaagctcgacctgccggaaaacccggtgcggctgcggctgaacagcaccgtggtgcgggtggaaaacggcaagagcgcggtggatatcggctacctggacaagggcggccagctgcgccgcgtgcaggcgcgccacaccgtgatggcctgttacaacatgatgatcccgcacatcatgcccagcctgcccgacgaccagaaacaggcgctggcgatgaacgtcaaggcgccgctggtctacaccaaggtagtgctgaagaactgggacagcttcatgaagctgggcgtgcacgagctgtactgcccttccatgccgtacagccgcatcaagctagactacccggtggacatcggcggctaccagcatccgcgcaagccgtccgagccgatgtgcctgcacatggtctacgtgcccaccatcgccggctccggcctggacccgcgcacccagtggcggatgggccgcgccaagctgctggccatgccgttctcggaaatggaaaccatggtgcgcgagcaactgcagcgcatcctcggccccaccggcttcgaccaccagcgcgacatcgccgccatcaccgtcaaccgctggtcgcacggctattcctacttcctcaactcgatgtacgacgacgaagacgagtccaagcgcatcatcgccgccgcccgccgcccggccggcaatgtgacgatcgccaactccgactccgactggaacccgtacacccacgccgccatcgaccaggcatggcgcgccgtcaacgagctgagctaa

SEQ ID NO: 3172 - DNA, 1227 bp, Chromobacterium substugae
atgaaattgatgaaaaccctgggcctggcggccctcttggccgccgccgcgcaagcggcgcaggccaatgtcgacaccgacagcgtgcggcgcggcgcctacctcgcccgcgtgtccgactgcatcgcctgccacagcgcgccggacggcaagcccaacgccggcggcctggcgatggacaccccggtcggcaagatctactccaccaacatcacgccggacaaggaaaccggcatcggcgactacagctacgaggacttcgcccgcgcgctgcgccagggcgtggccaaggaaggccactcgctgtacccggcgatgccctacacctcgttcgcgcgcatcaacgacgccgacatgcgcgacctctacgcctatttcatgcacggcgtggcgccggtggcgcaggaaaaccgcgacagcgacattccctggcccttgtcgatgcgctggccgctgacgctgtggcgctggttcttccacgacgacagcgcctaccaggcggatgccggcaagagcgccgaatggaaccgcggcgcctacctggtgcagggcatggcccactgcggcacctgccacaccccgcgcggcgcggccttccaggaagtggcgctgaacgacaagaaggcaggctacctgaccggctcgcagctggcgggctggtacgcaggcaacctgaccggcgacgcgcgcgaaggcctgggcggctggtcggcggacgaactggtggaatacctgcagaagggccgcaaccgctacaccgccgccttcggcccgatggccgaagtggtgcattacagcacccagcacgtcagcgcgggcgacctggcggcgatggcgatctacctgaagagcctgccgggcgccggcgccgccgacgtgcggccggtgcgcaccggctccgcgctgttcttcgagaactgcgccacctgccaccaggccaacggccagggccacgacaacgtggtgccggcgctggccggcagctcggcggtgatggcgcgcgacgccacctcgctgatccgggtggtgctggaaggcggcgtcaacgtccgcaccggccatctgccgtgggaatacagcatgccgggctacgcgcggcagatgtccgaccaggaaatcgccgacgtgctcagctatatgcgccagagctggggcaacaccgccagcccggtcgaagccgatcaggtggccaaagtgcgcgcgctgtcggcccagtccgcccactag

SEQ ID NO: 3173 - DNA, 498 bp, Chromobacterium substugae
atgcatatcattctggaaacgattccgcccgacgagctggccgatatcgaaaaagcggcgacgccgcgccgcctgtcgggccgggtggcggagcaggccttgccgccgcccgaagtggcggcgcgcgcgcgggagcgcctgcgggccggccagcgtccgtattggtgcctgcccttttacatgctggatggcgagggccgggtggtgggcgcttgcggcttcaagggcgagccgcgcgccggccgggtggagataggctacgcggtggcgccggcctgccgccgccagggcgcggcggctgcggcggtgcgccttttgctgcagcgggcgcgcgacagcggcgaggtggccgaggtgctggcgcaggtcaatccggaaaaccagccgtcgctggcggtggtgggcaagctggggtttcagcgcggcggcgtgctggtggacgaggatgacgagcccttgctgcagtgtgtctggccagtccgcttcggcgcgatttga

SEQ ID NO: 3174 - DNA, 420 bp, Chromobacterium substugae
atgttgatccgaggcgcctgccattgcggcaatatctcgttcgaactcgactggctgccggagccggcggccattccggcccggcgctgcggctgcgatttctgccgcaagcacggcggagtgtggaccgcatgcccgggcgacagcctgaaggtgcgcgtcagccggccggagcgggtgtcgaaataccgtttcggcaccgccaccgccgatttccacgtctgcgcggtctgcggcgcggtgccgctggtcagcagccggatagcaggcagagtatacgcggtggtcagcgtcaacgcgctggacgatgcgccggtgccggtgctggaacccgcgccggtgtcgttcgacggcgaaagcgaggcggagcggctggcgagacgcgctagcagctggatcgccgatgtcagtttcctgtag

SEQ ID NO: 3175 - DNA, 462 bp, Chromobacterium substugae
atggcaagctggatcgtcggagcgatggaaacctattgcggcgcgatggagcgcggccagcggcgctggctggaagtgcaggaggacgcctgtcgcacctggctgtcgtcctggtcgcccggttttccgctgtccgagggtgagatggagaaaagaatcgacggcggcctgctggtgggggcgtcgctgtggcaggcgcaggccgacacccagcgcgaactgatgctggcggcggaaaagctgctggcggacgtgagccgctgtctgcggcagcagttgcccgattacgacgccgcgccggtggcggcgatgcggcaggcgctggaagtgggctgggcgtccggcgcggcgatgtccaaggcgtcgcgccaggtcggctacttcgccaccaccaatctgtccgccacgccgctgaaggcggcgcgcgacatgcgccgggtgctgcaacagcgcaaaacctga

SEQ ID NO: 3176 - DNA, 900 bp, Chromobacterium substugae
atggaaatctaccagttgcggacctttgtcaccgtggcgcagcaaggccacctgacgcaggcggccgagctgctgcacctgtcgcaaccggcggtgaccgcgcagatcaaggcgctggaagaagaagtgggcatgcagttgttcgagcgcaacgccggcggcgtcagcctcacccgcgccgggcaggagctgctgccggaggcgcagggcgtgttgggcgcggcgcgcgatatcatcaaccacgcgcgcaagctcaagggccagctggctggccaggccagaatcggcgtcaccctgatgccggacatcctcaagctggggccgtgggtggcggcgctggtggaagccaacccgctgctggaagtgcaactgagccacggcgtatcggtcgacgtgctcaatctggtgcgcaagaaggagctggacgccggtttctacctgggacgcaatccctatatgaacgtcagcaccgtgccgctgcaaaccctgtcgttccgcgtggcgctgccggcggcctgggccgggcagctggacggcggcaagctcagggagctgggcaagctgccctgggtcggcatttcgcaattttccagcctgtccaagatcaccgcggaattgtggcgggagctgaatatttcgcctaaaaaagtggcggagagcgatcatttgtcggtgatcctggagctggtggcctcgggcgtcggcgtggcgctggtgcgcgaggaggaggcgctggcctggcaggcggccggccgcgtctggctggtgccggaattgcgcaagaacgccgagttgcagtttgtctatccggcggaccgggcgggcgacccggtgctggaaaccctgttgcgggagctgctggcggtgtggcggctgccgcgtccgcagtgtgttgtctga

SEQ ID NO: 3177 - DNA, 786 bp, Chromobacterium substugae
atggccaggtatctgacacttgaacggctgggcaaatcagccatcatcacgctttccaacctgcctgccaatctgctgacgacggaaagcctgaacgagttgacgtccacgctgcaggcgttgaatgccgatgattctgtgcgttcggtggtgattaccggcgccggcgacgctttcttttccgccggagcagatttgaagcagttcgccgcgggcgacaaggccgcggcggatatcttgttgcaagccttcgccgacgcgttgcaggcgatacgcagctaccgcggcgtcaccgtggcggcagtgaacggctatgcgctgggcggcggcctggaatgcgcgctggtgtgcgactacatcatcgccgagcgcggctccaagctgggtttgccggaagccaaggtcggcctgattccggccgccggcggcaccaagacgctggccgacaaggtgggcgtgtcctgggccaagcgcatcatcctgggcggcgaggtggtcagcgcggaaaaggcgctgagcatagggctgatcgaggaagtggtggaccagggcttcgccaagatcgtggcggtgagcctggccaacaaggtggcgacgcagggcgcggccgcggtggcggtggcgcgcaagctgatcgaagacagccccaacctgacgctggaacagcatctggcgcgcgaacgcgccgccacgctgggcctggtgggcggcgccgagcaagtggaaggcgtggccgccttcatggcgaaacgcccgcccagctgggcgcaggaggacgacgactga

SEQ ID NO: 3178 - DNA, 678 bp, Chromobacterium substugae
atgattgaaacgaatttctggattttgttcttggccggtttgctcggcggcgggcactgcgtggggatgtgcggcggcatcgtcgccgcgctcaccctgaaccaccccgccggccggcggcgctggcgcgttctcgccggctacaacctgggccggatcagcagctacgcgctgatcggcgcgctgctgggcggcctggccgccgccggcctcagcctggcggcctcgcacccgttccagcttgccctgtacgcgctggccaacctgctgctggtggcgatggggctgtacctggccggctggtctgcggcgataggctcgctggagaaactgggccagccgatatggcggcggctgcagccgctggtgggccgcatgctgccgatacgcggcgcgctgggcgccgccgcggtgggcgcggtgtggggctggctgccctgcggcctagtgtacagcgcgtcgatttcggcgctggccagcggttcggcctggcgcggcgccggcctgatgctggccttcggcctgggcaccctgcccaatctattgctgatgggggtgttcgccgacggcctgcgccgctggatgcaacaacgcccagtgcggctgattgccggactgggcgtggcgggactgggcgcgtaccggctggccgcgctgcttatcggaacgatttcatga

SEQ ID NO: 3179 - DNA, 897 bp, Chromobacterium substugae
atgaagaagctgtttggcgccctgctgttgctgggcatgccggcgttcgcgctggccaaggtgccggtggtggcgagtttcagcatcatcgccgacatgacccgcgaaatcggtggcgaccgggtggaggtggtgtcgctggtgggcccggatcaggacgcgcacgtgttccagccgtcgccggccgatatcaagaaggtgtccgctgccaaggtgctggtcgtcaacggcctgggcctggagggctggatgtcgcggctggacaaggcggccaatttccgcggcgtgaccgtggtggcgtccaagggtatccagacccgccaggcgcctgaggaagagcatgccgaaggcgagcacgaccacgatcacggcgatgtcgatccgcatgcctggcatgacccgtcgcgggtgcaaacctatatcaagaacatcagcgccggcctgatccaggccgacccggccggcaaggccgagtaccagcgccgcgccgccgattacgccgccaaggtgcaggcgctggacgactgggcgaagaagcagttcgccacggtgccggcggccaagcgcaagatgctgacctcgcacgacgccttcggctatatgggggagcactaccagctgaaggtgctggcgatccagggcgtcagcaccgagtccgaggcttcggccaagggcgtggcgcagctgacgcgccaggtgcgcaaggaaaaggtcaccgcggtgttcatggaaaacatgagcgacaagcgcctgctgcagcaattgtcgaatgaagccaaggtgaagataggcgggcagttgtacgccgacgcgctgtccagccccaagggcccggccgccagctacttgcagctggtgcgctacaacgtcgacaccatcatgaaatcgttccgataa

SEQ ID NO: 3180 - DNA, 876 bp, Chromobacterium substugae
atgcaacatctgtacgatctactggtttcgccgtttgtcgaattcgccttcatgcgccgcgcgctggccggttgcctggccttggcgctgggctccggccccatcgggctgttcttggtgatgcgccggatgagcctgatgggcgacgcgatgagccacgcggtgctgcccggcgcggcggtcggcttcatgttcgccggcctcagtctgccggcgatgagcctgggcggcttcgtcgccggcgtgctggtggcgctgctggccgggctggccacccgcttcaccagcatcaaggaagacgccagcttcgccgccttctacctgctgtcgctgtccctgggcgtgctgctggtgtcccggggcggcagtaatgtcgacctgatgcacatcctgttcggctcggtgctggcggtggacaacgccgcgctgtatctggtgtcgggcgtggcttcggtgacgctgctgaccttggctgtcatctaccggccgctgctgctggaaagcctggacccggtctacctgcgcgcggtgggcgcgcgcggcgcctggtggcatctgttgttcctgatgctggtggtgctcaacctggtggccggcttccagtcgctgggcacgctgatggcggtggggctgatgatgctgccggcgatcacctcgcggctgtggaccgagcgcatcgaggccatgctggcgctgtcggtcggcatcgccttcctcagcggcctgggcggcctgctgttgtcctaccacttcgaattgccgtccggacccgccatcatcctgctggccggcgtggtctatctgctgtctttgctgtttgccccggtgggcggcgccttgccgcgctatatccgcgcccgccatctggaatcctga

SEQ ID NO: 3181 - DNA, 744 bp, Chromobacterium substugae
atgagcatcatcctcaacaatctgacggtgtcctaccagcgccatccggcggtgcaccatatcggcggccgcttcgccgacggcgacgccaccgccatcttcgggcccaacggcgccggcaagagcacgctgctgaaggccatggtgggcgcgctggcgccggattccggcagcgtggacctgaatggccaccgccgcagcgacatcgcctacttgccgcagcaggccgagatagaccgcagcatgccggtgagcgtgctggagctggtcggcaccgggctgtggcacaagagcggcccgttcggccgggtggggcgcgccggcatggagcgttcgctgcaggcgctggagcaggtggggctggccgatttcgcgttgcggccgatcgccgcgctgtccagcggccagttccagcgcgtgctgttcgcccgcatcctggtgcaggacgccaggctgatcctgctggacgagcccttcaacgcggtggacgccaaaaccaccgaagatttgctgcggctggtggcgcagtggcgcggcgagaagcgcaccgtgatcgcggtgctgcacgacgcgatgcaggtgcggacgcatttcccgcacacgctgctgatggcgcgcgaggtgatcgcctggggcgacagcgccgcggtcctgactgacgacaatctgcggcgcgcggtggaaaccgccgcccactggcaggcccaggcgccggtttgcggcctggatggagtaagcgcctga

SEQ ID NO: 3182 - DNA, 183 bp, Chromobacterium substugae
atgagcggatcgcactcgcatggccatgaccatgggcacgaacatcaacacctgaccccggccacgttgcggccgccgctcagcctgctggcgatgtcggccggccagcgcgtcgcgctgaccctgctgccgctggccggcttgtggctgctggtgtggtgggccttgcaggagctggcatga

SEQ ID NO: 3183 - DNA, 918 bp, Chromobacterium substugae
atgaacaagaccaaagtcaacctgtttaccggctttctgggcgtgggcaagaccaccgcgctgcgccacctgatcgccaaccgcccgcagcatgagaagtgggcggtgatcgtcaacgagttcggcgaagtgggcatagacggcgccgccttgctcaacgacgagctggcggtggccgagatcgccggcggctgcctgtgctgtgtggccggcccgcagatgaccgccaccgtggcgaccttgctgcgccgcgaaaagcccgaccgcctgctgatcgaggccagcggcctggcccatgccgccggcgtcatcgacgaattgcgcgccaagccgctgggcgaggcgctggaagtggcggcggtgctgacgctggtggacccgcgccagttcattcagccggactatcaccgccagccgctgtaccgcgaccagatctccatcgccgacgtgctggtggccaacaagatagacgccgccgacatcccgaccatggaggccttccgcgcgcaggcggcggcgttgtttccgcccaagtccctggtcggcgaagtgcgcgacggccaactggacgtggcctggctggacgccgagcgcgccgccaagccgcgctaccgtccggcggcgctgccggacaatagcagcgcgtggcaatcggccggctggactttcgatccggagctgaatttcgacggcgagcgcctgacacgcttcttcgacgacctgccggccaaggtgccgggcctcacgcgagccaagggggtgttccgcgtgctggacagctgggtgtggctgaactgggccgccggacagtggggcgccgcccaggtgtcctggcgccgcgacagccgcttcgagctgatcgcgccggcgttcgaggccgacaaggtggaagcctggctgaaggagtgcctggaatga

SEQ ID NO: 3184 - DNA, 435 bp, Chromobacterium substugae
atggattcctccgcctatctcgccgccgccgagcgccattgcgccagccgcggcagcaaactgaccgaattgcgccgccaggtgctggagctggtgctgagccgccgcggcgtggtcaaggcctaccaggtgctggccgacctgcagcaacagcgcggctcggccgcgccgcccaccgtctaccgcgcgctggacttcctggtggagcacggcctcttgcacaaggtggatgccttgaacggcttcatcgtctgcgaccacttcgactgccagcacgaaagcctgatcctggtgtgcgaacaatgcggccgcgtcaacgaggtggacgccgccggcgggctggccagcctgcgcgacatggcgctggccgccggtttcacgctcagcccgcaaaacctggtgctggccggccgttgccagtcctgtgccatctga

SEQ ID NO: 3185 - DNA, 429 bp, Chromobacterium substugae
atgaaaaagatgttgctggcttcgctggcgctgctgctggccggccaggcgctcgccgcggatccgatcagccagcgcaaggacgcgctcaagcaatacaagccggtgatcggcgagatgggcaagatgctgaaaggcgacacgccctacaacaaggacgagttcgccaagctggccgtcaagctggagcagctgtcgcagcagccctggcaatacttcccggccggcagcggcgccggccgcaccgacgcgcgcccggaaatctggagcaagcccgccgactggcaaaaggcgatcgagcggcacaaggccgccaccgccaatctgaagcagacggcgcaaggcggcgacctcgccgcggtccgcaaggccttcgccgacacccagcaaacctgtaaagcctgccacaaggacttccgcaaggattga

SEQ ID NO: 3186 - DNA, 441 bp, Chromobacterium substugae
atgaacaaaacactgaccgcgctgctgctggcagccatcgccattcccgccgcccatgccgacacgccggccgaaatccgctcgcaggcgttcaagaagatgctgctgcagtcgttcgagccgatgggcatggcggtgcgcgggcgcgcgccttacgaccaggccaagttcgcgcagcaagcggaggcgatgaaaacgctggccgccgagccgttcaagcacttcccggcgaacagcatcaccggcaagagccgcgccaagccggaagtctggagccaggccgccaaattccaggccgaccgcgacgccttcctgaaatcggtcgatgcgctggccggcgccgccaagggcggcgacctcggttcgatcaagaaggcctacggccaagtggcgcaaaactgcaagacctgtcacgacgccttccgcggcccggaaaaataa

SEQ ID NO: 3187 - DNA, 657 bp, Chromobacterium substugae
atgtcgcagcaggtcaaggtgtgggatgcgccgacgcgtttgtttcactggacgctggttttgttgttcgcggcgatgtggttttgcgccgagcagggcggcgactggctgcaataccatatctattgcggcgtggctttggcgtcgctgctggtgttccgcttgatctggggcgtcatcggcagccagaccgcgcgtttctccagcttcgtgcgcggtccgcgcgccatcttgcgctatctgcggggcgaattgccggagcgcgaggcgcccggccacaacccgctgggcggctggatggtggtggcgatgctgctggcgctggccgcgcaggtgctgaccggcctgttcgccgccgacgtggacagttatctgtacgatggcccgctggccaagcacgtggacagcggcgtggcggaggccgccaccggcgtgcacaagctgctgttcaacggcctgctgggcctggcggcgctgcatatcgccgccatcgtcgtttaccgggtggtgaagaagcagaacctggtgaagccgatgctgaccggctacaagcaaatggccggggagaagcccaggctgcgtttcgcccacggcgcgctggcgctggcggccttgctgctgtcggccggcgggctgtatttcgcgctgctgcgctga

SEQ ID NO: 3188 - DNA, 1275 bp, Chromobacterium substugae
atgacgcaaaccgcccttcttcaggatctggaggcccgtggcctcatcgcgcaaaccaccgatatggccgcgctgcaggcactgctgaacaaggaaacggttacgctttattgcggcttcgacccgaccgccgacagtctgcacatcggcagcctggtgcccatcctgatgctgaagcgcttccagcaggccggccaccgcccggtggcgctggtcggcggcgccaccggcatgataggcgaccccagcttcaaggccaccgagcgcaagctgaacaccccggacatcatcgagagctgggtggagaagatccgcgcccaggtggcgcccttcctcagcttcgaaggcgacaacgccgcgctgatggccaacaactacgactggtttggcggcatgggcgcgctggagttcctgcgcgacatcggcaagcacttctcggtcaacgccatgatcaagaaagaagcggtgcagcagcgcatcgcccgcgaagaccagggcatttcctacaccgagttctcctacagcctgctgcaaggctacgacttctccgagctgaaccgccgcctggactgcaagctgcagatcggcggctccgaccagtggggcaacatcaccgccggcaccgatctcacccgccgcctgaaccaggcccaggtgttcggcctgaccatgccgctggtgaccaagtccgacggcaccaagttcggcaagaccgaatccggcaccatctggctggacgcgaagaagacctcgccctacgccttctaccagttctggctgtccaccgccgacgccgacgtgtacaagttcctgcgctacttcagcttcctgtcggtggacgagatcgccgccatcgaagaggccgacaagaaccgcgacggcaaaccggaaggccagcgcatcctggccgaacaggtcaccgcgctggtgcacggccaggccgcgctggaagcggcgcagcggatcacccacagcctgttcagcaacaacctgtccagcctgaccgccgacgacttcgcccagctggcgcaggacggcctgccctgcgtcaagctggacgccggccacagcggcctggtggacgcgctggccgccgccggactcgccaagtccaaaaccgaggcccgcaccttcatccagagcggcgcggtcagcgtcaacggcgccaaggcggacagcatcgagcttgaaatcggccaggaccagcgcctgttcggccgctacacgctgctcaagcgcggcaagaagctgtacgcgctggccgactggcaataa

SEQ ID NO: 3189 - DNA, 558 bp, Chromobacterium substugae
atgctggcggacgtggaactggccaaggcctatcgtttgctgaaccatggccccaccgtgctggtgagcagcgcggcgggaggcaggcggaacgtgatggcggcggcctgggcgatgccgctggatttcgatccgcccaaggtgctggtggtggtggacaagtccacctacagccgtgagctgatcgaggccagcggcgaattcgtgctgaatatcccgtgccgagcccaggcggcgcaggtggtgcgagtaggcagcgagagcggccatgagctggacaaattcgccgccagcgggctggagccgttgccggcgcgcaaggtcggcgcgccgttggtggcgggctgcataggctacctggagtgcaaggtggtgccggagccgcgcaaccagtcgcaatatgatctgttcatcggcgaagtcgtcgccgcccaggccgatgatgcgctgttcagcgccggccattggcatttcgacgacgatccggccaggcgcagcgtgcattacatcgctggcggcgccttcttcgccaccggggaggccttcagcgtcgcctga

SEQ ID NO: 3190 - DNA, 363 bp, Chromobacterium substugae
atgaccatcgtgaagagtttacgcgaatatgtattccatgctaaatttttatgccattttaatcatggaatcggcgtgaacgcagcgaaaaagatacggctgctgctggcgcagcgcgtggaccaagaacaaaccgaagtcttgctgcagctggccgtggacttgcaactgggcgcgcctttcgatttgcgccgcctgtgccagatcgatccgcagtatttcgagctggggctcgccttgctgaaggactggcgcgccggccatcacatcgccgcgcgcagccggctgttcgaggacatcctggcgcgggacgcgcgcctgcagcgccggttatgccatttggaggcgccggcgctgcattga

SEQ ID NO: 3191 - DNA, 1221 bp, Chromobacterium substugae
atgaacaagatgcttgcgggttggttcgcgctggcgctggtgttgggcggttgcgggggaggaggcggcggcggtggggccatttcgaatggtagcaacggcagcagcacgtccaatagcgtcgcgatgactgtcgataccgggccaagcggcgcccagggacagctgaacatcccctatgtgtcggtgactgtgtgcgcgcccggcagcgccagcaactgccagaccatagaccatgtgctggtggataccggttccagcggtttgcgggtgttgtcctcggtgctgggcagcgggctgcgcagcgctctgggcagccagcaggtgaatggcaagcaggtggtggagtgcgcccagttcgccgatggctacacttggggggcggtcaatgtggccgatgtgaagatggcgggcgaggtggccagttcggtgccgatccaactggtctccgatccggtttacaccacggtgcctgccagctgttccagcgtggggagcaatgaaggaaacctcgccgggctgggggccaacggcatcatcggcgtgggcttgaaccggcaggattgcggcagcgattgcgccggcaacgccaacaacggattttattacctttgcgccaccgcgctgacctgccagcccggcaccgtgccggtcgcgcagcaggtggcgaatccggtggccagcttcgccgccgacaacaacggcgtgctgttgcagctgcccgccattccggtgaccgggcaggcgagcgcgcaggggacgctgactttcggcatcggcacccagtccaacaacgctatcgcgtcgggggtcaaggcttacccagtctccagcgacggtttcaccatcaccggcgtctacaaggggcagatttaccctagcttcctcgacagcggatccaacattctgtacttcaccgacagcagcatcgctacctgcacggtgggcggcggcacttggttctgcccgggttctcagctcaatctgagcgccaccttgtcgagcggcggcagcagcagcacggtcaatttcagcctgatcagcgcccaagtgctcactcgcagcaactacgcggctttccccagcataggcgcgccaatgaccggcagcctgagcggcgatttcgattggggtttgccgttcttctacggccgcaacgtctacataggcttcgccggcagcagcaacagcctgggcagaggggcgatgtatattttctga

SEQ ID NO: 3192 - DNA, 447 bp, Chromobacterium substugae
atgatgaaggcatcttcgaaaattttgttgctattgctcgccgcgccgctcctggcccgcgcggagctggggcagaagctagatgccgcgcaggccgcgagcggcggcaagcagatgaccgcgctcgcgccggctggcggcgccttcagcgtgcagcagagccaggacgccgccgggcggctgatcaagcaatacgccgccgccgacggcacggtattcgccgtcgcctggagcggcggcagcctgccggatctgcagcaactgctcggcagctatttccccgcctatcggcaggcccagctggccaaccgcaacggtctcaatgtgatgcgggggcaggtcggcagcttcgtggtgagctcgcatgggcggatgggcgcgttcaagggcttcgcttacgacagcgcgctgttgcctgccggcgtgacgccggatcagctcaaataa

SEQ ID NO: 3193 - DNA, 375 bp, Chromobacterium substugae
atgcaaaaattcagaatcggcatggttggagtgggagagacgggcacgcctttgctgaagcagctgctggatgcgccatttgtggagatggtgggagtggcggatctggatttgcagctgcccggcgtattgctggccaaggagcgcggcgtggcggtcaccgacaatttcatcgagatcgcggagcagggcgagcgggtcgacatcatcatcgacgtcaccggctcgcgcaaggtgcgcgacgatctgcgccgctacatgcagttttccggcaacacccacacggtgatcgtgcatgagcgcgtggctttgttaatgttgtcgctgggcgctggacagtgggtggaaacccggcatgacgagttaacctattga

SEQ ID NO: 3194 - DNA, 252 bp, Chromobacterium substugae
atgaacatcctgcgtatgctgaatgagtccgactacattcaggtcaacaaccagttcgtcaagccggacttccatgcggtttccgaagaattttccgacgacgacgacgtggtgctggaagcgaatctggatggccaggagctggtgttgaccgtggccgacctgactgacgccacgccgctggcggacggcggcttctggctggaagggctgggctatctgcgcttcctgtcgcagcagaacctgcactga

SEQ ID NO: 3195 - DNA, 675 bp, Chromobacterium substugae
atgtcgattgccagttggcccgaatccgagcgtccgcgcgagaagctgctgcagcaaggcgccggttccctgaacgattccgagttgctggcgattttcctgcgcaccggcatcaagggcgtcagcgcggtggagctggcgcggcgcctgttgcaggatttcggctccttgtcgcggctgttgaccgcctcgctgccggagttcaagtccatgccaggcctgggcgaagccaagtacgcgcagctgatggcctgcaccgagctggcgcggcgggccttgtcggagtcgatgcggatgggcgacgcgctgtccagcccggagcaggtcagggactacctgaggctgagcatagggcggcgcgaggtggaaatatttgtcgtgatattcttgacggcacaaaaccatctgatcgaggtcgaagaagtattcaaggggacgctgaccgaaaccagggtgtatccgcgcgaggtgttgcgccgggctttgcggcacaacgcggcggcggtgatcgtcgcgcacaatcatccgtccggggtgagcgagccgtcgactgcggacagggtgttgaccgataccctcaagcgcgcgctggcattggtcgatatcaagttgctggatcacttcgtggtgaccggtggacacgcggaatcgtttgccgaacgcggttggctgtag

SEQ ID NO: 3196 - DNA, 1182 bp, Chromobacterium substugae
atgactgccaaacgcattcttctcggcatcagcggcggcatcgccgcctataaatcggccgaactgacccggctgctggtcaaggcaggccaccaggtggaagtggtgatgaccgaatcggccacccgcttcgtgacgccagccaccttccaggcgctgtccggcaacacggtctacaccgatctatgggatccgcgccccagcaacgcgatggcgcatatcgagctgtcccgccgcgccgacgtcttcctgatcgcgccggccaccgccaacttgctgttcaagctggcgcacggcgcctgcgacgacctgatctccacgctggccgccgcccgcgcctgcccgctggtcgtcgcgccggcgatgaacctacagatgtggcagaatccgcccaaccagcgcaacgtcgcgcagctgcgcgccgacggcgtcgccgtgttcggccccggcaacggcgcgcaggcctgcggcgaaaccggcgacggccgcatgctggaaccgcacgaaatcttcgagctgctgcaaggcgtcttcgccgagaaaacgctggccggcagaaaagtgctgctgaccgccggcccgacttacgaagccatcgacaccgtgcgcggcatcaccaacatcagctccggcaagatgggctacgcgctggcgcgcgcctgccgcgacgccggcgccgaagtgacgctggtatccggtcccaccagcctggccgcgccgctgaacgtgcgccgcgtcgacgtggcaagcgccgccgaaatgcagcaggcggtgttgacggaagtcggccgcagcgacatcttcatcagcgttgccgccgtcgccgactaccgggtgagaaaccgcagcgagcacaagatcaagaaaggcgcttcggtccccgtcatagaactggaagaaaacccagacatcctggccaccgtcgcatccttgccggccgcgccgttctgcgtcggcttcgccgccgaaagccagaacctgctggagttcgccgaggccaagcgccggcgcaagaaactgccgctgctggtggccaatctggcccagcaggcgatgggcgccgacgacaaccaggtggtgctgctggacgacgccggcgagcacccgctgcccaatatgcccaaggacgaggtggccgccgccatcgtccgccatctggccgccctgctgggccggcgctga

SEQ ID NO: 3197 - DNA, 453 bp, Chromobacterium substugae
atgccagcccaaatcgacgtcaagatcctggacgcgcgcctgcgcgacaacctgcccgcctacgccaccccaggctcggccggcctggatctgcgcgccgccaccgaagagacgatgaccatccagccgggcgaaaccaagctgatcccgaccggcatcgccatccacctggacaaccccggcctcgccgccatgctgctgccgcgctccggccttggccacaagcacggcatcgtgctgggcaatctggtgggcctgatcgattccgactaccagggccagatattcgtgtcggtatggaaccgcggccaagagccgttccgcctggagccgatggagcgcatcgcccagatggtgatcgtgccggtggtgcaggtgggcttcaatctcgtcgacgacttcgcggcatccgaccgcggcgctggcggcttcggcagcaccggccgcggctga

SEQ ID NO: 3198 - DNA, 1020 bp, Chromobacterium substugae
atgacgcagacaccgcttccggatcagaccgaaagcaaactgatactcgacagcctggtcgagctgacgtcgcagcgcgaacaggatatgctggagtccagcctgctctccaccctggtggaggtcatgcgcgtcgaccgagtggagctgttctcctgccgctgggtcaacaacgctccctatatccgccgccggctggaggcccgctccggcgccggcaagccggacatccgcgaaaccagcgccgacagctggcagccgccgccggtttttctttacgagctgctcgaccagctggaccgcggcgacggcatccaccgcattcccggcggcatgtgcctgccgctgcgctgcatgggcagcatcacctcgctggtgatcatccacgccgccggcgacgccaagatcaaccgcgccatgctcaaggcgatggcgcggatacacgagaacttcctgcgcgtgctgttcgaggccgaccgcgacatgctgaccgcgctgcacaaccgccgcaagttcgaccagcgcatctacggcctgatcgccgcgctgcaacacccgcaagccccgcctgacccttgcgtgctggccctgctggacgtcgatctgttcaagcgggtcaacgacctttacggccacatggtcggcgatgaggtgctattgctgctcgcgcagctgatgcagcaaagcttcggcgaggacgacggcctgttccgctatggcggcgaggaattcgcgctgctgctgcaggcgccggatctcgagcaggcggaagcggcgctggagcgctttcgccagcgggtggccctgcatgtgtttccccaggtcaaaaatctcaccatcagcataggctacacccgcgtcaaccctgcccagttgccgggccagttggtggagcaagccgaccgcgcgctgtactacgccaagagccacggccgcgatcagatccgcagctacgagaagctggtggcggacggctcgctggccgcgccgcaggccggcggcgaaatcgacgtgttctga

SEQ ID NO: 3199 - DNA, 1695 bp, Chromobacterium substugae
atgaaactgattccgctgagcctgtgcctgagcgtcagcctggcgctggccgcctgcatgtcggactcttcttccgtgggaggacgaggcgaaaacaataatcagcagcgccagcccgcggtggcggtcaagctgatcgccttcaacgatttccacggcaatctggaaacgcccggcgccttgtcggtgccggacccggccaatcccggcaaaaccatcaaggtgagcgccggcggcgccgactacctggcggcctgggtgaagtcactgcgcgacaagtcgcccaataccgtggtggtatcggccggcgacctgataggggcgagcccgctggtgtccggcctgttccacgacgagccgacgatagaggcgatgaacctgctgggactggacatcaacgcggtgggcaaccacgaattcgacgacggccaggaggagctgctgcggatgcaaaacggcggctgcaagcccggctccagcaccacctgccggaacggcggcaagttcgccggcgccaagttcaagtttttggccgccaatgtgcgcaaatccgatggcggcacgctgtttccggcctatgagatcaagcgctacggcaatatcccggtggcctttatcggcatgacgctgaaggggacgccggaaatcgtgtcgcccaccggcatccagggcctgagcttccaggacgaggccgacaccgtcaacgcgctggtgcccaagctgaaggcgcagggcgtgtccgctgtggtggtggtggtgcatgaaggcggctatcaaagcggcagcttcaacgactgcaacggcatctccggccccatcgtcgacatcgtcaagaagctggacaaggcggtgggcttggtcgtgaccggccatacacaccaggcctacaactgcgtgatagacggccggcgggttaccagcgccaagaactatggccaactgttcaccgagatagacttcaagctggacccggcgaccaagggctttgtccccggctcgatccaggcggccaaccgggtggtgagccaggacatcgcgccgcgcgcggacgtcgccagcctgatccagacctatcaggccttggtggcgcctatcgccaacaaggtggtgggacaggcgtccggcccgctgacccgcgcctccaacgccgccggggaaaccacgctgggcgatgtggtggccgacgcgcaattggcggccggccaggcgcagggcgcgctggcggcctttatgaacccgggcggcgtgcgggcggacattctgccggggggcgacggcagcgtcagctacaagcagctctacacggttcagcccttcggcaacaccatgatgacgatggacctgaccggccagcagatcgaccaattgctggagcagcagtggagcaacccggcccagcccaagatgctgcaggtgtcggccggcttcagctacgcctggagccagtccgcgccggccggcagcaaggtcgacatcgccagcatccgcatcaacgggctggcggtggatccgcggcaggtctaccgggtgcaggtgaataatttcatcgccggcggcggcgatggcttcaccgtgctgacccagggggcgaaccgggtgggcggcggcgtggatgtcgatgtgctggtggattacttccaggcgcgggcgcgggtggatgcgccgccgctgaaccgcatcgtccagctgccctga

SEQ ID NO: 3200 - DNA, 4812 bp, Chromobacterium substugae
atgtcgcttaccaacaagaccgaactggcaagcctgatcgcagatattcaggccgtagccgagagcaagctttctaccaaggagacccaacaactcgccgccttcttcccgatctacttcgaagagaccgaacacgccgacctgcggcagttctcctcgctcgatctgttcggcgcagcgatggcgcattacgagttcgccggcaaacgctctgccggacaggtcaagtgccgcatctacaaccccgatttcgaacgcgacggctggcaaagcacccacacggtgatcgaagtggtgaacgacgacatgccgttcctgatcgattcgatctccatgctgctgtcgcgctacaacctcaacctgcacctgttggtgcacccggtgctggcggtgggccgcgacaagagcggcgcgctgcaagaaatcaagcgcaccgaagaccgcagcttgccgctggaatcgctgatccatgtgcagatcgaccgcatcagcgacgcggcgctgctgcaacagctggaagccgacctcaagcgagtgatggccgacatccgcctggtggtcagcgatgagccgaaaatgcgcgaagtgctggccggcattggcaaggacctcgccaagctgaagggcgagcgcgctgtcgaagccaaggaggccgtggccttcctggagtggatggccggccgcaacttcctgttcatgggctattgcgactacgacctggtcaagcgcgacggcaaggacagcctgaagatcgtcaagaaatccggcctgggcatcctgcaggaccagggcgacaaagagtattccgccagcttcgaacagctgccgcaggagctgcgcgagctcgcgcacctgccgcaactgatcatcctgaacaaatcgcagacccgctccatcatccaccgcccggcctatgtcgacttcgtcggcatcaagcgcttcaacgacaagggcgaagtgataggcgagcgccgtttcctcggcctgtataccgccagcgcctaccagatgtcgccgaaggacgtgcccatcctgcgccagaaagttggcgcggtgatcaagggctgcgacttcgtcgacgacagctacaaggccaagaccttgggcttcgtgctggaaagctacccgcgcgacgagctgttcgagattccggccgaagtgctgggaccgatcgccgaaggcatcgtcagcctgcaggagcgcccgcgcgtgcgcctgttcgtgcgcgccgaccgctaccaccgttatgtcagcagcctggtctacgtgccgcgcgacagcttcagcaccgaagtgcggctgaagatcgaaaaagtgctgatgaacgccttcaacggcagcagcgccgaattcagcgtgcagatcggcgacggcaccctggcccgcgtccactacatcatccgcaccgcggccgccaagctgccggaattccacaccgccgacatcgaggccgaaatcgcgcgcctggtgcgcggttggagcgaagagctgcaccagcaactggtggaagctcatggcgaagagcgcggcaacggcctgttcaaccgctataaagacggcttcccgctggcttaccgcgaagaattcgcggtgcgcaacgcggtgctggacgtgcagcatctggaggccatcgacgccagccagccgttggcgatgaagctgtaccgccccttccaccgcggcggcgcggcgttcaacctgaagctgttccgcgagagcgagccgatgggcctgtccgccagcctgcccatcctggaaaacatgggcgtcaaggtgcgcgacgagcacccgtactgcgtgaagcgcggcgacggctcccaggtatggatcagcgacttcggcctggatgtcggcagcttcggcgagcagatggcccaggaccaggtgcagcatgacttccaggagttgctggcccaagtcttcgccaggcgttgcgaaaacgacggcttcaaccgtctggcgctggtggcggcgctggattggcgcgagatttcgctggtgcgcgcgctggccaaatacctgcgccagggcggcctgaccttcagccaggcctatatcgagcagtgcgtggccaactatccggccatcacccgcagcctggttgagctgttctatgcccgcctggatccggccggcttcgacgacgacaaggccgaactgttgctggccgccgtgcgcggcatgctggacggcgtggccaacctggacgaagaccgcatcctgaacggcttcctggctgtgattctggccacccgccgcaccaatttctggcagaagggcgccgacggcgagttcaaatcctacatttcgttcaagctggaatcgaaccagattccgttcctgccgcagccgcgtccgctgtttgaaatctgggtgtacagcccgcgcgtcgaaggcgtgcacctgcgcggctccaaggtggcgcgcggcggcctgcgctggtccgaccggatggaagacttccgcaccgaagtgctgggtctcgtcaaggcgcagatggtgaagaactcggtgatcgtgccgatgggctccaagggcggcttcgtcggcaagcaactgccggcgccgtccgaccgcgaggccttcctggccgagggcatcgcctgctacaagatcttcatctcggcgctgctggacgtcaccgacaacctggtgaccggccagatcattccgcctaaggacgtgcgccgcctggatccggacgatccgtatctggtggtggccgccgacaagggcaccgcgaccttctccgacatcgccaacggcatctcggaagcctacggcttctggctgggcgacgctttcgcctccggcggctccgccggctacgaccacaagggcatgggcatcaccgcccgcggcgcgtgggaatcggtgaagcgccacttccgccacctgggcgtcaacacccaggagcaggatttcaccgtgatcggcatcggcgacatggccggcgacgtgttcggcaacggcatgctgctgtccgagcacatctgcctgaaggcggcgttcaaccacctgcacatcttcctggacccgacgccgaacgcgaagaagagcttcgccgagcgcgcgcgcctgttcaatctgccgcgctccagctggtccgactacaaccgcgagctgatctccaaaggcggcggcattttcgagcgctcggccaagtccatcccgctgtcgccggaagtgaaggcgtggctggaaaccgacaaggaccagatggcgccgaacgagctgatccatgagatcctcaaggccaagatcgacctgctgtacaacggcggcatcggcacctacgtcaaggcatcgacgcagagccacgctgacgcccgcgaccgcgcttgcgatccggtgcgcgtcaacggcaaccagctgcaggcccgcgtggtcgccgaaggcggcaacctgacgtgcacccagctgggccgcgtcgaattcgcgctggccggcggccgcatcgccaccgacgccatcgacaactccgccggcgtcgactgctccgaccacgaggtcaacatcaagatcttgctgggcgcggtgatgcaggcaggcgacatgacgctgaagcagcgcaacgagctgctggccgagatgaccgaggaggtgggccacctggtgctgcgcaacaacgtgctgcagacccagatcctggccatcaagcgccaggagtcggcggcgatgctgaccacccatgcgcgtatgatcgcgcacatggaaaagaccggcgagttgaaccgcgagatcgagtacctgccgtccgaaacccagatcaacgagcgccgcctggcccgccagggcctgaccgtgccggagatcgccgtgctgctggcttacagcaagatctcgctggaccaggccatcctggccaccgatctgccggatgaccgcgacttcctgccggtgctggtcaactacttcccgaaaccgctgcaacagcgcttcggcaagcagatggaacagcatcagctgcgccgcgagatcatctccaaccagctggccaaccagatcatcaaccgcatgggcaccaccttcgtgttccgcatgcaggaagagtcgccgttctccgcggcagacatctcccgcgcatggtggatcgccagccgcgtgttcgacgcggaaagcctgtggggccagatcgaggcgctggacaacaaggtgccggccgatcagcagatgcagctgatggtgctggtgcgcacgctggtggagcgcgtcacccgctgggtgctgcgcaacaagcgtccgttcggctcggtcaacgccgtgatcgaacagtacgctgccaaggtgcagggcctgctggcccagctgcccaagctggtgccgtcggaacgctacccggcggtggcggcgctggaacagcgcatcgcccacgccaatctgccgcaggcgctgacccaggtgctggcgcgcctggagttcgccgtgccgctgatggacatcatcgaaatcagcgagggcagcaagctgaccctggaacaggtggccgccaactacttccagctgggcagcacgctgcagctggactggctgcgcgacgccatcaccagcctgccgcgcgacaaccgctggcagtcgctggcgcgctcggcgctgcgcgacgacctgtaccgcgtgcaccgcaacctggcgcgccaggctctgctggatggcgcggcgacggaaaccttcgcggtgcagtggctggagaagcagcacgcggcggtggaagtgtgcggccagatgttcgccgaactgcaatcgttcagcgcgctggacctggcgatgctgtccgccggcatgcgcgagctgaacaaccatctgctggcctga

SEQ ID NO: 3201 - DNA, 765 bp, Chromobacterium substugae
atgaaaaaagccctgatcgcaagcgccagccttgccttgttcgcctccctgtccgcccaggcggaaactctgcgcttcggcatcgacctcaactacccgccgttctccaagcaaggcgccgacggcaagccgcagggcttcgacatcgacatggcctacgcgctgtgcgcggcgatgaaggccacctgccagatcgtgccgcaggactgggacggcctgatcccggcgctgaacgccaacaagttcgacgccatcatctcgtcgatgcagatcacccccgagcgcgagaaggcggtggacttcacccacaagtactacaacatcgccagccgcatggtggccaagaacggcgccaaggtggacccggccagcctgaagggcaagaagatcggcgtgctgcgcgcctccacccaggaaaagttcgccaaggacttctggggcaagagcggcgccagcgtagtcgcctacgccaagtcgcctgaatccttcctcgacctgaagtccggccgcgtggacgccgtcttcgtcgacagcgccgtcggcgagcaggaattcctcaagacgccgcaaggcaagggctacggcttcgccggtcccaactactccgacgtcaagtacttcggccccggctgcggaatcgccgtcaagaagggcaacaaggctctggttgagcgcctgaacaaagccatcgagcaaatccgcaaggacggcagctacaagaaggcccaggacaagtacttcagcttcgacatctacggcggctga

SEQ ID NO: 3202 - DNA, 687 bp, Chromobacterium substugae
atgcttcaaggctatcttcccagcatcctcgaaggcggcgtgctgaccctgaaactggcgggcaccgcgctgatcgtgtcggtcgcgctcggcctggtcggcgcgctgttcaagtccagccaatcgcgcgtactgacgctgcttgccgagctctactccaccgtggtgcgcggcattcccgacctggtgtggatgtttctgctgtttttcggcgcgcagatgctgctcaacgacgtctgcggctacttcggctggcaaagcccgaacatcgatcccttcgccgccggcgtgctgaccctgggcttcatcttcggcgcctacatgagcgaaaccttccgcggcgcgatgatggcggtgcacaaaggccaaatggaagccggcctcgcctacggcatgtcgccgctgcgggtgtttttccgcatccagctgccgcagatggtgcgctacgcgctgcccagcttttccaacaactggctggtgctggtgaaatccaccgcgctggtttccgtcatcggcctcaatgacgtgatgtaccgcgccgacgccgccaaatcggccacccagcagccgttcgatgtctacgtcgtcgtcggcatgctgttcctcatcgtcaccggcgcgtccaatctgctgctccactggatggagaagcgctattcgctgggcgccaaggagagcggactgtga

SEQ ID NO: 3203 - DNA, 732 bp, Chromobacterium substugae
gtgatcgatcccaaactgattatcgagcggctgccggaatttttcggcgcccatgacggcgggccgatgctggccagcaccgacggcctgatcctcaccttgcagctgctgggcgtctcgctgctgctgggcctggcgctggccatcccgctggcgctggcgcgggtttcgcaaaaccgtcctctgtccggcgcggtatggctgttcggctatgtgttccgcggcaccccgctcttggtgcagctgttcatcatttactatggcctcgcgcagttcgactggatccgcgacagctgggcctggcagtatctgcaaaacgcttacgcctgcgccatcctggctttcacgctgaataccgccgcctacaccaccgagatcatcgccggccagctgcgcaacacccactggggcgagatcgaagccgcccgcgcgatgggcatgagccagtggctgatgctgcgccgcatcgtgctgccttcggcgctgcgccgcgcgctgcccgcctacagcaacgaagtgatcatgatgctgcagagcaccgccatcgccggcctggtgaccctggccgacctcaccggcgtggcgcgccgcatctatagcgaaagctatatgccgttcgagcccttcctcaccgccgccgtcatctacctgggcctgactttcatcctggtctggctgatgaagcgggccgagcgccgctacctggcctttctcgcgccccgcaagtcataa

SEQ ID NO: 3204 - DNA, 234 bp, Chromobacterium substugae
gtggggcagaagcaggaagccaaagcgcagggctttgccggtttggggcggatgacccatggtgtgattgtctgtactcggttggcaaaaagaccgccatgccgggaggcctggcatggcggcgtatcttgccgtgcattgtacgatttatttcagccggcaggcagaagaattgctgccgcttgctatcgtttgcaggcttatgacttgcggggcgcgagaaaggccaggtag

SEQ ID NO: 3205 - DNA, 948 bp, Chromobacterium substugae
atggccgacttcgccgccgcgtccgaggtgctcgcccacgctaacttgctggcggaaaagcgcctgtacgaaactctgctgctgtcgctggacggcggccaggtgcagctgtccaacggcgtcaagctgggcgtggacctgccgctgtcctacgcgcccaagctggactatctgctgatcctggccgatgaaatcggcaacgaattcgcgctggaagagttgagcaagggcatcgccgcctgcaacaccgacaagctcacgctgggcggcataggctgcggcagctactggctggcccgcgccggcctgctggccggacagcgcgccaccatacactggcgcgaaatctcgcggctgaccgaggagtatccggatgtgatcgtcacgtccaatctgtatgaaagcgaaggccgctatctgagctgcgccggcggcgccgccaccttcgatttcatgctggacttggtgggcaaacagcagggccatgaattcatcgcccagctgtccgagctgttcagcatggagcgcatccgcccgggcaacgagcgccagcgcatcccgctggccacccgcatcggcggcagccagcccaagctgaccgaggcggtcagcctgatggaggccaatatcgaagagccgctgtccaccgacgacatcgcctactacgtcggcgtctcccgacgccagctggaaaggctgttcaagcagtacctgggcacggtgccgtccaagtactatctggagctgcgcctgggccgcgcgcgccagctgctgcagcaaaccagcaagtccatcgtgcagatcggcctggcgtgcggcttctccagcggtccccacttctccagcacctaccgcaaccacttcaacatcaccccgcgcgaagagcgcgcccagcgcacccagaccagcgcgctgcagcgccagcccgcccagaccgagcgcggctag

SEQ ID NO: 3206 - DNA, 1475 bp, Chromobacterium substugae
  modified_base (508)..(508): a, c, t, g, unknown or other
gaactgaagagtttgatcctggctcagattgaacgctggcggcatgctttacacatgcaagtcgaacggtaacagggtgcttgcaccgctgacgagtggcgaacgggtgagtaacgcatcggaatgtaccgtgtaatgggggatagctcggcgaaagccggattaataccgcatacgccctgagggggaaagtgggggaccgtaaggcctcacgttatacgagcagccgatgtctgattagctagttggtgaggtaagagctcaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttcgggaggaaatcccgctggttaatacctggcggggatgacagtaccggaagaataagcaccggctaactanagataaccgctgaaagcatctaagcgggaaacttgcctgaagatgagacttccctggaggcttgacctccctgaagagtcgttcgagaccaggacgttgataggtcgggtgtggaagcgctgtgaggcgtgaagctaaccgatactaattgctcgtgaggcttgatcctatcatttgagtggcttgggaaactgagacacaagagagtggatgtgcgacgtacgtcaaataccgaatatatgcgaatctgtctgagagacgggttcgggcttctttaagtttgtacagtttatgtctggtggccatagcgaggtggtcccacgccttcccatcccgaacaggaccgtgaaacgccttagcgccgatgatagtgtggcattcgccatgtgaaagtaggacaccgccagacgccccatacagaaccccagctcgatgagctggggtttctgcgtttcggccgccgcccgtggggcggcgccgtttcggccttgccgtcccctccccgaacccgcgcggcgaccgtccgtcgccgctgcccatccgccagtccccgcgagggggcgcatcccgctgcccgccaggcgcctggcgggctttgactgggcagtcgacgtgccgcttgcccgatcgcgggccttgtttcaacgcttcagctggtgcggctaggcgcctggctcgcggtcattgcctgcttgagcgatttttgcaaaaatgcgcggcagatgttttatgcaatgcatattatttgaaatgtcagatatatccctggggcggaagtcttgagcaaattcaaaggtggcgagtggcttctgtttggtgctatctggctggtttgcgcgctgctggtgctgagccagtgggcgatgggtgagtaccgcaggctgcaggatggattcgagctggctgcgcatcaggcatacgcgggcgtggcgcgcaggttggatcagaacgagtcggtgctgtcggc

SEQ ID NO: 3207 - DNA, 118 bp, Chromobacterium substugae; identical to SEQ ID NO: 426

SEQ ID NO: 3208 - DNA, 693 bp, Chromobacterium substugae
atggtgcaatgtcggccttatttccaatctggtgaagcaggaatcatgatcaaggcagtattgttcgatttggacggcacgctggcggataccgcccgcgacctgggcgcggcgctgaatcgcctgctgaaggaagagggcctgccgccgcagccatacgaggcgatccggccgatggccagccatggcgcgcgcggcctggtgcggctgggcttcggtgccggactcgatgccgagcggatggagtcgctgcgggtgcgcttcatggatctgtacgacgccaacctcgccgaggagacgacgctgttcgacggcgtcaacgagctgatcgccgaattggacaagcgcggcctggcctggggcatcatcaccaacaagtcgatgcgcttcaccgaccgcctggtgccgtggctgccgttcgccattccgccagctgtcatcgtcagcggcgataccgtgggcgtggcaaagcccgacccgcgtccgatgctgcacgccaccgaacagatcggcatcgcgcccgagcattgcatgtatgtcggcgatgccgagcgcgacatccaggcgggccgcaatgtcggcatgaagacggtgctggtcaactggggctatttctcggcggacgacaagccggagcagtggggggcggatgccgatatcgatcacccgctgcagctgcttgatcatctataa

SEQ ID NO: 3209 - DNA, 1530 bp, Chromobacterium substugae
atgagcaatacgcaagactatctggaacgcatcctgacatcgagggtttacgacgtcgcggtggagacgccgctggagctggcgccgaatctgtcgcggcgctacggcaacaagatactgctcaagcgcgaagacctgcagccggtgttctcgttcaagctgcgcggcgcctacaacaagatggccaagctgagcgccgagcagcgcgcgcgcggcgtcatcaccgccagcgccggcaaccatgcgcagggggtggcgctgtcagccagcaagctgggctgtgaagcggtgatcgtgatgccggtgaccacgccgcagatcaagatcgacgcggtgaagcagcgcggcggccaggtggtgttgtcgggcgattccttcaatgaggcctatctgcacgcggtgaagctggcggaagagagcggccgcacctatatcccgccgttcgacgatccggacgtgatcgccggccagggcacggtgggcatggagatcctgcgccagcatccggacgacctggacgcggtattcgtcgccatcggcggcggcggcctggctgccggcgtggccagcttcatcaagcggctgaagccggaggtgaaggtgatcggcgtgcagccggtggactccgacgcgatgcgccagtcgatagagaagggcgagcgggtggagctgaaagacgtcggcctgttcgccgacggcgtggcggtcaagctggtgggggaggaaaccttccgcatctgccgcgaattgttggatgagatcatcctggtcgattccgacgccatctgcgcggcgatcaaggatattttcgaggacacccgctccatcgtcgagcctgccggcgcgctggcggtggccggcgccaaggcatacatcgagcgcgaaggctgcgccgggcagtcgctggtggcgatctcctgcggcgccaacatgaatttcgaccgcctgcgccacgtgtcggagcgttccgaactgggcgaacggcgcgaggccatcatcgccgtcaccatcccggaaaagccgggcagcttcaagcgcttctgttcggtgatcggcggccgcaacatcaccgagttcaactaccgcttcgccgaccccagcgtcgcccacgtgttcgtcggcgtgcagatcgccggcaaggaagatgtggagcgcttgttgacggacttgcgcgcggcggagttggacggcatcgacctgaccgataacgaattggccaagctgcacatccgccatctggtgggcggtcatgcgccgcagctgaaagacgagcgggtgctgcgctttgaatttcccgaccgccccggcgcgttgatgcgttttctggaggcgatgcgcacagactggaacatcagtctgttccactaccgcaaccacggcgccgactatggccgggtgctggtcggcatccaggtgcccccgggcgacgcgcaggccttccagcagtttctggaaacgctgggatacccttatatagaggaaaccgataatccggcctatcggctgtttcttggcaagaccatccgttga

SEQ ID NO: 3210 - DNA, 1146 bp, Chromobacterium substugae
atgaaaaaactcaccactgccctggtggccgccgccctggcgctgccgtcccttggctttgccaataccgccttcaccccgccggcgccggacatcgccggcaaggcctactacctgctggactacaacagcacccaggtgctagccgaacgcgaccccgactcccgcgtcgagccggcctcgctgaccaagctgatgaccgcctatctgaccttcaaggcgctgaaggaaaagcatctgacgctggagcagacgctgaccgtatcgcaaaaaggctggaaaaccgaaggctcgcggatgttcctggatccgaaagtcccggccaaggtggaggacctgatccgcggcatgatcgtgcagtccggcaacgacgcttgcgtgacgctggccgaagccatcgccggcagcgaagacgtattcgcgcagatgatgacccagcaggcgcagaagctcggcatgaagaacacccagttcaggaacgccaccggcctgccgcacgccgaccactacaccaccgtgcacgacctgggcatcctcgccgccgcgttgatccgcgactaccccgagttctatccgatctactcgatgaagtcgttcacctacaacaacatcaagcagcctaaccgcaacctgctgttgtaccgcgaccccaacgtcgacggcatgaagaccggctacaccgacagcgccggctacaatatggtaacgtccagccaccgcgacggccgccgcgtgatctccgtcgtcgtcggcaccgccagcccggaagcccgcgcggtggaaagctccaagctgttgaactacggcttgcaattcttcgacacgcccaaactttatgcagcgaacacccgcgtctccgacgtggccgtctacaagggcagcgacaagatggtggcggtaggcttcggcagcgatgtttacgccaccgtggccaagggccaggccgccaagctgaaggccgacctgaccaccatgcagcccttgatcgcgccgatcaaggccggccaggtggtcggcaagctgacggtttcgctcgacggcaagccgctcttggagcgtccggtggtagcattgaaagcggtggaggaaggcaacttcttcagccgcctgtgggacagcctgaagctgatgctgggctggaagtaa

SEQ ID NO: 3211 - DNA, 270 bp, Chromobacterium substugae
atgtctgatgaaaaacaggaactgatggagttcccctgtcgcttcccgctcaagatcatgggcgagcggcacgacgaattcgtcgccaccatcaccgaagtggtgcgcatcaacgcccccgacctcgccgaggtcgacattgtgctgcgcgaaagctccggcggccgcttctacgcgctgaccgtcaccgtcaccgccacctcgcgccaacagctggacaacatctacctgtcgctgaccggccaccccatggtgaaaatggtcctctga

SEQ ID NO: 3212 - DNA, 624 bp, Chromobacterium substugae
gtgcaacgcatcatcaaacatttgggcctggccgactacgagccgacctggcgcgccatgcaggcgctcaccgaccagcgcgacgacgacacccgggacgaactgtgggtggtcgaacacccgccggtgttcacccagggactggccggcaagccggaacacctgctgcagcaaaacgacatcccggtggtgaagaccgaccgcggcggccagatcacctaccacggtcccggccaactggtgatctacctgctgattgatttcaagcgcatgcgcatcggcgtgcgcgaactagtgcgccacatcgagcaggccatcatcgacatgttggccgaacagggcatcgccgccaacggcgatgtcgacgcgcccggcgtctatgtcgacggcgccaagatcgcctcgctgggcctgcgcatcaagaacggcgccacctaccacggcctgagcctgaacgtggacatggacctgagcccgtttggctggatcaacccttgcggctacgccaacctcaaggtgacacaattgaagaatctgggcgtgaacctcacggtcgccgaagccgccgacaagctgctgccgcacctggaacgccacctgagcacaagcaaggagaccgcatga

SEQ ID NO: 3213 - DNA, 948 bp, Chromobacterium substugae
atgaagccggacaaccaggccggggtgaagcacaagggcgcggccaagaccgcccgcatcccgatcaagatcgtgccgctggacgaaaagctgagaaagccggagtggatccgcgccaagctgcccaacagccagcgcttccacgaaatcaagcagatcctgcgcgatcagaagctgcacaccgtgtgcgaagaagcctcctgccccaatatcggcgaatgcttcagcaagggcaccgccaccttcatgatcatgggcgacatctgcacccgccgctgcccgttctgcgacgtcggccacggccgccccaacccgctggacgagaacgagcccaagcatctggccgagagcgtggcggcgatgcggctgaagtacgtggtggtcacctcggtggaccgcgatgacctgcgcgacggcggcgcccagcacttcgccgactgcatcaacgcggtgcgcgccgcctcgccgggtacccagatcgaaaccctggtgcccgacttccgcggccgcctggacatcgccatcgacatcctcagcggcaccgcgccggacgtgatgaaccataacctggaaaccgtgccgcgcctgtacaagcaagcccgccccggcgccgactacgcccactcgctgcagttgctgaaagactacaaggcgaagaacccggacgtgcgcaccaagtccggcctgatggtgggcctgggcgagaccgacgaggaaatcctggaagtgatgcgcgatctgcgcgctcacgacgtggacatgctgaccataggccagtatctgcagccgtcggacggccacctgccggtgctgcgctacgtgcacccggatgtgttcaagatgttcgaggaaaaagcctacgaaatgggcttcgtccacgccgcggtaggcgcgatggtgcgctccagctaccacgccgacgtgcaggcgcatgaggctggcgtgtaa

SEQ ID NO: 3214 - DNA, 1716 bp, Chromobacterium substugae
gtgcgaaaggcaattccaaagatcaaggagtttccagacgacggccgcatctggagggtagattggtttggcggtgtagagcgcaatcctcagattccctccgaacctaaaatccaactcatcatcagcccggtggtggatggcgccatcgattacgctgccagcaactccgtcaatcacgaagaacgtagctcaatcagcatcggcattggtcagcttcccctcattaccatcggttcgctttggcaaaaccggcattgcttgatcgaaagtgccggcaaaaccaaggtcttcgaaaatctcgtcatctcgcctaagacggccctcttggtaaaatcggacgctctagtaggcgggcagccactcgtccgtaaaaagtaccaccagatcggcgcagggcttgctgcaaactgcttggctatcgaatggcagggagacccatacggcatcatcatcccgacagccgaggtcattcgtttttactatgccacgtcaacagatctcgccaaggccatttttgctggcgattttcgacatgaactgggttcaatcgtgaatccaactcagtgcggttacatcaagcaggaaaatcgctgcatcctcaagttgcgtaaggagtttgccgatgcggatgcctggactattggacgcatactgaatagccatgaagcgttcaatggtgccgtcctagtgcatgactcgatgatcaagcaagccgtacagagtaagtcccgcctgtatccagaagctgcgtttccttttgtcggggaaaccaacctacgggtgcggatgaaagcgatgaggtcgccagatgagaaacgctggcgtttcatcgtttttgcgttggaacactgcacgggaccatttccattcagtgctattacctgcgaccgtgataacagcaacctgcgcccagaggaagggcatgatcagccggatgaattgaaggcccctgcatatcctcgcaagcagcaatcggggaaggatgttaccgatggcgaattgcagagcaatgaggatgcctccaaggagatccagtcggctgttattgatctacctgaagggcggtttggcgcgctggcgaatatggaattggagaagcccgagaagaatatttgccactatttcaacgcggggagtgctcacccgctcgagctcccctctgatgtacttggcacgagcgatggcaattattctggtggtatcatgacgcaaacgtcaattgaggttaagcatgagcgccaagaggcgttgcccgcgagttttgcaaacttcgaggcgatggtgcgacatctggatggtttgcctgggtaccaagcaaagattcgccccagatctgatgccacaatgcacatcccgctgacgaaaccacaccgggcttggcagtggagttacttggattcgggaacacggcaaagacgtgcagttgtaattgcagacattacgcatgattgctgcgtgtacagcttagttgagtttcagtggcgagaagaggaatcgtttaagctcgcaatggtgtcgttatctggaggcgccaggctgagcgatgagcaattgcacttactgctcagaatgttggctaaaaaggaaggtcgctggggaagcactaagccattaccctggaatgccaagcttatcaccttcaagcacacatggccttccgttgacgcatatgcccaggcaattttggcaagagtaagcacattttcaaattaa

SEQ ID NO: 3215 - DNA, 1452 bp, Chromobacterium substugae
atggtaaatccagggttcaggaatcaagacgaggtttctctaaacaggcttcaccttgacacccagaacccaagacatgacccacttgaagatgaagatgagatcatcgctcagctctacaaagacgaacaggttctgaatcttgcaaaggatattgttgccaaaggaacgttgagtcctcttgaccgccctggagtgattgaaatggacgacaatcctggtcactacatcgtcgtggagggaaatcgccgaacgtgtgcactcaagctgttgcatgacccgcagaaagctcctactccagaagttcgtgctacatttgaagctttgtcaaaaaggtttgaagtaccctcctcgttttctgtcgttgtatttacagatcgcaatgctgctcgcccatggattggtttgcgtcacttgggggctcaggaaggggcgggaactcgcacttgggatgctgcacaaaagtcccggtatgctgaaacagaatcgcccaatcagttagcattggcgctgctggaccacgcggagaaatccggctggatagatgccgatatgcgtgagcaactggcaattactaccctcacgcgatatcttagtagcccactggtacgtgccgcacttgggcttggaaaccatcgagagctgttatatacccatgatgcttctgaagtagaggccgcgctacgtcagtttcttgctgacgcggctcctgtgcatgacggaggtgtgccacgtgttcattctcggtctagaaagttggaacgagaagcatatgccagagagcttgccgtgcgagggatcactcctcggagcttgttgccatttccaagtcagcctcctgaacctggttggcaggatgacctatctcccgacgtagtcgaacccgctccaattcatggtgtagatcctgggccagaaccccttgaccctggcattactcctccgcaacctgaaccggatcctttaccacccgcccctgatccaggcaagcccgctcaaccaagacctccacgtgggaaacaacatccggatgatcgcatgtacctcatgccaacggactttactttcactcatagtgataagtcactgcgtcgtttgcgcggtgaatttcgcagcacgccaatcgatgatcatgagttcgcagtaaattatctgctgagagcctttatcgagcgggtgttggttctctatgccaagcaccgaggggtacataggtcaaagatggcagatcagaaattggtgcaagtttgtgtagaggaactgggcaaagaaggcgtgccagataacgatctgaaattgatgagggttgcaatgtctgacgaaaactcggcgcatagcttgcataccttgggtactgctgttcacacaagccttgtcgcaactcgaaagagcctggtgggggcgtgggataactgggagaaggctctaaaaataatgctttctcgtatgtaa

SEQ ID NO: 3216 - DNA, 888 bp, Chromobacterium substugae
atgagccacttgaacgactcgaccctcaagctgctcgagctaagcgatccagaacggatagagaggatcagggcgccgcgttggattggctatccgcaggcgaaagcgatcctggctaagctcgatgatctgttgacctacccgaaatcgcaccgcatgccgaacctgctggtggtgggtgacaccaacaacggcaagaccatgctggtacagcggttctgctcccaacacccagccgacgacaacccctccggcgaaggcattcgagtaccggtgctttgcatgcaagcgccaccggttcccgatgaaggccgcttctacaatgccatcctcgaactgctgtttgcgccgtataagccgaatgaccgggtggataagaagcaattccaggtcatcaagctgctgaaatacgtcggactgcgcatgctgatcatcgatgagatccaccatgttctggccggaaatctgaaccgacagcgcgccttcttgaatgtgctcaaatacttgggcaacgagctgcaagttccgatcgtggccgtcggcacccgagatgccttccgcgccctgcaaactgacccacagttggccaaccgtttcgaaccggcgctgctgccccgctgggaattcgataccgactttctccgcctgttggccagcttcgaacggatgctgccgcttcgagagccatcggctctgcacagcactaccctggccgcaaagctgttttcgatgagcgaaggctacatcggagagctctcacggttactggccaatgccgccgagcatgcaatcaaaacagggcgggagcagatcgatgcacgcgctctcgacggagtcggttggatatcaccatctgatcgaaagcggcaagctcaactgagcaactga

SEQ ID NO: 3217 - DNA, 1833 bp, Chromobacterium substugae
gtggtctatcaaaatcgactccatcgcatcacccatgtgctggatctcgacgaggtgctgctggccgacgacgaaaccaaccaggtcagccacgccaaggtgggagacttggaagcggtggtcggcaattcgcagccgtcggcacggccggacttattgcaagtgctggacaaggattgggaggaggcaaaacggcgttacgagatcatccgcccgctgctcgacaaagcagaccgcagccggcaagacgtcaccgaccgaggcaaagctttcggccaccatgcgaatacgctctacgagtggctacgccgctacgaagacaatcatttactgacctcgctgctgcctcgtactcggagcgacaagggcgccaccaagctcacgccggaaatcgaagcgatcatccaggtggtagtagaaagcgaatacctgaccaagcagcgaaaatcgcagcagaaagtctgcgacgaggtgcgcaagcgctgtttgaatgccggcatagaaccgccgcacgacaacaccgtacgtaaccgcctgaaactgctggccggcgagtatgttatggccaagcgcagaggccgcaaagcagctgaccaagcctattcgccaatcgaaggcagcttccctggcgcggattggccgctcgccgttgtgcagatcgaccacaccccgctggacatcatcctggtggacgacatcgaccgtcggccagtgggcaagccatggatcaccatggcgatcgacgtattcagtcgaatggcggtcggattctacgtatcgttcgatccgcccggcgctctatcggccggccagtgtctggccaatgcgattcttcccaaggagggctggctggccaagcatggcgtcaagggggaatggccctgctggggcattccggcaaagctgcacatggataatgcccgggagtttcgcggcaatatgctgaagcgggcctgcgaccaatacggcatagacatcgaatggcggccagttgctcgaccacatttcggtggacacatcgaacgcctgctgggcactttcgccaatgaaatccataccctaccgggcactacattttccaatgttcaggagcgaggcggttatgactcggagggcagggcagcgctatcgctcaccgaattagaagagtggctggtgaccttcatcgtcaacgtatatcaccagcgcgtgcattccggcctccggatgccgccgatagagaaataccgccaggggatcttcggcaccaaggacatgccaggccgcggcttacctgcgcggatcactgacgtggatcgtttgcggctcgatctcatgccgtacgaggagcgcacggtccaggactacggtgtggtgatcgacgagatccactactaccatgatgtgctacgccgctggatcaatgcccctgacccggtagcgcccaagtacaagcgcaagttcatgtttcgccgcgatccgcgtgacatcagcacgatctggttctacgaccccgaggtcgatctctactacccgatcccctaccgggatacatcccaccctcctatcagcatctgggaaatgcgcgaggcaaagcgtcgagccgaggccgatggacgacgacatgtcgatgagcgtgcacttttcgccgcctatgaccgtatgcgggagatcgaacaaaacgcccaagccaaaacgatgtcggcgcggcgcgcaactcagcggcgcaaagaccatcaggaggtggtccgtcaacctactccgccagtggcgcaaatggtagagcacaccacgccgcagccgcaaactgtgccggcgatcctgccttttgatgaaatggatgacttggcatga

SEQ ID NO: 3218 - DNA, 657 bp, Chromobacterium substugae
atgcccgtgcgcaagatccccaagaactaccgtaacgtcaccggcatcgccgcgcaccgcaaggcgaacgggccggccatgttcgagtccacactggagcgtgactttatcacgttgctggaattcgacccggttgtcgaaaccttcgaggtccaaccgcttacgctcgagtggaccgattccgacggcaaaatccgccgctacacgcccgacgcgctcgccactttcaagctacctcatgggcagcaaagcaagacactttacgaggtcaagtaccgagatgaactgcgtagggattggcaagaactgcgtccgaagctccgcgcagccgtgcatttcgcccgcatcgaaggctggcgtttcaagatcgtcacagaggtagagatccgttcccagtatctcgacaacgccaagttcctgctgccgttcgttcgacaggggccggcagaagaagctcacatggacctactcgacgatcagctgcgtctgatccgccacgccacgccggcagagctgctgtccgcagtgtttcaggaccagtggaatcaggcgcgcctgcttccctccctttggtacttggtcggaacagggcaggttggcgtcgatcttaccaagaagctgacgatgaccagtccgatctggagccttcataaatga

SEQ ID NO: 3219 - DNA, 297 bp, Chromobacterium substugae
gtgggccgcttgcgcgatagtctggcgctgagcatgaagagcaatggcgagctggagttctgctgcctagcgttctggttgggcgtgggcgagcccaggcgaaagattcatgattcgcctgtggcttggctgaagttcaagtctgacagattgctcagcgcggcgcagagttcggtggcgagggatagcctggttgctaggcttgcgcaacccaaattctatcagggcgaatatgccggcggcgccagctatgcctgggctcccggcgtgctggtgatcgagaagccggccgtttga

SEQ ID NO: 3220 - DNA, 135 bp, Chromobacterium substugae
ttgctgttttcgcggcaagcgtggcggattcgtcttttttatattgatttgcaatatatggatagcgcggcattccagccgcatgcgttcgctttgcgcttgacatgcatggatttgtctatgctggacaagtag

SEQ ID NO: 3221 - DNA, 378 bp, Chromobacterium substugae
atgcgagccctgaaactgtcccaactgctgaaattctttacccgcggcaatacttccgctcaagttgccgacttccgcctgaatatcgtttgcgacaaagccgtcatcaccacgctgcgcaaacgcctgttctgggaaatgcacgacctcggcctgcgcgcctcgcaagtcaccatcggccccgacagccatgacaaccagtgcaagctgtcggtggtgctcaactgcccgctgacgcaacgccaggacctggacgacatggcgctgcgcctgagccagctgccggaaatccgccgcgtgcactggggccgccgcctgcatagcgcgcagccacatcaccgctcgttgttcggcagccgtccgcgcatcgccgcctaa

SEQ ID NO: 3222 - DNA, 345 bp, Chromobacterium substugae
atgcaaaacctgttcaccaccccccgcaatcagcagctgtatcagctgtccatcatctgcccatcgatgtcgctgggcgccgccagacgcgaaatccgcaccctggcgcaaaaacacggcttgcgcattcagcaatggcaggagcagccgcagccggccgcgcgggaaagccgccatacgctgacgccctggctgatctgcgccgatttccgctgcggctccgaggcctgcatgcatttcctgcagggcatcgcccagcggctggccaccatgccgcttacccgggtcaagctggattgcctgtcgctgccgccaagcggcatgcggcgtccagccagcgcctga

SEQ ID NO: 3223 - DNA, 2742 bp, Chromobacterium substugae
atgaccaaacacaacacccaacgcagcaagaaccgcggcttcatcgccaccccgggaaaacggcaggacaaagtcgccttccgcttggccgacgaagcccggctgccgctggaagacaccttcaagcgggtgcgcagccagccggacggcctctccgcgatggaggccgcgcagcggctgcagcaatacggccgcaatgaagtggcgcacgacaagccgccgcacccgctggttcagctattcctcgcgttcaagaatcctttcgtgatggtgctgatcgtgctgggcgtcatcagctacgtgatggacatcgccatggcgccgccggacgaccaggattggaccaaggtcatcatcctgtccgccatgatcgccatcagcggcctgctgcgcttctggcaggaattccgctcggccaaggcggcggaaaagctcaagtcgctggtgcgcaacaccgccaccgtgcagcgccgccccgccggccccaatccgccgctgcgtctggaggtgccgatgtcggaactggtggtgggcgacgtcatccatctgcaggctggcgacatgattccggccgatatccgcttgctggaatcgcgcgacctgttcatcagccaggccgtgctcaccggcgaagcgctgccggtggagaagtacgacacgctgggggcggtggccgccaagtcggccgagcgggacgccagccacgccgacgacctgctggacctgcccaatgcctgcttcatgggcaccaatgtggtgtccggcaccgcccgcgcgctggtggtcgccaccggggccgatacctatttcggctcgctggcgcgcaatgtggtcagccacaagcgcatcgaaaccagcttcgacaagggcgtcaacagcgtgtcctggctgctgatccgcttcatgctggtgatggtgcccatcgtgttcatgatcaacggcgtcaccaaaggcgactggatgtccgccctcaccttcgcgctggcggtggccgtgggcctgactccggaaatgctgccgatgatagtctccgccaacctggccaagggcgcggtggcgatggcgcggcgcaaggtggtggtgaagcggctgaacgcggtgcagaacttcggcgcgatggacgtgctgtgcaccgacaagaccggcacgctgacccaggacaagatcatcctggagcaccattacgacatccatggccgcaaggatgaaagcatcctgcaactggcctggctcaacagcttccaccagagcggcatgaaaaacctgatggacatcgccgtagtggagcatgccgacgagctgggcgaccgcatcaagctgcggcagtacgccaaagtggacgagctgccgttcgatttcgagcgtcgccgcctgtcggtgatcgtggaagacggcggacagcaattgatggtatccaaaggcgcggtggaggaaatgctggctgtctgcagccatatccgcgatggcggcgaaacccgcgcgctgaatgccgaagaacgcgccgccctgctgcgccgcagcgaggaatacaatgccgaaggctaccgcgtgctggtggtggccacccgcgacattcccgccgccgagcaaaaacgcagctaccgcaccgccgacgaacagggcctggtggtgcgcggcttcctcaccttcttcgatccgccgaaggactccgccgcgccggccatccgcgcgctgaaggaatacggcgtggcggtgaaggtgctgaccggcgacaaccccatcgtcaccgccaaggtgtgccgcgatgtcggcctcagccccggcctgccgctgatcggcaaggaaatcgaggcgatggacgacgtggcgctgtgcaccgcggtcaagcacaccaccatcttcgccaagctgacgccgctgcaaaaatcgcgggtggtgaaggcgctgcaagccaacggccacaccgtcggcttcctcggcgacggcatcaacgacgcgccggcgctgcgcgacgccgacgtcggcatctcggtggacagcggcgccgacatcgccaaggaaaccgccgacatcatcctcttggaaaagagcctgatggtgctggaagaaggcgtgatcaagggccgcgaaaccttcggcaacatcctcaaatacctgaacatgaccgccagctccaacttcggcaatgtgttctcggtgctggtggcttcggcctggctgccatgggagcctatgctggcgatgcagctgttgctgcagaacctgatctacgatctgtcgcagatgttcctgccatgggacaagatggacccggaattcctgaaaaaaccgcgcaaatgggaagccggcaacatcaagcgcttcatgctgtggctcggccccacctcttcggtgttcgacatcaccacctacatcctgctgtggacggtgttcggcgccggcgcggcctaccatctgcacggcggcgacggcggccagctgatcatgaacaccggttggttcatggaagggctgatctcgcagacgctggtggtgcacatgctgcgcacccgcaagattccgttcctgcaaagcacggcgtcgctgccggtgctgctgtccaccagcgtggccatcgccatcgcctgctatctgccgttctcgcccatcgccgcctcgctgggcttcatccagctggacgccagctacttctggtggctgctgctgaccatggccggctacctggcgctgacgcagacggtgaagaccatctacatcaagcgttacggccagtggttctaa

SEQ ID NO: 3224 - DNA, 1908 bp, Chromobacterium substugae
atggatgagacaagcggccagaaacgctgggcccgggactatgtgttcgacatcctgagccagctgggcatacaccggattttcggcgtgccgggcaccaacgaaattcccatcatcgacggcacctcctacccggaaaaccgggtggagtacatcgaatgcctgcatgagaacatcgccatcggcgcggcgatgggctcggcgcggatgaccggcaagcccggcgtgctggtggtgcacgtcacccccggcatcgcccacagcataggcaacctgttcaatgcctggcgttcgcaagcgccgctggtcatcctgtgctgccagcagcagaacgaactggtcacccaggaaccgctgctggcgtccaacctggtggacctggcgcgccaatacaccaagtgggcgcacgaagtgcgcaccgagcaggagttcccgatggtgttgcaacgggcgttcaaggaggcgatggcgccgcccaacggcccggtgttcgtcgccataccgtgggaattcaccatgcgccgcatcggaggcgacgaccgcatcaagggcgtgaccaagatttcgccgcacttcaccgccgacccgcaggcgatagaacaggccgccaaactgctgcgcgaagccaagaaccccatcatcgtcgctggcgacgccgccggctacgcccaggcctggcccgaactgcagcggatggccgaactgctgggcgcgccggtgctgcagcaaaccttcagcagcctggccaacttccccaacaacgattaccactggcaaggcgaattgcccggcagccaggccggcgtgcagcaagtgttcaaggaccacgatgtcgccttcctgtgcggcttcagcaaccaggcgcaaatcaccgtctacaagtacagcgacggcccgctgattccgccgcacgtcacccaggtctatctcagcaacaacacctgggacataggcaagaactactacggcgaagcggcattgttcggcgacctgaaagccacgctgccgttgatcaaccagttgataggcagccagccctcggccgccgccgccgcgcgcaatcagcaactgcgggaattcgccgtcaagcgcgccgcggattgggaggtttacctgcgcgaagcgatgcatcagaacgaaatctgggcggtggtgatcgccgacgcgctgcgcaaggaaatcggcgaacgcaaactggagaagcaattcgtctacgtgcatgaagcggtgtccgacccggcgccgttccagttcctgctgccgttcaccgaccaggcggcgcagccgatcagctactactgcgtcggcggcggctcgctcggctggtcgatgccggccacgctgggcatcaagctggagcaggacggctaccagggcatagacacccgcttcgtggtggccgccaccggcgacggctcctcactgttctatccgcaaacctggtggaccgcgcagcaccgcaagctgggcgtgctctacatcatcaccaacaaccacgaataccacacgctgcagatggggctgacccaggtggaaagcatctacggcgaagcgcccggctatgagtggacggcgaagacccaggacccggaatacctgcgcatccatcgccccaaaccggacttcgtcacgctggccaagtcgttcggcggcatggagggcgaaatcgtccgccatccggaagacgtgcgcgcggcggtgcggcgcggcatagaccatgtgctcagcggccaggcctatgtgctggacatgcataccgtgggcctggaccagcccacgcccgacctgcagccctccaacgcccgctatgagaaacagccgcggctggactgcgtccacttcagcagcgaagacggcctgcgcgcggcgtcggccggccagccgggcaatgtgccggtgatcttctga

SEQ ID NO: 3225 - DNA, 1599 bp, Chromobacterium substugae
atggcagacgaaaatctggacatcgccatcgtcggcggcggcgtatccggcgtttacagcgcctggcggctgaaacaggagcggccgaacgacaagatcgcggtgttcgaagccagcaaccacatcggcggccggctgttgtcggtgcggccgccggacattccggacatggtggccgaactgggcggcatgcgcatcctgccggcggtgcagccgctgatcacccggctgatcgccgacctcaaccgcgaattgccggccgatcagcagatcacgctgtacaacttcccggtggatgaaccgcagaacatcgccttcctgcgcggcgtctacctgcggctggccgatttgacccacgcgccggacaaggtgccctaccagctgaatttcctggaccacggcgaaagcgccggcagcctgatcgtcaacgcgatcgaacagatcgtgcccggcatcaccaacccgaacctcaacgaggcgcagcgccgcgaaatggcgcagcaggccgaattcggcggcataccgctgtacaagcagggcttctggaacgtgctgctgcgcgtgatcaccggcgaagcctaccactacgccgaagatgtcggcggctatgactccacgctgtgcaactggaacgccgccgacgccattccctggtatctgtccgacttcggcgtcagcccggaatacaagggcttctgcaacggcttccagcaggtgccgctgacgctggcgcaattcttccagcagctgggcggcgaagtgcggctggagtccagcgtttccaatatcgtcagcaagggcgaaggcttcgagttccaggtcaagggccgcaccatcgccgccaaatcgctgatcctggcgatgccgcgccgctcgctggagctgctgtccgccaccagcccggtgctgcaggaaatccagccgctgatcgccagcgtgacggcgcgcccgctgttcaagctgttcaccacctacaacagcccgtggtggctcaataccggctactccgctcccgacggcagctatgtgccggtgcaggcaggccgctcggtcaccgaccttccggtgcggcaaacctattactggccgaagagcaacggcgagccggccacccagggccacgccatgctgctggccagctacgacgacggcgacaacaccggcttctgggacggcctgcgcgccaggcgccgccagccgcgcgccgtcggcctggacgtggcgccgctggccgaccccttcatcggcgaagacgacaatgtgcgcaacgacgagctgacctggcaccagtacaaggcgccgcgcctgatgactgaagaagtcacccgccagctcaccgtgatgcacagcctcagctacacgcccaaggtgcgcaacgccgcctaccgcgactggggcgacgatccgtacggcggcggctggaacagctggaacatcggcgtgaagagctgggaagtgaagcaccgcatcgtgcagccgaccgatctgccgctgtacatctgcggcgaagcgtattccgacgcccaaggctgggtggaaggcgcgctgcaaactgccggctatctgctggaaaagttcggcgtgctgccattccactag

SEQ ID NO: 3226 - DNA, 1098 bp, Chromobacterium substugae
atgtacgaaatgaaaaagactctgatcgccctggcggtagccaccctgccggcagctgcttttgctgatgtgaccatctacggccaaatcaaggctggcgttgaaaatgttgatgccggcggcatgaacaaaaccaatatcgacgacctgggctcccgcatcggtttcaagggcagcgaagatctgggcaacggcctgaaagccatctggcaggttgaaagcggcctggatatcgacggctccaaccgccaaggctacggcagcttcgccagccgcgaatccttcatcggtctggataccggtttcggcaaggtgcgtctgggtaacatctccaccttcagcgactccaacatgagcgtcgtgaacccgtgggaaagctccagcaacgcgctgcaactgaacgccttcacccgcgacgacatccgcgtgaagaacgccatccgcttcgacaccgccaactacggcggcttccagggcgccctgctgtacggcaccaaggaagtgaagaacggcaccttcgccaatgcgaacaccgactccgctcagcgcgagacctacaacctgggtctgtcgtacgagaacagcggcttcttcggcaagtaccagtacatccatgagaccccggttgtggtgaccgtggctggtgccggcgtgaagacccaggccaacgacagccaccgtctggaagccggctacaacgccaacaacctgctgctggccgttggctatcgcaacgaccgcggcgacagcaccatcagcccgctgagcttcctgaaggacgcgaacgttccgaccaacggcagcaagtacaagtcgcaggaatacgcgctgaccgccgcctacaccctgggcgccttcacgccgaagttctcctacgctcaaggccaggacgtcaagatcgacggcgcctcctccccggatagcggctacaagcaattcctggtgggcgttgactaccagatgtccaagcgcaccgtggttggtctgcaatacggcgaagtcaaggctgaccaggccatcttctccaacgcagccgatggctccagcgccggcaacaagctgcgtggtctgggcctgaacatggttcactccttctaa

SEQ ID NO: 3227 - DNA, 1464 bp, Chromobacterium substugae
atgaggcgcctgcctcgcaccctgtacggccagttgctgctgacgctgctgaccagcgtgctgctggccaacgtgataggcatagggctggtgctgaccgaccgcgagcgcctgacccgcactttgcgcgcggagtacgtcgcccagcacctggccgacatgatcaatctgttggacgaaacttcggcgtccaaccgccccaagctggccagcgcgctcacttctccgtccgcccaggtgctgctggaccacccctgggtggaaaaccgccagtccgatctgcctgaagccagcaagctgtgccagctgatccgcaccgatctcaatttcccctaccgcatgcaagtgctgtccttccgcgaggacacgcccgacgcggccgaggacctgctgcggcctttcctggagcccggccagcacgtgttcaccgccggcaagcagttttgggtgcgtgccttgcccagcaagcgggaggatggcgaggaggagctgaaaatccagatggccaccgtgcaggtgaagctccgcgacggcgcggtggcgaccttccgcatcggccagatcgcctcggcggtggagacgccatggcgggtgaccgcctggctgctgctggtggcgctggtggtggcgggcgtatcggcctgggcggtgcgccggctgacccgcccgctggcggtattctcgcaggcggcttccggcctggcggccaatctggaccagccgccgttgccggaaaccggcaccctggaggtggtgaactccacccgtgccttcaaccgcatgcagaaggaattgcagcgctatctgcagacccgcagccagatgctggccggcgtgtcgcacgacctgcggctgcccatcacccgcatccggctgcggctggagcaactggatgagtcgccggctcgccaggcgatagagcgcgatctggaagacatggaccaactgataggcgacacgctggcctatctgcgcatggggcagcgcagcgagacctgcgtgctgctcaatgtggacgggatgctgcaaggggtgatcgaggatgtcgaagcgctgggcgcggaggtggtttaccgccccgagccggtgaagccgctgtgcgccaggccgcaagccctgcggcgctgcatcgccaatctgttggagaacgcccgccgctatggcagcgggccgatcgaggtgcgtttgcgcgagcgggagggccggctggcgatccaggtgcgagatcacggcccgggcatcgccgataaagacctggaacgggtgttcgagccctacgtcaggctggaggactcccgggcgcgccacaccggcgggagcggactgggcctggcgatcgcccgcgccatcgcgcgcgagcaccatggcgacatccaattgtccaatcatcccgagggcggtttgtgcgccgagctcagctttccggcggagcgcagccagtgcgtgccgcttaacactatttga

SEQ ID NO: 3228 - DNA, 714 bp, Chromobacterium substugae
atgtcccaagcgtcccgtttgcttatcgttgatgacgatcccgatctgcgcgatctgctgagcgattatctgagccgccagggcatggtcgtggccgcggtgggggatggcgacgcgatgaaccgcatcctggccgaacaatccttcgacatcctgatcctggacctgatgctgcccggcaccgacggcctgaccctgtgccgcgacctgcgctcgcgttccagcattcccatcctgatgctgaccgcgcgcggcgacgagctggaccgcatcatcggcctggagatgggcgccgacgactacctgcccaagcccttcaacccgcgcgagttgctggcgcgagtgcgcagcatcctgcgccgggtggaggagaagcgcagcaacagcgccttgcgcagcctgcagttcgccgagtggcggctggagctgggcgcgcagcacctggtggacagcggcggcgtggtgacgcccctgtccggcggcgaattcaagctgatgcaggcgctggcggaaaatccgcagcgggtgatgtcgcgcgaccagttgatggaagcgatgaacggcaaggaagccgggccgttcgaccgcaccgtcgacgtaatgataggccggctgcgccgccgcctgggcgacgacgcccgcgagccgctgctgatcaagaccatacgcagcggcggctacatgctggcatgcgaggtggtatcggtgcgatga

SEQ ID NO: 3229 - DNA, 993 bp, Chromobacterium substugae
gtgatcgagtttttgctttccccggcgctgggctacccgctgtgggtgtggctgatgttcctggcgggcgtgctggcgctgctggctttcgacctgggcgtgctgcagaaggacggccgcgaaatcggcgtcaaggccagcctgaagttgtcggctttttacatcggcatcggcctgttgttcggctgctgggtgtggtggtatcgcggcgcggacgccggcgtgcagtactttaccggctatgtgctggagaagtcgctgtcgctggacaatgtgttcgtgatctcgttgatcttctccagcatggcggtgccgcgcgcctatcagcatagggtgctgttctgggggatattgggcgccatcgcgatgcgcgcgctgatgataggcgccggcgcggcgctggtggccgaattccagtgggtgctgctgctgttcggcgccttcctgctgtgggccggcctgaaaatgctgtttagcggcgacgacgcggccacgccgcttgccgagcagaagttttaccagtggctgcgccgccatatgcgcctgacgcccgggctgcacggcaacgccttcctgctgcgcggcgaaaagcacggcatggcgcgcggctggtgggcgacgccgctgctgctgacgctgatcctggtggagtcggccgacctggtgttcgcggtggacagcatcccggccatcttcgcggtgacgcaggatccgtttctggtctacacctccaacatcttcgccatcctgggcctgcgcgcgctgtatttcgcgctggcggcgatggtgcatcgcttccactacctgaagtacgcgctggcgctggtgctggtgctgataggcgtgaaggtggggctggtgtatctgcacgacgtcggcctggtggcgttcaagctgcccacgctgctgtcgctgttgttgaccgtgctgctgctggctggcggcatcggctattcctggcataaaacccggcgcgatccggcgcagtcctga

SEQ ID NO: 3230 - DNA, 882 bp, Chromobacterium substugae
atgaaacgggtgatcttgctgattgccaccaacatcgcggtgatgctggtgttgagcgtgagcgtgcgcctattgggactggaccgctttatcaccgccggcgggctgaatctgggcatgctgttgatgttttccgcggtgctgggcttcggcggcgccttcatttcgctggccttgtccaagaccatggccaagtggagcaccggcgcgcgggtgattacccagcccaaaggccagaccgaggcctggctgttggccaccgtgcgccggctggccgaccgcgccggcctgcccatgcctgaggtggcgatctatgagggcgagcccaatgccttcgccaccggccccagccgcgccaattcgctggtggcggtgtccaccggcctgctgtcgggcatgaccgaggaagaggtggaggcggtgctggcgcacgagatcgcccacatccgcaacggcgacatggtgacgctgacgctgatccagggcgtggtcaacaccttcgtctacttcctggcgcgggtggtcggctacctggtggacagctggctcaagcgcgatgaggaaaacgccgcggccggcaccggcatcggctatttcatcaccgtgatcgtctgcgagatcgcgttcggcatcctggcctcggtggtggtgatgtacttctcgcgccagcgcgagtttcgcgccgacgccggcgccgccgaactgctgggctccacccggccgatggccgacgcgctgcgccgcctgggcggcatcgaggccgacggcctgccgcaaagcctggccgcgtccggcatcgcgggcggccgcggcctgttggggctgttcgccacccacccgagcctggaagagcgcatcgccaggctggaaggccgcgcctga

SEQ ID NO: 3231 - DNA, 882 bp, Chromobacterium substugae
gtggaaaagctcaactacaagcatctgtactatttctgggcggtggcgcgcaccggcagcgtcacccaggcggcggagcagctgggcatcagcatgcagaccatcagcggccaggtggccaagctggagcagcagctcggctgcgcgctgttccgccagcagggacgcggcctggcgctgaccgaggccgggcgcaccgcgcagggctacgccgaccagatcttcatgctgggcgaggcgctgggcgaagcgctggccgacgcgcggctggatcaggcggtgcggcttgccgccggcgtgtccgacgtgctgcccaaacgcatcgccagccatttgctgcggccggcgctgcaaatgggccgcaagctgcggctaagctgcagcgagggcgacttcgacgagctgctgggcgacctgggccggcatcggctggacctgatcctggccgaccgaccgatagccagcagcgagcagcagcaattccaatcctggctgctgctgcgctgcccggtgctgctgtacgccgcgcccgaactgtgccggcgctaccgcccggagtttccagccagcctggagcaagcgccgctgctgctgcccagccgcgacaacgtgctgcgccggcagctggaccactggctggaatcgcaaggattgagggtggaggtggccggcgagttcgacgacggcgcgctgatggaaaccttcgcccgccagggcctgggcctgctgccgtcgccggcgctgccggacgcggcgcaggatctgtcggggctggaactggtgggctgcctggacggcgtgtgggagcactattatgcggtggccagccgccgcaagctgcagcacccggcgctgcaggccatcctgcaggcctggggctga

SEQ ID NO: 3232 - DNA, 558 bp, Chromobacterium substugae
atgcaccccgacaacggcttcaccctgctggagctgctggtcgtcatggccctgctggcggtggtgctggcgctggcggtgccggcttatcagagcaccatcgccgtcaacgccatcctgtcggaaagcaacaatctctacggcgacatcctgttcgcccgcaacgaggcgatcaagcgcggccaggtggtgctgctgtgcccgtccagcaacggcagcagctgcaatgccgccagcgccggcggcgccaactgggcttcgggctggctggtgctggtggcggccaccggcagctgcgccgacagcaccggcaccctgctgcgccagcaaaaagccttcaccagcggcgacaccgccaactacagcaacagcgccaatcccgcgctgtgcttcaaccgcatgggctacgcgccggcggccaatgtcggcatggtcaccttcaacacctcgtccggcctcgcggccgaccgccgctgcgtggcgctggcggcggtcggccatccgcagatcctgtccagcggccagaccgacaccacgggacaatacgcatgtccgtga

SEQ ID NO: 3233 - DNA, 543 bp, Chromobacterium substugae
gtgaaccgcgccgccgcccatgccggcttcagcatgctggaagtgctggtcgcgctggtagtgatctcgctgggcctgctcggcatcgccggcatgcaggccgccgccatcaacaacaccgccatcgcgcgcacccgcagcctgggctcgatcgccgccgaaagcatggccgccgccatgcatgccaacaccgcctactggggcaacttgtccgccgccgccagcaacacctggtcggtcaacgccagcggcgtgaccggcacccccagcctgagccagaccgtggactgctcggcctcgggcaccgcctgcagcgccgccaacatcgccgcctacgacgtcacccagtggggcggcaacggcggctcgctggccaccctgcccggcggcagcggccagatcgcctgcgccgccgccagcgcgtcctcgcccaccgcgtgcacgatcacggtttcctggctggagaagaaaagcgcggtcaacgccgcctcggtcgcctccggggtcgccatccagagctatcaaatggtggtggagccatga

SEQ ID NO: 3234 - DNA, 684 bp, Chromobacterium substugae
atgagccgccgcgccgggcaaggcggcagcggcctgatagaagtcatggtggccatcaccatcggcctgttcctgctgagcatgctgatcatgatcttcacctccaccgaattgacggaaagcaacgaaaacggcctggcccaactgcaagacaaccagcgtacggcgatgacgatgatcaacgccatcgtccagtcggccggctactaccccagcccgcaatcgcagaccgccgccgccgcgctgcccgcggcgggcggcttcggcgcgggccagtccattctgggcgtcagcggtccgcctgacacgctgagcgtgcgcttcgccgccgcgcccaacgacggcgtgctcaattgcaacggcaacggcaacaccggcagcgccaacgccgtctacatcaatcagttcgccgtcaacgccgccaaccagctgacctgctcggtcaacggcggtagcgcccaagtgctggtggacggcgtcagcaatatgaccgtgctgtatggcgtggacggcagcggcagcggctcggtcaaccactactacagcgccgccaacctgcccgccggcgccgccgtgcgctcgatccaggtgacgctgaccatggccaatcctctggccgccaaaccgggccagccggccagcgtgaccatgtcctggctgataggcctgatgaaccagctatga

SEQ ID NO: 3235 - DNA, 552 bp, Chromobacterium substugae
atgaacgccgccgccctccgccccgcccgccagtctggcttcacgctgatcgccgcgctgatgatcctgatcgtcatcaccatcatcggcctggccatgatgcgcagcgtcggcctgcaagagcggatggccggcaatatgcgcgagaagggccgcgccttcgaagccgcgcaatcggcgctgcaatacgccgaatggtggctgacccagggcagcaacgccggcggcgccgccgtcagctgcagcggcgccttgagttcgctgcagatctgcagcaacgcgctggcgacgccgaccacgctgtcgtcgtgggccaccagctacacctattcgccgccctacctgagcgtgccggccaacggcgcggccggcggcagccaaaccttctaccagccgccgcagctttatctccaatacctgggcctgaacgccgccggcaacggcgccctgtaccagctgaccgcgctgggctacggcggcaacgcctattccatcgtggtgctgcaaagcacgttcacgctgtactccggcgtcaccaacctggggaaatga

SEQ ID NO: 3236 - DNA, 3288 bp, Chromobacterium substugae
atgagccctctgccgcgcccctccctgccccttgcctgcctgctggccgcggcgctgtggcccgccgcctgcggcgccgtcacagtcggcgacaacttcaccggcgccagcgcccaattgaattggctggtattcggcggcgcctgcatgactgccggcaacggcagcggcagcattcccgcctgcggcagcaaggaccccagcggcaacacccaagtgggcggctacgccggctcgctgccggacagcaacggcaacggcgcgctgcggctgaccaacagcgccggcagccagtccggcgccatcgtctacaacagcctgtttccatccaatagcggcctgcaggccaccttcaccagctacacctacgccggcgactcgggcggctcggcgggcgacggcgccgacggcatgagctttttcctgctcacagccatccccagcgccgtcggctccttcggcggcagcctgggttacagctgctccaacgtcaactctccgtacaacggcatcatcggcggctatctcggcctggggctggacgagtacggcaatttccccaacggcggctacaacaacgacaacacctcgtccggccccggcgccaagccgcagaacatctcgctgcgcggcgccggttcggtggccgccagcgcgctggccagccagttcggcggcagcttcagcgcgtcggcggtgcaaaacgtgtgccgcaacggcagctacgccggccacagcgtgatgaactacccgttcatcaacatccccggcgccagcggcggcgtctaccagttgccgggctcccagccgatggcggcggaatcggccgccacccgcggccaggcagtgccgatcagctacaagctgaaaatcaccaccggcaacctgctcagcctctggtacagctacaacaacggcgcctacgtgccggtgatcaacaactacgacatcaacaacaccgcggtcagcggcccgctgcccagccagatcaccttcggcttcgccggctccaccggcggcagccgcaatgtgcacgagctgacctgcttccaggtgcagccatccacccagtcggccagctccagcggcctgaacagccagcaaaccagcctgatcaagaccggcactcagcaatacgtcgccagctaccactccgacaactggtggggtgaggtggcgtcctacgcgctgctgggcaatagcggcaccggccaagtgaccgtgtcctccaccgccacctgggacgcctcctgcgtgctcaccggcggcaactgcagcgccaccggcgccagcaatatgagcgcgcagagcagccgcgccatcctcagttggaacggcagccagggcatccccttccagtggaccagcctgtcctccgcccagcaaaccgcgctcagccccgacggcaacggctcggcgcgggtctcctacctgcgcggcgcgcgcggcaacgaagtcaccacactgggcgccggcctgttccgcgaccgcgacagcgtgctgggcgacgtggtcaacagcagcccgatctgggtgggggcgccgcagaacagctatgccgacgcctggaaggacaagctctacccctcagcctctgttgccgaaaacgccaccggcgcgcaggcctacagcaatttcaagtccagcaaccagacccgggccaacatcatctacaacggcagcaacgatggcatgctgcacggctaccgcagcggcgccaacgacgccagcggcaactactccaccgcggccacgcccaacgacggccaggaagtcatcgcctacctgcccgccgccgcccaggccaacaccgttcagtacagcaatcccacctatgcccaccagtatttcgtcgacgccacgccggccgccgacgacctgttctacaacagcaactggcatacctggctgatgggcggcatgggcgccggcggccaggcgctctacctgctggacgtcaccaaccctgccaacttcgcggaaagcaacgccgccagcctggtggtcaaggagatcagcagcgccaccctcagctgcgtcaacaaaagcagctgcggcagcgacctgggctacaccttcggcacgccggtgatcacgcgcttccacaacggccagtggggcgcggtgttcggcaacggctacaacagcggcaacggccacgcggcgatcttcgtcatgctggtgaacggcagcggcgtccccagcttctacgagctggacaccggcagcggcagcgccaacgacccctccggcggcggcaacaaaaacggcatttactacgccaccgcggtcgatcttgacggcgacggcaccaccgactacgtctatgccggcgacctgttcggcaatgtctggcgcttcgacctcaccagcaacagccccggcagctgggccgtctcccagtacggcaccggcgccgccgcgccgctgttcaccagccagtacacctattgcaacgccactcaggccgccaacggcagctgcacccgcagcctgcagccgatcagcagcaagctgctggtatcggccattcccaccggcaattccagcccgcgcgtgctggtggccttcggcaccggccagaaaatccccttcaccacttcggccgccgacatctacgccggcggcacgcaaagcctgtacggcgtctgggactgggacatgtccggctggaacacgctggcgggacagtcggcctattaccccgccgccgcggccgccattcccgccagcgcgctgcgccccgccaacctcaccgcccagaccgtcaccgcctcgtacaactccaccctgagcagcgtgcaaggctaccgctcgctgtccagcaacaccgtctgctggcaaggcaacagcgcctgcgcggtcaacaccaataccagctacggctggaagctcagcctgccctccagcggcgagcaggtggtgtacaacccggtcaacgagctgggcaccttcaccgtcaacaccaccatcccgcccaacaacaacgcctcgtcctgcaccgtggcctcggccaccagcttctcgatgtcgctcaatatgaaaaccggcggcgccacccggctgtccttctacgccaacgaccagggcaatttcaacggcatcagcggcagcgtgatcaacggcatcgccatcaatatggccggcagcccgaatgtggtcagctaccagaacaactttttcgcaatcggcagcagcaccaacggcggcccgatcgccaccccgccgcagatcaacccggcggccttcgatctgcatacccgcttgaactggatagaattgcgctga

SEQ ID NO: 3237 - DNA, 435 bp, Chromobacterium substugae
atgcctagccgccgcgcccgacagggcttcaccatgctggaactggtcatcgcgctggcggtgctgtccatcctggtggccatcgccctgccgtcgtaccgcgccttcatcctgcaatccaaccgcacctcggccaaaaccgcgctgcaggacctggccacccgcgaggaaagctattactcgctgcagaacacctacgccagccagctcgccacgctgggctacgccagcaacaccgtctacgtgcccggcaacggcaacaactattacgcgctgaccataggcagcgccaccgccagcagcttcgcgctgaccgccgtcccgcagggccagcaggcgcaggacagctgccagacctaccagctggacaatctgggcaaccagagcaacctcgccgccaacggcgcctcgctcagcgtcagcggctgctggtag

SEQ ID NO: 3238 - DNA, 261 bp, Chromobacterium substugae
atgtctgatctgcagacgcttttcacccaggcccaggccgacgtcaaaaccctgtccgaacgtccggacaaccagaccctgctgcagctgtacgcgctgttcaagcaggcgaccgaaggcgacgccaccggcgagcgcccgggcatgatggacttcatcaaccgcgccaagttcgatgcctgggaaaagctgaaaggccaatccgccgacgacgcgaagcaaggctatgtcgacgtggtgaaacgcctgctggcggagtaa

SEQ ID NO: 3239 - DNA, 585 bp, Chromobacterium substugae
atgaaatttcgtccctggagcctggccgagcgcgggttgctggcgctgtggctgtcgctgctgctgcacgccgcgctgttgtggctgccggcgcggctgggccagccggcggcgcatgcaggcctccttgtgcggctggcgatgccggcggcggccccggcgcggcctgccgcgctcccaggcgcgaggccggcctctgccgccggcggcgaagcatcggccccggccggcgccgcgccgcgcgaggcggacggcaggctgcggctgggggcggacatctactacccggcccgcgaactggaccaactggcgcaggagcagggcgcgatcacgctgcctgacgtcgaactggatggccaggcgccgccggcgctgaccgtgctggtgttcatcagcgaaaccggacgggtggacggcgtgcgcttcgaaggcgcggcgccggcccggctggccgacgccatttccccggtcttcggcgcggccagttatcagccggcgctgaaggacggcgtgccggtgaaaagctacaagcggatccggatcgagccgcagccggccgcggccttgccgccactgtcgcattga

SEQ ID NO: 3240 - DNA, 735 bp, Chromobacterium substugae
atgaagacaagattgaagtcgctggcgctggccagcgggatgctgatgtcgctggccgcctgctctcaggccgccggcggcaatctcgacgcggtgaagaaggccttcgccgagcatttcccggacaaggaagtgaagagcgtcagcgccacgccggtcaagggcatctatgagttggtggtgggcggcaagcaggtggtgtacaccaatagcgacgccagctacctgttcgtcggcgacttgatcgacaccaagaccaaggaaagcctcaccgagaagaagatggccgaactgtccaaggtcgacttcaactcgctgccgttccagtacgcgttcaaggacgtgcgcggcaagggcgaacgcaagatggcggttttcaccgacccggactgcccgtactgcaagaagctggagcgcgaaagcctgaaggatgtcgacaacgttaccatctacaccttcctgtacccgctgacccagctgcacccggacgcgatgcgcaagtccaagcaaatctggtgcgccagcgacaagccggcggtgtggaccgccttcatgcgcgatggcaagccgctgaccggcccggacaattgcgataccagcgcgctggacaagatccaggcgctgggcgagaagctgggcgtcaccggcacgccggcgctggtgttcgccaacggccggctggtgccgggcgcgatagacggcagcgacatcgaacagctgctgaacgccaagtaa

SEQ ID NO: 3241 - DNA, 1149 bp, Chromobacterium substugae
atgcgagacagtcaataccacgcgattatcgtcggcggcggcctggtgggcgccagcctggcgctggcgctggcgcgcgccggcaagcgggtggccctgctggaggcccgcccgccgtccttcgacgggctggattccggctgggacgcgcgcatctacgcggtgagtccggccaatcgccgcttcctggaaagcctgggcgcctggcccggcatggagcggataagcgccatcgccgcgatggacgtttgcggcgatgccggcgggcgcatccagttttccgcgcgcgacgccgatgccgacgccttggcctggatcgcggaaaaccgctggctgctggcggcgctgtggcggcagctggccgatagcgatgtcgactgcctccatggcggcgcgcaatcgctcgccaccaccgcgagcgaggcgcggctggcgctggatgacggccggcagctgagcgccgagctattggttggcgccgacggcgccaattcctgggtgcgcagccaactgggcctcgccgccagcgtcaaaccgtacggccagagcggcgtggtggccaacttcgcctgcgaaaagccgcaccagggcgtggcgcggcagtggttcaccggcgacagcatcctggcctggctgccgatggcggggaaccgaatctccatggtctggtccactcctgacccgcagtctttgctgatcttgtcgccggaggcgctggcggagaaagtcgccgccgctggcggccgtcaactgggcgcgttttccaccctgaccgccgcggcggccttccccttgcggctgatccagccggaggcggtggtgtcggagcgggtggcgttgatcggcgacgccgcgcacaccgtgcacccgctggccggccagggcgtcaacctgggcttccaggacgcggcgcagctggcagacctgctgcgggccgcgcccgactgcggcgactggatgctgctgcgccgctaccagcgccagcgccgcgaagcggtcaccacgatgcaactcggctgtgacagcctgtaccggctgttccatgccaaaatgcccggcctgtcatggctgcgcaataccggcctgtccctgaccaactgctgcgcgccattgaagcggcagttcgccaggcaggcgattggatactga

SEQ ID NO: 3242 - DNA, 1170 bp, Chromobacterium substugae
atgcgagcaagaacgagcgagcacgccgatgtgctgatcgtcggcggcggcccggtgggcgcgctggcggcgctgcggctggcgcggcagggtcgcagcgtgctgctggtcgaggcgcgcggccgcgacgacgcggtgcgcgacgcccgcgcgctggcgctgtcctggcacagccgggagctgctggccgaagccggcgcctggccggacagcctgccggcgacggcgatagacaccgtgcacgtgtcgcagcagggcagctgcggccgcgcccggctggacaaggacgacttgcagttgccgcacctgggcgtggtggtggattacccggcgctggtggccaacctggccgaggtgttgagccaggccggcgtgcaggtgctgtggcgcagccgggtgcggtcggtgagcagcctgcgcgaatacgcctgcgccgaagtggaaacccccgacggcgaacggctgctgaccgcccgcttgctggtgttggccgagggcggcgcgctggccggcgcgctgccgggcgtgcgccggctggagcacgattaccatcaatgcgcggtgttggccgaagtggaaaccgaatggccggccgacggcgtcgcctacgaacgcttcgccgccagcggcccgttcgcgctattgccgcacggcgaccgctacatgctggtctggacgcgcagccacgccgacgccgagcggctgtcgcgcggcgacgaggccgaattgcgcgccgagctgcagcaggccttcggcgagcgccagggccgcatcctgtccatcggcccgcgcgccagcttcccgctggcgctgcgccaggccaacaaggtggtcagcggccgggtggtgctgatcggcaacgccgcccagaccatgcatccggtggcggcccaggggctgaacctgggtctgcgtgacgccgtcggcctggcgcaggcgctggcaggcgaggccgatccgggcgacccgcgggcgctgcggcgctatgccgcggcgcgcaagctggacagccacgcggtggtgggcttcacccacgggctgatcaagctgttcgacggccaccatccattgatgaacactctgcgcggcatgggcatgaccgcgctggacgcgctgccgccgctgcggcgcaaattcgccggccacctggtgttcggcgtgcgaggataa

SEQ ID NO: 3243 - DNA, 1293 bp, Chromobacterium substugae
atgtatcagccgcacgcaactcgccgcaaccgcctgttgtcgaccctcggcgacggcgtcgccctgttggccaccgcgccggaagcgacgcgcaacgccgactgcctctatccttaccgcgccgacagctattttctttacctgaccggctttgccgagccggaggcggtgctgctgctggatggccgcagcggcaagtccatcctgttctgccgcgcgaagaatccggaaatggagatttgggacggcttccgttacggaccggagggcgcgaaagaagctttcggcttcgatgaagcctatgcgctggacgaaatggcgcagcgcattccggacctgctggccgattgccgccaactgtggtggccgctggggcatgacgaggccttcgaccgccgcgtcaacggctggctggacggcgtgcgccgcgcccgcgtcggcacgcatgcgccggcgcattacggcgacctgcgcgcgctgctggacgagatgcggatggtcaaggacgaggccgaaatcgcgctgttgcgccgcgccggcgagatttccgccgccggccacgtcgccgcgatgcggacggtccggcccggccagtacgaatacgaggccgaggcggagctgctgcgcgctttcgtccgccgcggcgcgcgctatccggcctacgagagcatagtcgccggcggcggcaacgcctgcgtgctgcattactcggccaataacgcccgcctgcaagacggcgaactgctgctgatagacgccggctgcgaactggacggctacgccggcgacatcacccgcaccttcccggtgaacggccgcttcagcgcggcgcagcgcgacgtgtacgaggtggtgctggaggccgagctggccggcatcgccgcggtgcggccgggcgcgccatggaacgcgccggccgacgccgcgctccgggtgctggcgcagggcatgctggacctgggcctgttggcgggcagcgtggacggagtgattgaatccggcgactaccgccgcttctacatgcacggcatcggccacatgatagggctggacgtgcacgacgtcggccagcgcaagcagaatggccagtggcgcaactaccagccgggaatgtgcaccacggtggagccgggcctgtacatccggccggcgccggatgtgccggaggccttccacaacatcggcatccgcatcgaggacgatgtgctggtgacggcggacggcaatgaggtgtataccgccgccgcgcccaagcgggtggacgagatcgaggcgctgatgcgcggagagtga

SEQ ID NO: 3244 - DNA, 123 bp, Chromobacterium substugae
gtgcggctgatacatgttcggcttctccgcggcgtgggcgcggccatggcaaaaacgccagtttacaccctggccggcaagcgcccaagcctgccgctgccgcccgcgacgacgccggcatga

SEQ ID NO: 3245 - DNA, 726 bp, Chromobacterium substugae
atggcaggtcacagtaaatgggctaacatccagcaccgcaagggtcgccaggatgccaaacgtggcaagatcttcacccgcctgatcaaggaaatcaccgtcgccgccaagatgggcgggggcgatgtcaacatgaacccgcgcctgcgcctggcggtggaaaaggccaaggccgagtccatgcccaaggacaacatcgaaaacgcggtcaagcgcggcaccggccagctggaaggcgtcgactatgtcgaatgccgctacgaaggctacggcatcgccggcgcggcggtgatggtggattgcctgaccgacaacaagacccgcaccgtggcagacgtgcgccacgctttctccaagtacggcggcaatatgggcaccgacggctgcgtgtccttccagttcaagcactgcggctacctggtattcgccccgggcgtggacgaggacgcgctgatggacgcggcgctggaagccggcgccgatgacgtggtgagtaacgacgacggctccatcgaggtcatcaccggcccgtacgagttcaccgacatcaaggaagcgctggaagccaagggcttcaaggccgagatgggcgaagtgaccatgcgcgccgagaacgacaccgagctgagcggcgaagacgccgcccgcatgcagaagctgcttgacgcgctggaagacctggacgacgtgcaggaagtctacacttccgccgtgctggacgaataa

SEQ ID NO: 3246 - DNA, 777 bp, Chromobacterium substugae
atgctgacgataagcgacgtacagatcaatgcgctggtcggggccttcgtctggcccttcgcccgcatcgtcgggctgttcctggccgaacccatcttcgcctaccgcggcgtgccgcgcagcttcaaggcgggcttcgcgctgtttctcaccgtgatgctggcgccgctgctgccgccgctgccggcggtgccgctgatttcggcgggcggggtcgccatattgctgcagcagctgctgataggcctggcgatgggcttcgtgatgcgcatcgtgatcaccgcggtggagttgaccggcttcatcatcggcgcgcagaccggcctgggcttcgcgatgttcttcgacccgatccacgccgcccaggtgccggtgctgtcgcagatgctgtcgctgttcacctttttcctgttcctgtccttcgacggccaccacgtggtgctgtacacgctggtggaaagcttccgggtgctgccgataggcatgccgatgccggagcagggcatcaaggcgctggccttgtggggccgccatctggtggaatggggcgtgtggctggcgatgccggtgatcggcgccttgctggtcgtcaacctggccatcggcgtgatgacgcgcgcggcgccgcagttcaacatcttcactttcggcttcccgctcaccatcatggtgggtttcggcaccctgtacctgacgctgccgatgatggtgccggtgatagagcagatgtaccatgccggtttcgaaatgatgctgaagatgctgcaggcgaagtag

SEQ ID NO: 3247 - DNA, 270 bp, Chromobacterium substugae
atgagtccggaactcatcatcagcatcgtgcagaacgcgctgtacatcctgatcatcgtgtcggcgccggtgctgctgacctcgctgctggtgggcttgctggtcagcatcctgcaggcggccacccagatcaacgaaatgacgctcaccttcattcccaagctgctggcgatgttcctggtgctggtgctggcggggccgtggatgctcaatacgctgatcgaatacaccacgcgcctgtttcagagcatacccaacgtgatcggctga

SEQ ID NO: 3248 - DNA, 504 bp, Chromobacterium substugae
atgacggcgatgcggctggaggatttgtctgcggcggatctgcccgcctgccacgccttgttccaggccagcgtgcaggcgctggctggcggcgtctacaccgccgagcaatgccaggcctgggcgccggagcgggcgtgggatgcggagatcgacccgcactggcgcgccaggctcgcagcgtcctggggctgcaaggcgatggccggcgacggccgcctggccggtttcgcctggctcaagcgcggcggcgagttcgacatgctgttcgtcgctccctgggccggacggcaggggctggcggggcggatgctgggcgagctggaagcgcgtgctgcgcgggagggcgtatcggcgctgcacgcctgggccagccatgcggcgcggccggtgttcgagcgggcgggatatcttttgctgcgcgccaaccgcctgcagcgcaacggcgtggcgctggataattggctgctggccaagggcggctggcgggaggaggaggcatga

SEQ ID NO: 3249 - DNA, 753 bp, Chromobacterium substugae
atgaaaaagaatatcgtgatcgccctgctgtccggcggggccttgctgctgcccctgcttgccgacgcggcgggcggcttgccgctgatgaccagcactccgggaccgggcggcgggcagaactattcgctcagcctgcagatgctgctgttcatgacctcgctgactttcatcccggccatgctgctgatgatgacggcgtttacccgcatcgtgatcgtgctgtcgctgctcaggcaggcgctgggcaccacccagtcgccgcctaaccaggtgatagtcggcttggcgctgtttttgaccctgttcgtgatggggcccacgttcgatcaggtgtacagcaaggcctgggtgccgttttccgacgacaagatcaacatcacccaggcgctggacgaggccagcaagccgatgaaggccttcatgctgcgccagacccgcgagaaagacctggccttcttcatcgagatttcgcagtcggccaagccgcagaccaaggaagacgtgtcgatgaagacgctgattcccgccttcgccatcagcgaactgaaaaccgcgttccagatcggcttcatggtgttcatccccttcatgatcatcgacctggtggtggccagcattctgatggcgatgggcatgatgatggtgtcgccggtgaccatttcgctgccgttcaagatgatgctgttcgtgctggtggatggctggacgctgctgatgggctcgctggtgcagagcttctacaccggatga

SEQ ID NO: 3250 - DNA, 474 bp, Chromobacterium substugae
atggacatggcaaaaacatcgaaagtgcgcctggcgctgcggggcgcattttgctttatggcggcggcccccgcgctggccgcgccgcagctggctccggccgcggcggcggccccgtcgccgctggccagcctggtgcaggtgatactgggcctggcggtggtgctgggcgccatcgtcggcgtcgcctggctgttccgccggctgtccggcggcatgatgggtgccgccgggcgcttgcgcgtggtgggcggcgccatggtggggcagaaggagcgggtggtcatcgtcgaactggaaggcgaatggttggtgctgggcgtgaccgccagccaggtgaacctgctgagcaagatgccgcggccggaaggcgcggaccaggccccgcctgagcccgccgaaccattcgcccgctggctgaaggcggcgctggacaagagccgcccgcccaaggggccgcaggacaagcaatga

SEQ ID NO: 3251 - DNA, 444 bp, Chromobacterium substugae
atgagcgaagaagaacagcaagccggcgcggccggcgccgaagaagaagtgtcgatggacgactgggcggccgcgatggccgagcaggaggtggccgaaagcgccgcgcccgccgccgacgaggcggtgccggcgcagaacctgtttcaggagataggcgcgggcgccatctccggcgggccgcccaatctggacatgatcctggacatcccggtgcagctgaccgtggagttggggcggaccaagatcgccatccgcaacctgctgcagctggcgcagggctcggtggtggaactggacggcatggccggcgagccgatggatgtgctggtcaacggctgcctgatcgcccagggcgaggtggtggtggtcaacgacaagttcggcatccgcctgaccgacatcatcaccccggccgagcgcattcgccgtttgcagaaataa

SEQ ID NO: 3252 - DNA, 1005 bp, Chromobacterium substugae
atgggcgacgatatcctgtcccaggaagaggtagacgcgctattacggggcgtctccggggaggacgaagatgatgatggcagtcaggatgcgcagggcgtccgcggttatgatatcggccggcaggaacgcatcgtccgcggccggatgccgaccctcgaaatcatcaacgagcgtttcgcgcgcaatctgcgcatcggcctgttcaacttcctgcgccgcaacgccgaaatctcggtggggccggtgcgggtgcagaaatacagcgaattcatccgcaacctggtggttccgaccaacctcaacctggtgcatgtcaagccgctgcgcggcaccggcctgctgatcttcgatcccgatctggtttttctgatcgtggataatctgttcggcagcgatggccgctatcatgtgcgggtggaggggcgcgatttcacgcccaccgagcagcgcatcatccaccgtctgctggaggtggtgttcaccgaatgccagaaggcctgggagccggtgtatccgatcgagttcgtctacctgcgctcggagatgaacacccagttcgccaacatcgccaccccgaccgaagtggtggtggcgatgactttccacatcgagctgggcgcgggcggcggcgatttccacatctgcctgccgtattcgatggtggagccgatccgcgacctgctgtccagcaccatgcaggccgaccgcaccgaagtggacaaccgctgggtcaacctgatgacccaccaggtgcaggcggccgaagtggagctggtggccagcctggcgcacaccaaggtgacgctggggcagatactgaatttgaagaacggcgatgtggtgatgatagaaatccccgaactggtggaggccgacgtgtcggggattccggtgttcgaggccagctatggcacggtgcagggccgttacgcgttgaaagtggaaaagatactggcaggcgccaatgagttcatggagtcgccgggggataaagagcaatga

SEQ ID NO: 3253 - DNA, 522 bp, Chromobacterium substugae
atgtcggatgataaaaaggcggaaaaagcggaaaaaaaaccaggcgggggcggcaacaaactgatgctgatagtcatcgtgttgttgatcctggttttggccgcagtaggtggcttggctgcctatatgttcaccaatatgggcaaggcgccggcgggagcgcaggccgagcaggtcaaggaaaaaccgaagaagaagcatgacggcccgcccattttcgagaaaatggataccttcgtggtgaatctggccggcaacgacggcagcctgctgcaggtcgacatgcaggccgagcttggcgacgaggaagccaagaagaaattcgccgactatggccccaagatccgcagcgccgtcatcctgctgctgtcgtccaagagcgcggccgaggtcagcaccgccgaaggcaaggtcaagctgaaggcccaggtcaagcagatcatcaacgagtccatggacgcgggcgacgagccggtcgtggacagcgtgctcttcacttccttcatcattcagaagcaataa

SEQ ID NO: 3254 - DNA, 948 bp, Chromobacterium substugae
atgaccatcacggtaaacacgccagtgaccaatgccgcctccgcggccacttccgctcccggcggcgcggcgcccggcgcggcaggcaacggcgcggccagcgatctgttcgccagcctgctgggcatccagatgagcgcgatgggctcgacgctgcccggcatcagcgaccaaggcgacgccaagcccgccagcgacaagccggcggccaaggacgagtcggacggcggcgatgtgccggccgccgcggcgatgccgctgctcgccgcgctgcaggccagcctgcaggcgcagccgcagccggtggatagcaaggccgccaatcaggatctgctggcgcagcaagcggccagcaagcccgatttgacggccttgctgcaggcgaagccggcattcaattggcaaggcaaccagcaaaaattgccggccgccgacgcggatgcggcgcaattcttgccgctgcagcaattgcagccgcaacagcagttgcaaaacgtccaggcgcagaccaatgccaatatgccggtgctgaccctgccgcaaacgctgaacgacccggcctggggcaaggcgctgggcgagcagatgctgagcatggtcaacatgaaggccgacaaggcgcaaatccagctgaatccgccgcagatggggccgattgaaatcaccctgaaaatgaacggcaacgaccaggcgcaggtattgttcaccgcggcggtgccggcgacgcgcgaggcgctggaaaacaatatgcaccagctgcgctcgatgatgtcgtccagcggcatccagctgaccgattcccaggtgtccagcgggcaatccggccagcagcaacaggcttaccagcagaaaaaaggccgctccgaacccgtggttggcgaggtggaaggcgtggatgccttgagcgcgatcaaggccgcgcgcggcatactcagcatttttgcctga

SEQ ID NO: 3255 - DNA, 450 bp, Chromobacterium substugae
gtgtccggcaaataccagctgctgatccacctggccgaagagcgccagcaggcggcggcggagcggatgagcctggcgcagaaccggctgagcgaagcgcgggcgcggctggagcaattggacgcctttcgcgaggaataccgccatcggctggtgggcggcggcggcaagggcatgtccatcgtccagtatcaggatttccatcgtttcctttcccgcctggatgaggcgatgatccagcagcagcaggatctggaccgctgcactcagcgcttcgtgatggagcgccaggcctggcagatggagtacaagaagctcaaggcttacgaaaagctgttgcaacgcgagcaagagcgcgaggcgcgggaggaggcccggcgccagcagaagcagaccgatgaattcgccacccggcagttctgggaccggacccacggcgaagacgcctga

SEQ ID NO: 3256 - DNA, 1395 bp, Chromobacterium substugae
atgggcaacggcctgcttgagcgccagcgcggctggctggcggcctgcgccgaatcggccgccgccgccgatctgtggcaaccctgcggcaggctggtgcgcgtgaccggcatggtgatggaggcggtgggcatcaagctgccggtgggcagcgcctgccaggtggcgctgccggaccatggcgcggtggaggccgaggtggttggcttctccggcgacaaggtattcctgatgccgctcaccaatgtccacggcctgcagccgggcacgccggtgacgccggtgccggcttttcgtccgcccagctatggccgcgacgccgcgcccgcgcatgcgaacggacccgttggccgccaagtgccggtgggcgccagcctgctcggccgggtgctggattcgctgggccgtccgctggacggcctggggccggtccatcccgatgcctggtttcccctttacagccaaccgatcaacccgctcgagcgcacgccggtgcacgacgtgctggatgtgggcgtgcgcgcgatcaacggcctgctgacggtggggcgcggccagcgcctgggcctgttcgccggctccggcgtcggcaagtcggtgctgctgggcatgatggcgcgcttcaccaaggccgatgtggtagtggtggggttgataggcgagcggggccgcgaggtgaaggacttcatcgaaaacattctgggcgaggaaggccgcgcgcgctcggtggtggtggccgcgccggccgacatgccgcccttgatgcgtctgcacggcgccgcctacgccaccgcgctggccgaatatttccgcgcccagggcaaggatgtgctgttgctgatggattcggtcacccgctatgcgatggcgcaacgcgagatcgcgctcgccatcggcgagccgccggtgaccaagggttacccgccctcggtgttcgcgcgcctgccgcaattgatcgagcgcgccggcaatggcgaggagggcggcggctccatcaccggcttctacaccgtgctgtcggagggcgacgaccagcaggacccgatcgccgattcggcgcgggccattctggacggccacttcgtgctgtcgcgcgatctggccgagtccggccattatccggctatcgatatcgaacaatcgatcagccgggtgatggtggacgtggtgccgcagtcgcagatggacctggcgcgccatttcaagcagctttattcccgttaccagcgcaatcgcgacctgatcagcgtcggcgcgtatgtcgccggctcagatccggtgctggacgacgcgatgcgccgccagcttcccatggtcagcttcctgacccagcccatgcacgaatcgcacgactacgcgtcctgctgcgcgcagttggctaacgtgctggcctga

SEQ ID NO: 3257 - DNA, 864 bp, Chromobacterium substugae
atgaaggcctcatcgagtaataatcccatcattcccggcgaggagctggagggctggaccagctggagccccgagtcgctcgacggcttcacccgggcattgaccccggcgcaactggtgtcgatgagccagatgcgccgtcccggcgccagtctggccgaaaaaatagcgcaggcggaagcggaaccggcttccgaagtgtccgcgcctcagcctgaagcgccggaggccgaccttcctcccgaagaggaggaggtgtccggcatcggctatcccaccgccgccgaactggaagccattcatcaggaagcctggcaggccggccatgacgccgggctggatgccggccgcgccgaaggtttcgagcagggcctgcaggccggccgcgagcagggcatggccgatgtgcgcgccgagcagctgccgcggatggaagatgcctggcaggggctgtgccggatgggcggagcgttcgccgacgagctggcgcgggtggagcgcgagctggcggacgatgtgctgcagctggcatggcagctggcgcaaaagctgctgcagcagaagctgcggcaggatgatcaggcgctgctccctttgctgcaggccgcgctggcggagctaccgtccacgctgggcaacgcccggttgcgggtcaatccggccgacctttccgccgccagggagtttctgcggcaggagacgccggaaaccgtttggcaatggatagaagacccggccatggcccgcggcggctgcgtcatcgacaccgcttcggccaggctggacatgacgctgcccacgcggctggcggcgatgagccgcgcgctggggctggaggcggatgatgggcaacggcctgcttga

SEQ ID NO: 3258 - DNA, 984 bp, Chromobacterium substugae
gtgcgcaagagcgcggtgctgctgttcagcctcggccagaacgaggcggtcgaggtgttcaaatacctcggccccaaggaagtgcagaagatttccctggccatggcggcgatcaacaacctcagctacgagcagatcgacgacgtggtggccgacttccgcaaggagtgcaatgcccgggccagcatcggcgcgtccgacgaatacctgcgcaatgtgctgatcgaggcgctggggccggacaaggcggccaacctgctggacaagatcatgcagggcaacgaccacagcggcatcgaaagcctgaagtggatggatccgtcctccgccgccgacctgatccgccacgagcacccgcagatcatcgccaccatcctggtgcacctggagccggacctgtccagttccatcctgtccttcttccccgagcggatgcgcaacgaggtgctgatccgcaccgccacgctggaaggcgtgcagccgcaggcgctgcgcgaactgaacgacgtgctgacccagctgctgtcgggctccgaccgcatcaagaagagcgcttccggcggcgtcggcctcaccgcggaaatcctcaacttcatgggtggcaacgtcgaggcgtcggcgctcagcttcatccgcgagtacgacccggagctggcgcagcggatccaggacaagatgttcgtgttcgagaacatcctcgatatcgacgaccgttcgatccagaccattctgcgcgaagtgcagtccgattcgctggtcatcgcgctgaagggcaccagcaccgaattgaaggaaaaaatcttccgcaacatgtcgcagcgcgcggcggaaatgctgcgcgacgatctggaatccaaagggccggtcaagctgtccgaagtggaagccgagcagaaggaaatcctcaaggtggtgcgcaagctcgccgacgacggccagatcgtgctaggcagcaagggcggagatgaaggcctcatcgagtaa

SEQ ID NO: 3259 - DNA, 1695 bp, Chromobacterium substugae
ttgaatgaagcgggcgatcgcttcaagaccctcccgaacaacaaaaaaatcctgtttctgaccgcgatcgcggccatcttcgccgtggtcgtcggcgccgtggcgctcaatcgcaccccttcctataaagtgttgttctccaatctggccgaccgcgacggcggccaggtgacggctgcgctacagcagatgaacatcccctatcagctcaccgacggcggcgtgatctcggtgccgtccgacaaggtgtacgacgtgcgcctgaagctggcggcccagggcctgcccaaggccagcggcatcggcttcgagctgatggataatcaaaaattcggcatcagccagttcgccgagcaggtcaattaccagcgctccatcgagggcgagctcgcgcgcaccatagaatcggtatcttcggtgcagagcgcccgcgtgcacatcgccaccccgaagcaaagcgtgtttgtgcgcgaccagcaggcgcccaccgcctcggtgatgctgcagctgtatccgggccggatgctggacggcggccaggtggcaggcatcctgcacctggtgtcgagctctgtgccgaatctgccggtgaagaacgtcaccatcgtcgaccaggacggcaatctgctgtccaagcagcttgggccggacgagaactccgggctggaccagcgccagttgggcttcgtgcgccagatcgaagacggctacgtcaagcggatcgaggacatcctggagcccatcttcggccacggcaacgcccgagcccaggtgacggccaatgtcgacttctctgagaccgagcagacctccgaaacctatcgccccaactccagcccgaatccgtcggccacccgcagccagcagatcagcgagaagctggccaacggcgcggcccagcccaccggcgtgccgggcgcgctgtccaatcagccgccgtcagcggcgtcggcgccgatcacgctgccgccgggcgccgcgccaggcaccgccaatctgtccgggcaaaccatcagccagaacggcacgctgcagcgcgacatcaccaccaattacgaggtggacaaaaccattcagcacaccaaagtgccgaccggcgtggtgaagcggctgtcggcggcggtagtggtcaactaccggcgcatgcccgacaagaacggcgagatgaagccgacgccgctgtcggcgcaggaagtgcagcagatcaacaatctggtcaaagaggcgatggggtacaacgcgccgcgcggcgacacgctgaacgtggtgaacgccgccttcgccgataatgcccagccggtgaccatgcaagaccgggtggtcgactacgtgagcgacaacggcaccagcctggtcaagtacggcttgctggccatcgctgtgctgtatctgctgttcggcgtggtgcgcccgatcatgcgcgacctggtcaagccggcggccgcgcccgatccgggcggcgccgaaggcgcggcgggcgcggccgcgggcggcaggttgctgggcgtggcggcggaagagggcgagatgggcgcggcgttggccgcgggcggcgccggcggctcgtccgacgatccgcgcgaggtgcagaagcgccagtacagtagtaatctggaagcagtgcgcgaactggtgaaatccgacccgcgcatggctgcccagatcatcaaggaatggataagcgccgatgagtga

SEQ ID NO: 3260 - DNA, 324 bp, Chromobacterium substugae
atgtcagtcaataatatcgaccaattgctgggcgagctgagaagcgcggcggccctggccgccggcaagcaggcccccgcagcgcagcaaacgtcgcaggtcgacttttccgatgtgctcaagtccaccattgagcaggtgaattcggcgcagcagacttcggaggagatgcaaaagcagttccagttgggtgacaacaaggaggtgaacctgcaggatgtcatggtgtccttgcagaaagccagcttgtcgttccagaccatggttcaggcgcgcaacaaactggtgagcgcctatcaggaaatcatgaatacccaagtctag

SEQ ID NO: 3261 - DNA, 1377 bp, Chromobacterium substugae
atgaagtttctaccgattctggtggtcgaggacgacgcagacctgcgcgaagccatcgtagacaccttgtccctgtccggttaccccacgctggaggccggcgacggcacccaggccctgcaaaggctgaggcaggagccggtgggtctgatcatttccgatgcccagatggcgccgatggacggttacacgctgttcgaggaagtgaagaagcattacccgggcgtgccgttcatcctgatgaccgcctacggcgtgatcgagcgcgcgatcgagctgctgcgcgccggcgccactcattacctgctcaagccgttcgagccgcccagcctgctggccgaggtggaaaagcatatattgacgatggccggggacgaaggcggcgaggtggtggcggaatcggcggcgatgcggcagctgttcgccctggccgggcgggtggcgcaaagcgacgccagcgtgatggtcagcggtcccagcggcaccggcaaggaagtgctggcgcgttacatccatcgccactcccgccgaaaagacggtcctttcgtggcggtgaactgcgcggcgataccggacaatctgctggagtcgacgctgttcggccacgagcgcggcgccttcaccggcgcggcccaggcgctgcccggcaagttcgagcaggcgcagggcggcaccatcttgctggacgaagtgacggagatgccgctgacgctgcaggccaagctgctgcgcgtgctgcaggagcgagaggtggagcgcatcggcagcacccgcaccatcaagctggacatccgggtgctggccacctccaaccgcgatttgcaggccgaggtggagtccgggaaattccgcgaggacctgtttttccggctgaacgtctttcccttgcgcatcccggcgctggccgaccggccggacgatatcctgcccttggcacgattcctgcttaaaaaacatatggaggccgccgggcgcgcgtccctggtgttttccagggatgcggaacgtcatttgacggcctatagttgggagggtaacatccgcgaactggataatgtcgtacagcgggcggtgattcttgccgccggggcggaaatttctgccgccgatctgctgctgggcgatatcgcaggcgtggggcagtttacccgggcagtgtctgaatcagacagttcggtgtcggatgaaaccgacatgaaaacccttgaaaaacgccatattctggaaacattggcagccgtcggcggcgtgaagaagctggcggccgaaaaactgggcatcagcgagcgcactttgcgctacaagctgcagcgataccgtgatgaagacgctgcggattctggcctggatgtttcggagggaaatggcacggagtag

SEQ ID NO: 3262 - DNA, 696 bp, Chromobacterium substugae
atggccctgacttcgcgcgaaagagcgagcaaaaccccgctggagatagttcccagccatagcgcggatgtcattctgccgcgccagccgggcaagacgccgctggctagccaaaccgtgatcgtcatcggatcgtccaccggcggaactgaggcgctgcgcacgctgctgaccgcgctgccggccaatatgccgcccattctgatcgcgcagcacatgccggaaatgttcacccaatccttcgcgcagcggctggattcgctgtgccggctgcgggtgaaggaggcggaggacaatgaaaggctgcaggccggcatggtgtacatcgcgccaggccattcccatttgctgatcaagaacgcgccgaccataggctacagcacgtcgctgaacaatggtccggcggtaaaccgccaccggccctcggtggatgtgctgttccgctccgcggccaatctggttggcaagaactgcatcggcgtcatcctgaccggcatgggccgcgacggcgccagcggcatgctggagctgaagcaggccggcgcctggaacatcgcccaggacgaagccagctgcgtggtgttcggaatgcccaaggaggcgatcgcgctgggcgccgcgcacgaggtgctggggctgaccggcatcgctcaaagattggtgacgctggcgcatcagcgccagccttccgcataa

SEQ ID NO: 3263 - DNA, 249 bp, Chromobacterium substugae
gtggtggacgccgatttttccggctttgatctgatcctggcggcggatgccagcaatctggcggatttgcgtcggcgctgtcccaagactttgcagaaccgcttgcacctgatgcttgagccgctgggcggcgagatggaggtgcccgacccctattacggcggcggcaaaggctttgaaacggtgctggatttgttggagcaggcatgcgccggctggctgagccgattgcgcccggcggggggctga

SEQ ID NO: 3264 - DNA, 249 bp, Chromobacterium substugae
gtggagcagcagttacaggcttatcaggtgggcggcaacgatatcgtcgcggcttactcgcaggagggcgcgctggccgtgctggaggaactggcaggcgagaccggactcgccttggaagatgtcagtccgatcgaggaagcggaactggatgtgccggtggaagatgaagacggcgcagcctgcccgaccatccgccagatgctggcggagttgagcgaaccggcttatctgtttggctgggattga

SEQ ID NO: 3265 - DNA, 912 bp, Chromobacterium substugae
atgaaaccatccagactgatcgctcgggctgccgccgtcgcggcgctgctgcctcacttcggagcgcatggacaagaactgtgggacccgcatctgcgcggcgtcaacatcggcctcgccgccggcgcgctgccgcccgaagggctgtatggcgtgctgaacaactactggacttcggtggacaagttcgaccataacggcaacaagaccggcctgaaggtggatgcgctgatcgagctgcccgaggtgctatggtcgaccggcatcaagatatggggcgccgactacgcggtggccatcgcccaacccatcgactacaccacgctgaagggtaacggcatcccgtcgaatggccgctggggcgccttcaacaccatcttgatccccggccagctatcctggacgctgccggaaaacttccacctcaaaaccgggctggcggtttaccttcccaccggcagctcgtcgccgggccgcctgcccggtggcaccttcctgggatcggccaacggcttctggtcgctccagcccagcctggccgtcagttggctgcgcgccggctggaacctgaccatggacgccacctattcgtacaatttccagaataccgacacccattaccgctccggcccgcaattggccatagactataccgcggccaaaaccataggcaaatggaccgtcggcctgggaggctaccaggaaaaccagctgggcgacgactccggcagcggcgcggcggcctgcgcgcaaaccggcggctgccgcgccagcaactacggcatcggccccttgctcggctatcagttcggcagcttgaagctgatgggcgtctacacctacggcttccacacccgcagcgacgtcggcggcaactcgttcaacctgcggctgagctttcccttccaatag

SEQ ID NO: 3266 - DNA, 1506 bp, Chromobacterium substugae
atgtccgactcccccatccagcacatcatcgtcctgatgctggaaaaccgctccttcgatcatctgctgggtttttccaacatcaccggcgccgacgccaaaaccgggcgcgccacccgcgcgcaaggcgttccgaccccgccgccagtcaacgttttctccgaccacggcgaaacccatccctatgccgcggcggccggcaacgccccgttccagctgagcaccgaccccggccatgagtttcagaacacgctgacttgcctatgcggcgtagacgcctggcggcagaataccgacgcccatggccggctgaccggcgcggcctatccggtgccggcggccggccaggccaacagcggcttcgtcgccaattacgccgccggcggcgccaacgcccccggcctggccatgcaaagcctcacccccgagcaactgccggtgctgaacgcgctggcgaaggccttcgtgctgtgcgatggctggttctcgtcgctgccaggccccacctggccaaaccgctatttcgcgcacgccgcttcatccgccggcctggacgacagccccagcgatggccagatcgccgattactatgtggccggcttcgccctgcccaacggcacgcttttcgaccggctggaccatcacggcctcgactggaaaatcatagagggcgactcctttccccaggcgttttcgctgcgaggcatgacccacgcggcgctgaacggccatttccgcgacctcgacgatttcggcgaactgatcaacgcggacgacttcaacgccgcctacctgttcatcgagccgcgctacgacgtccacaaccactatctggacggcaacagcatgcacccgctgaacgacgccagggcaggcgaagcgctggtcaaaaccgtctacgaaacgctgcgggcctcgcgcatctggaccaacagcatgctgctggtgctgttcgacgagcacggcggattcttcgaccatgttttcccgcccgccgccacgccgcccggcgatacccagcccggcagcgagcacaatgcgcacaacttcgccttcgaccggctgggcctgcgggtgccgtgcatcgtcgcctcgccctgggtgggcgaaaacctgatcgaccatcgccagtacgatcacagctccatcgtcaaaaccgtgtgcgagctgttcgagctaggcgggccgctgacccatcgcgaccgcgacgccaacagcctcgcgcccttgatccagtccgccagccgccagaacgccccgcaaaccctgcccgccccggcggcgggtccggtcggcgcggccgccaccctgtccggcggcgcgccgcccccgtcgctgcgcggcttcgcccaaatcgcgctggcccgccagctgagcgtggcgccgccggaacagcagcaagccatcaaggacagcttcaacgccatccagggcgacccggacaaggccaaggctttcctgcaagccgcccacgacgccatcagcgcctggaaggcgcgcaactga

SEQ ID NO: 3267 - DNA, 846 bp, Chromobacterium substugae
atgaacccacgctacgacgccagcagcgccgcgctgctgaacccggggctgagcgacacgctgttccagttcgaccgcagctacagccacccgcaactggcggccgaatgcgcgcgcctggcctacatccgcttcgaagacggcgacgcggagcgccaccgcctggcatcggcgctgtcgctcgccgggctgcagttggcgcaaaccttcagcgtcgacaacagccactcgcacggcttcgccgcggtgctgccatccacattgacgatagtggcgttccgcggcaccgaagtcagccagatcaccgacatcgccaccgacctgcgggcatcgctgacgccctggagccagggcggcagggtgcatctgggcttcgccgccgccgccggccagctgctgccggccttttccagctggtgggacaaccatgccaccccgcaactgatcctggccggccacagcctgggcgccgccatcgccaccctgttcgcctcggcgcatcgccaggccgaactgatcaccatcggctcgccgcgggtgggcgatcaggacttcgccgccgcctgcgccggccaggccatctgccgctatgtcgactgctgcgacctagtcgccagggtgccgccggaaacgcccgacttcccgctttacgtccacctgcccggcgagcgctatatcgacaaggatggcggcattcacgacgcgcccggcttcgatatcgccgccgaccaggccgccgcgcgcgaggaatacctgctgcagcgcgcctggaagatagactcggtgccgctgcgcgatctggccgaccacgcgccgatcaattacctgacagcgctctttccatga

SEQ ID NO: 3268 - DNA, 936 bp, Chromobacterium substugae
atgaatgtcagtctgcgtcaattgcgggtattccgcgcggtggccgaacaagccagtttcagccgggccggcgaccagttgggcttgacccagccggcggtaagccgcgcggtgagggaactggagcaggcgcttgagttgcgcctgctcgaccgcaccacccgcgaagtggtgctgaccgacgccggccagcggctattgcccaagctggcgcgcgtgctggacgaactggacgaggtgctgctggctgcgcgcaaggagggcggccaggcgatgggcagcgtgcatgtggccagcagcccgacgctgtcggccagcctgatgccggccatcatcgccgcctgccggcagcgctatccgctgttgcggctgcatctgcaggaccaggtgcagcgcctcaacgtggcggcggtgcgcggcggcgaggcggacttcggcctggtggtggagcccgagcccggcgatgacctgtggcaggaggaagtgctggtggatgatttctggctggtgtgccgcggcgatcatccgctggcggccggcgcctgggtgtcgtggcgccagctggacggcgagccgctggtattgctggacgacagctccggcagccggccgctgatagaccagctgctgctgcggcacgggctggattgcccggtggcgcagcaactggggcattcccattcggtgttccgcatggcggccgccggcatcggcgtcagcatcacccccggcctcgccatgcccttgccggcgggctgcggcctggtggcgcggccgctgctgccgcgcgccagccgccgcatcgtgctgatccgccgccgcaaccgcaccttgtcgccggcggcggaaagcctgtggcggctggtgctggaaatgcgccagccgttgcaacggctggcggaggagatcatggaaagagcgctgtcaggtaattga

SEQ ID NO: 3269 - DNA, 993 bp, Chromobacterium substugae
atgccaaaactgctggactccttcaccctggccctgctctccaccgtcgcgctggccagcctgctgccctgctccggcgccgccgcgcaggccttcaacctgatcaccaatctggcgataggcctgctgttcttcctgcatggcgccaaactgtcgcgcgaggcggtgctggccggcatcggccactggcggctgcacctgaccgtgctggcctgcaccttcgcgctgttccccatcctgggactgctgctcaagccggtgctgacgccgctggtcacgcccgagctgtatctgggcgtgctgtatctgtgcatgctgccgtccacggtgcagtcgtcgatcgccttcacctcgatggcgcagggcaatgtgccggcggccatctgcagcgccaccgcgtccaacctgctggggattttcatcacgccgctgctggtgggctggctggtggtcagccatggcggcgtgggacaaggcatgggatcggcgctggacatcgtctaccagctgctgctgcccttcatcgccggccagatcgcgcggcgctggataggccgctgggtggatcgccacaaggccatgctgaagtacgtggaccaaggctccatcctgctggtggtctacaccgccttcagcgcggcggtgataggcggcctgtggcggcagacgccgccggccgcgctggccggactgctgctggtcaacgtcattctgctgggcctgttgctgggcctcaccacgctggcgggccgcaagctgggcttcaatcgcgaggatcaaatcaccatcttgttctgcggctcgaagaaaagcctggccagcggcgtgccgatggccaaggtgctgttcaccggccacgccatcggcgccatcgtgctgccgctgatgctgttccaccagatccagctgatggtgtgcgcgctgctggcgcagcgcttccgccagcagcgccagcacaccggccgcatgcaagaaaaatccccgctggcttga

SEQ ID NO: 3270 - DNA, 2013 bp, Chromobacterium substugae
atgctgctcaactttcccgatagcccgtttcagctgaaccagccgttcccgccggccggcgaccagcccgccgccatcgagcaactggtggaaggcctgtccgacggcctgtcctaccagacgctgctgggcgtgaccggctccggcaagacctacaccatggccaacgtcatcgcccagaccgggcggccggccatcatcatggcgcacaacaagacgctggcggcgcagctgtacagcgaaatgcgcgagttcttcccgcataacgcggtggagtatttcgtttcctattacgactactaccagccggaagcctacgttcccagccgcgacctgttcatcgagaaagactccagcatcaacgagcacatcgagcagatgcgcctgtcggcgaccaagtccattctggagcggccggactgcatcatcgtggccacggtgtcggcgatctacggcatcggcgatccgtccgactaccaccagatgatcctgcatctgaaggaaggcgaaaccacgccgcagcgcgagatcatcagccgcctcaccaccatgcagtacagccgcaacgacctggacttcggccgcggcaccttccgcgtgcgcggcgacgtgatcgacatctacccggcggaaagcagcgacaccgcgctgcgcgtcagcctgttcgacgacgaagtggaaacgctgaccctgttcgatcccttgaccggcacgacgaaacagcgcgtcggccgcttcaccgtattcccgtccagccactacgtgacgccgcgcgacaccgtgctgcgcgcctgcgagcagatcaaggacgagctgcgccaccgcatcgagtggtatcagaaagagggcaagctggtggaggcgcagcgcatcgagcagcgcacccgcttcgacctggaaatgctgtacgagatgggcttctgcaagggcatcgaaaactattcgcgccatttctccggccgcggacccggcgatccgccgccgaccttgatcgactacctgcccaaaaacgcgctgatgttcatcgacgagagccatgtcaccgtgccgcaggtgggcgcgatgtacaagggcgacgccgcgcgcaaggcgaatctggtggagtacggcttccgcctgccgtccgccgccgacaaccggccgctgaaattccacgagttcgagcaactgatgccgcagaccgtgttcgtctccgccacgccggcggtgtacgaaaaggaccatgccggccaggtggtggagcaggtggtgcggccgaccggcctggtggacccgcagatcgaaatccgtccggtggccacccaggtggacgacctgctgtcggaaatccgcgaccgcatggcgcgcggcgagcgcgtgctggtcaccacgctgaccaagcgcatggccgaacaactggccgactactacaccgagcacggcatcaaggtgcgctatctgcacagcgacatcgacacggtcgagcgggtggagatcatccgcgacctgcgcctgggcatgttcgacgtgctgatcggcatcaacctgctgcgcgaaggcctggatattcccgaagtgagcctggtggcgattctggacgccgataaagagggcttcctgcgcagcgagcgcagcctgatccagaccataggccgcgccgcgcggaacctgaatggcagggcattgctgtacgcggatcgcatcaccgattcgatgaaaaaggcgatggacgagaccgagcgccgccgcgccaagcagatggcgttcaacgccgagcacggcatcgtgccgcgtggcgtggagaagaagatcaaggacatcatcgacggcgtctacagcgtcgaggccgagcgcaagaagctggtggatgaggcggcggtggcgatgatggacgagaagacgctggccaaggaaatcaagcggctggaaaaggacatgatggaagcggcgcgcaacctggagttcgaacgcgcggcgcgcatccgcgacgaactgaagcagctgaaggaaaaggcctggctcagcgatctgtag

SEQ ID NO: 3271 - DNA, 210 bp, Chromobacterium substugae
atggcaggcgcgcgggaagtggcgaaaccgttgattttacgcctattgccggccaatctcacccccggcgtgcgccaggcggacatccgccggcgcggcgacgcgcccccttggctgtttcagccgcccgaaaacgtctttttcgtgccgcgcggcggcggaacattgtttagaatacaagcaggagctatcccgccgcatcatccatga

SEQ ID NO: 3272 - DNA, 870 bp, Chromobacterium substugae
atgatcaagaaaatcgcaagcttgctgatatcggcggccctggccgcgccggtgttggcggcttcgccccagggcgtgatggtagccagcgaaatgtccggctacaccgcccccaggctcaattcccactcagtgctggtgctcaacggcagcaccggcgaaaccctctacgaaaagaacacccaccagcgcatgcccatcgcctccatcaccaagctgatgacggcgatggtattgctggattccggggtgtctctcgatgacgaggtgacggtgtccgacgccgagatcgaccgtctgaagcacactacctccaggctggcggtgggcaccaccctcagccgccgggaaatgctgctgctggcgctgatgtcgtcggaaaaccgcgccgccgcgacgctggcccgcaccgccctccccggcggcagcgccgccttcgtccagcggatgaaccacaaggctcgcagcctgggcatgacggaaaccatcttccacgaccccaccggcctggacgtgcgcaatacctccaccgccgccgacctggccaagatggtgatggcggcgcagaaatacccgctgatccgggagttcaccaccaccgaaagacaccagatcctgtcggcgcgcaaccgcgtgctgcaatacaagaacagcaacgcgctggtgcgcgagggcgactgggacatcgcggtgcagaagaccggctatatccaggaagcgggccgctgcatggtgctgcaggcggtggtcggctcgcagccgctggtcatcgtgctgctggacgccggcgccagctccgcccgcgtcaacgacgccaaaaacatcaagacctggctggaagcccatccgggcagctggctggcgggctga

SEQ ID NO: 3273 - DNA, 498 bp, Chromobacterium substugae
atgaccatccagattcataccgctcagccgcaggacgcggccgccatccaccgcttcatcaccgagctggccatttacgaacgcgccgaacacgaagtggaatccagcgccgccgacatcgaggcgaccttgttcggccccggtgccaaagcgcaggccctgctgtgccatgtcgacggccggctggccggcttcgccgtgtacttcttcagctactccacctggctgggcaaaaacggcatctacctggaagacttgtatgtcacgccgcaagtgcggggcgccggcgccggcaaggcgctgctgcgccgcctggcgcaactggcctgcgaaaacgactgcggccgcctcgaatgggtggtgcaggactggaaccagccggcgatagacttctatcagtccatcggcgccaagccgcaagccgagtgggtgcgctaccggttggccggcgacgacctgcgcgctttcgccttggacgaaagcgccgtgaacgcctga

SEQ ID NO: 3274 - DNA, 546 bp, Chromobacterium substugae
atgcgcaacaccttgttgatcgccagcctgctcgccctgccgctggccgcccacgccgccggcttccagctcagcagcgaaaccatcgccgacggcaagccgctgacggcgcgccaggtctaccaaggcttcggctgcgaaggcggcaatgtctcgccgcagctgtcctggcgcggcgcgccggccggcaccaagagcttcgccgtcaccgtttacgatccggacgcgcccaccggcagcggctggtggcactggacggtggtgaacctgccggccaacgtgcatgcgctgccggaaggcgcaggcagcgccggcggccaactgccggcgggcgcggtgcagggccgcaccgacttcggcgaatcgcgcttcggcggcgcctgcccgccggttggcgacaagccgcaccgctaccaattcaccgtctgggcgctcaaaaccgacaagctgccggttgacgccaacgccagcggcgcgctggtgggcttcatgctgaacgccaacgcgctggccaaggccagcctcaccgccacctacggccgctga

SEQ ID NO: 3275 - DNA, 801 bp, Chromobacterium substugae
gtgagcgacctcgcgctgcgcgaatgccgcatcgaagccggcgaagtccgcgcccgcctgccgcagcgcatccgccgggtgccggtattcctgccggccctgtgccgggtgcgccacggcctcaagcgcatctggctgggcgaacgggaaatgtcggccggacccgcgcagctggtattgctgccggccggcagcgaactggacatcgccaaccttcccggccccgccggctatctggcggatgtggtcagcctgccgccggcgctgctggcgcgcttttgcgagcgccacggctcgctgctgctgcggcaacgggccggcaacgaactatgcctcgacatcggcgaaccgggccaccgcgcctggcagctgctgatggacagcctgcgcggcgatacgccgccggaaatgcgcgagcaccatgccgaaggcgtgctgctggccctggcgctggccggccaggccgggccgctgctgcaagcgccggccgcgccggtggcgcagcggatccgccagttgctgatgctggatcccgccgcgccatggagcgtggaaacggcggcgcggaggctgaatctgggcgcctccaccctgcgccgccggctggcggaagaagacagcggcttccagcgcctgctagaagacgtgcgcatgggccaggccctgcaaaacctgcaaaccggcgccaagcccatcgccgacatcgccgccgccagcggctacgcgtcgccgtcgcgcttcgccgcgcgctttcgccagcgctacggcctgtcgccaagcgaactgcggcggacgctgtag

SEQ ID NO: 3276 - DNA, 414 bp, Chromobacterium substugae
atggccattcaagtatgcgaactgcaccacgtgggtttcgcggtgcccaagcgccaggtggacgcgatgcgggatttctaccagcaggtattcggcctgcgtgccgatccgtcgcgctggaatatcccggacgtgcctggctgctttctggatgtggaggacgcgcggcaactgcacgtgctgggcagcgacggcgtgtcgcgctatgcgcaggggccggagcgcgatccggtgtccaatcacgtcgccttcaccgtggccagcctggaggcggcggccgaggagttgcgttcccgcggcgtggattttttcagccagcgcagcgtggtggcggaccggctgacgcagttgttcctgcgcgatccggcgggcaatctgctggaattgcggcaggcggcgccggccgcggattga

SEQ ID NO: 3277 - DNA, 471 bp, Chromobacterium substugae
atgcgggaaacggccagccaggacaccgaccgcgacgccgccgccgccggcctgctgctgctgtggctgggcgacgatgccttgcaactggtcaacgccagcctgtccaggcacggcctgtcggaaaacaagctgcaggtgctgctgttgttccggctacatgagcaaggcttgttcggcgaagcgccgccgacgccgtccagcatcgccgactactgcggcatcacccgcgcctcggccaccggcttgctggattggctggaaaaaagggactgggtcgcgcgcgcgccgcacccgagcgaccgccgcagcctgcaactgcgcctgaccgaagcggccaggacgctgctggccgaagcgctgcccgggttctggcgcgcctgcgcccgcgtgaccgacgccttgagcgccgaagagaaaagccagctgctgcgcctgctgagcaagatgcagcaggccggactgagctga

SEQ ID NO: 3278 - DNA, 906 bp, Chromobacterium substugae
gtggtggccgacgcggtctcgctgaccgtcgccgccggcgagacgctggccttgttggggccgtccggctgcggcaaaagcacattgctgaagatgatcgcgggcctggagcggccggacggcggcggcatccattttgacggcgaggatctgtgccgccagccgccggaacggcgcggcttcgcgctgatgttccaggatttcgcgctgtttccgcatctggacgcgctggggaacgtgatgttcggcctgatcgagcaaggctgcgccaagcgggacgccgcggcgcaggcgcgggagatgctggcgcgggtggggctggccgagcatggcggccgcaaggtatggacgctgtccggcggggagcaacagcgggtggcgctggcgcgggcgctggcgacccggcccaggctgctgttgctggacgagcccttttccagcctggacgccgatctgcgccgccagttgctgcaaacgttccgcgcgctgctgcgcgaagccggcatcccggccatcatcgtcacccacgacagggacgaggccttcgcgctggctgaccgggtggcggtgctgaaggcgggccggctgttgcaatgcgacacgccggcccggctattggcggcgccggcggacgcctggctggcgcgtttcatcggctacgacaacgtgctggcggatgccgctgtgccgccgggcgcgctgctgctgggggacgatcagccgccggcgcgcatcgtcgaactgatctggctgcccgatggcgcgcgcgtcaaggtggtggcggcggcgggcgagctggtgttgaatctgtcgggacgcgaggccgcgcgctggcaggcttcgctgttcgtcggcggcgagatcggcgtcggcgtggccgaggccgggctgctgcgctttaactga

SEQ ID NO: 3279 - DNA, 1566 bp, Chromobacterium substugae
ttgacgcagtcgggtgtccggcggctggcgctggccagcctgcccgtgttgtttttgagcgcgctggcgctggcgccgttggcgcggctggtggccgaaggcggcctgcagttcagtccgggcctgctggccgattcttatctgcgctggcggctgctgtggtcattgctgcaggcggcggccagctgcctgctgtgcctggcgctgggcgcgccgctggcctggctgctggcgcgctaccatttccccggccgcggcctgctgctcaggctgctgatgctgcccttcgtgatgcccaccctggtggcggcgatgggggtgctggccttgttcgggccgcagggggcgaccggactccatctgcaggacacgccgtggctgctgctgtacggcaatctgttcttcaatctgccgctggtggtgcgcgccgcctgcgacggcttttcccaggtgccggccagccggctggccgccgcccgcacgctgggcgccaccccgtggcgggcgttctggcgcgtggagtggccggcggcgctgccctggatcctctccagcctgtgcctggtcttcctgtattgcttctccggcttcggcctggcgctgatcctgggcggccagcgctacgccacgctggaagtcgaaatctacagcctggtggcttatgagttgaacctggccgacgccggcgcgctggcgctattggtgttgctggtgtgcggcgccgtcgccgccgtctatgccgcgcttatgcgccggctggcgacggcggccaaggtcgagccgctgccgctgcggccggcgcgcggctggcgggcgcggctggccttgctggccggtttgctgacgttgctgctgttcgccggcctgcccttgctggcggtgctgtggcgcggcctggccggcggcggcggctggctggcgctgtgggacgaggatgtccggctggccttgttcaacagcgcccgcttcaccgcgctgacggtgctggccgccggcgcgctgggcctgtgccacgcgctggccgccggccgcagcctggcgttgcgggcgctgatcttcctgcctttcgtcgcgtcgccggtttgcgtcgctttcggcctgttgctgctgtatccgcagtggagcgcagcgctggccttgctgctggcggcctacgcgctgctggcctatccctttgtcgccaaggccttgctgacggcgcgcgacggccagccgccgcattgggagcaggcggcgcgcagcctgggcgccggcccgtggcggacattccggcgcctgcagtggccgctgctgcagccggccttgcggcgcggcctggctttcgccgccgccaccgcggtgggcgaattcgcggtcacgctgtttttgtcgcggccggaatggctgacgctgaccacgctgatctaccagcggctggggcggcccggcgccgccaatatggacgcggcgatgaagctgtcctgcctgctgatgctgctggcgctgctggcgttctggatcatcgaaaccgccggcggcgccggctcatgggaggaccgtcgtgctgacgctgcgaaacctgaataa

SEQ ID NO: 3280 - DNA, 549 bp, Chromobacterium substugae
atgatcgcagacataagctcctcccgcctgatcctgcgccatatgagcgcggatttcctgcaggcctgcctgcgcggcgacatcgacgacgccgccgcgttgctgggcagccgcccagacgccggctggctggcggaggcgcaactgatggcgatgcggctggacgatatggccgaagacgccgcctacgcgccgtggtcggtgcgggcgatgctgcgccgcgacgatctggccatgatcggccacatcaatttccacacccggccgggccatccgtatttgcagggccacggcgacgtcgagctaggctatgcggtttatccggcgttccgccgccagggctacgcccgcgaggcgctgctggcgatggccggctgggcggccggacagggcgccgggagaatggtgctgtcgatcgaacccggcaacctgccgtcgcaagcgctggcggcgcagctgggcttcgccaaggtggcccaggcgcgcgacgaggatggttgcgaagatgtgctgacggccgactggccgttgtctggagcgaatgtttga

SEQ ID NO: 3281 - DNA, 1017 bp, Chromobacterium substugae
atgaagttgcttcccacccttgtcgccgccgctctgagtctggccggcctgtccgcccaggcggccgaactgcgcgtgctcgcccatagctcgttcagcgtcgacaagccgctgctggcggcgttcgaaaagcaatacggcgccaaggtgtccatcatcaaggccggcgacgccggagagatgaccaacaagctgatcctgaccaaggcgaatccgatcgccgacgtggtgttcggcctggacaacagtctgatcggcaaggccgagcaggccggcgcgctggccccgttgccggccgagctggcccgcggcggcaaggtaagcctgcccggcgccgccgccatcgactacggctacgtgacgttgaattacgacaaggcctggttcgccaagaacaagctgccgctgcccaaaaccctgaacgacctggccctgccggcctacaagaacctgctggcggtggaaaacccggccacttccagccccggcctagccttcctggccgccaccatccacgcgctgggcgaggaaaaggccttcgcgttgtggggcaagctgcgcgacaacggcgtgaaggtgagcaagggctggaccgaagcctattacaccgacttctccaagaacggcggcggccgccccatcgtggtcagctacgccaccagtccggcggccgaagtgttctacagcaaggaaaagctgagcgacgcgcccaccgccaacctgctgttgccgggcacggtgttccgccaggtggagggcgcggcgctggtcaagggcggcaaggagcccaagctcgcccagcagttcatcgccttcctgcgttccgacgcggtgcagaaggatatcccgacgcggatgtggatgtacccggcgatggacggcgtcgcgctggacccagtgtacaagcacgccgagcagcccgccgcgcacgatacccccgacagcgcgacgctggccgccaagcagcgggcctgggtcggccgctgggcgcgggtggtgctgaagtctggcgtctga

SEQ ID NO: 3282 - DNA, 624 bp, Chromobacterium substugae
ttgttcctgctttttttcttctcccttctggcgctgattttcttcctgacatggctgttttttttcccgctgcgggcattgggggattggctattcatccctttgccccgcggtcagtatctgcacctggagacaaatcaagttctgaaccagccgggtttcgtgctgccgctgctgttttgggtgttggctttgctgggcgcgctttccggttggcgcgatgggtttcgtaaattgcccaagcgggacaaggccaagcggcgacaaaaattggcgcagttgaatcagcggtgttgccgtttgctggcgatatgcgcagggctgagcgtgttgctgtctttgcccgccatgcgcagctatacagtcgtggctggggatggcatccatgatatggatttctatcgtcggcacgagacggtgtatccattttcgcagcttgaatgcattagaaggtcggtggtgcgcggggctattttttacgatttctactttgatcgaaaagaggatgactcgtttacagcggccggactcaatccgcaagcgttggcctgggtcgaatgccaaaccgggaaaagcttccagagctggatgggggcttgcggcggatggcggcggggccgatag

SEQ ID NO: 3283 - DNA, 1446 bp, Chromobacterium substugae
atgctcaaaaaaataatcctctcatccgtgctgttcagcctgccgctttgcgcgctggccgacatcggcgtcgacggcgcgcgccatctgctgctgcgcaccggcttcggcgccaatccggcgcagatcgccgcttacgcgccgctcagccgcgaagccgcggtggacaagatcctggccggcgtccgcacccagccggccacgccgccgcccggctgggccaacgaccccttcgagcgccccggccagcctggcctgaccgaggaacagaaaaaagcgctgcagcaagagcgcaaccagcacgcggtggagctgcgcagctggtggctggccgagatgctcgccacgccgtcgccgctgaccgaaaagatgaccctgttctggcacaatcacttcgtgtcggcgctggacaaggtgcgttcgccgcagatgatgtaccagcagaatttgctgctgcgccactacgcgctgggcgatttcggccaactcttgcacgcggtggcgcgcgacccggcgatgatgcgctacctcgacaccgccaataaccgcaaggaacaaccgaacgagaacttcgcccgcgaggtgatggagctgttcacgctgggcgaaggccactacagcgaacaggatatccgcgaggcggcgcgcgccttcaccggctggggcctggaccacgacgaccagttcatcgtccggccgcggctgcgcgacgccggcgagaagaccatcttcggccagcgcggcaatttcgacggcgacgacgtgatcgacctgttgctgcagcagccgcaaacctcggtattcatcaccaccaaattgtggcgcaatttcgtgtcgccgacgccggacgcggccagcatcaacaagctggccgccgacttccgccgcggccactaccagttgaagcccttgatgcgcgcgctgctgctgacgccgcagttctggcacagccagggccaactggtgaaatcgccggtggagctgaccgtaggcacgctggtgaccttcgacctgacgccgcccgactggcgcgtgatcgccggcctgaaccgccagctgggccaggacgtgttcgcgccgcccaacgtcaagggctggcccggcggcgaagcctggatcaacagcgccaccctgctcacccgcaagcagttcctcgaccgcatcgcccacgacgccgcgccggcgcgcgacaccttcgctcaggccgatggcagcctgaacgagatggccggccgcgaggcgcgcatcaaccgcttcgtcgccaagggtgtcgcatcgatgaagctgcaacccgacgaatgggccgccatctacgacgcccgcagcgcggctgacgccgcgcgcctgttgctggcggtgccgccggccaatccgctgccgcagggagaaagcggcgccaaggccatcgcccagttgctgctggacccggcctaccaggtggagtga

SEQ ID NO: 3284 - DNA, 1179 bp, Chromobacterium substugae
atgttcaaacgacgcgaattcctgaaagcggccggcgccggcctgatgctgagcgtgctgcccaacctgtcctgggcgctggccccggccggctacaaacgcctgctggtgctggttgaattgaaaggcggcaacgacggcctcaacaccgtcgtcccctacgccagcgcagattattaccggctgcgccccggcatcgccatcgcccgcgagcaggtgctgcaactggatgaggccatcagcctgaatccggcgttgtcgccgctgatgccgctgtggcgggaccagcagctggcgctgctgcagggcgtcggctatcccgagcccaatctgtcgcacttccgctcgatcgagatctgggacaccgcctcggccagccagcaatacctgagcgagggctggctgacccggctgttccgcgagcagccgacgccgaagcacttcgccgccgacggcgtggtgctgtccagccaggtgctgggcccgctggacggtggcgcgcgcgcggtggtgctggccaatccgcaggacttcgcgcgccaagccaagctggtggccgaccagcagcccggccacgccggctcggcgctggagcatattttgaaagtggaaggcgacatccgccaggccgccgccagcctggcgccgctgccgcgcaccgcgcccagcgaatcgcccaccgccggccccaagcccaacggcggcttcggcgtcgcggtgcgcacgctgaccgacacgctggcgcgcggcgtcgacatcgccgtcgcccgcatcacgctcaccggcttcgacacccacggcaaccagcagccggcgcaagcgcggctgctggccgagctggccgacgggctggcacagctgcgcggcgaaatgacgcggctgggccgctgggacgacacgctggtgctgacctacgccgaattcggccggcgtccgcgcgagaacgccaaccgcggcaccgaccacggcaccgccagcgtccacttcgccgccggcggccgcgtcaaaggcggactgtacggccaaacgccgcaactggccggcgtcagcgacggcaatctgccgcatgcgatagatttccgccaggtctacgccaccgcgatcgacagctggtggggcaaggacagccgcaatgtgctgggcggccgcttcgcgccgctgccgctgctgcgggtttga

SEQ ID NO: 3285 - DNA, 738 bp, Chromobacterium substugae
atggctggcggggtgtgcggcaagccgattcaggtggggtgggaggagcggccgccctatcattaccagggacgggatggccggcccgcaggctactcggtggaactgctgaaccaagccgccgcgcgccttggctgccgcctggcttatcgtcaaatgccctggtcgcgcaatctgcaggagttgcggctgggcacggtggatgtcgcgatgcaggcgttgaaaacgccggagcgggaggcgtacgcctgttttgtgccgggctacagctcagcgcaggtgcggctgtgggtgcgcgccgatcgcgctgcgcgctggccggttgcccagctgcaggacttgggcaagctgggcctggtcaggctgggcgtgacgcatggcgacagttacggcgacgcatgggaccgctggctgaaagcgcctccggccacggtgagggtggacgccggggaaacgctggccggcagcttgcgcaagctgcagctggggcggatagacctgctgctggcgaccatggacacgctgccgaatgagctggcccgcttgccgcaacagccggccatcgtggccctgccgccggcatggcgcgcgggcggcgccttttatgttttcagcaaacgcagcgtgcccgccgagctgtgccgggcttttgccggcgcgctgcgcgacatgaagcgcgacggcgtggtggaccggctctaccgcagccgcttcaacatcgcttatcccgacccctag

SEQ ID NO: 3286 - DNA, 834 bp, Chromobacterium substugae
atgacttcgaacaataccaaaagcaccgaccacccccaggcggcgacggaagacattccgctgccgccgccggaaaacgaactcaatctggccaatctggccatcccgctgggcgaaaccatcctcaccctcaatatcgagggcgcgccgatctacggcatcttgcagcgcagccgcgccatgacttcgcagtccgactacttccgcctgcaattccgcggctacgcccgcgccgacagcaaccagcactggcaaatgctggaaggcgacgacagccgcttccacgccgtgtacaacgtcgcctgggtgcgggtggaccgcccgagcaagtccgtcaccttcggccccaaaagcggcgtcagttgcagccctgcgctgatgggcagcggactggacgcctttttgttcgccagcgtgatcgtctgggccaagggcgtctgccccgactatgcgatcaccccgggcctggtcaataccgggcaaagcagcaccgaagaagaaaggctgcaacgccacgcctttttcgccggccaaggcttccagttcgagtggcaggatccgacccagcgcaccgcgctgtatttcaaggacaaggtgaacaagctgctgggggtgtggaacaaggatgtcatcaaggaattcggcggcgaggacatgctgaagcggctggcgggccaggatgaggcccgcgcctcgctgcagcaaaggatagaccagctggagggcgcgcacgacagcctcaagcgcgcgctgcagaaagaaagaagcacctcgcagatcctgaccggcgtgctggtgctggcggccatcatcggtttgtgggcggtgatctga

SEQ ID NO: 3287 - DNA, 513 bp, Chromobacterium substugae
atgacgaatgatttgccgaagatcgtgtcttcgcagcatctggtgtcggagcgcagccccgagttgtcggagttcgaattcagcctgacggtggtgaacaatgcctttcaccgctggatggtgcgctgcatggccgccgccggagaaaaggacatgacgcccaccgaggtgctgctggtgcatcatgtcaaccaccgcggccggcagaagaaactggccgacatctgcttcgtgctgaatatggaggacacccacgtggtggcctacgcgctgaagaagctggtgaagatgggctatgtgcgcagcgagaaaagcggcaaggaagtgttgttctccaccaccgagaatggccgggcattgtgcgagcgttaccgccaggtgcgcgagcagtgcctgctgccgacgctgagcgacggcggcatcgccaatccggccataggcgaggtggcccaactgatgagggcgctggccggcgtttacgaccaggccgcgcgcgccggggcctcgttctga

SEQ ID NO: 3288 - DNA, 678 bp, Chromobacterium substugae
atgccttccgcccccctcacctcgcccgcgatccattggctgggcagccaggccctgacgctggaaatgccgccgcccgccacgctggactgccagcgccgcatctggtggctggcccgacagctgcaagccggcgacggcatccgagaaatcgtgcccggcatgaacaatctcaccctggaactgagcgacgatccggcgctggccgcggccttgccggcccggctgcgcaagctgtggcagcaggcggaacaagccgacatcccgcagcggcgagtggagattccggtttgctacggcggcgaatacggcccggacctggaccacgtggcgcggcattgcggcctcagtccgcgccaggtggtggaacggcatggcgcgagcgattacaccgtgtatttcctgggctttcagcccggcttcgcctaccttggcggcctggatccgcggctggccaccccgcgccgcgccacgccgcgcatcgcggtgccggcgggcgcggtggcgataggcggctgccagaccggcatctatccgtcggcctctcccggcggctggcagatcataggccgcagtccggcccgcttgttcgacccggcgcgcgaacccgcctgcctgctgcagccgggggacatcgtccgcttcgtcgccagcaaggaatcgccatgctggaagtga

SEQ ID NO: 3289 - DNA, 927 bp, Chromobacterium substugae
atgctggaagtgatcaaggccggaccgcaaaccacggtgcaggatctgggccgcttcggcgcgcgccatctgggcgtatgccgcgccggcgccatggacggcctggcgctgggcatcgccaaccgcctggtcggcaaccccgccgacgccgccgcgctggaaatcacgctgccgccggcctgcttccgcttcttgcgcgccggccagttggcgctggccggcgccgattgccaggcgctgctggatggcgagccggtgtggccgggctggcgcgttgccttccgcgccgggcaaatgctgcagctgcaggcgccgcgcttcggcatgcgcgcttacctggcgctggacggcggcatccaggcgccggccgtgatgggatccgccagcaccgatctgctggccggcttcggcggcctggacgggcgggcgctgcgcgacggcgaccgcctggcgctggggcccgcgcggccgccggcgccgcggctgggcgtctggctgccccgccccggcagccagatccgcgtctgccccgggccggaactcaagcggctgtcgaaacaggcgcaagagcgtttctggcgcgaaccctggcaattgacgcccaacagcaaccgcatgggctaccggctggccggccccgcgctgacaggcggcgagacggtggatatgctgtcccacggcgtgctgcccggcctgatccagctgccgccggacggccagcccatcgtgctgatggccgatgcccaggccaccggcggctatccgcggctgggcatggtgatagaggccgacttgtggcagctgggccaggcgcgcctgggcagccagctgcacttcatcccgaccgaccccgacggcgcccgccaggcgctgcggctgcagcaacgctatcaacaccggatcgaaaggctgctgaatgcaaattga

SEQ ID NO: 3290 - DNA, 738 bp, Chromobacterium substugae
atgcaaattgacctcaacgccgacctgggcgaggactgcggcgacgacgccgcgctgctggaacacgtcagctccgccaacatcgcctgcggctggcatgccggcagcgcggacaccatgctgcaagtggtgcgcatggcgctgcggcgcggcgtcgccatcggcgcccatcccagctttcccgaccgggaaaatttcggccgccgcgagatgcagctgccgccggacgcggtgcgcgccggcgtgctgtatcagctgggcgcgctggacgccatcgtccgcgccgaaggcggcgagatgcgccacgtcaagccgcatggcgcgttgtacaaccaggccgcgcgcgacccggcgctggcggcggcgctggcgcgcgcgatccgcgacttcaatcccaggctgcgggtgatcggcctggctggcagcggctttctcgccgcctgccgcgccgagggcctggacacgcggcgggaggttttcgccgaccgcggctatcgcgccgacggcagcctggtgccgcgcggcgcgcccggcgcgctgctggacagcgccgaagcggtgctggcccaagtcagcgacatggcgctgcgccagcgcgtgatcgccgtcagcggcgaaagcgtgccgctgcgcgccgattccatctgcctgcacggcgacggcccccatgcggcggccttcgccgccaggctgcgcggccacctggaagccctgggcatccgcatcgccgccgactga

SEQ ID NO: 3291 - DNA, 717 bp, Chromobacterium substugae
atggacccagctgtcaatctgtggccgctgctaggcatagcggtggtcatcgcaggcttcctgctgcgcttcaatccgctgctggcggtatgcgccgccggcgtcgtcaccggcctggccgccggcatgccggcgctggccatcctggccaagctcggccagggcttcatgaaaacccgcaacatcaccttgatcctgctgctggtgctgccggtggtggggctgatggagcgccacggcttgcgcgaccaggcccgcgcctggatacggcgcatccgcaacgccaccgtcggccgcctgctgatcgtctacctgctggtgcgggaattgtcggccgcgctgggcctgaccggcttgggcggccatccgcagatggtgcggcccatcctggcgccgatgaccgaaggcgcctgggagcaacgccacggcgagccgacgcccgagcaacggcagaagctgcgcgccatgtgcgccgccaccgacaatgtcggcctgttcttcggcgaggacatcttcgtcgccttcggagcggtgatgctgatgcataccttcctgcaggaaaaccagatccccagcgaaccgctgcacatcgcgctgtggggcattcccaccgcgctgttcgccttcatcatccacgccgtccgcctgatgcggctggaacgccagctgctgcggcaagccgccccggccgcccatctgtcggagaagcgcgcatga

SEQ ID NO: 3292 - DNA, 957 bp, Chromobacterium substugae
atgatcctgcatgtcgagtacctgtactggctggccggcgcggtcctgctcttggtggcggccggcgcgctggccgaccccggccatccgcgccgctacggcagcgcggcgttctggggcctgttcggcatgctgttcctggccggcgactggctgccggcgcagctgtccggcgccatcgtgctggccatggtgctgctggccggcctgggccgcctcggcagcggccatcacatcgcgctgtcggccgcgcggctgcaggacagcctgcgtcggctgggcggcaaggtgtttctgccctcgctgctggtgccgctgctgaccgtggcgctcagcctggcggccaaggacgtgaaactggcgggcgcgccgctgttcgaccccaagaatgtcacgctgctggcgctgggcgtggcctgcctcgtttccttcatcgccgcctgcgggctgacgcgtgagcggccggcgcagagcatccgcgaaacccgccgcctgctggactgcatgggctgggcggtgctgctgccgcagatgctggcggtgctgggcctgctgttcgccgacgccggcgccggcaaggcggtggcgcatgtggccaccgcctacctgtcgctggacacgcgctgggtggcggtgctggcttatgtgctgggcatggcgctgttcacgatgatcatgggcaacgccttcgccgccttcccggtgatgaccgccggcatcggcataccgtttctggtcggcatgcaccacggcgacgcggcggtgatggcggcgataggcatgttctccggctactgcggcacgctgatgacgccgatggccgccaatttcaacatcgttcccgccgccctgctggagctggacgacaagaacgcggtgatcaaggcccaggtgccgaccgcgctggcgctgctggcggtcaacgccgcgctgatgaactggctgatgttccgctga

SEQ ID NO: 3293 - DNA, 633 bp, Chromobacterium substugae
atgcaaaccgtattgctgaccggcttcgagcccttcggcggcgaaaccgtcaatccgtcgtgggaggcggtgcgccggctggatggcgcggagctgggcggcgcccgcgttttcgcgcgccggctgccctgcgtgttcggcgcagcgctcgccgcgctggacagccatctggccgagctgcggccggagctggccatcgccgtcggccaggccggcggccgccccgacatcaccgtcgaacgggtggccatcaatgtcgacgacgcccgcatcgccgacaacgccggccggcagccgatagaccagccgatcgccgccgacggcccggccgcctatttcgccacgctgccgatcaaggccatcgtcgccggcctgcgcgcgcaaggcatcccggcctcggtgtcgcaaaccgccggcaccttcgtctgcaaccatgtgatgtacggactgctgcaccggcgcgtgccgcgcgccggcttcatccatattccctatctcccggagcaggcggcaggccatcccggcgcgcccagcatggcgctggacgattgcgtcgcggcgctcaggctggcggtggagctggcgctggcgcatcgccatgacctggcgctggcgggcggcgccacccactag

SEQ ID NO: 3294 - DNA, 1440 bp, Chromobacterium substugae
ttgattccctgtatcatcgccggcggcgccggcgcccggctgtggccggtttcgcgccaggcgctgcccaagccgttcatccgcatggcggatggccaaagcctgctgcagaaagccttcctgcgggcatcgcgcttggatggcgtgaggcgggtgatggtggtcgccaatcggcagctgctgttccatgtgctggaggaatgcggcgcggtcaatgcggcgaggctggagctggagatcctgctggagccggagggccgcaacacggcgccggccatcgccgcggcggcgctggacgcgctggcccgccgcgacggggcgcgccccatactgctggtgctgccggccgaccacctgatggcggacgagagcgctttcgccgaagcggcggtccgcgctcgcggcctggccgagctgggccgcatcgccgttttcggcctgaagccggtccggcccgagactggcttcggctatatcgaaccgggggaggcgattggacggctgggctatcgagtggcgcgcttcgtcgagaagccggacgcggccagcgccgaacgctatctggccgatggccgctttttgtggaatggcggcatgttctgtttcgacgccgaaaccctgcgcggcgagctggccagtcatgcgcccgctgtgctcgccggcgtggccgcatgcctggaggccagcccggagctgcgcggcccgggccgccggcagcgggagctggatccgcgcagtttcggccgctgcccggacatctccatcgactacgcggtgatggaaaagtcggacgcggcggcggtggtgccgtgcgagctgggctggagcgatatcggcagttgggaaagcctggcggccgagtacccgcatgatgaaaacggcaacgccagccatggcgaagcgctgctgcgcgacacccgcaacaccttcgtgcaaagcggcggccgtctggtggccacgctgggggtggacaacctgctggtgatcgacacgccggacgccttgctggtggccgaccgccgccgcagccaggaggtgaaggacatcgccgccgaactgaaacggcgcggccatccggcctatctgtcgcaccgcaccacgccgcgtccctggggccattacacggtgctggaggagggcggcaactacaagatcaagcgcatcgtggtgaagccgggcgcgtcgctgtcgctgcagatgcaccgccaccgcagcgagcactggatcgtggtgagcggcgccgctctggtggtcaacggcgccgaggagcgccggatcgaggccaaccagtccaccttcattcccgccggcgaaaagcaccggctcgccaatcccggccggatcgagctggtgatgatagaggtgcagagcggcgattatctgggcgaagacgacatcgtgcgcttctccgaccactatgggcgcgacgtcgtcggctga

SEQ ID NO: 3295 - DNA, 147 bp, Chromobacterium substugae
ttgcatggccgctgtctcatccctcctgtcaggcgccgcgggcggcggcgaagcctgctccagtgtatccagtttgtcagatctaacgatagccatgcccgcgccgttgaccccaccatctgctgtcgcggcagccgctgtccatga

SEQ ID NO: 3296 - DNA, 894 bp, Chromobacterium substugae
atgaacgaccgcgccgacttcgtcgtgcccgacatcaccacccgcaagaatgtcggactcagccacgacgccaacgattacacgctgccgcagccgctggaccgttacagcgcggaagatcacgccacctgggccaccttgtaccagcgccagtgcgcgctgttgcccggccgcgcctgcgatgaattcctgcaagggctggagcagctgggcgtggacgccgaccgggtgccggacttcgacaagctcaatcgccagctgatggccgccaccggctggaagatcgtcgcggtgccgggcctgattcccgacgacgtgttcttcgaacacctcgccaaccgccgcttcccggtgacctggtggctgcgcgagccgcatcagctggactacctgcaggagccggacgtgttccacgacctgttcggccacgtgccgctgctgatcaatccggtgttcgccgactacctggaggcatacggcaagggcggcatgaaggccaaggaactgggcgcgttgccgatgctggcgcggctgtactggtacacggtggagttcggcctgatcgatacgccgcagggcatgcgcatctacggcgccggcatcctgtccagcaagtcggagtccatctactgcctggacagccccagtcccaaccgggtgggcttcgacctgatgcgcatcatgaatacgcgctaccgcatcgataccttccagaagacctacttcgtcatcgacagcttcaagcaattgttcgacgccaccgctcccgatttcacgccgctgtaccagcgcctgtcggcggcgcagccgtggggcgcgggcgacatcgcgccggacgaccgggtgctcaatcgcggcgaccagcaaggctgggcggacagcgacgacgtctga

SEQ ID NO: 3297 - DNA, 492 bp, Chromobacterium substugae
atggtgcacaaaatgcgcaaaatagagctggaccgctttgatctggagatcctgcagcaattgcagctggacgcccgcgccacccaccagcggctggcgcaggacattccgctgtccgcctcgcaaatcggccgccgcatccagcgcatggagcaaaacggcatcatccagggctaccaggtggcgctggacccggagcaagtgggcctgtcggtgatggccttcgccaacgtcagcctggagcggcacaacgaagcggcgctgctggatttcgcccaatccatccacgcgctgccggaagtgctggaatgctacgccgcggcaggcgaagccgactacctgctgcgcatcgtggtgcccgacctgccgtcgctgtcggccttcgtgatgaacaagctgatgcagctgtcgctggtgcgcagtgtcaaatccaccatcgtgctcaacgccatcaagcaaaccatgaagctgccgctggcgtcgctgccctga

SEQ ID NO: 3298 - DNA, 597 bp, Chromobacterium substugae
atgcgtcgctaccatatggatagcaaggagaaatcgatggaaacgccgaatgcccgcgccccgatcccagccgagatcagtcccgggctactggccgcgctcaagcggctggaacagtttcaggcccgcctgagcctggaagacattcgcggcttccaccgctcgctgcgcctcggccgcgccgacttcgcgccgttctggctattcggcgacagccaatatcgccgcaaccgcatctatgccgatgatttctgcgaactgctgctgctgtgctggcgcagcggccaacgcagccagatccacaaccaccggggcagcctgtgcggcgtgcgggtgcttcagggcgtggccaccgaaaccgtgttcgaagaaacgccggccggcctgctggcttcgcgcgaaacccgcgaactggccgccggcagcctggtgatcaacggcgatcaggacatccaccagatagccaatcaacaagatggcgatctggtcaccctgcatctgtactcgccgccgctccggcaaatgcggctgctcggcctggagccgcagcatggccgcgcccgcttgccggacgactgtctcgaataccagatctaa

SEQ ID NO: 3299 - DNA, 1323 bp, Chromobacterium substugae
atgcaatctgctgtttcgcctcgctcggcgcgtctgctttccctcatcgtcgccggcctgttcgccgctcccgcggtccaggccgccggctttcaactgacggagcaaagcgtggccggcatgggccgcgcccacgccggcgccggcatggccggcgacgatctgtccgcggtgttttacaacccggccggcatgaccctgctgcaaggcacccgggcgcagggcggcttcacctatgcggaagtcgatgcgccgtttgagggcagcaataccgtcagcggttcgccggacccgcggctgaatcgaaccagccaagcctcggacaatggccgcgctccgggcgtcgccatccccaatgcctatttcacgcatcagatcaatgatcagttgtacgccggcgtgggcctgaccaccccgttcggtttgggcgcgcgctacaacgacaactgggcagggcgcgacagcggcatctccagctccatcatgacgctggacataaatccctcgctggcctacaagctggacgagcgctggagcttcggcgccggcgtgtcggcccagtacgcgaaggctcatctgaagaagggcgccttcctgcccggggccaccggcgagatcaaggccgacagctggggattcggctacaacctgggcgtgatgtatagctacagcgccgatacccgcatcggactgtcctaccgttccaagatcgaccacaaggccaagggcgactacatcaattccggcttcgtcgatctggcgccgaccatgccgctgtcgcgtctgaatggcacctacgccggctcggccgacgtcaccacgccggagtcgctgctgctgagcggctacagcaagctgaacagcaagttcgccgtcggcgccaccgcgcgctggacgcgctggagccgtttcgaccagttggtgatcaagggcagcccgcagttcggcggcatcgataccaccacccgcatcgacaaccactggaagaacagctggatgttctcggtgggtggcgactacttcttcaacgacgcgctgaccctgcgcagcggcctgggctatgaaaccactccggtgcccaacgccgagcaccgcaatccgctgattccggacgccgaccgcatctggctgagcctgggcgccggctacaagatcagcaagcaggccacggtggatgtcagctacgcgtatctgcgtgcggtgggcgatcgcaagatcgacaacgtctccaagagcccgttcggcacccaaagccacctgcaaggccaatacggctccattaccggccacctgctgggcgtgcaggcgcaataccgcttctga

SEQ ID NO: 3300 - DNA, 558 bp, Chromobacterium substugae
atgaagaaactgttctgcagcctggccctggccgccctgcccgcgctggccttcgccgccccggtggtggagatggtcaccaacaagggcaatatcgaaatcacgctggattcggccaaggcgccgaagaccgtggccaatttcgtcgcctacgccaaggccggccactataacggcacagtcttccaccgcgtgatcgacggcttcatgatccagggcggcggcttcgacgccaagctgaaccagaaacccacccgcgcgcccatcgtcaacgaagcgggcaacggcctgaaaaacaatgtcggcaccattgcgatggcgcgcaccaacgatccgaactccgccaccgcgcaattcttcatcaatgtgcgcgacaacgacgccctcaattacacttcccccaatccgcaaggcgccggctacgccgtattcggcaaggtgagcaaaggcatgaatgtggtgaaccgcatcgccaagacccgcaccggcagcatgaacggcatggatgacgtcccgttcgaacccatcgtcatccagaaagtcaccatcaaaccctaa

SEQ ID NO: 3301 - DNA, 492 bp, Chromobacterium substugae
atgatcaaactgacgaccaacttcggcgaaatcacgctggaactgttccacgaaaaagccccgcaaaccgcggccaacttcgagcaatacgtgaaaagcggccactacgacggcaccatcttccaccgcgtgatcaacggcttcatgatccagggcggcggtttcgacgcccagatgaagcaaaagccgacccaggacccgatccagaacgaggccaacaacggcctgtcgaacaagacctacaccgtggcgatggcccgcacttctgacccgcactccgcttcggcccagttcttcatcaacgtctccgacaacgatttcctcgatttcaagtcggaaagcacccagggctggggctacgccgtgttcggccaggtcgtggccggccaggacatcgtcgatcgcatcaagaccgtgcgcaccggccgcagcggcatgcatcaggacgtgccgctggacgcggtcgtgctggaaaaggcggaaatcatctga

SEQ ID NO: 3302 - DNA, 726 bp, Chromobacterium substugae
atggccacccacttcatttccgacctgcacctcgccgacgatacccccgcgctcaaccagctgttcctggacacgctgcagcaatggcggggccggatagacgcgctctacatcctgggcgacctgttcgaatactgggtgggcgacgacgacgactccagctatctggaagcgccgctggccgcgatgcgcgaattcgccgccgcgacgccgctctacgtgatgcgcggcaaccgcgacttcctgctgggcgccggcttcgaagcgcgcagcggcgcaaagctgctggatgatccgacgctgacagacgtccacggccagcgcatcctgctgtgccatggcgacgcgctgtgcaccgacgacgccgcctaccagcaattccgcgcgctgagccgcagcccgcaatggcagcaggcgatgctggccaaaccgctggcggaacgccacgccatcgcccgccacgcccgcgcgcaaagcgagatgaacaagcagcaaaccggcctcgccgccatttccgacgtcaccgaagccgcggtgcaggcgctgctggccgcccacgactggccgacgctgatccatggccacacccatcgcccggcccggcaccgccatcaggcgggcgagcgcggcgccagccgctgggtgatccaggactggcatggcgggcgcggcggctacctgctgctggacgacgccggcatccgcgcgctgccgctggggcgctga

SEQ ID NO: 3303 - DNA, 129 bp, Chromobacterium substugae
gtggattgttttccgaagagcggcttgtgcggcggcgcgaacatattttgccttgaaaatatcctggaagcggcaaatctagtcgagcgtcatttcattttcaagaaaccaacattgcaaaaagaataa

SEQ ID NO: 3304 - DNA, 2349 bp, Chromobacterium substugae
atgaaaccatcaaattacctgcgtcccgtgacgctggccgtcctggccgcgctgggcagtccggccgccctggccgacagcgcccagctggaaaccgtcaccatcaccggcgtcggcgacaagctcggcgtcggcctgctgcagcagcaggaaggcgtgcgtgcccgcagcgacgtcagcaaggcctcgctggaaaagcaaagcccgacgtccaacatctaccagggcatcaatatgctgcccggcgtcaacgcctccagccaggacgcttccggcttgttcggcggcgcgttgacgatacgcggcttcaactccgaccagctgggcatcaccatcaacggcgtgccggtcaacgattcgggcagctacgccgtctatccgcaggaattcatcgacaatgaaaacctgtgccaggccttcgtcacccaaggctccagcgataccgactccccgcatatcggcgccagcggcggcaacctgggcttcgtcacctgcgatccggaaaagacccgccgcttccgcatgtcgcagaccatgggcaacaaccatctgcaccgcacctatctgcgcggcgacaccggcctgttcgccgacaacaaggcgcgcgccttcatcagctattcgcataccgagtcggacaaatggaaaggctcgggcgacgtcacccgcgaccacgtcgacaccggcttccgctacgatttcgactccggcagctatatcaacgcctccatcctgtacaaccgccagctcgccaacgccatctacagcccgacgttggccgagctgcagaagtacggctacaactacgactattcgaccagcttcgcccccggccacctgccgccgaaaaacggcacggcccagatcgagtccggccccagcccggcttactaccagctggcgatgagcccgtttcaaaacgtgatcgccaaagtggacgccgtgctcaagctgggtcccgacacccgcgtcaagatcgagccctactactggtatggctacggcaccggcggcagccagcagcaactgctgtcggaaagcggcttcctcaaccccgccacccacagcaacaccgcctccaaagacctgaacggcgacggcgacaccctggacaagattctgatcgcctccagctcggtcacccgcacccgccggcccggcgtgacggtcaccatggagcaaagcctgggcaaccacttgctgcaggccggcctgtggtatgagcgcgccgaacacgtgcagaccagccccggcgtgccggtcaacaacgacggcacttccagcagcgtctggctgaactccaactacatcacccgtccggacggcagccgctaccagtatcgcgattgggacaccatcagcaccgccagccagctgttcgcgatgggcacgttcaacttcctggaagacaagctgggcatcaccgccggcgtgcgcgcgccatcgatcaaccgcgatttcaccaactacgccaacgaaggctgcggcgccaccgccaactgtccggcggcgtacaactacaacatcaaccgcacctaccgcgaaaccctgcccagcctcggcgcgcgctattacctgacgcccaagcagcaggtattcgtcaacgtcaccaagaactaccgcgcgccgcccaactacgtgtacagcagcaccaacggcaatgtgcaggtggtcaacggccaggtgcagctggtgaacgagatcgtgccggaaaccgcgatcaacaccgacctgggctaccgcctgcagtcggactacgtgacgctgagcggctcgctgttcaatgtcgactacagcaaccgccaggccaatagctacgacccggtgacgctgaagtcggtcaacgtcaacgccggcagcgtccacacctggggcgctgaaatcgagctgggcacggtgccggtgaagggatggagcgcctacgcctcgttcaccaccaaccacagcgagatgaagaacgacatcaactggcagaaaaacaccgtgctcgccacccagggcaaggacttcccgatgaccccgcaatggatggcggccctgtcgctgcaatactcgccgggcgcctggtatgtccgctccgacgtcaagcacaccggcaagcagtacgccaccctggtcaacgacgaggcggtgccggaatacacgctggtggacctggatgccggctaccgcttcggcaatacctccatgctcaagaatccgacgctgaagctgaacgtcggcaacgtcttcaacaccagctaccgcattccgtccggcatgaaggccaacgccagcgacggcggcggcgttcgctactacctgggcgcgccgcgcagcgtggccgtctcgctgtcggtcgacctgtaa

SEQ ID NO: 3305 - DNA, 738 bp, Chromobacterium substugae
atggtcaaagagcaggaaaaggtgcgtctggtcttgcaaaaacaagacatcccgcccgccttcaagatcaacgtcaagctgttcgccgatgtcagcggctccttccgcgacgaattcaccagcccgctgcccggcggcggctacgtggtggaccccttcttcaccgccgcactggcgatagccggcgagatcgaccccgaccgcaacatccagatcatcggcttctccgaccgcgcgctggataccggcgactactcgctggaccatgccggcaacctccgccaggaattcctccgccgcgcccagcccatcctgtggggcagcaccgattacggccgcgcgctgcaggcgctgctggaaagcgagggcatggccagcaagctgggcgggctgatcaagggcctgttcggcttcggcaagaaaacgccgccgccgcgcaaggaggcttacctcgcgctcttcgtctccgacggcgaggacatgggctcccaccagtatttcctgtcgcagctgcgccagctggccgaaatgggcaccttcgtcgtgctgatcggcgccaattccgacaaaaaagtccagttcgagcggatgcgcgaagccgccgaagcggtggaaggctgcaccttccaccgcttgaccgacctcgccgcgctgaaaacccagcagctttacgagcgcatattcgaccaggaattcaagcgctggcacgcccagttgccggccgaataccgcgcctga

SEQ ID NO: 3306 - DNA, 582 bp, Chromobacterium substugae
atgcaaaaaggcggcagcctgccgctgatcaagaacagcgcgccgctgaatgaaatccgcctggaactgtcctggtcgccgccgcaacacagcgccaagggcagctacgacctcgacaccagcgctttcccgctcaacagccagggcggcggcccgatgggcgccatcgctgatgtcggccacatctgctactggggccagcaaaaaaccccgtcgatggaacacctgctgggcgactcccgctccggcgacgccaaaggcccggacgaggccatcctgatccgtctgcacgccttgccggccaactgcgacgtggtggcgctggtcgccaccatagacaaggcgaccgcccgcggccagaccttcgccgaagtggccgacgccagcatgcgcgtctacaaccagcaaaccgacgaattgctgtgccaggtcgacctggccgcgctggacgccggctccaccggctgcctgttcgccagcatccgcaagcaaggccaggcctggagcgtggaaaacgtcaatcagggctacccgggcaaagagctgccggacttcttccacctgttcggctaccagggctga

SEQ ID NO: 3307 - DNA, 702 bp, Chromobacterium substugae
atgtccgactaccgcggcctgttcgacgcccagccgccgcgagcgcaagccgccgcgcccgaagcggcgcggccggacccgcgcgccctgttcgaccgcatgcctggcgcgcccggcgcggccgatgcccgcccgccggccgcgccggccagtatcgccacgccgaccgggttgcagcgccgctacgacgaattgctgcggcagaacgaaggcctggcccaccgggtgatagacctcgtgcaatcgctgaagctgcgcgaaacccggctcgaccagcagttccgccaggcgcagcggcaggcccgggagctgcagcaactgatgcggccgcgctggcgcctgccctggggccagccggcggcggacaagacgcgcggccaccaactgatagaccagttgcagggttttctgcgcagcgaaatgaagccggacgtgttcatcagcaaggacatggacgagctgcaaaggcagaccggctacctggagcggctttcggcgacgctgcaaaccgacgccggcgcgctgctgccgcccgacgccgaactgcggcagcgcatcggcacccaggcccatatccttgccatgcaggccgcgtccagccggcaattgatagaacaactgcaacgccaattacaggacatcgaagactggcgcgccaacttcctgtccctgctggtgatagacatccagcaacgtttgtga

SEQ ID NO: 3308 - DNA, 1074 bp, Chromobacterium substugae
atgccccaataccaaaacctgttcgatcgcccggccgcggcggccacccagagcgccgtccccgccaccaccgcagccgcaagcgcgcccgaccccatcctcatcagtcagctgcgccagctcgccagcgacaagctcgaagagataggcggcagccagacccgccagctgctgggcttgtccgaccagttgctggccaagacccgcgccggcgacaccggcgccttcggccgcggcatgaacgacgtgctgcggctgatgagttcggtgcaattcgaccagctcggcagcccggacggcctgagcggcctggtggacaaggtgcgccgcgccttcaagctggcgaaagtggacctggcgcaggccttcgacagcgccaagggccagatagacaagatttgcgccgatttgcgccagcggctgcaggtgctggaaggcgacaaccggtggctgaacggcgcttatgccgccaacctcaacgacatgcaggcgctggagcagctgctgccggcgctggaagccgtgcgcgacgaagaagccgccaagctggcggcgatgaaccccgccgagccgatgccgatggccgagcagcgccagcgggtggaccggctgggccgccgcgtcgaggcgatcgcgctgcagatccaccagtccaagctgcgcgcgatgcagatcaaggggctggaggacgccaaccgcggcatccacgacgatttccgcgcgctgctggaaaacgcgatccccgcctggagcgccgagatcggcatgggtttgctcagcctgcgccagaaggccaatatcgagatcagcaaccgggtcaaagatcagatccaggcgtcgatgaagcgcgccgctgaccagatccacgacaatgtgctgggcgcggagaaggcactgcagcgccaagcggtggatgtcgccacgctgcgccacgtgcaggacaagacggtggcgatgatccagcaaaagattcagttggcggaacagcgcgaccgccagcgtctgcaaaccatggaggaactggcgcggatggagcaggaactgaagcagtcgctgcgtcagctcggcagctaa

SEQ ID NO: 3309 - DNA, 1335 bp, Chromobacterium substugae
atgccgcctgatctgatcgggcgcctcatcaagcattggccggacgaattgtccggccaatgttcttttgaggtgggcctctccggcggcctggactcggtggcgctgctgtcgctgctgtgcggggtacgcgaggagatgccgggcctgcggttgtcggcggtgcatgtccaccatggactgagccccaatgccgacgcctgggcgcggcattgcgagcagttgtgcgcagcgttgcaagtgccattgcgcgtcgcgcgcgtggcggtgacggcggcgggcggcgacagcctggaagcggcggcgcgcgatgcgcgctacgcggcctatcgggagtcggccgccggggtggtggtgttggcgcaccatctggatgatcaggcggagacggtgctgctgcaactgttgcgcggcggcggggcgaaggcgctggcggcgatgccggcgctgcggccgctggcgggcggcaagctgctatggcggccgttgctggcgctgacgcgcgccgaactggaagcccatgttcgccggcaaagcctggcctgggtggaagacgaaagcaaccaggacacccgttaccgccgcaatctgttgcggctggaagtgctgccgcgcatcgagcgcggcgttccgcattaccgccgccatctggcgcgcgccgccgcgctgcaggccgacgccgccgccatcttgcaggaagtggccgacgccgatctgcgcgcctgccgctgcgaggcgggtttgagcctcccagcgttggcggcgctgtcggggccgcgccagcgccaatcggtgctggcctggatcgaaagcctgggctggagtgcgccggagccgggcgccttgctggagtttttgcggcaggcgcatcatgcggccggctctccgcaactggcgctgcctgccggccatctgttgcgttttgccgataccctgcaggcctggccgaaagttcagctcagtcacgggtcagaagtgttgccagattgccgcggcggacgggcgctgagcctgcccgcctggggcggcgagttgagctgggagtggcgcgaacgcggcctgccagacgcggcgctggccggtttgtggctggcattgcgccgcggcggcgagaagttgccggcccaggtcggccggcgcgaagtgaaagacctgctgcgcgaagcgggcctgccgccgctgctgcgccagcgctggccgctgctgtatggcgccgacggccaattgctggcactgcccggcatcgcgatttccttcgtccattcgacagggccgggctggtggccgcgctggacgccggtccgcgccggccatggcgacccggccagggcttag

SEQ ID NO: 3310 - DNA, 966 bp, Chromobacterium substugae
atgaagccgacctttctcgattttgagcagccgatcgccgagcttgagaacaaaatagaagaactgcgttttgttcaggatgactcggtgctggacatatccgaggaaatcgcccgcctgcagaagaagagcctggagctcaccaagacgctgtatgccaagctgaccccgtcgcagatcgcgatggtggcgcgccacccgcagcgtccttataccctggactacatccaggccatctttaccgactttgaagagctgcatggcgaccgcgctttcgccgacgacgccgccatcgtgggcggcctggcccgcttcaatggccaatcggtgatggtgatcggccagcagaagggccgcgataccaaggaaaagatccgccgcaatttcggcatgccgcacccggaaggctatcgcaaggcgctgcgcctgatgaagctggccgagaagttcggcatcccggtgctgactttcgtcgacaccaccggcgcctggcccggcattggcgccgaggagcgcggccagtccgaggccatcggccgcaatctatatgagatgacccgcttgcgcgtgcccatcatcgtcacggtgataggcgagggcggttccggcggcgcgctggcgatcgcggtgggcgaccacgtcaacatgctgcagtacgccacctattcggtgatttcgccggaaggctgcgcctccattctgtggaagaccgcagagcgcgcgtccgacgccgccgaggcgctgggcatcaccgcgccgcgcctgaaaaccctgggtctgatcgaccgggtggtcaacgagccggtgggcggcgcccaccgcgaccacgcgcaaatgatgactaccatcaagcgcgtgctgcaggacgaattgaaggaagtgcagtccaagccgctggaagaattgctgaaacagcgcttcgaccgcctgatgagctatggccgcttcaaggaagatgccgcctga

SEQ ID NO: 3311 - DNA, 73 bp, Chromobacterium substugae; identical to SEQ ID NO: 2733

SEQ ID NO: 3312 - DNA, 74 bp, Chromobacterium substugae
ggagtggtagttcagttggttagaataccggcctgtcacgccgggggtcgcgggttcgagtcccgtccactccg

SEQ ID NO: 3313 - DNA, 73 bp, Chromobacterium substugae; identical to SEQ ID NO: 2733

SEQ ID NO: 3314 - DNA, 74 bp, Chromobacterium substugae; identical to SEQ ID NO: 3312

SEQ ID NO: 3315 - DNA, 1545 bp, Chromobacterium substugae
atgaacaaggcaatcttgctggcggcatgcctggcctgtccgcccgccatcgccagcacgaccgccgacaccgccatctggcaataccgggtgcaggctggcgataccctctggtcggtcgcatcccagcacctggtctcacccagctacgttccgaagctgcaagcgcaaaaccatatcgccaatccctacaagctgccgcccggcagcctgctcaacattccctacgcctgggtgaagcaggatgtcgccgacgcggtgctggacgacatgtccggcaaggtgggcgcccagggccgcaacggcgccactctcagcctggtgcgcgggcaacactaccccggcggcacccgcttctcaaccggcgacgacgccatgctgcggctgaaattccaggacggctccatgctggtgctcaacgccaacaccacgctgacgctggaaagccaggcctactaccccagcaccggcgccatccagtcgcaaaacaagctggaaaatggcagcaccggcagctcggtgatccccaatatcctgatgcccagccgctatcgcatccagacgccgtcggccgtcaccaccgtgcgcggcactgaattccgcgtgcgcagccaaagcgacgacgacaccgccgccgaagtgctgcgcggcacggtaaacgtcaatgcccggcaaggcgaggtcgacgtgcccgccggcttcggcagccgcggcaaatccggcgacggccagccggtcgcgctgccgccggctccgccgctgacaggcctgccgccaagctccgcattcaatcccccgccgctgcaatggcaggcggcacccggagaggacggctaccacctgtccatccaccagcaaggcgatcaaccgcgcctgctacaggaacgcgacagcgcggcgccgcgcttttatcccgccttgccgcaaaacggcgcttatcgcctgaccatccgcgcggtcaacgccgtcggcctgcagggcttcgacagccagcgcgacttcgcgctgcgcgcctatccgctgccgccgctgatagtcgcaagccagggcccgcagcagcagcgcggccacacgatgacgctgcgcagcagcgccagcgcaacccagccggcttggctgcaagtggcgcgcgacgccggcttccagcaattgctgttcaacggccgcgtggacgagccgcagaaaagcctggaactgccggccgcgggcgcctggcactggcgcatggcctccatcgccgccgacggcgccttgggcccctatggcgatgcccagatcctggacgtgaccggctggctgggcctgccggatctgcgcgccccggctctcgccacccgccgctatccgctgcccggcctgcgctataccctgtcgttgatccccgccgcgggccaagccgccgcgccggcgttccagcaaacttcggatcagccgctctggccgctgcgcgacttgccgcgcggccgttttgccgtcaccatccatattgacgacaacaccggctaccacgccgaagagaaatacccgtcgctcgacctgccatga

SEQ ID NO: 3316 - DNA, 1602 bp, Chromobacterium substugae
ttgctgctggccatcctgggtttgctgctgacaggcagccaattgctgaaccggctggacctgtggctgtatgatggcctcagccgcagccgcctcgcccatgacgaccacgccgccatcaccgtcatcgccgtagacgagaaaagcctggccgaactcggccgctggccatggccgcgcgcctatcacgcccaattgctggacaagctgtcgcaagccaaggccgtgggactggacatcgccatcgtcgaaccctcggcccagccggaggccgaccagcatctggcggcggccatccgccgcaacggcaaggtcatcggcccggtattcccggaaatgcagggccggcgactggtggagacccgcccgctgccgctgctgagccaggcgatggccgggctgggccacaccgattacgaacaggacgacgacggcatcatccgccgcgtctacctgcaggccggcctgggcgggccgcgttatctcagtttcgccagcgcgttgtgccagctggccagcggcggaaaaccggcaacacctgccgccgcgcccgccggcgccgccgcctggcaccgggcgcaggcggtgatggtgcccttctcctccggcaaccgcccgtatcagacggtgtcctactcggacgcgctgaatcgcttgccgccggccagcttcgccagccgcatcgtgctgatcggcgccaccgccaccggcctgggcgacagccacccgacaccgatatcggccaacaaccgcgggctgtccggcgtggagatcaatgccttcatggtgcacgccctgctggaaaacctgcagatcacccaactggacaccgtctggaaaggcttgctcgccgggctgatcctgctgttggccgactggcggctatcgcgccagcgctcgccgcggcggctgctggcccattacgcgctgacggcgctggccatgctgctggcttccgccgtcgcgctgtacctgggccgcctctggatcggcggcggcgtgacggcgctgctgttgctgctggccggcatgctgcgcttcgtcgccagcctgtcccgcctgcacacgctggcgatgaccgacggcctgaccggactccacaaccgccgccatttcgacgaagccttcgccgcgacgctggccgcccatcagcgccaacgccgcccgctggcgctgctgatcgtcgatctggacaatttcaagggctacaacgatcactacggccattacgccggcgacgaggtgttgcagcgcaccgccggcgcgctgcgcaaatgcttccgccgcaaggacgaaaccgtggcgcggctgggcggagaggagttcggcatcctgctggcaaaccgccggccggagcaggcgctggccgccgccgagcgctttcgccgctatctggaagacctgcaactgcctcatgccgccagcccgctgggcaaagtcacctgcagcataggcgtggccgcgcgtccgccagccgacgacacgccgcgcagcctgttcgaggacgccgaccaggcgctgtacctggccaagagcgaaggccgcaaccgggtctgccaggccgaatccggcccagccgcgccgcaagcctcggctccctag

SEQ ID NO: 3317 - DNA, 495 bp, Chromobacterium substugae
atggctttgaatatgacgaacaggcagggctttctgctggtggcggcggcgtgcgccggcgcgatggcgtttgccctgtatgcgcaatatcagctgggcgaggagccgtgcccgctgtgcatcctgcagcggataggggtgatggcggcgggcgcgatcgcgctgctggcggcgctgcataatccaggtcgcgccggcgccaaggtgtggggcgggctgacggtgctggcggcgctggccggcagcggcgtgtcgctgcgccagctgtggctgcagagcctgccggcggaccaggtgccgcaatgcggcccgggtctggaattcctgatggagtccttccccttgtggcaggtgctgtccaaggtgctgaagggcagcggcgagtgcgcgaccatccagggcaccttcctcggcatgagcatgccgttctgggtggcggtgttcttcgccggggtgatcgtctggacgctgtggctggtgttccgccgccgctga

SEQ ID NO: 3318 - DNA, 1140 bp, Chromobacterium substugae
atgcgcaggccgggcagaatcggtttggtattgtcgggcgggggcgcccgcgcggcctaccaggtgggggtgctgctgggcatcgccaagctgctgccggatccggcgcagaatccctttcccatcatctgcggcacttcggcgggcgccatcaatgcggtggcgctggcttccggggccgccaactaccagctggcggtggcgacgctggccaaagtatggaagcagctgcacatccaggatgtgtacgatgtcagcaccagctatttcctgaaaacctttctgcatttcggcgtgtcgctgctcagcgccggccatgtctggcgcaatccgcaaagctttctcgacaacgcgccgctgcgcgacaccctgggccgggcgatgccattcgacgccatcggcggcgccatagacagcggcgcgctgcaggcgctggccttgacggcatcctgctacaccaccggcatgtcggtgacgtttttccaaggccaggacaagctggaagagtggacgcgctaccagcgcttgggaatacgcgagcggatcgggctggatcatttgatggccaccgcggccattccgctgatcttcccctcggtgcgcatcggcgagaaattctactgcgacggcgcggtgcgccagctatcgccgctgtcgcccgccttgcatctgggcgcggaaaagctgtttgtggtgggcctggccagccagcggcccgataccatagagcggcgcagcagtggtgcttatccgatgccggcgcaaatcttcggccacctgctcaacagcgtgttcatcgacagcatggcggtggacatggagcggctcagccgcatcaaccacacggtttcgctgctgcaaagcagtgaggagctggcgagccgcacgcaattgaagaaagtggagattttccagctcaatcccagcaagtcgctggaaggcatcgtctttcgccacacccacctgtttccgccgtttttgcgtttcatcatgaagggcaccggggccacccggcagcgcggcacggcgctggccacctatctgctgttcgagcccgagtattgccgggaactgatcgcgctaggctaccgtgacacgctgcagcagaaggaggaaatccgcaattttctggaactgtag

SEQ ID NO: 3319 - DNA, 900 bp, Chromobacterium substugae
atgccgctgctccactgttctatccccctgccgccgcacttccgtccgcaagacatcctggcttttcaccgccgcgacggcgagcggctggccgagcaggtggatggcgacggtctgcgcaaggggctgtcatggcgcggcgcgccggcttgcctggctttgcgctttgccggcggcgaagcccggctggaattggcgctggacggcgatggcgatggcggcgacgcgcggctgctggagcagaccgggcggcgcatgctgggcttggcgcagccggtggaggcgttcgagcggcgctaccgcgaccatccgcaactgggccggctgatcgccgcgcgccccggcatgcgggtgccgcagaccgcgacgccgttcgaggcgctggcctgggcgatcaccggccagcagatcagcgtgcaggccgcggtgagcatacggcggcgcctgctgcagctgtgcggccgccgccattcctccggtctgctgtgccatccggatgccgccgcgctggcggcgctggatgccgaccagctggggttggccgggttttcccgcgccaaaagccgcgccttgctggcgctgagccagggcgcggcggcgggggagctgccgctggacgattggctggccgacatgccggccgcggacatttcggcgcgcctgctggcggtgccgggcatcgggccgtggacggtcagctacgcgctgctgcgcggctacggctggctggatggctcgctgcacggcgacgtggcggtgcggcgcgcgctgcagatggtgctggcgacgcccgacaaggtgtcggcgccggacgcgcagcgctggctggaaggcttcgcgccgtggcgggcgctggtggcggcgcacctgtgggcgctgttgcaggctggcggattctga

SEQ ID NO: 3320 - DNA, 648 bp, Chromobacterium substugae
gtgagcgccagcctgttcgcgccgcagggcgagccctgggccgagcggctgtcggccggcgcggtgctgctgcatggctgggcgctgccccaggatgccgaattgtgcgccgaggtcgacgccgtcatcggccaggccccgctgcgcggcatggagacgccgggcggccagagcatgtcggtggccaccagcagctgcggcgattggggctgggtgtccgaccgcggcggttaccgctattccgccagcgatccgcaaaccgggcaagcctggcctcggatgccggcgcgtctgctgcggctggcgggcgacgccgccgcggccgccggcttccccggtttcgcgccggatgcctgcctgatcaactgctatcagcccggcgcccgcatgggcctgcatcaggacaaggacgagcgcgatttctccgcgcccatcgtctcggtgtcgctgggcctgccggcggtattcctgctgggcggcctgcgccgcgccgaccgcgcgttgaagatcgcgctggagcatggcgacgtgctggtgtggggcggggaggaccgcatgcgctttcacggcgtgcagccggtcaagcccggcgttcatccgctattgggcgcgcgccgcctcaacctgacttttcgcaaggcgcgctga

SEQ ID NO: 3321 - DNA, 1344 bp, Chromobacterium substugae
atggcagataagacattcagtttcagtgccgacgcgctgagcggcatcgccggccgcgtgctcgaactggccggcaagctgggcgccagcgccgccgaggccgatgtttccgaaggcgtcggccagtcggtcagcgtgcgcctgggccaagtggaaaccatagaatacaaccaggacaagggcgtcagcgtcaccgtctatctgggccagaaaaaaggccacgccaatacctccgatttttccgaccaggcgctggccgataccgtgcgcgcggcgctggacatcgcccgctacaccgccgaggacgactgcgccggcctggccgatccgcagctgctggcggacgagctgcccgacctcgacctgttccacccgtggcagctgccggtggagcaggcgatcgagctggcgcgccgctgcgaggacagcgcccgcgcggtggatgcccgcatcagcaattccgaaggggccagcgtgtcggtgcaggccaaccagttcgtctacgccaacagcaacggcttcaacggcggtttcgccagcagccgccacagcctgtcggcggcggtggtggccgagcagggcggcgtgatgcagcgcgactactggtactccgccgcccgccaccgcgacgatctggcgcaggtggaggagatcggccgcatcgccggcgagcgcgcggtgcgccgcctgggcggacgccggctgaagaccggccagtatccggttttgttcgaggcgccggtggcgatgtcgctggtcggccatctgatcgccgccatcagcggcggcagcttgtaccgcaagtcgtcgttcctgctggattcgctgggcaagccggtgatgtcgaagcaaatggtgatagacgaggacccgttcctgctgcgcggcctggccagcagcccgttcgacaacgagggcgtggcgacgcagtcgcgccggctggtcgacgacggcgtgctgcagggctatctgctgggcagctattccgcgcgcaagctgggcatgcagaccaccggcaatgccggcggctcgcacaatctggtggtgcattccaccggcgaaagcttcgccgagctgctcggccagatgggcagcggcctgttggtgaccgagctgctgggccagggcgtcaataccgtcaccggcgattattcgcgcggcgcggccggcttctgggtggagaacggcgtgatcgcctacccggtggaggaaatcaccatcgccggcaatctgcgcgacatgttcctcaatatcgaagcagtcggcaccgatgtgctggaccgcggcggccgccgcatgggctcggtgctgatcggcggcatgatggtggccggcgaggagtga

SEQ ID NO: 3322 - DNA, 555 bp, Chromobacterium substugae
atgagcgactaccagaacgacggccaggatgacggctttgtcagcaaatcccagcgcaagcgcgacatggacgcgctgcaggatctgggtagcgaactggtcgagctgtccaaggatacgctgaagaaaatggcgctgccggaagatttgctctccgcgctgctggaacacaagcgcctcaccgcccacggcgccatccgccgccagctgcagtacatcggcaagctgatgcgcaatgtcgatcccgagccgatccagcaatacctgcagatcctgaaaggcgaatcctccgagcacatctcctggcagaagctgctggagcgctggcgcgacaagctgatggcagacgacgccaaccagccgctgttcctgcaaagcttcccggaaaccgaccccaagcagctgcactcgctggtgcgccagtcgcgcaaggaaaagcaggacaacaagccgcccaaggccttccgccagctgtaccagctgatcaaggagcagatccccgagccgggcaagccgcgcatctggcaaaaggacgaggcagaggacgacgagtga

SEQ ID NO: 3323 - DNA, 579 bp, Chromobacterium substugae
atgctgaagataggcctggtttccatttccgaccgcgcaagccagggcgtctaccaggacaagggcctgccggcgctgcaggactggctggcgcgcgcgctggccaccccgtttgaaaccgtgtgccggctgatcccggacgagcagcccggcatcgaagccgcgctgaaggcgctggtcgacgacgagggctgccagctggtgctgaccaccggcggcaccggtccggcgccgcgcgacgtgacgccggacgccacgttggcggtggccgaccgcgaaatgcctggtttcggcgagcagatgcgccagatcagcctgcgcttcgtgcccaccgcgattctgtcgcgccagaccggggtgatccgcaagcaaagcctgatcctgaacctgcccggccagcccaaggccatccaggaaacgctggaaggcctgcgccgcgccgacggcagcgtggaagtgcccggcatcttcgccgcggtgccctactgcctggacctgataggcgcgccctacatcgaaacccacgagacggtagtcaaggctttccgccccaagtccgcgatcaagccggcgccatga

SEQ ID NO: 3324 - DNA, 969 bp, Chromobacterium substugae
atgagctatcgcgccccccgctggctgcgcggcggccacgcccagaccatctggccggcgctggccgtgaaggttgcgccgcccgcctaccgccgcgagctgtgggacacgccggacggcggccatatcgcgctcgatttcgtcgacggcaagcccggcgcgccgctggtggtgctgttccacggcctggaaggcagcagcgccagccactacgccaaggcgctgatgcaggcgctggcggcgcgcggctggcacggcgtggtatcgcacttccgcggctgcggcggcgtggacaacccgctgccgcgcgcctaccacgccggcgacgccgccgaagtgcgctggatactgcagcgcctgtcggcgcgcttcgccgccatcgccgccgtcggcgtgtctctgggcggcagcatgctgctcaactacctggccgaggaaggcgaagccgcgctgccctgcgccgccgccgccgtctccgcgccgctggacctggtggccgccagcacccggttggaccgcggcttgggcaagctgctgtacacccgcatgttcatggacacgctcaagcccaaggcgctggaatcgctgcagcgccatcccggcctgttcgatgccggcaagctgagccgcgcccgcaccttcatcgaattcgacgatctggtcaccgcgccgctgcacggcttcggcaccgcgctcaactactggcgccaggccagcagcaagccccggctcggccagatcctccgcccgacgctggtgctgaacgcccgcaacgaccccttcctgccggccagcgcgctgccggacgccagccaggtatcgccggcggtgacgctggacttccccgacgacggcggccacgtcggcttcgccaccggccccttccccggccggatagactggctgccgcaacggctgctggccttcgtcgagccccacctggcgatgcgcgccgcccaaacgtcataa

SEQ ID NO: 3325 - DNA, 513 bp, Chromobacterium substugae
atgcaagaccccagcaccatagaacgcagcctcatcgtccagtgggacgacccgatgataggcgcccgcgccgcccgcaccctcagcggcctggaatacctgcgggaaatggagcaaggccgcatcccgccgccgcccatcatgcaactgctcggcttcgaattcgtccgcgccgccgaaggcgaggtcgaattcgccttccgcccgcacgaatcgcacttcaatccgataggcagcgtccatggcggcgtgatcagcacgctgctggattccgcgatggcctgcagcgtccactccacgctgccgagcggcagggcttacactacgctggaattgaaagtgaatttcgtgcgcgcggtgcagccgcgccacggcaggctggtttgccgcggccaggtcatccacgctggcgcccgcatggccaccgccgaaggcaagctgctggacgcggccggccggctgtacgcccacgccaccaccacttgcatgattttcgacgccgcggccgcttag

SEQ ID NO: 3326 - DNA, 573 bp, Chromobacterium substugae
atgctacgctccgccttgctgtgcctcgcgttcgcgctgctgtccggctgcgcgtcgatggccgaccgcctccgcggctcgctgacgccgccgcccggccgcgcctacgccatcctgtccctcaccggcaaggccttcaaccccgacctcgccaccgtgggcatgagcgtccgcgacgcgcaagggcgggtggcggccgaggacgccgccagcctgctgaccgacacggtgttcggcgaggaaggcatgtcgccggtggaaggcaagctggtgctgctggacctgccgcccggcgactaccggctggccggcgtatgggggcactggtccgaagacggcgtcttcggctccgacctgaaaatgaaacagttccggctggacgcgcccttccatctggacgcgggcgaaaccgtttacctgggccaggtgcagctggaaatgtccttcctgccggaagtgaagctgggcgatgagcaaaaacgcgacttcggccacatgcgccgggtctggaagataccggatctaagccgggtggcggtgcggccgctgcggctggccggcccgcggccatag

SEQ ID NO: 3327 - DNA, 1161 bp, Chromobacterium substugae
atgacggattcgtctccaaaggtaaaactcccgcgcaattttttgcgcgcgggacagcagacgccggtggacgtgtatgccaagaacggcgtgctgttgctgaagcggggccattacgtgctgaccgaagagcagcgcgaccgcctggccaggctgggccatggcgaaagcgatgaagtcgaggccaggctggagcgcgagcggctggaacgcgccgcgatgcgggagaaggaggcggagcagcagcgcaatagctccaatccgctgcaggaaatggcgtttctgctgcgccgtgccgaaggcgtgctgctgcatggcctggcggtgcgcgacctggccggcagtctgctggacatggcggacggcctgctcaacatcagccgccgccatcccgacggcgttctcgccagcgtgttcctgctgccctaccaggacataggcagcgcccagagcgcccacgtggcggcgatattggcggtgctggggcggcggctgggtttgtccgacgcggaactgaggccgatgctgggcgcggcgctgagcatgaacatcgccatcaccggcctgctcaaccagctggccaggcaggcggagccgatgaacgccgaccagcaggggctgatgttcgcccatccggcgctggggtcggcgatgctgcgcgaggccggggtggtggacgagtgctggcaccagctggtgcagcagcatcatgagcagctggacggcgatggctacccgctgggcctggccggcgacgaggtggcgccggacgcgctgctgttgcagatggtggacctggtgtgcggctgcgtgcaccagccgcaaccgcagctgccggcgctggtgctgggcagcctgttccgcggcgaactggggcggtttccaccgcagcatgtgtcgctgctggtgaaagagctgggcatctatccgcccggaagcttcgtgttgctggccagcaatgaggtggcggtggtcacccaccgcggcgacaaggccaatacgcccagggtggcggcgctgcgcaagctggacgggccgccttacgccgatcccttgctgcgcgacagccgccagccggcctaccaggtgctggagccggtcgcggcgacggcggcggccaccaagccagcctacctctacaagctgtggtacaagccctga

SEQ ID NO: 3328 - DNA, 846 bp, Chromobacterium substugae
atgagccagcaggacgacatcctcccacgccgcagctttctcgccggcgccggcagcctgggcttcgcgctggcggcgcagcccatcgccgccagcgcgatcctgacggacagccaggcgctgcagaccggcgcgccggccatcgataccggcaacggtgtgatggccggctattacgccaaacccgcgcacgccgccggcccgctgccgctggtgatcgtgatccaggagatcttcggcgtgcacgagcacatccgcgacctgtgccgccggctggccaagctgggctatttcgcagtggcgcccgaactgtacttccgccacggcaacccggcgctggccccggacaccgacaccctgctgcgcgagatcgtcgccaaagtccccgacagcgaggtgcagagcgacctggacgccacctggcgctgggccggcgccaacggcgccgacctgaagcgcgccgcggcgaccggcttttgctggggcggccgccaaacctggctgtacgccgcccgcaatgccgaactgaaagccgccgcggcctggtacggcaagctggaagggccggccaccgccaatatgccgcgttatccgctggatatcgccgcggcgctgaaggttccggtgctgggcctgtacggcggccaggatcagagcattccgctcgcgtcggtggaaaagatgcgcgccgcgctgaaacaggctggccaggacgacgatatcgtggtgtacccggacgccggccacggcttcaacgccgactaccgccccggctacaaccgcgcggccgccgaagacgcctggcacaagatgctggattggttcgcccgccacggcgcgcgctga

SEQ ID NO: 3329 - DNA, 1116 bp, Chromobacterium substugae
atggccaagcagcagcagatgcctgaaattgtcgatccgattgcgttccaggagtttcacgacgccatgctggattacgcgccgcagcttgagcttctggtgtgccagctgggcgacggctcggacaatgccgaaaagatagcccagctgttccgcatcctgcacagcgtcaaaggcgacgccagtctgtgccaggtgcatttcgtcgagccttatgcccatgcgctggaaaccctgctggaccgcgtccggcagcgcgagctgccatatctcgaagtgataggcgacgtgctgctgctggtgatggacaggctggtgctgatggtggaggcggtgttcaacggcgaggcgctggacgatttgcagctgccgaccgtgctgtccgcgctggagaagctgcccaagctgtccgccgacgaagtgccgcaggcctgcgccaagctggtgtccagcatgatgggcaaggtggcggccgcttcggcggccgactcagggttgacgagcggcacgggtagccgctcggagcgccgcttcgccgacctgcagtttttccgctcgctcgccttgcagctggaacagcgtctgccgccctttttcggccgcaccgagcgcaatctggcgttggcgctggataccaatcagctgatggcgcagccattgaacgtggagcaattggcggcggcggtgtacatgcacgatatcggcatgatgctgctgccggaggcgctgtggctgaaggtggggcggatgagcgaggaggagcggcggcagatgagcgcgcatcccggctgggcggccgggctgctggagcggatgccgggctgggaggaggctgccaagatggtcaggcagcatcatgagatgcccgacggccacggctatccggatggcctggcgggcggagacatctgcgacggcgccagcctgctggcgctggtggacgcgttcgaatccgtgatgctcaagcatgcgcagcagggccagcgccgttccatgctgcgcgcggtggtggagctgaacgcgtcggagcgccagttcgacccggagctgctgcagctgttcaaccgggtgatccgcgccaggctggaggcgagggcgtcggtgggcgggcgctga

SEQ ID NO: 3330 - DNA, 204 bp, Chromobacterium substugae
atggcaaccggtaccgttaagtggtttaacgactccaaaggttttggcttcatcaccccggacgaaggcggcgacgacgtgttcgctcacttctcccagatcaatgccaaaggcttccgcaccctggctgaaaaccagcgcgtaagcttcgacatcgtcgacggcccgaagggcaagcaagcctccaacatccagccgatgtaa

SEQ ID NO: 3331 - DNA, 552 bp, Chromobacterium substugae
atgccagaccatgaaaccgtgatcgccgccaccaagacttggctggagaaagccgtcatcggcctcaatctctgccccttcgccaaagccgtgtacgtgaagaaccaggtgcgcatccgggtgagcgaggcgagcacgccccagcaattggccgaagagctggccgacgagctgcagctgctggctcaggccgacccggaggaaatcgacaccacgctgctggttcatcccaaggtgctgcaacgcttcctcgacttcaacgacttccaggacatcgccgacgccatcgtcgaagagctggaactggacggcgtgctgcaagtcgctagcttccaccccaaattccagtttgagggcactggcataaacgacgtggaaaactacaccaatcgttcgccctaccccaccctgcacctgatacgcgaagaaagcatagaccgcgcggtggccgcctttccggaagccgaagccatctacgagcgcaatatcgaaaccatgcgccagctgggcgcggccggctggaagacgctgttcgagcacaaagccgactga

SEQ ID NO: 3332 - DNA, 651 bp, Chromobacterium substugae
gtgtttggcgcttgccccgacgctgggcgcgcgtcggttgcggagccttgcacgcggagccgcgccgctgctcagggccgtcatgcatttcactatttcgataccccggtgatccgggaactgttccgctggctgtccctgctgctgttgaagctgagcggctggaagctcaaaggcgaatttcccgccttagacaaatacgtgctgataggcgccccgcataccagcaactgggatttccccatcacgctgggcctgtgtttcgccgcccgcgccaagatctactggatgggcaagcacacgctgttcaaggggccgatggggccggtgatgcgctggctgggcggcattccggtgatgcgccaccagaacaactccctggtgcagcagatggtggatgtctacgggcgcagcagcaggctggtggtggccattccgcccgagggcacgcgcaaggcggtcaaggagtggaaaaccggcttctaccatatcgcccacggcgcaggggtgccgatcgcgctggcttatttggactacagccgcaaggaaggcggctttggcccgatgtttacgcccagcggcgatatcgagcgcgacatgccgctcattcgcgctttttatgccgataaggtagggcgctatccgggctga

SEQ ID NO: 3333 - DNA, 228 bp, Chromobacterium substugae
atgaacacgaccatagcccaaccccgcatcaggctggccgccgccgcgctcatcgccatcagcctgttgtccggctgcgccaatatgtctcatcgccagcaaaacaccgccatcggcgcagccgccggcgcggtgctgggatcggtgctgaccggcggcgacgccatcggcaccataggcggcgccgccgtcggcggcgtgatcggccaccagaccggccggcactaa

SEQ ID NO: 3334 - DNA, 1350 bp, Chromobacterium substugae
atgaactgggagcgactgctctccacccgccgcttcaagatcatccagggcgaagtgaaagaaacccgcactccggccacacaggaaggcggctccgggctgcgcaccgatttccacatcgaccacgaccgcgtggtgttttccagcgccttccgccgcctgggccgcaaaacccaggtgcacccgctggcgcggcacgaccacacccacaaccgcctcacccacagcgtggaagtggccagcgtcggccgcagcctgggcaatcgcgtcggcgtgatgctggagcacgacggcctgctgccgcccggctacaccccgcacgacatcggcgccgtggtgcaggtggcctgcctcgcgcacgacatcggcaacccgccgttcggccataccggcgagtacgcgctgcgcgactggttccgcgacgacagcaacgcgcattggctaaacggcctgtcggcggcggaaatccgcgatgtgcaaacctatgaaggcaatgcccatggcctgcgcatgctggcctcgctggaaatgtacagcggcgagggcggcatgcgcctcacctccgccgcgctgggcacgctgatcaaatatccatggacctccgacgcgccgctcgcccgcgagcgcgacaagttcaacctctaccgcaccgagctgccctatttcgaacgcgtggcggaagagttgggcctgctcaggcacagcccgctgcaatggagccgccacccgctgtcatacctgatggaagctgccgacgacatctgctacgcgatactcgacctggaagacgcggtggaaatcggcatccttgacttcaaggagttcgaaacgctgttctccggctttgccgaacacgagcgcgtctggggcgtgcacgacgtccgccagaaatgcggcacgctgcgcggcgtggccatcggccgctgcgtgaccgaggtcgcggaaaaattcatgatgcaccactcctcgctgctgcgcggcgagtttccggccaaggatctgatcaacctttgcgagccggcggtgcaggacgcgctgctgcaagccaaagacctggccagccacaaggtataccgccaccgcaccaagctggtgaccgaactggcctcctacccctgcatcgccaccatcctcaatgtgctggtgccggcggtgcacgccttcatcaccaaggacagcaaggatctgaccccgcgcgaacacctggcgatgggcctgttggacggccatattcaaactggcgacagcctgtatcaggcctatatgaaggtgctggacttcgtcggcgccatgaccgacaactacgccgccaacctggcgcgcgagctgtccggcgtcggcatcctgtaa

SEQ ID NO: 3335 - DNA, 633 bp, Chromobacterium substugae
gtgacccgcttctgcctggttcgccacggcgaaaccgactggaaccgcgaataccggctgcaaggccacaccgacatccccctcaacgacaccggcctggaacaggcgatccagctggcccgcgccttctcgcccggccagcaccgtttcgacgcgctctacgtcagcgacctcacccgcacccgccagaccgccgcgcccctggcagacaagctgcgactggcagccctcgacacgccgcagctgcgcgagcgccatatgggagcgctgcagggcctcacctatgccgaggcggcgcaacgcattccggacatttaccaacgccagcaaacgcgcgaccccgactatgacttggagggaggcgaaagcctgcgccgcttccgcgcccgcgtcctggatggcatggccagcatcgccgcgctgcatcccggcgaagacgtgctgatcgtcacccacggcggagtgctggacatcatgtaccgcgccgccaccgccaagccgctggaagacaagcgcgacttccccattcccaacgccgcgctgaactggctggattatcaggatggaagctggacgctgcggcgctgggccgatgaatcgcacctctccggcgcgctggatgaaatccagtga

SEQ ID NO: 3336 - DNA, 390 bp, Chromobacterium substugae
atgaccatagagaaaaccgacgccgaatggcgcgcccaactgacgccggagcaataccgcgtggcccgacaatccggcaccgagcgtccgttcagcggcgaacactactttcaccacaagcagggcgactacttctgcgtctgctgcggcgcgttgctgttccacagcgacaccaaattcgacgccggctgcggctggcccagcttctgggcagaggccgccggagccaacatccagcgcatcaccgacaccagccacggcatggtgcgcgtggaagtgcgctgctctcaatgcgatgcccacctgggccatgtttttgaagatggcccggagccaagcggggaaagatattgcatcaactcggtgtgcctggatttcaaagcgaaataa

SEQ ID NO: 3337 - DNA, 195 bp, Chromobacterium substugae
atgacgctggccttcaaccaagccaaggttgtgcagcaagaccttgtctcgcagcgttttttcggtcaagaccgcgaaaagcccacctgcggattcgatcagtggcgcgatcacttggaaacggcgctggttctcaggggtgtcagcttcctcctgatacttgatctctacaacggcgcgtcgaccgtcgcgtag

SEQ ID NO: 3338 - DNA, 1812 bp, Chromobacterium substugae
atgtcactccagatcattctggaaagcccggaagggctttccggccaagaaccactggccagtgctaaacagcgtccattcgacagccactcctctcttgctcaaaccgcggctttacggcggcaggcctatactgacgccttcaatgcccagcgtagcccttgctacaccaaacataagctggaagcgttcatccaagacattgcccaacgcatcggggatagcaacccaccctctagcagtacgctatatcgatggcatacgcgcctgcaaagcagcggaggcaaccccttggtgctcgtgcctaactttgaccgccgcggagggaaaggcccgcggatggaaggcgagttgctcctcttggcagaggccgcaattcaaacaacctacttgaccttgaagcgcccatccatccgactcacctacgaaaagctgcttatccagattgctgctcacaacgatcaagcgcctgcggataaacaactcaaagtcccctgctacgacaccttccgacggttggttcgcaatcaacctcagtatgaggtagatcttgcccgctacgggcgcgagtacgcccgcaaaaagtaccggcacagcagcatcacacccaccacgatgtacctgctggaacgcatcgagattgaccatacgccattcaacatcttcgtcatcgatgaggagtctatgctggtgctggggcgcccgtacatcacggtgatcatcgattgccacacccgcatgatcctgggcttctacttgtcgttctcgccacccagcatcgaggcggtgctgcgttgcttgcagcacgccatcagcagcaaggactatgtgaaagagcggtatcccgacatccagcatgactggccatgccttggcatccccaccactgctgtcgtcgacaacggattggagtttcactcccaggacctgctgcgtgctactttcgaactgggcatcaactatcagttctgcccgccccgcacgccgtggttcaaacccatggtcgagcgatcactgcggacgctggcggaacagttcgcccaccagttgcccggcaccagctttgccaactggttcgaccgctacggctacgacccactgaaagagtcgatcgtcaccctgtcagagctggtccacgccctgcacatctggatcatcgacatctactcccaggcttaccatcgaggcctgaagcagacgccgtatgccgcctggcaacgcgcggcggaaatcgtcacgcctcgcaccatcgatcctgatcgcttacgactggtgctctccaagcaggctgaacgtgtgctgggtcatgccggcattgagctacatggcttgcgttacaactgcaaagatctgctcccttggcgtaaacagctcggcgatcgcatcaaagtgcaggtccgtttcgatccagacaacctgggctcgatattcgccctccacccgcagaccaaagaagctatgcccgtgccctgcctcaccccggactacgccgaaggactgcaactgcaccagcacaagttgattcaggcatcgctgcgcaaggagggcctggcatccgccgatccgctatcgctggctcgggccaaggtacgcatgcaggaggtggtcggccaattgctgcaaagccgcaaactggccgaccgcaaacgcgccgcgcgggccaaaggcgcgcactcaagcaaggtgatgaccaccggcaaactgcctcctacgatttcagaggacgcagaactccccccgacagacagctggtcaccgcccagcacgttgcccgtactcgcccacgatctagaaggagatggccatgagtga

SEQ ID NO: 3339 - DNA, 801 bp, Chromobacterium substugae
gtgctgctcagctttgccaaacagcaccccagctacgaaacggaggaggcgacgatacgcccagtggtctatgtccaagtgcccgcccaccccaccatccgtggtctggcagaggccattctgatcgcgctaggggccggcgttcagctccggggcagcaccgcggagaagaccaaccagatcgtgcagctaatccgcggcggtaaaaccgaagccttgctgctggatgagttccatcacttcgtcgacgccggccgtagaaccttcgaggaggtcaccgagtggctgaaggccctgatcgatcagatcgccattcccacggtactgtccggcctgccagagtgcgagtggatcctgcgctccaacgagcagttgcgccgtcgcttcgccgcccgcgtggcgctgacgccgatcggtttctcctgcaacgaggacaagtccttgttccgcgacgttgtccatgcctgggacacgcagatcaatcaggggcgtccaatctggggactcgccgagtgggactgcgtcaggcgcctgcactatgccagcaatggcctgctcggctatctctccaaggtaattctgggggcattggaatgtttgatcgaacaggagcagcaagatctcgaccaaagcgtcttggctatggctttctccaactatatctggcgagacagcccgcctgagctgaatcccttcgatgccaactttgtattccgacgcctaaatcagcctgacgagccattcgagccgacacggttctcccggaggaatgctccaaaagccgccatccccgcgttgtaa

SEQ ID NO: 3340 - DNA, 1848 bp, Chromobacterium substugae
atgacctccccactactgcagatccgccccaagccgcaggcgggtgaaagtctgctgggctattgcctacgtctgggacacgccaacggctaccccggacagacttggctaccgttattcgtcaaaaagcacgacgccgccaagcagaatctgaccctgctcaccggccatgatcagacaggtttggaatgcctgacaggccctgcaccagccagcctgggccgccacagccaccatcgattcggtctcaaggtgacgtactggaaccaccaccaccgccgctggtgccccgtctgtctggccgagcacggcatctggcaaacggaatggctgctgaccctgcaaatagcctgcccgattcatcgcctgttgctacgagaaaaatgccccggctgcaaccaactcatccgctggcatcaaggcaccatgtttacttgcagctgcggcgccgacttgcgccatgccgccacacgtccaggcaccgcagccgagctggcactcgccaaactgattgcccaggccatccggccactgattggtttacccgacctcgctgtcagcaatatccccacgccgccggagttagatcatctgcacccggcacagctatgcgacctgctctggttctttggcgcctatgcctcgcatcggcccaatacccgaccacaaaaaatagccgatcatggccggatcgaaatcattcagccctatctgcagctggccatgcagatcgctcagcattggccgcaacgcttccatcagctgctggaggagtacacgctgcccatacccgggaacacggcatcactgcgagtgtacttgcgggaaatacatcaggccctctaccggctgctgatccatccagaactgctatttgtacgggaagaattcgagcgttatgtccatgcacgctggccggacaaactgatcctgcagcaggacctgcgccaggcccatcccatcatcagcttggccaaggcagcggaacagctcaatctctcaagaggagctgtacacaagctgatcgaaagcggcgccatcaaaggctgccaatcctcatcggctaaagggaaagccacttggatggtggagcgaagctcgctggatgcctacgcccgcaatgagcacggcacgctgaccatttcggaggtggaacgcatgctgcgcatcaccccaaaacggatccgtttgctgatcgaaagtggtttgctgcaacccctgccccacgataaaaaacgtactcgatggtgctttcaactggaaaccatcaacgccttcctggagcagttgaaccatagccagatcagcccagaaccgaacaatccagaactgctatcggtgtgggaaatcactaagcggtggatgcaaggcagccagcccttcttggcggtggtccgcgccctgcaagatggctcgctggaggttgtaggccgcaccccggccgaccatggcctccgcgcgctgctggtttcccgacagcaattcacgctctggcatgagcaataccgccgctcccgcggcttcttcacggtcagggaggcggcagccgccatccagatggacgtcaacttgctctatcacctgattggcgccggacatgcccacgctagccagcagcagtatggctatgagaagcggatgctgctgggtatcgaggccaaggagctggaacggttgaccaacaactacatctggggcgaacacttggcggaaatggtcaacaaaccggtgcgacaggccgccagacacttggttaaacaaggactatgtcccctctatgggccaatggagaattgcggggacgagtatgtgttttggcgcgcggatgtagctgcaagcctaacttga

SEQ ID NO: 3341 - DNA, 1581 bp, Chromobacterium substugae
atgcctattgaggactccgaacgacgggtagctaatgccctgaagcgtctgccagatggctggaggattcttcaccatgtgagctggcagtctaagcgcggtggacgacagggggacggggaagccgattttatcgtcctccaccctaacaaaggcatgctcgtcattgaagtaaagggtggtggcatcgatatcgaggccggtcgatggtttacaactgatcggtacggcaaacgccactcaatcaagaatccctatgagcaggctattatctcaaagcacgctctagttggctggctgcgcgagcatggactgggagcaagggtacgtgttggccacgccgtggccttcccgcatatggatagccttccattttcggggcctgcggccaccgctgagatcagtctagccaagccgcaactagagaatatctgctctgcaatcacgaattgtttcgagcactgggaacttgaagcggggatctcgcaagaggaagctgacaagcttgtcgcattgcttgcgccgaccgtttccatgctcccaaagctttcaagccaaagctctgaggccgaaaccgaaatccttatgtttaccacagaacagattgaggcattctcgggcttacgggctagccgtggaggtttaatcttaggtggagccgggacaggcaaaacagttctcgcaatcgcgcgggcccaacagcttgcaagagacggctttcgcactctcttggtttgttacaatgaattattaggtcgggatttgttggcacgcacggagaatcttccaaaccttaccgcgtgcacataccattcactatgccttcgagaagctcaccgagcagcactcgacataccaggacacaaaccttcacattggtgggaaaaagaggcccccaacctgttaattgaagcttgtgcaattaatgggacgttgtacgatgcagtgattatcgatgagggacaggatttctcaccactctggtttaattcacttcgctgtttagtatccactcaccctgacgcgcctttcttcacgtttgcggaccccctgcaagatatgtggaaacgggattggctccgagacatggattattcctttgcctgggagttaacgcgaaacatgaggaatacccagccgatagcaacttgtgttgtggccaccctgaatatggaatgcagaggcaggggaatccctgggccaaaaccaacctggaagatttcagagggagtaccgagtgaaaaggacgtgatatctgcggttgaaggtcttcttgaagagggtttcgggccatctaacctagtcgtgctttgcggatcagcgggcctaattacacgactacacgagcgttcagttggcccttattcctttggtaagtggggaagtcgcggaattgctaccgaaacaattgcccgctttaaaggtttagaagcacaggcgatcatcctagcactcccctcgatcaccacagccaatgatcgaatcgaagcctatgttggtatgagccgtgcacgttcaatgcttgttgtcattggacgagactctgatcgccgcctacttaattggcctgagccgctgtag

SEQ ID NO: 3342 - DNA, 1716 bp, Chromobacterium substugae
atgaaggaaaagaggagtgggtcgcaaatcctgtttggtcatcttcccgaacaaaccatagatgcagatggtggtatttggaaagttaaacgctggaacgaccccaagactgagtctgcaatagatgttgctgcattacgtgaagagatcattcgtgcagcatatccatggaaggaggaaaaatgcgacggtggtcttgttgatgatctctatgcccaacgtactgtcagggtgagatcattgaaccgtgaggaggggatatggtgtgagccatttccccgtctatacctttgccaaatatgtaagcggcttcatgatgaacctctggggctttgtgaatgtggttctcgccggcgtagaggtcagcttccttttgttggataccatgatgcctgcggatccatcaagaccccatacgtaaaaaagtgccgtacacatgggcagcgggctgtccgcttcccaggcaccgcatcggctgcagaattaattttctactgtccagaatgcaacgatatcattcagcgggggtttggtgctgcttgcgactgtgatcaaggtggaacattggcctttactgtccatcgctccggaacggttttcaagcctcgcggcatcagcatgatcaaccctcctcggcgagaaattctaaacactatcgagcaggctggtggtggcgaacgtgccctcgaatggattctcgatggaatggcagggaagcgtgtcactgactctgcacccgctcgcaattcagaatcaattaagaaactgcttgagggacggggattcgatactgcgaccatcgacgccatgattgctgcaatgcctccggcgggacaaggaaatacccgttcgccaatggcaattgatccacaattacggacagatgctgaaagacaggcaaagcagatagcattggccacgtttgagagtcgtataacgctgtctgatttgctcgcccagtcagaaggatttgtgaccagacagttgtataaggatgactatcctctagccctggcacgcgcgggtgtggagcgagtcgaacttatcgatcgttttcctgtactgacggctcaatttggttacacccgggggggctccgagccagggaaaagccgtcttcgtacttatcgtgacaagaatggggactatagcatttatggtgaactagcacagactgaagcacttttgatacgtctcgacccaatgatgctccataggtggttggtaagggtggggcaggcagtaggacctgcaaccgataaaaggggggccgctgaggccattctatcggctatgtctcccatggaccggccaaacgaggtgactcgcagggtgaccgaacttgtccattcgttctcgcatgcctttatcaagcgtgcagcagtgtactccggaattgatcgaaatggcttgtctgaactaattttgccgacggcattctcgttctttgtctacgcagcggctcgaggtagttttgtgcttggcgggttgcaggctcttttggaatcggagcttcatatactccttgatggattagtcgacgatgagcatcgctgtgcgttagaccccggctgtgaggataacggtgctgcctgtgcggtatgcctgcatcttggcgaaccctcatgccagatgttcaatgcggcgcttacacgcagagccctcgccggaggcgatgggtatttcgatgtaactacagcggctcaggccaattaa

SEQ ID NO: 3343 - DNA, 3090 bp, Chromobacterium substugae
atggaattcattggtccgatgcagacggatgagagcaagtatcaagcagccgagcggtttgttaactggttgcaaaaacgtgttctcattgaggcgcgtggtgatgacgagactacttctccggttgacccaactggccgctactggttgggacgactaggtcctaaggacttcgtaacacgccctgatttacggggggaccgtcttgaaccctgcgctatcggcttgcgccttcgccctgcagagagtggtccatgggcattcctggttaccgtccgattttccctttggctccgccgtcgttcgacagaagagaaagggttacgttgggcttacgacaagacgccatatattgaagttcaagtgccagtaactgtagaagagcgtaccggagaccaaatatttggtgaagtcgctttcagtgaggcttttagcacttggaatgcgaataatctctcagctgaagtacgggtgcgcttaacagggcgaacggcaagctcccgggcaatcgaggttacgttcgtgaatacgagccgtgaagatgtcgatctggcggatggtcgattcttcgaagcctcattgtcggtaacgggattaaaatgcgttcctttcgatctcgaaagccttcctgacagctttagattcaatcggaaagtgccagcctatggtattaactgtggtgttgagatcgatggtgaagcataccgcactagtgacggacccaacgcaacaagatttcgcccaaatttttcggcatcgtctgagaagaaggtagatgttagttttgatgggcttgcacatgatccgtgtgcaagtgcgacagatttggttggcatatttgagctttgggcctctgatgtctggtctgaggagactctggcgcagcgtgccaaagatgaaagttggtcggcaggcatgcgagaagaagcagctgctgcacggcaggaattccaggacgagttgagacgcataaagcgtggtgccgagcttcttgctaccaacccgaatcttcggctggcattccagcggatgaatcgttcaatgacgatatcggcgagaggtcggtacaaaaagtggcgcccttttcaatttgcgtttctcctcgcaaacctcgaatgcctcgttaatcatgaatctgagagtgatattgtcgatatcgtatggttcgcgacaggtggtggaaagactgagacttatctcgggcttattctcactgcggccttccttgaccgtatgcgcggaaagatatccggtgttaccgcgtggtcacgtttcccacttcggatgctttcgcttcagcagacgcagcgctttgcaaacgcgctggcggcggccgaactgattcgccgcgaagcaaaaattgaaggtgatcagttctcgctggggttcctggtcggcggctcgtcaactcctaatcgcataaagaaagagagcgataaggcgaatgaggacgtcgacaaaatcgaagagcgaacaaatccattcaagctgcttgatcgatgcccattctgtcgtgagcgtgatgtatctacctcattcgatcgcgtgtattggcgcctgaatcatctgtgttcaaacggtgattgcccgagtcagggagggccgctgccaatttatgttgttgatgatgagatttggcggtttttgccaaccgttgtgattggcacgcttgataaggctgcgaatatcgctaggcaaacaggcatgcgtggtctgcttggcagcccaaaggggaaatgtactaagcctgggcacggctacacatatgctactagaagtgattttcccaatggttgtttagttccggattgtcgagggggggctcctgaggggctccctatggcagaggagctataccctgcaatgttccggcttcaggacgaactccatctcctgcgagatagtctcggtgctgtagacgcgcactacgaatgcgctatggacggaattcaggaaaggatcgctggcagcaaaccaaaaattctggcttcctctgcgacgcttacggggtacaaaaagcaggtggatgtactttataggcgtaaggctcgcgttttcccattgcccccgcctgtggatggacagggattctgggccactgattcagataagttgatgcgtcgctatgtagcgctggcgccgcgccgactcacagtcgaattcgttgttgataagctgattgtaacgctccagaacgcaatacgtagtctccttaacactcctggtaaaatttgtagcgaacttaatatcgatccatcttatgcatcgttactggtggatttgtatggcaccaatgttgtctatggaaacacgctgcaggacatcgatgccgtggtgcgttcgtcagagactcagtatgctgagcttgtacccccaccaaatgtggcgacccttactggtcgtacgaatttcgaagaagtgcggcagactttagatcgcttagagtcgccagagcctgaatttgataaacgccttcatattatcgcggcatcatccatgatgtcccatggtgtggatattgaccgactgaacatcatgattatgttagcctttccacttggggttgctgaatttattcaggctacggcacgcgtaggacgcttctggccgtcactagtacttgtcatcccaaagatgacacgtgaacgagatgcaagtgtttatcgtgcatttccagaattcgttactcatggtgatcgattcgttgaaccaattcctatcaccaggaaaagccgccgtgttttggagcgtacaatctctggccttgagcttgcgaggatttccatgatccatgagccttcctcagcagcccctatcacgacgatcagatccctgaatgcctttgtatctgcgaatcagggcgtccttgccaatgatgaacagtcgattgcagaggatttggggcttgcggatgaggatgagttcatgcgtaagcagctaagtcaatggttcaccgatttttctcggaatctgcgcgaaccaccaagtgactcaaaatttctttcagacctttgcccaactgggaatgcaatgacctcactacgggacgttgaagagcaagtgccaattaaaggggatagtacgcgatga

SEQ ID NO: 3344 - DNA, 1686 bp, Chromobacterium substugae
atgccaagaggggctcgtatgaacaagaagacgaaaaatttgcgagcaatagacttatattcgggtgtcggtggatgggcgcttggattgagactagccggcatcgagatagttgcatcatatgagcgcaggggtgtcgctaacgagacaaatttcaagaataaccggcatcaggcccagactgtcgatatccggcgtctcgacctcaatgagctgcctaagaatattgacattgtcgtcggtagtcctccttgcactcaattctctttttccaatcgtggtggcaatggcgacattgaggatggtcttcaggatatcatcaagttcctcgaaatcgttgatcatgtgaagcctaagatgtgggcaatggagaacgtgccccgtgttgccaagattatcgaaactgagctcctacctaagggacgtcttcaccgcttcaagcatctaaatattgttccgcacacaatcaatatggcggatttcggcgttcctcagaagcgcttgcgctgcattgcgggcaatttcgatttcaatctgttgtcatcatatgtgccagaagtaccgaaaaagacgtttgggcaagtcatcagggcactggcttccgattcgatcgtcgatcctgtttatggtctgcagctcaacaggcagcatctccgtgaccatgttgcagaagaggtgttgagtgctgaggaagtgcgcataaacaaggcagcaaaggtgactcacccagtgtacaactgcatgtcttttccagatcggctagaccgaccggtacgcacgatcaccgccacatgcacacgtgtttcccgggagagcattgtcattgaggatcccaacagagctggtgcatatcgccggttgaccatcagggagcgtgcatgtctacaggggtttcctgtcacatttcaattttatggggagacttatggacagcgccaacagatggtgggcaatgctattccgcctgtcttcactttttatcttgcgcaggcactcaagaatgtaagtgctgataagcttacgaagctgtcagatgctgctactggcttggaatgcccaatccccctgcccgtagatgcaaagccagataggtcaggggtcaagtatcctgagaagcggaaattccgatttgcgatccctagtcttcgactaaagagcggtgttcgcttcgaaatgatcaacacgttcgagggcagccagccggtgtggaaagttgatttctattttggcacttcgaagtctattcagtctttgcgactcgacaatacgctacacacattcctcattggtaaattgccgaaaacgcttaggtccaaggtcgaggaaaagcttgcatcgctattgaatttcatccgcaatgcagacgttgctcatatgcagcgcatatggagccataagggggtcggatgtacgaccccattcatgctgctagatagactcgatgagtccggtacggatatggttaagctgttgggtggagacgaactccttgcgcaggtgttggttagcgatgcgattatggccgagtatggtcaggctgcgggtggccttcctggtttagcaaagctggcacggaacgcacccttgatcttggctggtcttctgattggatcgttggccaacatggagttgtcaggtcacgtcgatatggtgccgagagcacaaaaaaaacaagtggtgggttga

SEQ ID NO: 3345 - DNA, 747 bp, Chromobacterium substugae
atgtgtgaaagaattttggcactgccgcaacaagcagggacatatgccgctatggctccatatcagaaacccgatgtcagcgtggatatcgtgctgcttaccctgttcgacaacaaactgcaggtcgccttgcaccgtcggaacagtgcgccatttcaggatcgtctggcgctgccgggagggtatatccatgtggatgaggacctcactcttgaagaggcggctattcgcacgctgcggcagaaaacggggctcagtccccgttatctggaacagctgcgcacctttgcggggcgggaccgcgatcctcgcggctggtccgtcgccatttcctatgtggcgctgatgccggtagaggagctgcaatcggcaggagagggagtgttccacttctatgaggtggaccagctccccgatttggcattcgaccacgcgcagcaggtggctgaggcagtgcagagggtgcgcaacaaggccagctactccacgctaccgtgctggctgctgccagagacatttacgctgactcaactgcagcgtgtatatgagcagattttcggcgaaaccgtatcacgcggcaccttccgttcccggctggggatcagggttggcgaggtgcaggccggtgaagctgccgatgacgcaaacatactggtggctacggaggatttcttgggcgggagccaacggcctgctcgcttgttcagggtgaatcagctgagcctgttccggcgggcttggtggtag

SEQ ID NO: 3346 - DNA, 810 bp, Chromobacterium substugae
gtgaaaatattcaagattgcaaacggcagtcacaggctgccggtatcgctgcaaagcctggtctttcccggaggcgaagtacacgtcacggtcgaaaccgatgtccccggcgaagccttgctgattgatgcccacctcccggattcggcagccatcatgaccctgctgctagtaaccgacgcgttgcaccacgcttatcccggcacgccgatcaccctgcgtctgccctatgtgccctatgcgcgccaggaccgggtggccaatccgggcgaagcgctcagcgccaaagtgttttgtcagctgatcaatagccagcaataccagcgcgtagtgattcaagacccgcacagcgatgtggtgtcggcgctgctggaccgcgtcgaaatcgaagatcctctgcccgcgctgcgtgaggtcatccagcaaatcggccctgtcgccctggtggcgcccgatgccggcgcgcgcaagcgtgtgctgaagctggccaaatcattggcgctggacgtggtcttcgccgacaaaatccgcgatacccgcaccggcgccatcaccggcacccaaatcgcctccccgctgcctgatctccccctactggtggtggacgatatctgcgatggaggccgcaccttcaccgagttggccgcggccctggccacgcaacagcaaacgcagaaccaagaccatccgctttatctctttgtgacgcacggcattttcagcaagggcctggagcctctgctgtcctgctaccacggcatcttcacgcgcaacaactggacccaagacaaccgctgccagctggtttga

SEQ ID NO: 3347 - DNA, 1686 bp, Chromobacterium substugae
atgaacacaaacacccctatcgctgaaaaaaacgccctggttccattcaatcttgccgacttctacaaaaccggccaccccgccatgtacccgcaagaaaccaccaagctagtggccaatttcacgccgcgctccgccaagtacgcgccggtgctgccggaactgttcgacaacaaagtggtgtggttcggcctgcagggttttatcaaggaatacctgcaagagctgtttcagaaggagtttttcgccaaacccaaaactgccgccgtacgaaagtttcagcgccgcatggatacggccctaggccctgaggcggtgcccgtcaaccggctggaagccttgcatgacttaggctatctgccgctggaaatccgctctttgccggagggtgttcgcgtagacatcaaggtgccccctattgtcttcatcaacactcaccccagctttccctgggtagccacgtatttcgaaaccttgttcagctgcgaatcgtggaagccctccactgtcgccaccatcgctttcgaattccgcaaactgttgagctatttcgccaaactgaccggcgcgccgcaagaatttgtcgactggcaaggacacgacttttccatgcgcggcatgagcggcgtgcacgacgccatgcgcagcggcgccggccacttgctgtccttcaccggaacagacaccattccggccatcgactatctggaagacttctacggcgccaatgccgatcaagagctggttggcggctccatcccggcatcggagcacagcgtgatggcgctgcgcatcctgctgacccagcagcggctggctcgcgatccggcacatgcccacctggacgccaaatccttgcgccgcctggcggaacgcgaggtgattcgcgagttcgtgacccaggactatcctgtcggcatggtctccttagtcagcgacaccttcgatttctggaatgtcatcaccgtcatcgccaaggaactgaaatccgacattttggctcgacaagccaacgcgctgggcatgtgcaaagtggtgttccgacccgactccggcgacccggtacgcatcctgaccggttatgccgacgatgaggttcgagcagatgccgaagctggcgggtatgaggtgatcgccactggacaacgcattaccgatgcggaacgcaagggcgcagtggaatgcctgtgggacatttacggcggcacggtcaccgaacgcggctacaaggtgctggattcgcatgtcggactgatctatggcgactccattaccctgcagcgcggccgcgacatcatgctgcgcctggcggacaaaggcttcgcctcttgcaatgtcgtcttcggcatcggctctttcacctacaacatgctgtcccgcgatacttttggctacgcgatgaaggccatctatgccgaagtagacggcgagtgcgtggacatttacaaagacccggctacagacgatggcaccaagaagtcggccaagggcctgctgcgggtagagcaagaaggaaaccagtatgtcctctacgaacagcaaaccttggagcaatttgatagtggcgcgctgcaaacggtattccgcgatggcgagttgctgatcacacagtcgctggcggacatccgagctagactccaagcttcgtggacttgccccgaaccgggtgccatcgcttggggctaa

SEQ ID NO: 3348 - DNA, 2709 bp, Chromobacterium substugae
atggtttctatccatgtagatggcgaagacaagaccgctcaaatcagcgactggacaattgcctggagtaaaaaagacgaagctctgaagttgacctgccattttccatccaagaaaacctacacgcgcccgctcagcgattgccgcatagtgcctacccgggagctgggcgagatgctgctgaagaagcgcaacagtagcgtcgtcaagcctatagaaaaagcgatggtctacggcgagcgctatgcccttgtctactatccgggcacagccaagccctatctgcacaagttggacagcatcagcttcgtcgcacagaccgcgctgaaggaaagctcggtctttcgctactttgcaaacgttgcgcatgcccggcgggaccgcgccagctcatcggaccaacaaaccatcgcagccaatgtcattcgccaactggaaaaactcccttcctgcgccgataccgctttgcacgcctattgcacgggtcagaacggaaggcaagcgccgggagaagcactgatctatccgtttggtgtcaatgaaagccagctggcggctgttgagcaggccttcagcgcgcaaatcagtgtgattgagggtccaccgggcaccggcaagacacaaaccatcctcaacattctggccaatatcctgctgcgtgggaaaacagttgcagtgctgtccaacaacaatgcggcggtggaaaacgtctacgacaagctggaaaggtttagccttgaccacctggtcgccaagctcggcagccaggagaatcgggacaacttcttcgccaaccagcctccctggccatcagctgaacccgaagctgcaccggaaatggccgagatccaggagatgctggcgcggttgaaacagcacctgcacgatcacaaccgagcggcccagctacaggcggaaatcgacgagctgaacatcgagcggcgctatctgcaacactggcagaaagacagcggagtatacgtatccgttcccctggacaaatacggcttgtccccgcgcaaaacggcggacctgatggcttatctatcccatcttggcgaacagcgcgtccggctcagagaccgctttgaattgctattcaacttcaagattttccgtaccaagcctttcgcccagctcgatgatcgcctgtccttcttccatgccctgcagatgcattactacgacaaggcgctaaaagacaaggaagcggctctgcagacttgtcgcgaatcgctggcgcgcgggaatttcactgccctgttgcaagaattgacgataagttcaatgcactatctgaagcaacatctgcatactcaagatcgaggatcagataccttcgacgcaaaaacataccgcaatcatttcgatgacttcgtgaagcgctttccaattgtcggcagcagcacgcactccatcgtcaactcaatcgcgccaggaacgatcctcgattacgtgatcatcgacgaggcctctcagcaggacatcgtgcctggcattctggcgctgggttgtgcaaagaacctgatcatcgtcggcgacagtcgacagctggcgcacattcccgtgaagctggacctgccggcccccgccgacgcctatgattgcgagcgatacagcctgctggactcctgcatcgccgtgttcaaggatgccgtacccaggactttgctaaaagagcactaccgctgccatcccaggatcatccagttctgcaactggcaattctatggcaatgagttgatcccaatgacccaggacaagggcgaggcacccctgcggctggtgctgaccgccaagggcaaccacacccgggaaaacaccaatcagcgagaactggactccttgctcaaggtgttggacggcaaaggcgagtccatcgaatgggaccaggacggccgcggtttcatttcccccttcagagcacaggtcaagctctccagtacctgcctgcccggggatttcgtcaaagataccgttcacaaattccagggtagggagtgtgacgaaatcgtcttctccaccgtgctggacaagaagcgccacaatcaggaacgactggattttgtcgatgatccgcgcatggtcaatgtggcggtgtcgcgggccaagagccgattcaccctggtgaccggcgatgaggtttttaccgcaaacaacggccatatcgcggccttgattcgctatgtggagtattacgcggaggacggacaaattgcgcgggccccggtggtatcagcgtttgatctgctgtaccgggaatttgaccagtcactggcacgactccagaccaggctacgccccgaagactcgcgcttccaatccgagcaaatcgtggcgcaactgttgcgtgaagctctgtccaaggagccataccggacattgacatgccacgcccagatccggctgaaccaggtcgcctcttcactcaatccggctttaacggagcgcgagctggcgttcatgcgcaaccgcgccagctgtgatttcgtagtgtatttcaaagtgggcaaaaccccgctgggggtgattgaagtggatggcggctctcacgaccggcctgagcaggcaatgcgcgatgccttgaagaacagcatcctgacgaagagcaatattcccatcctgcgcctgcgcaccgtagaaagccacatcgaagaaaagattgatagctttctcgctcaatgggcgagtgctacaacaaatgactga

SEQ ID NO: 3349 - DNA, 1275 bp, Chromobacterium substugae
atgatcctgctgttgacgctggcggtgggcggcgtgtcttattggtcggctttcaaagaagccaacgacatgcaggacggcatgctgaatcaggcggcatggctgctggaccaagagcgggtgccgcctatcgagaccacggccatgcacccggtggtgttggaaaacgagtctagggtgctgattcaatttttagccgcgcatcaagccgtgccgggccggctgccgctcccagccgatctgccgaatggattgcagaccttgcaattgaacggcgagccttatcgcgtgctggtgaaaacgctattcaacggggttcgcgtggcggtggcgcaggagcggcatattcgagacgacatcgcggcggacgtggcgatgcgtaccgccttgccgccttttttgttgctgcccttcatgatctggctggtcgcgcgcctgatcaaaaacatgttgcggcccataacggaattatctcgggaaatcgatctgcgccaggtaacggagttgcactccgtcgaggaggagcgtttgccattggaaatccgtcccttcgcggtggcgatcaatcgcctgctggaccgagtgtcgcagagcgtggacagtcagcggcgctttctggccgatgccgcgcacgagctgcgttcgccgatgaccgccttgtccttgcaggcggagcgcttggccgcgatagatctgccggacaatgcccgggaacgcatggcgactttgcgttgcggcattgagcgcagccgccgcttgttgaaccagctgctgacaatggcgcgggtgcagactacggccgctccgcaagccggcatggctgcgccggtgtccatccaggcggtgtttcgcagcgtgttggaggacttgatgcccttggcggaagccaagggcattgatatcggggtggaggatgggacggatgtcgcggtgaaggcttccgaactggacctggccacggtggtgaaaaacttggtggacaacgccatccgctatacgccatctggcggcaaggtggatttatccgccggcgtcctgcccgatggcgtttttttggtggtggccgacaatggccccggcattccggagcccgagcgcgaacgggtattcgatccgttttaccgaatgctggggactgagcagcaggggtccgggctgggcttggctatcgcgcgcgaggtggctggcaggctgggcggcagcatcgccctcaactggagcgaagaggctgaacggttgggtttgaaagtggtggtgaaattgcgggctgattga

SEQ ID NO: 3350 - DNA, 666 bp, Chromobacterium substugae
atgagggttttgttgatagaagacgatcccatggtgggcgaggctgtcgtgtcggcattgcgggacgccagctacgcggcggactgggtgcgggacggcaagcgcgcgctgttggctttggaaaatcatgtttatgacttgttattgctggatctgggtctgcctggccgagatggcatggatgtgctggctgccgtgcgccgaggcggcaatccggtccccgtgctgatcgtcagtgcccgcgacagcctggacgacagactgaaaggcttggatggcggcgcggacgattacttgctcaagcccttcgacatggctgagctgctggcgcggatgcgcgcggtggccagaagaaaaagcggccacgcggccgcctgtctggggaacggcgtggtaacgctggacccggccactcgcgaggcaagcgccgccggcgccgatcccgttttgctgtccaatcgagaattttcgctgttgcaggcgttgttggcgcggcctggcgccattctgtcgcgcggagaattggaagagcgcatctatggctggggcgaagaggtggaaagcaatgcggtggagtttctgattcattccctgcgccgcaagctgggcagcgccgtgatcaagaatgtcaggggaatgggatggatggtgtccaaaagcgcctga

SEQ ID NO: 3351 - DNA, 171 bp, Chromobacterium substugae
gtgacgttccgcggcgcaaacgcagccgcggcctatcagcctgccgctgccaatggcgcgccggcgcaggatcaggtccgcatcagcagcgcgggccgcgccaaacaacaggaagaagccgccgagtccgccgcccaagccgcgcaagaggcggcgagcggacaaagctga

SEQ ID NO: 3352 - DNA, 597 bp, Chromobacterium substugae
atggatgatgtcaattacacgctttttgaatggctcaacgcgccggctttgccatctggttgcttgttggcgctggccaaatttttaggcgaatacttgattgcgctgatgccgctgctgttggccggctgttggctctggggaggggcccggcagcgcaaggcggctttggaggccctggcggcggccttgtcggcgctggggcttaatcagctgatcgcctggctgtggccgcagcctcggcctttcatgctggggctgggacattgctttctcaatcatgccgccgatgcctcgttcccgagcgaccatctgaccttgtggtggtccgtcgccgccagcttctggttggggagggcgatgcgaaactgcggatacggtttgctggcggccggcttgcctatggcttgggccagaatctatctgggcgtgcactttccgctcgatatgctgggcgcggcggcggtggcctggttcagcgcctgggttgcgtatcgattggcctggcggtatttgccgcctgtttattgcgcggcattggcgatggagcgtcagctgtccagctatttttcctcccattccgggagtgttaaataa

SEQ ID NO: 3353 - DNA, 537 bp, Chromobacterium substugae
atgtcggacaatgctcgctatccgctttccgtcagcttgttgcactggttattggccttgctggtgtttttaaatttcgcgctcggttacttgctcgatgacgaagagtcgctgctggccgcgcataaattgatcggggcctggattttattgctggcgttggcgcgggccgcgaacaagatgcgcttgcgcaagcgcttgccggcctcgctcaatccgcccggctcctggccgtatctggcggaaaagtgggcgcatggcttgctgtatctgtgcatgctgggagtgccgctcttggggtggctgaaaaccaatgctgcgggtcacgccgtgacgttgttccccggcttggatttgccggcgctggcggcgacaaaccgcactctgtcgcactggttcggcggcatgcacgaaagcttggccgccttgtttgctttgttgatcgggctgcatgtcgcggcggcgctgtggcatcgcatcagccatcccggcttggggcaggcgcggatgctgcccatgcgcggcgtgaaacgctga

SEQ ID NO: 3354 - DNA, 324 bp, Chromobacterium substugae
atgttggcgctgactgtgccggcgcaggctggcgagctgaaaagcttgatgaaggatatgaaaaccgcgatgaacggcgcgatgggcagcgccgacgtcaacgagttttccaattgtctgcagcgcttgcgcctggatgtggaccgcgccgcgaaactgccttatcccgataatccaaccgattatcgggagggcatgcgcactttgagcgtcgatttgaacaaggcggaacagttcgcccgagcgggcaaccttgcggcggcgaagcaatcgctgcaagccgccaatcagaccaagaagcgctatcaccatttgctcaactga

SEQ ID NO: 3355 - DNA, 477 bp, Chromobacterium substugae
ttgggcctggccggcggcctgcttgcggcgacctccgccgctctcgcctcgccgccgctgaaaaactggttcgacgaccccttcttccaggcgcgcggccggatagccgcttgcccgctgccgcagggcccgttcgccaccgaggcggaaatgaaacagcaagcgcattcgcgcatcgagcgcggcaccagctgctggctggccaaacaatgcgccaagcccaacgcctacatgtacgacgccgacatcgccgccgatttgcggcgccgtttttctcaaagccgccgtttcgccgacgccagcctatggctcaccgtgcagcgccgcttcgtctacgtggaaggctgcgcccgcgcgcgccgcgcggtggccgggatagagtctttcatcaagcgcacccccaatgtgcagctggtgatcgccaacatccgcgtcggcgcggaaaagccaggctacgcggtgatgcccgcgccttag

SEQ ID NO: 3356 - DNA, 492 bp, Chromobacterium substugae
atgaatcttccaaaatcagagcttgatgatgtggatcgcgccatgatggcgctgctgcagcgggacggcaggctgtccaatgcgaagctggccgagcaagtggcgttgagcgaaacgccgtgctggcgccggctgaagcggctggaggccgacggctatatcgagggctatcaggcggtgctgaaccgcaagaagctgggctacggggtgctcgccttcgtgcaggtcggtttcggcagccataccggcgatgcgccgctgcgtttcgaggcgcaactgcaggcgattccggaggtgttgtcctgccacaacctgaccggcgagtgcgattacctgctgcaggtggtcgccgaggatctggaagcgttcggcgttttcgtgcgcgacgtgctgcgcgagctgcccggggtatcgtcgatccgctccagcttgtcgctgcgcgaggtgaaaatgtcgggccggctgccggtagcggcggatcggcgcggatga

SEQ ID NO: 3357 - DNA, 618 bp, Chromobacterium substugae
atgctgccactctccctgctgtcgctatacctagccgccctggtcgccgtctatgtcttgccggggccggacatggcgctggtgatggccacctccgccagccgcggcgccggcgccggcctcatgaccgcgttgggcatcgccgcatcgcgcttcctgcacgtgatgatgtcgggcctgggcctcgccgcgctgatggccacccacccgctgctgttcaacgccgtgcgctggataggcgcgggctacttgctgtggctggcgtggaaagtcgtgagcgccaagcctgcggctgaaaacgcgcctcaagtggcggaatcgggccgcgccgcgatcgcgcgcggttttctgaccaatctgctcaatcccaaggccttgatgttctgcgccttgttcctgccgcaattcgtgtcgccggcgtatggcgcggcgctgccgcagttcgcattgctcgcggccatcctggtcgcggtcgggctgtgcttcgataccgcctacgccttcgccgccagcggcatcgcacgccgcctgaaaaccagccgctcgacggcgaagctgcaaaaaggcctgctgggcggcatgttcgtggcgatggccgggcggctgatcttcggctga

SEQ ID NO: 3358 - DNA, 933 bp, Chromobacterium substugae
atgccactgcctctgaatctgaacctgctgcgttcgctggaagcgctgctggaaacccgcaacctcacccgctccgcagacaagctggggctgacccaatcggcgatgagccgccacctggtgcagttgcgggcgcagttccacgacccgctgctgctgcgcgagggacagcgcttcgtgctgaccgagcgggcggaagagctgcggctgggactgaaaacggtgctggagcaggtggagcggctataccagccgccgcagttcgatccggccgtctgcgagcgggagttctccttcgccggctccgactacctggccgaatacatgctgccggacatcctggaccaggtgctgccgcaggcgccgaacatgcgcctgaaattcctgccctggcaggccgggcgtttcgacatgctggtggatggcagcgcggacctggtttccaccatcgccgacgaaatcccggacaacatctacggcaagtcgctgggccaggatcagccgctgtgcgtgatggcgaatgaccaccccttgcgcggcaagtccgcgctgaaacaggacgactacctggcctggccgcacgcgcgcgtcagttcggccagcgacaaggacggcttcgtcgacgtgcagctggcgcaaaacggtctggcccgccaggtgcgcatcgccaccccctatttcgtgtcggcgctgagcatcgtctcccgcagccagatgctgctgacgctgcccgagcacttggccgtccgcttccagcgccaattcccggtatgcgccaagccgatgcccttcatcgattacacctaccgctactggctgctgtggcatggccgcgcggacaaggacccggcgcaccgctggttccgcggccacgttttcgacgcgctgcaccactccatccacggcgtcagcaactatgcgggagacgcatag

SEQ ID NO: 3359 - DNA, 624 bp, Chromobacterium substugae
atgacctggacgatctggctgcaattcgccggcgtgtgcatgctgggcgcgatgtcccccggccccagcctggcgatggtgctgcagcagacgacccgcggcggacgaagcagcggcctggccgccgcgtcgggacacgcgctgggcgtgggcctgtacgcgctcgccgcggcccagggcctggcgctgctgatggcggcgcacccgctgttgttccgaatcatcgctggtctgggcgccgcctatctggtgtggctgggcgtgcagggcctgcgcgcggcggcccgtccgcgcgcggccgccggcgcgaccaccgccgccgccgcgccgacgtccgcctggaaagccgcccgcaccggcctggccgtgtcgctgtccaatccgcatctggcggtgatgttcgtcgccctgctcagccagttcgtcaccgtcgatatgccagccagcggccaggcgctgctgatcgtcaccgcgatggggctggattttggctggtacgcgctgctggcgctgctgatctcccagcccgccgtcctgggcggcctgcaccgcaaggccagatggatagacggctgcggcggcgcgctgatgctgctgctgggtctgcgcatcctgatggtgtga

SEQ ID NO: 3360 - DNA, 459 bp, Chromobacterium substugae
atgaaatggaatccgcaaactttcgccgcgctggccgcgcgccacggcggcgaattgctggagcacgacgcgccgctgcgctcggcccgcgagggtgccgcccacttcggcatcgccatggcgcagaccgcgcccacgctgattgtggaggccgacggcgacatcttcgcctgcatcctgtctggcggccgcaacggcgtggactgggacaagctagcgcggctgctggaccgcgcccatgttcgcctgcttgaccgccgccgcgtccgcgatatcaccggttgcgacgccggcgcggtgccgccgctgggcctgggcctgggcctgccctgcgtgatggaccgcctgctgttggcccacgacttcgtctacggcggcgccggcgatccgctcagaacgctgaagatcgctccccgcgtcctggcggaactgaaccgggtgtcggcctggtacgaatag

SEQ ID NO: 3361 - DNA, 780 bp, Chromobacterium substugae
atgagcaaaagcatcatttccgacatggatggcgtgatctatcggggcaagcagctgatccccggcgcgcgcgaattcatccagcgcctgatcgacacccgaacccctttcctgtttctgaccaacaacgccgagcagacgccgctggatttgcggctgaagctggagagcctgggcataggcggcctgaccgaagacaacttcatcaccagcgcgatggcgacggcgatgttcctgagaagccagacccgcaaggcgatgcccaccgcctacgtggtgggcggggccggcctgatcaacgagctgtacaacgtcggcttctccatttccgaatcccatccggactacgtggtggtggccaagtcgcagactttcagcttcgagcagatcaagaaggcggtgcgcttcatcgaccagggcgccaagttcatcggcaccaacccggacatgatcgacccgatcgaaggcggcggctacgagccggccgccggcacgctcttggcggcgatagaggccgccaccggcaagaagccctacatcgtcggcaagcccaattcgctgatgatgatgctggccacccgcaagctgggcgtgcatccggaagaggcggtgatgataggcgaccggatggacaccgacatcgtcggcggcctggaggccggcatgagcaccgcgctggtgctgtccggcgtctccagccgcgaatcgatggagcaattcccctatcagccggactacgtgttcgacagcgtcgccgacatcgacccgcaagccttgtga

SEQ ID NO: 3362 - DNA, 342 bp, Chromobacterium substugae
gtgggcatgggagtggcggcctttttccggatgttggctcggcgcggcggcgcggccccgcgcgaacgcgccgcgctaggcttcaaattgaccctgacctgcgcggcggcggagttgaccagcctgcgcaggcaggtgatgcgcgagctgcgaagccggggcctgtgcgcgtgccgcatcgtcagcatgccggcctgcgccaacgaccgcgcctgcctgcagatcgtgctgagcggctcggcgctggggccgcaggcctgcaatgagctggcgctcagcatcagcaagctgccggagatagaccgcatccactggggccgcgccgcgctgcggccgcattga

SEQ ID NO: 3363 - DNA, 1101 bp, Chromobacterium substugae
atgggccgcctgttctggaagttcttcctgtttttgtggctggcgcagctgctcaccatgggcggcgtggccaccgcggtgtggctgggccatcctgatcggccccggccggcgctggccgccggagaggggccgccgccggatgccggccccccggcgcacggcccgccgcggccgccgcgccatggtccgccgcctgccggcctgtccatgctgttgctgcccttgctggccggcagcatcgccagcttgctgttcgccgccttgttggcctggtatttcgccaaacccatccggactatgcgggccgcgttcgacgcggcggcgacaggacggctggatgtccgcgccggcgccgcgatggcggggcgcaacgatgagctggccgatctgggcgacgatttcgaccgcatggccgagcggctgcaaaaactgttggacgcgcagcgccggctgctgcacgacgtgtcgcacgaactgcgttcgccgctggcgcggctgcaggcggcggccgacctgacgcggcagcagccggagcgcgcggcggagttcatcgaccgcatcgagcgcgacacggcgcggatggatgcgctggtgggcgagttgctgaccctggcgcggctggacgccggcatcgccgacggcgtggaagagacgttcgatctggccgagatgctggccgatatcgccgccgacgccggtttggaggcggaggccaaggcctgcgccatcagcgtggattgcgccgggcatctgagcgcgcgcggcagccgcgagctgctgcaccgcgccatcgagaatgtggcgcgcaacgcggtgcgccatgccgaggacggcagccgggtggagatcgccgcccgcgccgacgccggccggctgcgcgtcagcgtgtccgatcgggggcctggcgtgttcgacggcgacctcgccgccattttcgagccctttttccgcagcggttcgcgccctcccgccgccggctacggcctgggcctcgccatcacccgccgcgtgatcctggctcatggaggcagcgtgatggcggccaaccgcgtcggcggcggcttgacggtcaccatcgacctgccgtcggccggctag

SEQ ID NO: 3364 - DNA, 684 bp, Chromobacterium substugae
atgaatgtgctgctggtggacgacgacatcgaattgctggagctgctgcgcgactacctggcgcgcgaaggcttcgccgtgtcctgcgcccacgacggcccggccggcgtggccgcggccttgtcggggcggcatgacatcgcggtgctggacgtgatgatgccgggcatggacggcatagcggcgttgtcccgcatccgcgccgcgagcgcgatgccggtgatcatgctgaccgcgcgcggcgacgatgccgaccgcatcgccgggctggagctgggcgccgacgactatgtgcccaagccatgcacgccgcgcgaactggcggcgcgcatccgcgccattctgaagcgtgtggcaggcgcggcgcagcttccggcggcgccggccatcgtggccggggcgctgacggtgtggccggcgctgcggcgggtggagcgcggcgggcaagcggtggagctgaccagcaccgaatacaatctggtggaggcgctggcgcgccacgccggcatgccggtgtccaaggccgaattgtcgcaacaagcgctgggccggcccttggcccgcttcgaccgcagcatagacgtgcatatcagcagcatccgccacaagctggggccgctggcggacggcagcccgcggatccagaccgtgatccgcaagggttaccaattgatagccggttga

SEQ ID NO: 3365 - DNA, 492 bp, Chromobacterium substugae
atgcagaccgcgaagaaacgatggaccatccgcctggcggcgggaatggcggcggcggcgctggccgccggggtgatggcgcatgaaccggccggcgacgagcagcctgccgaatgcccgcctctgccgccgctgcacggcgccggctggctggccgtcccaggactgccgcaggcggcgctgcgcggcatcaagctgaccgaggcgcaagaggacaagctattcgagttgtcgcaggcgcaagcgccggcgcggcgcgcgctggccaagcaagcggcgcgctcgcatgaagacctgcgccgcgccgccgaaaccgagcctttcgacgaagcgcgggtgcgcgcgctggcggaagtgcacgcccaggcgatggccaggctgtttctgatgcaggccgagctggatgccaaagcccgcgcgctgctgacaagcgagcaacgccgacaatacgccgcggcgcgcccggcgccctgccctcctcaggcccgctag

SEQ ID NO: 3366 - DNA, 864 bp, Chromobacterium substugae
atggaaaacatcaattttcaaagcgatgccttctacgccaccaatccgtcattcactgccaccaatcatattattgaattcaccaaaccgctgaaaatcctgaaaatagattacttcacgtttgatcggcacttcaaagacaactccagagtggtgctgaccaattcgatagactggatcacccactactggcgcaacgacatgtaccagcacgccattttcgagaacaatccgctgagtttctccgatggccatgtcttctggaactggctcaaccgcgaacctatctattccgccgccagccaattcggcatagacaacggcatcaccatgatcgagaagcacatcgactacaccgatttctttcatttcggctcaatcaatgacaacagcgtgaacaacaactacatcatgagcaaaatgggaatcctgcaccagttcatttccctgttcaaatacaaaatgcaggacatgatcagcgatgccggcaagaaaagaatctatgttccggatttcaagaaaagcctggcttcgatacaggaaggcgaagtcaacaatgaaatcgtcgggctggatttttacaagctgatcaatcggcgcgatgtttcccggatctacctgggcgaggaatacaacaacgcctatctgaccaagaaagaggtagagctgatgaaggagctgaccagcggcaattcatgccaggaagcctcgctcaatctgggtatttccagcgacgcggtcaacaagcacatcaagaacatcaaggacaagctgaattgccgcacgctttgccagcttggcttcgtgatgggcaagctgagctcgaaaaacatctatccgtttttaataggcgacaggagttga

SEQ ID NO: 3367 - DNA, 699 bp, Chromobacterium substugae
atgaagatttggctggacacgatagatttcgacatcatccgcaatgcgcaagcgctgggcgttctcgccggggtaaccaccaatccggcgatactggccgcggccgacctgccggcgcaaaccgtcatcgaaaccctgctggacatccaggatggccaggtggcggcccaggtcacccgtgacgacttgccgggcatgctggcccaggcgcgcgcgctagcgcgaatcagcccgcggatggtgatcaagatcccggcgatccgccacggcttccaggcgatcgccaccttggaaaaggaaggcatcgccaccctggccaccaccatcttcgaaacccggcagatcctgatggccggcatggtgggcgccagctacgccgccccctatgtgaaccgcatcgaacaatccaccggcaacgccttcgccatcctcagcgaatcgcaggccatcctcgaacgctaccgctacaagaccatcatcatggccgccgccatcaaatcggtcgaacaatgcgtgcgctgcgcgcagttgggaatcggcgccgccaccctgccgtccgacatctaccgcggcctgttcgcctccaaccacgatatcgacgacagcctggccaaattcgacgcggcatgggcggcaagcaagttcacctccggctccagcctgtttcacgttccggccgccaaggaagcccgcctatga

SEQ ID NO: 3368 - DNA, 1224 bp, Chromobacterium substugae
atgaaccgtcccgaccccgcgctgaggaaaaccatcttcctggtgacctgcaccttcttcctgtggggcatgtcctacggcttgctcgacgtgctgaacaagcacttccaggaatccatgcacatcggcaaggcgcaatccggcctgctgcagctgtcttacttttccgcctacttcgtcatcgcgctgcccgcggcggccatcaacaagcgctacggctataaaaagggactgatcgcgggcctgctgctgttttccgccggcgcgctgctgttcatcccctcgctgcgcgaaggcagcttcgccggcttcatttgcgcgctgttcatcctcgcttgcggcctgggcgtgctggaggccaccgccaatccttacatgacgctgctgggcgacccgcgcggctcggaaaagcggctgaacctggcccagtcgttctgcggcctcggcaccatagtcggcccgctgatcggcggcgcgctcttcttcaggatcggcggcagcgacgcgcaagcgcagcacggcgcggtgatgcaggtttacgtgtggatttccgccttcgtggtgctgctggccgcggtgatcgcccgcaccgacatgccggcggcggagcaggcaagcgagcgcgcctccgacccgggcgcgtccctgctcggcaacggccgcttcatcggcggggtggccgcgcaattcttctatgtggcggcccaggtcggcatcggcgccttcttcatcaactacgcgatggaaaaccaggcctcgctgtccgccaaggacgccgcctggctgctgtcggcggcgatgctgctgttcatggccggccgcttcgccggcacctacgccatcgcccgcctgccttcgcaaaggctgctgaccggctatgcgctcgccagcatcgtcctgtcgctggtcgtcgtcttcgccggcggccggctggcggtcttcgccctgatgggcttgtttttcttcatgtccatcatgtatccgacgatattctcgctcgcgatcaaggacgtgggagcgaagaccaaacaggccggctccatcctgaccatggcggtcagcggcggcgcgctctatccgtacctgatgggctatatcgccgaccggcagcccatcgcccacgcctacctgctgccgctggccagcttcgtggcgatcttcgcctacggcctgtacctggaaaacaagccggcgccgctgccggcgcccgccgccgcgcgctga

SEQ ID NO: 3369 - DNA, 243 bp, Chromobacterium substugae
atggaactgaaaaacctagtcaagaaaatagaagacgacgacttcgccgtcgacagcatccagggcgactccgtgatcatcacccggcccgtgatcctgggcgagaaagactcggaatgggaaggttcgccgattttcaaccgcgaatacctgatagacctgatcgccatcagcctggcctaccaggtgttggaccactccgacctgaacaccgccttaagcaaagccaacgccttcacctga

SEQ ID NO: 3370 - DNA, 1407 bp, Chromobacterium substugae
atgttcgatacggaatgcatcgcgacagccggccgaatagcgccggcgcagcattatctgaaggctttctggcaggcggcgggcggcgatgccgccttgttggcccacgtcgcgatgacgggcgacggcgcgttgccgtcggcgttcgccgtcaccgatttcgccgcggcggcgataagcgcggcgggtttggcgatggcggagctgctggcgctggccggcggggcgatgccgcaggtggtggtggacaagcgtctggcgtcgttctggttcaccgcgtcgctgcggccgcaaggctgggccctgccgccaatctgggatgccgtcgccggcgactaccgggcggccgacggctggatacggctgcacaccaatgcgccgcatcaccgcgacgccgcgctggcggtgctgggcgccgcggccgaccgggaggcggtggcgcgggcggtggccggctggcgcgcggatgagctggaggcggcggtggtggaacgccatggctgcgccgccgccatgcgcacgttggccgaatgggccgagcatccgcagggccgggcggtggcggacgagccgctgctgcgttggcgagccggcatccgcgccgccgcgccggcatggacgccgacgcgcgagcgccccttgcgcggcgtgcgcgtgctggatctgacgcgggtattggccgggccggtggccacgcgtttcctggccggcttcggcgccgaggtgctgcggatagacccgcatggctgggaggagccgggcacggtgccggaggtgacgctgggaaagcgctgcgcgcggctggatctgaaaaacccggccggccgcgcccggctggagcggctgttgatcggggcggatgtgctggtgcatggttatcggccggatgcgctggagcggctgggcctgggcgcggcgcggcggcgcgagctcaatccggggctggtggacgtgtctttggacgcctacggctggaccggaccttggcgcggccgccgtggtttcgacagcctgatccagatgagcagcggcattgccgacgccggcatgcgcgccagcggcgccgagcgtccgctgcccttgccgaaccaggcgctagaccatgccaccggctatttgctggcggcggcggcgatccgcggactgagcgggcggctggcaagcggcgaaggctgcagcgcccaggcctcgctggcgcgcaccgcccggctgttgacggcgcatgccaaccccggcgatgccggcccgctgtcgccggagcggccggaggatctggctggcgctgtggaaagcacgtcgtggggcgcggcgcggcgcatcctgccgccgctggccatcgccggcgcgcccatgcattgggcgcatccggccggagcgctggggctggccgccgccgagtggcaataa

SEQ ID NO: 3371 - DNA, 1188 bp, Chromobacterium substugae
atggcccgctacctgagctccgccgccgccgccgcccgcctgggcgtctcccgccaaacgctgtacgcctacgtcagccgcgggctgctgcatgccgacaacagcggcggccagcgcgaaagccgctatctggaaaccgaggtggagcaactggccgcccaacgcacccgcggccgcaagcccaaggaagtggccaaggccaccctcagctggggtctgccggtgctggagtcggccatcaccctgatcgaggacggccagctgtactaccgcggcgagaacgcgctggaactggccgcctcgcagagcctggaagaagtggccgcccacctgtggcaatgcgacgccgcggccgccttcggcgtggacgcgccgccctggccggacacgctgccggcgctgatggcgcattaccggggccgccgcgccgaagagacgctgctgccgctgttcaccgccgccagcgacgacgcccccaccgcgctgtggcagaaatcggcgccgcgccaggccgaaggctgcggcgccatcctgcggctgatgacggcctgcctgctcggcacccggcccgacgccgctcccatccacctgcaatgcgcgcgcgcctggggcgtggacgccgaaggcgcggaactgatccggatggcgctggtgctgtgcgccgaccacgaactgaacgcctccagcttcaccgcgcgctgcatcgcctccaccggcgccagcctgcgcgccgcggtagtcggcggcctggccgcgctgaccggcggccgccatggcgccaccaccgccaggggcgaggcgctgctggacgagataggcgatgacgacagcgggcaaaaaatgcgtgaacggctggcaagaggagaggatttgccgggatttggccaccatctctatcccaatggcgacgtccgcgccatcgccctgctggcgcggatattgccccatcgcccgcgcttgaaaaccatggtcgagcagggtctggccctgaccgggcagccgccctccgtcgacttcgcgctggtcgccgtgcgccggcacctggggctgccgcccggttcggccttcggcctgttcgcgctgggccgcgccgccggctggatcgcccatggactggagcaacgcgatggcgaaaacctgatccgcccgcgcgcggcctacatcggcaagccacccggcatcgcctga

SEQ ID NO: 3372 - DNA, 1722 bp, Chromobacterium substugae
atgcgcctgtcccatattttcatcatcgccaccgtctccctgttcgtattgatcagcctgccgctggcatggatcatcagcagcgaatgggcggtcttccatgccaccgacgatggcctggacgccatacaggtggcgcatctggccatggtgacggtggagaagatcgcgctggagcgcggcccgaccaattcgctgctgggctcgccacccgatgacggccggcgcaagcggctgcagcatgcccgccaggccagcgaccacgccctgcttgccctgcggcgcgagctatcgtcgtccgcgtccgacgaccatcgccgcgccatgggctcggtgcgccagggagaggcgatactggccgatgcccgcgtccgggtggaccgcgtggccggcctgccgatgcgcgcgtctacccagatcatggacgcggtgcgccggatgtacgacgcgatcccgccggtgctgcaggcggtaaccgcgttgtcgttccgggcggaaagcatctatccgcaactggccaatccgctggccggtgcccgccaagccaccgagctgagggaatacgccggccgcctgggttcgcagctgaccgccgcgctgacggaaaaccgcccgttgaccgaagaggaaatccaggcggtggacatcctgcgcggccgcatcgaacagctgcacagcaccctgcgcctgcgcatcaacgtgccggaagcatcggccgccacgctgcaggccgcccaggcgatggaagaccattatttccgcgccggcctgcccatggtggaggccatcctcctcgccagccggcagggccgggtctaccaggtcggcccggccggcttcgccgccggctacgtgcccaccatggccaccatcgtgagcttgcgcgacaccatgatcgccgaggcagtcgcctccgcccaggcccgccaccggcgagcgttggtgcatctggcgctcgccgccgcgctgggcctgctggcgctgatcagccaggccgggctgttcgcctacatgcgctggcaagtggccaagcctttgctgcaagcctccacgctgctgaccgccatcgccaacggcaaactggacgccgacattcccgccggccgccgcaaggacgaaatcggcgaagtgctggcggccatcgaggcgctgcggcgcaacagcgtggaaaaaagccggctggaaaaagaaaaacagcggttgatagaagaactgaccgaggtgtccagcgtcgacttcctcaccggcatcgccaaccggcgcgccttcacccaggcggcacaggcggaaatcgcccgcgccggccgcaacgccgcgccggcggcgctgatcctgttcgacatcgactacttcaagcaggtgaacgacagccacggccatgacgccggcgacgccgtgctgaagcacgtcgccgccatcgccgagcaaacctgccgcgaaggcgacctgctcggccgctacggcggcgaggagttcgtggtgctgaccagccacagcggcggagccggcggcgtcagcctggccgagcggctgcgcgccaatctgcaggcgtcgccgctggccctgccccacggccaggccctgactgtcaccgctagcttcggcgtcgccgcgctgaatgaagagcgccattcgctggaaacgctattggccgccgccgaccacgcgctttacgccgccaagcggcggggccgcaaccaggtggtcgtggcggaaccatga

SEQ ID NO: 3373 - DNA, 996 bp, Chromobacterium substugae
atgtccgtttccgatttgaagaatggtttgccgttggcggagcactggctgccgcttgccggcgtgcgccttgccgccgcggagaatgaggtggagcggagcgcgttcggttatgtcctgaaagtgcaaaccaccatgaaggcgatcttgctgaacgagcctgaaaacggcgagaagcttgtccgggccaagcagttgctgtcgcagagccgctatacgtggggagatttgttcgagatggaggagctgtgcgtggaactggcccgcgacgacatgctggccatgatccgcccggccgatatcgatttgtcgctcgacatgagcgaaggcgatggcgtcgcttcggcgcaggaggcggcgaagcagccggcgggcgcccccgctgtttcgcgggcggcgttgagagccgcggtgttgcttggccagcagcgttttttccgggcgctgagacgcgaacgcgcattggacaggctgcgttttcgtttgggcaggttcaccctggcgctgctgttgctgggggcgtgctattactggttgtctgtcggccggacggatagctccttggcagtggccgccattttcggcattttgggcgcttatgcgagcatattgcagcgcattcaggatgtgggcaataaaaccagcggcaatgggcagtccggcgcgagcgtcgccatgctgatggatggctcctggagcctctatctggcgctggccagcggggtgctgttcggcattctgggattctggctattcgccgcgggcttgggcgccgcttttttgagcagcggtttggcgccgcagtttggcccgcatgagccatcctccgacgttttgccttatctgctgcgcggcgtcgattacggcaagatggcggtctgggcgttcttcttcggtttcgccgaacgtttcattcccgatttgctgacccagctggccaaaagcggcagcgccaacgacgatgcgggatccggttcggcgaaagccggcagatag

SEQ ID NO: 3374 - DNA, 2250 bp, Chromobacterium substugae
atgcataaaatccctctcgccgcgctttgcgccgccatggccgccgcgctgctggccttgcccgcgcaggccgcgccaaaacaaaaactgcagaaaaccccgcacctggcgcaggcccggccgcagcaggccgccgcgccgcgcctgtggcgccagcgcccgccgaccgacgcccaggcccgctaccgcctgcctgacaaccgcaccgtgatcggcaaaccgcagagaaaactggcgcgccacgccgccacgccgcaatgccaggacatgaacgcgctggccagccacagcggcgccgatctggccaactacctggccacgctgcccgattacacctgcggctacggcctgttctcgctggacaaaaaactggccgccaccatttacagcgccggcaatctgaacgccgtcgccggccgcttcgcccaggaggctgccggctacaatgcctcgtcgatggcgctggtcaatctgacgctctacctgcgcgccggctactacctggccagcaccggcgtcctgccggcgctggacgccaacctgcagaccgtgctgcgccccggcatcaagcaactggccgacggcgcggcgctgttcgccgccaacgcccaggcccccaccaccgctaacgaggtgatgacgctgatcaccaatatggcggacgaggcctattacctgccgtccatccgcgccatcgtccagcgctacaccaacggcgcggccaatcccgccgccgcgcaagccttgcgcgaaaccaccgcggcgcagggcttcaccggcgcgctgaccgtgttcttctacgcccacggccgcgccaacgccgcgccgctgctgcagaacgacggcagctactccgccgcgctgacgcaattcgtccaggcagacaaggccagcctgatcggcaccgaaagcgcctaccaattaggtgacgccacccgcgagggcctgcgcttcatgcaatacccggcgctcaagcccgccatcaagccgcaagccaaggccatcctggccggcagcagcatgaccggcgccgacaacgagctgtggctggcggcagccgaggcggtgaagtactacgacaatgccaattgctccgagtacggcacctgcaatttcgagacccggcttgccgacgccgtcctggccaaccgctacacctgcagccccaccatccatatccgcgcgcaggaaatgaccaccgagcagatgcagtcgtcgtgcgcgctgctgcagaaagaggaatcgtacttccaccagatgctgcagacgcataaccaaccggtggccaatgacaacaacacctcgctggaggtggtggtgttcgacgactacgacaattattccaagtacgccggcgtgatctacggcatcggcaccgacaacggcggcatgtatctggaaggcaatccggccgatccgggcaaccaggcgcgcttcatcgcccacgaagcgtcgtggctgcggccgacgttcaaggtatggaatctggagcacgaatacatccactacctggacggccgcttcgacatgtacggcgacttcgccgccgccacccgccagcccaccgtgtggtggattgaaggcctggccgagtacctgtcgctgcgcaacgacaatcagaccgccatcgacatcgccaagaccggcacttacaagctgagccagatctacggcaacacctacgacatggccgactacgtcccccgcgcctaccgctggggctatatggccacccgcttcatgttcgagcgccatcgcgccgacatcgacgccatgctgccgctgtggcgcaagggcgattacgatggctacatgggccagatgcggcagataggcaaccgctacgacgcggagttcgccaactggacgcaaaacgcctccactgccggccagccgccgctgccgcccgcctccggcctgccggcatgcgacgagggctacccgaatcggctgggcaagaattgctcgatcagcggccaggcctcgtccagcgcggcttacctcgccattctggtgccggccggcgtgcgcaacctgaagctgtggaccagcggcggcagcggcgacgtcgacctctacgtggccaaggaccgttacccgaccaccggcagctatgatttttcgtccgcctccgccggcaacgaggagtccgtggccatcgccgcgccgcagggcggacactggtattacctgacgctgcaggccaagcagccctttgccaacgtcaccgtcagcgccagctacgagtaa

SEQ ID NO: 3375 - DNA, 828 bp, Chromobacterium substugae
atggcccacatgctcatgcagcttccgcaacccagcatcatcagcgacctgccggccgcgcgcgccatggcggcgctgttcgaccacctgctggacgtggttttctcgatcaaggacaccgaaggacgctatctggcgatgagcgaaggctgcgtggtgcgctgcgcgctgcgccaccgcggccaggcggaaggccgcaccgcccacgagctgtttcccagcgccatggccaaccgctaccgcttgcaggacctggccgtattcgccgagcgcaggccgctgcgcaaccggctggacctcaccgtctacgccgacggcgcgcccggctggtgcctcaccagcaagcagccgctttatcatcccgatggccagttgctgggcctggtctgcatttcccgggacctggccgaactgacccgcgaaaaactgctggacgagcgcttcgccgcctgcgtcgaccatatccagacgcattaccaccggccgttgcggctggaagagctatgcgggctgtccggactgagcataggccagctggacaggcgcatgaagcgggtgttccaggtctgcgccggcgagttcatccgccgcacccggatggaagccgcctgccatgccattcagcacagccggcagccgctggccgacatcgccgccaattgcggcttttccgaccagagcgcgctcacccgcttgtgccggcagatgctggggctcagcccgcgccagctcaggctgcgcatgccacccggccacgctacggcgctggtatttgcacctagtaaaactactaggcacatcccgcggcacaagaacatacccttataa

SEQ ID NO: 3376 - DNA, 1497 bp, Chromobacterium substugae
atgccgcgccgccgcgcgctgttcggcgcctcccctcacccgatgccaaacgcgccatggggaaccacgatgtcgattatcgataacgccatcctgccaggcatcagcgaaagcgatgcctgtttccgcctgctggccagctgcgtggacgactacgcgatcttcctgctggacaccgagggccgtgtccgcagctggaacgccggcgccgagcgcatggaaggctaccgcgccgaagaaatcatcggcgagcacttcagcctattctatccgccaggaaccgacgccgaggcgcgggcgatgagcgaactcgccatcgcccgccaggatgggcgctatgccggcgaaggctggcgcatgcgcaaggacggcagccgctttctcgccgacatcctgctcaagccgctgcatgatcaacagggcgtgctgcgcggctacgccaagatcacccgcgacatcggcccgcgccgccgtctggaagagcgcttccaccaagtggtgcaggaagcgcccaacgccatgatcatggtaaacgccgccggcaccatcaccctgttcaaccggctggccgaatcgttgttcggctacgaatcgcacgaactgcatggcatgcgaatggaaaacctggtgccggaacgcttccgcagccagcacgggcaactgcggcaaaactacctgcaacggcccgaagcgcggccgatgggcgtaggccgcgacctgttcggcctgcgcaaggacggcgtcgagtttcccatcgagatcggactcaatccgatagaaaccgaagacggcccgatggtgctggccggcatcgtcgacatcacctcgcgcaagcaggttcagcgccagctggagatggcgctgcaggaaaaaaccacgctgctcaacgaggtgcaccaccgggtgaagaacaatctgcaggtcatcatcagcctgctgaacatgcagacccattacgtcgaggaggaaagcacgcggcacgtgctgcaggacagccaggcgcgcgtgcgctcgatgtcgctgatccaccagctgctatacgagcgccgggatttctccaaagtggatttgggcgaatacctgcagcgcatcaaccagctgctgctgagcagctacggcttgctgaccagccagttgcaggtggagcaggacgcgccggaagggctggtgtatatcgaactgcagcgcgccacgccgtgcggcctgttgatcaacgaactgctgaccaacgccctcaagcacgcctatccggcgggcaagggatctatcgacatccgcctgtcgctgctggacgacaagcacgcgctgctggtggtcggcgaccacggcatcggcatgccgacaccatccggccccggaccatccaaatctctggggttgcagttggtgcctatgctggcggaacagatgggagcggagctgagcctgcacgacaatcagccgggcgtgcgcttcgaggctcgcttcccggtattcggcacaatggagcctgcctga

SEQ ID NO: 3377 - DNA, 2439 bp, Chromobacterium substugae
atgaacttccgcattttgatcgtcgaagacgaacgcatcatcgcgatggatctgcagctgcagttgcaggcgctgggctacgcggtgtgcgccgtggtggccagcggccctcaggcgatagacaaggcgctggagctgcgcccggacctggtgctgatggacatccacctggaaggcgcgatggacggggtggaagccgcgcgcgaaatccaccagcgcctgaggatccccatcattttcctcagcgcctatgccgaagacgccaccttgcagcgggcggaaagcgcgctgccctacggctatctggtcaaaccggtatcgccgcgcgaactgcacgccacgctgcagatggcgatggtgcgtttcggcatccagcgcggcagcgacgaacaggtggagcgcttttgcaaggcgatggaggccgcgcagctggaagtgtgggaatggcatgtcgaaatcgaccagatgaatgtattcagcctgaacgacaatgacatgcgttcgctcagttcggtgctgtgcgagtcgatccgcagcttcctgcagcatatcgacccgcgcgacgaatccgaagtggccagcgcgatcaaccgcacccgccaaggcggcgacagcttcaacgtcagcttccgcctgcgcgccgacgaccaggccgatgtccgctggatggaggcccacggcaagcgcttcgacgacggcgaacgcggcggccgcatcataggcgtgatgcaggatgtcaccgagcgccgccgcgccgaggagaggctgcgccaggcggtgacggtgttcgaatccaccgccgaaggcatcgccatcctcgacgccggccgcaaggtgatatcggcgaatcccgccttcagccagctcaccggctacgccgaggacgaggccaaagcctggcccagcatcgacgcgttgtaccaagtcccgcacagctcgcccttcctggagcagctgcgccatggcgagcggcagatgtggcaaggcaacgccagctatctgcaccggaacggcgccgcgctctgcatctgggaaagcatcagcatcgtacccggtccggacggcaccatcggcaactacgtgctggtgttttccgacatcagctcggtgctggcggtgcaggagcagttggactttctggccaagcacgacccgctgaccagcctgtgcaaccgccgcatgctgcacgacaggctggaatacgaactggcgcaggccgcgcgccacggcagcatggtggcggtgctgctgctggacctcgaccacttcaagaccatcaacgattcgctgggccacggcgtcggcgaccaggtgctggcgctggtggccaggcggctgcaaagctgcatgcgcgccagcgacaccgtggccaggctgggcggcgacgaattctgcatcgtgttcggcggcatcggaacgctgggcgatgtcgatcaggtggcgcagaaagcgttggcgcggctggccgagccgatcgagctggagcacatgacctgctacgtaaccggcagcataggcatcgctttgtcgcccgccgacggcgccagcgtggacgagttgctgcgcaacgccgaccaggcgatgtacggcgccaagcacgccggccgcaaccgctgctgcttttacgcgccggccatgcagaaagccgccgaagtccggctgcggatatccagcggcctgcacgaggcgcttgagcgcaagcagctgctgctcgcgtatcaacccatcgtcgaactgggcaccggacgcgtgcacaaggcggaggcgctgctgcgctggcgccacccgcagcaaggcaatatcgcgccagcggctttcattcccatcgcggaagagtgcggcatgataggcgagctctccgagtgggtgctggacgaagcgctgcgcgccgcccgaatctggcgcgaaaccctgcggcccgacttccggatatcgatcaatgtgtcggccctgcatttccgcgaaaaacaaaaccaccagcgctggttgcgcaaactggcggacagcggcgtgcccggcgacgcgttggtgctggaaatcaccgaaggcgtgctgctgggcgccgattacgcggtgcaggaggcgctggagcgctatcacgctgccggcatccgcatcgcgctggacgacttcggcaccggctattcggcgctgtcttatctgaaacgttaccggctggactacctgaagatagaccagtccttcgtccgccagatcgccgaggacgcgcgcgatttggcgctgtgcgaagccatcatcatgatggcgcgcaagctggggctggaggtgatcgccgaaggcgtggaaaccgaagcgcaggctgccatcctgcgcgccaaccgctgccagtacgcgcaaggcttcctgtattcccaagcgctgccggcggacgaattctccgcctggctgcaaagaagcgacggcatcgccgttccatag

SEQ ID NO: 3378 - DNA, 204 bp, Chromobacterium substugae
atggcaactggcaccgtaaagtggttcaacgacgcaaaaggtttcggcttcatcactccggacgaaggcggcgacgatctgttcgctcacttctccgcgatcaacaccggcggcttcaagtcgctgaaggaaggccagagagtcagcttcgacgtcatctccggcccgaaaggcaagcaagcctcgaacatcctgccgcagtaa

SEQ ID NO: 3379 - DNA, 438 bp, Chromobacterium substugae
atgaaagacgataggctgcaaatctccaccgacaagcaccggctggatgtcggtttgatccatgccttcctgcgcgaccacgccccctgggccaaaggcattgcccgcgccaccgtcgagcaggcgatagccggctcgctgtgctacggcgcctatctgggggagcgccaggtgggtttcgcccgcgtggtcaccgacctggcgactttcggctatttgtgcgatgtgttcgtggtgccggagtgccgcggccgcggctatgccaggcagctgatgcaaaggatggcggacgagccggcgttgcgtcggctgcgccgcatggtgctggtcacgtccaatgcccatgcggtttacctgccgttcggtttcaccgcgttggagcatccggagcggtatatggagctgcaccggccggacatctacttgaagggggcctag

SEQ ID NO: 3380 - DNA, 924 bp, Chromobacterium substugae
atgaagacggcgcacgtattgttggcggtgctggtggccgcgatctggggcctgagcttcatcgtggtgaagatagggctgacccagtgcccgccgctgctgctggcggcgctgcgcttcatggtggtgttcgtggccggggtctggctgtttccgcggccgacgctgccgcggcggctgtatctgcgcgctggcttgtgcctgggcgtgatccagttcgccggcttgttctccgccatcaagctgggcatgccggccggcatcgtggcggtgctggcccaggtgcaggtgttcatcaccctgctgctggccgccgcgctgttgcaggaaaaccgctcggcgacgcagaaggcggtgatggcgctggccttgctgggcgtgctgcttcttggctatgcccgctaccatgacgccttgccgctgttgccgctgctgctggccttgatgggcgccgcgggcttcgcctggggcaatatcgagctgaagcgctccggcaaggtggacatgttcggcttcaccgtatggatgagcgcggtgccgccgctgccgctgctggtgctgtcgctcgcgctggagggcggacccgccgcggcatggagcgcgctggcccatttttcctggatcgggctgctggcgctgctgttcctggcattgatcggcacgctgttcgcgctggggagctggggcaagctgctcagcctgtacccggcatcgctggtggcgccgttttccttgctcagcccggtgttcggcctgctgggcggctacctcattctgggagaacgctacgacagcctgagcatcctggcctcggcgctgatcgtggcggcgctggcgctgaacatttattcgggccggctggccgcttgcaagagttggctgcagcgcgcccacctggccatcaaggagcttccacaccgatga

SEQ ID NO: 3381 - DNA, 1248 bp, Chromobacterium substugae
atggccagcggtgacgcctacgaggcctgcgtcaatccggcctggcgcgagattttgcgccaatgcgggctggacgcgcagcccgccgccgccgacggcagctggctgctgctggacgatggccgccgcctgctggacttcgtcgccggctacggcgcggcggcgctgggccataatccgccggccttgtcggctctgctggcgcaagacttgatggatcccacccccaatttgcacccgctgggctggtcggcgtcagctggcgagttggcggcgggcttgctggatttggcgggcctggctggcggcaaggccttgttcgccagcagcggagcggaggcggtggaaggcgcgctgaagctggcgcgcatggcctgcggcagggcgcgcgcgatagttttcgaaggcggtttccatggtttgacgcttgccgccacccagctggccggcagcgatttctggcggcagggtttgccggaggatgaggcggtgctgaggctgccgtggggggaccttgccgcggcggaagccgcgctggcggcgaacgacgtggccgcggtcatgctggagccagtgcagggcagcgccggcgcgcgggcgtggcgcgcggacgcgctgcatggcttggcggcgctgtgccgccgccacggcgcctggctgatctacgacgaagcgcagtcaggcctgggacgttgcggcgcctggttcgcctaccaggcgctgggcgggccgccgccggacatgctgctgctggccaaggggctgaccggcggcatcgtgccggtgtcggcgatactgtttcgcgacgcgatctatcaagcggtgttcgcccggcccggctgcgccaagatccacggctccaccttcggcggcaaccggctcgccatgcgctgcgggctgcatatgctggcggcgctgcgcggcatagacgcgccggccagggccgccgcgcgctcggcctatctgcgccgcgcctggccggatggcctgtttgcgctggagggcgctgggctgatgctggccttgcgcgccacgccgcgggcgaagcggcgtttcggcgagcaggccgccggcgccttgtggctgcaattattgtccgagggtgtgctcaccgcgcccgccgcccatgatgccgacgcgctgcggctgctgccgccgctgacggtgggcgaggacgagctggactatttcctggacgcgtaccggcgcgcgctggccgcgctggaagaagaggaggaaatgccatga

SEQ ID NO: 3382 - DNA, 1497 bp, Chromobacterium substugae
atggaagcctggcgcatcagtcattaccgcatgccgcgcctggtgccgttcagcgcccatctggccgaagacggccagaccgtggtgctggccgccgacgccagcgagtacgaaatcaatttcaccggagtggatggcggacgcgtgctggacagcgtgctggcaatggccaatcccggctccgaaatctggttcgacattcatgaaggatcggccccgtcgtggcagctgtcgctggcgcggcagctggacgagctgtcgctgatccgcgacgcgccggcggaccattccgcgctggaggcgcggcggcaggagctggagtcgctgacgcagcgctgcgtggctcggctgttggaggccactgcggctaaccgcggcctttacgcgccggcggcgctggtcatgctgaatctgctggatgagccggcgccgcaggcggatgccttcacggtggacggcataggcgcgccggagtggagcgacaatttcgcgttgcaaaccttctatctgcaaaagctgtatctggccgacaacatgccgcagctgatcggcctgtggcggagggtactgaacggcttcgccgacgcctgcgggctggccgggcgcgccgcctcccggcccccgccggttgagcggccggacagcctgggtttttactgcccggcccatgtcgaagcctatttgctgtgcctgatggatttgctgctgcaggcgccgctgcccgacgcgcggcgccggctgccgagccggccggcggcgaccgagccggatagcggcgtcaacttcatgcgccgcgccgagcagtacgcgctggacagcctcgcgcagcttggcgagtcccgctatgtgcggcggctgaacgccgatggcgcgggattcagcccgctggtgcagggcctgttcatcgagcagtaccacgtcacccagcgcttcgtcgaaatcatcgcgccgctgatgaccaagcgcctgcgcacgccgctcaagcagcgggtgtaccgctattttcaggaggagctgggccacgaggcgttcgaacgcgcgacctgcgaggcattgggcgtgccgccggcctggctggaccaggcgctgccgctgccgctgttccaggcctatgtcgacgccttcaccgtgctgggccgctacgatccgataggctatctcggctccatcatggtgaccgagggcatgccgggcgtggacaatccggtccaccatcggctggaggagctggtggagggccgcgccgactatcagcgcgtggccaagcgccacgatgatctcaatctggagctgaaccacgcggcattgtcgcgtctgtttttccgcgagatatcggtgctggcgccgctggcccagcagcgggcgctgggaaatctgggctatttgctggaactgaatctgcgggcgatggaccaggtggctgatttctatggcgcgcaaagccgcttggccatctgctcgctggacagctatgcggcgcgacatggccagcggtga

SEQ ID NO: 3383 - DNA, 1002 bp, Chromobacterium substugae
atgcgcgcacccggtgtccacgatctattccaccggccggccttgcgggccggcgtggaaatccaggagcaagaagacggcgtcgcgctgttgtaccgcgaccaatcctgcgatttgtccgtcgccgacgaaggccggcgcgaactgctggccttgctcgacgatctgcagcgcgcgccggccagcatgccggaactgcgcgcctcccatccccgcatggcggccagcctgcctggcctgctggaggagctggaccggctgggactggtgaccgaggcccgtttcgagctgccggccgacgccatttccgggctggaattcaattcgcggctgcgcaatctggctcagcgcgccatgcgcaagcgcggccgctcgcggctgtacggcatgctggccgacggcagcgcgccgcgcaatgtgctgatcggctacgcgctggaatattactgcctggtgcgtgccgcgccgggattgatcgcctcggcgctgtcgcacgccgatagccggcagaaccagcgctcgctgcagcgttttctgatgtctgagctggaccacgaccagatgctggcggacagcctggccagcgtggacatggaggtgaccggactggagcatctgcagccgctgccgtccacgttcgccttgtgctcggcgctgggcgtgttcgcccgccagcatctgctgtcgttcaagagcgtgttgttccttttcgaaatgccgggcgaacaattcaatcaggcgctggtgcgctgctgcgagcgccagggcctggcgaggacattctgggagccgctgctgcgccacgcccacatcaacgacacgctggggcacgatgacatcaccggcgagctgctggaggacatctcggccatcggccgcgaagaacagctggtggtggagaagaatctggtgctgaccgtggaaaccatggcgctgcaggacgaggaaatcgtcgactactacagccgcgccgacgcggcgatgccgcgcctctacctgtaa

SEQ ID NO: 3384 - DNA, 990 bp, Chromobacterium substugae
gtgatccaccaaccggaagcgcgttattgcctgaacggcgaagtgatttcgcagtcgccgctggtggtgaagactgccggcgacgaagaattggagctgtccgccggccaggccagcgcggcggaagtggcggaactggtggcgcggctggggcggggctgcagccaggcggaagtgcagggcgcgctgccgcgccagtcggcggacagcatccgccagttgctggccagcctggaggattacggcgtgatccgctcgatcgcgccggccgccggcaagaccggcatggaaatcctgctggaaatcgaggacctgtccaatcagctgctgtaccggacgctgtaccgcaacgaattctgggtgaactgccagaacgccagccggcccggcgacataccggagaaggtattccatggcatggtgatcgagaactaccatttcctgttccgcgaaagctatttcgacgcgccggtgctgtcctacgtgcccaatacccgggcgcggctggcgatgaacgccttcttcgccgaggagtacggccatgacgagctgttgctgcaggcgttgaaccgcatcggcatcagccgcgaagacctggcgcgcacggtgccgctgccgcagaccatggcattgtgcaacgcgctggcttactggtcgcacaacgatccgctgttcttcttcaccacgctgggcgtgctcgaaggcaaggacatccgccaggactcctttcttgacgccggctaccggctggggctggatcccgccttcctgcgcccggtcaaggcccactccgacatcaacctcaagggcgagcacggcagcctcacccggcagatcttctcgcagatcgatgtggtcgacctggagacggcgcgtcgcatgcacgcgcagacccacctgttcgtcgaactgtacgacgccttttacagcgcggtatggcggcactattccggcgacggcccgctgctgcgccgcatcgaagactactga

SEQ ID NO: 3385 - DNA, 291 bp, Chromobacterium substugae
ttggtggatcacgtcgcttccctcccaggacagccggccgccggccaatccggcggcgcggcagtccggcagaccgagggccgcatcgcgacaccccggccggccggcttacaggtgaaccggcaccaggaccggacgcggattgcggggtttgaccaccaccaccgcctcttgcatgctggtttgcatttggctctcctttgcttgcggaaaagaaacagcgcctggctcaggcgctttcttatcttatgcctgacagtccgcctcagaaatatcaaatacctgtcataa

SEQ ID NO: 3386 - DNA, 840 bp, Chromobacterium substugae
atgaacctgttccaacgcgcagccgcgccgctagccatcagccgcaacaacctcggccccttggccgaactggccggcaactgggtaggccacggctacaacatgatcgcggtgcccgaccaccaaaaccacaagccttttcgcctgatcgtcaacgccaccaaggaaacgctggccttcaccccgataggcggcccggtgccgaatcgcggctcgctgcaaaacgacatcgacatcttcggcctcacctatctgcaacaggtcaacgacgccgccaccgacgaaggcattcacatcgaacccggcatctggctgcatgtgcccgccaccagcgacccgaaaaaacccgccaccatcgtgcgccaatccaccatcccgcatggcgattcgctactggcagggggagaaagctcctgtgaaaagcgcgctccccacatcgcgccggccagcaccgaaccccatcgggtggatggcaagccgttgccattcggctataccgatccctaccagaacggcaagtttcctcccggcttcgacatgaaaaaccccaaccaggcgctggtggacgtgctgcaataccagcagcagcagctggagttgaaggtggtcgaaaccatcaacctgaaggtcagcaccaacgatgccggcggcatcaccaacattcccttcatcgtcaagaatgccaacgccacccacatggacgccattttctggattgaaaccgtccagcgccccgacggctcgcagttcatgcagttgcagtacacgcagaccgtgctgctggtattcgaggaaatcgtctggccgcacgtctcggtcgccacgctgctcaagcgctag

SEQ ID NO: 3387 - DNA, 591 bp, Chromobacterium substugae
atgaaccagcccatcccgcagtccgcgccgccgctgctgccgcagcagtggagcagcgcctacgtttcctattggtcgccgatgctgcaggacgaccagctcagctcgggctattgctggttcgactacggccgcaacatctgccgcatcgatggcctgttcaacccgtggtcggaggaggataccggctatcggctgtggatgtcggaaaccggcaatgccgccagcggacgcacccgcaagcagaaagtggcctacggccgcgaggcgatggcgtacggcaccgcgctgtgcgacatcccgctggacgacgaaaccggcccgttccggcagctgttcctgccgcgcgacgtgctggctgcgcatgacgcgcgctatgccggacggcacaccgtgctgggacaggaggccgatgcctggacgtatcaaagagcgggcaagggaccgtccacgctgtatttccaggccggcaccaatctgctgctgcgcatggtcaccggcgacgacaggcagcatgcgtcggtgcgggactttcccaatctgagcaccgcgatgatacctggcgagattttttcggccagcgatgcatga

SEQ ID NO: 3388 - DNA, 1125 bp, Chromobacterium substugae
atgaaaaaaatcctggttatcggcgcgggtccggcaggcctggtgttcgccagccaaatgaagctggcgaagcccgattggcagatcagcatcgcggaaaagaacgaccccgaggaagtggcgggctggggcgtggtgctgcctggccggcccggccagcatccggctaatccgctgtcctatctggaacatccggagcggctggacccgcagttcctggaggatttcaagctgatccaccataacgagcccaatctgatgagcaccggcgtgctgctgtgcggcgtggagcggcgcggcctggtgcaggcgctgcgcgagcgctgccagtcgctgggcatcgccatccattacgagtcgccgctgctggcgcgcgagcaactgccgctggacgactacgacctgatcgtggcggccaacggcgtcaaccacaagacttcgcacttcaccgaggcgctggcgcccaagctggagtacggcggcaacaaatacatctggttcggcaccagccagttgttcgaccagatgaacctggtgttccgcacccacggcaaggatattttcatcgcccacgcctacaagtactccagccggatgagcactttcgtggtggagtgcagcgaggaaaccttcgagcgcgcgcgcctgggggagatgtcggacgaggcgtcggcggagtatgtggcgggcgtgttccgcgccgagctgggcggccacggcctggtggcgcagcctggcctaggctggcgcaacttcatgacgctgagccacgacaagtcctacgacggcaagctggtgttgatcggcgacgcgctgcagtccggccacttctccatcggccacggcaccaccatggcggtggtggcggcgcagctgctggtgaaggcgctgtgcgccgaggccagcgtgccggcggcgctggccagcttcgacgcgcgcgcgatgccgttggtcaagctgttcagcgagcatgccaacagcagccgcgactggttcgagacggtggacgaccgcatgcatctgagcaatgccgagttcatgcagagcttcgatgcccgccgcaaggcgctgccgccgctgccggaggccctggcgcgcaatctgggctatgcgctcgatcgctga

SEQ ID NO: 3389 - DNA, 1206 bp, Chromobacterium substugae
gtggtcgagaagcggggcgatccgctgcaggatctgtcgtcctacgtcgacgcggtcagctcgcgcgccatcggcgtcagcatgacggtgcgcggcatcaaggcggtgctggcggcaggcattccgcgcgcggaactggaccagtgcggcgaacccatcgtcggcatggcgttttcggtgggtggcaagttccgcatccgcgagctgcagccgctggaaggcttgtcgccgctatccctgaacagggccgcttttcagcgcctgctgaaccgccacgccaaccggaacggcgtccgctaccacttcgagcacaaatgcctggatgtcgatctggaaggcaagtcggtgctgatccagagcaaggacggccagctgcagcgcctgcaaggcgatatggtcatcggcgccgacggcgcgcattcggcggtgcgccaggcgatgcaaagcggcatgcgccgtttcgaattccagcaaaccttcttccgccacggctacaagacgctggtgctgcccgacgccgaggcgctgggctaccgcaaggacctgctgtacttcttcggcatggattccggcggcctgttcgccggccgcgcggccaccatccccgacggcagcgtcagcatcgccgtctgcctgccgtatgagggcacgcccagcctggccacccaggaccgccaggcgatgaaggcgtttttccagcgctatttcggcagcctgtccgacgcggtgcgggaggagatgctggaacaattcctggtaaagcccagcaacgacttgatcaatgtccgctccagcaccttccactacaagggcaatgtgctgctgctgggcgacgccgcgcacgccaccgcgccgttcctgggccagggcatgaacatggcgctggaggacgcgcacagcttcgtcacgctgctggaccagcactgccatgatcaggagctggccttcgccgaattcaccgcgcagcgcaaggtgcaggccgacgcgatgcaggacatggcgcgcgccaactacgacgtgctcagctgctccaaccccatctttttcctgcgcgcccgctacacccgctacatgcacggcaagtttcccgagctgtatccgccggacatggcgcagaagctgtatttcacttccgagccgtacgacaaattgcaaaccatccagaagaagcagaacgtctggtacaaattggggagggtcaactga

SEQ ID NO: 3390 - DNA, 2997 bp, Chromobacterium substugae
atgagcattctcgactttccgcgttttcatttccgaggttgcgcccgcgtcaacgcgcccaccgccaaccgcgatccgcacggccatatcgacatggccagcaatacggtgtcggccggcggccagccggtggacctggcgcgcccgccggccgagttccaccagtatctgcggcaactgggtccgcatttcgacagcgagggcaagcctgccgacgacggcgtcttcagcttggcgctgggccacaacgccaacggcaacaaccatttctcctgggaaggcgcggtggtgaccgcggtggagccgagggccggcgcggccgaggccgacgacagcctgatcggtgcgaagctggccttgtggggacattacaacgaatacctgcgcacctcgttcaaccgcgcgcgctgggtggacaatgatcccacccggccggatgcggtgcagatctacgccgggcagttcgtcatttccccgcccggcgccgccgcccacgcgcccagcctgttcaccgccgacatcgaccaggcccacggcgcgcgctgggtgggcggcgggcatgtctgcgagcgttcaggccactttctggacgacgatttcggccgggtgcgggtgttccagttttccttgcccaagagcgatccgtatttcctgttcaatctgggcgatgacggctcggcgacgctgcaggcgctgcagcgggcgctggaagacgacgacgcgctgggactgactgtccagtacaccttgttcaacatgtccacgccgcggcagccggacacgccggtgttctacgacatggtcggcacggtgggcgtatggcggcgcgacgagctggccagctatccggccggccggctgctgcagcccgcaggcgcgggcctggggccgctgacgctgcagatccgcgatgaccgggtgtcgctgaatttgtgcgcggcgctgccgttcactacacgcgcgccgcgcatcgacgagccgggccggctgacgcacgcgctcggccccaagctggcgctgggcgacctgctgctgaaggatcgcggcggcgccctggtcgcgcggattccgcagcaggcctgcctggattattggcgtaatcacggcatcgtcgacgtgccgctgctcaatccgccgcagggctcgctgtcgctgtcgagcgaattggcgcgctgggacgaggtggactgggtgtcgcagaccgacgccaacaacctgtacctggaggcgcccgacgcggcgcgcggcctgagctttcccgaacgcgtcacggtgagaagctattaccgcggcgagcgccggccgcgcccggccatcccgttcaaggtggtcggcgacggccaggcggcggtggaggtgcggcaacgcgacggcgacgcggaatggctgattaccggcctgaagccgggcgtcgcgcgcatcgagctggacggcggcgtccagcgcgtcaacctgcgcatcctgccggacgactggcagctggccgaggtgccggcggagcaggtcgattacgccttcctgtaccggcacgtgatgagttattacgagctggtctatcccttcatgtcggacaaggtgttcagcctggccgaccgctgcaagtgcgagacctacgcccggctgatgtggcagatgtgcgatccgcaaaaccgcgacaaaagctactacatgcccagcacccgcgagctgtcgcggcccaaggccggactgtttctgaaatacctggccaatgtcgagcgcgcggcgccgtccgccgcgcccgatggcggcgcgccggcgcggatcgagaaccgcgcccagctggtggaagcgctgaagacggcggtggatctcgagctgtccatcatgctgcagtacgtctacgccgcctattccattccgaattacgcgcagggcgagcaattggcgcaatcaggcgcgtggagccaggagcaactggagctggcctgcggcggcggcgacaggcggcgcgacggcggcctgcgcggcgcgatcctggagatagcccacgaggagatgatccactacctggtggtcaacaacctgctgatggcgctgggcgagcccttccaccccggcgcggcgcgggtgggggacgaggcgcggcgcgcgttcggcctcgacaccgagttttccttcgagccgttttccgaatacgtgctggcccgcttcatcaagctggaatggcccgcgttcattccttcgccggccaagtccatcgccgccttctacgcgtccatccgccaggctttcgaggaattgcccgacctgttcgacggcgcggcgggcaagcgcggcggcgagcaccatctgttcctcaatgagctgaccaaccgcgcgtttcccggctaccagctggaagtcttcgaccgcgacagcgcgctgttcggcatccgcttcgtcaccgaacagggcgagggcggcgcgctggattcgccgcacttcgaacattcgcatttccagcgcctgcgcagcctggccggcaggctgatggcgcagccggcgccgttcgagccggcgctgccggcgttgaagaacgcggtgctggcgccgcgcgagggctgcaatctggtgaccgagccgcaggcccgcgcgctgatgcgcctgtaccagggcggctatgaattgatgttcgcgatgatggcgcagcatttcgcggcgcagccggcgggcagcctcaggcgctcgcggctgatgaacgcggcgatagacctgatgaccggcctgctgcggccgctgtccaccgcgctgatgaacctgccgtccggcgtgccggggcggaacgccgcgccgccggtgccggcggcggccgactgcaaggtattcgacgattacagcttgggatgccagatgctggccaagcgctgccaagcgctggcggatgaggcggccggcctggagccgggctgggtggcggacgcgccgaaggagttgctggcgttctactgccggcaactgatggatttggcttgtggaaagcttacaagagaggcctga

SEQ ID NO: 3391 - DNA, 1260 bp, Chromobacterium substugae
atgaagcactcttcggatatttgcatcgtcggcgccggaatcagcggcttgagctgcgcgacgtatttgctggaatcgcccgcctgccgcggcctgtcgctgcggattttcgacatgcagacggaggcggggggacgcatccgctcgaaaaacctggacggcaaggccgcgatagagctgggggccggccgctactcgccgcaactgcacccgcagttccagagcgtgatgcaaagctacagccagcgcagcgaacgctatcccttcacccagctgaaattcaagaaccgcgtccagcaaacgctgaaaagcgcgatgcgcgagctgtcgccgcggctgaaggagcatggcaaggaatccttcctcaatttcgtcagccgctaccagggcacggacagcgcgatcggcatgatcaagtccatgggctacgacgcgctgttcctgcccaatatctccgccgagatggcctatgacatcgtcggcaagcatccggaaatccagagcttcaccgagaacgacgccaaccagtggttttccgccgtggatggcttcgacggcctgatcgcgcggatgaaggacaaggtcaaggcgggcggcgccaagttcagcctgggctttcgcctggcgtcggtggagcgcgaccaggatggctatcgactggcgctggtgggggatgacggctggcagctgacgcatcacgcccggcacctgatcctggccattccgccgtcggcgatggccgggctcaacctggacttcccggcggcctggggccattcccgttatggctcgctgccgctgttcaagggttttctgtcttatgacgagccgtggtggcgcgactacaagctggaagatcaggtgctgatcgtcgacaacccgctgcgcaaggtctacttcaagggcgacaagtacgtgttcttctataccgacagcgaaatggcggcttactggcgcgcctgcgtcgccgacggcgaggacggctatctggaacaggtgcgcgtccatctggccgcggcgctgggcatcggggcggccagcattccgcagccaagccagcatgtccacaagtactgggcgcacggcgtcgagttttgccaggacgcggcggcggcggaccgcccgccggccttgctgaaccgcgacagcggcatcatcgcctgttccgacgcctacaccgagcattgcggctggatggagggcggactgctcagcgccagggcggccagcgcgctgctgctgcagcgcatggccggatga

SEQ ID NO: 3392 - DNA, 186 bp, Chromobacterium substugae
gtgcttcatcacgaaattccttggttcattcaatcgacacccgccggcggcgcggccgccgacgggtccaaatctgaaggggaatggctcagctcttgctctttgtcttgcagaatcgggaaccgcgcgccgctgtggctgccgtttcccggcgggcggcaagccgcccgccatcagtcattttga

SEQ ID NO: 3393 - DNA, 1737 bp, Chromobacterium substugae
atggccaggcgggatggcctggccggatttccaggccaattccgcaaatatgcttttgacgtattaatttttaaaaaattaaccgtattgaaaaccgcgctatccagactgatccgcttttcccaccacttgcgaggatgtcaaatgaaagcctggcgtttcctgtcatgcggggctctggccctgtccgcggctgctcatgccgcctatcccgacgatctcaaactcaccacttggaacgcgatgctgctgccgcaggccttgtatcccaattacggccagctgcggcgcgtcgagctgatggcggccgcgcccatcctgcaaggccaggatgtgctggtgttccaggagctgcaggacaatgccgcctcggagaagctgctggcgctgctacggccgcggtttccctatcagacgccggtgataggccgcgcgcaactgggctgggacggcaccgagggctggaacgcgctgaaaccggaggacggcggcgtggccatcgccagccgctggcccatcgtcgagaagcggcagtatctgttccagacgccgggctgcagctgggacgggcaggcattgaaaggcttcgcctacgccaagatcaatgtcggcggccggttctaccacgtgctgggcactcatctgcagtcggaagacagcggctgcgcccatcatgccgacatcgcggtgcgccagggccagctgcgcgaaatggcggcctgggtccaggcgcgccgcctgccggccgacgagccggtgatcatcgccggcgacatgaacaccgatcgccataaaagcgccgaataccaggcgatgctcgacattctgcaagccagcgagccgcgctacgccggcatgccggatagtttcgacacccgcggcaacggcatcgcgctggagcgctacggcgcgcgcagcggcgacgcgccggaatacatcgactacatcctgctgctcaaaggccaccgccagccggggatgtggcacaacctggcgctggacgcgccgtcgccgcagtggacggcgcagtcggcggtggcgaagcaaacctacgcctacgccgattacagcgaccactacccggtgcaggccttcgcctgggccgacgcgtcgacgccgacccgctcgctgaccgcgccggccggcggctatcgccaggtcagcctgcaaaacctggccagcggccgttatgtgcaaagcgccggcagcaacgacggctggctgaaagccggcgcggccgaggcggggccgcaggcacagttcaacctgtccaataatttctcgatgcgcgacaacggctgcgtgcgctccggcgaatacgtgcggctggagcgcgccgatcagcccggctggttctggacctggtggggcggagcgggcggcaaccagtacgcctattacaccgcccagggtccgctcagccggtccgctgagttgcgcctggtcaatcagagccgggccgacggctgcttgcaggatggcgacgtggtgtcgttcaaggactgggcgcgcgcggccgactactacctgaccgcctggagcggcggcagccatgccgaccagctgtatctatggcagccgtccgtcggcgacggcgagcgcttccgagtgcggatcggcgcgacgcgacaatatctggactggcgcgcgcaactggtttacgccggccaggggttggccgctcggccggaggtgttgcatttctcaaatggaaagcctgtcactaggaacaggtag

SEQ ID NO: 3394 - DNA, 126 bp, Chromobacterium substugae
atgcgaatccggccggcggcgcgccatacgctgagccatccaccctgtcgtttcggccgcttgcgcgtgggaaaggagcaaaccatgcatgccgcgatggttctgcagggcggcatggcgctatag

SEQ ID NO: 3395 - DNA, 117 bp, Chromobacterium substugae
atgtggctgggcgccagccgcgccggcgactcggcgcgcgaggagctgccgatcttcctgccggcgttcggcgtgccggcggccgtcgccgccgcgctgtcgcggaaactccgttga

SEQ ID NO: 3396 - DNA, 579 bp, Chromobacterium substugae
atgaacaaactgacccgcctcaccctggccgccgtcgccgtcgccggcttcagcagcgccgccctggccgctccggaaacctatgtcatcgacggcacccacaccttcccgcgcttctcctacagccacctgggcttttccacccagttgagccggttcgacaagaccagcggcaagatcgtgctggacaaggaagccaagaccggttcggttgacgtcaccatcgacatgaagtcggtggacaccggctacccggtgttcaacggccacatccagggcgccgatttcttcgataccgccaaattcccgaccgccaccttcaagtcgaccaaggtgctgttcgacggcgacaagccgagcgcggtggaaggcaacctgaccatcaagggcgtgaccaagccggtgacgctggcgctgtccagcttcaccaacaaagagcatccgatgctgaagaaggacgccatcggcgccaacgccagcgtcaagatcaagcgcaccgaattcaatgccggcaagtacgcgccctatgtcggcgacgatgtcaccatcgacatcgcggtggaagccatccacgaataa

SEQ ID NO: 3397 - DNA, 564 bp, Chromobacterium substugae
atgcagatcaaccgtaccgcgctgctgctggccgccgccttgtcggcgccgctggcggcccatgccgtggaattcacctccatccagcaggacaagagcaatatcgccttcggctacaagcagatgggcgtcggcatgcaggggcatttcaagaaattttccgcgcagctgaatttcgacccggccaagccggccgcggccaaggcggcgttcaatgtcgacatcgccagcatcgacaccggctccgccgaggccaacgaccaggtggccgacaaggactggttcaacaccaagcaattcccgactgcccgtttcgtttccagcgccatcaagcccttgggcggcaaccgcttccaggtggacggcaagctgacgatcaagggcaagacccaggctgtcagcaccaccgccgtcatgacgccgcaaggcaatgccgccgccttcgacggcgccttcgccatcaagcgcgccgatttcgccattggcgagggcgactggaaggatttcggcaccgtcgccaatgaaatccagatcaagttccatctgctggcccgcgccaagtaa

SEQ ID NO: 3398 - DNA, 543 bp, Chromobacterium substugae
atgtcacaagcgcgttacacctctcccgccatcttcctgcactggctgatggccatcggcctggtctgtctgttcagcgtcggcttctacatgcatggactgccgttttcgccgttcaagctgaaaatctattcctggcataaatggtccggcgtcacgctgttcctgctggtgtggctgcggctggcctggcgcttcgcccatcgcccgccggcattgccggccgccatgggcggcgcggtgcgggcgatggcccacgccggccacgcgatgctgtacctgctgatgatcgccattccgctgtccggctggctgatgagctcggccaagggcgtgcagaccgtctacttcggcgtgctgccgctgccggacctgatcgcgccggacaaggcgctgggcgattcgctggctggactgcataccgtgctgaactacctgttggccgcggtggtggccggccatgtcgccgccgcgctcaaacatcatctgatcgatagggacgacgtgctgacgcgcatgctgccctggcgcgtcaaaccctga

SEQ ID NO: 3399 - DNA, 201 bp, Chromobacterium substugae
atgcctcaagacgccagcaagccgcgcaacgcgccgctgtgcctgggttgccagcactacttcatcacttaccggccgggcttcccctacggttgccgggcgatgggcttcgccagcaagcgcgcgccctgcgtggacgtgcaggaagcgtccggccagccctgcatccgctttcagcccaaggccggcaagcctggctga

SEQ ID NO: 3400 - DNA, 756 bp, Chromobacterium substugae
atgacaaacggcttgtacgaagagcaggcgttggcggaggtgtacgacctgctcaacggctggggcgaggacaacgattactacctgggtctgacgccgcgcggcggccgggtgctggatctggggtgcggcaccggtttgctggcggcggcgatggcgcgccacgccgaggtgacggcgctggacccggccgcggcgatgctggcggtggcgcggacgcgtcccggtgcgcgcaaagtgcgctggctgcaggccgatgcgcggcgtttccagctggcggagcgcttcgagttcatctgctgcgccggccacgccgttcaggtttttctgagcgtcgacgatcggcgcgcgctatggcgcaacgtcaagcgccatctggcgccggacggcgtgttcgcgttcgagacccgcaatccgcacgccctcgcctggctgcagtgggaagggcaggcgccgcgccgggcggtgcatctgcgtcatggcgcggtggaattgagccatcgcctgctgtccgagcgcgatggcttggtggcttatcgcagccattatcgttttctggatcaggggcgggagcggagcgtggatgccgaattgcggttttgtgatgccccgaccctgacggccgaactcgaggcggccggcttgcgcgtcatcggggtggcaggcgactggcaaggcggcgagtggcgcgcggacagccgcgagatcatcatgcggcttggccatgctcagccaggcttgccggccttgggctga

SEQ ID NO: 3401 - DNA, 309 bp, Chromobacterium substugae
atgaatgaggagacactgaagaagattcagtccaatcccaaatacctggaactggtccacaagaagaccagcctgggctggaccctggccatcgtcatgctggccatctattacggctacattctgatcctggccttcgaccccgctttgctgggcaggccgctgtacgcaggcgccaccatgacggtgggcatcccggtgggcgtttgcatcatcctgtccgccttcgtcctgaccggcgtctacgtgcgccgcgccaaccgcgagttcgacccgctgacccggcagatcgtcgaggagtccagataa

SEQ ID NO: 3402 - DNA, 1680 bp, Chromobacterium substugae
atgcagccacgcaaactaaccctggcagccggcgcggccatgctggcgccggccctgagctgggcggccggcgcgatagaaggcgacgtcaagcagcaagccaccaactggcacgccatcatcatgtttttcgtgttcgtcgccttcacgctgggcgtcacctactgggcggcgcgccgcaccaagtccgccagcgacttctacgccgccggcggcggcatcaccggcttccagaacggcctggcgatcgccggcgactacatgtccgccgcgtccttcctgggcatttcggcgctggtgttcgacaagggctacgacggcctgatctactcgatgggcttcctggtgggctggcccatcatcctgttcctggtggccgagcggctgcgcaacctcggcaagtacaccttcgccgacgtggcgtcgtaccggctgcggcaagggccggtgcgcagcttcgccgcgctatccacgctggtggtggtggcgatgtacctgatcgcacagatggtgggcgccggcaagctgatccagctgttgttcggcatgagctacggctcggcggtgctgctggtgggcgtgctgatggtctgttacgtgctgttcggcggcatgctggccaccacctgggtgcaaatcatcaaggcggtgctgctgctggcgggcgccaccttcatggcgctgatggtgctggccaccgtcggcttcaatcccgaagtgctgttcgagaaagccgtggccgcccatggcaagggcatcgccatcatgtcgccgggcaaggccgacccgatcgactccatctcgctgggcctggcgctgatgttcggcaccgccggcctgccccacatcctgatgcgcttcttcaccgtcgccgacgccaaggaagcccgcaagtcggtgttctacgccaccggcttcatcggctacttctacatcctcaccttcatcatcggcttcggcgccatcatgctggtgctgaaccagccggggatgatggaaacggtgatgaaggacggcaaggaagtgcaccagctggtgggcggcagcaatatggccgccatccacctggccgacgcggtgggcggcaacatcttcctcggcttcatctcggcggtggccttcgccaccatcctggcggtggtgtccggcctggccctttccggcgccagcgcggtgtcgcacgacctgtacgccagcgtgttcaagcacggcaaggccaacgaggccgacgagatccgcgtctccaaaatcaccaccgtggtgctgggcgtggtggccatcgtgctgggcctggtattcgagaagcagaacatcgccttcatggtgggcctcgccttctccatcgccgcctccgccaacttcccggtgctgttcctgtcgatgttctggaaagggctgaccacccgcggcgcggtcatcggcggcctggtgggcctggtcaccgccatcgcattgatcgtgctggggcccgcggtatgggtggaagtgctgaagcacgagcatgccgtgttcccgtataagaaccccgccatcttctcgatgacgctggccttcgtcgtcacctggctggtgtcgctgctggacagctcgcagcaagccgccgaagaaaaagccaagttcgacgcccagtacgtgcgggcgatgaccggcatcggagccagtggcgccagcaagcattaa

SEQ ID NO: 3403 - DNA, 1965 bp, Chromobacterium substugae
atgtccacgctagattccattctcaaggaaacccgcagcttcgccccgtcggaagacttccgccgcaaggcccagatcagcggcatggaggcctacaacgcgctgtgcgaacaggcggatgatcactacctttcgttctggggggatctggcgcgcgaactgatcacctggaaaaaaccgttctcccgagtgctggacgacagcgcggccccgttcttcaagtggttcgacgacggcgtgctcaacgtgtcctacaactgcctggaccgccacctggccaccgacgccaacaagatcgccatcatcttcgaagccgacgacggcgaagtcacccgcgtcacctacgccgaattgcaccgccgcgtctgccagttcgccaatggcctgaagagcctgggcgtgaagaagggcgaccgcgtggtggtgtacatgccgatgggcatagaagcggtggtgaccatgcaggcctgcgcccgcatcggcgccatccactcggtggtgttcggcggcttctccgccggcgcggtgcgcgaccgcatccaggatgccggcgccagcgtggtggtcaccgccaacgaaggcctgcgcggcggcaagagcgtggcgctgaaggccaccgtcgacgaggcgctgaagctggaaggcgccgagtcggtgaaacacgtggtggtgtaccagcgcaccaatggcggcgccgactggaccgacggccgcgacgtgtggtggcacaaactgaccgaaggccagagcgaggcctgcgagccggaatggatgaacgccgaagacccgctgttcatcctgtatacctccggctccaccggcaagcccaagggcatccagcacagcagcgccggctatctcttgggcgcgatcaacagcttccgctgggtattcgactacaagcccaacgacgtcttctggtgcaccgccgacgtcggctggatcaccggccacagctatgtctgctacggcccgctgggcaacggcgcgacccaggtgatcttcgagggcgtacccacctacccggacgccggccgcttctggcggatgatagaaaagcacaaggtttccattttctacaccgcgccgaccgcgatccgctcgctgatcaagctgggcgccgacctgcccaagcagttcgacctgtcgtcgttgcgggtgctgggtaccgtcggcgagcctatcaatccggaagcctggatctggtattacgaaaccgtcggcggcagccgctgccccatcgtcgacacttggtggcagaccgaaaccggctcagcgatgatcgcgccgctgccgggcgcggtgccgaccaagcccggctcatgcacgctgccgctgcccggcgtgatcgccgacatcgtcgatgagtccggcgcgcaggtggagcccggccgcggcggcttcctggtgatcaagcgccccttccccagcctggtgcgcaccatctggaacgaccccgcccgcttcaagaaaacctatttcccggacgagttcaacggccagtactacctggccggagactccgccaatcgcgatgaaaacggctatttctggatcatgggccgcatcgacgacgtgctgaacgtgtccggccaccgcctgggcaccatggagatcgaatcggcgctggtgtccaacccgctggtggccgaagccgcggtggtcggcaagccgcatgacgtcaagggcgaagcggtggtggccttcgtggtgctgaagggcgcgcggccggagggcgatgccgccaaagcggtggccgccgaactgaagaactgggtagcgcatgagatcggcaagatcgcccagccggacgacatccgcttcggcgaaaacctgcccaagacccgctccggcaagatcatgcgccgcctgctgcgttccatcgccaagggagaggaaattacccaggacgtgtcgacgctggaaaacccgcaaatcctgggccagttgcagcaagccctgtga

SEQ ID NO: 3404 - DNA, 933 bp, Chromobacterium substugae
atgaacgcctgcctcgccgccgcctgcctgctggccgccgcgcacgcccgcgccgacgaaggcggcatgagctactggcaacccgggcagatcggcaccttcgccgccgtgcagaacgaccccggactgtcatggtcgttcagcgcctaccacgccgaggccgacacctcgaaaacccgcaaaagcctgcgcggccgcaccaccagcacgctgctgagcaccccgagcgacctgctgttcgtctcccccacctacaccttcgccaccccggtcgccggcgcgcaggcggcggtatcgctgaccgggctctacggccgcaccgaggtgtacaccgaggccgacaccaccaccgcccgcggcaagccccgcagccaaagcagcgacgacgcccgcgacggcttcggcgacctctacccgatggcgacgctgaagtggaatcgcggcaaccacaactacctggcttatgccgcgctgggcgtgcccgtcggcacctacaacgtcgaccgggatgccaacctgggcagcaaccactggtcgtacgacgccggcggcggctacacctatctgaacacccaaaccggcaccgagttttccgccgtgctgggactgaccctcaaccagaccaatcccgacacccagtaccgcaacggcaacgacgcccacctcgacgtctcgctgtcgcagttcctgaacgaagacttccatatcgggctggtcggctacgcctaccaccagctaagcaacgacaccgcccccggcataggcaggaaagacctgaaatcccgcgtcgccggcctgggcccgcagctgggctacttcttcccggtgggcaagaaaaagtggtacgccaatctgaaggcctacgacgagttcgacgccaagaaccgcaccgccggctggaacgcctggctgacgctgttcgtgccgatctga

SEQ ID NO: 3405 - DNA, 561 bp, Chromobacterium substugae
atgatggcgatgcgctaccggatcgcgctgccggccgattatccgatggagatcatcgagcgccgcatcgccgagcgcggccacttgaccgacggcctgccggggctgggcctcaaggcttatctgtattgccgcgcgggagaggacggggcagcggcgaacgcctatgcgccgttctatctgtggcgaacgacggaaggcatgcgcgacttcctgtccggcccgggcttcgccgcgctgtgcgcatcgttcggccggccggtggtgcaaagcgcggtggcatggttcggcgggtggcaggacaatgcggcggcggcgcgccacgcggtgatagagcggctggctttggccgagggcgaggatttggccgcccggcgcgcggcggaggatggctggggacggacgcagttgctggatggcggcgcgctggcggcggccagcgctttcgatcccgcggcgtggacgctcacccgcatcgcgctgctgcgcgaagcgcccgccgcacaggcgccggggcgcgaacattaccgcgtgggacgcgtgtcgccgggcgcggcgtga

SEQ ID NO: 3406 - DNA, 405 bp, Chromobacterium substugae
atgccctatgcccgcatttccctgcgcaaaggcaagccgccgcagtatctgcgcgcgctggccgacggcatccatcaagcgatggtggaatgcatcgccgtgccgcccaaggaccgtttccagctgatccatcagcacgaggccgaagagacgatcatcgatccggattacggcggcggcccgcgctccgacgatttcgtgctggtgacgctgcatctggggcgaccgcggaccaaagaagccaaggcggcgctctacgccagcatggctgagcgcttgagcgtgtcgcctggcctggcgcccgccgacctgatggtggtgctgatcgacggcgagatggataactggtcgttcagccatggccgccaggcctcgacgctgagcgccgaggagttgcggccatga

SEQ ID NO: 3407 - DNA, 315 bp, Chromobacterium substugae
atgtttacccacgcagatgccatgcccaggctggccccaaagctggcggagttgaccagccaagtgttgttcgacgatgtctggcggcggccgagcttgagcccgcgcgaacgcagcctggccaccattgccgccctgatcggccaggcccggccgcatgcgctggactttcacttgcgccgcggtttggagaacggcctgagcggcgagtcgatgggcgaattgctgacccatctggccttttacgcaggctggccatccgccaccgccgcgcttgagcaactggacgcggttttgacctcgcaaaccaaataa

SEQ ID NO: 3408 - DNA, 897 bp, Chromobacterium substugae
atgagacgaactttattggatctggacgtgctggccagcctggccagcggcgtggagctgggcagcttcgcccgcgcggccgacaggctgggccgttccacctcagccgtcagcgcccagatgaaaaagctggaggagcaggccggcgtggccattctgcgcaagagcggccgcggcctggagctgacgccagccggcgaggtactgctgtcctacgcccgccggctgctggagctgaacgacgaggcggtggaggcgacgcgcggcgcctcattggccggctgcgtgcgcctgggcctcgccgaggatttcggcgaaggcgtgctgccgctggcgctgggacgtttcgcccgcgcctgccccgaggtgcgggtggaaatgcgggtggcccgcagccaggaattgcaacaatcggtgatggccggggagctggatctggcgctggcctgggattccggcccgcgcgcgccgcacagcgcggctatcggccgctaccccgtgcactggataggctcggccagcggtccgcttcctcccgatccgctgccgctggcgctgtttgacccgccctgcgtcatccgcgcccaggcctgcggcgcgctggaccgcgccggccgcccctggcgcatggccgctagcggcagcagcctggcagggctatggtcggcggtgcgcgccgggctgggcatcagcgcccgcaccgccgttcaactgccgcccggcctgcggattctggacccggcccagcaccgcctgccgccgctgcccgccatcgacctgctgctgtgccgcgccgaagcccggcccgccgcgccggcgcagcggctgcacgacatcctgctggcgcaattgaccgttccgggtgttgaagcggaagcgcttaacatcgataattaa

SEQ ID NO: 3409 - DNA, 774 bp, Chromobacterium substugae
atgcccgtgatcagcctcgtcgaacggatcgacgccctcctgccccagacccagtgcggtcagtgcggccatgccggctgccgtccgtacgccgaggcgctggcgacgggccaagacccgctcaaccgctgcccgccgggcggcgaggacggcatccaggcgctggcggcattgctgggcaagccggccattcctttcgaccctgctggcccgcagccgaagccgcgcgcgctggcggtgatccgcgaagacagctgcataggctgcacgctgtgcatccaggcctgtccggtggatgccatcgtcggcgcggccaagcagatgcacacggtgatcgccgatgaatgcaccggttgcgagctgtgcctggcgccctgtccggtggactgcatcgacatgatcccggtggcggacccggccgacggcgagcgcgcgcaagtgatggcgcgcgccggccaggcgcgcctgcgctacgaacggcgccaggcccgccaggcgcgcgatcaggccgacaaagcccgccgcctggccgagcgcgccgccgtggcggccccggccggcccctcccccgcgccggccgccgctcagcccgccggcgcagccgccgacaagaacgagctgatacgccgcgcgatggaacgggcgcagcaacaggcggccagcgcgccgccggcgaccgccgccaacgacaagatggcgctgatccgcgccgccatggagcgcgccgccgcgatgcgcgccgcgcaagaccccgccgataaggacaagaagtga

SEQ ID NO: 3410 - DNA, 633 bp, Chromobacterium substugae
gtgaacgccgccaaacgcaaagagattttccagcgcctgcgcgacgccaatccgcacccggccaccgaactggaatacagctcgccgttcgaactgctgatttcggtgctgctgtctgcccaggccaccgatgtcggcgtcaacaaggcgacgcgccggctgtatccggtagccaacaccccggcggcgatactggcgctgggcgaagaaagcctggccgacttcatcaagaccataggcctatacaagaccaaggccaagaacgtgatcgccacctgccggctgttgctggaaaagcatggcggcgaggtgccgcaaacgcgcgaagcgctggaggcgctgcccggcgtcggccgcaaaaccgccaacgtggtgctcaacaccgccttcggccatcccaccatcgcggtggacacccatatcttccgcgtcgccaaccgcacccggctggcgccgggcaaggatgtgcgcgaggtggaggacaagctggaaaagttcgtgcccgccgaattcaaggtggacgcccaccattggctgatcctgcacggccgctatgtctgcaaggcgcgcaagccggaatgcgaacgctgcatcatcgccgacctctgcgaatatccggcaaaaccgttatga

SEQ ID NO: 3411 - DNA, 528 bp, Chromobacterium substugae
atgtccgacagcaaccgcgccacctggaatttcctcgccgacacttactggtacgtgacccagcccgacctgccggccttgcgcttcgatcccggcgacaatgcgctgagctggcagtcggaccagacggtctggcacatctccggctatcggaacggctatttctggggcgtatgctcggcgctgctgaccgaccccggcgcagaaggcggcacgccgcagctgcgcagcctggtcggcaccgtcaccgccgacggcgcgctccagatcagcttcgtccgcgacggcgcgctgcgcgattcggtgatcaccggctttggccgcctgctgcaatgggacggcgaatgggcatgccagatgcagatgaccgccgcggctagcggcggccagacgctgcattgggccaatatgcggcaaacccgcccgggcgaccccagctgggaccagttgcccggcaccgactactccgtgcccgacatgctggagggcgccagctacccgcagttttcaaccgaccaagcaacatga

SEQ ID NO: 3412 - DNA, 513 bp, Chromobacterium substugae
atgaccgccatcgccctgcccccttccctgttgcccgcgctgggcatcgccgcgctggtgatctggcgcctgtactcgcggatacgccgcatggtgggccggcaacggctgtcacccattcgcccctggctgaccgtgatcgtcttcccgctcctcctcgccggcctcgcccaaatgtcacatgcgcatcccgacaagctgctgatgctgctggccggcgccgtcatcggcgcgctgctgggccgctacggcatccggctgacccagttcgaaaccaccgaacagggccgcttctacacgcccagcctgcacttgggcatcgcgctgtcgctgctgttcatcggccgcatcggctaccgcctggtttcgctctacctgtccggcggctcgctgtccgcgccgccggccggcttcatcggccatcctctcaccttgctgatcttcgccatcctggccggctactatgtgtcctacgccatcggcctgctgcgctgggcgcgctcgaccgcctga

SEQ ID NO: 3413 - DNA, 132 bp, Chromobacterium substugae
gtgacgcgcattccggtccacggccggatgacgaaaaaaggcgaaaccgtcatcggtttcgccttttttgtttctttgcgagaggcggttcaggcggtcgagcgcgcccagcgcagcaggccgatggcgtag

SEQ ID NO: 3414 - DNA, 1398 bp, Chromobacterium substugae
atgagtttgatgcgcaagaagagcgtccagggaatgctggaaaccgctcagacttcgcgcgggctgcgaaaagagctctccgcgttcgaccttaccatgctgggcatcggcgccatcatcggcaccgggattttcgtgctcaccggcaccggcgccaccatcgccggccccggcctggtgctttccttcgtcatcagcgccttcgcctgcggcttcgcggcgatgtgctacgccgaattcgcctccatgctgccgatttccggctccacctacacctacgcttacgccaccctgggcgagctgatcgcctggatcataggctgggacctgttgctggaatacctgctggcctcgtcggcggtgtcggtcggctggtccggctacttccagagcctgctgtccggtttcggcgtcacgctgccgcaggcgctcaccgccgccgccggctcggtgccgggcaaggaaaccctgttcaatctgccggccttctgcatcgcgatgatcatcaccgggctgttggccttcggcatcaaggagtccaagcgcgtcaacaatatcgtggtgctgatcaaggtggccgtggtgctgctgttcatcgccatcggcgtctggcacgtcaagccggtcaactggcagccggcgctgccgttcggcttctccggcgtgttccacggcgccgccatcgtcttcttcagcttcatcggcttcgacgcggtcacctgcgcggcggaagaagtgaagaacccggccaaggacatcccgcgcggcgtgatctggtcgctggcggtgtgctccatcctgtacgtggtggtggccgccatcatgaccggcatcgtgccctacatgcagttcgccggcgtcgaccatccggtgtcgctggcgctgcaggtggccaagctggactggttcgccggctttgtcgacctgggcgcgatcctgggcatgatgactgtgattctggtgatgacctacggccagacccgcatcctgttcgcgatgagccgcgacggcctgctgccgaagatcttctccgatgtgaatccgaaatacggcacgccgtacaaggccacctggctgatcggcaccatcatcgcgctgctggccggcttcgtgccgctgcacacgctggccgagctggtcaacatcggcacgctggcggccttctcgctgatcgcgctgtcggtgatcgtgctgcgcaagcgcgaaccgaacctgccgcgcaagttcgtctgcccggcggtgcccaccattccggcgctggccatcctgtgctgcggcttcctgatgacccagctgtcgctgctgacctggacctgcttcgccgcttggctggtgatcggcttggtggtgtacttcggctactcgcggcggaattcgctgctgcacaatccggcgtga

SEQ ID NO: 3415 - DNA, 450 bp, Chromobacterium substugae
atgaaaggcgtatggatgggcggcttggcggccttgtcgttgctgtcgggctggagcagggcggaggatggcgccgccgcggcatcggcgccgcgcgtgcagctggaatgtttgccggccgccgatgccgccggcggctggcaggactggctggcgacgcgtctgtccttgcgcggcctggaaatcggcgcgccgccgctctggcggctgtgcttcaccgaggaggtggagcggcaatgggtggagcggccggtggactggcgctacgacggctactgggggcagccgccgtatcggctggagagttggccggccttggcgctgacggtgaagaacgccgacggcgcggtgttatggcagggacgggagcggctgggagagggagaaaaccggcggcaacagttggaacaggcggcgcgccggctgctggagcggatgccgatgccgtaa

SEQ ID NO: 3416 - DNA, 1269 bp, Chromobacterium substugae
atgaggacgaaaacgataagctggctgtgcattctgctgccgctggggcatggcctgccggcctgggcggaggatgcgcccgccgccgcgccggcgccgcagatcagcgccgagcagctgagcggcgcagtgaaaaaagcgctggatgatatgggcttccagttcgatggctatctgcgcagcggcttttacggcagctccgccgacaatctgcccaagggccagtaccagctgggcggcgatctgcagcacttccgcctgggcaacgagggcgacacctatatcgagttcggcgtcggcaagaaatggacgctgggcaatggcgtcagctggggcgcttacgtgatgcccaccatctacaacggcaagaccggcgcctcgcaggtctatggctacatcagcgggctggaattcgcgcccaatctgacgctgtgggccggccagcgctaccatcgcatccaggacatccacatccttgacaactggctgatgcaggacggcgacaactacggcgccggcgtggacggcatcgccgtcggcaaggccaagctgaacctgtcggtatcctcgtccggcagttacgccaacaacaacgccacccccaacaacgcgcgccgcgccaattttcagctgaccggcatcgagattaacccgggcggcaagctgacgctgaccggcgcggcgataggcggcgatttcgccatcggcaagcccggcgcggcgctgggcttgttgcataaccagaaggacttcctggcccagggcgtcaacaattcgctgttcctgcaggcttccagcggccacgcgtccttgtccggcgaattctacaatctggacagcaacggcgcggcgcaggccggcgcgcggcagagccgcatcgccgaagtggtggactggcagcgcggacgcttcggcggccaggcggtgctgggctggcagagcgtggcgccggacaacgccgccaaataccgcgacgccaccctgggcggccggctgtcctacggcgtggcggccaacgtcaagctgctgaccgagatcggcctgaccagccgcgataccgacaatcagcccttgcaacggttgaacaaggcgacgctggcgctggcctttgcgccgaataccgatttctggactcggccggaattgcgggtgtacgccagccattacaactggaacaacgcggcggcgcaggccaatctgaccagtttcgcggtgggcggccgcacccaggccaccactttcggcgtgcagatagaggcgtggtggtag

SEQ ID NO: 3417 - DNA, 1650 bp, Chromobacterium substugae
atgcctaaggacatgaaacaggcggtggtgtaccagatttaccccaagagcttcagcagccaccgcaaccaagccaccggcgatctgctgggcgtggcggaccggctggactacctggcctggctgggcgtggactatctgtggctgacgccgttctactgctcgccgcagcatgacaacggctacgacgtcagcgattactacagcatcgatccggcctacggcagcatggaagacttcgagctgctgctggcggaggccagtcggcgcggcatcggcgtgatgctggacatcgtggtcaaccacacgtccaccgagcacgcctggttccaggaggcgcgcaagggcagggacaacccctaccgcgacttctacatctggcgcgacgcgcccaacaactggcagtccaagttcggcggcaatgcctgggagaaggacgaagccagcggccagtattacctgcacctgttcgacaagacccaggccgatctgaactgggacaacctggcgctgcgccaggcggtgttcgagatgatgcgtttctggcgcgacaagggcgtggccggcttccggctggacgtgatcaatctgatctccaaggacccggccttctccgaggatgacagcgacggccgccacttctacaccgatggtccgcgcgtgcatgagtacttgcagcagatgcaccgcgaagtgttcgccggccatgagctgatgacggtgggcgagatgtcgtccacctcgctggagcattgcatcgcctacagccgcccggaccggcgcgagctgagcatgaccttcaacttccaccatctgaaggtggattatccggacggcgagaagtggcggccgggcgaggtggatttcatcgcgctcaagcgcatcctgtccgactggcaaagcggcatgcacgccggcggcggctggaacgccttgttctggtgcaaccacgaccagccgcgcgcgttgtcccgtttcggcgacgaccgccgctaccggaccgagtccgccaagatgctggccaccgcgctgcacggcctgcagggcacgccctacatctaccagggcgaggaaatcgcgatggccgaccccggcttcgccgatatcggccagctgcgcgacgtggaaagcctcaacgcctatcgccagctgttggcggagggctatgccgacgccgaggcgatggcggtgatccgccagcgctcgcgcgacaacgcccgcacgccgatgcaatgggatgatggcccgcatgccggcttcagcgcggctgagccgtggctgggcgtggcggcggatgcggccgagatcaacgtcgccgccgccatcggcgacaaggactccacgctgcaccactatcgcaggctgatccagctgcgcaagcagtaccgggtgttcgccgacggcgactaccgctgcctgacgccgaaccaccccagcttgtgggcctacacccgccgctgcgccgatgaaatgctgctggtgatcaaccacttcggcgccgacaacctccattaccagccgccgccggacgcggtgccggagggctgggtgctggaactgctgctgtccaactacccgccgcaggccaccggccagctaaggccctggcattcgctgctgtaccgggcgacgccgccagccgcgccgtaa

SEQ ID NO: 3418 - DNA, 1455 bp, Chromobacterium substugae
atgagtcacgactaccaagcgatcgccgcgcagatactgcaaaacatcggcggcgcgggcaatatccgccaggcggcgcactgcctcacccggctgcgcatcgccttgcacgacgagtccaaggtgcagggcgaggcgctgcgccaggtggcgctggtgaagggccacttcagcaatgccggcgtgtttcagatcgtcatcggggccggcgacgtggaccgcgtctacgccgaaatggtgaagcagggcggcgtggcccgcgccaccatcgccgatgtgaaagccagcggcgacgaaaaacagaaccggctgcagcaactggtcaaggtgttctccgacgtgttcatgccgatattgccggccatcgtcatcgccggcctgttgatgggcgccaacaatctcttgggcgccaagggcatgttcatcgcggaccagagcctgctggacgcttacccgggcttgtcggggctgtgggggctgatcaatatgatggccaacacctcttttgtcttcctgccggcgctggtgggctggtcggccgccaagcgctttggcggcagcgagattctcggcatcgtgctgggcctgttgctggtgcatccggacctgctcaacgcctggaactacggcaaggcggcggccgggctggatggcgcgtcggtgccgtacttcgacctgttcggcctgcgtatcgaaaaagtgggctaccagggccagatcctgccgatcctggccgccgcctgggtgatgtgccgcgtcgagctgtggctgcggcccagggtgcccaacgcggtgcagttgctggtggtgcccatcgtcaccatcgcggtcagcggcttcctggcgctggcggtgatcggccccttggcccgccatctgggcatcgccgtcaccgacgcgctggtctatgtgttcaacctggcgccgtggctgggcgcggccttgttcggcgcgctgtacgcgccgctggtgttgaccggcatgcaccatatgttcatcgcggtggatctgcagttgatttccagccagggcggcaccttcatctggccgatgatcgcgctgtccaacatcgcccagggcagcgccgcgctggcgatgttctggctggccaggaacgccaacgacaagaacatggcgtccacttccgcggtatcggccttcttcggcatcaccgaaccggcgatgttcggcgtcaatctgcgccacaagctgcctttttacgcggcgctggccggctccgcctgcgcggcggtgctgatcagcctgggccacgtcaaggcgtcggccatcggcgtcggcggcctgccggctttcatctccatcattccgcagtacatcccgctgttcctggcgggcacgctggtggcgctgatcgtgcccttcggcctgacctggctgctggcgcgccgccaactggccgcggccgcccaagaggaggccgcgcagcatgcctaa

SEQ ID NO: 3419 - DNA, 237 bp, Chromobacterium substugae
gtgactcatcgtctctcccctgtcccttgtcgcggcggtggattcgctcccggcacaatgccggaaatccgcctgttcgtggcgattgtccgcatgacaatcgcggtcaagttaactcgtacatacaagttggtcaacactcgtacatacgagtttgcgaaaagtcaaaacgactgccgccatttcgcaacagcgaaaagacgaaggcccgggcggatgactccgcgccgggcctga

SEQ ID NO: 3420 - DNA, 705 bp, Chromobacterium substugae
atgaacaaataccatcaaatttattccgaaatcatcgccgatatcgataatcagcgcttcgcgcaaggcgacaagattccctccgaatccgagctgatgcgcagctacgaggccagccgcggcaccgtgcgcaaggcggtggacctgctgcaggaacgcggctacgtgcagaagatccacggcaagggcgtgttcgtgctcaagccgggcaatatcgagttccagctcagcggcatcgtcagcttccaggaaatgaacgagcgcatggggcgcaaagtggtatcgcgcgtggcggaactggcgcgcgcgccggcggacgccgcgctggtccaggccactggcctggcggagggcgaggaaatcgtcaggatcaagagggtgcgcaatatcgacggcgaaaacgtgatcctggacgtcaaccattttgtcgctgagttgatccccggcctgaccgaagacatcgccgccggctccatctaccgctacatcgagcaggatctggggctgaccatcagctacgcgcagcgcaccatcgaagcccagccctgcaacgacgacgaccgccgctacctggacctgaacggcatggaccacgtgatcgtggtcaaaaacttgacccacctctacgacggccggctgtttgaatacaccgaatcgcgccatcgcttggataagttctatttcacggatattgcgaggcggtag

SEQ ID NO: 3421 - DNA, 897 bp, Chromobacterium substugae
atgagcgagctgaaacagctggagacctttgtcgcggtggtggggctgggcagcctgtcggccgcggcgcggcagttgggcgtggtgccggcgatggtggggcggcgtttggacgcgctggaagagcggctgggcgtgcgcctgctggcgcgcagcacccgccgcgtggcgccgacgcaggagggcgaagcgttttatgaagactgccaacgaatactggccgatctgacagaggcggaggctgcagcggcatccggcagcggcaaggcgcgcggccatctgcggctatcggcgccggccggtttcggccgccgccacgtggcgccgcatgtcgccgatttccagcgcctgcatccggaagtgaaagtgacgctcgacctgtccgatcggctggtggatttgcagcgcgaccgcatcgactgcgcgatccgcatctccgacctggccgattccggcctggtggcgatccggctggcggagaaccgccgcgtggtggtggcagcgccggcctacctggccgagcatggcgtaccgcgcgccccggccgatctgcagcatcaccagtgcctgtcgctgggagagagccagagccgcggctggagcttcgccgtggatggccggccggtgaaccttaaggtggccggcgcgctggagtgcaatgacggcgcggtgctgcacgactgggcgctgcaaggcctgggcctggcctggcgctcgttgtgggaggtgaaggaggacctgtccgaggggcggctgctgacggtgctggacgatttcgcctcgcccgattacccggtgtgcgcggtggtgcagcaacggcggctgctgccggcgcgggtgcgccgcttcgtcgatcatctgcgcgccgcctacgcggcgcccggatattgggattga

SEQ ID NO: 3422 - DNA, 1596 bp, Chromobacterium substugae
atggcagtcaaccttccgcagggcgtggaaatcttcgccgacatcaccccggcctacgccgaaatcctcactcccgaggcgctggccttcgtcgccaagctgcatcgccgcttcgagccgacgcgccgcgagcgcatcgccgcccgcgccgcgcgccaggccgagctggacgctggcaagctgccggacttcctgccagaaaccgccgccgtgcgcgcaagcaactggaaaatcgcgccgctgccgcaggacctgctggaccgccgcgtggaaatcaccggcccggtggagcgcaagatgatgatcaacgcgctgaactccggcgccaaaagcttcatggccgacttcgaggactccaactgcccgagctgggacaaccagatcgccggccagatcaacgtccgcgacgcctaccgcaaaaccatttcctacgcgagccccgagggcaagcaatacaaattgaacgacaccatcgccactctgctgctgcgcccgcgcggctggcatttgatggagaagcacgtcaaggtagacggcgagatcgtgtccggcagcctgttcgacttcggtctgtcgttcttccacaacatccgccacctgcgcgaacacggcagcgccacttattactacctgccgaagatggagagccatctggaagcgcggctgtggaacgaggtgttcgtgttcgcccagaacgaattgaacatcccgcaaggcaccatcaaggcgacggtgctgatcgagaccatcctcgccgccttcgaaatggatgaaatcctgtacgaattgcgcgagcattccgccggcctcaacgccggccgctgggactacattttcagctgcatcaagaaattcaggcagaaccgcgacttctgcctggccaaccgcgcgcaaatcaccatgacggtgcccttcatgcgcgcctacgcgctgctgctgctgaaaacctgccaccagcgccacgcgccggccatcggcggcatggcggcgctgatcccgatcaagaacgacgccgccgccaacgaaaaggcgctggccggcgtcaaggccgacaaggaccgcgacgccaccgacggctacgatggcggctgggtggcccacccgggcttggtgcctatcgccgacgccgccttcagcgcggtgctgggcgacgcgcccaaccagatcgccaagcagcgcccggacgtggccgtaaccgccgccgacctgttgaatttccagccggaaacgccgatcaccgaagccggcctcgccatgaacatcaatgtcggcatccaatacctgggcgcctggatttccggcaacggctgcgtgccgatccacaatctgatggaagacgccgccaccgctgaaatctcgcgctcgcagatctggcagtggctgcgcagccccaaaggcgtgctggacgatggccgcaaggtgacgctggagctgttccgcgaactgcaggcgcgcgaagtggccaagctgaaggacgagtacggcagccgctggagcaaacaatacgaggacgccgccaggatgttcgacctgctgaccacctccgacgacttcgtcgaattcctcaccctgcccggctacgaatacatagattga

SEQ ID NO: 3423 - DNA, 690 bp, Chromobacterium substugae
atgaaaaagtcccgcctcaaacccatgctgatgtgctgcctgctggccgccgcccttcccgccgccgccgaaggcatccagctgaacctgtcggccagcgcccagcgcgacatcgccaacgaccagatcagcgccaccctgtatgtgcaacaaagcaacagccaggccgcggtactggccgataggctgaacaaggccaccgccaacggcctggccatcggccgcggctacaaggacgtgcaactgtccagcggcagctacagcacctggcccagctacgacaagaacggcaagatcaccggctggcaaggccgctccgagatccagctgaagagcaaggactttgcccaggccgccgagctgatcgccaaactgcaacagaccatgctgctggaaggcgtgcaattcggcgtctccgacgaagcacgccgcaacgccgagcagggcatgattccggaagcgatcgccaacctgaaaaaccaggccgaagtggcggcgcgcgcgctgggcaaaaacgccgtcaacatccagcaactggatatcggccagcaaaaccacggcttccgtccgccggtgatgatgatgaaagccgcggtggccggcgccgaatccaacgtcagccagcccgacctgcagccgggtcagacccagctgcaactgcaggtcagcggcaaggtggaactcaagtaa

SEQ ID NO: 3424 - DNA, 612 bp, Chromobacterium substugae
atgaaactgatcgcttctttgaccagcccttacgcccgcaaggtccgcatcgtgctggctgaaaagaaaatcgactgcccgctcgaggaggaaacgccctggagcgcggacagccgcgtcccggagtacaaccccctgggcaaggtgccggtgctggagctggacgacggctccacgctgtacgactcgcgggtgattgtcgaatacctggacaacagctcgccggtgtcgcggctgctgccgcaagacaatcgccagttgatcggcacccgccgctgggaggcgctggccgacggcatcatcgacgcgatggtggccatcgtgctggagcgccgccgcccgccggaaaagcagatggaggaagtggtggagcgccagcgcggcaagatcgcccgcgcgctggcgacgctgtcgcaggatctgggagaaaagccgtggtgcaccagccacggctacagcctggccgacatcgccgtcggctgctgcctgggttacctggacttccgcgcgccggaattggactggcgcgccagccaccccaatctggacgcgctgttgcaaaggctgtatgcccgccagtccttcatcgacaccgagccgccagccgcctga

SEQ ID NO: 3425 - DNA, 687 bp, Chromobacterium substugae
atgagcctctggtttcctgtcatccgccgtttcatcgtcgtccgcatgctgctggccaggccgcggctggtgtggtcggcgctgttcggcgcgttagtgatcctggcactgccccatgtagcggccatgcacgacgtcacccgctatatcgtcggctggaatgccggcgcttggctgtatctcgcgctggtggcctggatgatgttcggcccgcgccagcagcagatccgccattgggcgcggctggaggacgaggggcagtggctggtgatgctgctggtggtgttggcggcgatcgccagcctggcggccatcgtgctggagctggcggtggtcaaggacatgaagggctggctgcgcggtgcgcacattctgctggcggtgttgacgctgctgtcgtcatgggcgttcacccatgtgatgttcgcgctgcattacgcgcgaaccttctatgccgagcatgcccgcggcggttcgggcggattggagtttcccggcacccggctgccggattacgccgatttcctctatttcgccttcatcatcggcacgtcgggccagaccgccgacgtcagcttcaccgacagccgccagcgccgcgccggaaccgcgcattgcgtgctgtctttcttcttcaacgccacggtgctggcgctgatgatcaatatcgccgccggactgatctag

SEQ ID NO: 3426 - DNA, 774 bp, Chromobacterium substugae
atggccaacaccccgacggcgccccgcccgcaagcgctgcaagaccgggacgcgcaactggaagccctgtgccgccaaatggcctgccgcgacttctgcctgctgccggccgcgctgtcgcgcgatctgctgctgctgcaggacccgcgcgcgctggccgattgggaagcgttccaggatagctggaaccacctgcggcaagacaagttcatggccgacggcggcagctaccgccaacggctgcacgccaccctcagcgccgagccctcggcgcggcgcgcgcgggcggaagcccaccagccccactaccaaagccggcagtacaatccgctcaacggcggcgtcgcccgccacttcgagccgatacgcaacgaaatcctgctgggcgccaccatgcaatcggtgctggagctgggctgctcgatattcggcaagctgtcgccttacacccgctggcatatcgaagcgcaccagttccgcatcgaggcgcgcaaccgcgagcgcggcaagcccaccccggaaggcatacaccgcgacggcgtgcacttcctgctgatgatgatggtgcggcggcgcaacctggtgaacggcgccaccgagctgtacgatctggaacaccagccgctggccgaattcacgctcagcgatcccctcgacatcgcgctggtcaacgacgagcgcgtgctgcacggcgtcaccccggtggcccagctcgacccctcgcgcgaaggcagccgcgacgtgctgctgctgagcttccgccgccacagttga

SEQ ID NO: 3427 - DNA, 747 bp, Chromobacterium substugae
gtggccagacagatcgcgatggttttggcggcggcttgctgctggtgcgcggcggcagtagcggcagcggacattcacgcttacaccgaagacgtgccgccgctcaactaccttgagaacaacaacgtccaaggctactccaccgaggtgctgcgcctggtcgccaaggaagccggcctcaagctcagcatcgacgttctgccctggctgcgcgcctatgccaaggtggagagcacgccggacaccctgctgtacaccatcgtgcgcacgccggagcgcgagcagcacttccagtgggtggggccaatcgggccgcgccgcatctacctgtaccggctggccgcgcgcgacgacatccgcatcgcctcgccgaacgacctgctgcgctaccacaacggcgcgctggccggatcggccgccgccagccagctcgccgcgctgggcctgcaagccggcagcgcgctggacatcggccacagcgacgccaccaatctgaagaaactgcagctgggacggctggacctggtggccatgctggactgggcgatggcttggcagctgcgcctgcaaggaaaaaccgaaaaagcggtggccccggtcctgctgctggacggcaagctggagtactggttcgcgctcaaccgcgccaccccgccggaacgggtcaaacagctgcaggacgcgctcaaccgcatccgcgccgacggccgcctgcaggccatccgccgccgctaccgcagcgactga

SEQ ID NO: 3428 - DNA, 1629 bp, Chromobacterium substugae
atgggcaagcgggttttcggcagcatcgattcttttgtggaaagctcggaaacggatctcaagctggggcggctggtcgccaacttcggctttctgcgggctttgctgcgctacgccgagttcgacgaattccacctgttttgcccggcgctggacaatctgaagctggtgcagcggcggctggaagcctgcgtcgacgacgcgctgctgtcccgggtggtgttgtcgcatcatctcaatgtgccggacgccttgtcccgcaccgacttttccgctttccacctcggcgactggtactggtacctgcccaagatggcgcgcctgcgcgcgcgccatgccagccatccgctgccgctgaccgcgcccatccacagcctcaacggcggcgacatgttcgacaaggtggcggcgctgacggccgcgccgctgcggccgggcgacgcgctgttctgcacctccacgctgggccgaggggtggtggagcgccatctcgatcatgccttgtcgtccggcgccggcaaccgcccggcctgccggctgctgccgctgggagtggaggaggaatacttcgtccgccgcgaccgcgcggcgtgccgccagcaactggggctggaggccggcgctttccatctgctctacgtcggccgcctgtcgcccgccaccaaggccgacctggtgccgctgctgtacctgttggcgcgtttgcggctggaggcgccgcgcgtcgattggcggctgctgctggccggcggcgccgcggccagcgatctggacaacctgcggcaggccgcggcggagttggggctggacggcgcggtcacggtgctgggtccggtcagcgacgcggacaagcacgcgctgctggcggcagccgacgtgttcgtgtcgccggtggacaattatcaggagactttcggcatttccatcatcgaggcgatggccgccggcttgccggtggtggcttccgatttcgacggttaccgcgatctggtgcgcgaaggcgagaccggctttcgcattcccacgctcgccacccagccgccgcgggtggccggcgacatgctggaggtgctggaggacaatctgtcctcgctgctgcacgcgcaaggcgtggcgctggacatggaggcgtttggccggcggctgctggagctggccgccgatcccgcgctgcgccgccggatgggcgagcgcgctcgcgcggtggcgttggcggaatattcctggcgcgccgtgatccagggctatgacgccgcctggcgcgaactcaagcgcgaggccgacgccgcggggctgcaaccgtggaccggaacgccgcggccggacatgcgggacatattccgcgattatccgacgcgccatctggaaggcgggttggcgctggagttgaccgccttggcccacgcggtgctgcgcggcgagctgccgatgcctgccacctatgccgaggtggccttgctgagcagcggcgagctgctcagccacacgctgcggacgctgctggccggcccgcaaacggtggcggcggtgcgcagccaagtgcaggccagcctggcggtcgccgccgaccacgtcgattaccagctcggctggctgctgaagtacggcctgctgcggctgcttgcctga

SEQ ID NO: 3429 - DNA, 282 bp, Chromobacterium substugae
atgcatttcgatgaaatccacagcagccatttcgtcaccctcagccgcactcccttgccgcatacgctgatcgagcaggcgctggtcaatatcggcggcggcggcaacgacggcatgaatttccgcaagcaggcgctggccgccgccggctggagttacgacggcctggtgccgttcgccaagcatcctgacaaggccgcccaggctttcaaccgcctgcggacggcattggcgtcctataccagcgcggaggcgctgatggcggcgctggaggccgaataa

SEQ ID NO: 3430 - DNA, 216 bp, Chromobacterium substugae
atgtttcccgaataccgcgatctgatttcccgcctgaaaaccgaagacccgcattttggccgcctgttcgatttgcacaaccagctggatcagcagatcaagaacatggaggcgcgcatcatccaggcttcggcgctggaaatcgaaaacctgaaaaaggaaaaactgaagctgaaggatgagttgtacgtgttgctgaaggcgcatacctcctga

SEQ ID NO: 3431 - DNA, 900 bp, Chromobacterium substugae
atgcaaccattgacgcgattattgttgaaaatagccggcggcctgctgacgctggtcatcttggggaatgtgctggagaaatcggtgctgagctggacggtgatcaatcccggctataccggcatcaagatcaaccggctggtggaccgcggtatcagcaaggaaaacgtggtgaccggcttcgtgttcttcaatcccatccagagcgtggtggtggtgtatcccaccttcgtccagcgcgaagtatggacccgctcggccaccgaaggcagcgccgccaacgaggagctgagcttcaacaccaaggattcggtgccggtttcgatagacgtggcggtgtcctatctgctgcgcgccgacaaggtgccggagttctacacccgcttccgcgccgacgacatttccaactggacccacggctacctgcgcgacaccgcgcgcaacatcgtggtggcgctgggatcggaatacagcttcgacgacgtcaacggcgtgaagaaggaagagtttctcggccgggtggcggcggagctgaaccggcgcaccatgccgataggcgtgtctatccagcagttcggcctggtgggcgcgctcaggccgccgccggagctggccaatgcggtgaacgccaagaccaaggcgattcaggactccatccgcaccgagaacgaagtgcgcgccgccaccgccgaagctcgcaagaaagtggccatcgccgagggcgaggcggccgccaaccgcgcgctggcctcgtcgctggatgacaggctgctggcctgggaaaggctgaagctgcagcgcgcctacatagacaaatggaacggccagatgcccagcgtggtgggcggcggcgaaggcggcggcatgctgctcaacctgccggcgccgacgcagaaatga

SEQ ID NO: 3432 - DNA, 1038 bp, Chromobacterium substugae
atgcccagccagcctccacagcccaaaaaccatgactcctccatggacagctccgccgccgccctgcgccagcgcctggaccacgccctgcaattgctgggcatgcgcggcaagggcctgttgctgctcggcggcctgctggcggccggctggctcgcctccggcatctaccgggtggagccggacgaacaaggcgtggtgcagcgcttcggccgctggagcgacaccacctcggccggcctgcattaccacctgccctggccggtggaaaccatccagctgcccaaagtcacccagatcaaacagctgaaactggccaatttgtacgagggctcgccgcccgacgccgccgacccgcgcgagaaacagatgctgaccggcgacgaaaacatcgtcgaggccgactgcgcggtgttctggcgcatcaaggacgccggccgcttcctgttcagcgccaaggagccggagcaggcgctgcgcatcaccgccgagggcgcgctgcgcgaagtgatctcgcacacccccatccaggcgtccatgtccaaccgccgccagcaggtggccgaagaaacccgcggcctgatccagcagcggctggacgcgcagcaggccggcatcctgatcacccaggtgcagctgcagcgcgtggacccgccggcggcggtgatcgacgccttcaacgacgtgcagcgcgcccgcgccgaccaggagcgcgcccgcaacgaggcgcaggcctacagcaacgacatactgcccaaggcgcgcggcgaggccgagcgcatccgccaggaggccgaggcctaccgcagccaggtggtcaacctggcccagggcgaggccaagcgcttcgactcggtataccagacctacgcccaggccaaggacgtcaccgcctggcggctgtacctggaaagcatggacgacatgctgaagaaggccagcaaggtggtgatagacggcagcggcaagaacggcagcggcgtgctgccgctgctgcaattgcaggacaaacccaaggccggcaaggagaaccgctga

SEQ ID NO: 3433 - DNA, 879 bp, Chromobacterium substugae
atggacaagcaatggcgcggaatcggctgggtggccggcatcgccgcggtctggctggcgctgtcggcgcagtacacgctgaacgaggggcaaaaggcgctagtggtgcggctgggcgcgccagtcaacgtggacggcgagccggggctgaaattcaagcttccgctgatcgatagcgtacagtactacgacacccggctgcagatgctggccccgccgccggaacaggtgatcctgggcgacgagaagcggctggaggtggaaacctacacccgctaccgcatcgccgacacgctgcgcttctaccaggcgctgcgcaccgaggagcaggcgcgcgcgcagctgacccaactggtgagcacctcgctcaggcgcgagctgggcaaggcgccgctgtcagacctgctgtcgccgcgccgcctcgccatcgtcgcgcgcatccagcaggaggtgaccgaacgcgcccgcccgctggggctggacgtgaccgaggtgcagctgcaccgcgccgatctgccgctggaaaccagccaggcgatttacgaccggatgaaatcggcccgccagcaggaggccaaggaattgcgcgcccaaggcgcggaatgggcgcagcagatccaggccaaggccgaccgcgaccgcaccgtgatcctgtccgaagcgcagcggcaaagcgccatcacccacggcgaggccgacgccgaggctggccgcatcttggcccaggccttcagcaaggacccgaagttctacaagttctaccgttcgctgcaaacctaccgccagtcgctggccgactcggcgccggtgctggtgctgtcgcccgattcggcactgctgcgcgacctgaaaaacggcccggcgggcggcaagccatga

SEQ ID NO: 3434 - DNA, 1239 bp, Chromobacterium substugae
atgtcgctgccaccgtcgacgctgcgccgcctgcgccacctgctggccgcgcttggccccggcctggtggtgatgctggccgacaccgaaaccggcagcgtgatcgccgccgcccaaagcggcgcgcactggggctaccggatgctgccgctgctgctgttgctgatcccgctgctgtacatggtgcaggagctgacgatacggctggcgctgggcaccggcaaaagctacggggagctggtgcgccggcgctggggccgccgggccgagcgggcctccgcctcggtgctgctgctcagctgcctgggggcgctggccacccagctgagcggcctggccggcgtcggccagctgttcggcatcccggtgtggcaaaccatcagcctgctgggcgcgctgattttcctcatggtgtgcaccggcagctaccgctcggtggagcgcaccgccatcgcgctaggggtgttcgaactggccttcctggccgaagcctggctggccaaacccgatccggcccagatgctggcgcagctgacccaactgccgctgggtaatcacgatttcctgctgctggccgccgccaatatcggcacctgcatcatgccctggaccatttgctaccagcagtcggccttgctggacaagggcctgacgctggccgacctcaggccggcgcggctggacaccctgctgggcgccatcctgtgccaggtgatcaccgccggcatcctgatcgccgccgcggtcgccttcggccatggcggcggcggcgccagcctggacaccattccgcagctggccggcggcttcacccgcctgctgggcccggccggcggccggctgctgttcgcgctggcactgtccggcggcgcgctggtggctaccatcgtggtgtgcctgaccagcgcctgggcgctgggcgaattggcgggcaagcgcgaatcgctggcgcggcgtccgctggaggcgccgtggttttacggcagcttcgcgctgatgctgatcggcaccggcgcgctggtgtcgtccggcgtcaacctggtcaagctgtccatcgccacctcggtcgccaacgcgctcttgctgccggcgatgctggccggcctgtactggctggccagccgcgagctgccgcccgcgctcaagcccggacgcggctaccgcctgctgctggccctgttgtttttgttgatcggcggcttcagcctctactccggcatcgccggcagcctggactga

SEQ ID NO: 3435 - DNA, 1086 bp, Chromobacterium substugae
atggaacccgacagcctcgcccacgccttcggcctgactttccaggtctcgtttctggacctgatcctcagcggcgacaacgcgctggtgattgcgctggcctgccgcgcgctgccgcaggagctgcgccgccgcgcagtgctgtggggcaccggcttcgccatcgcgctgcgcctgctgctcaccgcgctcaccggcgtgctgctgatggtgccgacgctcaagctgatcggcgccgccgtcctgctggcgatcgccatccagctgctgctgggcgacgacagcgcggacgacgacggcgcgcggctggcggaacaggccggccacagccggcagctatggaacgcggtgacgctggtggtcagcgccgacctggcgctgagcctggacaatgtggtggcgctggccgccgccgcccagggcagcctgctgttcctgctgttcggcctgctgctgagcgtgccgctcttgatgtacggcagcctgctgctgtcgcggctgatggacgactatccgctgctgatcccggccggcgcggcggtgctgggctggctggccggcagcctggcggtgagcgaccccttgtggaacgactgggtcgccgcgcaagcgccggcgctgcagatcgcggtgccgctgctcgctacggtcttcgtgctggtggaaagccgcatcatccgcgaacaacggcagcgcctgcccgcgttgccgccgctgcagctgctggccccgctcacccgccgcctggccatgctgggcgaggccggcatcgccggcgagccatcgccctctcccatcgcgccgcccgaaccggccatagccgcagccgcaccgcccgccgcctgcgccgaaacgcccgccgcggcggcgctagaggaaagcgcggctgtcctccagccgcgccagcccgcggcgatagacgaggaagcaggcgacgacgatgccagcctcagcccgccgctcaaggcgctggtgctggcggcggccgtcatcggcgcgctggcgctggcctggctggcctggcacctgcttagccagggctttctgcccacgcccagccaccacccggcggcgccgcgccattga

SEQ ID NO: 3436 - DNA, 2370 bp, Chromobacterium substugae
atgttcctgaaaggcgggttggccgccggcgcgctgggcggcgccgccttgctggccagccacggcgccgtcaccggcagccccttccagccgacgcaagcgtcgtggctggtcaagaccgccgacgccacctgcaccgatcccgcctggagcgcggccaccgtctacaccggcggccagcgcgtcagctaccagaaccagacctggcaggccaaatggtggacgcagggcaacaccccggccgccggcgacgccagcccgtggcagctgatcggccagtgcggcggcggcaatcccaatccgccacccgacccaccgctggtgcaagtgcccgcccccaccggcaacgcgctgtgccgccccgaagcgctggcgcagacccccagcgtcgacgtgccctactgcgcggcctacaagcagggcggcgcggaacaactggccaacggcagccgccgccgcatcatcggctacttcaccagctggcgcaccggcaaggacggcagcccggcctatctggtgaacaatattccctggggcaagctcacccacatcaactacgccttcgcccatgtcgacggcaacaatcagctgtcggtcaacgacagcgccgccggcaatccagccaccgacatgacatggccgggcgtggccggcgccgagatggacgccagcctgccctacaaaggccatttcaacctgttgacccagtacaagcgcaaatacccgggcgtgaagacgctgatctcggtgggcggctgggccgaaaccggcggctatttcgacgccagcggcaagcgcgtggccagcggcggcttctacagcatgaccgtcaacgccgacggcaccgtcaaccaggccggcatcaacgccttctccgactctgccgtcgccttcctgcgcaagtacggcttcgacggcgtcgacatcgatttcgaatacccgacctcgatgagcaacgccggcaatccgctggactggagcttctccaacgcccgcctcggctcgctgaccaagggctatgtggcgctgctgcaaacgctgcgcgaccggctggaccgcgccgccgcccaggacggccattactaccagatcaccgccgcggtaccagcctccggctacctgctgcgcggcatggaaaccttccagggcttgaagtacctggacttcgtcaacgtgatgtcgtatgacctgcacggtgcctggaaccgcttcgtcggccccaacgccgcgctgtacgacgacggcaaggacgccgaactgacgttctggaacgtctacggcaccgcgcagtacggcaatatcggctacctcaacaccgactgggcctaccattactaccgcggcggcttgccggcttcgcgcgtcaacatgggcgtgccctactacacccgcggctggaaaaacgtcaccggcggcagcaacggcctgtggggcagcgcagtgggcagcaactgcccgaccggcctgacggagtgcggcgacggcgcggtgggcatcgacaacatctggcatgatctggacgacaacggcaaggagatcccgggcggctccaatccgatgtggcacgccaagaacctggaaaaaggcatagccggcagctacctcgcgtcctacggcatcgacaccagccagccgatcaaccagctcaccggcagctaccagcgcaactacaacgccaccctgaccgcgccgtggctgtggaacgccagcaagaacgtgttcctgtccaccgaggacgaacagtccatcgcgcagaaggcggcctggatcgacgccaacaacatcgggggcgtgatgttctgggagctggccggcgactacgactggaacgcgcagcgcaacggcggccagggcgaatacttcatcggcaacaccctgaccaacctgctgtacaacaccttcagccagccggccaaggtcagcgcccgccgcgccgacgccgcgccggctccgactgcggccatcgatgtcggcttcagcctgggcaacttcgcgctgggcgacaacaactatccgatcaaccccaagctcaccatcgtcaaccgttcgcaaaccacgctgcccggcggcaccgagttccagttcgacgtgccgacctcggccccggccaatatcgccgaccagtccggtttcggactcaaggtgatcagcaccggccacagcggcagcaatgtcggcggcctgaagggcgacttcaaccgcgtgtcggtgaagctgcccagttggcagagcctggcggccggccagagcgtgacgctggacgtggtgtactacctgccgatctccggccccagccattacacggtgggcctgaacggcaaaacctacgccatccgcgacgaggcgccctacctgccctacctgaaataa

SEQ ID NO: 3437 - DNA, 216 bp, Chromobacterium substugae
atgaacgccgatgatctcgcccgttattaccaagactatctgtcgcgccaaccatcccgcttcggagtctcgccgctgcgggcgctggcccagctgcgcgaagtgatgcaatggccgcaggaggcggcggccgcggagaaaaaaagcggccgggagagcccggccggaacgagggaacaagagaaacgcggcggcccgcggctgcgggccggttga

SEQ ID NO: 3438 - DNA, 1584 bp, Chromobacterium substugae
atgcgcagcctgctggcgcaaatgcagcagctgggctggctggactggcagtcgcgcgccggccgcggccagcgctcgctgctgcgcttcgcgcaaagcctggagcaattgcggcaaaaccaagcggcgcagctgttggagcaagggcgcgtggaacaggccgcggcgctgctgggcggcgatccccggcaattggcgcccattctgctggccaggctgggccggcgctggagccaggaccgccaggtgctgggcgtgccctattaccggccgatgcccaatctgtatccgggcacgccgctgcggcgctccgaacgccacctggtaagccagatcttcaacggcctgacacggataaacgaggaaaaaggggaagtagaaggcgacttggcgcatcattggcaacagcatggcgacgccgagtggcatttccacctgcgcccggcggtgcgctggcacgatggccgcgaactgacgcaggacgacatcgccgccaccttgcaacggctgcggcgctggccgctgttttcccatttgcgcggcatccgccgcctggcgccgcacagcctggcgctggagctggagcggcccgatcgctggctgccctggctgctggccgacagcgcggcgctgatcctgccggccgatcatgacaagcaccccggcttcgcctcgcacccggtgggcaccggcccctaccgcgtcgcggccaacgacgcgcaccggctgtcgctgcaggccttcgacgactacttcggctaccgcgcgctgctggatcaggtggatatctggatgatgcccaagctgggcgacgaactggagcccggcgggcccggcctttgcgatttgacggtggaaatcaatccgcagcccgtccgtccgcaaaccgagatgtcgctggaggccggcgtctatttcctgctgtgcgacggccgcgcgccggccatgcgcgacagccaggcccgccagtggctggcccacgtgctggcgccgctggccatcatgcaacaaaccgcgccagcggtccgacaatattgggtggccgcctccggcctgctgccgcgctggcatcatgccaaacctgcagccgcgccgacccggacgccgttttcccggctgcggctggctttttatgaacagcacccggaataccagttgatcgccgacgccatcgcgcgctgcctgcgtcccttcggcgtggagctggaatgccgaaaatacagctatggcgactgggagcagggccgcggcgaagccgaactatggctgggttcggtcaacttcacccgcgccaccgactacgccattcccgcctggctgctgggcaccccgctgctgcgcggctgcctggcgcccgaactgccgctggacggctggctggacggctggcgccaaggaagcgaaaacgcccagggcctggccgccgcggtggtgcaaacgcattggctgctgccgctgttccacaactggctgaggctgaacggccctggccagatagaagatttccgcctcaacagcctgggctggttcgatttcaaatccgcctggctgcgccccgaagacatgtccgccgcgccgaaatga

SEQ ID NO: 3439 - DNA, 609 bp, Chromobacterium substugae
atggtttcaaacaattcgcaaatgagtcgaatcgcgcgccggccttggctggcggcattgtcggggctggcgctggccattctcccgcatggcggcgcgcatgccgccgagccgctgcagccgtaccgcggggagttgaagtgccaggcgcgggagatggacgatatctggctggaccagcgtctcgcctgcgtttctcccgggcagaagttcatcgtcaatgccgccggggccagcggcgcggctcgcgacgtggcttttgttgtgaacgaggcgatctacgacaagaatttttatcctatccaggatcgcaaggtgcgctactaccagtcattcctgtgcgtgcgcaatgcgccggcggacatccggccgctgtttctgtcgggcgacctcgccaatgcgctcaaactgagcaatctggatcaaaagccggaaggcgtgggtccgacctcggtgaatatcgccggcggcgaccgcgacggctgggaggcgacgccgtgcgatccggcgcgccatccgctgatcgtcgactaccgcaccggcgcggtggtgtcggtcaacccggcggcgctggccggcctgcggatttaccagttgcccggccgctga

SEQ ID NO: 3440 - DNA, 216 bp, Chromobacterium substugae
atggacttggcgggccgcgatggcgctggcgattgctttcgcatgcgccggcaagtttatcccaaaggcatgctgtggcgcggtgaaatgcgcctggggcagcggggccggccggcggcggggtgcgcgatttccgtctgcggcggccaggggcgcggcgcggagagtgcgggtttgctcttgcggcgggtgctggtgtcggggcggggccgatag

SEQ ID NO: 3441 - DNA, 71 bp, Chromobacterium substugae
gcgggtgtagctcaatggtagagcagaagcttcccaagcttacgacgagggttcgattcccttcacccgct

SEQ ID NO: 3442 - DNA, 2151 bp, Chromobacterium substugae
atgaaattgaactcaggccggctgtggctaagaatcgcgacttacggctcgctggccgtggttttgctgctggtattgatccgcgcattgatctactggcaattcgacgaagccgccgtgcgcggcgcgctgacccacgccctgaacgacacaggccgcgccgtccatatcgatggccgcatcactccctccgttttcccctatcccggcatagacatagaaaaagtcagcatcagcgaacccggcaagcccgccgttttcgcccgggtggaactattgcgcgtgtcgctggcctggatgccgctgctgttcggcaaccgcgaaatcaaggcggtggagctatacggccccagcgccagcatcacgcgcgggctggacggccaactgaatatttccgacctgttccagcgccgcagcccaggcgcctacagcatcaagctggaccagttgcgcatccgcgaaggcacgctgctgctgtccgaccagcccacccacaccgacaagcgcctgtccagcatcagcctggacgccgacgatctgcgcagcaccgccagcgtcagcgccggcgccattctcgacgacgacaagcgcccggtgcggctggcgctgaacacgccgctggccatccaggacgaccaggtcagcctgccgcagctggaggcggtggcgatcagcaacatccagggcctgggcgagaccaagctcagcgtcaccggccagtacaagctcaacttcgcctcgctgcaggccaccggcagcgacgtcaccgtgtcgttcagcagcgacaggcccagcagcgaagtgaagctcgcgctgccgcagatcaacgccagcctgcacgagctggccatgccctccggcagcctgagcgccaagttgatctacgcccgcagccagtaccagctgcaggcgcagttggaaaacctcaagctgagcgagggcggcctgtacgccgacaagctggacggcgaattcaactggctggccggcagcaccaaggtcaacgtcaagctcaacgcgccgttctcgctggccggcatgaaccagctgctgatgcagccattgaagctgaccagcaccatcgccaccccggcgctgccgcgcggcaagctggtcaccagcatggaaggctcgctggacggcgacatcgacgagccgcgcttcaatctgcgcgtggccggcaagctggacggctccgacgtgtcggccaccctcagccaatacggcctgatcaaaccgcgccacgaggccacgctgaccataggcaagctcgacctcaaccgctacctgccggaaagccagggcgacccggtggccatcttccagaacaccaacgagattccgctcgattggctggatttcttcgacctcaacggcaaggtggcgataggcgagctggcgatgggccgcttccgcatcaaccacatcagcagcaacgtccgcatcaatccgcgcgcgctggagctggaccagatgtcggccgacatctacgacggccgcctgcagggcgacgcctcgctcagccgccgcgacgtgccgcgcctgcaggtcaagcagacgctgcaggggatgaagatccgcccgctgctggtggacctgttcaatttcggccggctggacggcaagggcaacggcaagatagacatcagcgccgacggcaaatccttcgccgacctgcgcaacaccctcagcggcgacgccgccttcagcctgaacaacggcgcgctcaccggcatcgacctggtggcggcgctgaagaacctgccggcggagctgaaggaatggaacagcgccgcgcagaacgaccagaagaccaccttctccacgctgtcgaccagcttcaagctggacaagggcatcgcccgcaaccaggacctgaagctggcctcgcagctggtgaacgtgaacggcggtggcaagatagacctgaaacagagcatcgtcgactacacgatggacgtgcaggccaatccgcaggagtttgcccagctcaagggcgtcaacgtgccgctgaagatcaccggcccgatcaacgcgccggtgtacgcgctggatttcaacgcgatggtgaagggcaagaagaccgagggcgagaaaaagcaggcgctgaagcagcaactgcagaagcagatcaccaccattctgccctga

SEQ ID NO: 3443 - DNA, 2037 bp, Chromobacterium substugae
atgcattccatggcccccatcgttatcgtcctgttggccgcagtgttggcggtaaccctgtgccgcagcctgaaagtcccgccgatgctgggttacctggtagtgggcttcctggccggaccaggcgtggccagcctgataccgcaaggcaaggaaaccgcctttctgggcgagatcggcatcgtgttcatgatgttcaccatcggcctggaattttcgctgcccaggctgaaggcgatgcggcagctggtgttcggcgtcggtttcgcccaagtggctgtgaccatgctgctggtggccgcggccatcgcctatctgaccggcagcccgctgactggtttcgcgctgggcggcgcgctggcgatgtcgtccaccgccatcgtcagcaagctattgaccgagcggctggagttgaaccagccgcacggccagctggcgataggggtgctgctgttccaggacatcgccgtggtgcccttgctgattctgctgcccgccttcgccggccatagcgagaccttgtggctggatctgggcaaggcggcattgaaggtggcgctggtgctggcgctgctgctgtttttcggccagcggctgctgcggccgtggttccatctggtggcgcgccagcgctccggcgaattgttcatgatcaacgtgctgctggtgacgctgggcgtggcctggctgaccgagctgtccggcctcagcctggcgctgggcgccttcgtcgccggcatgctgatctcggaaaccgaataccgctatcaggtggaggaggacatcaagccgttccgcgacatcctgctgggcttcttcttcatcaccgtgggcatgcggctggagctgtcggtgctgttcaaccgcttcggcgaagtgctgatgctgctggcgctgctgctgccgctgaagctggcggtggtgttcggcctgggccgcttgttcggccaccgcgccaatgatgcgatgcgttcggcgctggcgctggcgcagggcggcgagttcggtttcgtgctgctggcgctggcgatggacctgcagctggtggccacgccgatggcccaggcggccatcgccgccatcctgatctccatgttgatcgcgcctttcttgatcatgcacggcgagcgcatcacccggcggctggtgaagcaggactggatgctgcagtcgctggatctgcaccagatgctggtggcgagcatgagcaagagcgagcacgtgctgatctgcggctacggccgcagcggccaggcgctggcgcggctgctggaggcggagagcatcaatatgttcgcgctggacatggatccggagcgggtgcgcgaggccggcgaggccggcgatccggtggtgtttggcgacgccggcaagaaagaggtgctgatcgccgccggcctgatgcgggcgcgggtggtggtggtgaccttcgccgacacccatgcggcgctgcgcattctgcacgcggtgcgagaggtgaggccggaattgccggtgatcgtccgcaccatagacgacagcgagatggatgtgctgcgccaggccggcgccgacgaggtggtggccgaggtgatggagggcagcctgatgctggcctcgcaggcgctgatggaggccggcgtgccgcccagccgcgtgctgcggcgcatccgcgcggtgcgcgaggagcgctacgatctgttccgcggctttttccgcggcagcagcgacgaggtggaaagcctggacgaggcgctggtgccgcgcttgctcagcatccaggtgtgcggcggcgccgccgccatcggccatccgctgggcgcgctgaagctggaggcgctgggagtggaggtgaaggccatccgccgccatcggcatccgctgggcgcgctgaagctggaggcgctgggagtggaggtgaaggccatccgccgccatcgggtgcgccgcaccgacttcgacgccagcttcgagatcggcgccgacgatgtgctggtgctgctgggcacgccggagcaactggcgctggcggagtcgaggattctgcagggcgattga

SEQ ID NO: 3444 - DNA, 981 bp, Chromobacterium substugae
atggaaaaaacacactccaccagccgcctggagatggcgcgcgaggttctgcaaaccgaagccgccgcgctcgtcaccctggccgaacgcctgaacggcgatttcctggccgcggtcgacgccatcctggcctgcccgggccgcgtcatcgtcaccggcatgggcaagtccggccatgtgggccgcaagatcgccgccacgctggccagcaccggcacgccggccttcttcgtccatccggccgaggccgcgcacggcgatctgggcatgatcaccggcgacgacatcgtgatcgcgctgtcgaactccggcgaatccggcgaagtggtgtcgctgctgccggcgctgaagctgaaaggcagccggctgatcgccatcaccggccgatcggagtcgtcgctgtcccaggccgccgacatcctgctgcacacccatgtcgagcgcgaggcctgcccgctgaacctggcgccgaccaccagcaccacggtacagatcgccttgggcgacgcgctggccgtcacgctgatggaggtccgcggcttcagccaaagcgacttcgccttgtcccaccccggcggcagcctgggccggcgcctgctggtgcacgtcgccgacctgatgcacagcggcgacgccctgccccgcgtggcgcccggcacgctgctgaaggacgcgctgctggaaatgtcgcagaagcggctggggatggtcaccgtctgcgacgccgacgacaccctgcgcggcatctacaccgacggcgacctgcgccgcacgctggagcgctcggccgacgtctacagcctgaagatagacgaggtgatgggccgctcgccgcgcaccatccaggccggcaagctggccgccgaggccggcttcgtgatgaagcagaaccagatcaccagcctggtggtggtggacgccgcaggcaagctcagcggggtgctgcacatgcacgacctgctgcaggccggcgtattttga

SEQ ID NO: 3445 - DNA, 519 bp, Chromobacterium substugae
atgatttccgagcaggcccgcaaggtgaaactgctgatcatggatgtggacggcgtgatgaccgacggccgcatctactacaacgcccagggcgaagagagcaaatcgttctacgtgcaggacggcctggggctgcgcctgctgcagagcaccggcgtgcagctggccatcatttccggccgcgccgaccgctgcgtcgagcaccgcgcccgcgcactgaagatcgaccactactacggcggcgtccacgacaagggcgaagcgctggccgacctcttgcaaaaaaccggctttagcgccgacgagtgcgcgttcatcggcgacgatctgatcgacctgcccatcctcacccgcgtcggcctggccgtcgccgtgccggaagcgccgccgcaagtgcgccagcactgccattacgtgaccggcaacccgggcggccacggcgcggtgcgcgaactggcggaattgatcatgcaggcgcagggcagtttcgacgccgtggtcgccaggtacttggcatga

SEQ ID NO: 3446 - DNA, 570 bp, Chromobacterium substugae
atgatgcggctattgcgctcccaccggctgttccccgtgctgctgatcggcctcaccgccatgctcaccctgtggctggaccagatttcgcgctgggacacccgccaccgcgagctggacccggacaagcccgaatacgtggcggaaaacctggtcgccacccatttcgacctgcaaggcaagatcgccgaccggctgatcgccacccgcatgtggcagtatccgagcaaaccggacgcctatttcgaaaaccccgacctgtaccaataccagcaaggggcgctgcaataccacgtcttcggcgagtccggccgctacaacaacaagaaccagcaggctttcttcgacaagaaagtcaccctgatcaaacccgcagacagcaagcagcccgaaacccggctggaaagcagcgtgatgctggtggactccgccaagcacatcgccagcaccaaggcgccgtcggtggtctaccatggcaagtcggtggcccactccatcggcttcgtctaccagcaaccgctgggcctgctcaacctgctgtccaccaccaagatcatctatgccaaataa

SEQ ID NO: 3447 - DNA, 555 bp, Chromobacterium substugae
atgccaaataagacccgcatcctgctggccagcctgctgctggcggcttccgccctgacgcacgccgaacaggccgacagcaccaagcccatggaaatcaccagcgacaacggctgcaccatggaccagatcaaaggcgtatccacctgcgaaggcaatgtggtggtgatccagggcaccctgcggctgaacgccgacaaggtggtagccacccaggacaagcaaggcaaccagacgctgcaggccaccggccgcatcgtcaccttccgccagaagatggacaacaacggcggctgggtggagggccaggccagcaagctcgactacagcagcgccggccacttggccgtgctcaccggcaacgcccgcgtcaagcgcaacggcgatctcgccatcggcaacgtgatcagctacgacacccgcagcgaaacctatcaggtgcagggcggcggcgccggcaatgccggcaagggccgcaccaccgtgatcctgcagcccaagaacgcagcctcgcagcccgcggcggccaagccggccggagccgccaaaccatga

SEQ ID NO: 3448 - DNA, 735 bp, Chromobacterium substugae
atgaacatgaagcacagcgtactcaccatctcccgcctgaagaagcgcttcaagaagcgcactgtggtcaaggatgtgtccctgcagatcgaaagcggcgaagtcgtcggcctgctcggccccaacggcgccggcaaaaccaccagtttttacatgatcgtcggcctggtcggcgccgacgacggcgacatcaggctggacgacgcttccatcacccgctacccgatccaccagcgcgcgcagctgggcctcggctatctgccgcaggaagcatcgatcttccgccgcatgacggtggaggaaaacatcgcgtccatcctggagatctccggccgcaagggcaaggagctggaaaaagagctggacctgctgctggacgatctcaacatcgcccacctgcgcgacagcaacgccttgtcgctgtccggcggcgagcggcgccgggtggaaatcgcccgcgtgctggccacccgcccgcgcttcatcctgctggacgagccgttcgccggcgtcgatccgatcgcggtgatcgacatccagaagatcatctccttcctgaagggccgcggcatcggcgtgctgatcaccgaccacaatgtccgcgaaacgctgcgcatctgcgaccgcgcctacatcatcagcgacggctcggtgctggcctccggcgagccggaagagctggtcaacaacgaaagagtgcgcgaggtctacctcggcgagcatttccacctgtaa

SEQ ID NO: 3449 - DNA, 1404 bp, Chromobacterium substugae
atgaaacaggcccttcagctcaaggtatcgcaacagctgacgctgacgccgcagctgcagcaatcgatcaaactgctgcagctgtccacgctggatctgcaaaccgaggtggaacgcttcctgctggacaatccgctgctggagcgcggcgacgagccgcgcgacgccgaagccgcgcccgaaggccaggactgccgcgaaaccgccgccgacgaggcgccggacagccatgacgacggcgccggcggcgaactgctggaatggggcgccggcagccgccagggcggcgacgacgactacgaccccatgctcaacgtgccgtgccaggtcagcctgcgcgagcacctgctggcgcaactgggcgaaatcgcgctggccggccgcgatctggccatcgtccggctgctgatcgaagagctggacgacgacggctacctgccgctcagcctggacgaactggccagccacctgccgctggagctggagctggaaagcgacgagctggcggtgggcctcaagctgctgcagcaattcgatcccgccggcgtcggcgcgcgctcgctggccgaatcgctgctgctgcaactgcagcggctggccgcggacgagcccggccgggcgctggcgctggccatcgcgcgcgagcacctggcgctgctgggcggccgcgactacgccaagctgaagaaagcgctgggctgcggcgacgccgagctgcgcgccgcccaggcgctgatcgcccgcctcaacccccaccccgccaccggcttcagccacggcgacgtccattacgtgattccggacatcagcgtgcgcaagcggcgcggccgctgggtggccgaactgaaccgctccgccatgcccaggctgcgggtcaaccgcctctacgagcgcatgctggccgacagccgcggccaggcgggcgaaatggccggccgcctgcaggaggcccgctggctggtgaagaacatccagcagcgatttgacaccatcctgaaagtggcggaagctatcgttgacaggcaacaatcgttctttgaacacggcgaagtggcgatgcggccgctgatcctgcgcgacatcgcggatgagctgggcctgcacgaatccacggtttcccgctccaccagccagaaatacctgctctgcccgcgcggcctgttcgagctcaagtatttcttcggcagcgcgctggaaaccgatagtggaggcgagtgctccgccaccgccatcaaggctcgcatacgcggcatgatagacagcgaggacagcggcaagccgctgtcggacagcgccatcgccgatgcgttaggcaagcagggaattcaggttgccagacgcaccgtagccaagtatcgtgaagccatgcagattccggcggtgaatctgcgcaaggctctgtag

SEQ ID NO: 3450 - DNA, 327 bp, Chromobacterium substugae
atgaacctcaaagtaaccggtctgcacctggaagttaccccgtcgctgcgcgaatacatcgaaagcaaactggagcgcatcacccgccacgtcgaccacgtgatcgacatctccgtcaccctgtcggtagacaagctggtccagaaggccgaagtcaacgtccacctgtccggcaaggacctccacctcgaagcctccgaggccgacctctacgccgccatcgacctgctgatggacaagctggaccgccaggttctgaagtacaaggaaaagctcaccgaacaccgggcgcagagctccggcgaagtttctcaagcctcgctgtga

SEQ ID NO: 3451 - DNA, 462 bp, Chromobacterium substugae
atgaatctcatcggcaagatcctgactccggaccatgtattgctggatctggacgtctccagcaagaagcgggtattcgaacaggtgggcctgctggtggaaaacacccgcggcatcgcccgcagcgaaatcttcgacagcttgttcagccgcgaaaaactgggctccaccggcctgggtcaaggcgtggccattccccacggccgcgcccgcggcctgaaggaggccaccggcgtgttcatccggctgaaggcgcccattcccttcgacgcgccggacggcaagccggtgcaatgcctgttcgtgctgctggtgccggaacacgccaccgatctgcacttgcaggtgctctccgaattggcccaattgttctccagccgccagatgcgcgaacagatgctgagcatcaagatgcgcgatgaactttaccagctcctcagcgagtgggccccccatgcctag

SEQ ID NO: 3452 - DNA, 957 bp, Chromobacterium substugae
atgcctagcatcaccgtacgcaggctgtatcaggaaaaccagcagaagctcaacctgacctgggtcgccggcaccggcggctcggacaatgtcatcggcaacgacgaccagcggcctacgctggcgctggttggccacctgaacttcatccacccgaaccgggtgcaggtgctgggcctggccgaggtcgactacctgaacaagctggagcagtcggccgccaagaccgcgctggaccagctgttccacaagagcatgtcggtggtgatggtggccaacaaccagccggtgccgcggctgctgcgcgactactgccacagccacaacgtgccgctgatgtgcagctcgctggaaagcccgtacctgatggacgtgctgcgcatttatctggcgcgcgcgctggcggtgtccaccgtgctgcacggcgtgtttctcgacgtgttcgagatcggcgtgctgatcatgggcgattcggcgatgggcaagagcgaactggcgctggagctgatctcccgcggccacggcatggtggccgacgacgcggtggagctgtaccgcatcggcccggacacgctggaaggccgctgcccgccgctgctgcgcgacttcctcgaagtgcgcggcctcggcatcctcaatatccgcaccatcttcggcgaaaccgcggtgcggccgaaaaaagtgctgaagctgatcatccacctggtcaaggccaacgaccaggcgatgcaggcgctggaccggctcaacatccagtcggaaacccaggacatcatcggcgtcaccgtgcgcaaagtggtgctgccggtggccgccggccgcaacctggcggtgctggtggaagcggctgtgcgcaattacatcctgcagttgcgcggcatagacagcacccgcgaattcatcgaacgccacaccaacttcttgcgagaccaggaaaatgcgcctgatattgattag

SEQ ID NO: 3453 - DNA, 831 bp, Chromobacterium substugae
ttgattagcggcctgtccggctccggcaagtcggtggcgctgcgcgcgctggaggattccggcttctactgcgtcgacaacctgccggccaccatgctgcccgaggcgatgtcgctgtacgccgatttcggctacgaacaaatcgccatcagcgtcgacacccgttccggcccgtcgctgggcgcgctgcccgacgcggtcgcgcggatgcgcgcgcagaacatcgacgtgcgcctgctgttcctcgaagcccggacggaaaccctggtcaagcgcttctccgagacccgccgccgccacccgctgtccggcgccggcatcacggtggaggaaagcatacggctggagcaggaaatgctggccgaagtgcccgagctcggcacccgcatcgacaccagcgaactgtcggccaacgcgctgcgcagctgggtccgcgaactggtggacgccgacggcagccggctgatgctgatcttcgagtcgttcggcttcaagcacggcctgccgcaggacgccgacttcgtgttcgacgcgcgctgcctgcccaacccctattacgacccgcagctgcgcccgttcaccggccgcgaccaacccatcatcgacttcttcgccaaacacggcgaagtcgccgaaatgatcgccgacatcgaagcgatggtggccaaatggctgccctgctacggcaaggaaaaccgcagctacctgacggtggcggtcggctgcaccggcggccagcaccgctcggtctacatcatcgaaaacctggcgcgcgccttcgccgacaggcaagtgctggtgcgccaccgccagctgtaccgcgaaccctga

SEQ ID NO: 3454 - DNA, 618 bp, Chromobacterium substugae
atgtcccgtcccaaaaccatcaccgtcgccctcaccggcgcctccggcctgccctacggcctgcgcctgatcgaaaccctgctcgccgccggcatccgcacctgggtgctgtactcgcaggccgcccaggtggtggccaagcaggaaatgcagatcaccctgccctcgcgcccggccgaaatgaaggcctggctgctgcagcgccatgcggccgaccccaccctgctcgacgtgtacggccgcgaggaatggttcgcgccggcggcgtccggctccaacccgccggacgcgatggtggtgtgcccgtgctcgatgggcacgctggccgccatccgccacggcatgagcgacaatctgatcgaacgcgccgccgacgtctgcatcaaggagcagcgcaagctggtgctggtgccgcgcgagacgccgctgtcggtgatccacctggaaaacatgctggagctggcccggatgggcgcggtgatcctgccgccggcgccgggcttctatacgcacccccagagcgtggacgacatggtggacttcgtcgtcgcccgcatcctggatcaactgggcgtggcgcacgaactgacgccgcgctggggagaagccgcgccatga

SEQ ID NO: 3455 - DNA, 1467 bp, Chromobacterium substugae
atgacctcgcagcccatcctgagcctggacgcgctgcgccggctggagcgcgccgccaacgccgccggcctgcagctgatgcggcgcgcggcgctggccgccgccgactggatgggccgccatgccgcgcccggctcgcggctgctggtctgcgccggccccggcaacaacggcggcgacgcgctgtacgcggcgctggaactgcgtcgccgcggctatctgatagacatcctgctgcccgtcgcgccaaccggcgccgacagcctggccgcgctgcgcgcggtacgggcggcgggcgtggcgctgctgtcggagttgccgggcggctacccgccgccggcatggctgatcgacgggctgttcggcatcggcctcagccggccgctggatgaggactggggccggcgcatggagcggctcaacgcgctgggctgccccacgctcgcgctggactgccccagcggcctggacgcctacaccggtcgggcggccggccccgccatccgcgccgaccatacgctgactttcctgtgccacaagccaggcctgttctgcggcgacggcgccgacctggccggcgtggtggagctggctgagctggactgcccgcggcagctgttccccgccgcggaaggcgcgctcaacgcccctagcgccgccggcctcgcgcgccggcgcgacagccacaagggcagcttcggctcggtggcggtgataggcggcgcgcccggcatgctaggcgccgcgctgctggccggccgcagcgcgctgcaaggcggcgccggcaaggtctatctgtgcccgctggacgacaggctgccggtggacccggtcgcgccggaactgatgatgcgcccgctggacgaaacgcccgagctgccggccgccgacgtgatcgccttcggcccgggcctaggccagcaggaactggccggcaaactgctgcggcaggtcgcggcgctgccgcagccgctggtgctggacgccgacgcgctcaacctgctcgccggcgatgcggatgccgccgaacgcctccgccgccgcgcatcccccgccgtgctgacgccgcatcctgccgaagccgcccgcctgctgcagaccgacaccgccgcggtgcagcgcgaccgcgtcggccatgccagggcgctggccgcgcgctaccgctgcgtggcggtgctcaagggcgccggcagcctgatcgcccgccccgacggccattaccagctcaacgccagcggcgggccggaactggccgccgccggacaaggcgatgtgctgaccggcctgatcgccgcgctgctggcccagggcctgccgcccttcgaggccgccgcgctggccgttcacgcgcacggcctcgccggcgacggctaccgccgggaaaacggcggcccgatcggcctgaccgcctccgccacccccgcccggatcagccaggcgctgaaccgcatgctggccggcggctaa

SEQ ID NO: 3456 - DNA, 915 bp, Chromobacterium substugae
ttgtcgtcacagaaaaaagcctacgccttcggcctcgccgccgtcctggcctggtccaccgtcgccagcgccttcaagctcagcctgcaacacctcagcccgatgcagctggtgctgtacgccagcggcgcttcgctgctgtcgctgctgtccatcctcgcctggcaaggccggctgccggagctggccgcgacgctgcgccgccactggaaaagttcgctgctgttcggcgcgatcaaccctttcgcctactatctggtgctgttccaggcctattcgctgctgccggcgcaggaggcccaggccatcaactacacctgggcgctgaccatgacgctgctggcggtgccgctgctcaagcagaagctccacccgctggacgccatcgccgcgctgatctgctacctgggcgtgctggtcatcggcacccgcggccagttgctggcgctgcatttttccaatcaattgggggtggcgctggcgctggcctcgacgctgctgtgggccggctactggatcttcaacacccgcgacagccgcgagccggtgctgggcctggcgctcaacttcgccttcagcctgccgctgagcctggcctggtgcgcctggcatggccaactggcgccgccctcctggcaggggctggccggcgcggcctacgtcggcgcgctggagatgggcttcaccttcgtgctgtggctgtcggcgatgaagctgacccgcagcaccgccagcatcgccaatctgattttcctgtcgccgctgctgtcgctgctgctgatccacctgatattgggcgaagccatcctcgcctccaccctgctgggcctggccttgatcctgggcggcctggccgtgcagaagctgcccttgcggcgcgccccgccgctgccggtggccgacggtcccggctga

SEQ ID NO: 3457 - DNA, 1548 bp, Chromobacterium substugae
atgaaaagcatcaagacaaggttaatgttatggctgatggcgtggatcaccaccattctgggcagcacgggtctgtatttctatcttcatgactacagcatagaccagagcgacttccagactcagcgcgccgcggtgcaatcccgtttgtccttgtcgctgccgcacggcatctggcagctggacgacgagaacgtgcgcttggcgctggacagcgaattgagctggccttcggtgatcgccatcaacgtcaagggcgaaagcggcctcaacctgggccggacccgcgacagcggcggcagcctgcgcgacatgctgcccaacgagcggcccaaggtggacgacatgctcagcatccccatcgtttaccagggcaaggagcatctgggcaccgccaccgtctacctgtcgcacgacgcgctgcgcgcgcgggaagaccagcacctgatcaccatcatcgcccagatcgtgctgctggacggcatgatcttcttcatcatgtcgttcaatctgcagcgcttcatcttccagccgctgtcgcggctgcagcaggcgctgaacaccgccatccgcgcgccggacgccaccggcgcgcagatcacccacctggccgacgacgagatcggcgccatcgtcaacggcttcaaccgcatcgtcgctcgcaccgccgccgacctggtcaagcgcaccgccgccgaagccgtggcgcgcgaggaaaaggaaaaggcgcagctggcctacagccaattgatggcgacgcaggaaacgttggtggaggcggaaaagatggcgtcgctgggcagcctggtggccggcgtcgcccacgaaatcaacaccccggtcggcatcacgctgaccgccgcctcgcacctgggcaccgccacctcgcacatcaccggcaagctcgacagcggcaacgtcaagaagagcgatttccagagctacctggaaaccgcgcaggaatgctgcgagctgatactggccaattccgaacgcgccgccaacctgatccacagcttcaagcaggtggcggtggaccagaccagcgaggccaggcgcagcttccatctgcacgactacctgaacgaggtgatcaccagcctgaagccgcgcttcaagcacaccaaggtgggaatagacatccagtgcgaagaggacatcctgctcgacagctatcccggcgcgctggcccaggtgctgaccaatctggtggtcaacgcgctggtgcacggctatgaaggcggggagattgctggcaatatcgtcatcgaggcccatcgcaacgacgcccagcacgtgtcgctgaacatcagcgacagcggcaagggcatcgcgccggaaaacctgagccggattttcgagcccttcttcaccacccggcgcggcagcggcggcagcggcctcggcctcaacatcgtctacaacatcgtaaggcaaaggctgggcgggaatatcgaggtacacagcgagccgggacaaggcacccgattcacgctggaaatgccctgcatcgcccccaccgtccagcacaaggagaatgtggcatga

SEQ ID NO: 3458 - DNA, 1596 bp, Chromobacterium substugae
atgagcaccgagacattgcctcccgatgacgacaactggctgctggacgacaatgacaacgaagacaatgtccgcccttccgagatgcgcaagccgtggaaggtgctgatcgtcgacgatgaaaaagacgtgcacaccgccacccgcatcgcgctgcgcggcatcagctacaaggaaaggccgctggaactgatcagcgcctacagcggcgtcgaggccttccagcaactgcagcagcatccggacatcgcgctgatcatgctggacgtggtgatggagagcgaggatgccggcctcaagctggtgcatcgcatccgcggcgacctgggcaacggcgtggtgcgcatcgttctgcgcaccggccagcccggccaggccccggagcaggaagtcatcctcaattacgacatcaacgactacaagaccaagaccgagctcaccacccagaagctgttcaccaccaccatcgcctcgctgcgcgcctacgagaacatggtgtcgctggagaaaaaccgccagggtctggccaagatactggaaagcgcgtccgacctgtaccagttgcactcgctgcgcgaattcgcctccggcgtgctgcgccagatcagcgcgctgctggacatcggcaccgacggcatcctgtgcgtgcgcaatgagaaccacagcggccggccagagctggaaatactggcggtgtcgggctcctacgaatacctggccgaagccggcgacctctccagcgagcccaagctggccgaggtgatccagcgcgtgttccacgaaaagcgcagcatcttccagcatccttacgacgtgctgtacatctcctcgcgcaaccgccgcgaattcgcggtgcacttcatgccgcaatggccgctggaaagcgtggaatgcgatctgctggacgtgttctgccagcgcatctccgccgcctacgacaatctctacctgtacaaccagctgcgcagcgcccaggaagccaccgtggtggcgctggccgacctggcggaattccgcgacaccgacaccggcgaccacgtgctcagggtgcagaagctgaccgacgccatcgcccaggagatgctggagcacaaccactatccggagctgatgacgcgcgagttcatggacatggtgggcatggccagcatcctgcacgacatcggcaaggtggccatccccgaccacatcctgctcaagcccggcaagctggacccggaagagcgcgcggtgatggagcagcacgccaccataggcgcgcagatcctcgacaagtcggccagaatggtggaaggcaccagctatctgtcgctgggttcggaaatcgccggcggccaccacgaacacttcgacggcaagggctacccgcgccagatcgccggccaggacattccgctgtcggcccgcatcgtcgccgtgatcgacgtgttcgacgcgctgctcaacaagcgcccgtacaaggagccatggagcatggaagacacgatgaagtacatcggcagccgctccggcagccagttcgacccgctggtggtggaggcgctgacgcggctggtgaacgagaaccgcctgccggtggcgccgcagcaggaataa

SEQ ID NO: 3459 - DNA, 618 bp, Chromobacterium substugae
atgtatcacggggaacgtttcaacggctattcccacctggccggcactttgctggcggtagccggattggtggtgctggtggtggaggcggcgatgcagggcgacccctggaagatcgtcagcttcagcctgtacggcggcacgctggtggcgctgtatctgatctccacgctgtaccacagcttcaccggcaaggcgaaagccattttgcagaagtgcgaccattcggcgatctatctgctgatcgccggcagctacacgccattcgcgctggtgacgctgcgcggcgcctggggctggacgctgttcggcctgagctggggcctggcgctgttcggcatcgtccaggagctgacgctggggcggcgcacgcgcctgctgtcgatgattctgtacgtggtgatgggctggctggtgctgattgccatcaagccgctgatcgacgcgctggcgccgggcggcctgttctggctggggctgggcggcctgctgtacagcgtcggtatctactggtttctcaatgacgagaaaatccgccatggccacggcatctggcacttgttcgtgctgggcggcagcatctgccaatatgtctgcgtgctgaactacgtcgcctga

SEQ ID NO: 3460 - DNA, 657 bp, Chromobacterium substugae
atgcgattgatcctgttgggcgctccgggcgccggcaaaggcacccaggccaattacatccgcgagaaattcggcattccgcaaatctccaccggcgacatgctgcgcgccgcggtgaaggccggcacgccgctgggcctggaagccaaggcgatcatggatgccggcggcctggtgcgcgacgacatcatcatcggtctggtcaaggagcgcatcgcccaggccgactgtgccaacggcttcctgtttgacggtttcccgcgcaccattcctcaggccgaggcgatgatcgccgccggcgtggacatcgactacgtggtggaaatcgacgtgccggacgccgccatcgtcgagcgcatggccggccgccgcgtgcacctggcttcgggccgcacctatcacatcgccttcaatccgccgaaagtggccggcaaggacgatgcgaccggcgaagagctggttcagcgcgatgacgaccgggaagacaccgtgaagaagcgcctggccgtatatcatgagcaaaccgccgtgctggtgggcttctacggcaagctggccgccgccggcgacgccaaggcgccgaagtacgtgaagatcgacggcacccgcgcggtggaaaccgtgcgcgacgaggtgctggcctcgctgggcgcctga

SEQ ID NO: 3461 - DNA, 759 bp, Chromobacterium substugae
atgagcggcttcaccgtggtgatcccggcgcggatggcttccagccgcctgccgggcaagccgctggccgacatcgccggcaagccgatggtggtgcgggtggccgagcaggcggcgaagagccgcgccggccgcgtcatcgtcgccaccgaccacgccgacattctggccgcctgcgccgcgcatggcatcgaggcggcgctgacgcgcgccgaccacgccagcggcaccgaccgcctggccgaggtggccgcccagctgggcctggccgacgacgcggtggtggtcaatgtccagggcgacgagccgctgatccagcccgagctgatcgatcagctggccgagttgatgctggcaggcgatgcgccgatggcgacgctggcgcacgccatccacgacgccgccgaccatttcaatcccaatgtggtgaaagtggcgctggacaaacatggccgcgcgctctatttcagccgcgcgccgattccctacgcccgcgacgcctacgccgccggtcgcgacagcctgccggccgggctgccggtataccgccatatcggcatgtacggctaccgcgccggcttcctcgccgcctatgccggcctggaggcggcgccgctggagcaatacgaagcgctggaacaattgcgcgtgctctggcatggttatgccatcatggtggcggtggcggacgaggcgcctgccgccggggtggacacgccggaagacctggaacgggtgcgccggctgctggacgcctga

SEQ ID NO: 3462 - DNA, 183 bp, Chromobacterium substugae
atggacgctaaatttctggaaatcctggtgtgcccgttgtgcaagggcccgttgctgttcgacaagagcaaggacgaactggtctgcaagggcgaccgtctggccttcccgatcaaggacggcatcccgatgatgctggaagcggaagcgcgcgagctggcgcccgaagaagaagtcaaatga

SEQ ID NO: 3463 - DNA, 1020 bp, Chromobacterium substugae
atgagtttgatagaacgacactggtaccggccgctaggctggctgactgcccttctggcgccgctggaagggctttttgcgctgctggccgccggccggcggctggctttccgccgcggctggaaaagcagcgaaacactgccggttccggtggtggtgataggcaacatcaatgtgggcggcgtcggcaagacgccgctgacgctggcgctgctggcggatttcgccgcgcgcggcgtcaaggcgggcgtgatcagccgcggctacggcggcagcgccgccgggccgacggaggcgctgcagggcggcgacccggcgcgggtcggcgacgaacccttgttgctggccgcttccggcgcgccggtggtggtggggcgcgaccgggtggccgccggccgccgcctgctggagcggcaccccgatgtgcaactgatattgagcgacgacggcctgcagcattatcggctggcgcgcgatctggaaatcgcggtgctggatggccggcgcggcgtcggcaacggccgcctgctgcccaacgggccgctgcgcgagccattgtcgcggctgcggacggtggacgcggcggtggtgaacggctccggcgctgatctggcgttgccgcccggcctcgcgcgcttcgacatgacgctgcgcgccggcgcctgccacgcgctgggcgacgcggcgcggctgcggcaggccgacggcttcgccggcttgaaggtggtggcgctggccggcatcggccatcccgagcgctttttcgatacgctggcggggttgggcatcgcggtggagcgccggctgtcttttcccgatcatcacgcgttttgcgccgccgacatcccggccgacgccgacgcggtgatcgtcaccagcaaggacgcggtcaagctcgagcgcgtgcttcatgatgcggcgcagcgtgctagactatgggttttgccggttcaggccacgctggcgcctgggctgtgcgactggatactcgcccgcttgaagatggaacatggacgctaa

SEQ ID NO: 3464 - DNA, 417 bp, Chromobacterium substugae
atgaactttcgtcgcggccgcggccgggaagagccggagatcaacttcatcccgttgatagacgtgctgctggtgatcctgattttcctgatggtcaccaccacctattcgcgcttctccgaactcaagatcaatctgccgagcgcgcagggcgagcagctgaagaacaagaccgtcgagatccgcgtcgcggtggccgccgacggcgcgatggcggtcaacgacgcccgcatcgccgccgcggacaagtccggcctgctggccaggctgaaggccgccgccgccggcaagagcgacgtggtggtggtggtcaacgccgacgcccgctccactcaccagtcggtgatcacggtgatggaggcggcccgcgaggccggcctgtcgcagctgactttcgccacccaaaatttgaagtga

SEQ ID NO: 3465 - DNA, 615 bp, Chromobacterium substugae
gtgtgggctatcgttgaagcggccggctggccgatctggaccattctggcggcttccgtcgtgtcgctggccatcattctggagcgtttgtacagcttgcgccgcggcgtggtggtgccggaaggcctgctggcgcagaccctgcaggaatatcgccgggtggacctgcgcgacgagctgatgcaccgcctggcgcggcattctccgctgggccgactgttcgcggccggactgcgcaatgtcagcggcagccgcgaggtgatgaaggagtcgatcgaggacgagggccgccaggtggcctaccagctggagcgcctgttgaccacgctgggcaccatcgccgcgatggcgcccttgctgggcctgctgggcaccgtgatcggcatgatcgagatcttcggctcgcaaaacggcagcggcgccaatccgcagcaactggcgcacggcatctccgtcgcgctctacaacaccgctttcggcctgatcgtggccattcccagcatgatgttctaccgcttcttccgctcccgcgtcgacggcctgctggtcgagatggaggcgcaggcgatcaagctggtggaagtggtgcacggcgagcgccggaacgggagctga

SEQ ID NO: 3466 - DNA, 474 bp, Chromobacterium substugae
atgaacctgcctatctggctgatcaagctgctgctcaatctgtggccgcccttcctcggcgccggcatccgcgtccaccgcctgtctgccgacttccgccaggccgaagtcaggctgaaactgggcgtaggcaaccgcaactacgtcggcacccatttcggcggcagcctgtacgcgatgaccgatccgttctacatgctgatgctgctgcgccagctgggcggcgactactacgtctgggacaaggaaggccgcatcgaatacatcaagccgggccgcggcctggtgcgcgcccgcttcgaactgagcgacgccttgctgagagacatccgcgagcaaaccgccgatggcggcaaatacctgcccgaaatgaaggtggagatacgcgacggcgacgacgaactggtggccaccgtgcacaagacgctgtacatcaaacgcaaacccgaacgccgccaggcgaagcccatatag

SEQ ID NO: 3467 - DNA, 297 bp, Chromobacterium substugae
ttgctgttcaacgacgaccagatcgaacagacatcgcgggcgatgaaggccatgtcgcacccgctgcgtctgaagatcatatcggtgctggaagaccgggaagtgagcgtgcaagacattgtcgagcaggttggcacctcccagagcaatatttcccagcatctcgccattatgcgggacaagggagttttgcgcacgcgcaaggatgccaaccgcgtctactaccgggtgggggatatccgcacgctggaagtcctgcggatgatgcgtgaggtcttctgcggcttcggggagtaa

SEQ ID NO: 3468 - DNA, 1524 bp, Chromobacterium substugae
atgaaatcaatcacaccggtgttgctattaatcctcgacggcttcggccaccgcacggaaggcgacgacaacgccatcctgcacgccaacatgccaacctggaaccgactgcgccagcgctacgcctacggcacgatcaacgcctcggaaaactttgtcgggctgccttccggccagttcggcaactccgaggtgggccacctgaacatcggcgccggccgcatcgtgcagcaggacatcagccgcatcgattgcgacatcgaggacgggcatttcgcaaacaatgacacactgcagcaagccatgagcaaagctcaaggctcggcgctgcacatcctgggcctgttatccgatgggggtgtgcacagccatgaaaaccacatccacgcgctgatccgcgccgcccaggccgccggcgtggcgaaaatatacgtccacgccttcctcgacggccgcgacaccccgccgcgcagcgccgaaaccttcctcaagcgcctggacgcggtactggccgaatgcccgaacgcgcgcctggtttccgtgaccggccgctactgggcgatggaccgcgacaagcgctgggagcgcgtcgagccggcctaccggctgctggtggagggcgaaggcctgttccacgccgaaaccggcctggaagcgctggccgccgcctacgagcgcgacgagaacgacgaattcgtcaaggccaccggcatcggcgcgccggtgaagatgcaggacggcgacgcgctgatcttcatgaatttccgcgccgaccgcgcccgccagctgaccaccgcgctgaccgacccggctttcgacggcttccaggcccgccagcccaagttcggctgctacgccaccctcaccagctacggcgaagcctattccgcgctgcccaccgcctacgcgccgcagaagatccacaacggcatgggcgaatacctgtcgtcgcaaggcctgaagcagctacgcatcgccgaaaccgagaaatacccgcacgtcacctatttcttcaatggcggcgaagagcaggtctaccccggcgaagaccgcatcctggtgccgtcgcccaaggtggccacttacgatctgcagccggaaatgagcgccggagaagtcaccgacaaaatcgtcgccgcgatccagtccggccaataccaggccatcttctgcaactacgccaatggcgacatggtcggccacagcggcatcttcgacgccgcggtgaaggcggtggaagcgctggacggctgcatcgaacgctgcgtcgacgcgatgctggccgccggcggcgaggtgttgatcaccgccgaccacggcaactgcgagcagatgtacgatggcgcgcaccaccagccgcacacccagcacaccaccaaccaggtgcccttcctgtatatcggccgcccggcgaccatccgcggcggcggctcgctgcgcgacatctcgccgtcgctgctggcgatgatgggcctggaacaaccggccgagatgaccggtcaatcgctgatcgacttccaataa

SEQ ID NO: 3469 - DNA, 1341 bp, Chromobacterium substugae
atgaaaccttacctgttgctggccctgctggccggcgccgcccaggcggccaacaccaacgcctcctccaccagcctgtccgccgccccgcaccagcaggacctgaaaaacgtgcgcaaggaaatcgacagcctgaaaaaagacctggcgcagaaacagacggtgcagaaggaagcgcagtcggcgatcaaggagtcggaacaggcgatcagccagacccggcaaacgctggccacgctggaacaaaagcagaatcgctccgcgcagcagctggccgacctgaacgcgcagatcgagaaaagccgcaagagcctggccgacgtgcgccagcgcgtcggccagatgctggtgcgccaatacaagaacggccagcacgacgcgatgaagctgatgttcaacgacagcgaccccaaccagagctcgcgcgacctcgcctactaccagcacatcgcccgcgccgaccagcaactggcgcagcaactggtggcccaacagcaacagctgcaggcgctgtccgcccagctggaggaagagctggcgcggctgaacagcctgtccagccgcaaaagccaggaaaagagcgagctggagaaagacaaaagccagcagcagcagcaactgaacaaggtgtccggcgagatcaagcagggccagagcaagctgacccagctgcaggaggacgagaagcacctgtccaacctgatcgcccagatcaaccgcgaaatccagcgccgccgcgccgaagcggcgcgcaaggcggccgaagcccgcaaggccaagctcgccgccgcccgcgaagccgcgcgcaaggaaaacgaacgccgccgccaactggccgcgcaagccaagaaacagggcaagccggtgccggaagaggcgaagaagccggtgatcgtcaaggaagagccggcggagaaagtggacgacgtcgccgacggcagcgcctcgggccgcgccttcgccagcttgcagggcaagatgaagctgccggtggccggccagatcgccggcgccttcggcaagatgcgccgcgaaggcaccacctggaaaggcatttttattcgcaccgccggcggccagccagtacacagcgtggccgacggcacggtagtatatgccgatgagttgcgcggattcggcaaggcggtgatcatcgaccacggcggcaattacatgaccgtctacaccggcctgtccgccatcgccaaatcgtccggcgccggcgtcaaagctggtgaaacactcggcaacactggaacactggacaatggggaagccggactgtactttgaaatccggcacctcggacgccccctcaacccgcaggcctggacacgctaa

SEQ ID NO: 3470 - DNA, 1308 bp, Chromobacterium substugae
atgctcacccgcgagtttgttctcaccttccgcgaagccgcgccctacatcaattcctaccgcggcaagaccttcgtgctggccatgggcggcgagagcctgcttgacggcgatttctccagcatggcccaggacatcaatctcttggtcagcctcggcgtgcgcatcgtgctggtgcacggcatccgcccgcagatcgaggcgctgttgaaacgccacggcatcgcgcggatgttccaccgcgaccgccgcgtcaccgacgccggcaccatggacgtggtcaagcaggccgccggcgccacccgccacgacgtggaggccaggctgtcgatgggcatgccgcattcgccgatgcacggcgcccacctgcgggtggccggcggcaacttcgtcaccgcccagcccctgggcgtgctggacggcgtggacatgcagtacaccggccaggtgcgccgcgtcgacgccgccgccatccgccagcggctggacgccggcgagctggtgctgctgaccccggtgggctactcgctgaccggcgaaagcttcaacctggcgatggaagagctggccacccacgccgccattgcgctgaaggcggaaaagctgattttcgtggtggaggggcgcggcgcggtggagcaggacggccagctgatcagctcgctcaccgcgctgcaggccgaacaattgctggaagcgggcagcctgccggaagacgtggccgcctacctgccctacgcgatccgcgccacccgcgaaggcattccgcgcgcccacttgatcagccgccacgaggacggcgcgctgctgctggagcacttcacccgcggcggcaacggcaccatgatcgcgcgcgacccgctggtgcgggtgcgcaacgccagcatcgacgacgtcggcgacatcctggccttgatccgcccgctggaagagcaaggcgtgctggtgcgccgcagccgcgagcggctggaggtggagataggcgagtactcggtgctggagcacgacggcaagatctacggctgcgtggcgatgcacccgttcccggaggcggaaaccgccgaactggcctgcctggcggtgtcgccggccaagcgcgacggcggcttcggcgaaatgctgctgcgccatgtcgaataccaggcccgcacccgcggcctgcagtcgctgttcgtgctcaccacccagacctcgcactggttcgtcgagcgcggcttcgccgaggccgacagaagctcgctgccgctggcgcgccagcagttctacaattaccagcgccgctccaaggtgtttgtaaagaagctgtaa

SEQ ID NO: 3471 - DNA, 273 bp, Chromobacterium substugae
atgagcagaaccgtcaattgcgtcaagctgggccgcgaagccgaaggcctcgacttcccgccgctgccgggcgagctgggcaagcgcgtgtacgaaagcgtttccaaggaagcctggcaaggctggctgcgctaccagaccatgctgatcaacgaaaaccgcctcagcctggccgacgcccgcgcgcgccagtacctggccgcgcagctggacgcttatttcttcggccagggcgccgacgccccggcaggctacaccccgccgcagaactaa

SEQ ID NO: 3472 - DNA, 2076 bp, Chromobacterium substugae
atgtcacaaccgcaagacttgctgctgaatcgcgaactgggactgatagaattcaaccgccgcgtgctggcccaggccgaagacgccaacctgccgctgctggaacgcttgaaattcctctgcatcgtctcctccaacctggacgaattcttcgaagtgcgcgtagcctggctgcaggacgccgcccacgccacgccggagcgcatcctggccgacggcagcaccccggagcaggcgctggccaaggtggcgcgcgccagccatcaactggtgaaagaccaatacgcggtgatgagcgaggtgctgttcccggcgctgcgcgaacagggcatcgtcttcctgcgccgcggcgagtggacgcagcagcaaaaggactgggtggaggcctttttcttccgcgagctgatgcccatcctgacgccgataggcctggacccgtcccaccccttccccaaggtgctgaacaagtcgctgaacttcacggtggagctggaaggccgcgacgccttcggccgcgcctccggcaccgccatcgtgcaggcgccgcgcatcctgccgcgcgtgatcaagctgccggccgaagtatgcgaaggccggccgcactgcttcgtgttcctgtcctccatcctgcactcgcacgtgcatgagctgttccccggcatgacggtgaagggctgctaccagttccgcgtcacccgcgacagcgaactgtcggtcgacgacgacgacttcaagaacctgcgcaccgcgctgcagggcgaattgcgccagcgccagttcggcgacgcggtgcggctggaaatcgccgacacctgcccgcagcacatggaatccttcctgctcacccagttcaatctgcagccgcgcgacgtctaccgcgtcaacggcccggtgaacctggtgcggctgatgcaggtgcccgacctggtggaccgcgccgatctgaaattcgcgccgttcagccccaccctgccgccgccgctgcagaaaaaagcgcagctgttcgaagccatccgcaagggcgacatcctgctgcaccacccgtaccagagcttccagccggtgatcgacttcctgaccctggccgccaccgacccgcacgtggtggcgatcaagatgacggtgtaccgcaccggcaccgactcggtgctgatggagtcgctgatcgccgccgcccgcgccggcaagcaagtgacggtggtggtggagctgatggcgcgtttcgacgaagaagccaacatcagctgggccagccggctggaagatgccggcgcccacgtggtgtacggcgtgatcggctacaaggtgcacgccaagatgctgatggtggtgcggcgcgaggagcgcggcctgcaccgctacgtgcacctgggcaccggcaactaccacccgcgcaccgcccgcctgtacaccgacttcggcctgttgacctgcaacgaggaaatcgccagcgacgtcaacgacatcttcgtccagctgaccggcctcggccgcgccggcagcctgaagcagctgttccaaagcccgttcacgctgcacagcatgatcatgcaggcgatagagcgcgaaaccgagcatgcccaggccggcaagccggcgcagatcatcgccaagatgaactcgctgctggagccgcaggtgatccacgcgctgtaccgcgccagccaggcgggcgtgaagatccagctgatcgtgcgcggcgtctgcgcgctgcgccccggcgtgccgggcctgtcggacaacatctcggtccgctccatcgtcggccgcttcctggaacacccgcgcgtgttctacttctacaacgaccacaaggaagacctgctgatgtccagcgccgactggatgagccgcaacttcttccgccgcatcgaaacctgcgtgcccatcatcgacggcaagctcaagcgccgcatcatcaaggaagcgctgcggctgtatctggaagacaacgtcaacagctgggacatgcagcccgacggcagctacaagcgccgcggcagccgcggcaagccgcactgcgcgcagcgccaattgctggagtcctactccgcccagccgcaggaagacaaataa

SEQ ID NO: 3473 - DNA, 480 bp, Chromobacterium substugae
atggcgatggtgggctatctgctggccgtcgtcatgatgctggccggcctggctggcaccgtgctgccggccattcccggcctgcccttgctgttcggcggcatgctgctggcctcgtggctggacaatttccagcacctcggcgccatcagtctgaccatactcgcggtgctggcggcgctgggcctgctgatagacttcgtcgccggcctgctgggcgccaaggccaccggcgccagccgccaggcgctgtggggcgccttcatcggcagcctggtgggcatgttcttcggcgtggccggcgtgatcctggggccgctgctgggcgccatcatcggcgaattcatcgcccgcaaggatgcgttccaggccggcaaggtcggcatcggcaccatcatcggcttcatcgtcggcgcggtggccaaagtggcctgcgccttcgcgatgctggccaccgccgcgctggcgctggcgttttaa

SEQ ID NO: 3474 - DNA, 426 bp, Chromobacterium substugae
atgccgctgcagcacctgatctacgtcagcaccgcccgccaggaactgagccacgcggagcaagaagcgctgctggaatcctgtgtgcgccacaacctgcagaacgacatcagcggcgtgctgctgtatggccccggcaacttcatccaggtgctggaaggcgaagccgcagccgtcgccgaaacctaccagcgcatactggacgacccccgccaccataacctgatagaaatcctgctcgaagacatcgagcagcgcagcttttccaactggcgcatgggtttcacccggctggacgacgacaccatcagcaagcatcccggcttcatcgacgtctacggtccggatttcctgccccaacggctggcgcagcggccgacgctggcgatgaacatcctgctgagcttccgcgccaactgccgctga

SEQ ID NO: 3475 - DNA, 1668 bp, Chromobacterium substugae
atggcccaatacgtgatgtcgatgctccgcgtgagcaagatcgtcccgcccaagcgacaaatcatcaaggacatttcgctgtccttcttccccggcgccaagatcggcctcctgggcctgaacggcgcgggcaaatccaccgtgctgcgcatcatggccaacgtggacaaggaatacgacggcgaagtgcagcacctggccggcgtcaagatcggctacctggagcaagagcccaagctggacaacgacaagaccgtgcgcgaggaagtggaaagcggcatgggcgacgtgatgggcgcgcagaagcgcctggaagaagtgtacgccgcctacgccgagccggacgccgacttcgacgcgctggccgaagagcaagccaagctggaggccatcatctccgccggcgccggcgacaacgtggcgctgcagctggagctggccgccgacgcgctgcgcctgccgccgtgggacgccaagatcggcccgctgtccggcggcgagaagcgccgcgtggcgctgtgcaagctgttgctgtccaaacccgacatgctgctgctggacgagccgaccaaccacctggacgccgagtccgtggaatggctggagcagttcctggtgcgcttccccggcaccgtggtggccgtcacccacgaccgctacttcctcgacaacgccgccgaatggattctggagctggaccgcggcgaaggcatcccgtggaagggcaactactcgtcctggctggaacagaaggaagagcgcctggcgcaggaagccaagagcgaaggcgcccgcatgaaggcgatgaagcaggagctggaatgggtgcgccagaacccgaagggccgccaggccaaatccaaggcgcgcatcgcccgctttgaagaactgtccagctacgaaacccagaagcgcaacgaaacccaggaaatcttcatcccggtggccgaacgcctgggcaatgaagtgatcgaattcgacggcgtgtccaagggcttcggcgaccgcctgctgatcgacaacctgtcgttcaaggctccgccgggcgccatcgtcggcatcatcggccccaacggcgccggcaaatcgacgctgttcaagatgatagccggcaaagagcagccggacagcggcagcgtgaagatcggccaaaccgtgcagatggccttcgtcgagcagagccgcgaaggcctggacggcgacaagaccgtgttcgaagacgtggccgccggcgccgacatcctcaccgtcggccgcttcgagatgtccagccgcgcctacctcggccgcttcaacttcaagggcgccgaccagcagaagaaggtgggcatgctgtccggcggcgaacgcggccgcctgcacctggccaaaacgctgctgaagggcggcaacgtgctgctgctggacgaaccgtccaacgacctcgacgtggaaaccctgcgcgcgctggaagacgcgctgctggaatacgccggcaccgtgttcgtgatctcgcacgaccgctggttcctggaccgcatcgccacccacattctggcggcggaaggcgaatcgcaatggactttcttcgacggcaactaccaggagtacgaggccgacaagaagaaacgcctgggcgaggaaggcgccaagcccaagcgcatccgctacaagccgatcagccgctga

SEQ ID NO: 3476 - DNA, 735 bp, Chromobacterium substugae
atgatgaaatgggttgggctggcgctggcctggtttggttcctgccaggcctgggccgcgccggcaggggatgtcgtcaatctgtacacgctggactatccgccgttcgtgatccgcgacacgccgcagagtccgccgcatggcatcgcggtggagctggtgtcgcaggcgctggcgcgcgccgggctgcggggacagtttgtcgatttgccgtggaaacgggcgcagctgcaggtgacgaacgaggaaagcggctgcctgatgccgctgacccgctcgcccaagcgcgaagggcaataccgctgggtggggctgatcgacgacagcagtcagtccttgttcgtcgccgccggcagcaaggcgcagatccgcacgctggccgacctgaagggtttgcgggtggtgaccttgctgggctcgtcgatggcggagtggctgcgtttgcatcaggtggggttttccgagttggcgacgacggaagacgcctatcgggaattgagcctgggcgtggccgacgcctgggcggtgcacagcccggtggcgcgctatctggtgaagaagcagggcgtgagcgcgacgccgatacgcgagattctgcggctgcaggaaaccggcatctacctcgcttgcggcaagcacatgccggaggaggaggcgcagcggctgggcgcggcgctcaagcaattgcgcgatgagggggtggcggccaaggtgatgtcccgctatctggattga

SEQ ID NO: 3477 - DNA, 678 bp, Chromobacterium substugae
atgtatttgcgaaccctcattctttgtagcagcttatggctggcggcctgcgccacgccccgcgcggccgacgcccccgcccccgccggctattaccgggtgcagtccggcgacaccctgtaccgcatcgcccgcaagcaccggcaaagcgtcggcaacctggcgcgctggaaccagctgtcggacagctccaacatccaggccggccaattgctgcgcgtgcagccgccatccgccggcaaaaccgccggcaacgccagccgcccgccggccaaaccggcggaaaagccggcgccgccgccggcccggctcgacatcaagctgcagtggcctgcctccggcgcgctgatcgccggcttcgacggcaaccgcaacaagggcatagacatcgccggcaacgccggcgacaaggtgcaggccgccgcggccggcaaggtggcgtatgccggcaagggcatccgcgcctacggcaacctgctgatcatcaagcacagcgacgacacgctgaccgcttacgcccacaatcagcagctgctggtgaacgagggcgatcaggtgagcgcgggacaaaccatcgccaccatgggcgacaccggcgccaaccgggtcaagctgcacttcgagctgcggctgcgcggccaggcggtggacccggcgccctatctgccgccgcgctga

SEQ ID NO: 3478 - DNA, 1200 bp, Chromobacterium substugae
atgaaacgcacctcgctcctgttgctcgccgcgctgctgtccgcctgcgccggcccgcggccgcaacccgcgccggcgcccatcgcctcggcgcccgccgtacagctgccgcccgaaaccgcctcgcccaccccggcggcgcccgcctccaatccggtgccgcaagcgccgccagccaaggctgcgcccgcgtcccgcgagctcatcgcccgcgccgtgccgccgcaagcgcgcgaccgccagggctggatcgccgacatcgacgccgccttgcgccacctgcggattccggccagcgccgacaatgtctgcgcgctggccgcggtgatagaacaggaatccagctggcaggccgacccggtggtgcccggcctgcccggcatcgtctggggcaagatagaagaaaaggcgcaccgttacctggtgccgctgtcggtggtgaaaaccgcgctgctgaagggctcgcccaacggccagagctataaagcccggatagacaatctgcgcaccgagcgcgagatgaacctgttgttcgaggacatggcgcgcgaagccggcaagatgggcctgcccgacatgaaaaacccgatccgcaccggcgggccgatgcaggtcagtgtggagttcgccgaggcccacgccaaagtctggccctatccctacccgcacagcgacagcatccgccaccaggtattcagccgccgcggcggcgtctacttcggcgccgccatcctgctgcaatatccggcgccttaccaggacatgctgtaccgcttcgccgacttcaacgccggccgctacagcagccgcaacgccgccttccaggccgcgctgtcccgcctgtccggccgcaagctggcgctggacggcgacctgctgaactaccagggccaaaccgcctccggcagccagcaggcggcgctttcgctgtcggggcggctggccatgggcgccgccgccatccagcgcgatcttcggcaggaaaagagcgtcggcttcggccagacccagctttaccgccaggttttcgcgctggccgaccaacaggccggccgcccgctgccgcgcgcggccatgccgcagatcgacctgaaaagccccaagatcagccgcaaactcaccaccgaatggttcgccaatcgggtggacggccgctaccggcgctgcttggtactattgcggcaaaccccggccccgtga

SEQ ID NO: 3479 - DNA, 1029 bp, Chromobacterium substugae
atgcgttcaactttttcctatttccgcggctcgctggccttcagcgtggccgtgctggccatcgtcgcctggtatggacacgcccagggcggcgtcgaacaggccggcgccttcctggtcaccgccgcggtgctggcggtgctggaaaccagcgtttccttcgacaacgcggtggtcaacgccaccgtgctcaaggcgatgagtccgcgctggcggcagatcttcatgaccgtcggcatcgcggtggcggtattcggcatgcgcatactgttcccgctgctgatcgtgtcgactgccggcggcgtgtcgctggcggaggccttcgcggtggctaccaagcagccggagcgctaccagcagatcatgcacgacagccacctgatgatcatgggcttcggcgccaccttcctgctgatggtggtgatcgaatacttcgtccagcatgagaaggatgagcactgggtgccgggcatcgagccgctgctggccaggctgggcagcgtggaaaacgcgcagtcgctggtcactatcctggtggtggccgccatcgccgcgctgctgcccgccggccagaaaatgccgttcatcagcagctgcttctggggctatgtggtgttcatggcgctgcatatgttcaagcagctgttcggcgggatggatatccagaccgccgccgccaagaacggcctgatcggcttcgtctacctggaagtgctggacgccagtttctcgatggacggcgtgatcgccgccttcgcgatcaccaacgatttctggctgatcgccgccggcctgggcatcggcgcgatgttcgtgcgctcgctgacgctttacctggtggagcgcaatgtgatgagccagttcaaatacctggaagtgtcggcgttctgggcgatcgccgcgctggtggccatcatgtatgccgccgcgctgcatgtcgaactgggggaagtgacgaccggcctgatcagcgtcgccatcatcgcgctgggcatcctgaccagcctgccctcgcgcggcaagccctga

SEQ ID NO: 3480 - DNA, 714 bp, Chromobacterium substugae
atggatcagttctttaaggagagcatcatgtcggtcggatctctgggcaacagctcaatctctttgcagtacacgcaggtggatatccaggaaagcttttcgtcggatcaggggcaatcttccggcggcggcgcggttcagggaacgggcggcggcggacaccatcatcatggcggcggcggcgagttgacccaaagcgtgctgcaggccttgcagcaatcggggctgctgcagtctggctcctccagcagcgggacggactcgtcctcggatggagattccggctcgaccggcgcggtggatgcgacgggaggaacgcagcagcaggccgtgcatgctttcatccattccttgttccaggctttgcagcaggagggagcggcatccggcagccagagcggcagcagcgaggccggcagcagcgaccagtccggcgacgccacgacggcggcatccggcagcggcggctacggcaatctgcagaacaatctgcagcagttgttgcaggacatcgccaacggcacccagaacagcgccacctcgaccttgagcagcgccttccagaatctgcagcaggctttgggaatcggcggcagcgggcaatcgtcgcaatcgtcgctgcagtccttcctgcaaaacctgaccaataatctgcagcagaatcaatttggcagcagcgccggcgtgggggcgctgctgagcacctcggcctga

SEQ ID NO: 3481 - DNA, 642 bp, Chromobacterium substugae
atgtcgcttgggtctgtgactggcagttattccattgccccgcaatatgttcccgccaccgctcccggcgtgctggcgccgtccggcaaccaggggcaggcagccgcctcgcgccgccaggacaatggaccggacggcggtttcgggcaggaagtggcgctggcgctgcagcagtcaggccttaatcttgccgccgccggcaactacaacaacgccggcgagcgcacaggcgacgccggcccgcaaaacaatgcgataggcgcgctgtcgggcagcgccggcagcaatgtccagcaggcgctgcatactttcgtccacgcggtgtaccaggcggtgcaggccgaagggctgtccagcagcaccgccggcgccggccaggggccggcgtccagcggctacggcgatttccagagcaatctgcagaagctgctgcaggatgtgagcaacggcagccagaacggcgccaccaccagcctggcctcggcgttcaaggatttgcagcagtccttgggcagcggcaacgggaccggcgggtcgcaacaggcgtcgctgcatacttttctgcaaaacctgctcaccttgcagaacgaccaggcgctgtcggccggcggcgtcggctcgctgctcaataccagcgcctga

SEQ ID NO: 3482 - DNA, 369 bp, Chromobacterium substugae
atgagcaagcgacaactgaagcgttcccacgcgcccatcttctgggggctgttcggcgccggcggcatgctggcggccttgttcgggccgatgctggtgtggatcaccggtttcgccgcgccgctgggctggctgccggccaaggcggccagctaccagggcgcgctagccctggcgcagagtctggtgggcaaggcggcgctgtgggggctggtcagcttgctgttgtggcacgcggcgcaccgcatctaccacagcctgcacgatatcggcgtgcatggcgggccggccgccaaagccttgacctatggcgtggcgatgctgggcacgctgctggcggcgggcctgctattgcgtttggggcgctga

SEQ ID NO: 3483 - DNA, 369 bp, Chromobacterium substugae
atgggcggctggtggcggaagagcccgtacttcatcgagtacatggtccacgagggcacggcgctgttcgtcgccgcttacgcttttgcgctgctgttcggcctgtggcggctgagccagggcgaggcggcatggaacggcttcatcgcggcgctgcgcagcccctggtctgtgttgtgccacctgattctgttcttgatgatcggctaccacagctacacctggttcaagatcatgccgcgcaccttgccgccgctgatcatcggcggcaagcgcgtctccgccgccgccatcaccgccggcggcttcatcgccgcgctgctcgccagcctggccttgctgggcatcgcatgggggatctcgcaatga

SEQ ID NO: 3484 - DNA, 747 bp, Chromobacterium substugae
atgacggacaagacgatgatcatcgaagtgatgcgctaccggccggaacaggacggcgagccgtggccgcaaagcttcgaggtgccgtacagcgacgacatgtcggtgctgcagggcctgcaatacatccgcgattacctcgatggcacgctggcgtttcgctggtcctgccgccaggccatctgcggcagctgcggcatgatggtggacggcgtgcccaagctcgcctgcaagaccttcctgcgcgactacccgggcagggtgagaatagaggcgttgcatcattttcccatcgagcgcgacctagtggtggtgctggacgatttcatcgagaaactcgaaagcatcacgccctatatcgtgcccaaggaaaacaagcccttgtccgagggggaatacaagcagacgccggcgcagatggactggtacgcccagttcagcggctgcatcaactgcctgctgtgctacgccgcctgtccgcagtacggtctgaatccggacttcctcggccccggcgccatcgcgctgctgcaccgctacaaccaggacagccgcgacggcgcatccgagcaaaggatggagctgctggcggcgcaggagggcgtgttcaactgcaccgcggtcggttattgctcggaagtctgtccgaaggcggtggatccggccaacgcggtgaacctgaacaagacggcggtggccaaggattatttcctgcggttcgcgcgtcccaagggagcgtgcaaatga

SEQ ID NO: 3485 - DNA, 1776 bp, Chromobacterium substugae
atgaaaacctaccaggccgacattgcgatcgtcggcgccggcggcgccggattgcgctcggcgatcgccgcggctcaggccgatcccggactcaagatcgcgctggtgtccaaggtgtatccgatgcgcagccacacggtggcggcggaggggggctcggcggcggtcaagcaggagcacgacagcttcgacgcccacttccacgacaccgtggccggcggcgactggctgtgcgaacaggacgtggtggagtatttcgtccgccagtgtccgcaggaaatggtgcagctggagcactggggctgtccgtggagccgcaaggaagacggcagcgtcaacgtgcgcgccttcggcggcatgaagatagagcgcacctggttcgccgccgacaagaccggcttccacatgctgcacacgctgttccagacctccatccagtttccgcagattcagcgtttcgacgaatacttctgcgccgacctgatcgtcgaggacggccaggcgcgcggcgtgctggccatcgagatcgccagcggcgaaagcttgctgatcgagaccggcgcggtggtgatggccaccggcggcgccggccgggtgttccgcgagaacaccaacggcggcatcgtcaccggcgacggcatggccttggcctaccgccacggcgtgcctttgcgcgacatggaattcgtccagtaccacccgacctgcatgccgcgcaccggcctgctgttcaccgaggcctgccgcggcgagggaggggtgttgatcaacaaggacggctaccgctacctgcaggactacggcctggggccggcggaagacaagccgcgcaacaagttcatggagctgggcccgcgcgatcggctgagccaggccttttggcatgagcagcagaagggccgcgcggcgcaggggccatggggcgaggcggtgtatctggacctgcgccacctgggccatgacaagctgcgcgagcgcttgccgcagatctgcgagctggccgaggagttcctcggcatcgatcccgcgcaggcgcctatcccggtgcgtccggccgtccactacaccatgggcggcatcctggtggacggcagctgcgcgtcgccgctgccggggctttacgccgtcggcgagtgttccagcgtcggcatccacggcgccaatcggctgggttccaactcgctggccgaactggcggtgttcggcaaggcggcgggggaggccgccgcgcgtttcgcccgcgacaacccgccggccgggcgcggcgttttgctcgaacaggccagggcggccgaggcgcggctgctggcgctgcgcgaccgccagggctcggagcgcatcgccgacatccgcggcgaaatggcgcaggcgatggagcaaggctgcggcatttaccgcaccgcggccggcatgcaagccgcctgcgacaagctggctgatttgaagcagcgcttccactacctgaacgtcgaggacaaatccagcgtgtggaacagcgactggctgctggccatcgaactgggctaccagctggacgtggccgaggcgatcgcgcattcggcgttgcagcgcaaggaatcgcgcggcgcccaccagcggctggacggctatgagcaacgcgatgacgccaacttcctcaagcacagcctggccatccatcagcctgacgccgcgccgcgcatcgcttacggcgcggtcaagatcaccacgtcgccgcccggcgtgcgcgcttacggcgcggcgggcgcggccgcggagcggggagagacggcatga

SEQ ID NO: 3486 - DNA, 621 bp, Chromobacterium substugae
atgctggacaaattgatcgtggaactggacaagggcctgcgcacattgtgcgcgccggcgcacagcgcgcgcgcgcatccggaccaggatatttccgaggccgacttgagcgcggccgacaagcgccacgcgctggggctgatgcgggtcaaccattgcggcgaagtgtgcgcgcaggccttgtaccagggccaggcgctgaccgcgcgcgacccgtccgcgcgcgaggcgctgcggcaggcggcgcaggaggaggtggagcacctggcctggaccgagcgccgcatccgcgagttgggcggccgtcccagcctgctcaacccgctgtggtataccggctcgctggcgctgggggtggcggccggcgtgctgggcgacaaatggaacctgggctttttgcaggaaaccgagcgccaggtcggcgcgcacctggacagccacctgagtgcgctgcccgacgacgacgccagaagccgcgccatcgtcagccagatgcgcgacgacgagctgcagcatgccgagatggcgcatgagctgggcgcggcggaattgccggcgcccttgaaggcggcgatgaagctgtcggccaaggtgatgaccggcagcagctaccgcatctga

SEQ ID NO: 3487 - DNA, 654 bp, Chromobacterium substugae
atgaatctcgccagcatcggcccgggcaaagacatgccgggcgacttcaacgtcgtcatcgaaatctccgccaacgccgctccgatcaaatacgaattcgacaaggactggaacacgctggtagtggaccgtttcatgggcacctccatgatgtacccggccaactacggcttcgtgccgcaaaccctggccggcgacggcgacccggtggacgtgctggtggtcaccccgttcccgctgccgccgggcgtggtggtgcgctgtcgcgcgctgggcctgatcaagatggaagacgacggcggcgtggacgccaagctggtcgccgtgccggtggaaaagctgtgcccgatgtacaagtccatccagaagctggaagacctgccggaactgctgcgccagcagatggtgcacttcttcgagcactacaaggatctggaaaagggcaaatgggtcaagatccagggctggggcacgctggaagacgccaagaccgaactggtggaaggcatcgctcgcttcggcaaagccgccgctccgagcccaagccggccctatggccggtttttttgcgcccgccgaatgctgcattgcacaatccgcctgttgcgcgggataatggtttgccgtatttccccgcatctgccacgcttctaa

SEQ ID NO: 3488 - DNA, 666 bp, Chromobacterium substugae
ttgcgccggctagcggcgcgaggactgccggccgcgtccgccagcggcccggcggcgtggcctgccgactggatcggcatcgcgctggaagacggctggctggacctcggccgggacggcgacgccgcgctggcgcgccgccagcgacaatgcgaggacgccggcttcgccttcatcgaactgggcggcgactggcaggctccggccgccgaacatggcttcatgctgctggccggcagccggcagccgcctgcgggagagacgctgaccctgctggacgcgctggcgccgcaagccggctgctggctgcattgcggcccggcgcacagcgcccgcttctgccagcgggtgttcgccgcgctgttgcacgccggccgcgccgcgctgcccttgcccgacgcccagccgcgcgcgctgcaatgggaagaaatgctgtccagccagtggcaattggcggacaagctgcgccagctcgccgatgcttacctgatcgaacatctgggccagcgcccgccctacccgtcgccgctgccggacgaggcgcggcatttcgccgccaacctagcccgcgccatcgcgctggcgctgccggacagccaggactggccggccctgctggagaaactggccgccgccctggccgcctgccggccggccggcaaatga

SEQ ID NO: 3489 - DNA, 567 bp, Chromobacterium substugae
atgtttaccaccacccaggaattctctgccctcggtcagtcacagttcgacaaggctgtccgtttgtcctccatcgtgctggccggcgccgaacgcttcgccagcctgcagctggacctgtcccgcaagctgctgtccgacaacgccgaagcgttcaaggcgctgagcgaagtcaaggacgccaagtcgctgagcgacctgcaaagcggcctggcgcagccggcgctggatcaggctttctccgccgcccgcaacgtctacgacgccgcgctgcttacccagaacgagctgtccagcttcgtcgaagagcagatcgccgaaaacagcaaggcgctgcaaaccagcctggatcgcctgtccaagagcgctccggctggttccgacatcgccgtcgccgcgctgaagaccctgctgaacacctcgaccgccgctttcgaaagcgtgtccaagaccgccaagaaggttagcgccgagatcgccgaagccggcgtcgaagccgccaccaattcggccaaggccgccagcgccgccgtcagccgcaagaaaaccaccaccagcgcggcctga

SEQ ID NO: 3490 - DNA, 708 bp, Chromobacterium substugae
gtggccaacgcctttgatatcaaatccgccagccttgacctgctggcgatcctgctgcgcaccgacaacctggatgagttgggccaggcgctggacgcgcgcttcggcaacaccagcggcgcgccggccgaagccttcgtgctcgatgtggaagcgctgcccaatccggccgagctggatctgggccgcctgctgccgctgctcagccgccgcggcatccgcgcggtggcgctgcgccacccggacaacgcgctggcggcggtggccagccagttcggcctggctttcgccagcagcgccgccttgccgcgttcggcgcaagcgccgcaggaacctgcggccaagcccgccgtcgaacctgctgctgcgcccgccggcgcgatgatcgtcgaccgcccggtgcgggccggccagcagatttacgccaagggctgcgacctgatcgtgctggcgatggtcagcgccggcgccgaagtcatcgccgacggcaacatccatgtatacgccccgctgcgcggccgggcgctggcgggcgcgcgcggcaacgccgccgcgcgcatcttcacccgcagcatggaggccgaactggtatccatcgccggggtgtaccgcaccatcgaacaggcgctgcccgacagcatcctaggcaagccctcccagatctatcttgagaacgagcgcctggtgatggccgcgctcggcgagtaa

SEQ ID NO: 3491 - DNA, 813 bp, Chromobacterium substugae
gtggcaaaaatcatcgttgtgacatccggcaagggtggcgtaggcaaaaccaccaccagcgcgagcttcgcctccggcctggcactgcgcggccacaagactgccgtgatcgacttcgacgtcggcctgcgcaacctcgacctgatcatgggttgcgagcggcgcgtggtctacgacctgatcaacgtcgtcaacggcgaggccagcctcaaccaggcgctgatcaaggacaagaactgcgacaacctgttcatcatcccggcctcgcaaacccgcgacaaggacgcgctgacgctggacggcgtggaaaaagtgctgaaagagctggccgacaacggcttcgaatacatcgtctgcgactccccggccggcatcgagaagggcgcgctgatggcgctgtacttcgccgacgaggcgctgatcgtcaccaacccggaagtgtcgtcggtgcgcgactccgaccgcatcctgggcatcctgtcgtccaagtccaagcgcgccgaggaaggccgcgaggcggtgaaggagcacctgctgatcacccgctacgcgccgggccgcgtcgacaagggcgagatgctgtcggtggacgacgtcaaggaaatcctgcgagtgccgctcctgggcgtcattccggaatcgccgagcgtgctgcaagcctccaactccggcacgccggccatccatctgaagggttctgacgtggccgacgcctattccgacgtggtggcgcgtttcctgggcgaacaacgcccgatgcgcttcctggacgcccccaaggtgggcatcctcaagcgcctgtttggaggttaa

SEQ ID NO: 3492 - DNA, 258 bp, Chromobacterium substugae
atgtccttgatcgatatgattttcggcaagcgccagaagtccgccgccatcgcccgcgaacgcctgcagatcatcctggcccacgaacgcaacggccgcgatgcccccgactatctgcccgcgctgcagcgcgagctgatggaggtgatctccaaatatgtcgcggtcaacctggaagacatcaaggtgcaggtggagcgccaggacgactacgaagtcctggaagtcaacatcgtgctgccggaacaccaacgctaa

SEQ ID NO: 3493 - DNA, 939 bp, Chromobacterium substugae
atgacgctgaccgaactgcgctacatcgtggcggtggcgcgcgagcgccacttcggccgcgcggcacagagctgcttcgtcagccagccgacgctgtcgatcgccatcaagaagctggaagacgagctgggcatcaccctgtttgaacgcggcggccaggaagtggcggtcaccgaaatcggcgaacgcatcatcgagcagtcgcagcgcgtgctggaagaggccgaggcggtgaagcggctggccggcgaacaccagaacgagctggccgggccgctgaagctgggggtgatcttcaccatcagtccctacctgctgcccaagctgattccggcgctgcgcatcctggcgccggacatgccgctgatcctggaggagaactacacctcccggctggcggaaatgctcaagcgcggcgaggtcgacgccatcatcgtcgccgatcctttcgaggaaaccggcatcgaagcctggccgctgtacgacgagcccttcgtcgtcgccacccccaagggccacccctgggaaaagcagccgcaggtcgacgcctgccagctggccgaggagagcgtactgctgctcacccagggcaactgcttccgcgaccaggtgctgcaagcctgcagcgaattgtccagccgccagcacttcggccacaatctggccagcacgctgcagggcagctcgctcaacaccatacgccacatggtggccagcggcatgggcgtcaccgtgatgccggccacctcggtcggccccggcgacgaaacgctgctgtcggtggtgccgttcagccagccggcgccgcagcggcgcgtgctgctggtgacgcgcaagcagttcttccgcaaaaaggcgatcgacaccctgcagcaggcggtgttccgctccggcctgcccggcgtcgtcatgctggagggcgagcccaagctgcagtga

SEQ ID NO: 3494 - DNA, 132 bp, Chromobacterium substugae
atgaagccggacagccacggcgccgcctgcttcgtccccggccattgcggcttgctgctgcaggactatcaccatccggaattcgccgccaactgcatgatgcatctgctggtggaaaacgccgccgcctga

SEQ ID NO: 3495 - DNA, 1941 bp, Chromobacterium substugae
atgcagaaaccggacaacccgagcaatgaaaccgagcgcatcgcggcgctgcatgcgctgaacatcctcgatacgccgcctgaagagcgctttgaccgcatcgcgcggctcgcccagcacatcatgcaggtccccatcgccctggtcagcttcgtcgacgcgggccgtcagtggttcaaatctcatcagggactggatgccaagcaaaccggccgcgacatttccttctgcgggcacgccattttgggcgacgacgttctttgcgtggccgacacccagctggacccgcgcttctccgacaacccgctcgtcaccggcaatcctcatatccgcttctatgcaggcgctccgctggacattggcggcggcgtgcgcctgggcacgctgtgcgcgatcgatcgcatgccgcacacacccagtccggagcagttggcggctctgcgggatctggccgccagcaccgtcgacatgatgctgatgcaacctgccgccgacctcatcaaacagctgcatgattccgacacgcgcctgcgcgccgtgctggacaccgtgatagacggcatcatcacgctggacgcccatggcgtcatggaaagcaccaacccggcggcatgccgcatttttggctatgccgccagcgagctggccggccggagtctagacatgctgatagcggacccctgccaaagcatggccggcggcatgcctggcatggcgggagccttgccgctccttgaacatggaaaagaagtcaccggcctgcaccgcaacggcgccacttttccgctggaactctccatcagcgaaatgcacctgcaaggaagctgcatgttcgtcgcggtggccagagacatttccgaacgcaaaaaagtggaacgcatcaagaacgaattcatttccaccatcagccacgaactgcgcaccccgctgacctcgattcatggcggcttggtcctggccctgaacggcggcgacgaaacgctctctcccaggaccaggcaactgctggaaatcgccagcagcaactgcgcccggctgaccgcgctggccaatgacatactggacctgaaaaaaatagaggccggccacctggagttcacctttgaaaaggtcgatttgtccgccttggtcaagcagtcgatcaaggccaacgaggcctatgcccatcaaagcggcgtcagtctccaagctttaaatgccttgagccaatcctacgtcataggcgacccgaaccggctgatgcaagccatttccaatctgctgtccaatgccgtcaaattctctccagtcgatggcatcgtggaaatctccatccataaaatccaggacagataccgggtggcgatacacgacgagggaagaggtattccagaaagtttccgcagtgaaatcttcaatcgcttcgcccaagcggataaatccgacaccagagaaaagagcggcgccgggctgggcctgaacattaccaaagccatcatagagcgccaccatggcctattggattacgagagcaccatgggcacaggcaccacattccatttcgatcttcccgccgccaccgcgctggttgccgccaagccatcccgtctgctgatatgcaagcgcgaggaaagcgaaaccgaagccttgcgcgcctcgcttgatgagcaaggcgtcgagagcgacggcgcctatcggggacacattgcgctcgatttgctgcggcacaccgcctaccaggccgtcttgatcgacctgccccaccatgaaagcctggccatgattgaggctatcctcagcatgcggggactgaatgcgccagcgctggttctgcccgatgaaagaaaaacggactatctggaatcgatccagacggagggcctggccattcactggtttccccggcatgcgactttggccgcattggaaaaaaccatattatccgcaataaaccatgcataa

SEQ ID NO: 3496 - DNA, 387 bp, Chromobacterium substugae
atgtcatcaagaaaaatacagctgatgttcatcgacgacgaccaggatattcgaagcatcttcgcattcgcgttcgagcaggaacaggacatggaaatcaagctgtgcgcatcgagcatcgacgccatctcctgggccgaggcctcgccgcccgacattatcgtgttggacgtgatgatgccggaaatggatggtcccaacacgttcagccgtttgaaagccatcccggcgctcgcgctgacgcccatcatttttctgacggcgaaagtacagaaacaggaaatcgaaagactcaaagcgctgggcgcaacggccgtgatagaaaaaccgttcaatccgctggagctgcccggcctgatccgctcgctcgcgccggaaatcggctag

SEQ ID NO: 3497 - DNA, 627 bp, Chromobacterium substugae
atgaatgacgattttgtcgccgtaatcgacgacgacgacgcgctgcgggaaatgctatgcctgatgctgggcagcataaaaattccggtgatcggctatcccgatgggcgatcgttcatggaggacgccaagcggcatcaatgcgcttgcgtcgtcctggacatgcgcatgccgggcatgagcgggctggacctgcagcggcagatccgcagtgaaacgctggacatgccggtgatcttcatgacggcgcatgcggatatccgggtggtggtggacgccatgcgggatggcgcgttggagttcctgcaaaaacccatccaagggcaggagttgctggactgcgttcaacaatgcttgcaaacgctgccgcagcggaaacagaaagtccgcgaaaaagaagtctttcaggccagattggcgaatctcacgccgcgcgaaaaacaagtcctcgatgaaatcgcctccggcatgagcagcaagcaaatcgccgataagctgggcgtgacgctcaataccgcagagcagtatcgcagcagcgtcttgaagaaaatgcgcgcgtcctccacggccaaattgctgagcagcatggagctgtggcagcgcaagaccgccggcaagcgagagtaa

SEQ ID NO: 3498 - DNA, 348 bp, Chromobacterium substugae
atgcgcggcgaaaggaaagacatggatgccgccgaaacgcaaaaacggatgcaggcattgcgcgcgcaatatcaggaccgcttgctccgccaactggacgagatgcaagctctggcagcccaactgaacggcgaggccgccgatcaagctgtgtattccgtcttgcgggaacgtctgcacaagctcgccggctccggcggcacctttggccaaccggagctggggcggcgctgccggagcctggaatgcctgctcgatggctggctggccgcggacgcgccgcccattgacgcgggcatgcggcggcagtttctggccgatctggcggccctggccgcgctaacataa

SEQ ID NO: 3499 - DNA, 2148 bp, Chromobacterium substugae
atggaaaacgataccctgtccgccgcgttcgctgttttcatagacgaggcgcgggacctgatcggccagatggaagacatattgctgcgcttggaggccggcagcgcggatggcgacgatctgcccgcgctgttccgttgcgcgcataccatcaagggctcggccggcatgttcggtctggaggaggtggtgcgcttcacccacgtggtggaaagcgtgctggatgagttgcgtaacggcgcttttgcgtttgattccgatctggccagcgtgctgctggattgccaggatcacatctccgggctgatcgccgccgcaacggacggaggcgaggcggaccgcgcgcgcagcgacgcgctgattccgcagctgtcgcgttggctggggcaggaggcaccgcccgccgcgtccgcgagcgaagcgcttccgcagcaggaggcgaccggggatgagcaaggggtggcgtcgccgttctggcatctgtctctgcgcttttctccgtccattctctgcgatggcatggatccgctcaaattcatcaattatctgaaccgctacggccgcgtccagcatgtggaaacggtttgcgaccacctgccgccgctggaggcggcagacccgcagcagtgctatctgggtttcgaggtggttttggacagcgccgccagcgcggaggagatcgccagcgtattcgccttctgcgctgaaagcgcgagcatcgtcatcctgccgccgcacagcccgctgcccgcgtttcagcgcttgatccaagccttgccggaagcctccggccgcgtgggcgaaatcctggtggcctgcggaaccttgacgtccgacgagttgtaccggttgctggttctgccgcacgggggcggcgaagcattgccggtcgagccaaggggcgtgggcgaggaggcgcagcccaagcccaagcccaagcgcgaagaggagcggcggccggctgagggcggcagcgtcaaagtgccggcctgccggctggatgccttgatcgaccgagtgggcgaactggtcatcgccggcgcgggcaatcaggcgcaggccgccaaagccgcccatccggccatgctggaggcggcttcccaattgttgacgctggtggaggccgtgcgcgacatggcgctgcagctgcgcatggtggccgtaggagaggtcttttaccgctttccgcgcgtggtgcgcgacgtggcgaaagaactgggcaaagagatagaactgcgcatctccggcgcggaggcggaactggacaaatccatggtggagaaaatcgcagatccgttgatgcatctgctgcgcaatgccatggatcacggcatcgaaccggcggagacgcgcatcgcccgcggcaagcccatgcaaggcaccgtcacgctgaaggcctaccacgagtccggtgccatcatgatcgaggtggcggatgacggcggcggcttggatcacgagaagattctgcgcaaggcgatagagaagggcatcgtggcggatggcgcgaatctgtcgcgccacgacatccatcagttgatcctggcgcccggcttctccacggcggagcgtgtcaccaatctgtcgggccgcggcgtgggcatggacgtcgtgaagagccatatcgaagcgctgcgcggctcgttggtaatcgagtccgaaccgggccgtggcaccacgatgcggctgtgcctgccgcttacgctggccatcatcgacggtttccatgtgggagtgggcggcgcgcagttcatcgtgccgctggacatggtggtggagtgtctggagctgccgcagtgccaaggcgatgtggattatatggacaaagacggcgccgccttgcccttcgtgcgcttgcgtgagctgtttggcgagcgcggcccggctcatccgcggccgcgcgtggtgaccgtcagttttgcgggcaagcgcatcggcctggtggtggacaggatttacggcaagtgccaaaccgtcatcaagccgctgggtgccctgttccagcatgtgccctgcgtgaccggttcgacgatactcggcgacggcgaggtcgccctgatcatagacgtcgtccagttgattcagggcgtggtggcgcgggacgtgcagcaaagacaaagaaacgcgtctgtggcgttgacggcatga

SEQ ID NO: 3500 - DNA, 345 bp, Chromobacterium substugae
atggacttctccttggacttcgatgaagaaaccggccggcatctgtttcggggcgaattgggcgtctataccgcccatgcggtgcaggcggtttggctgaatctgttgcaggctgccgacggcatctgcatggatttggccggcgtcacggaaatcgataccgccgggctgcagttgctgttgcagatgaagctccacgccgccaagagcgtgagcttctgcaacgcgtctgagccggtgcgggaaatggccaggctggtgaatcaggaagctttgctcaagcagcccgacgctgtgggcgagggctggcttgaccgcgccgctggtcgtcactacacaaggtga

SEQ ID NO: 3501 - DNA, 366 bp, Chromobacterium substugae
atggcaaaacttatactggtggtggatgactccgcgtctttgcggtccttggtggcgatgacgctgaccgatgccggctatgaagtgatggaggcctgcgacggcgccgacgctttgtcgaaattgaaggggcagcgcatcagcctggtgatttcggatgtgaacatgcccaatatggacggactcacttttgtccaggagctcaagaaaaatccagcatacaagtgcgcgccggtgatcatgctgacgaccgaggtggcggaggacaagaaacaggcgggccagtccgccggcgccaaggcctggatggtcaagccgtttcagcccaagcaaatgctggctgcggttgagttgctggcgagctga

SEQ ID NO: 3502 - DNA, 555 bp, Chromobacterium substugae
atggcggacaatcaagcgagcaacccgaatccggcaatcggcgccgcgcaacacgaatccagcgtcggcaagctctatcttgccttcagcctgggggggaatgcctactccatcgagatcgagcggatccgggaaatcatcgaatacgacgtgccaacggcggtgcccatgatgccgctcgccgtgtgcggcgtcatcaatctgcgcggcgcggtggtgccggtcctcgatctggctgtgcgcttcggccaccaccctatcgtcgtgagccgtcgcagctgctatgtgatcgtggaggtggagcatgggggcgcattgcacgtgatcggtttgctggtggatcgcgtgacggcggtggtggaaatcgacgatgcggacattgagccgccgccggcttttggcgcgcaaatcgacgtggacttcatcgccggcctggcgcgccatgacaatcgtttcctgatcattctgaacatggcgcgcgccttgtcgatagcggaaatatccgcggtgacgaggatgggcgaggagaaactgcctcaagccgatccggcttga

SEQ ID NO: 3503 - DNA, 2001 bp, Chromobacterium substugae
atgccggcgcttgtcgccatgctcgaacagatggcaaacggcaatctgaatacgcgtctggaaatttcctcccatggcgaggccggccgcgtcgcgcgcttggccacgcaaatccagtccggtttgcaaacgttgctggccgatatgaaacgcatgtcggccgaacacgaggcgggcgatatcgacgtgcgcatggacgaaaccaagttcgagggggcttaccgcgagatggtcagcggcatcaatgagatggtggcgggccatatcgccgtgaagaaaaaagccatggcctgcgtgaaggagtttggcgaaggcaatttcgatgcccagctggaagtgttccccggcaagaagcgcttcatcaacgataccgttgagcaggtgcgcgccaatatcaaggccttcatcggcgaaatgaaccatatgtcggccgaacacgatgcgggcgatatcgacgtgcgcatggatgaggcgaaattccagggcgcgtatcgttccatggcggccggcgtcaatagcatggcggcgggccatatcgccgtgaagaaaaaagccatggcctgcgtgaaggagtttggcgaaggcaatttcgatgcccagctggaagtgttccccggcaagaagcgcttcatcaacgacatcgttgagcaggtgcgtgccaatatcaaggccttcatcggtgaaatgaaccatatgtcggccgagcatgatgcgggcgatatcgatgtgcgcatggatgaggcgaaattccagggcgcgtatcgctccatggcggccggcgtcaatagcatggtggcgggccatatcgccgtgaagaaaaaagccatggcctgcatcaaggagtttggcgagggcaatatggaagcgccgctggaactctttccgggcaagaagcgtttcatcaatgacacaattgagcaaatgcgcgccaatatcaaggccttgatcgtagataccgacatgctggtccaggcgtcggtggaagggcgcctggacgagcgcgccaacgcgaatgcgcaccgcggcgatttccgcaaaatcgtcgaaggcatcaacaagacgctggacggcatggcggggccggtgaaagaagtgatgcgggtaatggagtccctggcggtcggcaatctgacttgcctagtggaaggacagtatgcgggagatttcgatcagctcaagcgctccgtcaataccagcgtggaccaattggcccagaccatacgccaggtgagcgaggcgatagaggagatatccagcgcactgaatcaggtgaacagcgcgtcgcaggcgctgtcgcagaacgcgaccgagcaggccgccagcctggagcagaccacgtcctccatggaggaaatgtcagtctccatcgcgcagaacaccgataacgcggtagtgactgatggcatcgccacccagtccgccaaggatgcgatgcgcggcggagacgcggtggacgagaccgtgaaggcgatgcgcgccatcgcggacaagataggcattatcgacgacattgcctaccggacggacctgttggcgctgaacgctgcaatcgaagccgcgcgggcgggcgaacacggcaagggcttcgccgtggtggcggctgaagttagaaaactggccgaacgtagccagatcgcggcgcaggagatcagcggtctggctgccaacagcgtacagacggccgagcaggcgggccagctgttgtccgaaatgctgccgtctatcaacaggacggcggatctggtgcgtgagatcacggcggcgtccaacgaacagagcataggcacgaaccagatcaacgaggcgatgaaccagctgaacttgactacgcagcaaaccgcgtcggcatcggaagaactggcggcgaccgcgcagacggtggccgaacaggccgagctgctgcgcaatctgatgagtcagttcgagctgcgcgaatcgcacggcaacgccatgcgcgacaccatggccctgatgagaagcggcgggcgctcctacgcatga

SEQ ID NO: 3504 - DNA, 126 bp, Chromobacterium substugae
atggcgacaagcgccggcatgccattttcctggctgcgggaaagccatgcggccatcaataacagaggcaaagacaaggtgctgacccatatggcggcattcacccaaatcttttcaccctcataa

SEQ ID NO: 3505 - DNA, 1179 bp, Chromobacterium substugae
atgaaatcttccatccgcctgcctttcagccttactgtttttccgctggttttggcgctggcatgcgcgtcgtttttgcttggcgtgctgggggcccatccgatcgcgctgtcggcgggcggggcgctgctggctttaggatgggctggccggacatggatgggccgggatgtgggccgctttatagacgcttctgtgcagcggagccgtacgatatccgacgcggagacggcggtgcatcgcgatcaggcggcttatctggactcgttgcgcgtcacttgccgcgccatgctgccgcgctggcgcacaaacgtggagctggtgcgcgcgcaatccgagtcggcagtcgatgggctggtggcggaattccgagatatccgcagccggcttaagagagccttgggagcttttgccagccaagggcaggaagatctggcgtctaccataggcggggcgcgcgacgagctggaaaccatcttgtctgagctgaaagccgcgactgcggccaagcagcagatgatgggaaatatcgcctcactggtgcagttgaccgaggaccttcaaaaaatggccatcgaggttggcgacatcgccgcgcgaaccaatcttctggcgctgaacgccgccatcgaggcggcgcgcgcgggggagagcggccgcggctttgccgtcgtcgccgacgaggttaggaagctatccaatttgtccgcgactacgggcgccagcatccgggacaaggtatcgactgccaatcaattggtcggcggcgccctggccgccgccgagcggctgtctagcgaggacaagcgcctgcttgtcagttccgaaagcgccatcgcggcgacgctcgcccgcatcaatcaagcggccgatgggctggcctctgccagcgccagcctgcgggcggaaaatctccaggtcagccaacgcatcgaggaagtgttggtgaatctgcaatttcaggatcgcaccgcccagatcatgggatgggtgctgtccgatatggggcggttggatgaacggttgacgcaggacgaggagcaggtccggcagggcgaggtgccgcaacctatcagtgtcgatagctgggtggaaaaggcggaaagccagtacaccaccttggagcaagcgccccatcggcatcaggtcgatgcgcaatccagcatgattttgttttaa

SEQ ID NO: 3506 - DNA, 2025 bp, Chromobacterium substugae
atgaacgccaatcctttgctgcaagactggaataccccccaccagctcccgccgttcggcctgattcgccccgaacatttcgaaccggccctcgccgcgctgttcgccgagcacctggccgaaatcgacgcgctggccgcattggaagaagcgcccagcttcgccaacaccgccgccgccttcgaccgcagcggccgccggctggagcgcgcccagctgctgctggataatttgaccgcatcggaaacctcggccgagctgcaggaagtggaacgccgcaccgcgccgcagctggccgagcacaacagccgcatctacatgcacgccggcttcttcgcccggctggacgccgtccacgcccgccgcgccgagctgggcctcagcgaggaacaggatcggctgctggacctgatccaccgcaacttcgtccgcgccggcgccaagctgcagggcgaagaccgccgccgctacgccgaaatcgtttcccggctggccgagctgaccaccgccttcggccagaacgtgctggccgacgaggccgagtacgcgctgccgctgggcgagaacgacctcgctggcctgccgcccttcctgctggacgccgcccgcgccgccgccgaggcccgcggccttgagggctgggcgatcacgctgtcgcgttcgtccatcgtgcccttcctcaccttctccgcccgccgcgagctgcgcgaagccgcctggcgcgcctggaccgaacgcggcgaacatgccgagcgcgacaatcgcccgctggcgcgggagattctggcgctgcgcgtcgagcaatcgcggctgctgggtttcgacactttcgccgactacgcgatcgccaaccgcatggccggcaagcctgccgccgtgcatgcgctgctggaacaggtgtgggagccggccaaggcccgcttcgagtcggaaaaggccatgctgcgcgaagaggccgccaggctcggcgagccggccgacatccagccctgggactggttctacctggccgagaaggtgcgcatcgcccgctacgcgctggacgacgccgagatcaagccctatttcggcctggaaaacatggtgacggcgatgttcgacgtcgcccgccggctgttcggcctcagcttcgccgagcgccatgacctcacgctctaccatccggacgtgcgcgcctgggaagtcagccgcggcggcaaggtgatcggcctgttcctcggcgacaactacgcgcgccaaagcaagcgcggcggcgcctggatgcatgtctaccgctcgcaagcgcgcaacggcggcgaagcgctgcccatcgtcgtcaacaacaacaacttcgccaaagccggccacggccagacgctgctgagcttcgacgacgtgcgcacgctgttccacgagttcggccacggcctgcacggcctgctgtccaacgtcgaataccggctgctggccggccccaattcgccgtgggactacgtcgagctgccgtcgcagctgatggagaactgggcgctggtgccggaagtgctggccaagcatgccctccacgccgaaaccggcgcggccatcccggccgagctggtggccaagatcaaggcggcgcgccatttcaaccagggtttcgaaacggtgcgctacaccgcctccacgctgatcgacctggcgctgcaccagcgcgccgacgcggacggcgtcgacatcgccgccttcgaagccgccgaacgcgaacggctgggcgttccgcccgcggccggcatgaatcaccgcccgccgcacttccgccacatcttcaccggtccggaatacgccgccggctactacgtctacatgtgggcggaagtgctggaggcggaagccttcgccgcattcgaggaagccggcgatgccttcgacccggcgctggcggacaagctctatcgccatatctacagcgccggcgacgccgtcgagcagcgcgccgccttccgcgccttccgaggccgcgacccgcaagccgcggcgatgctgaagaaacgcggcctgcagtaa

SEQ ID NO: 3507 - DNA, 582 bp, Chromobacterium substugae
atgacaaagaaaatcggcaaatccatcaagtggctgctcccgaccatcgtcctcctcgccatcggcgcgctgttctggaaatcgcagcagcctacgcacaaggcctcgcccccggcggaagcggcccgcatccactacctcaactacgccaacgtccgcttccccttttccataccttaccccaaaggtctgctgattccgggcgaagagcccgacaacggcgacggcctggccttcacctcgcccgatgggcaaaccgtcatgaccgcgtccggcatcaacaacgccaacgacgatacgctgcaaagcgaataccgcgacgacttgaaaagaccatccgaatccggccagccgcgcaaagtcgccttcaaaaccatcaagaaagactggttcgtgatttccggcaccgaaggcgacaagatcttctaccagaagacctatctggtggacgaccaattcatgaccttcgacatccgctacccggccagccagcgcgcgaaatgggacccgatcgtcgcccacatcagcaagcagttcaaggtgacgcccggcaacaccccgtacgaagtccagtcccagtga

SEQ ID NO: 3508 - DNA, 132 bp, Chromobacterium substugae
atggtgagggatgatggttgcgcgggagaagtctccgtcagcggtctatcgcttcgtccaggtacggacgacggagacatcgcgttcactgggactggacttcgtacggggtgttgccgggcgtcaccttga

SEQ ID NO: 3509 - DNA, 2016 bp, Chromobacterium substugae
atgagcaatccgctgctgcaacactgggacaccccgcaccaactgccgccgttcgacgccatccgcgccgagcacttcgcgctggccctgcagcagttgatggccgaacatcgcgccgccgtcgccgccatcgccaatcagccggagccggccagcttcgccaacaccgtggaggcgctggacgccgccgcgctgccgctcaagcgcgtatcgctggtattccacaatctgcgcagctcgcattccgatgccgaactgcgggccgccgagcgcgaactggcgccgcagctggccgcccaccacggcgccatctgcctggacgaagcgctgttcgcccggctggacgcggtgctgcggcaagcgccgcagctggagttgaacgaggagcagcgccgcctgctgcagcggctgcatcgcgacttcaccatggccggcgcctgtctgcgcggcgaagatcgccgcgagttcgccgacgccaacgaagagctggcccgcctgtccgcgcaattcggccagaacgtgctggccgacgaatccgaattcgtgctgcgcctgagcggcgaggacgatctcgccggcctccccgcctcgctgcgcgccgccgcggcgcaaaccgcccgcgagcgcggcctggacggccatgccgtcacgcttgcgcgttcgtccgtcaccgccttcctcgcccactccagccgcgccgacctgcgcgaaaccgcctggcgcgcctgggtcggacgcggcgaacagccgcaacgcgacaaccgccctctgatccgccgcatcatggcgctgcgccagcgccaggcccggctgctgggctacgccaactacgccgactacgcgctgaccgaccgcatggccggcgcgccggcagccgtccatcgcctgctggaacaggtgtgggcgcccgccaaggtgctgctggccagggaaaagctgcaattgcaggcactggcgcgcaaacagggcctgaaccccgacatccagccctgggactggcgctacctggcggagaaggcgcggctcgagcattacgcgctcgacgacgccgaagtgaagccctacttcagcctggaaaacatgcaggcggcgatgttcgacgtcgccggccggctgttcggcctgagcttcgccgaacgcgacgacctgccgcgctatcatcccgacgtgaagggctgggaggtataccggcacggcgagttgatcggcgtgttcctcagcgacaacttcgcccgccccggcaagtcgggcggcgcctgggccagcatctaccgcgcccagggccgcaacggcggccgctccctgcccatcaccgtcaacaacaccaatttcatcaagggcagcccgacgctgctgagcttcgacgacgtgcgcacgctgttccacgagttcggccacggcctgcaccacctgctgtccgatgtgcgctaccagcgcctgtccggcacccaggtgctgcgcgacttcgtcgaactgccgtcgcagctgctggagaactgggcgctggtgcccgaggtgctggagcggcacgcgcgccacgtcgaaaccggcgcggcgattcccgcggcgctgatcgcccggatcctggcggcgcgcaatttccagcaaggctacgccaccgtgcgctacgtcatttcggcgctgctggatctggagctgcaccaggccggcgacggcgtcgacgacatcgccgctttcgaggacgaagtctgccgccgccatggcctgccgccggaagccgggctggcccaccgcctgtctcacttcagccacctgttcaacggcggctacgcggccggctattacgtctacctgtgggccgaagtgctggaggccgaggccttcgccgccttcgaagcgcgcggcgacgccttcgacgccgaattggccgacagcctgcgccggcacattttcagcgtcggcaacagccgcgatccgcagcaagccttccaggccttctgcggccacgcccccagcgctggcgccatgctggaaaaacgcggtctggccggctga

SEQ ID NO: 3510 - DNA, 636 bp, Chromobacterium substugae
atgcgtcacctcgctgcagcctgcctcgccctcgccgcgctatccggcagcgcccgggcctttgacctgggctcggtgctcaattcggtcaaccaggccgtggacaccgccaagaatgtcggcaacagcgtctccggcggcaatccagccaccggcgacggctccctgacgccccggctgaagctcaaccgcccgtcaccggtgggctcgccgctgctggccaagctggacgaatacaaccatcattacaaggaactggacgaatacaccgtcttcctgtcgcggcccaaccagaacagcgacggctcgatccgggtggccaaggccgagctgctgcgcggccaggtctacaaggacctgtacaaccatcctgattcgcaaagcaccatgcaggtgtgggaagcgtacaaaagccagctgagccaggacggctacaaactggacttcatctgcgacaaaccttgcgccaaccatgtcaatctgtggcagaccgcgctgagttcgtccttcatcgtctacgacaaatccgaccgctacctggtggcgcacaaggacaacacctgggtcagcgtcgccatcggcgaaatcggatcgcacccgttgtccagcgtcaatgtcgtggttcgcggcaactag

SEQ ID NO: 3511 - DNA, 402 bp, Chromobacterium substugae
gtggagattttcttctacgcctacaaggcgctcaccaccaagccggacgaaatgctggccaagcgcggcctggcccgcgtccaccatcgcatcctgttctttgtcgcccgctatcccaagctgtcggtcaaggatttgctgggttttctgggcgtgaccaagcaggcgatcaacatcccgctgcgccagctgctggaaatggagctgatctgcagccaggccgcgccgcacgacaagcgggtcaagcagctcagcctgagcgaggaaggcctgcggctggaggaaagcctgcaccgcgagcagcagcgcctgctgcagaccgccttcggcgattgcggcgacaaggccacccgcgactggtttctgatcaacggcaagctgtccgagcacatcctgccctga

SEQ ID NO: 3512 - DNA, 603 bp, Chromobacterium substugae
atggggcggcggcgcgcgccgacatcaatcagcaagacggaaaccatcatgagcaaggcgttcaccaaggaagaagaccaggcggaagacgatctgccatcggaacagcgcttgccggcggcgagcaagaactacatcacgcccggcggctggcagcgcttgaaggacgagctgtaccatctggtcaaccgcgagcgtccggaaatggtgcaggtggtcaactgggcggccagcaacggcgaccgctcggaaaacggcgactacctgtacggcaagcggcgcttgcgcgagatcgaccgccgcatccgctttttgaccaagcggctggaaatcgccgaggtggtggacccggaaacccgcgaggcgaccgatcagatcttcttctcggccacggtgctgatccagcgcggcgacggcgccgagcagcggctgacgatagtcggcgtcgacgagatagacctgccgcgcggccgcatcagctggatctcgccgatcgcgcgcgctttgctgaaggcccgcgaaggcgacagcgtgctgttccgcggcccggacggcgacgaagacatcgaggtgctggaagtctgctactgcaaggtggaatga

SEQ ID NO: 3513 - DNA, 540 bp, Chromobacterium substugae
gtgctggacggcttgaccgcgggatcaagcatgggcgaccgccgattggcggttgcccgttttgttttggggggaagcgtggaagatttcggccagaatcaggacgccggcctggccttgccggcggagccgcgcaaacagcgcgccgccatcgtcatcatcgaaggcggcaagctgctgctgatgcgcagaatcaagccgggcaaggattattactcgctgcccggcggcaacatcaagaaaaacgagacgccggcgatcgcctgcgtgcgcgagacgcgcgaggagaccggcctcaacgtctggctgggcgacaagctgtgcgtgctggaaggccgcagccgcaccgagcatgtgttcgtggcgcgcgagcaccgcggcatgctgcggctgggcgggccggagttggccaagctgtctgccgacaaccattacgagctggcctggctggacgcggcggcgctctgcgcggtgaaattgcggcccaaggcgttgctgccttactgcctggcgctgcttgagggcggcgatcaggcataa

SEQ ID NO: 3514 - DNA, 1401 bp, Chromobacterium substugae
atgtctacaaaaggacaacgtaccaacgcgcgccaaccggttgcgcgtgtcaaaggtcgtgaaaccgcacagccgcgtcagaatgccggccgcaaccagggccagcaagcgcgccaaggcaagtccggcccgagcgcccagccccgtttcccgcaacagcagcaagccggcgctggccagcagaacggccgccgcaacggtccggcgcgccagccgcgcgatgcttacggcaacccggcggtgccctcgcagaatggcgtgccgctgttcaagctgagccgccgcgaacaggagcaacaggcgctggccgccgcccgcggcaagccggtctacggccgcgacagcaatggcgacgtcaacggcaacgtggcgctggaccacgagcgccgcttcggcaacaagaacgcggcggcgccggttgacggcaacgccgccaaaccgccgcgcggccccaagcccgaaggcgaaggccgcggccgaccgcagcaggtgcagaaggccaagaagctgcgtctgcgcagccccagccaggacatcaagagcaagtcgcaaaagctgaaggaagtgcgcgtcgatctgaacgagatcgagcccatccgcctgcagaaggcgctgtcctcgtccggcgtcggctcgcgccgcgaaatggaagaatggatcgaagccggcctggtcaccgtcaacggcaagaaggccaatctgggcgacaaggtcggcccgcacgaccgcgtgatggtcaagggcgacgcgatcaaactgaaatggcctgaccgcctgccgcgcgtgatcatgtatcacaaggaagagggcgagatcgtcacccgcgacgatccggaaggccgcgtcaccgtgttcgaccgcctgccgcaagccaagtccagccgctgggtggccatcggccgcctggacgtcaacactgcgggcctgttgctgatcaccaccagcggcgagctggcgaaccgcatgatgcaccccagcttcgaagtggagcgcgagtactcggtgcgggtgatgggcgagctgacgccggaaatcatgaaggaaatggtcaagggcgtggagctggaagacggcccggcgcgtttcgaccgcattttccagaccggcggccaggaagaagcggccaaccagtggttcaacgtggtgatcaaggaaggccgcaaccgcgaagtgcgccggatgttcgagcacttcggcctgaccgtcagccggctgatgcgcgtgcggttcggcaatatcggcctgccgccgcgcctcaagcgcggccagttctacgagctgaacccggcggaagtggcggcggtgatgaaatggtcgaatctgaccgtcaccggcggcaagaaggcgccggctcagcgcaaggcatcggcccgcaagccgcgcaccccgcgtccggagtaa

SEQ ID NO: 3515 - DNA, 633 bp, Chromobacterium substugae
atgtccaccattaccgatttaaaatatctgaagatcgtgctggaaacagccttgctgacggcccaggagccgttgtcggtttcccagctgaaaaagctgttcaccgaagacgtcaaggccgccttgatcaatgatattctggatgacattcagggcgactggcgcggacgcggcatcgagctggtaaagctggcttccggctggcgctttcgcgccagggccgaattcacgccctatctcaaccggctcaatccggaaaagccgccgcggtattcgcgggcggtgatggaaaccctggcgatcatcgcctacaaacaacctgtgacccgtggcgacatcgaggcgatacgcggcgtatccgtctccaccaatgtgatgcagaccctgctggagcggggctggatcgaagtcatcggtcacaaggacgtgccgggccgtcccggcctgtacgccaccacgcgcaagtttctggacgatttgagctttgtctcgctcaacgatctgccgccattggcggagcttggcacactggtggtgccggacacccaattgcaagacgacagccccgatgcgggcgcagacgatctccccctcgacgatgaggcggacaatttagagcctgtcgcagaataa

SEQ ID NO: 3516 - DNA, 519 bp, Chromobacterium substugae
atgaaaatcgaagccgccagcgagcaccatctgtcagcttatcgccgttacttccaggcctgccgcgaagcggatttcgaatattaccgcggcctggaggacgacgccggccactggctgggccaggtggtgctgcatgcgcagggcaagtcgctgccggcgggctgggtgccttgccagacctggtttctgctgacgggcgagggcgagatcatcggcgccgcccgcttgcgccagggcgaaaccgatgtgatacaggatgtgatcggccatatcggcttcgaggtgttgccgcagtggcgcggccatggctacggccgggtgctgctgcagtacgtgcaggcgttgggcagcagcccggcctgcggcaattgggtgctggtgtgcgacgccgacgatccggccgccatccgcaccatagaggcttgcggcggccagcggctggaggacatgccgcagccggatggccgcgtgctcaggcgtttcagcctgacttcgctggccggactgatggattaa

SEQ ID NO: 3517 - DNA, 978 bp, Chromobacterium substugae
atgagcgacaccccacaagccatcctgttgatgggccccaccgcctccggcaaaaccggcctggcgctggagctggcccgccgtttcccgctggagatcatcagcgtcgactcggcgctggtctaccgcgggatggatatcggcagcgccaagcccagcctggcagaaatggcggcctgcccccaccatctgatagacgtgatcaccccgctgcaaagctattcggcggcgcagttccatgccgacgccaatcgcctgataggcgaaatctccgcccgcggcaacatcccgctgctggtgggcggcaccatgctgtattacaaggcgctgctggagggcttgtccgatctgccccaggccgacgccgcgctgcgcgccgagctggacgccgacgccgcgcggctgggctggccggcgctgcacgcccggctggccggactggaccctgccaccgccgcccggctcaatcccaacgacgcccagcgcatccaccgcgcgctggaggtgtgcctgctgagcggcaggccgatgtcggaactgatcgcccaaggcaaggccgccgccgccgatttcagacacctgccgctggcgctggtgccgcgggagcgcggctggctgcaccaacgcatcgcgcagcgcttcgacatcatgctggagcaaggcttcctcgacgaagtcagccgcctgcgcgcccaatatccggacctgagcctggacctgccgtcgatgcgctgcgtcggctatcgccaggcctgggaacaccaggacggcctgtacgaccgccgcgaattcatcgaacgcggcatcgccgccacccgccagttggccaaacgccagctgacctggacccgcggcctggacgtgatgccggtggatgcccagcaacaagacctggccggcttgctgacggacgcggtggcggacttcctcgccggcaagccgccagccgacgcgctacgtttcagcgggccgttctga

SEQ ID NO: 3518 - DNA, 591 bp, Chromobacterium substugae
atgaccggcaatcgattgagcaacaccgcgctggcggccgcgctgctggcggccagcatcgccgcgcaggccgacagcaagctgctgggcgtccccttgaccgtgcaggagcatagccagtggtgctgggcgggctccagcaaggcggtgctggcgtggtacaagcagacgccgagccaatgcgccatcgtcaactgggccttcggcatcaactacgcctgcggcaacagcaatttcaactggaacagcgacgccaacagccccaacaatatgttcggcggcaacggcagcctgcaggacatcctgacgaattggggcgtgtccaattacacggtatacgactatctgtcgtggacccacgtgcagcaggacatccaggccaatcgccccttcgtgatccgctatggctggaccagcggcggcggccacttcatcgtcggccgcggttaccagaccggcagcggcggcaattacctgtacatgatgaacccgtggccgggcgagggcatgacctatgccagctacagcagcgtggtgtcggccagcgaccatgattggacgcataccctgcggatgaacgccagtccctga

SEQ ID NO: 3519 - DNA, 708 bp, Chromobacterium substugae
atgcagtccaaatccttgatcgcggcagtcttgttcagtcttgccgccctggccggcgggccagccggcgcgcaacccgcgccgttttccgtctcgtcgcaaaccgcggcggaggccgccgccgcggccagccgcggcctggcgcaattcgcccggcaaaatctgctggacttcggcgccaggttgccggcgggcttcccgctggatgtcgccgacgggcgggagctgcccgccctgcgcatcggccccggctttccggtgtacagcgtagacccgcagcaattgctggcgggcaacggcgacatcagccagctgatggcgccgaccggcagctggcgtttcgtcgtctatctgcgacagcaggcggtgggcctggtgacggtggagcaggtgggtggccattgggaggcggtatcgtatggcgccgccggattggccaagagcctggagtcgctgcaggcggcttatggcaacgccgaacgcagcaacacccgctttgtcagggtgtatcaggcgcaatccgacttcctcgaggtgagtccggccgggggcggcaaaccgcgcttcgccgcgctggcctcggcctacgcgtcgctggcgctcaaaccccaggcggccggcgccgtcggcaatggcctgatggatagcgccgacttcatcgagccgctgcgcgccgcggtgcgcaacaacctttcccgtttccgctga

SEQ ID NO: 3520 - DNA, 348 bp, Chromobacterium substugae
atgagcatctaccgtcacaagcagggcgcccgcctggccgaggccgtggtcagcaacggactgatcttcctggccggccaagtgccggaaaacaccgacgccgacgcccgcgcgcagacggaaaacgtgctggggcagatcgacgccctgttgaaggaactggattccgacaagagcaagatcgtcgacgtcaccatcttcctggccagcctggccgattacgacgcgatgaacgccgcctgggacgcctgggtgccggccggccacgtgcccgcccgcgccacggtggaagccaagctggccaatccggcctggaaggtggagatcaagctggtcgccgcgcgctga

SEQ ID NO: 3521 - DNA, 1143 bp, Chromobacterium substugae
atgaccgatttccacaccctggctgtgaccgccggcgcccacgaagacccgttcggcgcggtgatgccgccgatctacgccacctccacttatcgccagcgcgcgccgggcgagcacaccggctacgagtactcgcgttcgcagaacccgacccgcgaagcgctggagcgcgcggtggccgaactggaaggcggcgcgcgcggctacgctttcggttccggcctggcggcgatttccaccgtgctggaattgctgccggccggcagccacctgatcgcggtcaacgatctgtacggcggcacctaccgcctgttcgaaaaagtgcgcaaggccagcgccaatctggaagtgacctacgtcgcttccgaagacagcgccgcgctggaagctgccatccggccgaacacccggatgatctgggtggaaacgccgtccaatccgctgaaccagctggtggacctgcagcaggtatccgccatcgcccgccgccacggcctgatcggcgtggtcgacaacaccttcgcctcgccggtcaaccagcggccgctggacttcggcttcgacatcgtcgtgcattccgccaccaagtatctgaacggccactccgacgtggtggccggcgtggcggtggtcagccgcgacaagccggagctggccgaacagctggccttcctgcacaacgcggtgggcgccatcctggacgccttccccagcttcctggtgttgcgcgggctgcgcacgctggcgctgcgcatcgagcagcacaaccgcaatggcctggccgtcgcgcgctggctggaagcgcagccgtgggtggaaaaagtgctgtatccgggcctggagagccatccgcagcatgagctggcgcgccgccagatgcagggctacggcggcatcgtgtcgttctacctgaaaggcgacgtcaaggccttcctggccaagctcaagctgttcgcgctggcggagagcctgggcggcgtggaaagcctggtgtgcctgccggcggcgatgacgcacgcctccatcccggccgagcgccgcgccgcgctgggcatccacgacaacctgatccggctgtcggtcggcgtcgagggcgaggcggcgctgatcgccgatctggagcaggcgcggcgggacagctga

SEQ ID NO: 3522 - DNA, 1371 bp, Chromobacterium substugae
atgaaagacgattccgtcctgtcgctgataggcaatacccccttggtccgcgtctcccatctggacaccgggccgtgcgagctgtacctgaagctggagagccataacccgggcggttcgatcaaggaccgcatcgccctgacgatgatagaggcggccgagcgcgatggtttgctgaagcccggcggcaccatcatcgaggccaccgccggcaataccggcctgggcctggcgttggtggcggcgcagaaaggctatccgctgatcctggtggtgccggacaagatgagccgcgagaaaatcctgcatctgcaggcattgggcgcgcaggtgcggctgacccgctccgacgtgggaaagggccacccggagtattaccaggatctggccgcgcgcatcgccgcggaaacgccgggcgcctgctacatcgaccaattcaacaatcccgccaatccgctggcgcacgaaaccaccaccgggccggaaatctggcggcagatgaacggcgaggtggatgcggtggtggtaggcgtcggttccagcggcaccctgaccggcctgacccgctttttccgcgccaaggcgccgggcaccgccttcgtgctggccgatccggtgggttcggtgatggccgattatgtcgaaaccggcagcttcggccaggccggcagctggctgatcgagggcataggcgaggacttcattccgccgctgaccgacctgtccatggtgaagcgcgccttccgcatcagcgatcaggaaagcttcgataccgcgcaggaattgctgcgcgccgaaggcattctggcaggctcttcgtccggcgcgctgctggcggcggcgctgcgctattgccgcgagcaaaccgaacccaaacgggtggtcacgctggtgtgcgacagcggcaacaagtatctgtccaagatgtacaaccgcgactggctggtggaccagggcatgctgagcttgccggtagtgggcggtctgaccgatctgatcgtgcgccgccaccaggacggcagcaccgtgtcttgccatccggatgaggcgctgtctgtcgcctaccagcgcatgcgcctgcacgacgtatcgcagctgccggtgctgaaggacgacaaggtggtgggcatcctggatgaatgggacctgctgctgtcggtgcacggcgagccggagaatttccgccagaacgtcgacagcgcgatgagcagccatgtgcagacgctgtcgccgcaggcctcgctgcaggacttgctgcaggtattcaacgccggccacatcgcgctgatagtcgacaagggccgctatctgggcctgatcacccaggccgacttgctggcgttctggcgccgccagccgcgcgccgcctga

SEQ ID NO: 3523 - DNA, 828 bp, Chromobacterium substugae
ttgcaactggcggaaacgcaggccgatctgccctatatccatgggttttccgcggccgagcaggcgcggctggtgcgccaggcgcgcttttccgaagcgatggtgtatcgcgatgtcgatttctccggcgtggagcgcttgctggaggtgggctgcggcgtcggcgcgcaaaccgagatcctgctgcgccgctatccggagctggccatcaccggcatagacttcagccagcgtcagctggcggtggcgcgccagcgtttgcagggcagcccctatcacgagcgggttcgcctgcagcatatggacgccgaggacctggacttcgcgccggccagcttcgacgccgctttcctgtgctggatactggagcacgtgcatgcgccggagcgcgtgctggccgaggtgcggcgggtgctcaagccgggcgcgcggctgtacgcgaccgaggcgatgaacgcctccttcttcctggcgccgtattcccccaatctgcagcaatactggctggctttcaacgaccatcagctgtcggtgggcggcgaccccttcgtcggcgccaagctgggcaacatcctgcagcggcttggcttccgccaggtggagacgcaggtgaagacctggcatctggacagccgcgaaccgcaccgccgccagctggtgctggattactggaccgagctgctgttgtcggcagccgaccagctgatcgaggcgggcagggtggacagccagctggtggaaacgatgacgcgcgagttgcggcagttgcgcagcgatccggaactggtgttcttctatagcttcatgcaggcgagcgccgtggtctga

SEQ ID NO: 3524 - DNA, 1218 bp, Chromobacterium substugae
ttgtatctaaacaccggacgcatcgaatacatgaacctgaactggctcaacggtctcttggatctgccatggtggggcaatatcgtcgccgccctgatcctgacccacatcaccatcgcctcggtcacgattttcctgcaccgccaccaggcccaccgcgcgttggacctgcacccggcccccagccatttcttccgcttctggctgtggctgaccaccggcatggtgaccaagcagtgggcggccatccaccgcaagcaccatgcgcgctgcgaaacgctggaagacccgcacagcccgcaagtgctgggcatcaagaaggtgctgtgggaaggcgcggagctgtaccgcgcggcctgcaaggaccagtccatcatggacaagttcggccacggcacgccggatgattggctggagcgcaacgtctacagccgccacaacgccaagggcatcgtgctgatgctgatcatcgacctggcgctgttcgggccgatcggcctgtcgatctgggcggtgcagatggtgtggatcccgttctgggcggccggcgtgatcaacggcctcggccacttctggggctaccgcaatttcgagaacgaggacgcctccaccaatctggtgccctggggcattctggtcggtggcgaagagctgcacaataatcaccatactttcggcacttcggccaagctgtcgtataaatggtacgaattcgacatcggctggatgtacatccgcatcctggaaatgctgggcctcgccaccgtccgtaaggtggcgccgcaattggcgcaggatccgtcccgtccgcagctggacctggagcatctgcaggccatcgtcgccaatcgctacgccatcgccgcgcgctatgcccgcgagctgcgcgacgaataccacgccgagctgggcaagctcagtctgccggagctgccgcaggtgaatctgccgcgcaaaatgaaaatatggctgaagcaggacgccaaggacacgccggaggacgagcgcttgcaactggcccgtctgctcgagcaaagccaggttttggccaccatctacaatatgcgccaggagctgacccggctgtgggagcgctccaacctcagccgcgagcagttgctgaaggagttgcaggactggtgcgccagggcggaggcttccggaatcgccgcgctgcagcgcttctcgttgagtctgcgccaggccgcgctcgcctga

SEQ ID NO: 3525 - DNA, 123 bp, Chromobacterium substugae
gtgctgttcctgcagggtgtcttcggctttgacgcctgccaagtagctagaggctgcatacaggacaaacaggccaccgagggtggcgccggcaatgatcagtcgacgttttggcaacactag

SEQ ID NO: 3526 - DNA, 1590 bp, Chromobacterium substugae
gtgttgccaaaacgtcgactgatcattgccggcgccaccctcggtggcctgtttgtcctgtatgcagcctctagctacttggcaggcgtcaaagccgaagacaccctgcaggaacagcaccggatgctggccagcctgccgctgttcaaggtcaaatcgcacagctacgaacgcggctggttctcgtccaccgagaccaccgagctggtgttcaaccgccatttgtccggcccgtatgaaaacatgctgccggacaatatgaagcccttgctgaacgccaccatcaagttcaccaatcatgtccagcacggcccgctgcccgggctgtccggcttccacttccgtccgggctgggcgctggtgaagactgaattcgcgatgagcgactccacccgcaagacgctgaagaccttcttcggcgacaaggagccgatcaccatcaccaaccacatcggtttcagcggcggcggcctgctcgacgtcaacgtgcccgccttcgactacgaagaggcgctgtccggcgtcaagatgaagtggaagggcttcgacctgaaggtcgactacgccaacggctacaaggaatacaagaccgaggcgctgtcgccgggcttcctgctggaagccgccagcaagggcacggtgtcgttcgagggcgtccgctacctgtccgacatgcgcccgggcaacaccgacatcaagctgggcaccagcgagctgaccataggcaacgtccagctcagttcgcgcgagagcgtgccgtacagcatcaagctgaacgagctgatctacctgatgacccgcgtccgcgtcggcgaattcgtcaacccgtccggcgagttcaagccctcctcggtggcgctgaagaacttcagctaccagatcgtcaccagcgagcaggacgacttcatcaacagccgcggcaaggtcaacttcgccgagctgagcttcaacgccaaccgctatggcccgctgcggctggatgtggcggtcaatcacctgcacggccgcacgctggcccagctggacaaggccatcggccagatcccgttcgaaggcgtggacccggcggtgttgcgccgccagtacgtcgacaccctcaagaggaatatcgggcccttgctggaaaacagccccaaggtgctgatcaacgagttctacctgaagatgccgaccggcgaagcgacgctgcaggccagcgccggcatccacggcttcacctcggccgacctgaacgacttcacccagttggcgaagcgcttcaccgtcgaagccaaggccagcctgccgcggcagacgctggagaacctggtgcagacccagttccgcaacctgttcaccgtcgaccacaccgcggaagaccagccgaacatgcaggaagtggacgacctggccaagagcctgctggacagccagctggcgcaatggaaggcgcaggactacatcgtcgaggaaaacgggcagatctccaccgagctcaactacagcgcccagggcctgaccatccacaagaagaaggtcgccctgccctgggaggaaagcgaggagccgacggacgcctcggcgccggcggcctcgccggccaagaagtaa

SEQ ID NO: 3527 - DNA, 477 bp, Chromobacterium substugae
atgcaaggcgacaagaaggtcatcaaatacctgaatcagattctcaggaacgaactcaccgcgatcaaccagtattttctgcatgcgcgcatgttcaagaactggggcctgaagaagctcaacgagcacgaatacgaagaatccatcgatgaaatgaagcacgccgacaagctgatcgagcgcgtgctgtttctggaaggcctgccgaatctgcaggatctgggcaagctgcacatcggcgaaaccccgcatgagatgctgcagtgcgacctgaagctggagatggaggcgctgccgctgctgcgcgaggcgatcgcctactgtgaaaccgccaaggactatgtgacccgcgacctgctggaagacattctggagagcgaggaagagcatgtggactggctggagacccagctcgacctgatcgagcgcgtcggcatccagaactacctgcaaagccagatggacgacgcgtcctga

SEQ ID NO: 3528 - DNA, 177 bp, Chromobacterium substugae
gtgaccgacagccagatccgccaggccgtccatgccggcgccagccgcatgtgcgatctgcgccgcgagctgggcgtcgcttccgattgcggcaagtgcgcatgcatggccaaccaggtgcgcaaggacgcccaggccgaactggccgtctgctcggtggcccgcaccgccgcctga

SEQ ID NO: 3529 - DNA, 468 bp, Chromobacterium substugae
atgattgtcaataacctgcaaagagagtggaagcccaacgctaccgtcgccgccattgtcgaacgcggcggccgcttcctgatggtggaggaagacaccgccgacggcctgcggctgaaccagccggccgggcatctggaacccggcgaaacgctgctgcaggcggtggagcgcgaagcccgcgaggaaaccggctggcgctttacgccgcagggactgaccggcatctacctggccgaccgccccggcagcgacatcacctatctgcgcttcgccttccacggcagcgcggcgccgccgcaacaacccgccgcgctcgatgccggcatcgtcgccgtgcactggctcagccaccaggagatccaggcccagcaagcccggctgcgcagcccggtggtgctgagctgcctggccgactacatcgccggcgtccgctaccctctcgatctgatacgcgacctgcgctga

SEQ ID NO: 3530 - DNA, 588 bp, Chromobacterium substugae
atgccgccatgcctgacgccattgctgttgattctgctgtgcctgcttcccgccgccgcccgcgccgatggcttaaacatctgttatcattaccgttgttccagacaagcctactttgaaatttccgaagaggcccgcgactggctggccgcccgcctggcgcgcgccggctccgccgccgccgaacgcgaagtggtcagcgacgcagtcgtcgcgctataccgcatcgccgcgcgcgacactcccatctggcaggacaagggcggcaatttccatgacggcccggccgaaggccggatggattgcgtcgaccacagcagcaacgtcaccgcttttctcggctatctcgaccgacagggctggttgaaattccaccatgcggcgccacctgcatggagagcgccgtggatactggatctacattacaccggcgtgctgcacgacatcgccgccggccaggactgggcggtggacacctggttcagggatttcggggaaccgcccgtggtggttcccctttcgatttggatgaagggatacgagccgccggccgtgtccgcgcctgacgcgtcaggccagcaaaagtaa

SEQ ID NO: 3531 - DNA, 1077 bp, Chromobacterium substugae
gtgacgggtaagaaacgcatagtcgtcggcatgtccggcggcgtggattcgtcggtgaccgcctggctcttgaagcagcaaggccatgaggtgatcggcgtgttcatgcaaaactgggaagacgacaacgacgacgagtactgctcgatcaagcaggacgcgctggacgcgatgagcgtggccgacatcgtcggcatcgacatggaaatcgtcaacttcgccaaggaatacaaggaccgcgtgttctcgtacttcctgaaggaatattcggccggccgcacgccgaaccccgacgtgctatgcaacgccgagatcaagttcaaggccttcctcgactacgcgatggaactgggcgccgactgcatcgccaccggccactacgcgcgcaagctggaaaaggacggcacccactacctgatgaaggcggtggaccacaccaaggaccagagctacttcctgtaccggctgcagcagcaccagctggccaaagccatgttcccgctgggcgacatccgcaagaccgaggtgcgcaagctggccgaggaagccggcctgcccaccgcggccaagaaagactccaccggcatctgcttcatcggcgagcgtcccttccgtgaattcctgaaacgctacctgcccacctcgcccggcgccatggtgacgccggacggcaagacggtgggcgagcacatcggcctgatgtactacacgctgggccagcgcaagggcctgaccataggcggttcgcgcgacggcaacggcgagccttggttcgtcgccggcaaggacatcccgggcaaccggctgatcgtggtgcaaggccatgaccacccgctgctgctcaagcccacgctgtcgatggccgacctcagctggacgttgccggacgcgcccaagcccggcgactacagcgcgaaaaaccgctaccggatggcagacgccggctgcagcctgtctcctatcgtcgacggccaggccagcctgaccttccgcgaaaagcaatgggcggtgacgccgggccagtcggccgtgctgtacgacggcgacatctgcctgggcggcggcatcatccagtaa

SEQ ID NO: 3532 - DNA, 1251 bp, Chromobacterium substugae
gtgtccgcccccgcttcctccgcgctgccttccgccgttcttgccgccgcatccgcggcgggcaagctgcaggccggcacgccggctttccgctccacctcccgcgcgatgttcgtcggcggtttctgcaccttcgccatgctgtacagcacccagccgttgatgccggtgttcgctcatgatttcggcctgacgccggccgcggccagcggcgcggtgtcgatggccaccggcgcgttggccatcagcctgattcccgccagcctgctgtccgaccgcttcggccgccgtgcgctgatgaacggcgcgctgggcttggccgccttgctgatgctgctgtcggtcttcgtcgacggcttcgggccgtttctgttcttgcgcgccttgttcggcgtagcgctggcgggcttgccggcggtggcgatggcctatctgagcgaggaggtggatggcaagtcgctcggccactcgatgggcctttacatcgccggcaacgccttgggcggcatgtgcggccgcttcctggccgcggtgctggccgaccatttcggctggcgcggcgcgctgctggccttggcgctgctgggttgcgccggcgcctggctgttctggcgctggctgccgccgtcgcgccatttccagccgcggcggcaggattttggccggctgcggcgcgagctggcggcggtggcgcgcgacggcgggctgccctggctgttcctggccgccttcctgctgatgggctgtttcgtcagcctgtacaactacctgggcttccgtctgctggccgcgccgttcggcctgagccagagcgcgctggcgctggtgttttccttgtacgtggtgggcatctgggcatcggcctgggtgggcaggctggccgacaggctgggccgccgcaacgtgctgtggctgatggtggcgctgatgctggccggcctggcgctgacgctggccgacacgctgtggctgctggtgccgggcatcgccttgttcaccttcggcttcttcgccggccattcggtggccagcagctgggtgggcttgcgggcgagggaggcgaaggcgttggcttcggccctgtacctgtgctgctattacctgggctccagcgtgtacggctcggtttccggcctgatgtggggcggcggcggctggctgggcgtggcggcggcgttggcggcgggattgtcggcgctgctggcggcggcgttgtggctgcgccggctgcagccgttgtcgcagggctga

SEQ ID NO: 3533 - DNA, 885 bp, Chromobacterium substugae
atggaactcaggcatctgcgctatttcctggcggtggcggaagaactgcacttcacccgcgccgccgaacggctgcacatcggccagccgccgctgagccagcagatccaggcgctggaggcggaactgggggtggcgctgttcctccgccaccagcgcaaggtggaactgaccgccgccggccgccaattcctgccgcgcgcgcgacagatcctggccgacagcgccgccgccatcgcggccgcccgccgcgccgccaacggagaaaccggcgagctgcgcataggcttcacctcgtcgctgccgctgacgccgattctgcaccgcagcctgcaccgctaccgcgaggcctacccggatgtgcggctgaccttgcgcgaaatgttcaccgccggccagttcgaggcgctggaaaaaaagcagctggacctaggcttcgtccgtttcaacggcccgacgcccagcccgctgatccaggtggaagaattgcaccgcgaccggctgctggcggtattgccccttgcccatccgctctccggcgccgccagcctggcattggcggatctggcgcgcgagccgctgataggctatccgcgcgagtccggcgccggcctgcgcgacgtggtgctgcagctggcgcgacagaacgggctggagttgaacgtggtgcaggaggccggcgaagcgatcacccagatcggcctggcggcggccggcgtcggcatcgccatcctgccctcgccgctggaatgcgtgcagattccggcagtgcgctacgttccgctatcggacagcgacgcctacctggcgatgggcatcgccacccgccgcgacgaaacatcgccgctggtggcgcatttcctggccggcgtggccaaagactag

SEQ ID NO: 3534 - DNA, 741 bp, Chromobacterium substugae
gtggacggcaaggtagccctggtgaccggcggctcgcgcggcatcggcgcggcgacgacccggctgctggtcgccgccggctggcgggtggcggcgaactatcgcgccgacgaggccagcgccgccgcgctgaaaacggaactgggcgatgcggtggagttgttccgcgccgacgcgtcggacgagcgggccatcgtccgcctgttcgacgacgcgttgtgccattacggccggctggacggcctggtcaacaacgccggcgtcaccgcgccgatgtgccggctggaggattacagcgccgagcgggtggagcgggtgttgcgcgtcaatgtgctggggccgctgctgtgctgccgcgaggcggtgcggcgcatgtcgacccgccacggcggcgatggcggcgccatcgtcaacgtgtcgtcggccgcgtcgcggctgggctctgccggcgaatacatcgattatgccgccagcaagggcgcgatagacacgctgactctgggcctggcgcgcgaggtggcggaggagggcatccgcgtcaacgcggtgcgcccgggcttgatcgagaccggcatccacgccgccagcggcgaagcgggccgggtggcgcggctggcgccgtcggtgccgttgcggcgcggcggccgggcggaggaggtcgccgaggccatcgtctggctgctgtccgacgcggcctcattctgcaccggcagcctgctggacgtgtccggcggccgctag

SEQ ID NO: 3535 - DNA, 885 bp, Chromobacterium substugae
gtgcagcagcagatagacaccctggtggtggcgggcgtcggcctgatcggcgggtcgttcgcgctggccttgaagcgggccggacgggtgcgacgggtgataggcgtgggccgcacgctggccaacctggagcgggcgctggcgctgggggtggtggacgagatcagccaggacatcgccgcggcggcgccgcgcgccgacctggtgctgctggcgtcgccggtggggcagatgggcgccttgatggcggcgctggcgcccggcttgcgtcccggcgccatcgtcaccgacggcggcagcaccaagagcgatgtggccgcgctgtaccgccggcacctgcccgaccatctgccgtggtgcgtgccggcgcatcctatcgccggttccgacatgtcgggcgcggtggcggcccagtacggcttgtacgaaaaccgccgcgtggtgctgacgccgctggccgaaaccgcgcccgaggcggcggagacggtagcggcgttgtggcgcgcctgcggcgcggagatccacagcatgagcgccgccgagcatgacgcggtgttcgccagcgtcagccatttgccgcacttgctggccttcgcttatgtcgaccgggtggcggccaaggacaacgccgagcgctgcttcgatttcgccgccaccggctttcgcgatttcacccgcatcgccggcagccacccggaaatgtggaccgacatcagcttggccaaccgcgacgcgctgctggccgaactggccgactaccgcgccgggctggaacgtctgagcgccatgctggcgggcggcgacgccgccgggctccaacagcttttcagcgaggcgcgcggcgtgcgcacccgctggcatcagcaattcctgaggaggggctag

SEQ ID NO: 3536 - DNA, 264 bp, Chromobacterium substugae
atgaagccgacgctgtattgctatttcaaggttggagccgatcgcggcgcgctgctggaacagttgcgcgcgctgcacgcggaactggccgccgccggttggcccgggcagttgctgcgccgctgcgatgacgccgacacctggatggaggtgtatccggacattgacgaccgcgacgccttcctcgccgcctggctggctgcgcgccgccggcacgggctggagagcttggccgcgcatcaggaatggttccagccgctttaa

SEQ ID NO: 3537 - DNA, 1224 bp, Chromobacterium substugae
atggaagggcggcaggctggacaagctgacaagaggttgcctgtgaagttgatcctgaagttgctggccggcatggcgctaggcatcgcgctgggcctgtgcgcgcccgcgccgctgctgtcgctgttgctgacgttcaagggcctgttcggccaattcatcggtttcatgatcccgctgatcatcgtgttctacatcatgagcggcatcgccgcgctggagagcggatcgggccggatgctaggctggaccgtaggcctcgcctacgcgtccaccgtgctgtccggggcgctggctttcgccgcggcgtcgaccatcctgccgcaatgggtgggcgaggccgccgccgcgcccgccgccgcggcgcaggccgcgccgttgttcaagctggagatcaagccgctgttcgacgtgatgacggcgctgatgctggccttcgtgttcggcctgggcatcgccgccaccggcgcggcgcggctgcgcgagatagccgagcagggcaaggacatcgtcgagaaggtgctggcccgcgtgctggtgccgctgctgccggcctacatcgcctgcgtgttcgccgagatggccgccgccggcagcgcgctggacaccttgaagaccttcggcgcggtgctgctgttggcgatcggtctgcacgcgctgtggctggcgctgctgtacggcgccagcggcctgttgttggggcgcaacccgttcgcgttgctgcgggcgatgctgccggcctatttcaccgcattgggcaccatgtcgtccgccgccaccatcccggtggcgctgcgttcggccggcgccatgaaagtgtcggcgccggtggggaatttcgtgatgccgctgtgcgccaccatccacctgtgcggctccaccatcaccctggtcagctgcgccaccgcggtgatgctgatgaccggcggcctggcggtgccgggctgggaagtgatgctgcctttcatcctgctgctgggggtgaccatggtggcggcgccgggcgcgccgggcggcggcgtgatggcggcgctgggcattctgtccagcgtgctgggtttcccggaggccagcctggcgttgatgatcgcgctgtatctggcgcaggacagcttcggcaccgcctgcaatgtggccggcgacggcgtgatcgcgctgtgggtggaccggctggccggccgggccgggcagggctgcgccgcggcggcgccccagcgcggctga

SEQ ID NO: 3538 - DNA, 813 bp, Chromobacterium substugae
atggcgatgctggtcaacggcctgccggccgaggcggtgtcggcgctggaccgcggcctcgcttacggcgacggcgtgttccgcacgctgcagctgcgcgacggccggccgcggctgtggcgctggcagtacgcgcggctggccgacgacgccgcccggctggcattgccgctgccggacgagcaactgctgctggatgagctggcggcgctggggcgcgagcatccgctggcggtgggcaagatcacgctgacccgcggcgtcggcgcgcgcggctacgcgatggcggcggcgggcgagcccacccgcatcgtgtcggcggcgccatgggccggctacccggaggaatacggcgagcggggcgtgagcgcgcgctggtgcgaactcaggctgtccttgcagccccggctggccggcgtcaagcatctgaaccggctggagagcgtgctggcgcgttcggaatggagcgatccggccattcaggaaggcctgctgctcgaccaggacggctggctggcggaaggcaccatgagcaatgtgtacctgctgcgcgacggcgtgatccacacccccttgctggattgctgcggagtaaacggcgcggtgcgggattggttgacagaaaatgtttcaagtttcggacttgaatttacagaatcgagactttctcccgccgatttgattgacgctgacgcggtgtttctctccaatagcctgataggcctctggccggtggcccgcctgggcgaccgcgcctggacgccttcccctttgctgcagacgctgcggcaagccttattacaacaagcctga

SEQ ID NO: 3539 - DNA, 1293 bp, Chromobacterium substugae
atgttcacccagaaactcgacttcattcccgacctgctggccctgcatgccgcggaccgcgaacactttccctatctgatgcagtcgtccggcgacagcggctgggacctgctgctgatgcagagcgagcggcgcgtgttcatggcaggcgaggggcaggccttcctcgacgccctgcgcgcgttccgcccgcagccggtgtccaacccgcatgagctgccctttgtcggcggctggttcgtctacctggcctacgacctgctatccgaattcgagccgcatgtgccggccgccttgccggacagtttcccgctggcggtatgggcgcgcacgccggcggcggtgctggtggaccgcgcgaaaaacgaagcctggctggtcggcgaaagcgccgacgactggcacgcgctggagcgcttggtcgcgcgtcagcccgatttccagccgcggctggtggcgctggcggcgctggaggaggacccgcccgagtggtataccgaggcggtggcgcgcctgaagcgctacatctacgaaggcgacgtgttccaggtgaacatctcgcgcggctggcgcgccgaattggccgacggcatcgccgcgcccgacctgttcgccgccctgcgccgcgccaatccggcgccgttttcggcgctggccgacttcggcgatgcgcagatcgtcagctcgtcgccggagcggctggtacgggtgcgggatggctgggcggaaacccggcccatcgccggcacccacccgcgctcgaaagacccggccgaggacgccgaattgaaaaaacggctgatcagcagcgtcaaggagcgcgccgagcacgtgatgctgatcgacctggagcgcaacgacctgggccgcatcagccggccgggcacggtagaggtgaacgaactgatggcggtggccagctacgcttacgtgcaccatatcgaatccaacgtccgcggcaagctgcgcgacgaggtggcgccggcggatgtgctgcgcgcgctgttcccgggcggcaccatcaccggctgccccaaggtgcgcaccatgcagatcatccgcgagctggaaaacagcgcgcgccgggcctataccggcagcctcggctatctgaaccgcgacggcaccatggacttcaacatcctgatccgcactttcatgcaggaaggcaataagcttcgcttccgcgccggcggcggcatcgtcgccgactccgaccccgagcgagagctgcaggaaacccgccacaaggcgcgcggtttgctgcgcgcgctgggcgtggagcaggcctga

SEQ ID NO: 3540 - DNA, 1242 bp, Chromobacterium substugae
gtgtccaaacgcagagttgtagtaaccggcctgggccatgtgtccccggtcggcaatgatgtcgccaccggctgggccaatctggtcgccggcaagagcggcatcgccaagatcacccgtttcgacgccagcgacatggcgtgccagattgccggcgaggtcaaggatttcgacatcgcccaatacatctcgccgaaagaagcgcggcgaaacgacctgttcatccattacggcatcgccgcggcgctgcaggcggtgacggatgcggggctggacgacattccgggcttggacaagacccgggtcggcgtcaatatcggttccggcatcggcggcttgccgctgatcgaggaaaccggcgtggcgctgatggaaggcggcccgcgcaagatcggcccgttcttcatcccgggctcgctgatcaacctcatcgccggccaggtatccatcctgaagggctatcagggtcccagctacggcatcgtgtccgcctgcaccaccggcgcgcactgcatcggcgacgccgctcgcctgatccagtacggcgacgccgacatcatggtggctggcggcgccgaaggcgcggtatcgcgcctgggcatcggcggcttcgccgcgatgaaggcgatgtccacccgcaacgatgatccggccgccgcctcccgtccgtgggacaagggccgcgacggcttcgtgatgggcgagggcgccggcgtgctggtgctggaagagtacgagcacgcggtgaagcgcggcgccaggatctacgccgagctgatcggcttcggcatgagctccgacgcgcaccatatcaccgcgccgagcgccgagggcccggcccgcggcgtggccaacgcgctgcgcgacgccggcatcaacgccgacgcggtgcagtacgtgaacgcgcacggtacttccacgccgctgggcgacgccaacgaaacccaggcgatcaagatggctttcggcgaccacgccaagaagctggtggtcaactccaccaagtcgatgaccggccacttgttgggcggcgccggcggcgtggaggcgatctacaccatcctggcgatccacaagcaggtatcgccgccgaccatcaacttggtcgagcaggatgtggagtcgggctgcgatctggattacgtggccaacaccgcgcgcgacatgaagatcgaggtgggcatctccaactccttcggtttcggcggcaccaacggcaccctggtgttcaaacgcgtctga

SEQ ID NO: 3541 - DNA, 243 bp, Chromobacterium substugae
atggaaaacaacatcgaacagcgcgtcaagaagatcgttgccgaacaactgggcgtgaacgaagccgaagtgaagaacgaatcctccttcgttgacgacctgggcgccgactcgctcgacaccgttgagctggtgatggctctggaagaagagttcgagtgcgaaattccggatgaagaagccgagaagatcaccactgttcaacacgctgttgactacgttaacgcgaacctgaacaaataa

SEQ ID NO: 3542 - DNA, 738 bp, Chromobacterium substugae
atgagtctgcaaggcaaagtggcgctggtgaccggcgcctcgcgcggcatcggcgcggcgatcgccgacgcgctgctcgccgagggcgcggtggtgatcggcaccgccacctcggaatcgggcgcggccgccatccacgaacggctgtccgccaagggcggcgccggccgggtgctgaacgtgaccgaagacggcgcggtggaagcgctgatcgaatcggtggaaaaggaattcggcgccgtcgctgtgctggtcaacaacgccggcatcacccgcgacggcctgctgatgcggatgaaggatgaggattgggacgccatcatggataccaacctgaagtcggtgttcaaggcttccaaagccgtgatgcgcggcatgatgaaggcccgctccggccgcatcgtcaatatcgcctcggtggtgggggcgatgggcaatgccggccaggccaactacgccgccgccaaggcgggcatcatcggcttcaccaagtcgatggcgcgcgaggtcggcagtcgcaatatcaccgtcaattgcgtggcgcctggcttcatcgataccgacatgacccgcgcgctgccggaagcgcaacgcgaagcgctggttggccagatttcgctgggccgcctgggcgacgccaaggatattgccgatgccgttgtatttttggcgtcggaccgtgcggcctacattacgggccaaaccttgcacgttaacgggggtatgctgatgccataa

SEQ ID NO: 3543 - DNA, 930 bp, Chromobacterium substugae
atggcttttgcttttctgtttccgggtcagggctcgcaaagcctgaaaatgatggacggcttcgccgacctgcccgtggtgcaacacactttcgaagaagcgtccgacacgctgtcgctggacctgtgggcgatgctgcaggccgacagcgccgatgcgatcaacgccaccgtcaatacccagcccatcatgctggccgccggctatgccacttatctggcttggcaggagctgaacggcaagcagccgtcggtggttgccggccatagcctgggcgaatacaccgccctggtggcggcgggcgcgctgccgttcgccgaggcggtgaagctggtccgtttgcgcgccgaggcgatgcaggcggcggtgccggtcggcgtcggcgcgatggcggcgatcctcagcctgtccgacgacgacatccgcgccgcctgcgcagaagccgcgcagggcgaggtggtggaggcggtcaatttcaattcgccgggccaggtggtgatcgccggccacaaagccgccgtcgagcgcgcgatggagctgtgcaaggcgcgcggcgccaagcgcgcgctgccgttgccggtttcggtgccgtcccattgcgcgctgatgcgcccggcggcggaccgtctggccgacgcgctgcgggatgtgcatttgaacgcgccggcgattccggtgctgcacaatgccgatgtcgccggctacaacgacgccgagcagatccgcgacgcgctgacgcgccagctgtacatgccggtgcgctggaccgaaaccatccagaagctggccgccgacggcatttcgctgatggccgagtgcggcccgggcaaagtgctggcgggactcgccaagcgcatcgatggcgacgtcaagtgcctggcgttgaccgatcgcgccgcgctggaagccgcccgcgaccagctggcctga

SEQ ID NO: 3544 - DNA, 960 bp, Chromobacterium substugae
atgggctattcccgcattctcggcaccggcagttatctgccatcccaggtgctcaccaatgcgcaattggccgaacgcgtggataccagcgacgagtggatcgtttctcgcactggcatccgcgcgcgccatattgccgacgatcagcacaagaccagcgacctcgcgctgatggccgccaacgcggccatcgaaaacgctggcatagacaagcacgagatcgacctgatcatcgtggccaccaccactccggacatgattttccccagcaccgcttgcatcttgcaggaaaaactggggctgccgggcattcccgccttcgatgtgcaggcggtgtgcgccggcttcatctacgcgctctccacggccaacgcctacatcaagagcggcatggccaagaaagcgctggtgatcggcgccgagatcatgtcgcgagtgctggattgggacgaccggcgcacctgcgtgctgttcggcgacggcgccggcgcggtggtgctgggcgagtccgacgagcctggcatcctgcacgccaagctggccgccgatggccgctaccagggcctgctcaacaccccggcgcagatttccggcggcaagatccagggcatcccctacttgcacatggatggtccggcggtgttcaagttcgccgtcaaatccttgtccgacatcgccgtttccaccttgaaggaagccggcgtggacaaggccgcggtggactggctggtgccgcaccaggccaatctgcgcatcatcgaatccaccgccaagcatttgggcctggacatggcgcgggtggtggtgacgctgccatcccagggcaatacctcggccgcgtcgatcccgctggcgctggacgtggcggtgcgtgatggccgcattcagcgcggccacaccgtgctgctggaaggcataggcggcggtttcgcctggggcgcagtgctgctgacattttaa

SEQ ID NO: 3545 - DNA, 876 bp, Chromobacterium substugae
gtgcgtgagcgcatcctgatccagcacgccacccaggtggtgggcatggacgaggcgcctcagctcgccctcaagaataaaaaagattcgtcgatgcgggtggcgatcaatctggtcaaggaaggcaaggctcaggccgccgtgtccgccggcaataccggcgcgctgatggcgaccgcccgcttcgtcctcaagaccattcccggcatagaccgtcccgccatcgccaagctgctgcccaatgtcaagggcacatcctgcgtgctggatctgggcgcgaacgtcgattgcaccccggaacaactgttgcagttcggcatcatggggtccgaactgatgagctgcctgcaagggcggagccatcccagcgtcgggctgctgaatatcggcagcgaagacatcaagggcaacgacaatattaaaaagactgccgaactgctgcgccagtcggagctgaatttctacggcaacgtggaaggcgacgacatctgcaagggcacggtggatgtggtagtctgcgacggttttaccggcaatgtggcgctcaagacagctgaggggctggcgcacatgttcgccgtcttcctgaaggaagagttcggccgcagctggtggacgcgcttgtgcgcgctggccgcgctgccggtgctggcgctcttcaagaaacgcatcgatccgcgccgctataatggagccagcttgctgggcctgcgcggcatcgtggtgaaaagccacggcggcgccgatgtcacaggattccgttacgcgttggcgcaggcatgcgaggaggccggctccgacgtgattggtcacatcgccgaacgggttgcaaatcaattaaacaacctcaagcaatccgaggcagaagcgaactga

SEQ ID NO: 3546 - DNA, 180 bp, Chromobacterium substugae
atggctgttcaacagaacaaaaagtccccgtccaagcgcggtatgcatcgtgcccacgattttctgaccgctccggcactggcagttgaagccagcaccggcgaggcccacctgcgtcaccacatcagcccgaacggcttctaccgtggccgcaaggttgtgaagaccaagggcgagtaa

SEQ ID NO: 3547 - DNA, 912 bp, Chromobacterium substugae
gtggaacaccacggtgcggccgctcatccacttgagcatctccacgccgttttcaaagctgccgggcttgccgatctgcttgccgtccagcaaggcgacctggtcggagccgatgatcagggcgtcgcggtgcttgcccgccagcgattgcgccttggtgcgagccagccgcacggcggtttcgagcgcggtttcgccggccagcggcgtttcgtcgcagatgggcgcctcggcgctgaatggcaggccgaggcgggcgatgatctcttggcgatagcgcgaagtggaggccagtacgatttgcatgggttcggggtcgggttgcggcaaggccgggcgccggggcgggcgcttccgtccttgccttgtttctttcaaatcaggggaagtggattgcatgcgaggtttatgtctaaaccgattttgatcgacccgctcaagttcgcccgggaagggcgttcgcagtccggcctggtgccggtttgcgaactcgacgagcgtgtgcacagcgacctgtccgacacctccggcgaggtgtcgtatcagctcacgggctttcgtgacgagctgcagcgcttcgcgctgcgcatccagctggatgccaagctgcaagtcacttgccagcgctgcctggacggcatgccgttcagcttggccaccgattcggtgatcacgctgtttgccagccaggaaaagctggatgaagcctgcgagcaggacgaggagctggacgccattctcgccgagcccgaactgaacgcgattgcgctgatcgaagacgaaatcataatgggcttgccgcattcgcccaaacacgacgaatgcagcagggatactctctcgctcgccaaggctgacaagcccaacccgtttgcggtgctggcggcgcttaagagacccaagtccgagtaa

SEQ ID NO: 3548 - DNA, 705 bp, Chromobacterium substugae
atgagcggcaccttgtttttgatccccgcgccgctcggcgacgaaaacgtcgcctggctgccggaaggcgagcgcgccaaggtgatccacatcacccacttcgtggtcgaggcggaaaaaaccgcgcgcaagcatctaaaagcattgggcgtaaccgcgccgatccgcgagctggccatgagcacgctgaacgaacacaccaaggaagcggatgtcgccgcgctgctggcgccgctgcaagccggccacgacgtcggcctgatctccgaagccggctgcccggcggtggccgatcccggcgcgcagctggtggcgctggcccaccggcatggcatccgcgtcgagccgctgatcggcccctcgtccatcctgctggcgctgatggccagcggcgccaacggccaatgcttcgccttccacggctacctaccggtggatgcggcggaaaaggccaaattggtgaaagaactggagcagcgctcgcggcagcgcaacgaaacccagctgttcatcgaaacgccttaccgcaacaacgcgctgctgcagcaactgcgcgagacgctggcgccctccacccggctcgcggtagcctgcgacctgaccctgccgacgcagaccatcgtcagccatcgggtgcaggattggccgcaaaacccgcccgatctgcacaagcggccggccatcttcgtgatccacgccgcctga

SEQ ID NO: 3549 - DNA, 1209 bp, Chromobacterium substugae
atgcccaagaacacgcccatcatccagtcgctgctggataccgatctttacaagttcaccatgctgcaagtggtgctgcaccagttcccggccgcgcacggcgaatacgagttcaagtgccgcaaccatccggacacgccgctgacccagctgaaacagcaattggaaacccagctcgaccacctgtgccagctgcgcttcagccaggatgaactggactatctgcgcggtctgcgcttcatcaagagcgacttcgtcgattatctggagctgttccatctgcagcgccgcttcatcgaagtggcggaggaaggcgagcagttggccatccgcatcaaggggccgatggtgcaggcgatgttcttcgagatcttcgtgctggccatcgtcaacgagctgtatttccgcccgctggacaaccagaaagtgcgcgaagaaggccgccgccggctggaggccaagctggcggaactggagcgcttccagcgcgaggaggcggcggaacagcgcttcccgctgctgatcgccgatttcggcacccgccgccgcttcagccgcgactggcaggagcacgtggtggaaaggctgaacgccgcgctgccggaaatcttccgcggcaccagcaatgtccatctggcgcgcaagctgggcatcacgccgatcggcaccatggcgcacgagttcttccaggccttccaggcgctgggcgtgcggctgcgcgacttccagaaggcggcgctggaatcctgggtgcaggaataccgcggcgacctcggcatcgcgctgaccgacgtggtgggaatggacgccttcctggcggacttcgacctttacttcgccaagctgttcgacggcctgcgccacgacagcggcgacccctacatctggggcgagaaagccatcgcccactaccgcaagctgcgcatcgacccggccagcaagatgctgaccttcagcgacggcctgtcggtggatagcgcgctgcagctgcaccgccacttcagcccgcacatccaggtgagcttcggcatcggcacccacttcaccaatgatatgggcctggagccgctgcagatcgtgctgaagctggtcagctgcaatggccagccggtggccaagctgtccgacagccccggcaagaccatgtgcagcgacgaaaccttcctcgcctacctgcgccaggtgttccgcatcgccgcgccgcagtag

SEQ ID NO: 3550 - DNA, 855 bp, Chromobacterium substugae
atgcggacgctgacggtgatcggccccggacggttgggcagcagcctggcgcgcttggcgcggctgtctgggcagtttgaggtggtggatgtgatggccaggcggatgccgccgttgttgcgggcttgcgaattcatcggcgcggggcgggcggtgagcgatatgcatcagctggcggcggcggatctgtacttgctggcggtgccggacgcggccatcgcattctgcgccagggcgttggccgccgctggggtggtgccggccgggagcgtggtgttccacgctagcggcgcgggagagtccgcgctgctgcggccgctggcggagcagggcgcgcatgtcgccagcctgcacccggcgttctccttcgccgacccggagcgggcggtggcggggtttgccggcactttgtgcgcgctggagggcgatgaagaggcctgctcgcgcctggagggtttcgccgcggcgctgggaggcaggccgttccggctggggccgggcggcaaggcggcttaccacgccggcttgtcggtggcgtccaattttctggtggcgctgctggaaatggcggaaggcctgacccgccaggctggcgtgccggatgggctggctgcggatttgctgggcgggctgatgcggcaaacgctggagaacgcgctgctgctgggaccgcatgcggcgttgaccggccccatcgtgcgcggcgacgtcggcacggtggagcggcacttgtcggtgctggaagatgcggagctggcgtccgcctaccgggcgctgggccggcaggcggtggcgctggccggcgacaggttgccggcgcaggcgcgccagcagttgatggcgctgctttattga

SEQ ID NO: 3551 - DNA, 1143 bp, Chromobacterium substugae
atgaaaaaaagtctgattgccctgctggtagccaccctgccggctgcagcttttgctgacgtaaccatctacggtaagatcaaaggcggcgttgagtacaacgacaacggcgtaaccaagcaaaccaacatcgacgatctgggttcccgcatcggcttcaagggtgctgaagatctgggcagcggcctgaaggctatctggcaagttgagaccggcttcggcattgatggcaccggcaccggctcctccagcggcaccttcgccaaccgcaactccttcctgggcctgcaaagcaacctgggtaccctgcgcttcggcaacgtgtccaacttcctggacagcgacatgggcacggttgacacctgggaatacaacagcaacgcgctgggtctgggcatcttcacccgcgacgctacccgcctgaagaactccgtacgctacgacctgccggccgtggttccgggcctgaccgccgccctgcaatacggcgccaaggaaaccaagggccaagcatctgccgatcgcgaaacctacaacctgggcctgggctacgagaacagcggcttcttcggcaagtacaactacagccacgaaagcaaagcggttagcagcgttgccgttgtcgtagacaaagccactggcaaaatcgaatcggttggcgtagtagatgccaaccacactgcagttgccagcttcgcccagaatgacactgctaacgagaagcaccgcctggaagttggctacaatgccaacaacctgttcgttggcttcggctaccagcaagccaagggcggcctggatgtagttggcagcgcttggggcaaccaagttatcgctggcttcgcagtaccgaatggccaaaccatcagcgcgaacggcaaggttaagactcgcgaatacgctctgaccgctggctacaccttcggcgccatcaccccgaaattcacctacgctcacggcgacaaggttgaagtcggcggcgtgaagctggacaacacccaatacgaccagtacgtactgggcgctgactacgctgtatccaagcgcaccaccatcggcgctcaatacggccagatcgctgtcaagggcaccggcaacaacgacctgaagtccttcggcctgaacatggttcacgcattctaa

SEQ ID NO: 3552 - DNA, 651 bp, Chromobacterium substugae
atgcaaaccagacgaacacagcaaagccgcagggagtccaccataggcaaactggtggaggcggcgatcgaatgcctgatggagtgcggctaccacggcaccagcgtgcagttgatctgcaaccgcgccggggtgtcgcagggcgcgctgttccgccatttcgccaccaagaacgaattgatgcagccggtggggcgcaaggtggtcgacgatatcttcgaggccggcttggccctggccggcaagctgccgcccggcatgccggaagaagagcgcatcgtggcgctgatgaaggcgctggtgatggcgccgcgccatatcgtgctgctggagctgctgatggcggcgcgcaccacgcccgatctgcgcgaaatcttcctcggcaacgccagcatctatttccgcgaccgcttcgtcgcgatgatggcttcgctattcccgcgctacgccatttccaccggctttttcgccaccttgctcaccatgatgaccaccatgcacggcatggcgctgtaccgcacgctgtccgagcatccggatggcgataaaatgcgcgagcagtggttgcaaaacgcgctgcgcagcgagctggagcgcatccggctggagggcgcggatagccgcaacccggtgtatcagctgccgttctga

SEQ ID NO: 3553 - DNA, 1584 bp, Chromobacterium substugae
atgaaaaccatcaacgccctgctgttggcggcgtggctgccggccctggccgtcgccgccaagccgctcaccgtttgcaccgacgccaatccggaaggcttcgacgtggtgcaatacaactcgctggtcaccaccaacgcctccgccgatgtgctgatgaatcgcttggtggagtacgacgccgccagcggcaagctcaagcccggcctggcgcgcagctgggaagcgggagcggatggcctgagctataccttccacttgcgtcccggcgtgagctttcactccacggaatacttcaagcccagccgcgctttcaacgccgacgacgtggcattcactttcgagcggatgctgaatccggacaatccctggtacaagaccgcgccgacgggctatccgcatgcgcaggcgatgcagtttcccaagctgatcaaggcggtgcgcaagctggacgcgcagacggtgcgtttcgagctcaactacccggaagccaccttcctgtccagcctgaccatgggtttcgcctcgatctactccgccgaatacgccggccagctgctggccgccggcaaaacggccgatctcaacagtaagccggtcggcaccgggcctttcgtcttcaagagcttcgccaaggacgcgcaggtgcgctacctgccgaatccggcctatttcggcggcaagcccaaggtgtcggcgttgatctacgccatcacgcccgattccgcggtccgtttgcagaagctgcgcgccggcgagtgtcagatcgcgctgtcgccgaagccgcaggacgtgcaggcggcgcagggcgatggcaagctgcgggtatggcaggcgcctgccttcatgaccgccttcgtcgcgttcaacagccagaaaaagccgctgaacagcccattggtgcggcaggcgatcaatctggctttcgacaaggccagttatctgaaggcggtgttcggcaataccgccgtcgccgccaacctggtgtatccgcccaacacctggagctacgacaaggccatcaagccttatccgtacgatccggcgcaggccaggaagctgctggcccaggccggctaccccaatggcttcgatgtcggcatctgggtgcgtccgggcggcagcaccctgaaccccaatcccaaggccggcgccgagatgctgcaggccgatctggcgaaagtgggcatccggctgcagatcaaggtgctggagtggggcgagctgatcaagcgcggcaaggccggcgagcacgaaatgctgttcatgggctgggccggcgacaacggcgatccggacaacttcctcacgccccagttttcctgctctgcggtgcagtccggcaccaatttcgcccgctattgcgatccgcggctcgacaagctgatagccgacggcaagaaaaccagcgacttcaaggccagagccaagctgtatcaggcggcgcaaaagctcatccacgagcaggccttgtggctgccgctggcgcatcccaccgccttcagcctggcgcgcaaggatgtcagcggctatgcggccaacccctatggccgagtcgatttctccgcggtcagcctgaagtga

SEQ ID NO: 3554 - DNA, 1950 bp, Chromobacterium substugae
ttgctggaggccctgggcctgccgctatggattttcgatatcgatcacaagcgcgtgttctgggccaatcaggccgcgctgcgggtgtggggggcgcgcagcctggccgagttgcagcagcgcgacatgtcgcttgacatgtcggtttcggtggcgcaacggctgggccagtatcagcaggacttcgagcgggaaaacgccagcttcgtcgaaagctggaccctgtatcccaatggccgcccctgcgtgctgaaggtggcgttccgcggcatccgcgccgacgggcgggtgatgatgttctgcgaagcgcagaacccgctgagcgccgatccggccagcttgcgcagcgcggaggccttgatgcacacctcggtgccgatcacgctgtacgactccgccgggatggcgctgtaccgcaatccctccgcccgcgcccaggtggcggatgccggcgagcgctggcgccagcatttcctccacgacggcgattggcaggcgctgcagcagggcgtggcggcggtcggggaggcgcgccaactggcgcgcgtgcatacccggcggggcgagcgctggcacgagatcgccgtgcgcgcttgccgcgacgcggtgtccgggcaggacgcgctgctggtcagcgaggtggacatcaccgatctcaagcatgccgaagcgcgcgccagcttcctggccaatcacgacgtgctgaccggcttgcccaaccgcaacggcatccgcagcgatttcctgccctatctgcagcaggccctgcgcaatggccgccaggcggcgctgatgttcatcgatctggaccgcttcaaaaacgtcaatgattcactcggccacgcccgcggcgacgagctgctggtgggcatgaccgcgcggctgtcccggctgctgcggcatgacgagaaggcggcgcggctgggcggcgatgagttcctggtgatgctggcggcgccggacgccgcggggcgggcggaagcgctggggcgggacatcctgcaggcgcttggcatgccgatccgtctgggcggcatggacatcagcgtgtcggcgtccatcggcatcagcgtgtgccgcgacgggacgctggacctcgagcagatgatgcgccacgccgacctggcgatgtatgcggccaaggatgcgggccgcaacaacctgatgttcttcacgccggcgctggaggcgcgcacccaggcgcagctggcgctggagagcgatatccgccgcggcctggagcagggcgagttcgtcgccggctttcagccgcgggtggatgtcgccagcggcaaggtggtcggcgccgaggcgctggcgcgctggaaccatccgcaacgcggcctgctgaagcccgacagtttcatccaggtgtgcgaggacagcgggctgatcctgcaactgggacggcagatcctggcccaggcgacgcggcagcagcgcttgtggcgcgagatgggactggacttgatggtgtcggtcaatctgtcgccgtgccagttcgtcgacccggcgctgccggcgatggtggccgccgtgctggcggacagcggctgccaggcggacaggctggagctggagatcaccgagtcggtgctgctgggccatgacgatcagaccatgcgcaccttgcaggcgctgcgggcgcagggggtgagcatcgccgtcgacgatttcggcaccggctattccaatctggcctatttgcagcgttacccgctcagttcgctgaagatagaccgttccttcatcgcggatctggacagcacgccggccatcgccgaattgatcatcaccatgtgcaggatgctggggctgaaagtggtggcggaaggggtggagacgccgaagcagctggcctggctgcggcagcgaggttgccaggagtaccagggctatctgtgcagcccggcgctggcggctggcgagttccacaagctgttgttgtga

SEQ ID NO: 3555 - DNA, 675 bp, Chromobacterium substugae
atgctgggaaatatcgtcggcatgagcggggtgagtgaaatgggaatcgctaattttgacgctttctatcgcagcaatggttctttctatggcgaccggccagccttgtcgctgatgtattttctggacaaattcgatgtgcggggcggcgggcagggactggacttggcctgcggccagggacgcaacgccttctatctggccagcctcggtttttcgatgtacggcgtggatgaatcttcggaggcggtttcccgcatgggcgagctggccgaccagcgccggctgtcggtgtgcggcaaggtggtgaacctggccgacctggagatcgagccgcaaagctaccgcatcatcgtcgcctataccgcgctggatcacctcgacgccgccgccggcgaacggctggcccagtccatgatggcggggctggagcccggcggctacttgttcgcggcggtgttcatggtggatgaccctggctgcagcggcagggggggcgatgtcagcgaaaccgccgcctatgtccgccattactaccggccgggcgagttgcgcgaacagttttccgcgctggcgccgctggcttaccaggaggagtacgcgctggatctcagccacggccggccccatcatcacagcatggccaggctgttcgcctgcaagcaagccgcctga

SEQ ID NO: 3556 - DNA, 2853 bp, Chromobacterium substugae
atgtcgctctccgcactcttcaatcgcaacgaattcatcgcccgccacatcggcccgtccgacgacgagcgcgccgagatgctggccgccatcggcgcggcctccatcgacgcgctggtcggcgaaaccctgccggccgacatccgcctgaaccgcgcgctggatctgccggcgccgcagccggaagccgaggcgctggccgccctgaaagcggtggccgccaagaacgtggtcaacaaatccttcatcggcctcggttactacccggtgaagacgccgtccgtgatcctgcgcaacgtgctggaaaacccgggctggtacaccgcctataccccgtaccaggccgagatcgcccagggccggctggaggcgctgctgaacttccagcagatggtgatcgacctgaccggcctggaaatggccaacgcctcgctgctggacgaagccaccgccgccgccgaagcgatggcgatggccggccgcgtgtccaaatccaagtccacgcgcttcttcgtcgacagccgcgtgctgccgcagacgctggacgtgatgaagacccgcgccaagtacttcggcttcgagctggtgcagggccatccggaagaggccggcaacggcgattacttcggcgcgctgttccagtatccgggcgaagccggcgatctgatcgacctgaccccgcatatcgccgccatcaaggccaagggcggcgtcgtcgccgtcgccgccgacgtgatggcgctggtggccttgaagtcgccgggcgagatgggcgccgacatcgcgctgggcaatacccagcgcttcggcgtgccgatgggcttcggcggcccgcatgccgcctatttcgccttcaaggacgagatgaagcgctcggcgccgggccgcatcatcggcgtctccatcgacgccaagggcaagaccgcgctgcgcatggcgttgcagacccgcgagcagcacatccgccgcgagaaggccaactccaatatctgcaccagccaggtgctgctggccaatatcgccggcttgtacgcggtctaccacggcgccgagggcgtcaagcgcatcgccgcccgcatccaccgcttggccgccatcttcgcccacgcggtgcaggccgccggcggcaagctggtgttcgaccgcttcttcgacaccgtgcaggtggacgcgcccaaggccgacgccatctacgccgccgcgctggcggccggctacaacctgcgccgcgtgggcaagaccgtgttgggcgtggccttccacgaggccgccaccgaggcggatctggccaagctgatcgagctgttcaccggcaagcaggcagatatcgccgccttggacgccgccgcccaggatgcgatcccggccgcgctcaagcgcgaatccgcgatcctgagccacccggtgttcaatgtgcaccatagcgagcacgagatgctgcgctatatgaagaagctggaaaaccgcgacctggcgatgaatcattcgatgatcagcctgggcagctgcacgatgaagctgaacgccaccagcgagatgattccgatcacctggccggaattcgccaatatgcacccgttcgcgccgcgcgagcagaccgtgggctatctggaaatgatcgccggcctggagaagcagctgcgcgcgatcaccggtttcgacatcatctcgatgcagccgaactccggcgcgcagggcgagtacgccggcctgttggcgatcagccgctaccacgagtcgcgcggcgaagcccatcgcaacatctgcctgattccgcaatcggcgcacggcaccaacccggccaccgcgcagatgatgaatatgcaggtggtggtggtgaaatgcgatgaggccggcaacgtcgacgtcgccgacctgaaggccaaggcagaacagcacgccgccaacctggccgcgctgatgatcacctatccgtccacccacggcgtgttcgagcaggccatcaagcagatctgcgaaatcgtccacgcccacggcggccaggtgtacatggacggcgccaacctcaacgcccaggtgggcctgactcgtccggccgacatcggcgccgacgtgtcgcatatgaacctgcacaagaccttctgcatcccgcacggcggcggcggcccgggcatgggcccgatcggcctgaaggcgcacctggcgccgttcatcgccaaccacgtggtggcgccggtgccgggcgcggaggcaggccaaaccgcggtatccgccgcgccgttcggctccgcctccatcctgccgatatcgtatatgtacatcgcgatgatgggcgccgagggcatgaagcaggcaacggaaaacgcgttgctgtcggccaactacctagctacccgcctgggcgagcactacccggtgctgtacaccggcgccaacggccgcgtcgcccacgagtgcatcatcgacttgcgcccgctgaaggccgcttccggcgtgaccgaagtggacgtggccaagcgcctgatggactatggcttccacgcgccgaccatgagcttcccggtgccgggcacgctgatgatagagccgaccgaatcggagccgaaggccgagctggaccgcttcatcgccgcgatggccgccatccgcgccgagatcgaccaggtgcagaacggcgcatggccggcggacaacaatccgctggtcaacgcgccgcacagcaaggccgacattgcgggcgactggaaccggccgtacagccgcgagcagggcctgttcccgctgccttacgtgctggagaacaagttctggcccagtgtgaaccgcatcgacgatgtctacggcgaccgcaatctggtctgcagctgcccgggcatcgaaaactacatgtga

SEQ ID NO: 3557 - DNA, 387 bp, Chromobacterium substugae
atgagcaatatccccgccgaactgaaatatgtggaaagccacgagtggctgcgtctggaagccgacggctccgtgactgtgggcatcaccgcgcacgcgcaggaattgctgggcgacatcgtgttcgtcgaactgccgaaagtgggcgcggccctggcccgcgacgagcaggccggcgtggtggagtcggtgaaggccgcttccgacgtctactgtcctatcgccggcgaaatcctggcggtgaacgaagagctggaaggcgagccggaactggccaacagcgagccctacggcgatggctggttcttcaagatcaagccggccaacgccgccgatctggatggcctgatggacgccgccgcctacgccaaggaaatcggcgcctga

SEQ ID NO: 3558 - DNA, 1089 bp, Chromobacterium substugae
atgacggccccgaaacgtaccccgctgtttgacgcccacgtcgccgccggcgcgaaaatggttgatttcgccggttgggaaatgcccatccactacggctcccagctgaaagagcacgagatcgtccgctcggacgccggcatgttcgacgtttcccacatgacggtgatcgacatcaccggcgccgacgccaaatcctggctgcaaaaactgatcgccaacgatgtcgccaagctcggtttcgagggcaaggcgctgtattccggcatgctcaccgccgaaggcaccgtcgtcgacgatctgatcgtctatctcacttcctatggctaccgcatggtggtcaatgccggcaccaccgaaaaagacctggcctggatggaaagccagaaggccggcttcgacgtggcgctgcaagtgcgccgcgatttggcgatgctggcggtgcaaggcccgcaggccattgaaaaagtctgctccatcaagccggagctggccgatgccatccgcgcgctgaaagtgttccagggcctgccgcaggacgagtggttctacgcccgcaccggctataccggcgaagacggcctggaaatcatggtgcctgccgatcaggccatcgccttcttccatcaattgcaagccgccggcgtcgcccccatcggcctgggcgcgcgcgacacgctgcgcctggaagccggcatgaacctgtacggccacgacatggacgaaaccgtgtcgccgctggaggcgggcatgggctggaccatcgcctgggagccggccgaacgcaagttcaacggccgcgaggcgctggaggcgcagaaggccgccggcgtgaagatgaagcaggtgggcctggtgctggaaggccgcggcgtgctgcgcgaaggcttgaaggtagtggtggagggcgtcggcgaaggcgtgatcactagcggcaccttctcgcccacgctgaagcattccatcgccatcgcccgcgtgccggccgccaccggcgccacggccctggtggacctgcgcggcgcgctgaccgatgtgcgcgtggtgaagatgcccttcgtgcgcaacggcaagaaagtattcgaataa

SEQ ID NO: 3559 - DNA, 1332 bp, Chromobacterium substugae
ttgagcgaaaacagttccatccaaaagaaaggctcgctcggggtctggatgtgcaccgccctggtggtgggcaatatgataggttccggcgtgtttctgctgccggcctcgctggcgccgttcggcggcatctcgatgctgggctggttgctgacctccggcggcgcgatctgcctggcgctggtgttcgcgcgcctgtcggccatcctgccgcgcgaaggcgggccgtatgcctatattcatgccggcttcggcgatttcgccggtttctggatcgcctggggctactggatcgcgctgtgggccggcaatgccgcgctggcggtggcggccaccagctatatgcaggtgtttttccccatcctcggccataacgagccgctggccggcgctttcgccatcagcctgatctggatcgtcacctggatcaacagccgcggcgcgcgcagctccggcatggtggcggtggtcaccacgctgttgaagctgctgccgctggccgcggtgacgttcatcggctttttccacatgcatccggaaaacctggccttcaatccgcacggcaagccgctgctgtcgtcgctgtcggccaccatggcgctgacgctgtgggccttcttgggcctggagtcggcatcggtgccggcgggcgatgtcgtggagccggaaaagaccattccgcgcgcgacggtgatcggcaccttgctggcgaccgtgctctacattttgtccaccatctcgctgatggggctgatgccggccgacacgctggccgcgtcgcaagcgccgttcgccgacgccgcccggctgatgtggggcgactggggctattgggcggtgggcttcggcgcggtggtgtcctgcttcggcgcgctcaacggctggagcctgatgcaggcgcatgtgccggccgccgccgccaaggacaagctgttccccagccgcttcgcccagcgcaacgccgccggcgtgcccatcttcggcctggtgctgtccagcgcgctggtcaccatcctgatggcgatgaaatacgccggcggcgacagcggcgtgaagatcttcgaattcatcatcctgctggccaccgccaccacgctgctgccgtacgctttctgctcgatggcgctgatcgccatcatgctgatgcgcggcaaggcgttcgcccccaaggactacgtcgcccccggcttcttcgccggcatcggcttcgtctattcgctgtgggcattgtacggttccggcgccgataccgtgatgtggggcatgctgttgctgatgctgggcctgccggtctacgtctggcagttgaaggagcggcacgcggcggcttga

SEQ ID NO: 3560 - DNA, 897 bp, Chromobacterium substugae
atgtccaagtcatcataccggggccgtttcgcccccagccccaccggcctgctgcatgccggctccctcagcaccgcggtcggcagttatctggaggcccgcagccgcggcggcgaatggctgctcagaatggaagacctcgacccgccgcgggaaatgcccggcgcggccgacgacatcctgcgcacgctggaggccttcggtttcgaatgggatggcgaggtggtttaccagagccggcgccacgagcgctatcgcgccgccctgctgcagttggccgccagcggccatgcctacgcctgctgctgcacccgcaaggaaatcgccgcggccgcccggcgcggtctggacggctatgtctatcccggcacctgccgcaacggctgtcccggcggcagggaaggccgggcctggcgcttgcgcgcgcccgaccgggatgtgtcggtgatggatcgtctgcagggcgaatgccggcagaacctggccggcgacatcggcgatttcgtgctgctgcgcgccgacggcttttgggcctaccagttggcggtggtggtggacgacgccgagcagggcgtcaatgacatcgtgcgcggcgccgacctcctggtgtcgacgccgcgccagctgcaggtttacgacagcctgggcctgccgccgcccggctattgccacctgccggtgctgaccaacgccgccggcgagaaattgtccaagcagacgctggcgccggcgataagcggcggcgacgccgcgcgccagctgcgcgcggcgctgggctggctgggccatccgccgccggccgagtgcggcaggctggacgaactgtggcgttgggccatcgccaattggtcgctgagccgcgcgccgcgcggcccgctgatcctgcctcatgcataa

SEQ ID NO: 3561 - DNA, 324 bp, Chromobacterium substugae
atgacgtacgttgtaaccgatgcctgtatcaaatgcaaatacaccgactgcgtggacgtgtgcccggtggactgcttccatgaagggcccaacttcctggccatcgacccggaagaatgcatagactgctcgctgtgcgtggcggagtgcccgattagcgccatttatgccgaggacgacttgcccaagggccaggaaaacttcctggccctcaacgcggaattggccaagaactggccggtgatcaccgaaaagatcgatccgctgcccgaccatgccgactgggccgaggtgaaggacaagctgcaatacctggaacgctga

SEQ ID NO: 3562 - DNA, 606 bp, Chromobacterium substugae
atgaacttccccggcgcgatggatggcaaccgctattacgacaagcatttccagacgatggcggtgaaggtgttccccggcgaattccacgccaccaatcagcggctgatgctggtgacgctattgggctcctgcgtggcggtgtgcttgagcgatcgcaccgccggcgtctgcggcatgaaccacttcctgctgccggaaggctcgctggatctgggcgccggcgcttccgcggcgcgcttcggcgtcaacgcgatggagttgctgatcaccgacatgcagaagctgggggcgatgcggcaccggctggaggctaagatcttcggcgcggccaatgtgctggagggcatgaccgtggtgaacgtcggcgagcgcaacagccagttcatccgcagctacctcgccaacgagcagattccggtgctggccgaagacttgctgggcgagtgcgcgcgcaaggtgtatttcttcaccgaaaccggcagggtgctgatcaagaagctgaagcgcagcggcgtggcggtcaaggccgagcagccctaccgcggccgcatcctggaacagggcgaaggcgccaagaccggcgacatcgatctgttcctgtga

SEQ ID NO: 3563 - DNA, 1065 bp, Chromobacterium substugae
atggcggtcatccggagcaagatcagggtggtggtggtcgacgattcggcgctgatccgcagcctgctcaccgccatcatcaacggggcgccggacatggaggtggtggcgaccgcctccgaccccatcctcgcccgcgagcggatacgggaaaccagcccggacgtggtgacgctggatgtggaaatgccgcgcatggacgggctggagttcttgcgccggctgatgcggctgcggccgacgccggtattgatgatctcgtcgctgacggcggcaggctccgaaaccgcgctggcggcgctggagctgggcgcggtggatttcgtgcacaagccggcagaggatgtcgcgcgcagaatgccggactatgcggaggaaatccgcgccaagctgaggatggcggcggccgcgcgtctgcgccagccgatgcgtttcccgccggttccggttggcatgctggctggcccggacgccgggcgcgcgctgattttcgtcggcgcctcgaccggcggcaccgaggcgatcaaggagtttttgctgggcatgccggccaattgtccgcccatcctgatcgtccagcacatgccggaacatttcactttcaccttcgccgcccgcctggaccggttgtgcgcgatgcgggtgacagaggccagggatggcgagccggcgcaaatcggcgcggcttacatcgcgccgggccactcgcacatgcgggtgaggccgggcgggccgaccggctatcagatcgcgctggaccaaggcgaaccggtcaaccgtcatcgcccggcggtggacgcgctgttcgattccgccgcgcggcatctgcgcggcaacgccatcggcgtgctgctcacagggatggggcgggacggcgccgccggcctgttgcggatgcgccaggccggcgccgtcactttcggccaggacgaggccagctgcgtggtgtacggcatgccgaaggaagcggtcaaggcgggggcggtgatgcacgtctgcccgctggcttcgctggcgttccgggttgtcgagtgtctgcaactgcatggcgaaaggatgacatga

SEQ ID NO: 3564 - DNA, 843 bp, Chromobacterium substugae
atgatggacgagaccgagctgaaattcaccggcagcgatttccggcgggcgcgggacatgctctaccaaaaggccggcatcgcgctgcacgactccaaaaaacacatggtctacgcgcgcctggcgaggcgggtgcgctcgcgcggactgcgcagtttcggcgaatacctggacctgctgcagcaagaccaggaggagggcgagtggcagggtttcatcaatgcgctcaccaccaacctcacgtccttctttcgcgagccgcatcatttcgagatgctgcgcgagcatgtccgccgacgccggccggcgggggagacgtttcgggtgtggagcgcggcctcctccaccggagaggagccgtattcgatagccatcaccttgctggagtcgtggcgcgagtccggcggcggcgctttcgagctgctggcgtcggatatcgacacccaggcgctggcgcaggcggcgcgcggcgtttatccgctggagcgagtcgtccagcttgcgccgcatctgctgaaacgctatttcgacaaaggggcgggagccaatgagggcatggccaggctcaagcggcaggcgcgggaggccgcgctgtttttccagttcaacctggcggcgtcgacatggcccgatatcgggcgtttcgacgtgattttctgccgcaatgtgctgatctacttcgacaaggccacccaggcggacatcctgtcgcggatggcgccgtgcctgaagccggatggcctgctgttcctggggcactcggaaaacatctcgcatctgaccgaggccttcgccggctgcggcaggacggcctatcggctggcgcgcccggacggcggctag

SEQ ID NO: 3565 - DNA, 3174 bp, Chromobacterium substugae
atgagcgacatgaagctgaagcatcagctggcccttggcttcgggctgctgctggcggcgctagcggcggctttgttcctggcgcaggcgcaattgcgcggccagcaggcgcgcgacgacgatgccgccgccggccggctgatccaggccgggcaattggcgctggcggggcgggcgcaggatgccggcgcccaattggttctgcgcgtggccggcctgctggccggcggcgacggcgcgcaatggcgggcagagcagccgcgggtcgacgccgcgctggaggcggcgatgacggggctgagcgcgttgacggcccatgccgccggcgacggcaaaccgctgctggaggccgcgcgcgaggccggactcgccgtgcgcggccagatcgccgactaccgccggctggcggctgcggcccatggcgacgaggcgcggatctatctgcgcgcctcgctgtggccggcagcgcaaaaataccaggaggcggttggccgctatgcccgcttcgagggcgagcagtcgctgcggctggccgcggcggaggcgggcgcatcgtccggccgcgccgcggacggagtcgcggtcgccggcgcggcgctggcggcgctggccgtcgcgctgtactggctgttggcgcgggctctggagaggcagttgggcggcgatccgcgggtactggcgatggtgctgcgcgaattggccggcggcgaggtgcgcacggcgttcaatgtgcgcgacggcgacgacagcagtccgttcgcctttctgcgcgccgcggtgtcgcgctcgctggagaacatgcggctgcgcagcgcgctggatgtgtgcaccactaatgtgatgatcgccgacggcgagcatcaggtggtgtacgccaaccgggcggcgctggacatgttccagcaggcggaggcggacatccggcaggagctgccgcagttttccgcccgggcgatcctgggctgcagcatagacagcttccaccgcaatccctcgttccagcgcggcttgctgcaggatttgcgaggcacccatcgcggcaccatcaaggtgggcggacgcaccttccatctggtgttgacgcctatcctggatggacagaaccgcaagctgggcgcggtggtggagtgggtggacgccacgcgcgagctggagcggaaggcggaagaggatgcgcgcctggccgccgaccgcctggcggcggcggagaacgcccgcatccgcagcgcgctggacgtctgcaccaccaacgtgatgatcgccgacgcggagcataagatcatctatgccaacggttcggcgctggcgatgttccgcaacgcggagccggacatacgcaaggatattcccagcttttcggccagccggctgctgggctccagcatcgacgaattccacaagaatcccggctaccagcgcggcctgctggcgcaggcgcgggacacgcaccgctcgtccatcgcggtgggcgggcgcaccttcggcctgatcctgtctccggtggtcggcgccaagggcgagcggctgggttcggtggtggaatggcaggacaacaccgagatgctgcggctgcagcaggaggcgcagcaacggatggaccaggagcgcgcgcaggccgccgaaaacgcccgcatccgcaacgcgctggacaattgcaccaccaatgtgatgatcgccgacaacgagcgccgcatcatctacatgaaccacagcgtcaccgacatgctgcgcagcgtggaggccgatctgcgcaaggcgctgccccatttcgacgtgcgccggctgttgggcaccagcatagacgagttccacaagaatcccgcccaccagcgcgagctgctggccaatatgcgcgccacttaccgcgccgagatcgtcgtcgccggccgcacgttttcgctggtgtccaatccggtgttcggcgccgacggcgcgcggctgggttcggtggtggagtggaaggaccgcaccgctgaagtggagatcgagcgcgaggtggccggcatcgtcagcgccgcttccgccggcgagttcggcaaacgcatcgatgtggagggcaagcagggctttttccgcttgctgagcgaaggcgtcaatcagctgatgggggtgaccagccagggactggccgatatcgccggcgtgctgggcgcgctggccggtggcgacctcacccgcagcatatcggccgactaccagggcctgttcggccagctgaaggccgacagcaacgccaccgtcgacaagctgaaggagatcgtcgccaatatcaaggactccaccgacacgatcaacaccgcggcgcgggagatcgccgccggcaacgccaacctgtccagccgcaccgagcagcaggcggccagcctggaggaaaccgcgtccagcatggaggagatcaccagcacggtgcggcagaacgccgaaaacgccagaaaggccaattcgctggcgataggcgcgtccgacatcgcggcgcggggcggcaaggtggtgggcgacgtggtgtcgacgatgaacgagatcaacgacagcgccaagaagatagtcgacatcatcagcgtgatcgacggcatcgccttccagaccaatatcctggccctgaacgcggcggtggaggcggcgcgcgcgggcgagcagggccggggcttcgcggtggtggccagcgaggtgcgcagcctggcgcagcgctcggcggcggcggccaaggaaatcaagtcgctgatcggcgactcggtggacaaggtggagtccggcagccggctggtggacgaggcggggcggaccatggacgagatcgtggtgtccatccgccgggtggccgacatcatgagcgatatctcggcggcctcggccgagcaaagttcgggcatcgagcaggtcaacctggcggtcacccagatggacgaaaacacccagaagaacgccgcgctggtggagcaggcggccgcggcggcggagtcgctggaagagcaggcgcgctatttgtccggcgcggtggcggtgtttcggctggatgaatcggggcgaagcggccagccgccgcagacgaggccgctcgccagccggcagccggcggcgtggacattcgccgccaagggacggggtccggcgcgggcgctggagcctatccgtccgccgcgggacgcggacgacgggacatgggaggagttttga

SEQ ID NO: 3566 - DNA, 483 bp, Chromobacterium substugae
atgccgatggacaagcctaacgacgcccaggcgcgcgaactgctggtgttcacgctgggcgacgaagaatatgcgattgacatactgaaggtgcaggagattcgcggctacgacgcggtgacgcggatcgccaacgcgccggacttcatcaagggcgtgatcaatctgcgcggcagcatcgtgcccatcgtcgacctgcgcttgaaattcggcctgggcgacccgcagtacaacgccttcaccgtggtgatcatcctgaatctcggcaagcggacggtgggcatggtggtggacggcgtgtccgacgtggtccagctgggccaggaggcgctgcgcgcgccgccggagttcggcgccagcgtcgataccgcctatatcgaaggcctgggcatggtggacgagcagatgatcatcatcgtcgacatcgagcgcctgatgaacagcgaagagatggcgctgaccgacgcggcggcccggtcctga

SEQ ID NO: 3567 - DNA, 2109 bp, Chromobacterium substugae
gtggccatcgatatgtcgcagtttcaccaggttttcttcgacgaggcggatgagcacctggccggcatggaatcgctgctgttggcgatcgatgtcggcgagccgcaggcggaagacctgcatgcggtgttccgcgccgcgcattcgatcaagggcggcgcggccactttcggtttttccgacatggcggacctgacccacgtgctggaaagcctgctggaccgggtgcgcaagggcggcgtgaagctgactgcgcagatggtggacgttttcctgcaagccaaggatgtgctgcacggcatgctggccgcccacaagggcggcgcgcgcgccgacccggaacgcgccgaggcggtgcggcggcggctgcgggacatcgaagacagcgccggcggcgagccggcggcggcgccggcgctggtcggggcggcgatggcgcctgggcaggagcggatctggacgctgtttctcgaattgtcgccggcggagggccttgatatgcgccggctgctggactcgctggccgcccatggcgacctgaccgtggtgcagcagggcgcggcgcaggccgggctgccctgggtggcggtattcacgtctgcgctggacgccggcgaggtggccgagtcgctggctttcatgctggcccccgagcagttccgcatcagcgtcgatcatggctgcgaggaaggcggcggtttcggcttgttcctgtcgggcgacgccgcggccgccgcagcggagggagccggctccggcttcggtttgttcgagccgccgccgccagcccgcggcgccgatatcgagggcgagggcttcggcttgttcgccgaagcgcccggcgtggtcaaacccgcgccagccgccgttgcgcaggcggacaaggggccggcggccggcgagagctcgatccgggtcaatatcgaaaaagtggacctgctgctcaatctggtgggcgagctggtgatcacccagtcgatgctggtgcagtccggcagcgcgctcgatccggccgagcatgagcgcctgctcagcggcatcggtgccttgcagcgcaattcccgcgaactgcaggaggcggtgatgtcgatccggatgacgccgatcgccttcgtcttcaagcgatttccgcgagtggtgcgcgacttggccggcaagcttggcaagcaggtggagctgaaaatggcgggggagaacaccgaactggacaaaagcttcgtcgagaagctgtccgaccccctgacccacttggtgcgcaacagcctggaccacggcatcgaatctcctgcagtccgcagcgaaaagggcaagcagccggccggcaagctgacgctgcgcgccttccatcagggcggcagcatcgtcatcgacgtttgcgacgacggcgccggcctcgaccgcgagcgcatcctggccaaggcgcgcgagcgcggcatggaggttcacgacgccgcgtccgaccaggaggtctggaacctgatcttcgaggccggtttctccaccgcggcggaagtcaccgacatctccggccgcggagtcggcatggatgtggtcaagcgcaatatccagagcatgggcggccgcatcgaaatcgactcgatgctggatgtcggcaccaccatcagcatccgcctgccgctgacgctggcgatcatggacggcatgtcggtgcgggtgggccgggagatttatgtgctgccgctgggttgcgtgctggagtcgctgcagccggcgccgggcgagatcaagaccatcgccggccgcggcgaagtggtgcgcatccgcggcgaatacctgcccatcgtcatgctgggccggcatttcggcgtggcggacgccggctgcgccgccaccggcgggattctggtggtcgtcgaggcatcgggcgggcgggcggcgctgctggtggacgacctgatcggacagcagcagttcgtggtgaaaaatctggaaacccattaccgcaaggtggacggcctggccggcgccaccatcctgggggacggccgggtggcgctgatcctggatatcgcaaccatagtccgcagccacggcggccagcgcgggccggccagcgccgtcgcgccggccgagacgggcgcagggtag

SEQ ID NO: 3568 - DNA, 366 bp, Chromobacterium substugae
atgtcgaagaaaatccttaccgtcgatgattcggcgtcgatccgccagatggtcagcttcacgctgaagagcgccggatatgaggtagccgaggcggcggacggcaaagccgggctgggcaaggcgctgggcgcgcagttcgatctggtgctcaccgaccagaacatgccgggcatggacgggctgacgctgatccgctcgctgcgcaagcagcccgcctacgcggccacgccgatcctgatgctgaccaccgagtccagcgatgaaatgaagacgctggggcgagccgccggcgcttccggctggctggtcaagcccttcgacccccaacggctgctggatgtcgtcaagcgcctggtcggttag

SEQ ID NO: 3569 - DNA, 153 bp, Chromobacterium substugae
atgggatttccgctagcaaatgattccgatcgatgcgatcgccgccgccaggcctgctggccgggaccggcggatggcgtcatcggcaaacacggcagccgcgccgtcgccgtctttcgccgctcggccaatcccgctcatcattttatgtga

SEQ ID NO: 3570 - DNA, 312 bp, Chromobacterium substugae
atgagaccgatagtcaaagtggaaggcggcattggccggatcatcctgatcgggcagttcgatttcaatctgcaccgagaatttcgccaggcaggccaggagttgctggacaataacgcggtgaaaatcatccgcatcgatatggaacaggtgccgcaaatagacagctcggcgctgggcatgctgctgctgttgcgggagagagcggccatgaaccggatgactatggagatagtcaactgccagccggcggtgaagcaggtgtttgagatcgccaatatgtccacccatttcaacttccagttcgcctaa

SEQ ID NO: 3571 - DNA, 276 bp, Chromobacterium substugae
atgcggctgattgggcagttcgacttcaacttgcacaaggatttccgccaggccagccaggagttgctggacaatccggcggtgcaggagattcatgtcgatttcgaccaggtgccctttctcgacagttccgcgctggggatgctgctgctgttgaaggagcgcgccgccgggcagaagaaatcgatgatcttgatcaattgccgggaggcagtgatgcaggtgtttgaaatcgcctgcttcaacaagatgttcaccatccgccccgcgtcctga

SEQ ID NO: 3572 - DNA, 1158 bp, Chromobacterium substugae
atggtttcaagcctgaaggatcagcagcaactggaggcggcatttgagcagttcaatgcggtttccagccaactcattgatgcatataggcaacttgaggttcaggtcaacgttttgaacgcccaattggacgaggcgaacaatcagttgcgcaaacagcgcgacgagaatgccgcgttggcggaacgtttggcactgttgcttaaagtgctgccggccggcgtggtggagctgtcgccggaaggacgggtcatcgcggagaacctggcggcggagatgctgttaaatggctgttatataggtgaaatgtggtcggatttcatgaccggcctgcagcgttcggaattggacgatacctatgccttggaacagggcggcgagtcgcgccggctgacgctgcaataccaggatctgccggcttcgggcgggcggattgtgcttattcacgatgtcacccggctgcatcagctgaccagcgagctggcgcagcagcagaaactggcctcgatgggcagcatggccgcggcgctggcgcaccagctgcgcacgccgctggccagcgcgatgctgtataccgccaatctgaagcaggatattccgcggccagaggaccgcgcccgcttcgtcgacaagagcctggccaggatgcgggcgctggagggcttgatccagaatatgctgagctatgtgcgcggccagatttcgtcgctggagatggtggaggtggccgcgctgttggaggatgtctgttcggtaatggcgccgcaatgccatgacaaaggtgtgatttttgattgccatctgccggcggagtctgccataacggtcttgatagaccgcaaagcgttgcagggcgccttgctcaatctgctggaaaacgcgctgcagttcacgccgccgggcgcgatggtggcgctggcggtggagaagctgcgggacggcgtggttttccgcgtcgacgatggcggtccgggggtagacgccgcggtggccgacaagattttcgagccgttcttcaccatgcgcccgggcggcaccggcctggggctggccatcgtgaagaaggtggcggaagaactgggcggcaatgtacgttgttacaacaggacgtcgggcggcgcctgtttcgagttgaagctgccggtctgccgggagtaa

SEQ ID NO: 3573 - DNA, 954 bp, Chromobacterium substugae
gtgtcagagcttctcaaaaaaatcgacgccagaaccaaactggcaggcaccaacaagctggaaatcctgctgttttccctagggcatgatcagcgtaccggccgcaaggaagtttttggtatcaacgtgttcaaggtgcgcgaagtcatgcgcacgccggaaatcacgtcggcgccggaaatgccgtcctcggtcgaagggatggtcagcctgcgcggcgcgctggtgccggtgatcgacctggcgaaatacgctggcattgtgaccagcaaccgcccggaaatcatgatagtcactgagtacaacggccacactcaaggcttcctcgtcgaggcggtcgacacaattctgcggctggactggtccgccatgcgcgtgccgcccgacatgatcaccaaccgcatggccggcctggtgaccgcggtcaccgagctggacaacggcacgctggtgatgatgatggacgtggaaaaagtgcttgccgaaaccagcatcgtcgatgacgggcacagcttcatcaatatcgaaccggtaaaggaagagcgccgcatcttcttcgccgacgacagcgcggtggcgcgcaagcagatcgagcgcacgctggaagcgatgaacatcaagtacacctcggccatcaacggcatgcgcggctgggaagacctgcagaaaatggccagccaggccgaggccgccggccgccagctgtgcgacgaactgcatctggtgctgaccgacgtggaaatgccggaaatggacggctacatgctgaccaagatgatcaagagcgatccgcgcttctccggcatcccggtgctgatgcactcgtcgctgtccggatcgtccaaccagaagctcggcgagtcggtcggcgtcgactcctacgtcgccaaattcgagccgcagaagctggccagcaagctgcgtcagatgctgaaactggaaccgagcaactaa

SEQ ID NO: 3574 - DNA, 942 bp, Chromobacterium substugae
atgcctagcaccgacgcctccttgcttgccactgttgacgccaggaccaagcttgccggctccaacaagatggagattctgctgttctctctgggaacccgcgagacattcggcatcaacgtgttcaaggtgcgcgaagtctcgcagacgccggccatcaccaagacccccaacatgcccttcggcgtggagggggtgctgtcgttgcgcggcaacatcattccggtcatttctctggccaagttcatcggccatgacaacaacggcagcaagttcgacaccatgatcgtcaccgaattcaacaagagcacccaggccttcctggtggactcggtggaccgcatcatccgggtggattgggacaaggtgcgcgcgccggaaaacatcatggcggcggcgggcaccaatcaaaacctgatcaccgccgtcaccgagctggaaaacggcaagctggtctccatcctcgacgtcgagcagattctcgccagcgtcgtcggcgagccgcgcctgccggacgtgccgaccgcccagctggaaatcgaccagtacatcttcttcgtcgacgactcggtggttgcccgcaaggaaatcaccggcgtgctggaaaaaatgggcatcaagttccagcaggccaccaacggccgcgaggcctgggaccgcctgcaggtgctggccggccgcaactggggcgaaggcgaatgcctgcacgactacctgaagatcattctggtggatgccgaaatgccggaaatggacggctacgtgctgaccaagctgatcaaatccgaccagcgtttcaagggcattccggtgatcatgcactcgtcgctgtcgtccaacgccaaccgggcgatgggctccagcgtcggcgtggattcctatgtggcgaagtttgacccgggcgtgttggcagaaactttgattccattcctgcaaaggtag

SEQ ID NO: 3575 - DNA, 396 bp, Chromobacterium substugae
atgtcagacaagaatatgaaatttctggtcgtggacgacttctccaccatgcgaaggatcgtccgcaacctgctgaaagagttgggtttcaccaacgtcgacgaggctgaagacggccaggtggcgttgcacaagctgaaaacccaaagcttcgacttcgtcgtttccgactggaacatgcccaatatgacgggcattgagctactcaaggcagtccgggccgatcctcagctcaagcatctcccgttcatgatgatcaccgccgaggccaaaagggaaaacatcatcgaggcagccatggcgggcgccagcggctacatagtgaagcctttcaccgcggccaccatggaagagaaaatgaacaaaatcttccagaacatgaacaagccagcctga

SEQ ID NO: 3576 - DNA, 741 bp, Chromobacterium substugae
atgttggagaatggagactcgccagagctcgaagccctgtttgaaagcgttgcgcgccagcagcaggatcaggagccgccggccgccgcgccggcaggcgaagagaccgcttccaagatgttctcaagtgaaaccaatccctccacgatgtacgaacacatcgggcagatgacccgcaagatgcatgacgcgctgcgcgatcttggatatgacaaatcgctggaaagggtagccgaaaccattccggatgccaaggaccggctggcctatatcgcgacgctgaccgaaaactcggccgagcgcgtgctgaacgccaccgacatcgccaaaccgttccaggacaatctcgaacgccaggcgcaagcgctcagcgaacgctgggaaaagctgttcgccaacctgctgagcgtggaagaattcaagaacctggcggccgaaacccgacaatacctgaaggacgtgcccagccagacccaggcgaccaatacccagttgctcgaaatcgtcatggcgcaggacttccaggacctgaccgggcaggtcatcaagaagatgatgggcatggtcaagattctggaaaccgagctggtcagcttcctgatcgagttctctcccgacgagaaaaagggcgagctcaacagcagcctgctgaacggccccgtcatcaatccggaaggccggaccgacgtggtcaacagccagcagcaggtagacgatctgctggaaagcctgggcttctga

SEQ ID NO: 3577 - DNA, 1884 bp, Chromobacterium substugae
atgagcgaatttggcggcatggaagagttgttaggggacttcctgatggagtccaccgaccttctgtccgatgtggacaacaaactggtcgaactggaaaagcgtccggaagacaaggcgctgctcaatgatatcttccgcggtttccataccatcaagggcggggcgggctttctcaacgtcatccccatggtcaacctgtgccaccgcacggaaaacctgttcgacaagctgcgcaacggcgagctgcacatcacctcggaagtgatggacgtgattctggacgcgaccggcatcgtgcgcgacatgttcggcaccctgggccagggcctgatgcccggcgacgccgacccccgcatcttggccgcgctggatgccgcgctggcgggcgagccgctgaccgaagccgcgcccgccgcgccggagccggccgtccagcaagccgctccggccgcagtccctgccgccggcagcccggactggaatcagttgtaccaggcagtcgctcccgcagccgccgctgcggcccccgcggcagcgcctgccgcgccagtcgccgccgcggcaccggcgccggcgcgagtggatgccccgcctccggccgccaagccgccggcgccgaagcctgcgcagcaagccaagcccagcggcaacgctcccgccgccagcggcccgcaggaaaacaccatccgcatcgatacggtgcggctcgacatggtgctcaacctgtccggcgaaatcggcttgaccaagaaccgcctgaccacgctgcgcaccgaaattctgcaaggcaaccgcgacaccaacacgctgcgctcgctggacgaagccatcagccagctggacctgctggtgggggatctgcagaacgcggtgatgaaaacccgcatgcaacctatcggccgcctgttccagaaatatccgcgcttggcgcgcgacctggcgcgccaattgggcaaggaagtggaactggtgctgtccggcgaggaaaccgagctcgacaagaccatgatcgaggatctgaacgatccgctggtccacctggtccgcaacgccgtcgaccatggcatcgagtcgcctgaggaccgagtcgccagcggcaagaagccgcaagcgctggtgcaattgaccgcagaacaggtcggcgaccacatcctgatcgagatcaccgacgacggcaagggcatgaacccggacgccctgcgccgcaaggcgatcgaaaagggcctgatcgatcaggaaaccgccaactcgctggacgagaagcagtgcctgcagctgatcttcctgcccggcttttccaccaaggaccagatttccagcgtgtccggccgcggcgtcggcatggacgtggtgcgcaccaacatccagaaactgaacggccgcatcgacatcaactcggtaggcggcgaaggcacccgcatcagcatctcgctgccgctgaccctcgccatcctgccagtgctggtggtgcgcgcctgcaatcaaccgttcgccgttccgctcgccatggtgcgcgaaatcatcaccatcgacagcggcgccatccaggaggtctcgggcaagcccaccatcgtggtgcgcgatgaaatcctgccgctgaagacgctggccggcctgctgggctgggcgccgacgcagaagccatacttcggcgtgctgatgcagtccgcggaaaagtccttcatcctggcgatcgactccttcgtcggccgcgacgacgtggtgatcaagccgctgcagaacatccgccccaaaggcgtcgccggcgcgacgctgtccggcgatggctcagtcgtgctggtgctcgatatggaagacctgctcgcctccagcgaaagcaacaacaccacggtgcggacgacggatgtgattgccacctaa

SEQ ID NO: 3578 - DNA, 1224 bp, Chromobacterium substugae
atgacctcaaacactgccttcatcggacggcagccggttctgaaccgcaatcagcagctcataggttatgagctgctttttcgtcccagcggcgacgcagtgggcgtcggcaagcacaccgagctgcaggccgacaccgacgtattggtgaacacgctcaacaatatgggcaccagctggctgataggcaacaagctggccttcatcaatatcggcgagacgatgctcaacagcgagttccttgagctgctgccgccgcgccgcatcatcctcgacatctcgccgcgcatcgtgcccagcaacgagttgctgtcgcgcgcgcgccatctgcgcgcgatgggtttcggcatcgcgctggacgacttcagcttcgaatcgccggccgccgccttcctcgaactcgccaactacgtcaagctggacatccaaaaccaggacaccacccgcttccagatgctggcggcgcggctgcgcagctacccgctgatccgcattgccgaacgggtggaaacccacgcccaattccacctgtgcaaggagctgggcatggacggcttccagggctattacttcgccaagccggaaacgctggccgccaaggtgatccaccccaccttcagcaacaccctggagctgctcaacctgctgcggctggatgccgacatccgcgacatcgaacaggtgctcaagcgcgacgtggcgctgtcctacaagctgctgcgctacgtgaactcggcggcggcggggctcaacacctcgatcagctcgttctcgcacgccgtcaccgtgctgggttaccagaagctttaccgctggctgaccctgctgctggtcaccgcctccgacgacaaccatgcgccgccggcgctgcagaaaaccgcggtcacccgcggccgcttcatggagctgctgggcatcacgctgggcgaacgccacgacgtcaacgacaatctgttcatcgtcggcctgttcagcctgctggacgtgctgttcgacatgccgatggacaagatcatcgaacatctgcaactgcccactcccatcaccgacgcgctgctgcacgagcgcggcgccatgagccactacctgcggctggccaaggcctgcgaggacggtgggctagatggcgtgccgcaattgtgcgaccaactggggctctccagcgaacagctgaaccaggcccacatctccgcgctcgcctgggtggaggaactgggcttataa

SEQ ID NO: 3579 - DNA, 444 bp, Chromobacterium substugae
atgagcgtggtccgcccgttcagcccggacgatccgcaacgactggccgatatcgagcggcaagccgccgggcacgcctggagcgctggccagtaccgcgacgccatcgccgccggctacccatgctacggcgtattcgacgacagcgacgcgctgcaaggcttcatgctggtgatgcgcgcgctggatgaagctgagatcctcaacatcgtcatcgccaaatcgaatcaggggcaagggctgggtcgccagttgctgcggcacgcgatgctggacctcgccgcctccggctgccgccgcctgtttctcgaagtgcgcgaaagcaacgcccccgccctgcgcctgtaccagcattgccagttccgccagtgcggcatgcgcaaacactattacccgacccaggatggccgcgagcacgccatcctgatggaggccgccctgtga

SEQ ID NO: 3580 - DNA, 852 bp, Chromobacterium substugae
gtgagccgcaacagcctgctgcagcaaaccatgggcctgggcccggcttggcagccgcgcgacggctggttcgaacaacacccggcgctgctgctgcgcgcccaggccgccgccctgcccgatgccgaaccggaaacctcggccccagccatcgacgtcgcgccgcaagtcgccatcgcctccatcccggcggaaacgcccaaggcggaaacgctgcgcgagcccgcccagccgcagccggcgcccgaaatggcgcccgcccctgccgcccgcagcgaaatgcccctgctcgactggccgcagctggagcgccaggttgccgactgccagcgctgccgcctgtgcgaaacccgcatccagacggtattcggccgcggcaatcccaaggcgcgctggctgctgataggcgaagcgccgggagaacaggaggacaggcagggcctgcctttcgtcggcaaggcaggacagctgctcgacaatatgctggccgccaccggactcgatcgcgagcaggacgtctacatcgccaacgtgctcaaatgccggcctccgggcaaccgcaatccggccccggatgaaatcgccgcctgccacggctatctgcagcagcagatccgccacatccagccgacgctgatcctggcgctgggccgcttcgccgcccaaaccctgctgcagaccgaggaatcgatcggccggctgcgcggccgcgtccaccgttaccaggacgtgccgatggtggtcagctaccatcccgcctacctgctgcgcaaccagccggacaaggccaaggcttggcaggacctgctcttggccaggcgcatcttccagcagaccgccggccgcggctga

SEQ ID NO: 3581 - DNA, 156 bp, Chromobacterium substugae
atgcgcgataaaatcaagctggaatccactgctggcaccggccacttctacaccaccaccaagaacaagcgcaccatgccggaaaaaatggagatcaagaagtttgatcccgttgcccgcaagcacgttctgtacaaagaaaccaagctgaagtaa

SEQ ID NO: 3582 - DNA, 291 bp, Chromobacterium substugae
atgtctggctttatttatgttataaatccagcttttaccggttttgggagtttaaccatggcgcgtgtttgcaaagtcaccggcaagcgtccgatgaccgggaacaacgtttcccacgccaacaacaagactaaacgtcgtttcctgccgaacctgcaatatcgcaagttctgggtggagagcgaaaaccgctgggtgcgcctgcgcgtatccaacgctgcactgcgtaccatcgataaagttggcatcgatgtagtgctggctgatctgcgcgctcgcggcgagatctga

SEQ ID NO: 3583 - DNA, 1641 bp, Chromobacterium substugae
atgaccaagtacatcttcgtaaccggcggtgtggtgtcctccctgggtaagggcattgccgccgcgtccatcgccgccatcctcgaatcccgcgggctgaaagtcaccatgctgaagctcgacccgtacatcaacgtcgacccgggcaccatgagcccattccagcatggcgaagtcttcgtgaccgaagacggcgcggaaaccgacctggacctcggccactacgaacgcttcatccaggccaagatgaagaagagcaacaacttcaccaccggccaggtgtacgaatcggtcatcaccaaggaacgccgcggcgactacctgggcggcaccgtgcaggtgattccgcacatcaccgacgaaatcaagctgaagatgaaggaaggcgccgctgacgccgacatcgccatcgtcgaaatcggcggcacggtcggcgacatcgaatcgctgcccttcctggaagccatccgccagatgcgctccaaccacggccgcaagaacacgctgtacgtgcacctgtcctacgtgccctacatcgccaccgccggcgaaatcaagaccaagccgacccagcactcggtgaaggaactgcgcgaaatcggcattcagccggacatcctgctgtgccggatggaccgcgagctgccggaagacgaaaaacgcaagatcgcgctgttctgcaacgtcgaagagaacgcggtgatcggctgttacgactccgactccatctacaaggtgccgggcatgctgcacgcccagggcatcgacgacatcatcgccgaacagctgcaactggacctgcccaaggccgatctcgccgtatgggacggcatcatcgacgccatccagcatccggaccacgccatcaacatcgcgatggtgggcaagtacgtcgatctgaccgaatcgtacaagtcgctgaccgaagcactgaagcacgccggcatccacacccgcaccagcgtcaacatcatctatgtcgactccgaagagatcgatcgcgacggcgccgactcgctgaaggacatggacgccatcctggtgccgggcggcttcggcaagcgcggcgtggaaggcaagatcaaggcggtgaagttcgcccgcgagaacaacatcccctacctgggcatctgcctgggcatgcagatcgcgctgatcgaatacgcgcgcgacgtggcgggcctcgccggcgccaactccaccgaattcgacctcgacaccaactacccggtggtggcgctgatcgacgagtgggtgaaccacgacggcaaggtggaaaagcgcgacgagaactccaacctgggcggcaccatgcgcctgggcggccagcaatgcgacctggtcgacggctcgctggcggcgcgcgtctacggcaacaccgagatcgtcgagcgccaccgccaccgctacgaagtgaacaactactacatccagcgcctggagcaagccggcctgaccatcagcggccgttcttccggccacgaaaagctggtggaaaccgtcgagctggccaaccaccgctggttctttgcctgccagttccaccccgagttcacctccactccgcgcgacggccacccgctgttcatcgcctacgtgaaggccgctctggcataccaggctgacaagcaaggaaactga

SEQ ID NO: 3584 - DNA, 843 bp, Chromobacterium substugae
atgaaattgtgcggatttgaagtcggcctgcagcagccgctgttcctgatcgccggtcccagcgtgatcgaaagcgaacagatggcgctggacaccgccggccagctgaaggagatcgcccacgcgctgggcatccacttcatctacaagtcgagctacgacaaggccagctacacctacggcggctcgttccgcggcttcggcatcgacgaaggcctgcgcatcctgtccgaggtgaagcgccagatcgaagtgccggtgctgaccgacgtccacaccgaaaacgaagtggtccaggtggccagcgtggtggacgtgctgcagacgccggccttcctcagcagccaggccgacttcatccgcgcagtcgcccaatgcggcaaaccggcaaacatcaagaagggccagttcatggcccctggcgacatgagccaggtcatcctcaaggcccgcgaagcggcgcgcgaagccggcctggaggaagacagcttcatggtctgcgagcgcggcgcctcgttcggctacaacaacatggtatccgacatgcgctcgctcagcatgttgcgcgaaaccggctgtccggtggtgtacgacgccacccactcggtccaattgcccggcaacgccgccgccagccagcgccatttcgtgccggtgctggcgcgcgccgcggtggccgccggcatcgccggcatcttcctggaaacccatccggcccccgcccgcgcgatgtccgacggcctcaacgcctggccgctggctcgcatcaaggaattgctgaccacgctcaaggcgatggacgagctggtcaagcaaactccctggcctgagcactcgctgtaa

SEQ ID NO: 3585 - DNA, 1284 bp, Chromobacterium substugae
atgagttcgatcgttgacgtggtagctcgcgaaatcctggactcccgcggcaatccgaccgtggaagcggacgtattgctggaatccggcgtgatgggccgcgcggcggtgccgtccggcgcctccaccggcacccgggaagccctggaactgcgcgatggcgacaagagccgctacctgggcaagggcgtgctgaaggccgtagacaacatcaataccgagatctgcgaagcgatcatcggcctggacgcctccgaccagaccttcatcgacaagaccctgatcgaactcgacggcaccgagaccaagtcccgcctgggcgccaacgccatgctggccgtttcgatggccgtggcccgcgccgccgccgaagacgccggcctgccgctataccgctacctgggcggcgccggcccgatggcgctgccggtgccgatgatgaacgtcatcaacggcggcgaacacgcgaacaacaccctggacatacaggaattcatgatcatcccggtgggcgcgcaaaccttccgcgaagcgttgcgcatgggcgccgagatcttccacaacctgaagaagatctgcgacaagaagggctacgccactaccgtcggcgacgaaggcggcttcgcccccaatctggaaagccacgaagacgcgatcaagctgatcctggaagccgtcgacaccgccggctacgtcgccggccaggacgtgatgatcgcgctggactgcgccgcctccgaattcttccgcgacggcaagtaccacctgaccgccgagaagctgtcgctgagctcggaagagttcgccgactacctggaaaacctggccgacaagtacccgatcatctcgatcgaggacggcatgtccgagcaggactgggacggctggaagctgctgaccgagcgtctgggccagaaggtgcagatcgtcggcgacgacgtgttcgtcaccaatccgaagatcctggcagaaggcatcgccaagggcgtggccaactcgctgctggtgaaggtgaatcagatcggcacgctgtcggaaaccctgaaagcagttgatctggccaagcgttcccgctatacctgcgttatgagccaccgctcgggcgagaccgaagacagcaccatcgccgatctggcagtcgccaccaactgcatgcagatcaagaccggctccctgtcgcgctccgaccgcatggccaagtacaaccaactgctgcgcatcgaggaagagctgggcgacgccgcccactacccgggccgcgcggctttctaccatctgaagtga

SEQ ID NO: 3586 - DNA, 324 bp, Chromobacterium substugae
atgcgctggctgaccgtgaccctggtaaccgtgatccttgccttgcaatggccgctgtggttcggcaagggcagttggctcagggtctggcagctggacaaacagctgcaggaacagcgggcgaccacccaaaagctggtcgcccgcaatgccgcccttgacgccgaagtgcgcgacctcaagcaaggcagcgatgcgatagaggaaagagctcgtaacgaacttggcatgattcgcaacggcgaagtgttcttccaactgctggatcccagcaagaacaccccgctgccgagtcacccgataacggacactcactcccactga

SEQ ID NO: 3587 - DNA, 1815 bp, Chromobacterium substugae
atgatggcaggccgccttaaaagcaccaaggtttgggcaatgacgacacaaaaccctatcgaagtggcacgtgaaaccctgaagcagctgtccacgcggaaactgctgccgacgccggaaaacttcgagcgggtttaccacgagttgacgcaaaccccgatggtgcgcgacaacaagctggccgtattgctattgcgggcgctggaaaccttgccgcaggacaacgtccaggccaaggtcaccctgtcgcgcctgcgccaggccctggacgaaagccgctgggagcaggcgccgcagctcgtcatcgatttcctgcgcggcagcttcgccacccagcagctgtcgcaaagctggggcctgctgatccagaacctgatgcgcagctgggaaacccgccagcccgacctgccgcaacaccacaagcaaagcgcgctggaacgcgtgctgatcaattacggcaatcagccggaagaactcaaccagaaactgaccgcgctgctgcaaaactggaacgccgcgccctccctccgggaaaccaccccgcagccggatggcgccgcggatgcggcggataccggcacgcccgccgccgtttccgacaactggttgtcgtggcagcgcacgctggctttcgcgctcaagcacggactggagccgcggctggccagctaccccgacctggtggactgcctggaaggcctgctcaaggagctggacggcgtcgccgacgacgccagcctcaacgccttcatgcccaagctcagggccttcatgatcaagctggagctgcagtcgcagcaggaaggccgcctcgcctccgggctcaccaacctgttgcggctgatgctggacaatgtggcggagctgaaccgctccgacgaatacctgctgggccaggtcagctcgctgcaggagctgctcacccacgaaccgctgtcgatgcagcaggtctaccagctggaaaccagcctgaaggaagtgatacgcaagcaaggcatgcagaaaagctcgctggacgaggccgccagctcgctgcgcgccttgctcgaccgcttcgtcagccggctggcgctgatgaccgacagcaccgacgagttccacgccaagatccagacccacagcgaaaagctgaagcaaaccagcaatgtcgacgacctgggcggcatcatcagcgcgctgatggaagacacctcgatgatgcagctcgacctcacccgctcgcgcgacgagctgatttccgccaaggagcaggtggaagccgccgagcaccgcatccacgaactggaaaacgcgctggaggccgccagcgccaaggtgaaggaagaccagctgaccggcgcctacaaccgccgcggcctggccgaatatttccagcgcgagatcggccgcgccgagcgcaccgcggcgccgctgtcggtggcgctgatagatgtcgacaacttcaagcagctgaacgaccgctacggccacctggccggcgacgacgcgctgaaatacctggtggacaccatcaagcacagcctgcgcccggccgacatcgtcgcccgcttcggcggcgaggaattcgtgatcctgatgccggacacgccggagaacgaagccatcctgacggtgcaaaggctgcaacgcgaactgaccaaaaccttcttcctggccaacaacgacaagctgttgatcaccttcagcgccggcgtcgcccgctggcatctgggcgaacaggaaaccgacgtgctggagcgcgccgaccacgcgatgtaccaggccaagatcaacggcaagaaccgcgtctgttccgccgaggaagcgctggagtaa

SEQ ID NO: 3588 - DNA, 303 bp, Chromobacterium substugae
atgattgagacgctggaggtggaagtggcgtacgcgcggccggaccggcagtggctggtgccgctgcggctgccggcaggcgccaccgcggcgcaggctgcggccgagtccggcattctggcgcagtgtccggaactggacatggccacgctgaagctgggcgtgttcggcaaggcggtcaagccggacgcgccgctgcgccagcatgaccgggtggagatctaccgcgcgctgctggccgaccccaaggaagtgcggcgccagcgcgccgccgccggcaagggcatgaaaaaaggcggctga

SEQ ID NO: 3589 - DNA, 438 bp, Chromobacterium substugae
atgcagcatgtcgaaaaaagcgtcctggtggcgcacacgccggcgcagatgtatgcgctggtggacgatatcgaacactacagccgtttcctgccctggtgcggcaagaccgaggtgttgtcgcgcggtgaggggcaggtggtggccagcctgcacatcgactacctgaaggtgcgccagcacttcaccacccgaaaccgcaatgtcgagaacgagtccatccacatggagctggtcgacgggcctttcgagtcgctggagggtttgtggcgcttcaagccgctgggcgatttcggctgcaagatagaattcagcctgcgctaccagttttccagccgcatcctggagaagctgatcggcccggtgttcggccatatttcgggttcgttggtggacgccttcatccaggaagcggacaggaagtacggcaatgattga

SEQ ID NO: 3590 - DNA, 456 bp, Chromobacterium substugae
atgagcatcatccagaaccgcaaggctttccacgactacttcatcgaggaagaactcgaggccgggcttgtgctggaagggtgggaggtcaaggcgatccgcgccggccgcgtgcagctgaaggaaagctacgtcgactggaaaaacggcgccttctggctgataggctgccacatcacccctctgcaatccgcttccacccacgtcaatcccgacccggtgcgtccgcgcaagctgctgctgtcgcaggccgagatcaaccgtttcatcggcaaggtggaacgcgccggctacaccatgatggcgctggacctccactactccaagggcaacgtcaaggccaatgtcggcctggccaagggcaagaagctgcacgacaagcgcgataccgaaaaagaccgcgaatggcagcgcgagaaacagcgcgtgatgaagagccaccggggcgcggcatga

SEQ ID NO: 3591 - DNA, 351 bp, Chromobacterium substugae
atgaaacgcggcgccgccctgcccatcgcgctgatctgcctgggatgcgtctggctgctgaaaagcaccgccctgctgcccaacaccaccaccctgctcgccctgctgctgttcgcggcgggcgtgctgctattggcgctggatggattcaacaaatccacgctggtgaccagcccgatgctggcctacaccggcgccgccgtctacgcggtcgatcagctgggcctgcgcgtcagccacttcgcggcggtgggcatggtgctgatgggcgtgctgatgctggtggcgcgcagcgacggcataccggaacgccgcgaaccgccgcgccggctaccgccgggcgacgactga

SEQ ID NO: 3592 - DNA, 1578 bp, Chromobacterium substugae
atggacaagatcctcattctcgacttcggctcccaggtcacccagctgatcgcccgccgcgtacgcgaagctcacgtttactgtgagcttcattctttcgacatgcccatcgaagagatcaaggccttcgcgcccaaggccatcatcctgtccggcggccccaactcggtgtacgaatccgactaccaggccgaccccaagctgttcgagctgggcgtgccggtgctgggcatctgctacggcatgcagttcatggcccagaccctgggcggcaaggtggaaggcggcgacaagcgcgagttcggctacgcccagatcaaggcccgccatcactccaagctgctggaaggcctgcaagaccagatcgatgacgccggcaacggcttcctcgacgtgtggatgagccacggcgacaaagtcacctcgctgccggccggcttccaggtgatcgccgaaaccccgtcctgcccgtacgcggcgatggccgacgagacccgcggcttctacggcgtgcagttccacccggaagtcacccacaccaagcgcggcaccgagatgatccaccgcttcgtgctgcacgtggccggctgcaaacccagttggaccatgcccaactacatcgacgaagcggtgaagaagatccgcgaccaagtcggcgatgaagaagtcatcctcggcctgtccggcggcgtggactcctcggtggccgccgcgctgatacaccgcgccatcggcgaccaactgacctgcgtcttcgtcgaccacggcctgctgcgtctgaacgaaggcaagatggtgatggaaatgttcgcgcagaacctgggcgtcaaggtggtccatgtgcaggccgaagccgacttcatggccaagctggccggcgaaagcgacccggagaagaagcgcaagatcatcggcgcggaattcatcgaagtgttcgaccgcgaatccggcaagctgaccaacgccaagtggctggcccagggcaccatctacccggacgtgatcgaatcggccggcgccaagaccaaaaaggcgcacaccatcaagagccaccacaatgtgggcggcctgccggaagacatgaacctgaagctgctggagccgctgcgcgagctgttcaaggacgaagtgcgccagctgggcgtagccttgggcctgccgcacgacatggtctaccgccaccccttcccgggcccaggcctgggcgtgcgcatcctcggcgaagtgaagaaggaatacgccgacctgttgcgccaggccgacgccatcttcatcgaagagctgcgcaacaccgtcgacgagaagaccggcaagaactggtacgagctgaccagccaggccttcgccgtgttcctgccggtgaagtcggtcggcgtgatgggcgacggccggacctacgactacgtcgtcgcattgcgcgccgtggtgaccagcgacttcatgaccgcgcactgggccgagctgccgtacagcctgctgggccgcgcgtccaaccgcatcatcaacgaagtgcgcggcatcaaccgcgtggtctacgacgtgtccggcaagccgccggcgaccatcgagtgggagtga

SEQ ID NO: 3593 - DNA, 1458 bp, Chromobacterium substugae
atgtggaaatcgacggccgccgcccttgccctgctgatcctcgctggcgctgccagcgctggcgaacagagcgcctgcgatcgcctgctgcggaaattgggcccgcaactcgccgacgccagttgcgtcgaaagccccgacctgacgacccgcaaccccaacaccacgccagccaacgactcgctgcccggcctgccgccttcggcgttcatgccgcaagccgaccgcgacatactcgtggcggatcccgcccacaggccctccatcaagaaggcggtccccggcttgcagattcaggcccgcttcgccaaggatcctctggggcaggcgcgcttcctgctgcggctgcccaaggactggaatggccgactcgtggttgccggcgcctccggcgcccgcagcgaattcaacggcgacttcgtctggagcgattacgtgctgcagcagggctatgcctatgcttcgcagaacaagggggtgctcagcgcgcatgcgagcacggcggcggatccgctggcctgccgcaccgggacgccggacaatccccactatgtccactactacgacgatgatccaggccaggaattcacccgctggcgcgacttcatggtgatggcttccgacttggcgcgccgcggcgtagaggcgcagtatggccgcaagccgcgctatacctatgcggtcggcgcgtcgaacggcggctatcaggtgcgccgcgcgatcgaaaccgcgccggaatccttcgacggcggcgtggagtgggccggcaccttcgtcgatccccgcgggccgaatctgctgactggcctgcctccggccctcctcaactaccccgactatctcgcctccggccgctcgcccaccagcaccgccgccttgaacatcctggcggccggctatccgcccgatctcgtagccgatacagcaaatggccgggtctcgctatggggcaatcaccatgactcattctgggagcccacgcaatgccaatggcaaaagcgcctggatcctggctacaacacctatggcgccgggccggacaggtacaactacttggcgcggctgtccgcctcgaaggtgggcgccaatgtggcggccatcgccaccgacggcaagatcaagcgtccgctgatcacggtcgccggcacgatggatgcgttgctgcccatcgacctccatgcgcgtgcctatgcgcggcaggttgccgcggagggcggcgagcacgcccaaacctatcgcctctacgagatccagaacggcaatcacgtcgagcgctacgcgagcctgttcccgcagcttgagctggtcgagccgcacgcgcagcgcgccttcgacttgctggtccgctttgtcgaacagaaaacgccgctaccgcccggccaatgcgtcgctcgcggcggcaccatcggcgatgcgcccgctcagccggggcactgcccaaatttgctggcgccttga

SEQ ID NO: 3594 - DNA, 855 bp, Chromobacterium substugae
atggcgctgtgccatctgacgatgagcgccaacgctcgggccgacgacaacaccatcagatggcaaatgccgggcaatccgccggtcaccatcaccgatggccccgacaagggccagggctacgctgacgtgttcctgcgatatttcattgagcgcgcgcccgagtacaacagcgtgatagaacgcgccagcctggcgcgcgtctccggcctgatgaagcagggagagcacgtttgccagcccagcctgctcaagacagtagagcgcgaagcgtatatggaattcagcgacccggtcgaattcgtgctgccgtattacatcgtaatgcgatcggatcggacggcccgcctgaaggcctaccgcgatgccgacggcgccatagacatcgcccggctgatgcatgacctatcgttgaccacggtccgccaagagatgcggggctacccgcccgtcgttctgtcagccttcaccgcggcggccgggcagaagaacatcctccagacgagcgccgacgacgtggggcctttcagccagctggccagcggatgggtggactacatcatcgcctatccggacgaggtctattggttcgccaggcacttgaaactgccgacatcaatcaagtttgtttactttcccatcgccggccaccccaaatatacgatcggctatgcggcttgcaccaagggcgcttggggacggaagatcgtcaagcgggtcaatgaaatcgttgccaaagccggcagacgtcccccgtggatcgacgccgaagcccgcttgcttgatccggaagcggccaaacgctacgaggaggtctacgcccgctattctccgttccgcaggcaggccgactaa

SEQ ID NO: 3595 - DNA, 1308 bp, Chromobacterium substugae
atggatgccaatcgccaggcaaaggataacgcccaatcgcgcaactcccctttgattttcatgccgcagcgcggcctcgcgcggcgcatgctggtctggatcatctgcatcagcacgacggcggcgctgatcgcgacctcggtgcaattgttcttcgactaccgcagcgatgtgtccgaactcgagcagggcatgcgctacatcgagcagagccagctgcctggcctggccgacgcggcctggaacttcaacgtcgccggcatgcaggtgcagctcgacggcatcggccattccccctgggtcgccggcgccacgatccactacggccccagccagtcggccgcgctgacaaccgggcagctggatgctgacgcggggaggctcttcaagtacgtcttgcggcgcaacggggtggtcgttggcaagatctacatcgagcccaatctgcacacgctctatagccgcaccctggatcgcattggcatcgtattggcgacgcagggcggcaagtcgctggtgacttcgatcagcatcctcttgctgatttcctggatgatcacgcggcatttgacccagatggcggagttcgccagatccttcgagccgggcaagagtttcacgccttttgtgctgcgccggcgcccgcaagggctgcgcgatgagctgagcgtgctggtcgatggactcaacgatgcctatgcccgactccaaaaagcgcacgaattccaggtgcgccacaacgagatcctgagccagcaagtcgaactgcgaacggccgaactactcgaagcccaccagcagctggccctgctggccgtaaccgacaagctgaccggcacggtcaaccgccggggcctggacgaggtgttcaaaaacgccatggcgctggccgaccctgacagccgtccgcttgcgatcatcctgaccgacatcgacagcttcaagtccgtcaacgacagccgcgggcatctggcgggagacgccctgcttcaggaattcaccggcatcttgaatcgcgtggtgcgggcgaccgacaccgtgggtcgctggggcggcgaagaattcctgattctttgtcctcagaccactctggaacaggccttgcgcctggccgagcacatgcgcgccagtgtgcaggcgcatgcctttgccgggataggcagcaagaccagcagcttcggcgtcgcggttctgcgccagggagaaactgcggacgatctggtgaggcgggcagatgaagccctgtatcaggccaagaagagcgggcgcaacagagtctgctcggaagccccggatatcgtgagctga

SEQ ID NO: 3596 - DNA, 174 bp, Chromobacterium substugae
atgccggccctgttcacgacggccttgccgcaggggccgcagctgggatggcgcagcctgccggtgcaggcgctgctggccggagcgctggccttgctgtcggcgctgatggtgttgatcttgctgaggcgcggcggcgaacaagccagccaagcctggcggagccggcaatga

SEQ ID NO: 3597 - DNA, 1305 bp, Chromobacterium substugae
atgactgactcccgctcgacaaccctcacccgcgccgactaccagaccctgggcctggcggcgctgggcggcgcgctggaaatctacgatttcatcatcttcgccttcttcgccaccaccctcagcaagctgttcttcccgccgcacatgccggaatggctgcgcctgctgcagaccttcggcatcttcgccaccggctacctggcgcggccgctgggcggcatcctgatggcccatttcgccgaccggctgggccgcaagcgcatcttcagcctgaccatcctgctgatggccggcccttgcctgatcatcggcctgatgcccacctacaccgacatcggcatcgccgccccgctgctgctactggccctgcgcatcctgcagggcgcggcggtgggcggggaggtgcccagcgcctggtccttcgtcgccgagcatgcgccgctacaacaccgcggctacgcgctgggggtgctgcaggccggcctgaccttcggctacctgctgggcgcgctcaccgccaccatcctcgcccgcgtgttcacgccgcaggaaatgctggaatacggctggcgcatccccttcctcctgggcgggcccttcggccttctcggcgtgtggctgcgccgctggctggccgaaacgcctatcttcctggccatgcgcagccgccaggcggaacaggtcagctaccccttgctgacgatcctgaaggaacaccgcgctaccctgctgcctgcggcgctgctaacctgcgtgctcacctccgccgtggtggtgctggtggtggtgacgcccacattgctgcagcagcgcttcggcatgagcgccgaccatgccttcggcctcagcagcataggcatcgtatttctcaacctgggctgcatcgtcgccggccacgcctgcgaccgcatcggccaccgccgcagcctgctgctgtacagcctgttgctgccgctaggcgtggggctgctctacgcctgcctgatagatggctggggctggccgggcctggcttacgccgccgcagggctatgttgcggcatcgtcggcgtggtgccatccatcatggtggccatgttcccggccaaggtgcgcgtatccggcatttccttcacctacaacatcgcctattcgatctgggccagcgtcacgccgctgctgttgatcgccgccatgccctggagtccgtggatctgcgtcgcgtattgcgcggcagtggcgctggcgggcatgtcctgcgcccgcgccgcgcggcctgcgcgggaaccttcgctggacgaagcgctctaccaacgcggatga

SEQ ID NO: 3598 - DNA, 120 bp, Chromobacterium substugae
atgatgaaagaagacaactcaaaacgcagacgcggcgtggaccggccgcgtcaaaccaagctaacaggctggtgcggccgcgtcaaaccgcctggtcaagcggttcatccgcgttggtag

SEQ ID NO: 3599 - DNA, 315 bp, Chromobacterium substugae
atgtcgaatgccgccatcgccaaggaaaaagaacagctgctggatgacgtacgccaggttttggccagcaccgaagaactgatcgacgccgccgccgacgacggcagcgcgcacagcaaggaattgcgcaaacgcctcagcgaaaagctgggcaccgccaaggccaagctgcgcgacgccgaagtcgccgtggtcggcagggccaaggaagccgccaaggccaccgacgaatacgtgcacgaaaacccgtggaaatccataggcatcgccgccggcgtgggcttcctgctgggcatgctggtctcgcgccgctga

SEQ ID NO: 3600 - DNA, 393 bp, Chromobacterium substugae
atgtcggaaccgacccgcccgccccgtcccggcaccctgcgctccttcgccaacggggcggcggcgctgctgctcacccgcgccgaactgatggcgctggaggcgcaggaatggaaggacgacatcgtcggcaatctgctgcaaggcatgctgggggtggtgttgctgggctgcggcctgatcgccgcggtgctggcgctgtgggcgctgacgccggtcgaatggcggctggcggtgatggcctgcctggccctgctgctgggcggcgccggcgccgcgctgctgcttggcctgcggcgcaagctgcgcgagcagccggcgccgttcgccgtcaccctggaagaggcccgcaaggattgggcggcgctggggcccggcggagaacggccatga

SEQ ID NO: 3601 - DNA, 273 bp, Chromobacterium substugae
atgacgccgcaggaccgcgcgctgaaaaaacagctgctggtgatgaagggcgaagccctgcgcgtcaagctgaagctggaaaaacagaaactgctggagccgctgcgctgggccggcgagggtttcgcgctgtggcgcgcccctggccagctaggcgccgcgctcgatattctgggcaagctgctgccgaacgaaaagctgggccgctggctcaaaggcggcggccggctgctggccgcctggcgtctgttcggccgctggctcaagcgctga

SEQ ID NO: 3602 - DNA, 1026 bp, Chromobacterium substugae
atgtccgtgatcactccccaatcctccgtgtccaggctggatctgtggcagaggacgagcatcgccgccaagccgtccaccgatgccgcgccgtcgtcttcctccgccgacgcccaggcccagtcacaggccgcccggctgtccactgcccccaacgatttgcagcaggcgctgaaccgcggctggcaggactacatgcaaaagctgcgggtggacctgaaccgcccggcccagcgccagagcccgcaggccgacgacatccagaaaaaaatgctcaagcagcaggcggatgcgctgcgccagatgatgatggtcacccgcgacaaggcgagtttgcgggcgcttgccacccagctggcgcgcctggcgcgcgagttgaaagacctggtcagcagcatgacccagaacgcggccgaccagcagatggcggtcaatgtgggcggggatcaggcgtccggcggggccgcggcatcttccgccgccgaggcttccgcaggttcggatgcgggctctggaggcgactcggacgcggaggcggcaagcgcggaggcggccgccgcggcttcgtcggcccaggcggcgcctgccgccgctgacggagccgacgcgcagcaagccgcgtccggccagaacaccgcgcaggaggcgtcggcggccgacgcgaatgcgaacgcgcaagcccccgggcagaccgacgcgcagggagattccggcaatgtcgacccgcaggcggcgctgcgcaacatgctggccaacggcaacccggtggccggcgatccggacatcgagcagatccgacaggtgctgaagatggtgcaggccttcatcaagcagatggcgcagcagctgcaaactcagaaagacccgaattcgcgcgacctgaaagacgatatgaagcgggcggacaaggatctggaggatgtcgacaagatcctgaagggcggtccggaggcgatggcggcgctcaacggccagatggatgtgaatatcaatgtgtcggcggatgccggcacggcgaacgcctga

SEQ ID NO: 3603 - DNA, 132 bp, Chromobacterium substugae
atgcggttgcgggatcttgccattatcgccggtttggcggcggcgaccaagccggcgcgcccggcggccgagcaggctgttgccgccaacatgccgattggcatcaagaaaaccaaattgttgccgatatga

SEQ ID NO: 3604 - DNA, 735 bp, Chromobacterium substugae
gtgacgctgacctcccccccgcttcctccctcggccctcgcctggctggccgaacaggacatccattcccagccgcagctgcaagcgcgcggcgcggtcaccgctttcctgctgctgaaggcggccggccataccgtgacccgccgcctgctgttcgcgctggaggccgcggcgcgcggcatccactggcagcagctggaagaaagcgacaaggcggcgttgctgcgccgcctggccgagcacccgccggtgtccctgccccctccgctggcggcaagcctggactacctgcggcaggcgcgagagctggcggcgcaggccgcggccgagggcgaggtgccggtcggcgcgctggtggtgaagaacggggaaatcatcggccgcggctacaaccagcctatcggccgccacgacccgtccgcccacgccgaaatgcaggcgctgcgcgacgccgcggcgcgcttgggcaactaccggctggacggctgcgacctgtacgtcacgctggagccctgtccgatgtgcagcggcgccatcctgcacgcgcgcatcgcgcgggtggtctacggcgcgcgcgacgccaagaccggcgcggccggcagcaccgtcgacctgttcgccgatccgcggctcaaccaccacgcggcagtgttcggcggcgtggacgccgacgcctgcgccgagcagctgtccgccttcttccgccagcgccgccaagatgcggcgggaggctga

SEQ ID NO: 3605 - DNA, 627 bp, Chromobacterium substugae
atgcgttgcctcctcgtcctgctgctggccggcctcgcccattcgtgcctggcggccgacgacgccgccgcgctgattctgcaggcgcagacggcggcgccgctgcaagccacccaccccaatgcccgccattacggcgagccgtggatctgggtaggagtgcgatcgcagacgctgcggctgctggacggctggggccgggtagaaaaggaatacgcggtatcgaccgcgaaaaacggcgtcggcgaaatgagcggcagctaccagacgccgcgcggctggcacacggtctgcgacaagatcggcgccggcgcggcggaaaacaccatcatcttccgccgccaggtgacgccgtggaagtacacgccggaactgcacgcccagtatccgaacaaggactggatcctgacccgcatcctgtggctgtgcggccaggagcccggcatcaaccaaggcggggatgtcgacagctacgaccgcgccatctacatccacggcgccggcgatcatgtaccatggggcaggcccagctcgctgggctgcgtccgcatgaagaaccacgatgtgattgaactgttcgatgccgcgccgaccggcatcgatgtatggatagacgagaacgcctga

SEQ ID NO: 3606 - DNA, 414 bp, Chromobacterium substugae
atgcactccgcactgaccctgagcacccccgcgctgctgttccccgccatttccctgctgctgctggcctacaccaaccgctttctgggcctggccggcatcatccgcaacctgtacgaagagtaccgcgacagccaggacccgaaaatcctgcgccagatcggcaatctgcgcacccgcatcacgctgatcaagtggatgcagtttctcggcatcggcagcctgtttctctgcacggtggcgatgttccaggtctacaccggctggcaggcatggggggagatcaccttcggcgtcagcctgctatgcatgataggctcgctggcggtgtcgctgctggaattggtgcgctcgtccgacgcgctcaacatcctgctatccgacctgcaggcggaatacgagcgccggcgctga

SEQ ID NO: 3607 - DNA, 783 bp, Chromobacterium substugae
atgaatatgtctcccgcctccgtcgccaccttcagcctgtacgccgatctgtacgcgcgttatcgtccttcctacccggaggcgctgtatggctggctgctgccgctgtgccccggctatgcgcgggcatgggattgcgcgaccggcagcggccagaccgcggtgcgcttggggcagagtttcgcccgggtggacgccaccgatatcagctccaaccagctgtctgcggccgaaccgcacacccaggtgtattaccgcgaatgcccggcggaggtgacgccgttcgacgacgactgcttcgacctggtctgcgtgtcgcaggccttgcattggttccaccatccttcgttctggccggaggtgcggcgggtgttgaagccgggcggcatcttcgccgcctggggctatcaccactgcgtggtgacgccggagatagaccgcgcctgcagcgtgctgtggtcgatcatcgagccgttctggtccagccgctgccagctgttgtgggatgattttcgcagcagcggctgtccgctgccgctattgaaagcgcccagcttttccatcgtcaacgactggacgctggagcatttcctcggctttctcaataccacttcggccagcaagctgtgcaagcaggcgctgggggaaaacatcctggacgacgccagcctgcgcatcgcgcgcgcctggggctcgcccagccagacgcggcgggtggagctgccgctgcacctgatggtggcgcgcaaggacgcgccgcaggatttccccggctacggctga

SEQ ID NO: 3608 - DNA, 1749 bp, Chromobacterium substugae
atgaaagtgcacagcatgccgacctttacgcgcaagcttcttccccttttgaccctcagcgttctcgcagcctgcggcggcggcggctccggcagctctggcagcgcgccctcccaaaacaacaatgcctcggctcgctaccatgtcgccggccaggtgcaaaaagggccattcattttcggctcgcaaatctggatttccgagctggacgacaagctgtcgccgaccggcaaagtctatatgacgcaaaccaaggatgacctgggcaatttcggcattcccggctccgtcaacacgaaactggtggagctgaccggcagcggctattacatgaacgagttgaccggcacgctatccaccgcgccggtcactctgaatgcggtggcagacctgagcgtgtccaagtcgctgaccatcaatctgctgaccaccttgcaagcgccgcgcttgaaggcattgatggctggcggcagcgactatcaaaccgcatacaaccagtcgcgcaacgaagtgctggcggtattcggcatagatcccgccaaagtcgacagtctcggctcattgttcgatatgcgcatcaacggcaatgcggatcaagactccatcttgctggcaacctctgtcattctatctcaggcagcgaaaaatcaggctttgcaagccaataccgatactgccgaactgtcccacctgatcagcaccatcgccagcgacctagccaataacggcaaactgtcctcccaatcgctgcaagatcaactctccgttgccgccacccagatcgacttggacgcggtaaggaggaacgtcgaaacctattacaccaagcggggtatccaactggtcgcgcccaagtttgaagaatggatcgacaaagacaacagccagaccattccgcgcaggcttgttcccactagcggcttgtctttccaggacagcgccgacgccaatccggagcagatctactccagcaacgcagtgaaaatatctggtttgaaagatggccaggctgccatcctgaggttgaatggaaccggcacgcttctgaagaatgacaaggccgtcacgacggactcgtttgttaaaaacaatgatgtcattcaactgaaagatgccgcgccatcgttcaacgaagaaaaaagcaatacggtccaaataggctccagcaccgccacttggaaaataaagagcgcatccacccacctcaggattgatgatcagaacggtggcctgttccccgcccccggcgtcgagcaagcctatatatttcttcaccaaagccagttcattgccttccgatttactccaagcgcggatttcatcgccaaatactcgggggtcgatgtcaatgccgtaggcggcgccgtagtctccaacctcagcatctactccgataacaataacaaccctgaccaagcattgatcacttcgaatgagaaaaccagcctgtacaagaagttgattaccggaggctcggtcagagagttcatccccaactcggttcaatatcgtcttggctctagcggagttcaactcaaagccaataagaattactggatagtgctagcgatgacagtcccggactttcccatggcgggacttcaagggggaaaaggaaaaacatcgcaatatgatggaacactgaaactcagcaagaatggaacgacgtggtgctcgcaaccctctgaaagagacacgccctgcttcaacaattacatatcgccagcatcattctggctggccgattaa

SEQ ID NO: 3609 - DNA, 1530 bp, Chromobacterium substugae
atgaccatcatccggcaggacgacttcatccagagcatcgccgatgccttccagtacatcagttgctaccacccgaaagactatatcgacgcgctgtaccaggcctacctgaacgaggagagcgccgccgccaaggacgcgatggcgcagatcctggtcaacagccgcatgtgcgcggaagggcagcgcccgatctgccaggataccggcattgccgtggtgttcctgaaagtgggcatgaaagtgcagtgggacgcccagctcagcgtgcaggagatggtcaacgaaggcgtgcgccgcgcctacaaccatccggacaacaagctgcgcgcctcggtgctgctggacccggccggcaagcgccagaactccaaggacaacaccccggcggtggtgcacttcgagatcgtcgaaggcgaccaggtggaggtgatctgcgcggccaagggcggcggttcggaaaacaagtcgaagatggtgatgctgaatccgtccgactccatcgtcgactgggtgctgaaaaccgtgccgaccatgggcgccggctggtgtccgccgggcatcctcggcctgggcatcggcggcacgccggaaaaggcgatgctgctggcgaaagagtcgttgatggaccacgtcgacatccacgaactgaaggccaaggccgccgccggcgaggaattgtcccgcgtcgaagcgctgcgcctggagctgttcgagaaggtcaacgcgctgggcatcggcgcgcagggcctgggcggcctgaccacggtgctggacgtcaagatcctggactacccgactcatgcggcgtccttgccggtggcgatgatcccgaactgcgccgccacccgccacatccatttccacctggacggcaacggcccggcgcatctggagccgcctagcctggaagactggccggacatcacttacgacccgtccaacggcaagcgcgtcgacttggacaagatcacccgcgaagaagtggccagctggcagccgggcgacgtgctgctcttgaacggcaaaatcctgaccggccgcgatgccgcccacaagcgcatggtggacatgctgaacaagggcgagaagctgccggtggacttcaccaaccgtttcatctactacgtcggcccggtggatccggtgcgcgaggaagtcgtcggcccggccggcccgaccaccgccacccgcatggacaagttcacccgccagatgctggagcagacggggctcttgggcatgataggcaaggccgagcgcggcccggcggcgatcgaggcgatcaaggacaacaaggctgtgtacctgatggccgtcggcggctccgcctacctggtgtccaaggcgatcaaggcgtccaaggtggtgggcttcgccgatctgggcatggaggcgatctacgaattcgaggtcaaggacatgccggtgacggtggcggtggattcctgtggcacgtctgtccacaataccggtccggcggaatggcgggtgaagatcggcaagattccggtgagcgcggcgttgtga

SEQ ID NO: 3610 - DNA, 141 bp, Chromobacterium substugae
gtgaattaccccgccgccggcgcctcgctctgcctgcgcccagcggcaactaaaaacctggttctgattgtaacactctccgtcatgaactttgaccccggacaaggcgcgacgccggccattctgcgcggcgcgccatga

SEQ ID NO: 3611 - DNA, 729 bp, Chromobacterium substugae
atgcattacaacctgcacaatctgttcgatcttgatctgttcggcatgttgcataccttgatctgcctggcgacggccttcgtctccggcaccgtgatcggcctggagcggcaataccgccagcgcaccgccggcttgcgcaccaacgcgctggtggcggtgagcgcggcggccttcgtcaacatggccttgcaactggatggagccggcagcgcttcccgcgtggtggcctacgtggtgtccggggtgggcttcctcggcgccggcaccatcatgaaggaagggctgaacgtgcgcggcctgaacaccgccgccacgctgtggggctcggccgccaccggcgcctgcgccggggcgggcatgctgggccaggcgctgctcaccacgctgttcgtgctggcggtgaatacgctgctgcggccggtggtgaattccatcaaccgccggccgatcgacgatgaaaccagcgaagtcacctatcagttgtgcgtgatcgccagccgcgacgagcagaagcgggcgctggcgcaggtgggcgagctgctggagcaggccaactacccggtgggcgacctggacgtggaatcgttcagcgacgacgaggtggagatgacggccaccttgctggcgacatcggtggattccgacgagctggaccgcatcgccgccgcgctggccgcccatccctacatcagccaggcgtactggaacaccagcaccagcgagtga

SEQ ID NO: 3612 - DNA, 1647 bp, Chromobacterium substugae
atgaccaatccaatcaaaaacgaagctgtactggatagcgcccacatcggcgacatccgcggtgcgttcggcaccatccgccacggcgatgtggcggctcgcaagggcatctggcagcgtctgcgcacgctgctggccatcctgggccccggcctgatcgtgatggtgggcgacaacgacgccggcgccttcagcacctattcgcaggccggccagaactacggcacttccctgctgtggacgctgatcctgctgatcccggtgctgtacgtgaaccaggaaatggtgctgcgcctgggcgcggtcaccggcgtcggccacgcccggctgatcctggagcgcttcggcaaattctggggcgctttcagcgccatcgacctgttcctgctgaacgcgctgaccatcgtcaccgaattcatcggcatcacgctggcgctgcagtacctgggcttgcccaaggagtggggggtggtggcggccgcgctgctggtgatggccgcggccagtaccggcgatttccgccgtttcgagcgcttctcgatgatattggtggtgttcagcctgctgctggtgccggtgttcatgatggtgcacccgccgatggcgcagatcggccatgacctgttcgtgcccggcatgccggccggcggcaagctgtccgacgtgatgttgctgatcatcggcatcgtcggcaccaccgtggcgccgtggcagctgttctttcagcaaagctacgtgatcgacaagcgcatcacgccgcgcttcatcaagtacgagcgcgccgacctgtggctgggcatcgtgatggtgctgatcggcgccatcgccatcatcgccatggccgccgcgctgttcgccggcaagccggaattcggcaatttccaggacgccggcgccgtggccgcgggcctgggcaagtaccacagccatctggccggcgtgctgttctcggtggccttgatcgacgccagcctgatcggcgccagcgcggtatcgctgtccaccgcctatgcgctggccgacgtgctgaacatgaagcactcgctgcaccgcaagccgagcgacgcgcgcgctttctacctggtttacttcctgctgatcgccggcgccgccgcgctggtgctgattccgggcgtgccgctgggcctgctgaccaacgcggtgcaaaccctggccggcgtgctgctgccgtccgcatcggtgttcctgctgctgctgtgcaacgacaaggaagtgctgggcccgtgggtgaacggccgctggaccaatctgttcaccggcgccgtcgccgcggtgctggtgctgctgtcggtgatcctgaccgcttccgtgctgtggccggacatcagcagccagaccatcatcaacatcctggtgggcggcggcatcgtcggcggcatcgtggtgatcgccgcgcacaccgtcaagctgcgccgcgacgccgaaaccggcgccgacctggccgaagaagccaagccgagcaagctgtacatgcacaactggcgaatgccgccgctggcgcaactgaagcccatggtgctgtcgcgcagcaaccgtctgtggatgggcgtgctgcgcggctatctggtggtggcggtcatcatggtggtgtacaaggtggcggaggtcgccttgctcgcccactga

SEQ ID NO: 3613 - DNA, 114 bp, Chromobacterium substugae
atggcgcggcctcgccatcggaacggggcaccagccgccgtccgcggcaaacgcggcatgcgcaaacctgactcggcgctccgtgcatggcggagcgcagtaatcaagcagtaa

SEQ ID NO: 3614 - DNA, 897 bp, Chromobacterium substugae
atggccatgctgtttcccctgctggcggtgctgatctgggccgccaacgtgattgtctccaaagccgccgcgaacgtgctggacccggcggcgatctccatttaccgctggctggtggcggcgttggtgctgacgccgttctgcctgccgacggtgcgccgccgcgcgcgcgagctgaagccctggctgggcaagtttctggcgctgtcggcgttgggcatggtgatgttccagtgcctggcctattacgcggcgcacagcaccagcgccaccaatatgggggtgatcaccgcgatggtgccgctgctgggcctgctgctgaacgccgcggtgttccgccagaaggtatccgcgccggcctggctgggcgtggcggtgtcgctgtccggcgtggtgtatctgctgggcaagggcgatccgctcggcctgttgtccaacggcatcaatatcggcgacgggctgatcctggccggcgcggcgtcctacgcgctgtacggcattttgctgcggcgctgggcgccgccgttcggctcctgggtcaacctctatctgcaggccagcctggcggtgctgctgttgctgccgctcacgctgaccgcgcgcagcatggccattccggccgagggcgcggggctggtgctgttcgccggcatcggctcctcgctgtttgccgcctatctgtggatgcacggcatccagaagctgggcagcgaccgcaccgccatcttcatgaacctgttgcctttgttcaccgccttgatggccagcgcgatgctgggcgagaccatccaccattaccactgggtcggcggcggcctgatcctgctgggcgtggcgatggggcagggggttttgcggttgcggccggcgcgcagggaggcttttgtaaataaataa

SEQ ID NO: 3615 - DNA, 819 bp, Chromobacterium substugae
atgctccccgaccaggacgactacttcgccagcgacgccgcgctgccggaacccgcgccgctgaccttccgctaccaccgcttcacgccgaaaagcgaattcgcccgccaccgccaccgctggggccagctcagccgcatcaatctgggcctggtggagctgctgctggacgacggcaaggtggtggcaccggcgcaatacctgctgtggacgccgccggaagtgccacacgccgcttatgtgcggcaagccatgcactacatctcgatctacgtcagcggcgacatcgccgcgcggctgccggcccacacctgcctgatcgaacagacgccgctggtgcgcgcgctgctcgacgatttcgcccagcgccgcatcgtctctcccgtcgatccatgggacatccgccaggccgagctgctatgccagcggctgctggaatcgggccgcgaggccagctatctgccggacagcggccagaaactgctgcggccgatactggacgccatccgccacgacccgagcgacgcgacgccgctgaaagcatgggcggaacgggtgttcagcaccgaacgcacgctggcacggctgttccagcgcgagctgggcatgagcttcggccagtggcgcggccgggcgcggctgctggaggcgctgtcgcggctgaagcagggcgacagcgtgcaggacatctcggcgcggctgggctacgccacgccgtcggccttcatcgccatgttccagaaacagctgggcgcgtcgccggaacgctatcgccggcagctgctggaaggcggccagtgggacgagctcagcgcttga

SEQ ID NO: 3616 - DNA, 1416 bp, Chromobacterium substugae
atgagcaaacgctatcggatggcgctggtgtggctgcgccgcgacttgcggctggacgaccacgccgccttctaccacgcgctgaagctcagcgaggcggcggcgccggtgttcgtgttcgacgccgcgattctggacgcgctgccgcgcgacgaccgccgcgtcgatttcatccaccagagcgtggcggcgctgaaggcggagctgaacgcgctgggcggcgatctgctggtgcgccatggcctgccggccgacgaaatcccgaagttggcggcgcaactgggcgccgacgcggtgttctgcaaccgcgactacgagccggcggcgcgcgaacgcgacgccgaggtggcgcggcgcttgtccgagcgcggcatcgctttccatgcggcgaaggaccaggcgatcttcgacaccgacgaggtgctgaccggcgccggcaagccgttctcggtgttcacgccgtacaagaacgcctggctgaaaacgctgacgccgtttcatctgcaggcctatccggtgcggcgctatctggacgcgctcttgccgcgccaggccgaggcgatgccgagcctggccgacatcggctttctgcccagcgatctgtccgcgctgccggtgcgggcgggcgcggacggcgcggaggccttgttcgccgacttcaccagccggatcggccgatacaagacgcagcgcgacttccccggcgtcaagggcgtgtcctatctcagcgtccacctgcgtttcggcaccatctccatccgccggctggcggcctatgcctggcatgacggcggcgagggcgcgatgacctggctgagcgagctgatctggcgcgatttctaccagcaggtgctgtggcatcggccggatgtggtgggccacgcgttcaagccggaatacgacgcgctgccgtttcccaatgatgcggattggttcgcggcctggcgggaagggcgcaccggctatccgctggtggacgcggcgatgcggcagctgaaccgcagcggctacatgcataaccggctgcgcatggtggcggccagctttctggtgaaagacctgttgatagactggcgctggggcgagcgctatttcgccgagaaactgctggacttcgacctagcggccaataacggcggctggcagtgggcggccagcaccggctgcgacgcccagccttatttccgcattttcaacccggtcagccagagcgagaagttcgaccccgacggccgcttcatccgccgctacgcgccggagctggcgcggctgccggacaagctgatccacgcgccgtggcaggcgaagccggagcagctgcgcgacgccggcatccagttggggcgcgactacccgcaccccatcgtcgaccacgccgcgcagcgcgagctggcgctggccttgttcaagcgctga

SEQ ID NO: 3617 - DNA, 942 bp, Chromobacterium substugae
atggagcatttcaccgcgatgccgatcttcgtcgccgtggtcgaggccggcagtttctctgccgccgccgaacggctggggctgaccaaatccgcggtcagcaagcgcgtccagcaactggaggccgggctgaacgtgcgcctgctgcagcgcaccacccgcagcctgagcctgaccgaagccggcgagcgctattacgaccgcgcccgcgccgccctggcgctggcgaatgaggcggaagaggcggccgccggcctgcaggggcggccgcaaggcttgctgcgcgtcgccgcgccgatggctttcggccgcctgcacctgtcgccgctggtggccgaattcctgcgccgctacccggacatccagctggatctggcgatggacgaccggatggtggacctggtggagggcggttacgacctggcggtgcgcatcggcaatttgccggataaccgcatggtggcgcgccgtctggcgccgtgccgggtggtggtgtgcgcgtcgccagcctatctggccgcgcatggcgcgccggcgcatccggcggagctggtcgggcacaactgcatccattattcctattaccgcggcggcgccagctgggttttcagcgggccggacggcgaaatccgcgtgccgccgcgcggcaattaccaggtcaacaacagcgaggccaggcgcgacgcgctgctggccggactgggcatttgcgaaatgcccactttcatcgtcggcgcggacctggcggccggccggctggtggaggtgctgagcgcttacccgctgcccgcgcacgccgtccacgcggtgtatccgcagcgcggcctgccggccaaggcgcgcgccttcatcgattttctggacgaaaaactgggcggcgacgcgccgccgtgggatgccggcctgaccgcgtccccatccgccgaaagagacccaatatga

SEQ ID NO: 3618 - DNA, 471 bp, Chromobacterium substugae
atgccctcccatcccctgcccgcccggccgctcagcgattacgcgctggccgcgctggccttgtccgccggcgcgctgctggccctgatgatccactgcaacagccggctggccgccgccagcgatccgttgaccgcctcctggatcgcccacgccgcaggcgccttcgccgcctggctgctatgggcggcctggcggcgtcccgggcctgccgccggaccggcgccgcgctgggcgtatctgggcggcgtgcctggcgcgctgacggtggcgctggccgccatcgccgtcaacagcccgctgggcctggccggcacgctggctctggccatggtcgggcaggtgctcttcggcctgctggcggaccatttcggctggctcggcatgccgcggcgccggctgggccgcagcgatgcgctggcggcgctgctggtgttggccggttgcgcgatactgattttcggagcctga

SEQ ID NO: 3619 - DNA, 462 bp, Chromobacterium substugae
atgctgatcgtcatcgccgccgccatcgccaacggcctgtgcataggcggcagccgcgccgtcaacggcaaactgggccaacatcgcggcgcgctggccgcgtcgttctggaaccatctgggcggcctgctgtttctcagcctgctgctggccgcgtcgggggcaatgccgcgcctgccggcgcacgccccctggcacgcctggtgcggcggcgtcatcggcgcgctgttcgtcgcgctcaacagcttcgcgctgccgcggctgggcacgatgaaaaccgcgctgctggtgatcgccggccagatgctggctggcgtgctgatcgaccacctggctgcgggcggcggcaaatccgcgcctatccagctggccggcgccgcattgatcgcgctgggcctgttcgcgtcccggcgcgccgcggctcaggcttcccaaccgccgacagcggcgcggcaggcctga

SEQ ID NO: 3620 - DNA, 384 bp, Chromobacterium substugae
atggccggccgccgggagggcggcgcaaagaagaaagagcgcgtggaactgatatcgaatttattgcggatgggcggcttgttcgccttgaccgcgctggcggaaatcgtcggctgctatctgccctggctggtgttgcgccaaggcaagccggtttggctgttggcgccggcggcggcatcgctggcgctgttcgcctggttgctgacgctgcacccggccgccgccggccgcgtctacgcggcttacggcggggtttacatcacggtggcgctgggctggctgtggctggtggacggcatccggccggaccgctgggacgcgttgggctgcgggctggcgctggccgggatggcggtgatcatgctggcgccgcgcggctga

SEQ ID NO: 3621 - DNA, 498 bp, Chromobacterium substugae
atgcaactgacccgtttcaccgacctcggcctgcgcgtgctgatgtacctgaccgggctggagcccggccaactggccaccatcccggagatcgccgagcgcttcgtcatttcgcgcaaccacctggttaaggtggtgcacttcatggcgcagcagggctggctggcgaccagccgcggcaagggcggcggcctggcgctggcgaaaccgccggagcactaccggctgggcgaggtggtgcgcacgctggaaggcttgtcgcagttgatcgactgcgccgagccgccgtgcgcgctgttcggcggttgccggctgaaaggggcgctggatgcagcgctgcaggcctttttccagacgctggacggctacacgctgcgcgacatcatcgccagccccaccggcgaggccatcatccgcatgcaccgcggcttgtccggcgctcaggcagagggcgggcctttgagctctatcacattgccgtccggatcgggcagatag

SEQ ID NO: 3622 - DNA, 1218 bp, Chromobacterium substugae
atgctgagcgcatccactcgtgccctggtcaaggctaccgtgccggtattgcaacaacacggcgtggcgttgaccagccatttctaccgccgcatgttcgagcacaatccggagctgaaacacctgttcaaccagggtcatcagcattccggccagcagcagcaggcgctggcgatggcggtgctggcctacgcgcagcatatcgatgatccgtcgccgctgttgccggtgctgacccgcgtcgcgcacaagcatgtcagcctgggcatccgcgccgagcactatcctatcgtcggcaagcatttgctggcttccattcgcgaagtgctgggcgatgccgccggcgacgacctgatccaggcttgggccgaggcctatggccagttggcggcgttgatggctgggctggaaaacgatttgtaccgggacacggtcaacgccgatggcggctggagcggctggcggccgttccgggtggtgcgcaaggaggcggagagcgaggaaatcgcttcgttctacctggagccgagcgacggcggcgccttgcccggcttccggcccggccagtacgtgtcggtgaagcgcttcgtgccggaatggggactgagccagccgcgccagtacagcctgtccgatgcgcccaacggcgagcacctgcgcatttccgtcaaacgcgaggatgccggcccgggcaagccggccgggcggatgtccaatctgctgcaccgcgaagtggcggtgggcgacgtgctggaactgagcgcgccgcagggcgatttctgcctgaacgaagacggcgccgggccggtggtgctgatcagcgccggcgtcggccagacgccgatgctggcgatgctgggccaattgctgcgccagggcggccagcgcgaaatccgtttcctgcacgccgcgcgccatggcggcgcgcatgcgatgaagcacaagctgcgccaattggcggagcgccatgcgcggctcaagctgcacatctgctacgagcagccgcgggcgcaggatctggccggggtggattaccacgcggcggggcggctacaactggacgcgctgcgcgaattggcgctgctgccggatgccgattactatctgtgcggcccgctcggcttcatggatgtccagcgcggcagcctgctgcggcagggcgtggcgccggcgcgcatccattacgaggtgttcggctccaacccgtcggcggactga

SEQ ID NO: 3623 - DNA, 801 bp, Chromobacterium substugae
atggcgcagcggggccggcagaacggtcagcagcagccgcttggccctggcgcgccagtcaaaaaggccagccagcagtcgtggcggaatggctacgctgcgggcagccgcttcgccgccgcttggcggcgccggctgtatttcctgacattaaccaaggggattttcatgagccaaaccaagatggaatcgaaagccggcatgcaacccagacatggccaggtgttcaagccggagtcgcgcggccagctctgcgtggacggcgtcaacgcgcagtgcccgctgcaaagctggcacgtcaatggcctggaaagcggcaagtttttcccggcggcggtggccggcctgatggatcctctggcgccgaccgatacccccaacgcggcgccgccggccgatggcaagatcgccagcgccggccaggcgcactcggcggtgctggacgagcaaagcgccgagcgctgggccaagcatccggccaagtccggccaggagatggagtttcagtggagctaccacgcccgccacctgacccggcgctggaactacttcatcaccaaggcggactggaatccgaaccagccgttgagccgcgcgcagttcgagtccgagcctttctacaaggtggagatgagcgcccagccctattgggagcacagcgccgaactgatgccgccggagccgaccatccacatgatgcggatgccgcaacggcagggctatcacgtggtgctggcggtgtgggaggtggccgataccggcaacgccttctatcaggtgatcgacttcgatttctcttga

SEQ ID NO: 3624 - DNA, 2625 bp, Chromobacterium substugae
atgcgccaccccttacctgcgcgtcccgccctgctgggcttgttgatcgccagcctgttcagtcctctcgcccatgccgccgaagccttcggcagccccggcgacacgccggtgcgcggccccgccgccaaatcctttgtcggcaccgccgtcggcagtccatccaaggtttacttcaccggctatcgcggcgtggtgtccgaggtgtactacccggtgctggacacgccggaatcggtggacttgcagtttctggtgggcgacgccggcaagactttcgtcgatgaggaaaagcgccaggcctactccgccgggcaaaccgacgcccgcaccatgagctggatcgccagcaccggcaatggcggccacaactggcagatcagcaagcgcatcttcgccgaccccaatcacgacacgctgatccagcgcgtgaccttcaccgcgctcaacggccacaccgtcggcgacttcaatctctacgtcctgttcaagccttatctcgacaacgccggcagcggcaacagcgcgcagaccgtggcggccgccggcggctacgcgctggcagccagccacaacagccgcgcctccgcgctgatggccagccagccgtggaaagtcgtcaacggccagcccatgctgtccaacggcttcgtcggccagagcgacggctggaccgatctgataggcagcggcgacaacaagatggactggacttatagctcggccaccaacggcaacgtcgcccaaaccggctggctggacctgggcgatcccaccgccaccagcgtgtccttcgacgcggcgctgggcttcggcgccagccagagcgacgccgtcaacagcgccgccgcctcgctgggctccgacctcaccgccgcccagcaacagtacgacaaggcctggcacgcctacaccgccggcctgtccacccagggcggcctggccgacgaccgctactaccaggcggcgatgacgctgaaaaccatgcaggacaagagcaacggcgcgatgatcgccggcatcggcacgccgtggggcgagacccagggcgacgccaaccagggcggctaccacctggtgtggccgcgcgacctgttcaagttcgccaacgccttgaccaccgccggcgacaccgccaccgccaccacggtggtcaattacctgttcaacaccctgcagcaggccagcaactgcggcgcggccgaatacaacgccgccggctgcgcggccggctacagccgcgtcggccgcttcccgcaaaacgcctggatcagcggctggccttactggcaaggcacccagatggacgagcaggcgatgcccatcctgctggcctggcggctagggtcggccgtgtccaatccgctatggcccaaaatcaagctgaccgccgactacatcgtcgccaccggcccgtggagctatcaggaacgctgggaagagaattccggctattcgccgtccaccctcgccgccgagatcgccggcctggtggccgccgccgacatcgcccgcaacaatggcgacgacgccagcgccggccgctatttgtccgcggcggactattggcagcaaagcgtcgccgcctggacctacaccaccagcggcagcttcggcaacggcagctactatctccgcatcaacccggccgcgcgcgccggcagcggcgccgaccgcgccagcttcaacccgtccgccgggccggacacgccgcaaacgctgatggtgaaaaacggcggcggcagccacgacgcccgccgcgtggtggacggcggcttcctggagctggtgcgcatgggcgtcaagcgcgccaacgaccccaccatcgtcaacaccatcaatgtgttcgacagcgtgctgggacagaatctggcgctgcccggcgcgcccgccctgccgtataacgcctggttccgctacaacttcgacggctacggcgaacacaacgacggcagcgatttcaacggcacgggcgccggccgcctgtggccgatcttcaccgccgagcgcggcatgtacgagatcgcccgccaaggcagcgctgccgccggccagccctacttcgccacgctgaagctgctggccacgccggaaggcatgctgccggaacaagtgtggtccaacagcgccatgttgccggacggctgggcggtgagcacgccggccggctatctgcctggcgcgccgaccaagtcgatggcgccgctgaactgggcgatgggcgaatacatcagcctgctggcctctatccacgccggacgggtggtcgacatcccgcaagtggtgtgcgcgcgctacaacaactgccgcgccgcgcccaaggccggcgaggtgccggttgacatcaacgtgaccgccagcacccaatggggccagcagatctacgtcaccggcaacgcgcgcgctttgggcaactggaacaccgatctgggcattccgctggacgcggccgcttacccggcttggcaaaacggcgtcaacctgccggccggccagcagatcgcctacaagtactaccgcaagaacgccgacggcagcgtgacttgggaaagcctgtccggcaaccgcagcctgcagacgccggccagcggcagcctcagcctgaacgaccaggtgagctggtga

SEQ ID NO: 3625 - DNA, 333 bp, Chromobacterium substugae
gtgaccccgcgccgcgcctggactgccgccctgctattgaccgcggcggtggccggcggcgcggtctggcggctatggccggcgcaggcgccctcgccgccgccggctgtcgccaagccgcctgccgccattttgccgacccggcccatcgtccatcaggccacgccggcccagccctggcggccgcccgcgcgcccggccctgccgccggtgaagaaaggcggcaacagctggcggccggaggcggcgccggtggcggccaaggtggaagtccagcggggcgcgccggacatgccggacgcgcagcctctgcccaggccgcccgatccttga

SEQ ID NO: 3626 - DNA, 528 bp, Chromobacterium substugae
atgccgcaccgggaagtcttcgcgctcgacgccgcgcaaaccgaagcctggctgccggaaatggccgaactgctgcacgcctgcgtgcatggcggcgccagcatccatttcgtgcagcctttcactctggagcaagccaccgccttctggcgcgacagcaccctgcccggcgtcgccggcggcggccgcgtgctgctggccgcgctggtggatggagaactggccggcagcgcgcagctggactgcggcaccccgcccaaccagccgcaccgcgccgaggtatgcaagcttttggtgcatccggactaccgccgccagggcgtcgcccgcgccttgatggcagagctggaggcgcaggcgcgcctgcgcaagcgcagcctgctgacgctggacaccgccagcggcgaccatgccgaaccgctctatctgtcattgggctatcaggaggccggacggattcccggctacgcctgggacggccgcggcgaaaaactgcaggccaccacgctgatgtacaagacgctgtag

SEQ ID NO: 3627 - DNA, 2229 bp, Chromobacterium substugae
gtgtgcctgctgtcgttttcggccctgctttacatgggcagggagatttaccaggctgcgccgccgattcccgccatggtgcgggatgccggcggcaaggctttgttcaccggcgagcagatccgccgcggccagcaagcctggctggcgtccggcggccagcaattgggcacggtgtggggacatggcagctatgtggcgccggactggtcggccgactggctgcaccgcgaggcgctggcgctgcgggaggattgggcgcggcagcgtttcggcatggcttacgcgcagttggatatcggccggcaaggcatgctggacgccgaactgcgccgcgagatgcgcgccaacggctatgacgcggccagcggcacgctgacgctaagcgcggcccgcgcagccgccgcgcgcgaaacggcccggcattaccagggcctgtacagcgccgatccggccttcgacacgctgcgcgagcagtacgcgatgactgccgacgcgctgccgtcggccgacgaccgcgtggcggtatcggcgttcttcttctggtccgcctggtccgccgccgccgaccgtcccggcgaagctggcgtgtcctacaccaataactggccgcatgagccgctggtcggcaacgcgcccaccgccgccaacggcatgtggtcgatcgccagcgtgatcctgatgctggcgggcatcgccgcgatggtgtggtaccacatggccgccggcgaaggcgaggagcccgcgcaggtgccggatgccgacccgctgggccggctcaaggccacgccgtcgatgcgcgccacccgcaagtatttttatgtggtgatcggcctgttgctgacccaggtgggcatgggcgccatcaccgctcactacgcggtggaaggccacagcttcttcggcatcccgttggccgaggtgctgccctgggtggtgagccgcaccatccacacccagttcggcgtgctgtggatcgccaccgcctggctggccaccggcctctacatcgcgccgctattgtccggccatgagcccaagcatcagaagctgggcgtggacgcgctgttctgggctctggtcttcatcgtcgtcggttccaccgtcaccggctgggtgggtaccttgcagcgtctgggcaccgatttcagcttctggatcggcaaccaggggctggcctacaccagcatggggcgggtgtggcaaatcctgctgttcgtcggcttgttgttctggctgtttctggtggcgcgcgcgctgctgcctgcgctgcgcgataaggaaaccgaaggccgcagcctgatcgcgatgctgctgctgtccgcggcctgcatcggcctgttttacgccacctcgctggcctggggccagcgcacccattattcgatgatcgagtactggcgctggtggctggtgcacctgtgggtggagggcttcttcgaggttttcgccaccgcggtggtggcgctgatcttcgcgcggctgggcctgatccgcatgagcagcgccaaccgcgccatcgtgctggaaaccatggttttcctgttcggcggcatcctgggcacgctgcaccacctgtatttcaccggcgcttccaccgcggtgatctccgtcggcgcggtattctcggcgttcgaggtggtgccgctggctctggtgggtttcgagggctggcagacttaccgccgggccggcgccgcgccatgggtggagcgctacaagtgggcgatcctgtgcttcgtcgccgtcggggggtggaacacggtgggcgcgggcctgctgggcttcgccatcaatccgccgatctcgctgtactacgtgcagggcctgaacatgacgccggcccacggccacgcggcgctgttcggcgtctacggcatgctgggcatagggctgatgctgttttgcctgcgcggggtgtctgatgcgcagcgatgggacaaccgcctgctgaagccggcgttctggctgctcaatatcggcttgttcctgatggtgtttctgtccatcctgccatccggcatctaccaggcctgggccagcgtcgagcatggcctgtggtacgcgcgttcgccggaggtggtgcactcggcgctgatgcagaacctggtgtggctgcgggtgccgggcgacatcgcgttcgcgctgggcgtgctgtatctgggatgcttcgctctgcgcctgctgggctggggcggcaagaaagcgctggccgagcaacgcgtgtga

SEQ ID NO: 3628 - DNA, 2442 bp, Chromobacterium substugae
atggccatgtcgacaagataccccgctctgctgctagtgctgctgagcctggccggctgcaaggagtcgcagcccaagcccggcaccgtgctggatgaggccaaacaggccaaacgcaccgtggaatcgttccccgccgccgacgaggactatttccacgcgatggacagcggcgtgaagctggatgccgacgaagtgaaaggccgcaacacctggctggtctggaccggcggcaacgataggctgtgggacaccctggccaccgtcagcgtcggcaacctcgacctgctcaagaccctgtcctcccatcccggcctcaaattcggccgggacagccgctgggactacctgggcctggtcaacgaaccctgttttgaaaaggccaccggccccgacccgcagcgtttcggcctgtggctggaccaccgcagcgccaactgcccgaaggaccccttcgagaacgagcagaaatatcccggcgtggcgctgggcgcccgcggcaagaacctgcctgccggctcttactacggctacgccaccggggtggtgggactgcggcttttccccaaccccgccttcgacgaagccgcggcgaaaaaatgggaccccaagcgctattacgaagaccccagctattacaacgacaaggacctgatccggccctaccgggtggggatgtcgtgcgcgttctgccacgtcggccccaatccagtgaatccgccggctaatccggagcatccgaagtgggaaaacctcagctccaatgtcggcgcgcagtacttctgggtggaccggatcttctcctggcaggccgatcccggcaatttcgccttccaacttttccataccgcgcgtccgggcacgctcgacacctcgctgatctcgaccgactccatcaataacccgcgcaccatgaacgccgtctacgacctggtcccgcggctggagctggccaagcgctggggcaaggaaaccctggccggcggcggcctcgacaacaaacagttcaacgacttcgtcaaggatgggccgctgacccagttctacaaagcgccaaacaccgtctggacgccgcgcgtgctgaaggatggctcggactcggtcggggcgcttggcgcattgaaccgggtgtatctgaacatcggcctgttcagcgaagaatggctattgcacttccgtccgctgatcggcggcaaaaccatcacgccgatagagatcaaggtcgccaacaaaaactcggtctactggcaggccacggaaaaccagacgcccgacatggccctgttcttcctgaaaagcaccgacccgcacaagctcaaggacgcgcccggcggcgaacaataccttagcaaggacgccgcccagctgacccgcggcaaggtggtgttcgccgaaaactgcgcgcgctgccactccagcaagctgccgcccgaagtaccggcgctggacccgacccagggttgcgccgggcccgactacctgagctgcttcaacaagtactgggagtcgaccaagaccgagcgcttcaaatccgagatgcggaaaatcgtgctggccgacgacttcctgaaagacaactacctgtccaccgagctgcgcgtgccggtgacgctgctggaaaccaacgcctgcagcccgctggcccgcaatgcgctgaaggacaatatctgggacaacttctcgtcgcaaacctacaaggacctgccgtcggtgggcagcatcaccgtccacaacccgttcaccggccagccctggcagtacaagatgccggccggcggacgcggctacacccggcccgcctcgctgatcagcgtctggtcgaccgcgcccttcctgctcaacaacaccgtgggcaagttcaaccccagcccctcggtggccggacgcatggactcgttcaacgactccatccgccagatgctgtggccggaaacccggcagaaggattcggtgctgggcgacaaggtgccgggcgtgatagaccgcaccaccgcgcgcagctacctgcgagtgccgataggctatctgcctgactccctgcaggaactgcaaggcccgctgcaacgctatctgccctggctgttcggcgacgactcgctggaaatcggcccgatcccggccggcaccccggtcaacctgatcgccaacctggagctggtgctggaaaaccccagcctgggcgagcggctgaaacacgacaaaaagctggtatcggtattgctcaagctgatccacgacctgaaggcgctgcccaaggacgccagcgacgaggaagcgcgcaaggtattcgccaacctggcccagccgctgctggagctgagcacctgccccgacttcgtcgtcaaccgcggccattatttcggcacccgctacatgaagggcgaagccgggctgagcgatagcgacaagctggcgctgatcgaattcctgaaaaccttctga

SEQ ID NO: 3629 - DNA, 1899 bp, Chromobacterium substugae
atggcgggcatgagcgcggacagcaatcgttccaccgattacgaatacatcgtcgtcggctccggcgcgggcggcggcaccctggccgcccggctggccgaggaagggcatagcgtgctgctgctggaagcaggcggcgacccgtaccggctgcaagggggggatgcctggcagccggacgccgaccggctgccggacgactacaatgtgccggtgttccacgcgctggcgtcggaaaacaaggcgatgaagctggattacttcgtccgccactatcgcaacgacgaacaacagcggcgcgaccccaagtaccgggccgagtgggatggccagcgggtggacggcgtgctctacccgcgctccggcacgctgggcggctgcaccgcccacaacgccatgatcaccgtctacccgcacaacgccgactgggacaacatcgcccagctgaccggcgacgccagttgggcgtccggcctgatgcgccgctatttccaaaaactggaaaactgccaccaccgcccgctgtaccgctggctgggcaagttctgcatcaaccccacccgccacggctggaaaggctggctgcagacggaaaaagcgataccggagtccgcgctgggcgacgccggcctggtggacaccctgctggtctcgctggacaaggccttcaacgaggtggacgtgccgcacagcagctggcgctggttgctgcaggggcaggccgatcccaacgactggcggctggtgcgcgacaacgccgtcggcgtctgctacccgccgctggccacccgcaaccaccagcgcaacggcagccgcgagcgggtaatcgatgtggcgcaacgcttccctaaccgcctgcacatagagctggacgcgctggccacccaggtgctgttcgacgagcgcaaccgcgccaccggcgtcgaatacctgaagggagaaaagctctatcgcgccttccaccagccgggcagcggcggcgaaaaacgcgcagcccgcgccagccgcgaagtcatcctgtgcggcggcgcgttcaacaccccgcaattgctgatgctgtccggcatcggcccggccgcgcacctgcaacagcacggcatcccggtgcgggtggacctgcccggcgtggggcagaacctgcaggaccgctacgaagtaggcgtggtcaatcggatgaacttcaagcactgggaagtgctgaaaggcgcggaattcgccaagggcgacccgcaataccagcaatgggagcaaggccgcaagggcgtctacaccaccaatggcgcggtgctggccgtgatcaagcgctcagccaaggaaaggccgcttcccgacctgttctgcttcgcgctgctgggcctgttcaaaggctacttccccggttactcccggctgtttcccgaacacctgaactacctgacctgggcgattctcaaggcccacaccaacaaccgcgccggcaccgtgacgctgcgctcggccgacccgcacgacccgccgcaaatcgacttccactacttcgaggagggcagcgccggcggcgaacaagacctggactcggtggtggacgggatcaagttcgtgcgcaccctgaccgccgatctgaaaaaacaaaagctgatcgcggaagaagagctgccaggggatgcggtgcaaaccgacgatgaactgcgtcagtttgtccgcgacaacgcctggggccaccatgcctcctgcagctgcgcgataggcccgcgcgaacagaacggcgtgctggacagcgatttcagggtatacggggtgcacggcctgcgggtggtcgacgcctcggtgtttccgcgcatccccggtttcttcatcgtttccgccgtgtacatgatcgcggaaaaggcggcggacgccatcctggccgacgccggatga

SEQ ID NO: 3630 - DNA, 2661 bp, Chromobacterium substugae
atggactcccaagctgagacatctctctccaaatggcaagacgtattgcgggcagaacgggccagcatcgccgcggccaggcaggccgaggacataccacgcccagccggccccgacggcgccgacatcccccaggacgccatgatagggctggccttctccggcggcggcatacgcagcgccaccttcaatctgggcgtgctgcaggcgctggccaaaaccggctggctgcagcaaatggactatctgtccaccgtgtccggcggcggctatataggcagctggctatccgcgctgaagcgccggctgcggcccaaggaaaccataaaccagacgctgaccgatctgcagggccgggcgccggccattcagttcctgcgcgagtacagcaactacctgacgccgaaaaccggcctgttcagcctggacaccctgtccgcggtcgtcacctacggccgcaacctggttctcaaccagttcgtgctgctgtgcttcctgaccgcgctgttgctatgccctcacatgctggtggcgttcgccggctacgccgccacctaccccggcggcgacatgatgtcgctggcggtggccgtgctggccgccattttctccgcgcggcaggcccgcgacacagtgaacgacggtttgcaggccgccaaacccgccgccgcgtccaccagcgtggcgttgctgctgatcttcgtctacgcggtgtccatcctggcgctgtcccggctgaagcaaggcaatctggcgtggcatgaactgtccctgacgccattcctgctgatctgcagcccggcttacgcgctctactgggcgattctggcgcacggcttcacccagctgaacaatcgcggctaccggcgcagcgtgtgctgggcgctgctggccggcttgatcggcggcggcgggttgtggctgatgctgcaggcgctggactatctgctgccggtgcggcaagagccgttcctggcctggcatgtgatcggcttcggcttcgtgctgctgccggcagccttcatcatgaccgcaaccgcgcatatcggcctggtcaaacgcagcttttcggaactgcagcgcgaatggtggtcgcggctgggcgcgctgctgctggtgagcgacctggcgctgctgctggttttcgccatggtggcgctggcgctgcccttggtcgaggtggccgacgactggatacgcaacgcggtattgccggcctggctgctgtccacgctggccgcggtatggcaaggccagtccgccgccaccagcggcaaggaaaagggggattggcgcgaatgggtggccaagatcgggccctatgtgttcatcgccggcctgctgctgctggtcagcgcgctgctgagctggctgctgacctatttcaagaccaccggcgcccagtgggcgctaagcgacaatccctgtcccgactaccgctgcgacctcaccgagtgggccagcctgcacttccaggcctcgcacgacgccggccacggcggcctgttgtacctgctgctgctggcggccagcctggcggtcggcattttcgcctcgtcgcggatagacatcaacgtcttctccttgcacaacttctaccgcaaccggctgacccgttgctacctgggcgccagcaaccgcctgcgatcggagcgcgtcaatcgcttcaccggcttttgcgccgaagacgacctggcgatgtccgagctggccagggcgaatccggtgcagcgcccctaccacctgatcaacaccgctctcaacctggtatccggctccgacctggcttggcagcaacgcaaggccgcgtccttcactttctcgccgctgtattgcggctacaaattcccggacaccgctccgcacccggtagacgtgtttgtccgcaccgccgactacctgcaggacgacccctcggcgctggaggcgggcccgatgctgggctcgctggtggccacctccggcgcggcggtcagccccaaccagggctaccacagctcgccggcggtgagcttcctgctgacggtgttcaatgtcaggctgggccgctggtgccccaaccccaaccgggccagcgccgcccaactgcgggaaatgtcgccgccggtcagctggcgctacctgctggacgaattgttcggccggaccaacgccgaatcgggcttcgtctacctgagcgacggcggccattttgaaaacctgggcatctacgaactggcgcggcgcgaatgcgcgctgatcatcgcctgcgacgccggccaggacgaaaacatgaccttcgaagacctgggcaacgcgatacgcaaatgccggatagacctgggcgcggaaatccgcatcgatgtggacagcatccgcatcgatgccaccaccggctacagtccgtcgtgctgccaaatgggcgacatcttctacgcgtcaggcaagcgcggccggctgctgtacctgaaaccctgcctgcgcggccacggcgccgagccggtggacgtgctgcagtacaaggcggcgaacccgtccttcccgcaccaatccacgttgaaccaatggttcgacgagtcgcaattcgaaagctatcgcaagctgggcctgtgcataggagaaaccgcgctggccgaattgagccgccccgccagggcgcctgatgcagcagatccggcctag

SEQ ID NO: 3631 - DNA, 942 bp, Chromobacterium substugae
atgttgggcgcgctcaggagtttcgaggccgccggacgcctgctcagtttcacccgggcggcgcaggaattgcatctgacgcaaagcgcggtcagtcagcaggtccgcaagctggaggagcggctgggctaccggctgttcgcgcgcggcagcgcgttggggctgaccgacaagggcggtgcgctgctgcggacggtttccgccgcgctgggcgaaatcgagcagaccctggcgcgattgggtgcggacgcggccccgctgcaactgagctgcgtgccttccttcgcgctgcgctggctgatgccgcgcttgaccgaattccaacgcctggcgcctgaggtgccgttgcggctgctggcggagtttcagccgccggatggcggcatggccggggcggacatcgccatccggtacgacgccgcgagccatgtcccgccgcaggcggtaccgttgctggacgaatacctgctgccggtcgccacgccggcttacctggcgcgccatccggccttcgccgccggcgaatccatggatggcatcgcgatgctgcatgacgcctcaccctgggacggggccgaagctttcgccgaatggcggctatggctgcaggcggcgcggcccgattggctgccgctgctgggcggcgcgcagttcaacctgtccagcctggcgctgggcatggcgttgaaccacgagggcgtggcgatggcccgcaccgcgctggtgtgggacgagctgcaaagcggcaggctggtggatgtgttcggccgctgggtggcgtcgccggcgcgctatgcgctgcttggccgcgacccatcgcggcgggaaacccaggccttcgccggctggatttcgtcagcctgcgcgcggttcgatgccgagcgcgagcgcgagcgggtccgggctcaggggcccggaccccggcggcggcaggcgggctag

SEQ ID NO: 3632 - DNA, 1272 bp, Chromobacterium substugae
atgctatggctaaacgatcaggccggcgtcgcgccgatgccgccgcgtccgcaagccgccgatatcgaatccgcccgaacgcggctgcagcgctgccaaggcctgctggcgcgcttgtttcccgacttgtccgcctgcggcggcgtcatcgcgtcgccgctgctgccgttggccaagctgcaacaagcgcaaggcggcgacgccgcgcgggaaggcgcatggctgctgaaagccgaccatgcgctgccggtggccggctcgatcaaggccaggggcggttttcacgaggtgctggcgctggcggaggaattagccctgcgccacggcctgctggatgcggccggcgaccgcgccgcgctggcggaacccgctgcgcgcgcctgcttctcccaatacaccgtgatggtcggcagcaccggcaatctgggcatgagcatcgggctgatcgccgccgcgctgggattccgcgccgtggtccacatgtcggtggaagccaaagcctggaagaaggacaggctgcgccgccacggcgtgcaggtaatcgagcacgccggcgattacgcgcaagccgtcgccgccggccgcgccgccgccgcggccgatccggccacgcatttcgtcgacgacgagcaatcgctggcgctgtttctcggctacgccgccgccgcccgcgaattggcggagcaattgcgcgccgccggccgcgcggtggacgccgagcgcccgctgttcgtctacctaccttgcggcgtcggcggcgcgcccggcggcatcgccttcggcctgaaggcgctgtacggcgagcatgtccactgcttcttcgccgaaccggccgcctcgccctgcatgctggtgcaactggccgccggcgccgccgccccggtatcggtttacgatatcggcctggacaaccgcaccgaggccgacggcctggcggtgggcctggcatcgccgctggccagcccgctgatggccaggctgctgtccggcgtgttcaccgtggaggacgcgcagctgttcaccgggctgctccagttgttcgaaaccgagggcatcgcgctggaaccatccgccgccgccggcctgcccggcccggactggatctgccgctcggcggccggccgcgcctatctcgacctccacggcctggccggccggctgggcagcgccactcacgtgatctggtctaccggcggctcgctggtgccggaagccgaacatgagcgcttccgcgccgaaggccgccgcctgcgggatcgccaagcccaataa

SEQ ID NO: 3633 - DNA, 618 bp, Chromobacterium substugae
atgtcacgagccaaccacaccgccgatacccgcgaacacctgcttgccacaggagagaaaatcatcctgggcaaaggcttcgccgctgtcggcctggcggaaatcctgtccagcgccggcgtgcccaaggggtcgttctaccattacttccagtccaaggaaggatatggcgtggagttgctgcgtcgttatttcctcaattacgacgagcagctggtgctgcggctgcggccggaagccggccccgcccgcgactcgctgctcaagtatttcaacggctgggtcagccagcaccgctgcgatgcgcaaagccatacctgcctggcggtgaagctggcggcggaagtgtccgatctgtccgagccgatgcgcgaagcgctggcggaaggcatgggccgggtgatttcccgcctggccgacgccatccgccgcggccagcaagaaggcagcctgtgcgtgcatctgccggcggacgaacttgccgccagcctgtacagcctgtgggtgggaagcgcgctcttgtacaaggtgcaacgctccgcccagcccatgctcaatgcgctgaagctgaccgaaaccatgttgaaggttccctccgccgccaactgcggcgcctga

SEQ ID NO: 3634 - DNA, 741 bp, Chromobacterium substugae
atgaacgaaaccttgcaactgatgcagcaacaccgcagcgtgcgcagctatcaggacaagcccatttcccagcaaacgctggacgcggtgctggacgccgcctggaagggccccacctcgatcaacggccagcaagtctcgctggtggtggtgcaggacgccgaacagcgccagcgcatcgccgaaatcgccggcggccagccctggatcgcccaggcgccggtcttcatcgccgtggtgatcgatttccacaaaacccggctgggcgtggagatggccggcgcccagcagacgatacacaacagcgtggaagccttcgccgtgggcgcggtggatgccggcatcgcgctgggcaatctgatgaccgccgcgcgctccgccgggctcggcgtggtgccgatcggcggcatccgccgcgatccgcaggcaatgatagaactgttgcaattgccggaactgaccttcccgctggtgggcctggcgctgggccaccccgatcaggaaggcagcgtgaagccgcgcctgccgcgcgacagcttcgtccacaacggccagtaccaggcggaagccctgcccggccacatcgccgcctacgacgaaaccctgcgccagtactggcaagacatcggccgcggcgacggcgagccctggagccgcaataccgccggctactaccgcaacgtttacttccccaaggttgcccccgtcgcgcgcagccagggttttggcttcgatcaataa

SEQ ID NO: 3635 - DNA, 1095 bp, Chromobacterium substugae
atgcaagccgataaactgttcaccccgctgatcatgggcgccgtcactctggccaaccgcgtggcgatggcgccgctgacccgcctgcgcaacatcgagccgggcgacgtgcccggcccgctggccaaggaatactaccgccagcgcgccagcgccggcctgatcgtggccgaaggcacccacatctcgcccaccgccaagggctacgccggcgcgcccggcatctatagcgaagagcaggtgaaagcctggagcgaagtgaccggcgccgtgcacgaggccggcggcaagatcgcgctgcagctgtggcacaccggccgcatctcgcaccgctcgctgcaacctaacggcgacgcgccggtcggcccgtccgccatccaggccgacagccgcaccaatatccgcgccgccgacggcagcttggtgcgcgagcaatgcgacacgccgcgcgcgctggaaatcgaggaaatcgacgacatcctcgaagactaccgccgcgccaccgacaacgcgcgccgcgccggcttcgatctggtggaaatccacggcgcccacggctatctgctggaccagttcctgtcgccgcaggccaatgtccgcgccgaccagtacggcggcagcgtggaaaaccgcgcccgcttcctgttgcaggtcgtcgacgccgtggtcggcgaatgggacgccgcccacgtcggcatccgcatctcgccgctgggcatcttcaatggcgtcagcaacaccgaccaactggagatggcgctgtacctggccgagcagctggccaagcgcaagctcgccttcctccacatctccgaacccgactgggccggcggccccaagctggacgaaactttccgcgccgagctgcgcaaacgctacccgggcgtgatcgtcggcgccggcggctacaccgcggagaaagccgaaaccctgatcaagcaaggttatatcgacgccgccgccttcggccgcagctacatcgccaacccggacctggtggagcggctgaaacgcaacgcgccgctgaacccgccgcaagcggaaaccttctacggcggcggcgcggaaggctataccgactaccccgcgctgtaa

SEQ ID NO: 3636 - DNA, 642 bp, Chromobacterium substugae
atgatgataccgatcggtatcatcgtcaagacggatggcaaaatgaacaagcgaaaagcggccgattcttcggtcccgccgcgggagcgtctcctcgaggcggcaggcgaactgttttacaacgatggcatccgcgcgaccggcgtcgaggcgatcgccgcccgggcgaataccaccaagatggcgctgtatcgacacttccagtcgaaagacgcgctgttggcggaatggctgcgccaggtgatagccggctactggcgcgcgttcgacgccatagcggccgagcacgccggcgatccgcgcgcgcagattctggggtgggcggcctttttcgccgacgacgccggcgcctggtcgcaccgcggctgtccgttcatcaattcgatcgcggagctgccggacagagagcacgtcggccgcaagctgatagcggaatacaagcaaggccagtggcggcggctggcgggcttgtgccgggccgccggcctcgcgtcgccggaggatacggcgagcgaactgatgctggtgttcgaaggcgcgcaggtcgccgcgcagaaccagtccatcgccgatgccggcgcgctggcgctgcggatcgccagcgccatcgtcgaacgccaggcgcaggcgtcgataggctga

SEQ ID NO: 3637 - DNA, 1497 bp, Chromobacterium substugae
atgaaactttcggaatatgcgcaatacgacgcgatcggcctgggccagcttgtcgcgcggggcgaagtcagcccgcaagaactggcggaaacggcgctgcgggcgtgcgcggcggtcaatcctcacatcaacgcggtcatcgaaacctggcagcccgagctggccgacgccgccgcggcgctggagcgcggatcgccgctcgccggcgtgcccttcctgataaaggacgtcggcgtcgccatggcgggcagaaagatagaattcggcagccggctggcgcagggcttcaccgccgccgccgactccatcctgatgcggcgcttccgccaagcggggctggccacgctggggcggaccaccacgcccgaattcgcctggagcggcaccaccgaatccgcgctcagcggcccgacccgcaacccctggaacgcggcgcgcggcgcgggcggctccagcggcggcgccgcggcggcggtggccgccggtatcgtgccgatcgcgcatgcgaccgacgccgccggctccatccgcattccggccgccgccagcggcgtgttcggcctcaagcccacgcgcggccgcgtatccaacggcccgattctcgacgaggccatccacggcctggccgcgcagctgggcgtcagccgctcggtgcgcgacagcgccgcgctgctcgacgccgcgcgcggcgcggacggcggccagcccttctccatcgcggaacccgccggcagttatttcgcgcaagtcggcgccgagcctggccggctgcggataggcgtgatggcgcaagcctggggcggccagcgcaccgccgccgccgtcctcgagcggctggccgaagcgacgcggctgtgcgaatcgctcggccacatcgtagaggaagcggcgcttcccctgggttgcagctgggacgccttcgtccatgccagctccgtgctatgggccgccaacatcgccgtgtggatcgacgacatggcggcagccaccggacggcagatcgacctgtccacgctggagcagcagacgctggccgtctaccggaccggacatgggatgcgcggcgtcgagatcgtgcgggcgctggacttgcgcaacgccgtcacccgcagcgtcgcggctttcttcacgcgctacgatctgctgctgacgcctacgctgcccgagctggcgccgcccatcggcagttatgccgccgacacggcaagcatggacggccatcaatggaccgcgcatgtgatgggcggttcgccgttcacgccggcattcaacgccgcaggcgtgccggccatgtcggcgcccttgttccaggatgcggcgtcggcgttgccggtcggcatgcagttcgtcgcgccggccggacgcgaggacaggctgttccggctggccggccagctggagcgcagcctgccgtgggcggaccgcaagcccgccatctgggctggccgcgatccacgcgcggaacccgcttgccgccatgatgacaacaggatttga

SEQ ID NO: 3638 - DNA, 129 bp, Chromobacterium substugae
atgatgacaacaggatttgaaacgcgctacagtctgggattggccgccgccgcgagcggcgcgccgccacaacagaaagccctgcacgccgccggcggcaagggctccgcccccaggagaacatcatga

SEQ ID NO: 3639 - DNA, 2070 bp, Chromobacterium substugae
atgaagaccagactgctcgcatccgcggccctgctgttggccacgcaggctcacgcggcggcagatccctacctatggctggagaacatccagggcaaggatgcgctgcaatgggtgaagcagcagaacgagcacaccagccgggaagtggagaactggcaagatttctccgcgctgaagcaaggcatcctgtccgttctcgactccggcgcccgcattcccgccatcgaaaagataggcggccgctactacaacttctggcgcgacgcccagcatccgcgcggactgtggcgcagcgccacgctggacgaataccgcaaggccgaccccgcctgggaaaccgtgctggacctggaccagctggccaaggatgaaaaagaaaactgggtatggcagggcgccgactgcgtcaagcccaggcaagaccgctgcctgatccgcctgagccgcggcggcggcgacgccgcggtggtgcgcgagttcgacctgccggccaagcgcttcctcgccgacggcttcgtggtgccggaagccaagagcgaagtcaactgggccgaccgcgacacgctgtacgtcgccaccgatttcggcaagggcacgctgaccgactccggctacccgcgcatcgtcaaggagtggaagcgcggccagcctctggccgacgccgccacgctgttcgagggcaggcagaccgacatctcggtcaacgccgacggcatcgacaccgccggccagcactacgacgtgatcagccagggcaccagcttcttcaccaacgacacctatctgaagcgcgacggcaaatggctgaagctggacaagcccggccatgtcgaggcgtctttccacggcgcctggctgctgttgcggccgcgccagaactggcaggtcggcggccatgactggaaggccggcagcctgctggcggtgaaggtggacgactacctgcaaggcaagcgcgatttcgccgcgctgttccagccgaccgccaccacctcgctgggcggcagcgctggcacccgcgacgcgctgatcctgaccgtactcgacaacgtcaagagccggctggtggaatggaaggtggcggacggcaagtggcggtcgcgcccggtggccgcgcccggctacggcagcatagacgtcagcccagtggacggcgacagctccaatgactacttcttcaccttcaccgacttcctgacgccgacctcgctgtcgctggcccacatcggcagcgacgcgcgcgagccgctgaagcagcagccggccttcttcgacgccaagccctaccgcatccagcagttcttcgcccgctccaacgacggcacccgggtgccttacttcgtggtggcgcgcaaagacttgaagctcaacggcaagaacccgacgctgctatacggctacggcggcttcgaggtttcgctgacgccctattacagcggcaccttgggcaaggcctggctggagcgaggcggcgtctacgtgctgggcaacatccgcggcggcggcgaatacggcccggcctggcatgaggcggcgctgaaacacaagcgccagaaagcctacgacgatttctcgtccatcgccaaagacctgtcgcgccgcggcatcgccgacgcgcgccacctgggcatcaagggcggcagcaacggcggcctgctgatgggcgtgatgctgaccaagtatccgcaactgttccacgccatcgtctgccaggtgccgctcttggacatgaagcgcttcaacaagctgctggccggcgccagctggatggacgaatacggcaacccggaccagccgtccgactgggcctacatcaagcgctactcgccgtaccagaacattcgccccggcacccgctacccggccacgctgttcgtcacctccacgctggacgaccgcgttcatcccggccatgcccgcaagatgttcgccgcgatgaagcagatcggcgccgacgtccgctactacgagcgcaccgagggcggccacggctccgccgccaatcacgacgaagaggcgcgcatcgccgcgatggaatacgcgttcttgtggaagcaactgcgctga

SEQ ID NO: 3640 - DNA, 4539 bp, Chromobacterium substugae
ttgtccaccttccgttcccgcatctggtcgcggcccgaactgcgcgttgccgtcgttttcgtctgcacgatgatcgcggtcaccgcggcggtggtgttccagaccggcctgcaccagcgccagcagctgctgtccgcctaccagatccgcctgggctacgtcacccacacccgcgacgccatcctgcgcaaccaattcgaccaactggcgcgcgacgtgcgtttcctcagcgccaccccgccggtctccggcatcgtccgcgccagcgcgcacggcggcgtcgacccgcaggaaaactccacgatggcggcctggcacagccgcctcgcctccatcttcagcgccttcctcgccgccaatcccgaattttcctctgtccgcttcatcggcatcgccaacgatggcaaagaactggcgcgggtggagcgcaatgcccaagaccaggtggaagtcacccccgcggcgaaactgcaggcgcacggcgaccgcgactacatgcaggaaaccatccgcctggaaaccgggcaggtgtacttctccgacatcaacctaggctcccgccaccgcgacgccggcggcaacaccgcggtgccgaccatccgggtggccacgccgatacgcgacgccggcggcaaaaccttcggcatcgtcatcatcaatttcgacgcccgcaatctgctggcctcgctgttccagagcatcccggtggaactgaagctttacgtcaccaatcagggcggcgactacctggcccaacccgaccccagccgcgtcttcggcttcgaaaagaacctgcaatggcgctggagcgacgacttccagccgaccaccccgttgctggggcagccggaaggcctgcaggcctactcgtcgccgcacggcaccgcctatgtgcgctcgatcaacatcccgttcaacccggccttccccaaccactactgcaccgtgtacgcggtgctgcctgacgaggcggtggccggcatggtggccaccacccggcgcgccacgctggccacctcgctgggcatcttcctgctgatcggcgccgtcgcctcgctctacctgaggaaataccggcaggccagcgcgcggcaggccgaactggccgccatcgtggaaagctcgcacgacgccatcatcggctgcacgcccgacggcaccgtcagcagctggaacgccggcgccgaaaaaatgttcctctacccggccgcggaaacgctttcccgcaaattgaccgagctgatcgtgccgcccgagatcgaaccgctgctgcgggaactgcgccaggatggcgtgcagaacagcttcaacagctcgctccacacccgcgaaggcctgctgctggacgtcgccatcaccatgtcgccgatccaaagccgcgacaaccggctaagcggcttcgcgctgaccatccgcgacatcaccgaccagaaagccactgaaaagcgcatccgcgagttgaacgcctcgctggagcaacaggtggaggcgcgcaccgcgcaaatccgcatttactcggcgctgcagaacgccatcctggccaatgccggctacgccatcatcgccaccgatctctccggcatgatcacgctgttcaatccagcggcggaacgcatgttgggataccgcgccgacgagatgataggccggcagccgctgacgcggctgcaccgccagagcgagctggccgcgcaggcggccagcttgtcgcaggaactgagcgaggacatccaggccggcttcgacgccatcgtcgcccgctcccgccacggcctgagcaatgaaagccagtggacctacgctcgccgcgacggccgcctgttcccggtgcagctgaccgtctcgacgctggaaaacgaggctggcgaggccagcggctatctcggcatcgcggccgacatcaccgagcgcgaacaggaccggcgcgcgctggagtcggcgcgcgaccaactggaaaaagccgccgaggtggccgaactgggcatctggcgttgggagatcaacagcgacaccctggaatggaatgaccggatgttcgagatttacgacatccccaaatccttcagggtgttcggcctgtactacaaccactggcgctcgcgcgtccacccggacgatatcgcgatggccgaacacaagctgcagggcgcgctggaaggcagcgacgtctacaaccccaccttccgcatcgtccgccaggacggcgaaatccgctacctgcaggccgcggcgctgatcgaatacgaagccgacggcaagcccggccgcgtgctgggcatcaaccgcgacatcaccagccagcgggagcaggaggactggctgctggaggccaaggccgccgccgacagcgccaaccgcgccaaatcggaattcctggccaatatgagccatgaaatccgcacgccgatgaacgccattctcggcatgctgcagctgctgcagcagaccgggctggacaaccgccaggcggactacaccgacaaggccgccacggcggcgcgcaccttgctggccatcctcaacgacatcctggacttctcgcgggtcgaggccggcaagctcacgctggaccctcaccccttcagcatcgacaagctgctgcgcgacatcggcgtgatcctgtccgccaatgtcggcgacaaggatgtcgagatcctgttcgacatcgatccggcgctgccggacgaaatcgtcgccgacgccctgcgtctgcaacagatcctgatcaacctgtccggcaacgccatcaagttcaccgagcgcggggaagtggtgctgtcggcccggctgcaacaacaggacgagaaccggctgaccatcgccttcgccatccgcgacaccggcatcgggatttctgccgaacaatgccagcgcatcttcgaaggcttttcgcaagccgaaacctccaccgcccgccgctacggcggctccggcctgggcctggcgatcagccagcgcctggtcagcctgatgggcggccagctgagcgtggcaagcgagcaaggccagggcagcaccttcagcttcaccatcgaatgcgagacggcgcagccccccccgctggctccgcccgccggcatcgtctcgctgcataatctgagctgcctggtgatagaggacaacgacaccgccaggcaaacgcaaagcgccatcctgcgctccttcggctggcaggtggatgtcgccggcagcggcgaggaagcgctggccatggtggccgaagggcgggactacaacatcgtcctgatagactggaagatgcccggcatggatggctgggaaacctgcagccggctgcgcgcgatgcaaagcggccggcacacccctgtcatcatgatggtgaccgcctacggacgcgaactgttcgcccagcggcaacagcgcgatcccgacctgttcgacagcatgctggtgaaaccggtcactgcctcgatgctgttcgacgccgtcgccgacgcccaggccagccatggcgagcccgcgccgacgccgatccgcccggcgaacctagccccccggctgagcgggctgcgcctgctgctggtggaggacaacccgaccaaccagcaggtcgcccgcgaactactgggccacgaaggcgcggaagtggcggtggcagattgcggccaggcggcgctgcaggcagtgcatgacgccgcgccgctatacgatctggtgctgatggacatccagatgccggacatggacggctacaccgtcacccggcgcatacgcgccgaccatcccgccgaccaactgcccatcatcgccatgaccgccaatgtgatgccggccgaccgcgaggccgcgctagaggccggaatgaacgaccacgtcggcaagcccttcgatctggcgcagctggtggaagtgatccagcgccataccggcaggcccgccgcgccgccgccggcccctcccccgcaaccgcggcccgcggacggcaagcaaacgctgaacagccagtccgccatcccgcgcttcggcggcaatctgcagatctaccgccataccctgctcagtttctgcgatgaaatccattcgctgctgcgcgacctggaggatgcccgcgccagccagcgccgggacaaggccgtccaggccttgcacaccctgaagggcctggccgccaccgtcggcgccgaagaattggcggcgctggccgcggcggaggaaaaaaccatgcgcgccccggaacagcgctggcccgacaatccggagccgctgcgccaggccgcgcagcgggcggaagccgccgcccaggaagaggcggaacggcttccccatggcgcggcgcccgccgcgcgggccgatacggacgccgaagacctgcacatcggcctcgccagcctgcggcacatgctcaatacggctaatcttgaagcgatgcatgtcttcgagcagttgcgccagcagcattaccacgccatgccgggcgagttcgaccagctcagcgacgccatcatgaagatgaacttcgctgcggcggcccgcctgtgcgcggacatcctgcaacgagccaaggtggatcagccatga

SEQ ID NO: 3641 - DNA, 936 bp, Chromobacterium substugae
atgagcgccaatctatccgcagaagccccggccccggcctttcaccgcggccggatactggtcgtggacgatcagcccagcaatatcatggtcgcccaccagatattgcagtccgaacacgaggtattcatggccaccagcggcgaacaagcgctggctttctgccagaatgccccgcccgacctgctgctgctggatgtggaaatgccgggcatgaacggcatggaggtgtgccggcgcctgaaacaggagcccgccacccagggcataccggtcatcttcgtgaccggccatcaaagccaggaacaggaggcggcctgttgggaggccggcgcggtagatttcgtcaccaagccggtgacaccggccaccttgcgcaaccgggtcaacgtccacctcaccttgaaacaccaggccgaccagttgcgcgcgctggccttcaccgacgggctgaccggcatcgccaaccggcgctacttcgacgcgcaattcgacaaggtctggcgtcattgcctgcgccacggctcgtccttggccttgatcatgtccgatgtcgatcatttcaagaaatacaatgatcgctacgggcacacgatgggcgacgaatgcctgcgccagatcgcccgcaccctgcagctgcagctgaaccggccttacgacctggccgcgcgcttcggcggcgaggaattcgtctgcctgatgccggaaaccagcctggccggcgcggtgtcggtggccatcaagatggaggcggcgatccgcgcgctgcagatcgaacacgccgattcgcaaccggaccacaccgtcaccctcagcctgggcgtggccgccatggcgccggatgcggacagcgatggccggcatctgatgaaaatggccgacgaccagctctatctggccaagaataccggccgcggccgcatctgcgccgtctag

SEQ ID NO: 3642 - DNA, 1155 bp, Chromobacterium substugae
atgtcgtcgacgaccatcttgctggtagaggatagcgccaccaaccggtatttcatcgaacagttcatcatggaactgggatatcggtgcgtgtcggccaagaatggcctggaggcggtggcctattgtcgggatcatctgccggacctgatcctgatggatgtcatcatgcccgaaatggacggcctgcaggcgacggccgagctgcggcggatgttcggcgaacactgggtgcccatcattttcctgaccagcctgaacgaactggaaagcgtggtcggcgggttgaaatcgggcggcgacgactacctggccaagccggtgagcttcgatttgctgtcggccaagatccatgtcttcctgcgcatcgccgagatgcagaaccagatcaaccaggacgcggtgcggctggaaaagtacttccgcgagaacgaggtcgagcagcagctggcgctggaactgatcgagcggctgatcggccagcgcacatcccagccggagtatgtctggcaatacctgagccctgccgccagcttcaacggcgacctgatcatcatctgccagccgccatccggcggcgaacacatcatgttggccgactgcaccggccatggcctgacggcggccatcagcgcgctgccggctatcgattgcttctatgaaatgacccaggccggctgcggcatggccgagatcgccaggggggtcaatcagaagctgcaccgcctgctgccgggcgggcgtttcgtcgccgcggcgctgatcgccatcgaaccggaagggcggcggctgaacatctggaacgggggcgtgccctgcgtgttgctgttcaacgaccaggcccaggtgataggcagctgcaaatcctcccatcccccgttaggcattctgccgtcggaggcgttcgacgattcgatgcagtcgctggaatggcggccttcccaagtgctggtggtcagctccgacggcatcaccgaggcgaaaaacggcgccggagagatgtttggcctgccgggcgtggtggcggccgcgggcaagggctggccggcgcggataggagaaagcgtgctggaggcggtgacggcccatatgcaaggcggcgcggccagcgacgacatttccttgctggtgattcgccacccgcccccgcattga

SEQ ID NO: 3643 - DNA, 702 bp, Chromobacterium substugae
atgaatcaagcatctgaaaaagccctggtagtgctctccggcggccaggactccaccacctgcctgtactgggcgctgcggcgcttcggcgacggcaatgtagaagcggtgaccttcgactacggccagcgccaccgcgtggaattggccgccgcgaagaaaatcgccgccctcgccggcgtgcgccagaccgtgctgccgatcgataccttcgccgccatcggcggcaatgcgcttaccgacgacggcatcgcgccggaaaccggcgcgcgcgacgacgacgcgctgcccaataccttcgtgccgggccgcaatctggtatttctcaccttcgccgccgccttcggctatacccgcggcgcccgccatctggtgaccggcgtggcccagaccgactactccggctacccggactgccgcgaaaacaccctgaaagcgctggaagtggcgctgcgcctcggcatggacagccgggtcgagctgcacacgccgttgatgtacctgtccaaggccgaaaccgtgacgctggcgcaacaggtgggggccatggaagccctggcctggagccatacctgttacaacggcgaggtgccgccctgcggccgctgcgcctcctgcgaactgcgcgccaaaggcttcgccgaggccggcgtggccgacccgctggtatcccgctgccaggccgaagcgcaaggaaactga

SEQ ID NO: 3644 - DNA, 1020 bp, Chromobacterium substugae
atgcacgcctgttacatgatggccggcgccggcttcgaagctgcgcggcagctgcatgccgcccccggccgcgaagcgcgcccgcacggccacagcttccgtctcggcgtccgcgccgaagcccaatacaccgatcagacgacgctgcaagccgcggttgaagccgcggcggcggcgctcgactatgccgacttgaacaccgcgctggccgcctgcgacgatctggcgctagcccgccacctggccgacgccctgccccatccggcggccatccggctgcaaagcgcgccggaccgcggcgtgatgctggacggcgtccaagcgctggtctggctgaatacttcgttcgaggccgcccaccatctgccgcacgtgccgcccggccacaaatgcggccgcctgcacggccacggcttcggcgtgcgcatcgtcgccgacgccgcgcgctgcagccaggacgacttggcgcgcgcctgggagccgctgcgcggccgcctcaaccaccgctacctgaacgatatcgccggcctcgacaatcccaccagcgaagtgctggcgcaatggctgcaccagcaattgcgggacgcgctgcccggcctcgcctgggtggaagtgcgggagacccacagcgccggcagccagttcgacggcaagcgcttccgcatctggaaggaacagcgcttcgaaagcgcgatgccgttcgacgccgccggcaattacaccggccacagctacctggtgcgcctgatgctgtccggcggcatcgaccgcaccatgggctggctgctggacttcggcgacgtcaaggaccgcttcaagccgatctaccgccagctggaccacaatccgctggacaagctggccgggctgcgcagccgggacaacgccgcggtggcggaatgggtccacgcccagctgtcgccgctggtgccggagctggctcgcgtcgacctgatggaaaacgaaaacgccggcgtctcgctgcatttccatcaggatatgcgctggccgctgctgtaa

SEQ ID NO: 3645 - DNA, 636 bp, Chromobacterium substugae
gtgactacctataccgtcaaggaaattttctacacgctgcaaggcgagggccgccaggcaggccgcgccgcggtgttctgccgcttcgccggctgcaatctgtggtcgggccgcgaggaagaccgcgccaaggccgtttgccgattctgcgacaccgacttcgtcggcgccggccctgacggcggcaagttcgacggcgccgaggccctggccaagcgcatcgccgccgaatggccgcaagacgccggcggctcgccctacgtggtgtgcaccggcggcgagccgctgctgcaattggatgcggagttggtcgacgccttgcacaccgaaggcttcgagatcgccgtcgaaaccaacggcaccgtcgccgcgcccgccgggctggactggatctgcgtcagtcccaaggccggttcggagctgaaacagctggcgggcgacgagctgaagctggtctatccgcaagccgcccagatgccggaaagcgtcgcccatctggacttcggcaccttctatctgcagcctatggacggccccgacctggccgccaacacccgcgccgccatcgcctactgcatggcgcatccgcagtggcggctatcggtgcagacccacaaggtggtgaatatccgctga

SEQ ID NO: 3646 - DNA, 252 bp, Chromobacterium substugae
atgaaccgcaacaagactctgatcgccaccgccttcggcgccgtcatcgccatgggcgctctcgccagcgcgccggctgccgccgccgacaaggaccagtgcttcggcatcgccaaagccggccagaacgactgcaagaacgccagccacgcctgcgcaggccaggccaagaccgacaacgaccccgccgacttcaagctggtgccggccggcacttgccagcagatgggcggtcaaaccaagccgatgtga

SEQ ID NO: 3647 - DNA, 261 bp, Chromobacterium substugae
atgaaacagagcaaagccctcatcgcctccgcgctcggcgccgtcatcgccatgggcgctctcgccagcgcgccggccgccgccgccgacaaggaaaagtgttacggcatcgcccaggccggcaagaatgactgcgcctcggcgaccggcgcccactcctgcgccggccaggccaagatggacaaggacccgggcgactggaaatacgtagccaagggcagctgcgagaaaatgggcggcagcaccaccgtcaagaaataa

SEQ ID NO: 3648 - DNA, 825 bp, Chromobacterium substugae
atgccccccctgcccaatgtctgcggcataggcctgcgcgccccgcattaccgcgaagcactggaaaccctgccgccccttggctgggtagaggtgcacagcgaaaatttcttcgacggcggcaccccgctcgccatgctgcggcgcgtggccaaaaactggccgctgtccctgcacggcgtaggcctgggcctgggctcctgtccgcgccccgacgccggtcatctggcctcgttgaagcgcttggtggacgagctgtccccggcctccgtttccgaacatctgtctttcaatcattcgccgtcgcgctatgtgaacgatttgctgccggtaccctacacccgggccgccctcgacgccgtcgccggccacgtcatggaaacccaggacgcgctgcgccgccccatcctgctggaaaacctgtccagctacgtcgaatttcccggcaatgaaatgaacgagggcgaattcctggccgagctggtgcgtctcaccggctgcggcatccttctggacgtcaacaacctctacgtcaaccgcatcaatctgggcacagacacccgcgcggtgctgtccgcgctgccggccgaagcgataggcgaaatccatctcgccggctacagcgagcgcgaaggcatgctggtggacacccacagccagccggtgcacgaaggcgtctggcagctgttccgcgaagtgatccgccagatcggcccgcggccgacgctgatagagtgggatctggacataccgccgctggcggtgttgcaggccgaggccgccaaggcccaggcgctgctggaggcccgacatgaactggcatga

SEQ ID NO: 3649 - DNA, 765 bp, Chromobacterium substugae
atgaactggcatgactggcaaagcgcgctgctggaagccatcgccgatccggcccagcccgcgcctgccgccgaactgggcctgcgcgccgacgggctggcggtctaccgcaacaactaccgtgtcggcctgatcgacacgctggcccacagccacccggtctgccggcaactggtgggcgaggagtttttcaccgccctggcgcgggagtacgtcaagactcacgcctcgcacagcggcaatctgcatctgtacggcgcgtcgttttccgatttcatcgccggcttcgagcactgccgcgagctgccctatctggctgacgtcgcccgcctggaatgggccgcgcaccgcagctattacgccgccgacgccgaggcgctggacagcggcgcgctggcggccttcgcgccggaacaatgggagcagctgattttcacgccgctgcccggcgtggcgctatgcgccgctgacagcccggcgctcagcatctggctcgcccaccgcgacggcggctcgctggaaggcatattgcaacgcccggccgaaaacgcactggtgttccgcctgcgcggcgaagtccaggcgcaagcgctggaccccgcccgctacgccttctacgccgcgctgttcgccggggcggcgttggaacgcgccatccccccggcgctgcagaccgacgaaaacttcgacctgcaagcggccttgttcggcctgttccaacccgccctgctctcgtccatccatctacaaggcgcacccgcatga

SEQ ID NO: 3650 - DNA, 471 bp, Chromobacterium substugae
atgaataaacttatccaggcgccggtttgcggctaccagctgctgatccgctgcgccaacctgctgcaacccctggtgctgctgctgttgcggctatggatcgccaatgtgttcttcagctccggcctgaccaagatcgccgactgggacgtgacgctggctctgttcagcgacgaataccacgtgccgctgctgccgcccgccgtcgccgcggtgatggccacctgcggcgagctgggcctgtcctcgctgctggcggcgggactgggcggccgcttcgccgccgccggactgttcattctcaacgccgtcgccgtcatcagctaccctgacctgaccgaggccacgcgccagttccactatttctggggcgcgcagatcctggtgctgctggctttcggccccggactgctgtccttggaccggttggtgcaatggcggctgcaaaaacgcggcggcgcagaaggctga

SEQ ID NO: 3651 - DNA, 843 bp, Chromobacterium substugae
atgagcgcacagaaaaccctggtagtcctcgccccgcaaccggacccgcaacatctcgccgacatcgcccgcctggccggcggccagcctaccgtcggcgagggagccgcgcgcatccgcgcagtcctgccggaacaccgccggcaagcgatcgaacagtgccggcgccacggctacgacgctgcctacgtcgacagcgacaagcgcttgggcgacttcggcctgctggtgtccgacatggactccacactgatcaacatcgaatgcatcgatgaaatcgccgacatcaagggcctcaaaccgcaagtggcggaaatcaccgagcgggcgatgcgcggcgaactcgacttcggcgccgcgctgaaggaaagggtggcgctgctggcgggcctgccggagtcggcgctggaacaggtataccgcgagcggctgcggctgaatcccggcgccgaggcgctgctggccgcctgccgcggcctggggatcaagaccctgctggtgtcgggcggcttcacctatttcaccgacaggctgaaggccgactacggcctcgactacgcctacgccaaccagctggagatcgtcgacggccgcctgaccggccgcttgaccggcgacatcatcgacgccgccgccaagcagcggctgctgatggcgacccgcgacgcgctgcagctgcgggccgaccaggtgctggcggtcggcgacggcgccaacgacctgcctatgctgcgggaggccggcgtcggcatcgcctatcacgccaaacccatggtcagcgccgaggccgacatcgcgatcgaacgcggcggcctggacgccattctgcagctatttctctga

SEQ ID NO: 3652 - DNA, 525 bp, Chromobacterium substugae
atgcaagacgccaaagcgccggaccttccgcaactggacaccgtcagtttcgacgccgacctgccgtttcaagtccaggagcgcgaaggcgactattcgccgcgactgcaaagagaaacccggctggcgctgcgcgtgctggccgcgccgggagaaacgcccgatgacagcaaccccgtgctgctgcggctggaggccaagctggacctggcgctggaagtctccctgctggagcgccaccccgaccgccccgcctgcacgccctgccgcctgggcctgagcgcggtggcctggtgcgacagccgggcctgggcgccgggccaagcgctgctgatctcgctctaccccaacccggactcggcgctcagcctatgcctgaacggccgcgtgatccagtgcgatagccaatcgccgcagcgccatctgctggtggccgacatcagcggatcgttcgacctggacacccacctgatgtgggaaaagtgggtgttccgccgccaccgccgcgccatactggagcgctga

SEQ ID NO: 3653 - DNA, 975 bp, Chromobacterium substugae
atgctgattgaccgttttggtcgagccatcgagtacctgcggctgtcggtgaccgaccgctgcgacttgcgctgcaactattgtctgcccaagggtttcaagggtttcgaggagccggccaactggctgactttcgacgagatcgagcgagtggtcgccgtattcgcccggctgggcacccgccgcgtgcgcctgaccggcggcgaaccgctgctcagacgcaatctgccgcaactggcggccaggctgtctgccctgcccgggctggaggatttgtcgctgaccaccaatggcacccagctgcggcgccacgctctggagttgaagcaggccggcgtgcgccggctgaacctcagcctggattccctgcgccgcgactgcgtcgaacggattaccggcagcgacagcctgccgcgcgtgctggatggcctgatggcggccaaggaggccggtttcgcgccgatcaagatcaatatggtggcgatgcgcggggtcaacgagcaggacatcgagtctatggtggccttctgcatcgagcatggcctggtattgcggctgatcgaggcgatgccgatgggcgataccggccgcgccgcgcaatatctggatctgcagccggtgctgcaacggctgagccggcagtttggcttatcggcgcaggccgtctccttgggcggcggtccggcccgctactggagcagcgccgacggcgctttctcgctgggcgtgatcaccccgatctcgcaacacttctgcgccacctgcaaccgcgtgcgcctgtcggtggacggcacgttgtacatgtgtttggggcaggaggaaaaaatggagctgcggccactgttgcgcgccggcatagacgatgccggcctggaggcggcgattcggcaggcgatagagctgaagccggagcgccatgagtttcgcgagcagccacagaagctggtgcgcttcatgtcgatgaccggcggctga

SEQ ID NO: 3654 - DNA, 129 bp, Chromobacterium substugae
ttgagggtccggaccgcttgccgccggcgcggcggatggcggccctatccggcggctttcgccgtttgcgcggcttgttttgatgagtgccggatatccagtttgaataaactggcgggaccagtataa

SEQ ID NO: 3655 - DNA, 297 bp, Chromobacterium substugae
gtgtatgaaatgaagccaagcattctgatactggccgccggtctggccttgtccgcctccgcggcgtttgccgacaccgcgaccaataccatcgtcggcggcgccctgggcggcgcggctggcgctgcaatcggccattcggtgggtgggcgcgacggcgccatcattggcggggcgataggcggcggcgccggagcggccatcggcaacggttatggcaagtcgggcagccgcgaagcgcgcggcgacggccgctatcgctgccggcacaagcatcgccatcatcgttgccgctaa

SEQ ID NO: 3656 - DNA, 741 bp, Chromobacterium substugae
atgaagccgcatgaagtgcgtagccgtgccttcgccatgccccttaccagcccggcctacccgccgggaccgtaccggttttacaaccgcgagtatatggtcatcacttaccgcaccgatcccgatgcgatccaggcggtattgccggagccgttgcaggcggatggcgatatcgtcaaatatgagttcatccggatgccggactccaccggcttcggcgattattcggaaagcggacaggtgattccggtcacgttccgcggcgtgcgcggcagttattcccatgcgatgtttcttgatgatcagccgccgctggctggaggacgcgagttatgggggtttcccaagaaagcgggccggccgaagctggaggtttgcggcgacaccctgatcggcagcctggatttcggccccctgcgcatcgccaccggcaccatgggctacaaataccagcagctcgaccaggtggcgctggaggccagcctggctgaacccaatttcctgttgaagatcattccgcatgtcgacggcacgccgcggatctgcgaattggtgcgctaccataccagcaatgtggtgataaaaggcgcttggagcgcgccggcttccctggagctgcatccccacgcgctggcgccggtggcggacttgccggtattggaggtgctgtcggcgcggcatttcatctgcgatctgacgctggacctgggatcggtggtgtatgactatttgcagcagtga

SEQ ID NO: 3657 - DNA, 300 bp, Chromobacterium substugae
atgaacgccgccaagaaaatccgccgcttcctggaggaagggcacgatcctcagcaaatgcaggtgctcaaggaattggcggccgccctggaaatgggccgctccttcgatttgagccagctgtacgatatcgatatgcgctacttcgaagtcgctatcgacctgttgaaagactggcgtttcgatcatcacatcagcgcgcgcagcaagttgctggagcaactgctgaccgaaatcgccccctcgcaacaagccgcacccgcaacggaagagcgcggcagggaaaaacgcaaaggctaa

SEQ ID NO: 3658 - DNA, 1044 bp, Chromobacterium substugae
atgcctgatcaattgagagtgggtctgatgggttttggctatgcgggtgcgacgtttcatgcgccgctcctgtcggcgacgcctggcatcaagctggccgcggtggcatccagcagggccgagctggttcgcagcgcattgccggccgcgcaggtttttccatctcctgaggcgttgttgacagggagcgaggtggatctggtggtgatcgccaccccgaacgatagtcatttcgccctggccagcgccgcgctggcggcgggaaagcatgtcgtggtggacaaaccgtttacggtgagggcggtggaggctcgcgggttggcgctccaggccgagcaggccgggttgttattgtcggtattccacaatcggcgttgggacgcggattttctcgcggtgcggcagctgttggctgatggggtgctggggagggtaacgcattttgagtcccattttgaccgttatcggccgcatgtgcggcaacgctggcgagagtcggcgcaggcgggcgcgggcttgtggtatgacctggggccgcacttgctggaccaggcggtgcagctgtggggcttgccagaggcgatttctctggagctggccgctttgcgcgatggggcccaggcggatgactggttccatgcccagttgcgttatgccgacaagcgggtgattttgcatgccagcgccttggcggcggatgccgggccgcgtttcatcatccacggcaccgcgggcagctatgccaaatatggtttggatacgcaggaggatgcgttgaaggccggcgatcggcctggacaggcgggatggggaggggacccgcggccggggcgcttgctgctcgcggggagcgaggctgtcgaaaggccggctggcgccggcgactacatgcggtattacgccggggtgcgcgacgccattctgcttggggctgccaatccggttgacgcttgggaggcatggcgggtgatggtgttgctggaacttggctgcgacagcgctgcccaacagtgctggaaggccgtcgcgccttccctggcttag

SEQ ID NO: 3659 - DNA, 118 bp, Chromobacterium substugae; identical to SEQ ID NO: 426

SEQ ID NO: 3660 - DNA, 2712 bp, Chromobacterium substugae
  modified_base (2693)..(2693): a, c, t, g, unknown or other
atggctgaatcgcaaaaaaaacaaaaaaagctttccctgcgtgaccaggatcctttcctggagcgggaaaaactcaaatattccaatcccttgcccagccgcgagttcttgatgcagattctcgccgagcagggggtgccgctgtttccggacgaattggcgcagatgctgtcgatcgctccggccgagattctctactttgaacgccgcctgcgcgcgatggagcgtgacggcgaggtcatcatcaatcgcaagggcgcggtctgcgtcgcccagaaactggatctggtccgctgcaaggtgtccggccaccgcgatggcttcggcttcgcgatgccggatgagggcgaaggttccggcgcggatatcttcctgcctgaacgcgaaatgaaaaaagtgatgcacggcgatcgcgtgatggtgcggccgtcgggcgtggacaggcgcggccggcaggagggccgcatcgtggaggtgctggagcacgcggtcacccgcctggtcggccgcatccagcgcgagcgcggcgtgtgggtggtgctgccggaagacaagcgcatcaaccatagtattctgatcgaaccgggcggcgaggccggcgccaaggagggccaggtggtgatggtggagatcctgcagcagccggatgcccaccaccagccggtcggccaggtgacggaggtgctgggcaattacgccgatccgggcatggagatcgagatcgcgctgcgcaagcacgatcttccgcaccgcttccccgacgacgcgctgctgcaggcgaaggaaacgccgaagaaagtgcgcaagaaggattggagcaaggatcgcgtcgatttgcgcgagctgccgctggtcaccatcgatggcgaaaccgcgcgcgatttcgacgacgcggtgtacgcggaaaagaaaggcaagggcttccgcctggtggtggccatcgccgacgtcagcttctatgtgcagccggcagacgcattggataaggaggcgctcaatcgcggcacctcggtttacttcccgcgccgggtgatcccgatgctgccggaggcgttgtccaatggcatctgctcgctcaatccggatgtggagcgcatgtgcatggtctgcgacatgcagatcaacgccaagggcgaagtgaagaagtaccagttctatccggcggtgatgcgctccaaggcccggttgacctacaaccaggtgtgggattggctgcagaacggcagcgatcatccgatgctgccgcacgtgaaagatttgtacgcgctgttcaagattctgctggcggcgcgcgccaagcgcggcgccatcgagttcgattcggtcgaaacccagatgatcttcaacgatagcggcaagattgaccgcatcgtgccggtggtgcgcaacgacgcgcatcgcctgatcgaagagtgcatgctggcggccaacgtttgctcggcggatttcctgctgaagagcggccacaaggcgctgtaccgggtgcacgaggggccgacgccggaaaaactggaaaacctgcgcgcctatctgcgcctggtcggcctgacgctgggcggcgcggacaagcccagcgccaaggattacgccgttttggcggagcaaatccacggccgccccgacgcgccggtgctgcagaccatgctgctgcgctcgatgcagcaggcggtgtacacccaggagaacaacggccacttcggcttggcgtacgaggcatatacccatttcacctcgcctatccgccgttaccccgacttgctggtgcaccgcgcgatcaaggcggtgctgaagaacgaaaagtacaagccgggcaagtgggctgccttgggcgtgcattgttcgatgaccgagcgccgcgccgacgatgccagccgcgacgtcgagtcttggctgaaaacctactatatgcgcgacaaggtgggcgaggttttccagggcaagatcagcgcggtcacaagcttcggcgtatttgtgttgctggacgacgtgtatgtcgaaggtttggtgcatatctccgagttgggcaaggactacttccacttcaagaaggacatccaggcgatagtcggcgagaagagcggcatgcagtaccggctgggcgacgcgttgaccgttaaagtgatgggcgccaatctggaaagcgcccaggtggatttcgcgctggtgcgcgaaacgccagtcgtttcagagacgtcggctgcctctggcaagaccgaaggcgatgcgcccaggtcgtcgcggcgcagtcgcggaaaccgagcagcgcccgcggcggaagcgccggaggcgcgggaaagcaagccggcaggcttgccggcggcgccaaagggacgtagccgccaaactgcggggcggaaccgtgcggctgaagctgtcgctgcgccagccgctcaggccgtcgagcagggtaagcctgctgctcaagcgaagcctgttgctcaagcgaagcctgttgctcaagcgaagcctgctgctcaagcgaagcctgctgctcaagcgaagcctgctgctcaagcgaagcctgctgctcaagcgaagcctgctgctcaagcgaagcctgctgctcaagcgaagcctgctgctcaagcgaagcctgctgctcaagcgaagcctgctgctcaagcgaagcctgctgctcaagcgaagcctgctgctcaagcgaagcctgctgctcaagcgaagcctgctgctcntgaagctaaccgatactaa

SEQ ID NO: 3661 - DNA, 84 bp, Chromobacterium substugae
gcccaggtggcggaattggtagacgcactaggttcaggtcctagcgcccgcaagggtgtggaagttcgagtcttctcttgggca

SEQ ID NO: 3662 - DNA, 84 bp, Chromobacterium substugae; identical to SEQ ID NO: 3661

SEQ ID NO: 3663 - DNA, 84 bp, Chromobacterium substugae; identical to SEQ ID NO: 3661

SEQ ID NO: 3664 - DNA, 84 bp, Chromobacterium substugae; identical to SEQ ID NO: 3661

SEQ ID NO: 3665 - DNA, 1413 bp, Chromobacterium substugae
atgcagttgaaaatcgcccccggcatgctgacgccgttgattgtcgccacggccctgttcatggaaaacatggacgccaccgtgatctccacttctttgcccgtcatcgcgctggagctcggcgtcgatccgatctcgctgaaactggcgctgacgtcttatctggtcagcctggcggtgttcatcccgatcagcggctggatggccgaccgcttcggcgcgcgccgcattttccgttccgccattctggtgttcatgctgggatcgctgctgtgcgccgtcaccagcagcctgcacggcttcgtgatggcgcgctttctgcaaggcataggcggcgcgatgatggtgccggtcggacggctggtgattctgcgcaccatagacaaggcggacctagtgcgggcgctcagctatctgacggtgccggcgctgctggggccggtgattgggccgccgctgggcggcttcatcagcacctatttccattggcgctggatttttctgatcaacatccccattggtctgctggggctggctctggccggccgtttcatcgccaatctgaaagaggacgaggtgccgcggctggattggtggggcttcctgctgaccggcgccggcctgtcgatgctgatgttggggctggccaccgagggcaagcacatgttgtcggtgacggcgtcgatctggctcagcctgctggggggcgcgctgctgctgatctacctgtggcattaccgccgccagcagcatccgctgctggacttgtcgctgctgaggctgcccactttcaatgccggggtggtcgggggcttcatgttccgcgtcgggatcggcaccattcccttcctgttgccgctgatgttgcagttgggcttcggtttttcgccgtttgaatccggcctgctcacttgctccaccgcgatgggcgcgataggaatgaaaacgatagtggccaaggtgctgcagcgcttcggtttccgccgggtgctggtgttgaacagcattctggctggttgctcggtggcggtgtacgcgctgttccaggcggacacgccgcattgggtgttgctgatggtgttcgtgctgggcggttgtctgcgctcgctgcagttcaccagcctcaacgccatcacattcgccgatgtggacaaggatagactgagccaagccaccagcctgtccagcgtcgcgcaacagctggcggcgggctttggcgtgacggtgggggcgtttgccttgcaggccgcgtcctggctgcagggccatcagcagctgacggccggcgatttcggccacgccttcctgttcatgggcagcctgaccgccttgtccagcctgctgttcctcagcctggagcgggacgccggccagcaggtatcggcgggccatgagggcggagaggaaaagtaa

SEQ ID NO: 3666 - DNA, 2109 bp, Chromobacterium substugae
atgaatcgcctgacctgtggactggcgctgaccctgatcagcgccgccgtgctgagcgcctgcggcagctcttccagcccttccgccaacgccaccagcggcgtggtcaccggcagctatttccgccatgccaaagtgtgtctcgatagcaatggcaacggccgttgcgacgcgggagagcccagcgcctataccgacgacaacggcgcgttcagcttgaacggcggcggcgcgctggtggtggaggtgggcaccgacgccacccgctacgatcccgataccggcacagcggcggcggtgacccagccgctggtattccgcgcgccggcgaacagcggcggtgtggtcagttcgctgacgacggaagtggcggatctgatggacagcaacggcggcgatctgaacgcggcgcgcaatgcggtggccgaccgcctgggcgtgcctgcggacaaggtgatggcagaccataacaaggaaagcgatcccgacatcaaggcgacgctgaaggcggccatcaaccagaacatcgacgcgatcgcggacgcggtgaaggaggcgggcaacggcggcgacatcaaggccagcctgcacaagcgcatggcgctgagcgacatcaagaacgtggtggtgatctacgccgaaaaccgcggcttcgacaatctgtacggcctgttccccggcgccgacggcattccgggcgtgaatccggcatccaggggccagtactcgccgcagaaggatttcgacaattccgcgctgccggtattgccgcccacctggggaggcctgaccgccgccggccagacggtgacgctgacccaggcgcagaccatgaatttcgccaacaagccgttccagatcgacgaccccaagggcctgaacggcaccggcgtggtggtgccgcaatcggtggtgacgcgcgacttggtgcaccgcttctataacaaccagatgcagatcaatggcggcgccaatgacaaattcgccgcctattccgacgccggcggcttgtctatgggctattacgacggcagccagatggcgatgtggaagctggcgcagcagtacacgctggccgacaatttcttcatgggcgctttcggcggctccttcctcaatcaccaatatctggtttgcgcctgtgcgccggaatatccgaatgcggatacttcgccggccaagggcagcatctcggcgatagacaccgatgcgaaaggcaatttcctgcgtctgacgccggccgccaatgcgccggcttcggtgttgtccggcactgccaaatacctgaatgacggcaacctgacgccgaaggacagcgccggcaaatactatgcggtgaacaccatgcagccgccgttccagcccagcggcaatgcgccggcggacaaggcccagtatgccgatccaagcaagtcgaccacgttgccggcgcaaagccaggcgacgatcgccgatcgtctggacgccaagaaaatcagctgggcctggtattcgggcggctgggcggcttcgctggccgatcgcggcaatatctataacggcagccaacccaacttccagccgcaccaccagccattcaactatttcgccgctttcgatcccgccgcgcaggcggattaccgcaatgcgcatctaaaggatttcgaccagagcttcctggcggacgccgcggccggcaagttgccgcaagtggccttctacaagccgcagggcaacttgaaccagcattccggctatgccagcgtggccgacggcgacgcccatatcgcttcggtgatcgccaagctgcagcaaagcccgcagtggagcaatatgctggtggtggtgacctatgacgaaaacggcggtttctacgatcacgcgcaagtgccgaagggcgaccgctgggggccgggcacccgcattccggccatcctgatttcgcctttcgccaagaaaggctatgtcgaccatacccagtacgataccggctccatcctgcgcttcctgacccgacgtttcgggctgaaggcgttgccgggcgtggcggggcgcgatgccgccctggtgcgcaacggcggccgtccgatgggcgacttcaccagcgcgttggctttcgaccgcaaataa

SEQ ID NO: 3667 - DNA, 1266 bp, Chromobacterium substugae
atgcacgcttccaccccctggttattgaccctcagcttgattgtcggcggcgccctggccgtctccgcggcagcctcgcacgccaccccggccgccaaaccggcatacgccgacgccagctacacgcccggcgcccatccgccatccgccaaacaactggaagcactgggcaagcaattgttcttcgatcgcggcctgtcggcatcgggccggatgtcctgcgccagctgccacagccccgaccacgcctacggcccgcccaacggcctcgccgcgcagcttggcggcctggatggcaagcagccgggcacccgcgccgtgccgtccttgcgttatctgcagaacgtgccagccttcagcgaacactttcacgacaacgacggcaacgacagcgaagacgccggccccaccggcggcttcacctgggacggccgcgcagattccacccatagccaagccgcgctgcctctgctggccgccaacgaaatggccaacggtacggcggaaaacgtcgccaggaaactgcaggcatcgcccgtggccgccactttccgccaactattcggcaaggatgtcttccagcgcccgaagcaagccttcgacaaggccgtgctggcgctggaagtattccagcagaatcccgccgagttttatccctatagcagcaagtacgatgcctatttgcgcggccaggcccagctctccgccgcggaaatgcgcggcctgagggttttcaatgacccggccaagggcaattgcgcgtcctgccacctgagccagcgcagcgagagcggcgccttcccctccttcagcgacttcggccacatcgcggtcggcgcgccgcgcaatccggacatcgccgccaaccgcgacggccactattacgacctggggctgtgcggcccggcccgcaccgacttccgcaaccgcgccgactactgcggcctgttccgcacgccgggcctgcgcaacgtcgccacccgcaaagtgtttttccacaacggcgtcttccacgacttgcgccaggtgctgcgcttctacgccgaacgcgacgtgaagccggaaaaatggtacccggccggccagaatggcaaactggccaagttcgacgacctgccggcgcgctaccagggcaacgtcaatatggaagcgccgttcggcggcaagaaaggcggcaagccggcctatggcgaacgcgacatcgacgacatgctggctttcctgaaaacgctgaacgacggctatcagccgggcaagcgcggctga

SEQ ID NO: 3668 - DNA, 351 bp, Chromobacterium substugae
atgactgtgcagcgcatcgtcgccaacctcgccgccgccgaccccgcccgcgccgacgcgttctaccgcggcctgctgggcctggacctcatcatggaccacggctggatccgcacctatggagccgacagccgaatgcaaacccagctcagcttcgccagcgaaggcggctccggcgcgccgctgcctgcgctgtcgatcgaagtcgacaacctggaccaggttctagcgcgcgcgcgtgaagccggtgtcgccatcgaatacggcccggccagcgagccgtggggcgtgcggcgcttcttcgtccgcgatccgttcggcaccctcgtcaacatcctgcagcacgaatag

SEQ ID NO: 3669 - DNA, 1296 bp, Chromobacterium substugae
atgtccaagaacgttgtcgtgattggcacccagtggggtgacgaaggcaagggcaagatcgttgactggctgaccgaccacgcgcgcgcggtcgtgcgcttccagggcggccacaacgctggccacaccctggtggtcggcggcaagaaaaccgtgctgcgcctgatcccgtccggcatcctgcgtcccgacgtggaatgctacatcggcaatggcgtagtgctgtcgcccgaggcgctgctgaaggaaatcggcgaactggaagaggccggcgtcaacgtgaccgcccgcctgaagatcgccgaaggctgcccgctgatcctgccgtatcacgtagcgctggaccaggcgcgcgaagccgccaagggcgaagccaagatcggcaccaccggccgcggtatcggcccctgctacgaagacaaggtggcgcgccgcgcgctgaaggtgatcgacctgttcgactcggccggcttcgccgtcaagctgcgcgaaaacgtcgattactacaacttcctgctgacccagctgttccaggccgagccggtaagcttcgacgacatcctggcgcagaccatgctgctggccgagcgcatcaagccgatggtggcggatgtgtcgcgcacgctgtacgacatgaaccaggccggcgtgccgctgttgttcgaaggcgcgcaaggcacgctgctggacatcgaccacggcacctaccccttcgtcacctcgtccaactgcgtggccggcgcggccgcgccgggcgccggcgtggcgccgcagatgctcaactacgtgctgggcatcgtcaagggctacaccacccgcgtcggctccggcccgttcccgactgagcaggacaacgagatcggcatgttcctggccaagcgcggcaacgagttcggctcggtcaccggccgcccgcgccgctgcggctggttcgatgccgccgcgctgaagcgctccatccagatcaacggcgtgaccggcctgtgcgtgaccaagctggacgtgatggatggcctggaagagatcaagctgtgcgtcggctacatgctggacggccagcgcgtggacatcctgccgttcggctccgacgcggtgaccaagtgcgaaccgatctacgagagcatgccgggctggaccgaatccactttcggcgccaagcgctgggaagacctgccggtcaacgcccaggcctacctgacccgcatcgccgaagtatgcggcgcgccggttgccatcgtctccaccggtccggaccgcgaagagaccatcgtgctggatcacccctacggcctgtaa

SEQ ID NO: 3670 - DNA, 1152 bp, Chromobacterium substugae
atgcgcaactggctgttacccgaatatatcgccgacatcctgccggccaccgcccggcaggttgagtcggccaaggccgcgatgctggaaggcttccgcgtggccggctacgagctggtgctgccgccgctgatcgagtacatcgattccctggtcagcgaaggcgacgtcacgctggacctgaaaaccttcaagctggatgaccagctgtccggacgccagctcggcctgcgcgccgacatcacgccgcaggtggcgcgcatcgacgcccacttgctgggcggccgcaccggcgtcacccgcctgtgctacgccggcagcgtggtgcacagccgtccgtccggcctgaccagctcgcgcgagccgctgcaggtgggggccgagctgtatggctacgccggcatcgaggccgacctggaaatcatcgacctgatgctgtcgacgctggaaaaagccggcgtgaagaagctaaggctggatgtcggccatatcgccatcttccgcggcctggccgccgccgccggcctggcgccgggggtgacgcgcgagctgttcagcctgctgcagaacaaggacgtcgcgagcatcgccgagctggtggccggcgtggccgagccgtacaagagcgccttcctcgcgctgccggagctgtatggcccggccagcgtgctggacaaggcgcgcacccgcctgccttcgctgccggaggtcgagctgggcctgatgcagctggctgccatcgcccgcgcggtgcaaggccgggtggagctgagcttcgatctggcggagctgcgcggcgatttctaccataccggcttgatgttcgccgcctatgcgccgggctggtccgacgccatcgcccgcggcggccgctacgacaatgtgggccgccgtttcggccgcgcccgtcccgccaccggcttcagcctggatctgcgcgatctggtgcgcatcctgccggagcgggactcgtcccgcggcgtgcgggtggcggcccgccatctgccggccgcggcggaagaggtggcgcgcctgcgcgccgccggcgaaatggtggtggtcgactacctgggagagtccgcggtggcgcttaattgcgaccgcgagctggtgcctgctgccgatggatggcaactggctccttttaactga

SEQ ID NO: 3671 - DNA, 882 bp, Chromobacterium substugae
atggaaagaatgattcccgccgtggtggcagtcgtgggcgcgttgtttgtcgccagcctgtcgctgtttaccgtcgatcagcgccagttcgcgctggtattccagttcggcgaggtcgtgaaggtgatctcccagccgggcatccagttcaagattccgttgctgcagaacgtccgttatttcgatcgccgcgtgcagaccatcgacgccgaagcgcccgagctgttcaacacccgcgagaagaagaacgtgctggtggacagcttcgtgaagtggcgtgtggtagatgtgtcacagttctacaagagcgttggttccgaggccgccgcggtggcgcgcctgaagcaaaccatcaatgacggcctgcgcgccgagttcggccagaaaacggttgccgacgtcatttccggccagcgcgaccaggtgatggagacggttcgcaagcgcgcggacgcggatgcgcgtaaaataggtgtggaaattctcgacgtgcgcttaaaacgcgtcgattttccggataaaataagcagttccgtctacgaccgcatgcagtccgagcgtcgtaccgtggccagccagctgcgcagcgaaggcgctgccgacgcagagcgggtgcgggccgaagccgacaagcagcgcgaggtgatcctggcggaggcttacagcaaggcgcaggcgctgaaggggcagggcgacgccaaggcggcggcgatttacgccgaggcttacggcaagaacccggagttctacgcgttctggcgcagcatggacgcctacaaggaatcgttcaagaacaagagcgatgtgctggtgctggacccgagcagcgacttcttcaagtacctgaagaatccgcaggcggggcagagcaaaggcaagtag

SEQ ID NO: 3672 - DNA, 1128 bp, Chromobacterium substugae
gtgttccgtaacctgaaccagaaactggcccgcctattgggggcgaagcctaccgccggccgcccgggcggcgccggcgcgccgccatcctacaaaggcggcgccctcgctgtggtcggcgtgctggcagccttgtggctggccagcggcttttacgtggtggacgcccgcgaagagggcgtggtgctgcgcctgggcagcttcaatcgcctgactgaacccggtctgcaatggcatgcgccgtatccgttcgaaaaggtggaaatcgtcaacctgaccgagctgcgcagcgtggaagtcggctatcgcggcagcgcgcagaaccgcgtgccggaagagtcgctgatgctgaccgccgaccagaacatcatcgatgtgcagctgtcggtgcagtacgacatcaaggacgcgcgcgccttcctgttcaacaacgccgcgcgcgagcgcgacgccaaggacatcgtcaagcaggcggcggaaaccgcgatccgcgaggtggtgggacgcaacaaggtggacttcgtgctgaacgagggccgcgcccagatcgccgccgaggcgcgcaaggtgatccaggacgtgctcgaccgctacgcggtgggcatccgcatcgccaaggtcaacatcaacgacgtgcagccgccgcaagcggtgctggcggcgttcgacgacgcggtgaaggccggccaggacaaggacaagctgctgaacgagggcatggcctacgccaacgaggtggtgcccaaggccaagggcatggcggcgcggctgcagcaggaagccgaaggctaccagcagcaggtggtggcgcgcgcccagggcgacgccgagcgtttcaaacaagtgttgtccgaatacaacaaggcgcccaaggtcatgcgcgagcgcatgtacctggacatgatgcagcaaatcatgaacagcagcagcaaggtgctggtcgatcaaaagggcggcaataacctgctctacctgccgctggacaagctgatgcagatgtcggctcccgcatcccccgccgcgccgcaggctcccgcagcctccgctcccgccacggccacgccgccggcggctaagaacgggcgcgaaatttcgcgcggtcgcgatttctttggagcggagcgatga

SEQ ID NO: 3673 - DNA, 1131 bp, Chromobacterium substugae
gtgtttgatcgtcccgacttaggcgaccaggccgttctggtcagcctggattttggtgatgccgattaccaggaaagcgttgcggagtttgccgagctggtgcgcagcagcaatgtggagattctgggcaaggtggagggcaagcgccagcgcccggatgccgccttgttcgccggcaagggcaaggtggaggagattgccgccgtggtgcgcgccaccggcgccaatgtggtgatcttcaatcacgccttgtcccccggccaggagcgcaatctggagcgcgcgctgcaatgccgggtgatagaccgcaacagcctgattctcgacatcttcgcccagcgcgcgcgcagccacgaaggcaagctgcaggtggagctggcgcagctgtcgcacctgtccacccgcctggtgcgcggctggacccacctggagcggcaaaagggcggcatcggcctgcgcggtcccggcgaaacgcagctggagaccgaccgccgcctgctcggcatccgggtgaaatcgctgaaggaccggctggcccaggtgcagcgccagcgcagcacccagcgcaagagccgcacccgcgccggcatcgcctcggtgtccatcgtcggctacaccaacgccggcaagtccacgctgttcaacgcgctgaccaaggccaacatctacgccgccgaccagctgttcgccactctggacaccaccagccgcaagctgttcctccatcacgattgctcggtggtgctgtccgacaccgtcggcttcatccgcgacctgccccacaccttggtggcggccttccgcgccacgctggaggaaacggtgcaggccgatctgctgctgcacgtggtcgattgcgccaacgagacgcgcgacgcgcagatcgacgaggtgaacaaggtgctggccgagatcgacgccgacggcatcccgcagctgatcgtgtggaacaagtgcgacttgaaggatctgccgccggaaatcgaacgcggcgaaaacggcgaaatcgccgcggtgcgggtgtcggcgctgaagggcatcgggctggaactcttgcgcgaggcgattgccgaaagggtgcaaccttccgcaaataaccataaagaaccatacgagcatgtcgcagaatga

SEQ ID NO: 3674 - DNA, 261 bp, Chromobacterium substugae
atgagctctaaagggcaaatgttacaagacccgttcctgaatatcctgcgcaaggaacacgtgccggtctccatctatctggtcaacggcatcaagctgcagggtcaggtcgaatccttcgaccagtacgtggtgctgctgaagaacactgtgacccagatggtctataagcacgccatctccaccgtggtgccggcccgcccggtcagcatcccgcacgaacatccggcgcaaaagcaggaacaggcgcaggacgcttaa

SEQ ID NO: 3675 - DNA, 1413 bp, Chromobacterium substugae
atgaaacctaccgtagctctggtcggccgccccaatgtgggcaagtcgaccctcttcaaccggctgacccgcagccgcgacgccttggtcgccgaccagccgggcctgacgcgcgaccgccactacggccaaggccgcgtgggcgagaagccgtacctggtggtcgacaccggcggtttcgagccggtggtcgacgaaggcatcctgttcgaaatggccaagcagacgttgcaggccgtcgacgaggcggacgccgtggtgttcctggtggacggccgctccggcctgacgccgcaagacaagatcatcgccaaccgcctgcgccagcttgaccggccggtctacctggcggtcaacaaggccgagggcatgcgccacgccatcgccggcgccgagttccacgaactggcgctgggcgagccgctggtgatttccgccgcccacggcgacggcgtgcgcgaactgatggaactggtgctggaaaccttccccgacgaagtggaggaagaagaaagccgccatccgaagtttgccgtcatcggccggcccaatgtcggcaaatccacgctggtgaacgccatcctgggcgaagagcgggtgatcgcattcgaccaggccggcaccacgcgcgacagcatctatattgattttgagcgcgaaggccatacctataccatcatcgacaccgcaggcgtgcgccgccgcgccaaggtcaacgagatgctggagaagttttccgtcatcaagaccatgaaggcgatcgaagacgccaacgtcgcggtgctggtgctggacgcgcagctggacatctccgagcaggacgccaccatcgccggcttcgcgctggaggcggggcgcgcgctggtggtggcggtcaacaagtgggacaacctggacagcgagcagaaggacaatgttcgccgcgagatcgcccgcaagctgaacttcctcgattttgcgaagtttcattacatctcggccatcgagggccgcggtgtggcagacttgttcaaatccatcgacgaagcctatcgcgcggcgatggtgaagctggcgacgccgaagctgacgcgggtgttgcaggtggcgctggagcgccagcagccgccgcgttcgggcctgatccgtcccaagatgcgctatgcgcaccagggcggccagaacccgccgatcatcgtcgtgcacggcaacgcgctggacaatataccggccagctacacccgctatctggaacatactttccggaaagtgttcaaactgcagggtaccccgctgagggtgcagtacaagtcgtcggaaaacccgttcgacaccgaggaaggcaaggaaaagtctcgcgccaagcccaagccgatgtccaagatgcggggcagggaaaaagaagttcgctacggcaaaagcagcaaaaaatag

SEQ ID NO: 3676 - DNA, 1140 bp, Chromobacterium substugae
atgcgccgccaactgttgcttaccaccgttctgtcctcgatgctgctggccggctgcgccagctggttcgaaggctcttcccagttccagccgacgccgctggccaacatcaagccgctgcaggcgctggatgtgaaatggtcgctgcagcaggcgggcccggcgtccagcttcctgccggtctacgatagcggcaatgtggtgagcgccgacgccgaaggccgcatccgcagcgtcgacgcgctcagcggccgggtgcaggccgatgtggcgctcaagcgcgcgctcgccagcggcgtcgccgtcagcggcgacgtggtgctggtcggcagcgccgacgccaagctgctggcggtggaccgcaagagcggcaagatcgtctggcagcagccgctgaccagcctgatgctggaggcgccgcagatcgccggcgacatcgtggtggtgcgcaccaacgacgcccgcctgaccggcttcagcctggcggacggcaagcagcagtggtcggtgggcaatgtgctgccgcaactgaccgtgcgcaacaacggttcgatgcgcgcggtgggcaaggaggcggtgatggtggggcaggccggcggccgcctggacatcgtcaatccgcagaccggcaacacgctgtggcaaggcgcggtggccacgccgcgcggcgccaccgagctggagcgcgtcaccgacgtgaccagccgcccggcttacgacggcggccaggtgtgcgcggtggcctaccagggccgcgtcgcctgcttcgaggcgcgcaacggcagcctgttgtggggccgcgaggtgtcgtccagccgcggtttggccatggacgcgcgcaatgtctacgtgacggccgaggacggctcgatctgggcttacgaccgccagagcgggcgcaatctctggaaaaacgatgaactcaagtaccgcaatgtttccggcccggccatgatcgggcgcttcgtgctggttgtggatggcgaaggctatgcccatctgctatccaacgagagcggcagcattgtcggacgcagcaagatcggcacctccgggccggtcaatcaaccggtatcgctcggttcctccgccctgatccaggggcaggacggccgcctggcgatgctgaatctgggataa

SEQ ID NO: 3677 - DNA, 630 bp, Chromobacterium substugae
atggcgttcgacttgcaggaacaggaacagatcgattcgctgaaggcattctggcagcaatggggcaagctgatcggcggcgcggtgctggcggtttgcctgggcaccttcggcttcaagggctaccagtggcaccagaaggagcagtccgagaaagccgccgcagcctatgaggcggtggacagcgcggtggccgccaaggacatcgccaagctgaagtccgcggcccagctgctgcagggcgaatacgccggcaccatctacgccagccgcagcgcgctggtgctggccaaggccgcgttcgacaagaacgacccggcgctggcgaccagccagctggaatgggcggcgaaaaacggcaaggatgaggcgatccaggccatcgcccgcatgcgcctggcctcgctgcacctggatcagaagcagtacgacgccgccatctccgagctgaatcaggagcacccggccgctttcgacgcgcagtacctggagctgaagggcgatgtgttcgtcgccaagggcgacaacgccgccgcccgcgacgcttacaaggccgccctggccaagctggtggaagaaagcccggtccgccagctggtccagaccaaactcgacgcgctgggagcctga

SEQ ID NO: 3678 - DNA, 1272 bp, Chromobacterium substugae
atgagtcagaaataccaagcggtcaagggcatgaacgatgtgctgccggccgagtcgtaccagtgggaatattttgaaggggtgctgcgcaagctgctggccgattacggctaccagaacatccgcacccccatcgtcgagggcacgccgctgttcgtgcgctccatcggcgaggtgaccgacatcgtcgagaaggaaatgtacaccttcgtagacagcctgaacggcgacagcctgacgctgcgcccggaaggcaccgccggcaccctgcgcgcggtggtcgagcacaatctgctctacaacgccgcgcccaagctgtggtacatgggcccgatgtaccgccatgagcgtccgcagaagggccgctaccgccagttccaccaggtgggcgtggaggcgctgggcctggccggtccggacatcgacgccgaaatcatcgcgatgaccgccgatctgtggcgccgcctgggcatcagccagtacgtgcggctggagatcaactcgctgggcaacgccgaagagcgcgccgcccaccgcgaggcgctgatcgcgtatctggagggccacgtcgacatcctggacgaggacggcaagcgccgcctgtacaccaacccgctgcgcgtgctggacaccaagaacccggcgctgcaggagatggccgacaacgcgcccaagttatccgactacctgggcgaggagtcgcgcgcccactatgccggctggaaggcgatgatcgccgcgctgggcatagaattcgtcgaaaatccgcgcttggtgcgcggtctcgattactataaccgctcggtgttcgagtgggtgaccagcgagctgggcgcccagggcaccgtctgcgccggcggccgctacgacggactggtggagcaactgggcggcaaggccgcgcccggcatcggcttcggcatgggcatggagcgcgtgctcctgctgttgcaggacaagaacctgttgccggcgcagcgcagcgtcgatgtctatctggtcaaccagggcgagggcgcaggcctgtactcgatgaaactggcgcaaaccctgcgcgccgccggctactcggtggtgcagcatctgggcgaagccagcttcaagtcgcaaatgaaaaaggctgacggcagcggcgccgagttcgcgctgatcgtcggtgaaaacgaaatccaggccggtcaggtggtgatcaaggcgctgcgcgccgacatcgcccagcagaccgtggcggccgatgcggttctggccaccctcgccactctgaaagcttga

SEQ ID NO: 3679 - DNA, 1290 bp, Chromobacterium substugae
atggatagcgtgaacatcgcgcgccgcctgacccgccaggtgcgggtggggcatgttttggtgggctcggacgcgccggtggtggtgcagtcgatgaccaataccgacaccgccgacgcggccgccactgtggaacaggtgtaccaactggctcaggccggctccgaagtcgtgcgcatcaccgtcaactcgctggaggccgcggcccaggtggcggaaattcgccgccggctcgacgatatgggctgcgacgcgccgctggtcggcgatttccacttcaacggcgaccgcctgctgaaggaattcccggactgcgcgaaggcgttggccaagtaccggatcaacccgggcaatgtcggcaagggcgccaagggcgacgacaagttcgccttcatgatccgcaccgcgatggagcatgacaaggcggtgcgcatcggcgtcaactggggcagcctggaccaggcgctgctggcgcggatgatggacgccaacagccgcgccgcccagccgctgccgctgcccaagctgatgcaggaggcgctgatcgtgtcggcgctggagtcggccgagaaagcggtggagctcggcctgtcgccgaacaacatcattctgtcgtgcaaggtcagcaatgtgcaggatctgatcagcgtctaccgcgagttgggcggccgctgcgattaccccttgcacctggggctaaccgaggccggcatgggcagcaagggcatcgtcgcctccagcgccgcgctggcggtattgctgcaggaaggcatcggcgacaccatccgcatctcgctgacgccgcaaccgggcgaggcgcgcaccaaggaagtggtggtggcgcaggagctgctgcagaccatgggcctgcgcagcttcacgccgctggtcaccgcctgtcccggctgcggccgcaccaccagcaccttcttccaggaactggccgaccatatccagggctatctgcgcgagcagatgccggtatggcgcttgcagtacccgggcgtcgaggacatgaaggtggcggtgatgggctgcgtggtgaacggtccgggcgaatccaagctcgccgacatcggcatcagcttgcccggcaccggcgaagtgccggtggcgccggtgtatgtcgatggccagaaggatgtgacgctgaagggcgacaacatcccagccgagttcacagccatcgtcgacgactatgtgcgaacccgttacggcgagggcggcgccaagcgccgcgaggcgccggcgcctcgcaccattcccatccgtccggtggacgccagataa

SEQ ID NO: 3680 - DNA, 957 bp, Chromobacterium substugae
atggaaaaaaaaatcgaacatcacgactcgcctatgcccagcggtatcggcgcccgcttgaaagccgcccgcgaagcggccggccttggcctgggggaagtggctgacaggctgaaactgtcgctcaggcaattggacgcaatagaacgcgacgatttcgacgcgctgccgggcgcgaccttcgtccgcggctttgtccgcaattacgcgcgctttctggaagtggatcccgagccgctgatgcaggcgctggagcagcatttcccatccgcggtcaatgaagtggccaatctggtcaagggtaccgcggcgcgcgaaaccgctcatgaagccgaagagccggaaccggcgccggccggcggcggcgccggcaaatggctggccttgctggtggtggcggccgcattggccggcggcggcgcctggtacgccaaccgcgacgccgactccgccgccaagcaggccggcagcgccgacaaccagctggcgccgatgctgacccagcaacatgaggcctcggccgcgcaggccgttgcgcccgcagcggacaaggccgcttccgcgccggttgccgcggctccggcgcccgctgcgcagggcaagccgcaggcgtcggctccgcaggccgccgccaagccagtggcgaagcccgtggccagcgccgcggccgcggtaaaagtcgccaagcctgcagccgccagcgcgccgcaggcagaaggaagcgaccgcgtcagcgtcaatgtcaaggacgcggcctgggtgtcggtgcaggacgccaatggccgccgcctgatctatcaggtgatgcagccgggcaacgccaccgaagtgaccggcctcgcgccgttcaaggtggtggtgggcaacgccagccaggtggaactgaactacaacggcaagccggtggatttgagcggcaagatccgcggcaccaccgccaagattcaactcaagtaa

SEQ ID NO: 3681 - DNA, 711 bp, Chromobacterium substugae
ttggcatttggcgtttccactttcgccatggccgcgggcaacgtccgcgagctggcgcagatccgcagccagctggcggtggagtatgcccgcatcggcaatctgaaatcggcgctggacaacgccaaccaggcggtgaaggcggatccgtccttcatcaccgcctacgtgacccgcgcctacgtgctgggcctattgcagcagaacggtctggccgaagacgacttccggcaggcgctgcggctggatccggccaattcggaagccaacaacaattacggcctgttcctgtgcgagcacggccgggcacaggattcgctggcgctgttccagaaggcgctggccaatccgctgtacgacgcgccgcaagcggcttacctcaatctggggcgctgtagcgccaagctggggcaaaccgagcaggccaacgattacctgctgggcgcgctgcggctggcgccggactatgcgccggcgctgcgcgaactggccgaaatgcacctgggcctgggcaacgccaagctggccgccttctatttcggacggctgcgcaacggcggccaaaacggtttgaccgcggccgacctgtggctgggagccagaatcgcccgcaagaccggtgacggcgctttggaaggcgaatgcgccaatgcgctgaaaaaccggtatccggactccagggaaacacaactgctgttgagtggaagctga

SEQ ID NO: 3682 - DNA, 1095 bp, Chromobacterium substugae
atgaaaaccaacctgctcgacttcaatctggaccaactcacccagcatttcgcagaaatgggcgagaagccgttccgcgccaagcaagtgatgcgctggatgcaccagatggccgaagccgatttcgacgcgatgaccgaccttgccaagagcctgcgcgccaagctgcacgagcgcgccgtggtgggcgtgccttcgctgatgaccgggcaggagtccagtgatggcacccgcaagtggctgctcgacgtcggcaccggcaacggtgtggaaaccgtgttcattccggaagacgaccgcggcaccttgtgcgtgtcatcccaggtgggttgcgcgctggagtgcacgttctgctccaccggccgccagggattcaaccgcaacctcagcaccgccgagatcatcggccagctgtggtgggcgaacaaggcgatgggcgtgacgccgaagaacgagcgcgtggtgtccaacgtggtgatgatgggcatgggcgagccgctggccaacttcgacaacgtggtcagcgcgatgcagatcatgctcgacgaccatggctacggattgagccgccgccgcgtgacgctgtccacctccggcctggtgccgcagatggaccggctgcgcgaggagtgcccggtggcgctggcggtgtcgctgcatgcgccgaacgacgtgatccgcgacgaaatcgtgcccatcaacaagaaatatccgctggcggagctgatggcggcctgccgtcgctatctggaaaaggcgccgcgcgatttcatcaccttcgaatatgtgatgcttgacggggtcaacgatagaccggaacatgctcgccaattgctggaattggtgcgggaggtgccgtgcaagttcaacctgatcccgttcaacccgttccctaactcgggttatgatcgctccagcaacaacgcgattcgcattttccgtgaaattctgcaagaacgaggatatgtggtcacggtgcgcaagacgcgcggcgacgacatcgacgccgcctgcggccagctggccggccaggtgcaggacaagacgcggcgccaggccaagtggatgcagatagtcgaggacaagaaactatga

SEQ ID NO: 3683 - DNA, 426 bp, Chromobacterium substugae
atggcaattgaacgtaccttgtccatcgttaagccggacgccgtagccaagaacgtcatcggcaaaatctacgaccgcttcgagtccgccggcctgaaggtcgtggccgccaagatgaagcagctgtcgcgcgccgaagccgagggcttctacgccgtgcacaaagagcgtcctttcttcaaggacctggttgacttcatggtttccggcccggtgatgatccaggcgctggagggcgaaaacgccgtgctgaagaaccgcgaactgatgggcgccaccgacccgaagaaggctgacgccggcaccatccgcgccgatttcgccgaatcgatcgacgccaacgccgttcacggttccgacagcgtggaaaacgctgccatcgaagtggcctacttcttcgccgcttccgagatcagctcgcgctaa

SEQ ID NO: 3684 - DNA, 962 bp, Chromobacterium substugae
ttgagtattattacgccactcgggttacccaattctgacgaacccgctattttagcagtgttttcaaacacgtgctgcacattccatccaggcaccatgcgcgaacaaaaccaacagcaaccgccggccgacggcgacaatgaatccgacctcaacagcaagctgaaaaaacggctatggatcgccggcggactggttgccgtcgcgctggccgcgattccgctgatggacgcgctgaccaaacccaagatggacatgagcagcgacgcgcaaagccccagctccggcaagatcgtcaaaccggcggcatccagcccgtcagccggcgccatcgcgctgcccaaagccgccagcgccgccgcggagcaaagcagcgcccccgccgccgaacccgccaaccgcgcgccggcgacgccggccgaaaccagcccggccagcccggacctcagcaagaccccggccgtcgccaaccagcaggccagccgccacgccggcgccccccaccccgcggcgcagaacaagccggccgcgccggaaaaaacgccgccagccgcaaccgcccgccagccggcccctcccacccgcaacgccgcggccgccccgcagcccgccgccccgcagcccgccgcccagcaagaggcgccgccggccaaaatcgccgccgaagcccccgccaaggcgtgcgccttggcgggggcttcggcggcgatatcgccgccgaagcccccgccaaggcgcagcccgccggcagctcggtcggctaccaggtgcaactgggcctgttcgccagcatgggcaacgcgcaaaagctggtcaaagacctgcaaaaacacggcatcgccgcccacaccgtcacccgcgtgcaactgggccccttcaaaacccgcgccgaagccgacgacgcgatgagcaagctgcgcagcctgggctattcgccactgcttgccgccgaaggccaataa

SEQ ID NO: 3685 - DNA, 73 bp, Chromobacterium substugae
tggcggttagctcagttggtagagcatcggattttgattccgagggtcacaggttcgagccctgtatcgcctg

SEQ ID NO: 3686 - DNA, 73 bp, Chromobacterium substugae
gccggtatagctcagttggtagagcagcgcattcgtaatgcgaaggtcgggggttcgactcctcttaccggca

SEQ ID NO: 3687 - DNA, 74 bp, Chromobacterium substugae
cggagtgtagcttagcctggtagagcgctacgttcgggacgtagaggccggaggttcgaatcctctcactccga

SEQ ID NO: 3688 - DNA, 74 bp, Chromobacterium substugae; identical to SEQ ID NO: 3687

SEQ ID NO: 3689 - DNA, 978 bp, Chromobacterium substugae
atgtggtttaggcaactatctttttatcgtttgaacgcagaaagcctggtcgacgctgacaagctgttgcaggcattggaaaaacgtccgttccagccctgcatgggactggattggttcagcgaaggctgggtggcgccggccggccatctggacgctccggtctatgccgcgcgcggcagcttgatggtgtcgatgcggcgcgaagacaaggtgctgcccgcctccgtcatccgcgacttcgtcgacatgaaagtgcaggagatagaagacaaggagctgcggaaggttggccgcaaggagaaactggcgctgaaggaacaggtcaccgacgacctgctgccgcgcgccttcgtgcgcagcggccgcaccagcgcctatctggacatccagcgcggctggctgatggtggactccggcaccgccagcaaggccgaggcgctggtttccaagctgcgcgaggcgctgccgcccttccccgccgccctgccgcgcaccaagctggcgccgcacgcggcgatgaccgactggctggcggccggcgaagcgccgggcggcttcgagctggacgccgattgcgaactgaaggacagcagcgaaaacggcgcggtggtgcgctgcagccgcatcgacctcaccagcgacgaaatccgccagcacatcgccaccggcaagcaggccaccaagctgggcctgatctggaatgaaaagatccgcttccagctgaccgacacgctgcaactgaagcgcatccagttcttggacgtgctgcaggaggaagccagccaggctggcgacgaccgcgaaagcctgttcgccgccaccttcctcttgatgagcgaagagctgggcgaactggtcagcgcgctggtggaggcgctgggcggcctggaggacagccaggcgctgccggcgctggaccagccgcaggccgaagccgcgcccgcctccggcagcgtcgacgtcccctgggactga

SEQ ID NO: 3690 - DNA, 1446 bp, Chromobacterium substugae
atgagcaagcacaacctcaccaccgccgccggcgcgccggtcgtcgacaaccagaacgtgcagactgccggcccgcgcggtccgatgctgctgcaggatgtctggtacctggagaaactggcccacttcgaccgcgaagtgattcctgagcggcggatgcacgccaagggatccggcgccttcggcactttcaccgtcacccatgacatcagccgctacacccgcgccgcgctgttttccgacatcggcaagcagaccgacctgttcctgcgcttctccaccgtggcaggcgagcgcggcgcggccgacgccgaacgcgacatccgcggcttcgccgtcaagttctacaccgaggaaggcaactgggacctggtgggcaacaacacgccggtattcttcctgcgcgacccgctgaaattccccgacctcaaccgcgcggtgaagcgcaatccgtacaccaatatgcgcgacgccaacgccaactgggacttctggaccctgttgccggaggcgctgcaccaggtcaccatcgtgatgagcgaccgcggcatcccggccagctaccgccacatgcacggcttcggcagccacaccttcagcctgatcagcgccaagggcgagcgccactgggtgaagttccacttccacacccagcaaggcatccagaacctcagcgacgccgaggccgaggcgctggtgggccgcgatcgcgaaagcgcgcagcgcgatctgctggaaagcatagagcgcggcgatttcccgcgctggaccctgtacatccaggtgatgaccgaagcccaggccgacgcttgtcccttcaaccccttcgacctgaccaaggtgtggtcgcacaaggcctatccgctgatcgaagtgggcgtgctggagctgaaccgcaatccgcagaactacttcgccgaggtggagcaagcggcgttcaacccggccaacgtggtgccgggcatcagcttctcgcccgaccgcatgctgcaaggccgcttgttcgcctacggcgacgccgagcgctaccggctgggcgtcaatcaccacctgatcccggtcaacgcgccgcgctgccccttccacaacagctatcaccgcgacggcgcgatgcgggtggacagcaatgccggcgccaccatcggctacgaacccaacagccagggcaagtggcagcagcagccggcgttcgacgagccgccgctggcgctgcaaggcaacgcctaccactacgacttccgcgccgacgacgacgattactacagccagcccggcgcgctgttccggctgatgacgccggcccagcaacaagtgctgttcgacaacaccgcccgcgcgatgggcggcgtcgacgaggcgatccagcgccgccacatcgccaactgcgccaaggccgatcccgcctacggcgccggcgtggccaaggcgctgggcctgaagatctga

SEQ ID NO: 3691 - DNA, 177 bp, Chromobacterium substugae
atgcaaaccgtcagccccttcccttcccgccacaaggcgggcaaaaccgccccctcgccgcgccgccgctggcggcgttggctgggtctggccatcttctgcgccggctgcctgctgtggctgcaacacggcgtagcgcccgcgccgcgccccgtggcggcatcggccgcgcgttga

SEQ ID NO: 3692 - DNA, 780 bp, Chromobacterium substugae
atgactacccgacaaccctcgctgttcatttcccacggcgcgccgacgctgccgatagaagacagccccacccgccacttcctggagcaactgggccgcgactggccgcgaccgcgcgccatcgtcatcgtatccgcccactgggaggaccgcgcgctcaccgtcaatctgcagcccaggcccgatacgatgtacgacttcggcggcttcccgccggtgctgcgcacgctgcgctaccccgccgccaccgacgcggcgctggccgaacgcgtggtcggcctgctggaccaagccggcctgccggtggccgccaccgccgagcggccgctggaccacggcatgtggacgccgctgctgctgatgttcccccaggccgacatcccgctggtgatgatctcgctgcaccaccaggccggcaccgccgagcactacgcgctgggccaggccttgcgcccgctgcgcgacgacaacgtgctggtgataggcagcggcagctacacccataatctgtgggagctgagcccggaaggcagcgagcgcgcgccttgggcggcgggcttcgccgactggatggaccaggcgctgcaggacaaccgccgcgacgacatcatccactggcaacagcgcgcgccctatccgaacgaaaaccatcccagcgacgaacacttccagccgctgctggtggcgctgggcgcatcgaacgacgaagcggcgccggtcaagctgcacgacgactggcggatgggttcgctgtcgatggcgtgctggcgcttcgattga

SEQ ID NO: 3693 - DNA, 951 bp, Chromobacterium substugae
atgtccgacgaccatgcggtagacctgtccgtcacctggctgggccgcgccatgcccggctgcctgtacaacgcctccggcgtctggtgccgcgaggaggacgagttggcggcgctgcgcgcttccgccgccgccgcgctgatcaccaagagcgcgacgctggcgccgcgcgacggcaaccccgagccgcgctaccatccgacgccgctgggcagcatcaattcgatgggcttgcccaatcgcggcttcgactattacctggatttcgcccggcgctatggcgacggcggcggcaagccgctgttcctgtccttgtccggtctgacgctggacgacaactgcgcgatgttgcgccgtttggcggaggcaggcctgccggcgctgccggagatcaatctgtcctgccccaatgtgccgggcaagccgcaactgggctacgacttcggggcgacggccgaagcgctggacgcgttcgacgccgcttatcccggactgtacggcgtcaagctgccgccttacttcgatcccgcccatttcgccgcgatggcggagatattgaaccgccaccggcggctggccttcgtcacctgcatcaattcaatcggcaacggcctggtggtggatgtcgacagcgaagcggtggtgatcaagcccaaggatggcctgggcggactgggcggcgattacgtgctgccgaccgcgctggccaatgtgcgcgagttttaccggctgctgccgggcaaggacgtggtcggctgcggcggggtgaaaagcggccgcgaagctttcatgcacatcctggccggcgcgcgcgcggtgcaggtgggcacttgcctgcaccaggaagggccgggcgctttcgcccgcatcgccgccgagctggcggcgctgatgcgggccaagggctaccgccgcctcgatgacttccgcggcaggctgcgcaccttgtag

SEQ ID NO: 3694 - DNA, 138 bp, Chromobacterium substugae
atgccctggattgtgcggaaaaacgccggccgcggcgctgagcgcggtcaagacctgcgcgcgcggcaaagaaaatgcccggcttggccgggcatgtggtcgatggcggcgaacgcttacatctgcgcctgctggtaa

SEQ ID NO: 3695 - DNA, 468 bp, Chromobacterium substugae
atgcaaggcgatcccaagaccatagcgctgctcaacgacctgctggccgaagagctgtccgccgccgaccagtatttcatccatgccgagatgtacaaggacatggggctgaacaagctgttcgaacgcatcgaccatgagcgcgaggacgaactggagcatgcccgcgcgctgatcgcccgcaccctgttcctgcaaggcaagcccaatgtggcgcgccgcgtgccgatccaggtgggcgaagacgtgccgacgatgctgaaggccgatctggaggtggaataccgcgtcggcgccttgctgaaggaagtggtcgcccattgcgagagcgtgcgcgactacgtcacccgcgacgcgctgatggtgctgctggaggaaaccgagaacgatcacgcccactggctggagcagcagctgaagctgatcgagatgaccggcctggcgaattaccagcaggcgcagatgtaa

SEQ ID NO: 3696 - DNA, 1770 bp, Chromobacterium substugae
atgaagcgcttcgccctgataggcctgcccaataccggcaagtccaccctgttcaaccgtctgactggcatgtcgcagcgggtgggcaactggcccggcctcaccgtggacctgatcagcgcccgcttgctgcttggcggcaagatggtggagctggtcgacctgcccggcatcaacgacctgaccggctattccgacgacgaggcggtggtgcgcgacgtgctgctggccgcgccattcgacggcgcggtgctggtgctcaacgccagccagctggatcgccagttgccgctggccttgcaaatgatagccagcggcctgccttgcctgctggcgttgaacatggccgacgaggccaggctgctgggggtgtccatcgacgcggacgcgctgtccgagcggctgcggacgccggttgtcctgatctcggccaagcggatggaaggctggcccaggctgatggaggggctgaaccggctggcctcccgcgctgagccggctgttcacgcgcaactggagagcgtgccggaatcgcagcaggcgatagacctggcccgccgccagctggacggctgctggcggctgccgccggtgctgccgacgctgctgacggaaaaggtcgaccgctggctgctgcacccgtggctgggcctgcccttgtttttcgccttcatggcgctgctgttcaatctcacttaccagatcggcacgccgctgcaggacgcggtcggcggcggcctggactgggtcaaggaccacgcgctggcgccggcgctttcttccgtgccggccattctgcagagcctgttgctggacggcgtgtggcagggggtggccacggtgctgactttcgcgcccattctgttcgtgttcttcgtgctgatggcgatggtggaggatagcggctatctggcgcgcgcggcattcctgaccgacgcgatgatggccaggctggggctggacggccgcggcttcgtgatgcagctgatgggcttcggctgtaatgtgccggccatcctgggcacccgggtcatgcgcgagcgcaagcagcggctgctgaccatgctggtgatcccgttttccttgtgctcggcgcggctgcaggtagtggtgttcttcgccggcatcctgttcagcaaaagccaggcgccatgggtggtgtccagcctgtatctgatgactttcgtcgccgccatcgtcaccgcctgggtgttcaagcatcgctatcgcggcgacgaggctttcttgctggaggtgccgccgtaccggttgcccggcgcgcgccacatgctggcgcgggcgacgggcgaggtcagcgcctttttgcgcctggcctccactttcatcctggccggcgtggtgatggtgtggctgctgacccacattccggccggcggcggcaagacgctggcctatgcgctgggcgaggcgatgtcgccgctgctggacccgataggcatccgcgccgagctggcggtggcgctgctgttcggcttcatcgccaaggagatcctgctgggcagcctggcggtgatctacggcgtgtcggaggctggcctgggcggggcgctggtccagcatctggactgggcgtcggcgatgagcttcctgatcttcacgctggtgtacgtgccctgcctgtccacggtggcggcgatgcagcgcgaatccaagagctggggcttcgccgcgatgtcggccggctggtcggtgctgttggcctggctgctgtcgttcgccttctaccagggggtgcatctggcgcgctga

SEQ ID NO: 3697 - DNA, 231 bp, Chromobacterium substugae
atgccttctctggatgtttttcccgccggccaagccggcgtggtggccagcctggatctggccgacgaggtgttccgccgcgtggcggccttcggcctggtgccgggcggccgcttccatctgctcaaggccgcgccctggggcggcccgctattgctggaggtgggggccacccgcttcctgttgcgccgcagcctggcgcgccgcatccaggtgagggccgcggcatga

SEQ ID NO: 3698 - DNA, 573 bp, Chromobacterium substugae
atgagcatcaaatcggacaagtggatccgccgcatggcggacgagcacggcatgatagagccgttcgaagccaaccaggtgaaaatggccgccgacggccagaagctgatctcctacggcacctccagctacggctacgatatccgctgcgccgacgaattcaaggtgttcaccaatatcaacagcaccatcgtcgatccgaagagcttcgacccgaactccttcgtcgaagtgtcgggcaaaggctattgcatcatcccgcccaacagcttcgcgctggcgcgcacggtggaatacttccgcattccgcgcagcgtgctgaccgtttgcctcggcaagtccacctacgcgcgctgcggcatcatcgtcaatgtcaccccgttcgaaccggaatgggaaggctatgtgacgctggagttttccaacaccacgccgctgccggccaagatctacgccaacgagggcgtggcgcaagtgctgttcttcgaatcggacgaagtctgcgacgtgtcgtacaaggaccgcgccggcaaataccagggccaggtgggcgtcaccctgccccgcccctga

SEQ ID NO: 3699 - DNA, 477 bp, Chromobacterium substugae
atgaacctatacgacttctccttccgccgcctggacggcgtcgaacagcctctggccggctatcgcggcaaggtcatgctgctggtcaacaccgccagccaatgcggcttcacgccgcagtacgccgggctggaacaactgcaccagcgcttcgcggaccaggggctggtggtgatcggctttccctgcaaccagttcggccgccaggagccgggcgacgccgcccaaatcggcgcgttctgccagaagaactacggcgtggatttcacgatggcggacaaggtggaggtcaacggcgacggcgcccacccgctgtgggcctatctgaaacagcagaagcgcggcctgctgggccggccggtgcgctggaacttcagcaaattcctggtggaccgccagggccgggtggtggcgcgcttcgcgccgttcacccgcccggacaagctggccgccaacatagaggcgctgctgaaatga

SEQ ID NO: 3700 - DNA, 282 bp, Chromobacterium substugae
atgggattggccttgaagaccttgctggcggagttggaaactcagcgcgccggggatcctgacgcgatggccgagttggagctggtggcggtgcgcaccttggaagtgccgctggacatcaccgcttgccgcgagctgagagtcctggcgcatgtgttcaacggcgatcaggcggaactggccgctgcggtgctgcgcgcggcgctggcggacatccaggagcatctggatgacgatctcgacctgctggcggcgcacgccaggcgttgcatagattcttga

SEQ ID NO: 3701 - DNA, 1059 bp, Chromobacterium substugae
atgaagttttccaagcctggaaaaatcatgctcaccatctattccgaatcccatcgcctgcagcacggccgcgccgagctgatcgatggcaccctcaagccctgctttgaaaccccatcccgcgccgacatggtgctggccgccgtgcgcgagcgcgagctgggcgacgtgatccacccgcgccgccatggcctggcgccgatcctcgccgtgcatgacgacggctatgtccgcttcctggaaagcgcctggcagcgctggagcgcgctgggacgctaccacgacgcgctgcccaagatgtggcagatccgccggctgcgcgaaagggtgccggagcaggtggaaggccagctctgctattactcgatggattgcggcacgccgctcaccgccggcacctggccggccatcactgccgccgccgattgcgcgctcaccggggtggagcggctgatcggcggcgagcgggcggcgttcgcgctgacccggccgcccggccatcatgccgcgcgcgactattgcggcggctattgtttcttcaacaacgccgccatcgccgcgcaggcgctgcgcgagcacggcctgcgcaaggtggcggtgctggatgtcgactatcaccacggcaacggcacccaggacatcttttatgcgcgttccgatgtgctgtttctgtcgatacacggcgacccggccaccgagtacccgttttttctcggtttcgccgacgaaaagggcgcgggcgaggggctgggctacaacttcaactttccgctgccggccggcgcctgcgtcagcacctggtttgtcgcgctggactgcgcgctggagcagatcgcccgcttcggcgccgaggcgctggtggtgtcgctgggcgtcgacacctatcagggcgatccgatctcgcgtttccggctggattcgcccgacttcgtcactctgggcgccaggctggccggtctgaagctgccgaccttgttctgcctggaaggcggctacgcggtggagccgataggcaccaatgtggtcaatgttctggccggcttcgaggcccgctgctag

SEQ ID NO: 3702 - DNA, 408 bp, Chromobacterium substugae
atgaagtcgaagaaacaagccaaggccgcctgtccctgcggcggcggcgagctgtccgcctgctgcggccggtatctggcggccgacgcgccgccggcgcccagcgcccaggccttgatgcgttcgcgcttcagcgcctacgcgctgggccgggaagattacctgctggcgacctggcacgcgtcgacgcggccggccgcgctggatctggccgaggacgccggggtggtcaagtggatcgcgctggaggtgttgcgctgcgaggcgggactggccggcgacgccgccggcatcgtcgaattcgtcgcccgctacaaggtgggcggcaaggcggaaaaactgcgcgaggtcagccgcttcgtctgcgaggacggccgctggtattacgtggcgggcgaggtgtcctga

SEQ ID NO: 3703 - DNA, 474 bp, Chromobacterium substugae
atggccggcatgaaaagacagcttatcgctttctccctgctcggttcgctgaccgcgtgcagcgcgctgcagcaactgggggcgccggtccattccggcacgggggcttcgtcccggccggcgccgtcgcgcgccgccgacaaggtcgatcaattgctggccgaggccaaccgcctggccgaccaggtgaagagcggcgcgctcacccgcaccgccgccgccgaccagctgggcgccgcccggctgcggatagccggcgccaacccggtcgacaacgacaacttcgcggtctaccgccagttgacggtagaccgcgaggcaggccgcatcgattccgacgccttccgctcccggctcgagcagcacctgcgcgagtggatgcggcgctggccgaagtattcgtccaagcctgccgatccggctttcaccaattttctgctgaaactgtacggtttgccgccgctgggttactga

SEQ ID NO: 3704 - DNA, 948 bp, Chromobacterium substugae
atgaggaataagactatgcgcatcgcccataccattaccgacctgatcggcaacacgccgctggtcaggctcaaccgcgtcaccgacggcgtcggcgccaccgtggtggccaagctggagttcttcaacccggcgcacagcgtcaaggaccgcatcgcggtggcgatgctggacgcggcggagaaggccggcaagatcggcccgaacaccgtcatcgtcgagcccacctccggcaataccggcatcggcctggcgatggtgtgcgcggcgcgcggctacaagctggcgatcaccatgccggaaaccatggcaaggaaccgccggcaactgctgaaggcctacggcgccgagctgatcctgaccccggggccggacggcatgggcggcgccatcgccaaggccaaggcgctggtcgacgagtttcccgacacctatttcatgccacagcagttcgagaacccggccaatccggaaatccaccgccataccaccgccgaagaagtgtggaacgacaccgacggccaggtcgacattttcgtggccggcgtgggcaccggcggcaccatcaccggcgtcggcgaggtgttgaaggcgaggaagcccggcgtgcagatcgtcgcggtggagccggacgcctcgccggtgctgtccggcggcgccaaggggccgcacccgatccagggcataggcgcgggcttcgtgccggccatcctgaataccggcatttacgacgagatcatccgcgtcaagaacgacgacgcgatgcagaccgcgcgcgaagtggccaccaaggaaggcatcctggtcggcatctcgtccggcgcggcggtgtggtcggcgctgcaactggccaaacggccggaaaacgccggcaagctgatcgtggtggtgattccgtcgttcggcgagcgctatctgtccacggcgctgttcgaacatctggcctga

SEQ ID NO: 3705 - DNA, 870 bp, Chromobacterium substugae
atgcccacccaggaaaccctgattccgctagccggctggcgccgcaagctttacatcgtcatctacgaggccgatacccgcgccggccgcctgttcgacctgacgctgacgctggccatcctgatttccgtcgcctgcgtgatgctggaaagcgtggccggcgtgcggcagcgctacggcacgctgctgagcgtattggactgggctttcacgatactgttcaccgtcgagtacgcgttgcggctgatctgcgtgcacaagccgctgcgctacgtgaaaagctttttcggcgtgatcgacctcttgtccatcctgccgctgtacctgggcctgttcatcccggaaagccgcttcctggccgacgtgcgcatcctgcgcctgctcaggatgttccgcatactcaaactcagccgccacctgagcgaggcgctggagctgcggcgcgcactggccgccagccggcgcaagatcacggtgttcctcgccaccgtcatcttgctggtgatcatcctgggcacgctgatgtacgtgatcgaggggccggagcacggcttcaccagcatcccgatcagcatctactgggccatcgtcaccctgaccacggtgggcttcggcgacatcacgcccaaaacgccgctgggccaggcgctggccagcctggtgatgatcaccggctacggcatcatcgcggtgcccaccggcatcgtcaccgccgaaatcgcccgcagcaagcccgccgccaacgccgacaaccaatcggccacccggctgtgcccgcattgcttcagcgagggccatgactgggacgcccgcttctgcaagcactgcggcggccagctgccgcgccccgcccgcgaccaggtcagctga

SEQ ID NO: 3706 - DNA, 513 bp, Chromobacterium substugae
atgcaaagcgactggttgcagtgctgtcagggcgatatcaccgcgcagcaggtggacgccatcgtcaatgctgccaacagcagcctgctgggcggcggcggcgtggacggcgccatccatcgcgccgccggaccaggcttgctggccgagtgccgcggcttgggcggttgtccgaccggcgaggcgcgcttgacccaaggctatctgctgccggcgcgttatgtgatccataccgtcggtccggtttggcggggaggcgcttgcggcgaggcggccctgctggccgcctgctaccgcagctgcctggcgttggcggagcagcagggcatagccagcatcgcgtttccagctatcagctgcggcgcttacggctatccgctcgaccatgcctgcagggtggcggctgcggcgctgcgcgactggctgcggcgcgggccgcatagcctgcgcctggtgcggctggtggcgttcgacgcgcgggcgctggccgcctatcggcgggcgctcagctga

SEQ ID NO: 3707 - DNA, 1374 bp, Chromobacterium substugae
gtggatcacttgacaagacagaatttttttgatcgcagccaggatgtgatcagcgtctcctctctcaaccgcatggcgcgcgacttgctggaagccggcattccgccggtatggataggcggagaaatctccaatctgacgctggccgcttccggccacgcctacttctcgctgaaggacggcggcgcgcaggtgcgttgcgtgatgttccgccacaaggtgtcggcgctgcctttccgtccccgcgaaggcatgcaggtggagctgcgcggccaggtgacgctgtacgaggcgcgcggcgattttcagatcaatgtcggcgagatgcgctcggctggcctggggcggctattcgaagccttcgagcggctgaaggccaaactgcaagcggaagggctgttcgataacggccgcaagcgcgagctgcccgcccaccccgccgccatcggcatcgtcacttcgccggcagccgccgcgctgcgcgacgtggtcagcacgctgcgccgccgcatgcccggcattccgctgatcctctacccggcccaggtgcagggcgaaggatcggcgcagcaaatcgccaaggccatccagaccgcgggagaacggcgcgaggtggaggtgctgatcgtctgccgcggcggcggcagcatagaggacttgtggtcgttcaacgaggaagtcgtcgcccgcgccgtggccgcttgcccgattcccaccgtcagcggcgtcggccatgaaaccgatttcaccatctgcgacttcgtcgccgaccgccgcgcgccgacccccaccgccgccgcggaactagtgtcgcccaaccgcgagcacctcgccatgcagctggaacagacccgccgcggactggagcgcgcgctgagccggctgctgatggacaagacccagcaactggacttcctgggccgccgcctgctgcatccgggcgccaagctgcaggcgcggcgcgaacggctggctgcgctgtcgcaagggctgcgccggcgcgtcgacgccgccttcgaacaaggccgctggcggctgcagctggctggcagccgcatggcccgccatcagcccgatttcggcgccctgtcgcaatcgctgcggcaacggcaagaccggctgcagcgcgcgcgcgacaggctgctggacaaccgccgccagcagctggcgcagctgtccgccacgctgaccgccctcaacccggacgcggtgctggcgcgcggctacgccatcgtgcaaaagcgcgacggcaaggcggtgaagcatccgtccgagctgctcaaccacgagaaagtgacattgcggctggccgagggcagcaccgaggcccgcatcgagcatccgcagggggcgcagccggaactgcctttctga

SEQ ID NO: 3708 - DNA, 243 bp, Chromobacterium substugae
atgaaccttgccaaactgatgcccttgctatcctgcgccctgttgctggccgcttgcgccacaacgcccggcgccagcgccgtggcaggcgatgactccgggcgcgaagagccgaagtatctcaccggcagcaatattccgcaccgcggcgggaagaccgaggtgttgacggaccaggcgatgcaggacttggccgaccagattcatcgcggcagcccggttacctcgttcggcaagccctga

SEQ ID NO: 3709 - DNA, 933 bp, Chromobacterium substugae
atgacgaagaccatcatgctcgccaatccgcgcggcttctgcgctggcgttgaccgagccatcgccatcgtcgagcgcgccatcgagctgtacggcgcgcccatctacgtgcgccacgaagtggtgcacaaccgtttcgtggtggatgacctgcgcggcaagggcgcggtgttcatcgaggagttgaaggacgtgccggcaggcagcaccttgatctattccgcgcacggcgtgccgctgtcggtgcgcgccgaggccgaggcgctggggctgcaggtgttcgacgccacctgtccgctggtgaccaaggtgcacgtggaagtgaagcgcatgcacaaggccggcatggaaatcatcatgataggccacgccggccatccggaggtggagggcaccatgggccaggtggatggcggcatgtacctggtgcagaccgtcgccgatgtcgccacgctccaggtggcgcggccggacgcgctgtcctatgtcagccagactaccttgtcggtggatgagacccgcgacatcatcgaagcgctgaaagcccgcttcccggcgatacacagtccgaagaaggacgatatctgctacgccacgcaaaaccgccaggatgcggtcaagcagctggcggaggactgcgacatcgtgatcgtggtgggctcgcccaacagctccaactccaaccgcttgcgcgaagtggcggcgttgaagggcgtggacgcctatatggtggacaatgccagcctgctggagccgcaatggtttgtcggcaagcagcgggtgggcctcaccgccggggccagcgcgccggaagtgctggtgcaggcggtgatagaccgcatcaagactttcggcatcggccaggttgccgaattgcccggcgtggaggagagcacggtgttcgctctgccgccggcgctgcggcaagcttga

SEQ ID NO: 3710 - DNA, 501 bp, Chromobacterium substugae
atggattctgcaatgactatgcctggggcccgccgctggtccaaatggttcgtgctggcggcgctggtcatcgtgctcgaccagttcagcaagctttatttcaacggccatttccagtacggcgaagtccgctcggtagtggaaggctttttcagcttcacgctggtttacaatccgggcgcggccttcagcttcctgcacgatgccggcggctggcagaagtatctgttcaccgtgctcgcgttcgcggtgtcgggctggctgggctggaatatcgtcaagggccgcttctccggcctgatgaacctggccgccgccttcatcatcggcggggcgctgggcaatgtgatcgaccgtctggcctatggccatgtgatcgatttcatcatggtccactactacaaccagtggtactacccggcgttcaatctggcggactccttcatctgcgtcggcgccgccttgatggtgctggacagctttaaaaaaccgtcgcgctga

SEQ ID NO: 3711 - DNA, 2778 bp, Chromobacterium substugae
atgagcatcgattatcgtaaaaccgtaaacctgctggatacacccttcgccatgcgcggggatctggccaaacgcgaaccggcctgggtcaagcgctggcaggaagagaagcgctatgaaaagctgcgcaagctgtccgccggccgtcccaagttcatcctgcatgacggcccgccgtacgccaacaacgacattcacctgggccacgcggtcaacaaggtgctgaaggacatcatcgtccgctccaagacgctggccggtttcgacgcgccttacgtgccgggctgggactgccacggcctgccgatcgagctgatggtggaaaagctgcacggcaaggacattccagccgccaagttccgcgagctgtgccgcgaatacgccaaggagcaggtggcgcgccagaagaagggcttcatccgcctgggcgtgctgggcgactgggacaatccctatctgaccatggacttcaagaccgaggccgacatcgtccgcaccctcggcaagatccatgaaaacggctacctgaccaagggcgagaagccggtgcactggtgcatcgagtgcggctcgtcgctggccgaagccgaagtggaatacgaagacaaggtgtcgccggcgatcgacgtcggcttcaaggtagtcgacgccgacaaggccggcgccgctttcggcgccgacgccaatggcgcgatggcggtgatctggaccaccacgccgtggacgctgccggccaaccaggcggtcgccgccggcgccaatctggattaccagctggtggacacgcccaagggcaagctgattctgggcaaggatctggtcgagtcggcgatgaagcgctacggcgtggacgagtaccgcgtgctgggcgaagccaagggcgaggcgctggagctgatccagctgcagcacccgttctatgcccgccaggtgccggtgatcctgggcgatcacgtcaccaccgacgccggcaccggcctggtgcacaccgcgccggcccacggcctggaagacttccaggccggtctgcagtacaagctgccgatcgccaatccggtggccgacgacggccgctacaagagcaccaccgaaatcttcgccggcatgctggtatgggacgccaatccgcgcgtgatcgaaacgctggaatcgcacggcgcgctggtgcacaaggccaagctggagcacagctacccgcattgctggcgccacaagacgcctatcatcttccgcgccacgccgcagtggttcatcagcatggaccgccaggccaatggcggcgagacgctgcgcgaagtcagccagcgcgcggtggacgccaccgaattcttcccgtcctggggtcgcgcccgcctggacgcgatgatcaagaacagccccgactggtgcgtatcgcgccagcgcaactggggcgtgccgatgaccttcttcatccacaaggaatcgggcgagctgcatccgcgctccgcccagctgctggaagaagtggcgctgcgcatcgagcagcagggcatcgaagcctggttcagcctggacgccaaggaattgctgggcgacgaggccgagcaataccgcaagctgaccgacacgctggacgtgtggttcgactccggcgctacccacttcgcggtgctgaagcagcgcccggagctggcctggccggccgacctgtacctggaaggctccgaccagcaccgcggctggttccagtcgtcgctgaagaccggctgcgccaccatcggccgcgcgccgtacaagcagctgttgacccacggcttcactgtcgatgacaagggctacaagatgtcgaagtccaagggcaacggcatcgcgcccgaggaaatatgcggcacgctgggcgcggacatcctgcgcttgtgggtggccagcgccgactactccggcgacatgtcgctgtcgcaggaaatcctgaagcgcaccaccgaaagctaccgccgcctgcgcaacaccatccgcttcctgctggccaacctgtccgatttcagcccgctggagaacacggtgccgctggcggacatggtggaactcgaccagtacgcgctgctgcgcgcccgcgaggtacaggaaaaagtggtgggcgagctgtactcccgctacgccttccaccacgtggtgcaggacgtggtcggctactgttcggaagacctgggcgcattctacctggacgtgatcaaggaccgcctgtacaccacccaggccgacagccacgcccgccgcagcgcgcagaccgccttgtaccacatcacccgcagcctgttgctgatggtggcacccatactgtgcttcaccgccgacgaggcgtggaacgtgctggtggacagcgaggaagaatcgacgctgtaccacatctggcatgagttcccgagccaggcgccggagcgcgaacaggcgctggccggcaagtggcaggccatccgcgagctgcgcgcgcaggtcaacaagcaaatcgaagaactgcgcagcgccgacaagctgggctcctcgctgcaggccgaaatcgagatcgacgcgccggtcgcgctggcgcagcagttgctgagcctgggcgacgagctgaagttcgtgctgatcgtctccaaggccagcgtcaaggaggcggcggaagtcgcggtgcgagttcacgcctcgacgcacgacaagtgcgagcgttgctggcactaccgcgccgacgtgggccgccaggctggccacggcgcggtctgcggccgctgcgtcgacaatctggacggccagggcgagcatcgccgccacgcctga

SEQ ID NO: 3712 - DNA, 936 bp, Chromobacterium substugae
atgcaggtatttctgggagatccgcgtcgcttcgccctgccgggctgcgccttgaccatcggcaacttcgatggcgtgcaccaggggcaccgacgcatgctggaacggttgcgccttgaggcgcgcgcgcgcggcatgccgactgccttgctgactttcgagccgcacccgcgcgagttcttcagccgcggcaacccgccggcgcgcctgtcgacgctgcgcgacaagttcgtgatgctggaggagttgggcctggtcgactatgtgttcgtctaccgcttcaaccacagcttctcgaatatgccggccggcgaatttgtcgacaaagtgctggttgaggagctgaaaacccgttacctgctgatcggcgatgatttccagtttggctttgcccgcaaggggaatttcgacttgctggcgtcctgtccgcatttcgccaccgaagcgatgccgtcggtgctggtgcagggcgagcgcgcttccagcaccctggtgcgggagaggctggccgccggcgacctggattccgcgacttcgctgctgggcagctgctaccggatatcgggcaaggtgatgcatggcaagaaactggggcgtaccataggctttccgaccgccaacatccatctgccgcacctgaagccggcattgcagggggtgttcgtggtggaggcggatacgccgttcggccgcctgggcggcgtggccagcctggggctgaaccccacggtcagcgacacgcctgactacaagctggaagtgcacctgttcgattttgccggcgatctctacggcaagcgtctgaccgtacgattcctgaagaagctgcgcgatgaagcgcgctatgatgatttggcgacactggtggcgcagatagagcgcgacgcggccagtgccaagacctatttgacaagtttgcagcgagagcaggcatga

SEQ ID NO: 3713 - DNA, 687 bp, Chromobacterium substugae
atgactaaacagctgaaactgagcgcactggttgccgccctgttggtttctgctagcgcttttgctgctaaaccgggttacgccgtagaccaatccaccgacgcagtgacccgcaacagctacggcgaatgctggaagaccacctacttcgacaaggccaaggacggcctggttgagtgcggcgatcgcgaagcggccaagccggtagtcgtaaaagaagcgccgaagccggttatggtttccgtgaaggaaaaagttaccctgtccgctaaggttctgttcgacttcaacaagaacaccctgcgtccggacgccaagaacgaactggacccgctggtcgccaagctgaaggctcacgccggccaaggccacctgaacggtgttgaaatcgacggttacaccgacttcatgggttccgacaagctgaacaacgctctgtcccagaagcgcgctgacgctgtcaaggcttacttcgagaacgctggcgttccggccgagaagatcactgccgtaggcaagggcaaggctgaagccaagatgaccgaagagtgcaaggccaagttcccgcgctacgtgaagaacaagaagcaaaacgccgagatcaaggcttgcatcgagtctgatcgtcgcgtagaagttgtgatcgacgcggttaaagaatccgtagtcgaaaagccggctaactaa

SEQ ID NO: 3714 - DNA, 504 bp, Chromobacterium substugae
atgccccagtacattaaggatggacgcatccgcgcggacggctggacgcgcttgctgccggacgagcagggcgccttgccggcatctcccgccgatagcgacgtgatcgtcccgctggtcgcttggctggcggatgccggcaaatggcaggcgcgcggcggccgggtcggggtgtgcctggcgccggacgacgatccggcgctgctggagccgtacctggccgaccttgtcctgattgccattgactttccggcattcaccgacggccgtggatacagcctcgccaggctgctgcgcgaacgctatgattatgccggcgagctgagagcggtgggcgatgtgtgggcggatttgatccgacccttgtggcaggtggggttcgatgctttccagatcaaggatggcaaagcgctgggggatggtgattattacaatactttcagcgatagctatcaagtaacatatcgacagccattgccactgtttcgcagacgcgtcacataa

SEQ ID NO: 3715 - DNA, 1659 bp, Chromobacterium substugae
atgtatcgatatgacgaagtagaccatcgcctggtgaaggaacgcgtcgcccagttccgcgaccagacccgccgtttcctggcaggcgagctgtccgaagacgaattccggccgctgcggctgatgaatggtctctatatccagcgccacgcgccgatgttgcgggtggccattccctacggccatctgcgcagcgagcagctgcgcaagctggccgacatcgcccgccgctacgacaagggctacggccacctcaccacccggcagaacatccagttcaactggccggcgctctccagcgtgccggacatcctggaagaactgtcgacagtggagatgcacgcgatccagacttccggcaactgcgtgcgcaacaccaccaccgacgccttcgccggcgtggcggccgaccagctgttcgacccgcgcccctactgcgagatcatccgccagtggagcaccatgcacccggagttcagcttcctgccgcgcaagttcaagatcgcggtatcgggcagcgaggaagaccgcgccgccaccatggtccacgacatcggcctgcatgtcagccgcaacgaagccggcgaagtgggcttccgcgtgatggtgggcggcggcctgggccgcacgcccatggtgggcgaggtggtgcgcgaattcctgccgcgccagcatctcttgacctatctggacgcggtgctgcgggtgtacaaccgcttcggccgccgcgacaacaaatacaaggcgcgcatcaagatcctggtcaaggcgatgacgcgcgaaggcttcgccgccaaggtcgaggacgaatggctgcacctgaaggacggcccgtccaccttgcgcgatgaggacgtcgcccattacgccagcttcttcgtcgatccggactaccagccgctggcggacatgccggaagcgctgcgatcggcgctggccgaagacaaggctttcgcccgctggtatgagcgcaatacccggccccaccgccagacgggctaccgctcggtgatcctgtcgttgaaggaaaccggcgcgccgcccggagacatcaccgacgcgcagatggacgccgccgccgactgggccgaccgcttcggcttcggcgaattgcgggtggcgcacgagcagaacctggtgttgccggacgtggcgcagaaggatctgcacgccttgtggctggaggcgcgccaggcgcggatggccacgcccaatatcggcctcttgaccgacatcatcagctgccccggcggcgacttctgctcgctggccaatgcccgttccatcccggtggccaacgccatccagcagaccttcgacgacctggactacctgtacgacctgggcgacatcgcctgcaacttctccggctgcatgaatgcctgcggccaccaccatatcggcaatatcggcattctcggcgtcgacaagaacggcgaggagtggtaccagatcacgctgggcggcagccaggggcgggataccaccataggcaaggtgatcggcccctcgttcgcccaggccgatgtgccgcgcgcgttctcgaaaatcatgcaggtctacctggagcgccgccaggtgggcgagccctttatcgatacgctgcgccgcgtcggcgtggagcctttcaaggagagggtgtatgccccagtacattaa

SEQ ID NO: 3716 - DNA, 705 bp, Chromobacterium substugae
atgagcctggagtccaaactcgccgccaccacggccctgctgaaaaccatagcccaagcgcatcccgacgcggcgctggccaacagctacggcgccgaagacatggtgctgaccgacctgatcgccagcctgggcctgccgctgcagagcttcagcctagataccggccggctgccggcggaaacctacgcgttgatgcagcaggtggctgaacgctaccccgggcacccggtcagggtctatttccccgacaccgccgccaccgagcaatacgtcaacctgcacggcatcaatggtttctaccaaagcgtcgatctgcgcaagtcctgttgccaggtgcgcaagatcgagccgctcaggcgcgcgctggcgggccgctcggcctggatcaccggcctgcggcgcgaacagtccccgacccggcaggatctggccagccaggaatacgacgccgacaacggcttgcagaagttcagcccgctgctggactggaccgaggccgaggtatggcagtacctgcgcgaacgccaggtgccgtacaacgcgctgcacgaccgccattacccgtcgataggctgcgcgccctgtacccgcgcgatcagcgtcggcgaggatatccgcgccggccgctggtggtgggaaaacccggaaaccaaggaatgcgggctgcatgtgaaagccagcccgctgcaacgccccgtctga

SEQ ID NO: 3717 - DNA, 945 bp, Chromobacterium substugae
atgaagctacaacaacttcgctacctggtggaagtggccaagcaggggctgaacgtttccgaagccgctgagaagctgcacacctcgcagcccggcatatccaagcagatccgcctgctggaggacgagctgggcatccaggtgttcatccgcaacggcaagcgggtggtgtcggtgtccgagccgggcaaggaagtgctgcgcatttccgagcgcatcctgcgcgaagcgcaaaatctcaagcgggtcggcgacgaattctcccgcgagtcggaaggcgcgctgaccatcgccaccacccacacccaggcgcgctacgcgctgccgcaggccatcgccgaattcgtgcgccgctatcccaaggtgcggctgtcgctgaaacagggcagcccgacgcagatctgcgaaatggtggtgtccggcgaagccgacctcgccatcgccaccgagggcatctcgctgtacaaggaactggcgatgctgccctgttatgagtggaaccgctcggtggtagtgccgcgcggccacccgctcagccagctggaccgcaagatgacgctggccgacatcgccgactacccgatcgtcacctacgatttcgccttcgccggccgctccaagatcaacaaatcgttcgccgaccagggcctgacgcccaatgtggtgctgaccgccatcgacaccgacgtgatcaagacctacgtctcgctcggcctcggcatcggcatcatcgccagtatggccttcgagccggaacgcgaccagaacctggtggcgatcgacgccggccacctgttcgagccgtcgaccaccaagatcggcatccgcaaggacgcctatctgcgcggtttcgcctacactttcgtcgagctgttcgcgccgcacctgcaccgccgcgaggtggattccgcgctgctggcccacgagggcgagctggacgactag

SEQ ID NO: 3718 - DNA, 759 bp, Chromobacterium substugae
gtgaaagaagggaataccatgcgtttaaaagggaaagtgtccatcatcaccggttcggccagcggcatcggcaaggccaccgccgagaaattcgtcaaggaaggcgccatcgtcgcggtgtgcgacctgaacccggacgcggtcaagaccgtcgtcgatgaactgaaggcgctgggcggcgaggcctacggctatcgggtggatgtgaccgacaaggcccagatcgccgacatggtggccgacttgaaaacccgctgcggccgcatcgacgtattggtcaacaacgccggcatcgtccaggacgcgcagttgatcaagatgagcgaagaccagttcgacaaggtgatcgacatcaacctgaagggcgtctacaactgtgcccgcgccgtggtggacaccatggtggagcagggcggcggcgtgattctgaacgcctcgtcggtggtgggcgtctacggcaacttcggccaaaccaactacgctgcggccaagtttggcgtgatcggcttcgtcaagacctgggccaaggagctgggcaagaagggcatccgcgccaatgcggtgtgcccgggcttcgtcgccacccccattctgaaggcgatgccggagaaggtgctgcaggctatggaagacaaggtgccgatgcgccgcatggccgatccggcggagatcgccaacgtttacgccttcctggcgtcggacgaggccagctacatcaacggcgccgcgatcgaggtgacaggcggcctgacgctgtaa

SEQ ID NO: 3719 - DNA, 1608 bp, Chromobacterium substugae
atgcagtttggcgtgaaacccttgttcgagaaggtttccgtcaaattcggcgaaggcaaccgttacggcctgatcggcgccaacggttccggcaaatccactttcatgaagattctgggcggcgacctggaacagaccgccggcgaagtggccatcgaaaacggcctgcgcctcggcaaactgcgccaggaccagttcggctacgaagatcagcgcgtgatcgacgtggtgatgatgggccataccgagatgtgggcggcgatgagcgaacgcgacgccatctacgccaatctggaagccaccgaagacgattacatgcacgcggccgaactggaagccaagttcgccgagtacgacggctacaccgccgaggcgcgcgccggcgagctcctgatgggcgtcggcattccggtggagcagcatttcggcccgatgagcgaagtggccccgggctggaagctgcgggtgctgctggcgcaggcgctgttctccaatccggacatcctgttgctggacgaaccgaccaacaacctggacatcaacaccatccgctggctggagcatgtgctgaacgagcgcaactccaccatgatcatcatttcgcacgaccgccacttcctgaactcggtgtgcacccacatggcggacctggactacaacaccatccgcatctacccgggcaactacgacgactacatgatcgcgtcggctcaggcgcgcgagcgccagctgtcgtccaacagcaaggccaaggagcggatccaggagctgcaggagtttgtggcccgcttctccgccaacaagtccaaggcccgccaggcaaccagccgtctgaagcaggtggacaagctgaagtccgagatggtggaagtgaagccatccagccgccagaacccgttcatccgcttcgaaatggacgacaagttcaagctgcaccgtcaggcggtggaggtggagagcctgaacaaggcttatgagaacaaggtgctcttcaaggatttgaacctgattctggaagccggcgcgcgcctggccgtcatcgggccgaacggcgccggcaagacctcgctggtcaagctgttggccggcgccttcgaagccaagttcgccgaaggcctgagcgccgactacggcagcatcaagtgggcggaaaaggcgcagatcggctacttcgcccaggaccatgaagccgatttcgactccgacatgacgctgaccgagtggatgcgcgagtggggccaggaaggcgacgacgagcaggtgatccgcggcacgctgggccggctcttgttcggcggcgacgaagtgggcaaggcggtgcgcgtgctgtcgggcggcgagaagggccgcatgctgtacggcaagctgatcctgcagaagccgaacgtgatgatcatggacgagccgaccaaccacatggacatggagtcgatcgaatccctgaacatggcgctggaaaagtacaagggcacgctgatcttcgtttcgcacgaccgccagttcgtcagcagcctggccacccatgtgctggagctggacggcaagggcggctacgactactacaccggcaattacgaagattacctggccagcaagggtctggagtaa

SEQ ID NO: 3720 - DNA, 840 bp, Chromobacterium substugae
atgtcgcaggatggcgcggtggacttcgcagcgttgcaacgattggttgagttccacatcgaaaacggcactgccggcatcgtcgccgtcggcaccaccggcgaatcggccacgttgtctgtggaagaacacatcgaagtggtcgccgccgtagtcaaatacgccgccggacgcgtcaaggtcatcgccggagccggcggcaacgccaccgccgaagccatcgaactgggacagcgctcggccgacgccggcgccgacatggtgctgtcggtggtgccctactacaacaagcccacccaggaaggcatctaccagcacttcaaggccatcgccgacgcgagcccgctgccggtcatcctttataatgtccccggccgcaccgtcgccgacatgagcaacgacaccgcgctgcgcctggccgagcacccgaacatcgtcggcctgaaggacgccaccggcgacatcggccgcgcctgcgacctggcgctgcgcgcgccgaaggatttcgcgctgtactccggcgacgacgccaccggcatggcgttcatgctgtgcggcggccatggcgtgatctctgtcaccgccaatatcgcgcccaagcaaatgagcgcgctgtgcgtggccgccacctccggcgacgcgcgccaggcccgcgcgatcaacgacaagctgcaaggcctgcacaagcagctgttcatcgaacccaaccctatcccggccaagtgggccctcgtccggatgcaacacatccgcgaaggcatccgcctgccgctcaccccgctcagccaagctgccgaggcagccgtcgaagcggccctgaaacaagcagaaatcctttga

SEQ ID NO: 3721 - DNA, 987 bp, Chromobacterium substugae
gtgccgccggatctgaccaccccgcagatccagaacaagtacaacctgcccggcggcgtcacgaccgccagcgccgatcccgccgtcgccgccgccacgtccccgatcgccatcaatcaactggacaaggtgcgcatggagcgcgccggcacccagcgctggctgctggtcggcgacaaaaaggccgccgaactgtggccggtgctgaaggccttctggcaagaaaacggcttcgtcatcaaaaccgaagacccgagcgtcggcatcatggaaaccgactgggcggaaaaccgcgccaaactgcccaacgacggcctgcgcaaactgctggaaaccgtcggcctgggcagcgtctactccaccggcgaacgcgacaagttccgcatccgcctggaaaacacgccgcaaggcaccgaggtttacttctcacaccgcggcatggaagaggtctacgccgacaacagcaagaccaacaccatctggcaggctcgcccgaccgaccccaatctggaagccgagctgctgggccgcttcatgatccgcctgggcatgaccgaagagaaagccaaggcgcaggttcagcaaacgctggccaagccggccaagccgcaagaccctatcgtagacggccaactgcagctggccgacggcttcgaccgcgcctggcgccgcgtaggcctggcgctggaccgcgtcggcctgatcgtcaccgaccgcgaccgctcgcaaggcctgtactacgtgaagccggccaagggcgagaccgacagcaaggaagactccggcagcggcttctggtccagcctggctttctggaagagcggcgacggcaaggcggtgaaaccgaccgagcaggaataccgcatcaagctgctggaacagaccggcggcagcaccacgctgcaaattcaggacaagcagggcaagccgctgtccgacgacttcgtcaaagccgcgctgggcaagctgcaaaccgagctgcaataa

SEQ ID NO: 3722 - DNA, 204 bp, Chromobacterium substugae
atgaaacagtcgctcctcgttgctgccctgctggccgtagccctgtccgcttgcggtaagaaagaagctccggctgaagcttccgctcccgcagttgaagcttccgctccggccgcttccgctccggccgctgaagcttccgctccggctgcttccgctccggctgctgacgcttccgctccggctgcttccgctgctaagtaa

SEQ ID NO: 3723 - DNA, 1134 bp, Chromobacterium substugae
atgaacacgacaactctactgggcggcatgtcgcccgaacaattcctggccgaatactggcacaagaagccgctgctgatccgcggcgccttgaccgatgtcggcccgcacgtcgatttctccgttttgtccgagctggcgcagcgcgacgacgcggagtccaggctcatcgaattcaagcgggggcgctggcatctggagcggggcccgttccgcgcttcccgtttccgccggctggcggaaaccgactggaccctgttggtgcagggggtgaaccaccatctgccgcatatcgacgagattctgtggcgcttcaatttcatcccttatgccaggctggacgatctgatgatcagctatgcgccgcccggcggcacggtggggccgcacttcgacgcctatgacgtgttcctgctgcaggtgggcgggcgcaagcgctggcagatctcggcgcagcacgacgacgatttcatcgaggatgcccccatccgcgtattgaaagacttccgggtggaggaggagttcgtgctggagcacggcgacatgctgtacctgccgccgcactatgcgcaccacggcgtggcgctggagccgggcatgacctattcgataggtttccgcgcgccgcccgcgcaggagctggcgacccagttcctggtctatctgcaggaccggatgtgcctggacggcgtgtacgccgacccgaacctgaagctgcaagccgatcctgcgcgcatcagcgcggaaatgattgaacaggtgtccggcctgctgtcgcgcatccgctgggacaaggacacggtatgcgactttctcggccactatctgaccgaacccaaggcgcatgtgttctacgatgcgccggaggaggaactggacgaggacgagttcgccgaggcgctggcgagccaggggctggcgctggatcgcaagagccagatcctgttctgcgacgactgcgtctactgcaacggcgagaaactggcggcggacgccggcgatttcgcgcattggcggcaattcgccaaccagcgcaagctggcgccggggacattctcggccgatatgctggcttctttgtacgatggctatctgtcaggttattggcatttgctgactgatgtagcacaatag

SEQ ID NO: 3724 - DNA, 480 bp, Chromobacterium substugae
atgcaaatcgccaaaaacaccatcgtcaccctccactacgagatgttcgatgtcgacaacaacctcctcgacaagaccgaagagccgatcagctacctgcacggcggctacgacggcatcttcccgctggtggaagaagcgctggaaggcaagaacgttggcgaatccgtcgacgtgaagctgactgccgacgacgctttcggcgatccggaagaagagctggtccgcgtggaagacctggaagtgttcccggccgatgtcgaaatcggcatggtgttcgaagctgacgatccggaaaccggcgaactgctgctgttccgcgtcaccgacatcgccgacggcaaggccatcgtcgacgccaaccacccgctggccggccagagcatccgcttcgccgccaaggtggtggaagtccgcgccgcctccgccgaagaaatcagccatggccacgcccacggcgaacacggccatcatcattga

SEQ ID NO: 3725 - DNA, 750 bp, Chromobacterium substugae
atgtcgccgcgatggaaatcctgctggcccgcgtggctgctgacgccgccgatcgcctgcctcgcgctgtggccggaggccaaccggcaattgtttctggcgctccatccctggctgcagcagctgcccgcgccgttttggcgtttcgccagcgtgttcggcgattggccgacggtgctggccttgctgctcgcgctgagctggcgcgcgccgcaacggctgccggcgctgctggcgggcagcgtcgccgccatcgtgctggcggtggcgctcaaggccggcttcgcggtgcccaggccgccgctggtgctgccgccgggggcggtggatttgctggaccgtctgccgggcaacggctctttcccatccggccacgcgatggcggcggcggcgctggccaccttcgcccggcatggcgcgaggtggggctgggccgcggcctggtgtctattggcggcggcggtgctgctgtcgcgcatcgccatcggcgtgcattggccgctggacctgttggccggcgccttgctgggctgggcgacgatgcggctggcgctgcgccacgcttggcccggcggctgggcgcgcgacatcacccggaccgcctggatgatcctgctggtgctgttggccggctcgctggcctggcaattgggacatcacggagtgttcgccgagtactggctgcgggtggcgatcggggccgccgtgctgctgtggggatttgtcaggctgggccgctcgggccactag

SEQ ID NO: 3726 - DNA, 825 bp, Chromobacterium substugae
atgatgctgactatcgaacaggcgctgcgccgccactccctgccgcggctggaaagccgcatgctgctgatgcgcgtctggcccggcctgacgcatgccgccatcgtcggccacccggaacgcgagctggccgccgatatcgccgcggctttcgacgcgctggccgcgcgccggctggccggcgagcctatggcctatctgattggcgcgcgcgaattctacggccgcgatttccaggtgagtccggcggtgctgatcccgcggccggaaaccgaacatttgatcgagctggcgctggcccgcgtcgatccagccgctccggcgcgggcggtggatctgggcaccggcagcggcatcatcgccgtcacgctggcgctggaagcgccgggctggtcggtgggggcggtcgatgtctccgccgacgcgctggctgtcgcgcgcggcaatgccgatgcgctggctgcccgcgtcgatttccggctgggcagctggttcgccccgctggacgccgacgctcgcttcgatttgatcgtgtccaatccgccgtatatcgagcgcggcgaccatcatctggccgaaggcgacctgcgcttcgaaccgcgcggcgcgctgaccgacgaggccgacggcctggcctgcctgcgcgagatcgccgccggcgcgccggcgcggctggccgacggcggctggctgatggtcgagcacggctacgatcagggcgaggcggtgagggcgctgtttgccgactctggtttgagccaggtggaaaccatccgcgacctggccggccaggaccgcgtcaccatcgggcgcaaagcgggctga

SEQ ID NO: 3727 - DNA, 1443 bp, Chromobacterium substugae
atgacggttgcctacaagcaacaatccgccgatcgtctgcaagaaagcctgggcctggtgcaaagcctgatcgagcgccaacgccagctggaacatcttgtatcgcgccaggacgcggccgaatccgcggccgccgacggcctggcgccgcaacataatctgaccgaattgcgccagaagctggcgcagctgcatccggccgacatcgcccacatcctggaggcgctgccgctggaggaccgcctgctggcctgggacatggccgaggccgcccgcggcggcgccatcctgctggaggtgtccgacgcggtgcgcgaatcgctggtcgaagtgatggaccaggaacggctggtggcggcggtgagcggcctggaggccgacgagctggccgaactggcgccggacctgccgcgccaggtggtgtacgaggtgatgggacggttggacgaggaagagcgcggccagttgcaggcggtgctgtcctacgacgacgaccgcgtcggcgcgctgatggatttcgagctggtgaccatccgcgccgatgtcagctgcgaagtggtgctgcgctacctgcggcgcttcgacgaattgccgggccagaccgacaagatcttcgtcaccgacgaagccggccggctgaagggcgtgctgtccatccgcaagctgctggtgtccgaccccgacgccgaagtggcgcaggcaatggccaccgaggtggtgagcttccaccccgacgaggcggcgctggacgccgctctggcgttcgagcgctacgacttggtgaccgcgccggtggtggacgagcgcggcgtgctgctgggccggctgacggtggacgcgatggtggacgtgatccgcgaggagtccgacagcgaagtgcggaacctggccggcctgaaggaagaggaagacctgttcgcgccggtgatggattcggtgaagaaccgctggtcgtggctggcgatcaatctttgcaccgccttcttcgcctcgcgggtgataggcgcgttcgagcactccatcgcgcagttggtggcgctggcggccttgatgcccatcgtcgccggcatcggcggcaactccggcaaccagaccatcaccatgatcgtgcgcgcgctggcgatgggccagatgcggatgggccagaccggccggctgtggcgcaaggagctgggcgtcagcgtgatcaacggcatggtgtggggcagcgtgatcggcgccatcgcctggctgctgtacggcagcgcctcgctgggactggtgatgctggcggcgatgacgttgaacctgatgttggccgccaccatgggggtgatgattccgacgctgatgcagaagctgggcaaggacccggcgctgggttccagcgtgctgatcaccgcctgcaccgattccggcggcttcctgattttcctcggcctcgccacgctattcctattgtag

SEQ ID NO: 3728 - DNA, 126 bp, Chromobacterium substugae
ttgttgcttgtaggcaaccgtcatgcacgtctccttccgcccacagggcgcacaaggtgcagacggtgtgaggcgggcttattcgctaagggtgtaacgggattggattacgggataactgggtaa

SEQ ID NO: 3729 - DNA, 687 bp, Chromobacterium substugae
atgtcgcgcatcctgttgaagatcctggcggccctggtggccgcttttgtgctgtataacctgtgggtgttcggccatgtcgtctattggcgcgaccacaatcccagcgccagctccttcatgaacgagcggctggccaagatgcaggccgacgatccggacgccgaattgagccagcgctgggtgccgtacgcgaaaatctcgccgaatctgaagcgggcgctgatcgcgtcggaggacgccaggttcgtcgaccacgaaggcttcgactgggacggcatcgaggcggcgttcgagaaaaacctgaagaagggcaagatcgtcgccggcggctctaccatcagccagcaactggccaagaacctgttcctgtccagcggcaagacgccgtggcgcaagctggaggaggcgctgatcaccatgatgctggaagcggtgctggacaagcgccgcatctatgagatctacctcaacgtgatcgagtggggcgacggcgtgttcggcgccgaggccgccgcgcgctactactaccataccagcgcggccaggctgtcctcgtcccaggccgccaagctggcggcgatggtgcccaatccgcgctattacgacgcccaccgcaacgcgccgggcctggcgcggaagacccgcatcatccagcggcgcatggcttacgtcgaattgccctga

SEQ ID NO: 3730 - DNA, 822 bp, Chromobacterium substugae
atgaccgaccgttacgccgttatcggcaacccgatttcgcacagccagtctccgttcatccatcaggagttcgcccgggccttgggccaggacatcagctatgaaaagctgttcgccgaactgggcgccttccgcccgcaggtggaggccttcgtcgccgcgggcggcaagggtctcaatatcacgctgccgttcaagggcgacgccttccgcttcgcgcaggaagtgaccgagcgcgcccgcgccgccgaggcggtgaacacgctgaccttccgcgatggcaaggtctacggcgacaacaccgacggcgtcggcctggtgcgcgacatcgtggaaaacctggactacccgatcgccggccagcgcgtgctgatcctgggcgccggcggcgcggtgcgcggcgtgctggagcccatcctgcagcaaaagccggccagcctgaccatcgccaaccgcaccgtgatcaaggccgaggcgctggcgcaccatttcgcccgctacggcaaggtggaggcggtcggctacgacgcgctggcgggccgcagcttcgacatcatcatcaacgccacctccaccagcctgagcaacgagatgccgccgctgccgcatggcgtgttcaccgcccgcaccctggcatacgacatggtgtacagcagcggcctgacgccttttctgcagcgggcacagggcgaaaacgccggcatgctggccgacggcctgggcatgctggtggagcaggcggccgagtccttctccatctggcgcgggatccagcccgacacccgcaaggtgaccaatatgctgagggaagtgttagcctga

SEQ ID NO: 3731 - DNA, 453 bp, Chromobacterium substugae
atgagcaaagtgaagcagattctgcaaaccgcccatcagcgcgccgagcgctccggtctgccctacagcggcgcgctgctgccggatgaagcctatgaattgctgcagtccttgcccaagacggtgctgctggacgtgcgcagccatgccgaatggcagttcgtcggcacggtgcccggcgcggtgaacatcgaatggaaaagctacccgggcatggcggccaaccccaatttcctggcgcagctgacgcatcaggtggatccagaggcggtgctgctggtgatgtgccgctccggcgcgcgctccgaccaagtggcgcggctggcggcggccaacggctacagcgaggtgtacaacgtgctggaaggcttcgagggcgatctggacgccagcggccatcgcaactctgtcggcggctggcgccagcgcggcctgccctggatgcagggctga

SEQ ID NO: 3732 - DNA, 150 bp, Chromobacterium substugae
ttggatcagcttgactacgtcggctactgccatggtttatctcctgaaaggcaacgtgcacccaagggcaagtgcgaaaaaatcggtacgcccggctttaagcaggaagcgtgccagctccaaaatcgctgctgttgcattgtgtcatag

SEQ ID NO: 3733 - DNA, 1419 bp, Chromobacterium substugae
atggcagtagccgacgtagtcaagctgatccaagaaaacgacgtcaaatttgtcgatctgcgctttaccgatacccgcggcaaagagcagcacgtctccatcccggcccatgtgctgctggaagacgccgacgcctggttcgaacgcggccacgccttcgacggctcctccatcgccggctggaaaggcatccaggcatccgacatgctgctgatggccgacccggccaccgcccgcatcgacccgttcttcgacgagccgaccgtattcatgtcctgcgacgtgatcgacccggccgacggcaagggctacgaccgcgacccgcgctccatcgccaagcgcgccgaagcctatctgaaggcctccggcgtcggcgacaccgcctacttcggcccggagccggaattcttcatcttcgacagcatcacctggggcaccgacatgtccggctgcttcgtcaagatcaaggccgaagaagcggcctgggcctcggctgaagaattcgaaggcggcaacatgggccaccgtccgggcgtcaagggcggctacttcccggtgccgccggtggattcgtcgcaagacatccgctccgcgatggtgctgctgctggaagagctgggcgtgccggtggaagtgcaccaccacgaagtggccaccgctggccagaacgaaatcggcaccaagttcagcacgctgacccagcgcgccgactggacccagatcctgaaatacgtggtgcacaacgtcgcccacagctacggcaagaccgccaccttcatgcccaagcccatcgtcggcgacaatggctccggcatgcacgtgcaccaatcgatctggaaagacggcgtcaacctgttcgccggcgacggctacgccggcctgtccgataccgcgctgtactacatcggcggcatcatcaagcacgccaaggcgctgaacgccatcaccaacccgggcaccaactcctacaaacgcctggtgccgcactacgaagcgccggtgaagctggcctattcggccaagaaccgctccgcctcggtgcgcatcccgcacgtggccagcccgaaaggccgccgcatcgaaacccgcttcccggatccgctggccaacccgtacctgtgcttctccgcgctgctgatggccggcctcgacggcatccagaacaagatccacccgggcgacgcggccgacaagaacctgtacgacctgccgccggaagaagacaagctgatcccgaccgtatgcgccagcctggacgaagccctggcggcgctggacaaggaccgcgagttcctgacccgcggcggcgtgttctccaacgattggatcgactcctacatcgagctgaagatgcaggaagtcaacctgacccgcatgaccacccacccggtggaattcgcgatgtactactcgctgtaa

SEQ ID NO: 3734 - DNA, 459 bp, Chromobacterium substugae
atgaaaacattagcccttctcctgctgctggcctgcggcggcgtccaggcggccaccatctacaagtacgtggacgccaacggcaacgtcacctacaccaatgtgccgatccgcggcgcgcagccgatcaagctgaatccgctttcatcctaccccggcggcaagagcggcggcgcctccgccggcaagccggccgcgtccggcggctaccccagcgtggacgccaatatccagaagcagcgcgacaatggccgcaagaaaatcctggaacaggaattggccaacgaggcgaaggcgctggatgccgccaagaaggcgctggccgacggcaaggccacccgcctgggcgacgaggcgcgcaactaccagaaatacctggaccgggtgcagaaactgcaggacgaggtcaccgaccgccagaagaatgtcgaggcgctgcgccgcgagctgggcatgtga

SEQ ID NO: 3735 - DNA, 1062 bp, Chromobacterium substugae
atgcccctacccagctttgccggactggaactgctagacaccccggtgctcatctgcgacgccgcagcctcgctgcgcttcgtcaaccccgcctgcgaaaacctgctggcgctgggcagccgcgaaatgctgcgccacagcctgctggagctgttccagccctgccccgcgctgcgccaggcgctcaccaccgcgctgctgcaaggcgccagctacatcgagcacgacctggaactgaagccgcagcacaacgacgccgtgctgcacgtggcgctgaccatcaccccggtagacgccgacggcagcctggcgctgatcgaactgcggccgctggaccagcagctgaaaatcgccaatgaggagcgctctctgctgcagcaccaggccaaccgcgagctgatccgcaacctggcgcacgaaatcaaaaacccgctgggcggcatccgcggcgcggcccagctgttggagcacgagctggccgaccgccccgagctgaaggaatacaccgcggtcatcaccgaagaggcgctgcgcctgcaggcgctggtggaccggctgctggcgccgcaccgcagccacagccgcgcgccgatcaacatccacgaggtgctggagcgggtgcgcagcatcgcgctggcccagcatccgcaaggcctggcggtgatccgcgactacgacaccagcctgccgctgctgtcggccgacaaggaacagctgatccaggtggtgctcaacatcgtcaacaacgcggtgcaggcgctgcgcggccagggccgcatcgtgctgcgcacccgggtggcccgccagatcacgctggcgcgcaaacgccaccagctggcactgaaattgcaaatcgaggacaacggccccggcgtgcccgacgacatccgcgaccacatcttctacccgctggtcaccggccgcgccgaaggcaccggcctggggctgacgctggcgcaggccttcgtccaccagcacggcggcagcatagagttcgaatcgcgcccaggccagacctgcttcaccgtgctgctgcccttcgccgccgacgcggcgagctga

SEQ ID NO: 3736 - DNA, 1410 bp, Chromobacterium substugae
atgaccaagccggtctggatcatcgacgacgacaaggcgatacgctgggtgctggaaaaggcgctgacccgcgccgagatcggcttcgacagtttctccagcgccgacgacgcgctgaacgcgctgtacgacgccaccccgcaggccatcatttccgacatccgcatgcccggcaccgacggcctgaaattcctggccaaggtgaagaacgagcatccgcagctgccggtgatcatcatgaccgcccactccgacctggactccgcggtatcggcgttccagggcggcgccttcgaatatctgcccaagcccttcgacatcgaccaggcggtgctgctgatcgagcgcgcgctggcggaaagccaggcgcaggccgccggcccggacagcccggaggcgatgccggtgctgctgggccaggcgccggcgatgcaggacgtgttccgcgccatcggccggctggcccagtccagcgtcacggtgctgatcaccggcgaatccggcaccggcaaggaaagggtggcggaagcgctgcatcgccattcggtgcgctcaggcaagcccttcatcgcgctcaataccgcggcgatcccgaaggacctgctggagtcggaactgttcggccacgaaaaaggcgccttcaccggcgcgctggccgcccgccgcggccgtttcgaggaggcagagggcggcacgctgttcctcgacgaaatcggcgacatgccgaccgagctgcagacgcggctgctgcgcgtgttgtccgacggccatttctaccgcgtcggcggccacaccccgatcaaggccaatgtgcgggtgatcgccgccacccaccagaacctggagcagcgggtgcgcgacggccagttccgcgaagacctgtaccaccgcctcaacgtgatccggctgcggctgccgccgctgcgcgagcggcgcgaggacatcccgctcctgacccgccacttcctggccaagagcgcgtcccagctgggcgtggaggccaagcgcctgtccgaggcggcgatggcgctgatccagcgcagcgccttcagcggcaatgtgcgcgaactggaaaacctgtgccagtggatctgcgtgatggcgccgggccagacggtggaggtggcggacctgccgccggaattgcgcgacccgcagggccagccggccgctgcggcggcatccggctgggatcagcaattggccgaggaaatccgccagcgcctgctagccggcgaaaccggcatcgtcgacgagctcacccaccgcttcgaaagctgctgcatccgcgccggcctcgcccacaccggcggccggcgggtggaggcggctcacctgctgggctggggccgcaatacgctgacgcggaaaatccaggagctgggcctggaccatggcgatccgagctga

SEQ ID NO: 3737 - DNA, 756 bp, Chromobacterium substugae
atgccacgccttgtcctcgctctggcctgcctgacgcccctggccgcgccggccgcgccgctgcagatcgcgatcagcgacgcgctcaccagcccgtacgtgatcgaagatccgtccgccgccgcgccgccgcgcggccgcgccatcgagctggcccaggccgcgctggagcattgccggctggagggcggcttcaaccgccaacccggcgagcgcatcgtgcagaatctggcgctgaaccgcatcgacagcgcgctgctgctgtcctacaagagcgagcgcgccggccagatggcctttccgatgcgcgccggccaggccgacccggaacgccggatggccaccttccactacgcgttctatgtccgcagcgacagccgcctgcgctggaacgggcgcgcgctggtcggcctcgccggcgcggtcggcatcaaccagggctggtcgataggccgcgacctgctgtcgcaaggcatcccggtggaggaaagccacggcatcgccgacaacttcgccaagctgcaggccggccgcaccgacgcctacgcattgcatcagctggccggcgacctctacctgcgccaccacccggagctgaaaatccgccgcctgtcgccaccgctgcaaagcaagacctattactgggtgttcagccgcggctacgccagccggcatccacagcaggtggactgcctgtggcggcaaatgccggccctgcgcgcgcgctatctgccggaaagcgtcgccgcgcgctga

SEQ ID NO: 3738 - DNA, 684 bp, Chromobacterium substugae
atggacgggggggcgctgggcggcatcgccgcgcgcgtcggcggcaagcgcctgcccgcatttcaaccgctggctggcctgcgcgccgccgcccttgcgcggcctgggccaggcatatctgaacagccggctgcggccggccgatcagggctggccatttcaatgggcatcacaggaatcgatatgggcatcaaacgactcaaccacgccgtgctttacgtcagcgacgtggccggcagcaccgctttctaccgcgatgtgctgggcttccgccccaagggcgacgccggctccagccgcgcggtgttcacccaggccgcgcattcggacaacgaccacgatctggcgctgttcagccgcaatctgggccagcaacgctccggcccgttcagcccgcgcggcgaggcgccggacccgcatcagcccaaggccggcctgtaccacctggcctgggaggtggacaccctggcggaattgaagcgcatccgcgacgagctggccgcgcttggcaagctgggcatggaggaagaccacggcgtgcacaaaagcgtctacggccacgatccggacgggctgctgttcgaggtgtgctggttcgtgccgccgcagttgctggacgcggcgccggcgccggccgaggacggcaggctggattgggcccgcgagctggcgcgctacggctga

SEQ ID NO: 3739 - DNA, 924 bp, Chromobacterium substugae
atgagcgtgctggagcttaggcatttgaaaagcctgctggcgctggcggaaagcggcagcgtgtcgcaggccgcgcaacgggtgtacctgacccagtcggcgctgtcgcatcagttgaaacagctggagacggcgtacggcctggccttgttcgaacgcaagacccagcccttgcgcttcacgccggccggcgagcggctgctgggtttggcccgcgatctgctggcgcgggtggcggcggccgagcgcgacctggcgcgcatccgccagggcgaggccggcgaaatccgggtggcggtggagtgccacacttgcttcgactggctgatgccggcgatggaccagttccgccagcactggccggcggtggagctggacatcgtgtcgggcttccacgcggacccggtgggcctgctgctgagcggccgcgccgatctcgccatcgtgtccgaggccgaggcgcaggccggcatcgtccaccaaccgctgtttgcctacgaaatggtggcgatcgccgcgcgcgaacacccgctggccggcaaggcctgctggcgggccgaggatttcgtcggcgaaacgctgatccactacccggtgccggacgatatgctggatctgctgcgcaaggtgctgctgccggccggcgtcaacccggcgcggcgcaccgccgagctgaccatcgccatcatccagctggtggccagccggcgcggggtggcggtgctgccgtactggacggtgcagccctacctggagcgcggctacgtggtggcgcgccaggtaggggaggcgggcctgcagagcgagctgtacgcggcgctgcgcggcgacgacgccggccaggcctacatgcaggactttctgcagacggtgcgggactgcagcttcgccagcctgccgggactatcgcctttgccggcttga

SEQ ID NO: 3740 - DNA, 2280 bp, Chromobacterium substugae
atgaccaccacccacctgccgggcttcccccgcatcggcgccaagcgcgaactgaaaatcctgctggaaagctactggaagcgcgacatcggcgaagccgagctgctcgccggcgcgcgcgaactgcgccaacgccactggctgctgcaaaaaggcgccggcgtcgatctgccgccggtcggcgatttctcgctgtacgaccatgtgctggacgcgcagctgctggtgggcgccgcgccggcgcgcttcggtttcgccgccgacgccatcgacactgagcgctacttccagctggcgcgcggcaatgccagccagccggcgctggaaatgaccaagtggttcgacaccaattatcactacctggtgccggaatggcaggcagacaccgcgttccgcgcccagccggagcggctgctcggccaggtccgcgaagccctggcgctgggcgtgcgcgccaagccggtgctgctcggcccgctcagcctgctgtggctgggcaagtgcaagggccggacgttcgaacggctgcaattgctgcccggcctgctggccgcctatcggcaaatcctggccgcgctgcgcgaagccggcgtggaatgggtgcagatcgacgaacccattctggcgctggacctgccgcccgcctggctggacgccttcccggccagctaccggcagctgcaagccgacgcgccggccatcctgctggccagctacttcggcggcgtggccgagcatgccgatctgctcaaggcgctgccggtggccggcctgcacctggacctggcgcgcgcgccgcaacagctgtccgccttcttggccggcttcccggccgacaaggtgctgtcggccggcgtcatcgatggccgcaacgtctggcgcgccgacctgtccgccatcctgcggcagttgcaggccgcccacgcccagctgggcgaccggctatggctcgcgcccagctgctcgctgctgcacagccccttcgacctggccgccgaaatcgcgctggctcccgatatcaaagcctggctggccttcgcggtgcagaaactgaacgaactgagaaccctgcagcgcggcttgcggctgggccgcgacgccatcgccggcgaattggccggcagcgacttcgcccaacaacaaaaacagcacagcccgctgatccaccttcccggggtgcgccagcgcatcgccgcgctgcccaccggcgccgaccgccgcgccagcccctacccggtccgcgccccgctgcagcaggcctggctgcgcttgccgccgctgcccaccaccaccataggatccttcccgcagaccgcggccatccgcgccagccgggccgcctacaaacgcggcgaactggccgccgccgactatcaaaaagcgatggaaggcgaaatcgagctggcgatccgccgccaggaagcgctggggctggatgtgctggtgcatggcgaggccgagcgcaacgacatggtggaatatttcggcgagcagctgtccggcttcgccttcaccgccggcggctgggtgcaaagctacggcagccgctgcgtgaagccgcccattctctacggcgatgtcagccgccccgcggcgatgaccgtggactgggcgcgctacgcgcaaagcctgaccgccaagccggtgaagggcatgctgaccgggccggtcaccatcctgcagtggagctttgtccgcgacgacctgccgcgcagcgaagtctgccgccagatcgcgctggcgctgaacgacgaggtgcggggtcttgaggccgccggcatccgcgtgatccagatcgacgagccggccatccgcgagggcctgccgctgaagcgcgccgaccgcgacggctacctggcctgggccggccaggccttccgcctgtcctgccacggcgtcgacgacgccacccagatccatacccatatgtgctattcggaattcggcgacatcctgccggccatcgccgcgctggacgccgacgtgatcaccatcgaaacctcgcgttcggacatggcgctgctggcggacttcggccgcttccgctaccccaacgccatcggccccggcgtctacgacatccacagcccgcgcgtgccggcgccggcggaaatccgccagttgctggaaaaagccttgcaagtgattcccgccgcgcagctatgggtgaacccggactgcggcctgaaaacccgcgactggccggaggtggaggcggcgctggccgccatggttcaggtcggccgggagttgcgggaggagatcgcgccagcggtttga

SEQ ID NO: 3741 - DNA, 459 bp, Chromobacterium substugae
atggatttgatcttgtggcgccatgccgaagcggaagagggcgccgacgatctgtcgcgcgcgctgacccggcgcggccagcagcaggccagccagatggcgtcctggctgcgccagcgcctgcccgacaattacctgctgctggcttcggaagccaagcgttcgcagcagaccgccaactacctggccaagagctataccgtgctgccggagctgaatcccggttccgatgtggacgaggtgctggcggcggtggggtggccggatgcggagcgcgcggtggtgctggtcggccatcagccgtatatcggctggctggcggcgcgcctgctggctgaacagcagcagctgtggagcgtgaagaagggctcggtgtggtggctgaaccgccgcgagcgccacggcatggaacagatcaggctgaagttgatgctgacgccgggaatgctggagccgtga

SEQ ID NO: 3742 - DNA, 717 bp, Chromobacterium substugae
atgatcccgattttgccctccgccgtgctggattcgccgctgaccggcattttcgtcaccctgctggcctaccggctggcgctggccgccagccggcgcagccatggccacccgctggccaacccggtgctgctgggcgtgttgatggtgctgctatggctgtggctgagcggcagcagttatcagcagtacatgggcggcgcgcgcttcatccagctgttgctggggccggccaccgtggcgctggcggtgccgctgtacggcaatctgccgcggctcaagcgcgccgccgtccccttgctgctcagcgtctgcgtcggcggcctggccggcatggcaagcgcggccggcctgggctggtggctgggcctggaccacgcggtgctggtgtcgctggccacccgggcggtgaccacgccgatcgcgatgagcctggccggcaagctgggcggcgcgccggagctggcggcaatgttcgtgatcgtgtccggcatcgtcggcgcggtgctggcgccgccgctgtgccggctgctgggctgggacgacgacatgctgatgggcgtggccaccggcgtcaccgcccatggtatcggcaccgcccgggtattccatctctccgaggccgcgggcgccttcgccgggctggcgatgggcctgaacggcgtgttcactgcgatgctgttgccatggctggtgcgctggctgcaggtcggttag

SEQ ID NO: 3743 - DNA, 345 bp, Chromobacterium substugae
atgctggacctgttgctgtggctgctggcgtatcaactattgggagaagcgctggcgcggcatttcggctggccgctgcccggcccggtgctgggcatgctgctgctgttcgccaccctgtggctgcgccgggcggtgccggccacgctgcagcgcgaggcgccgcgttttcttggccacatgtccttgctgttcatcccggcgggcggcgccttgctggcctacgcgcccttgctgcgcagccatggctggcagctgctgctgattctgctggcgtccacgctgctcaccgcgctggtcagcgccggcatgctcaagctgttgttgcgggggaggcgcagatga

SEQ ID NO: 3744 - DNA, 1461 bp, Chromobacterium substugae
atgataacggcaagccggccgcgccgggtagcgacaagcccgctcggcttttggcataatgcgcgccatggtcgatgcccaatggcgctgcgcgccgcccgtcctgcccgcccccttactggattgtctgaccgagcccgcctcgctcagcctgcgcctgcaggccggcggccgccgtttcgccgtgcgggtgctggaccagggcgacagccgcgcgctgcccgacgaggccgaggcgctggatctgccgtccggcgcgccgctgtacgcgcgccatgtgctgctgacgctggacgagacgccggtggtgtacgcccgcagcgccacccgccacgactgccccgcctggatgccggtgctgatgcgcggcagccgctcgctgggcctgaccttgttcggcgaattgcccgcgctgcggcgcgagccgctgcattaccaattgctggacagccgccatccgctggcggtagaagccgccgccgccgaagccgccgagacctacccggcgcggcgctgccgcttcctgctggacggctcgccgctgctgctgaccgaactgttcctgcccgccctgaaggatttactgtgatctcgtccgccaccctccgcgaccgctacgacaactacaagcagctgatgcgctgggacaagcccattggcaccctgctgttgctatggccgacgctgtggggcctgtggatcgccgccgacggcaaacccgacgcgctgatcgcggccatcttctgcctgggcaccttcctgatgcgctcggccggctgcgtgatcaacgactacgccgaccgcgatttcgacgcccatgtggcgcgcaccagccagcggccattcgcccgcggcgcggtcagcaagaaagaggcgctgctgctggccgccttcctcgccctgctgtccttcctgctggtgctgccgctcaaccatctcacctggctgctcagcgtgccggcggtgctgatcgccgccagctacccgttcaccaagcgctttttcccgatgccgcaagcctacctgggcatcgccttttccttcggcatcccgatggctttcgccgcccagaccaaccaggtgcccgcattggcctggatcctgctgctggctaacgtattctgggtgttggcctacgataccgcctacgccatcgccgacaagccggacgatctgaagatcggcatcaaaacctcggccatcacgctcggcgactacgacgtcgccgcggtgatggccttccacctgctgttcctggcggtgatggccggcgtggggctgcgcctcggcctgctgtggccctactatctgggactggcgcttgccgccgcgctgatggcgctgcaataccgcgacatccgccaccgcgaccgcgcgctgtgcttcaaggccttcctcgacaacaaccgcgtcggcgccgccattttcgccggcctgctgctcagctactggctgcgctaa

SEQ ID NO: 3745 - DNA, 216 bp, Chromobacterium substugae
atgaaaaaactgctgaccgctctgatcgctgctgctttcgctggttccgctttcgccgccccggccgcatccgccccggccgccgaaaagaagatggaacacaaggccgagcacaagaagtcgcaccacaagaaagcgcacaagaaacacgcctccggcgccgcgcatgaaaagcacaaaaaggctgagcacaaggcagcctccgccaccaagtaa

SEQ ID NO: 3746 - DNA, 432 bp, Chromobacterium substugae
atgacggccaagcagcgcaagctgctgtggctgggcgtggcgctgattgttttcggcgcgctgaaggcggggctgatctactggtatctgcacaacaaaccggcggcggccaaaccgctgacgctgtcctgcgacatcggccgcggcggctgcgccttgccgggcggggggcggctggcgttctccgcgccgcccgagcacggccggccgttcgagctgcggctgagcggattggcgggggagacgccgccggcggtggacttttcgatgccggacatggacatgggtttcaaccgctacgtcttcgtccgcgacggcgccggctggaaagcgacggtgacgctgccgatgtgcgtcagcggcagccgcaactgggtggcggagctgaaggacggcaaggccgcctaccggctgccgttcactgtgcgctag

SEQ ID NO: 3747 - DNA, 936 bp, Chromobacterium substugae
atgacgagcaacaagatcatagaggtggtggccggcgcgctgatgcggccggatggcggtttcatgctgggcagccgcccggagggcaagccctacgccggttactgggagtttcccggcggcaaggtggagccgggcgagacgccgctggaggcgttgaagcgcgagtttcacgaggaaatgggcatcatcgtcaccgccgccacgccgtggctgaccaagatccaccattacgagcacgcgtcggtccacctgcgctttttccgcatctgggactggcagggcgagccgcagccgcgcgaggcgcagtctttcgcctggcagcggccgggccgctacacggtggcgccgatgctgccggccaacggaccgatactgaaatcgctggagctgccggcctgctatgcgatcacctgcgccgccgagatcggcgtcgaggcgcagctggcgcggctggtcgagcgcgactggggcatggtgcaggtgcgcgagcatgggatggggcatgaggagctggccgatttcgtcgcccgcgccgccgccatcgtccgtccacgcggcggcaagctggtggtcaacgccgatccggcctggctggaaggctggccggtggatggcgtgcatctgacaggcgcgcggctggccgcgctgaccgcgcggcctgcgttcgactgggtgggcgcgtcgatacacggcgcggacgaattggcgcgcgccggcgagctggggctggactacgcgttgttgagcccggtggcgcccaccgccagccatcccgacgcggcgttgttgggttgggacggctttgccgcctgcctggccggcggcgtgccggtgccggtgtacgcgctgggcggactgactgccgaagatctgccgccggcgcgcgagcatggcgcgcacggcgtggcgctgatgcgcggggcctggcgatga

SEQ ID NO: 3748 - DNA, 693 bp, Chromobacterium substugae
atgacgacagccacccccacccaacgcaatctcgccctgttcgatctcgaccacacgctgctggccggcgattccgacttcgaatggccgcgcttcctgatcaagcgcggcatcctggacgccgcccagtacgacgagcgcaacagctatttctaccgccagtaccagaacggcacgctggacatgcaggagtacctggctttcatcctggcgccgctgacccgcttcagccgcgcccagctggacgaattgcacgccgactatctggaaaaccatatcaagccgctgatcccgaacaaggcgcggcaacgtctggcggcgcacgcggctgagggcgaccagatcgtcatcatcaccgccaccaaccgcttcatcaccggcccgatcgcccgcgacctgggcgtcgagcacctgatcgccatcgagctggaagaggacgccgacggcaacttcaccggccgcccgaccggcgtgttgagcttcaaggaaggcaagatcacccgcatcgagcaatggctggccgagcgcggcgaaagctgggacagctacggcaccagcttcttctacagcgactcgcacaacgacctgccgctgatgaagctggtggacaagccggtggcggtggacccggacgacaagctgcgcgcccatgccgaagcgcacggctggccggtgatctcgctgcgcgattga

SEQ ID NO: 3749 - DNA, 675 bp, Chromobacterium substugae
ttggaccagctcgtactcgatctcacgcccacgccgctgccggccttcgacaatttcctggccgagcgcaaccgcgaggtgatcacggccctgaccgccaccgaaggcgaacgcttcatttatctatggggcgagcccggttgcggcaagacccatctgctgcaggcctggatcgcccacgccgagcggctggggcgcgccgccatctatctggacggcaagggcgaccatctgccggacttcgcgcgcgaggccagcttcatcgcggtggaccacgtcgacgacctggcgccggacgaccagatcacgctgttctccttctacaactcgctgaaggaaagcggcgaatcgcggctgctgatggccgggcgcaacccgccgatggccttgtcggtgcgcgacgatctgcgcacccggctgggctggggactggtgctggaagtgaaggcgctgtccgacgacgacaagctggccgccttgcgcagccacgccgccacgcgccagctgtcgattccggacgatgtctaccgctacctgctcacccactggcggcgcgacctgtccagcctgatcggcatgatagacatgctggaccgctactcgctggcgatgaggcggccgatcaccgtgccgctggtgaaaaacgttttgcaaaccgccaccccggaatcatga

SEQ ID NO: 3750 - DNA, 168 bp, Chromobacterium substugae
ttgttcgattttacgccgatacggcccttcggtggaaccgccttttgccgcggcggcggcgacggacgcggcgatgccgccgcccgcgaaaaaccgcccgccgcttttgccagcctgtttgccatttttcagttaaaatacagtgctttcgcaccggcgaaagcttga

SEQ ID NO: 3751 - DNA, 1038 bp, Chromobacterium substugae
ttgaataccacgtccctcagttaccgtgatgccggcgtagacatcgacgccggcgacgcgctggtcgaaaacatcaagccttttgccaagcgcaccatgcgcccggaagtgctcggcggcatcggcggtttcggcgcactggtggagatttccaagaagtacaaggaaccggtgctggtatccggcaccgacggcgtcggcaccaagctgaaactggccttcgactggaaccgccacgacaccgtcggcatcgacctggtggcgatgagcgtcaacgacatcctggtgcaaggcgccgagccgctgttcttcctcgactacttcgcctgcggcaagctggacgtggcgcaggccaccgaggtgatcaagggcatcgccgccggctgcgagatggccggctgcgcgctgaccggcggcgaaaccgccgagatgcctggcatgtacgtgcccggcgaatacgacctggctggcttcgccgtcggcgtggtggaaaagagcaaggtgatttccggccgcgacatcgccgccggcgacgtggtgctgggcctggcctccaacggcgtgcactccaacggctacagcctggtgcgcaagatcatcgaccgcgcgcagccggaactggacgcgccgttcgacggcggcaagacgctgcgcgacgcggtgatcgccccgacccgcatctacgtgaagccgctgctcaagctgatggaaaccctgccggtcaagggcatggcccacatcaccggcggcggcatcaccgagaacaccccgcgcgtgctgccggacaacgccgtcgcccagatcgacgccaagagctgggaactgcccaagctgttccagtggctgcagcgcgaaggcaaggtggacacccaggagatgtaccgcaccttcaactgcggcatcggcatggtggtggtggtggcggccgaacacgccgagcaggcgatggcgctgctgcgcgaagccggcgaaaccgtctatcgcatcggcaccgtccgcgagcgccagggcgacgagcaccagacgcagatcgcttaa

SEQ ID NO: 3752 - DNA, 642 bp, Chromobacterium substugae
atgaaaaacatcgtcatcctgatttccggccgcggctccaatatgcaggccatcgtcaacgccggcatcgccggcgcccgcgtcgccgcggtgatcgccaaccgcccggacgcggccggcctcgcctgggcggccgagcgcggcatcgccaccgcggcgctggaccacaaggcctaccccagtcgggaagccttcgacgccgcgctggccgaggcgatagacgcccacgcgcccgatctggtggtgctggccggcttcatgcgcatcctgaccgcaggcttcacccgccgctacgaaggccggatgctgaacatccatccgtcgctgctgccggccttccccggcctgcacacccacgagcgcgcgctggaaatgggctgcaaactggccggatgcacggtacacttcgtcaccgccgagctggaccacggccccatcgtcgcccagggcgcggtgagcgtgcaggacggcgacacgccggacagcctggccgcgcgcgtgctgaagctggaacaccagctgtatccggaggcggtgcgccgcttcgccgccggcgagctctccatcgtgaacggcaaggtggccagcggtccggccgccgcctgcgatctgatgtccccgccgccatcctataaggtttaa

SEQ ID NO: 3753 - DNA, 1182 bp, Chromobacterium substugae
atgtcccgccgccgtctgctattgatcgcgctgtttctgtcgctggccctgcacttcgcgctgctgggctccggcatgctgcccgccatcagcctgccgccggccgaagacaccaagctggaaaagatagacatcaagatgcaggcgatggggctggaagaagcggcgcgcccggcgccgccagctggcgccggcgtcaacctggccccggccgcggcgcggccaaacccgcgccgaaacccaaaccaaagccgaaaccgcagcgcaaagcggccgcctcgcaagcggcggacgaaccgaaagccgcggcgtcggcgcccgcggccgaaaccgccgccggccaaggcgagcgcgccgccagcgcgccacacgccgagaccgcccccgcgccgtccgccagcgcgccacacgcggaaacccggcatgcggcggcgcagaccgcgtccgaagacgcgggccaaaccgcaagacccggccggcttcctgcacccgccgcagccgctgcgcaagttcccggccgcggccaagctcagctaccagctgtactggaacggcgtctacgccggaaccggtgagctaaactggcagcaaggccatggccgctacctgctggaaaccgtggcgacgccggcgttcgcctaccgcatgttcacccgcggctatcgctaccgggtggaaggcggcatagacgccggcgggctgcgcccggacagcatgctgtcgttcgagggcgacaaggccaaggaagaggcccgcttcgactacgccgccggccagttgcgctacggcatgggcgccggacagcaagtggcgctgcgcgccggcgcgcaagacatttacagcctggccttccagctggggctgaagggcggacatctgggcgacaaggcgctgcagatcaccaccgccaagaaagtctacgattacccgatggcgccgactggagccttcgactacgacaccaacgccggcaagatgcgggtcgcggtgttccaggccaaaggaggcggcgacaccaccgaattctggctggcgacggatttcgccaacctgccggtgcgcatcacgcgcatcgacgacaagaagcggatcgagctgcgcgcggtccgcatagaagtgaatggcgcgctgcagtgggaactgccgccgcaaccgacgagactgaacaagaatgcacattag

SEQ ID NO: 3754 - DNA, 1260 bp, Chromobacterium substugae
atgcacattagccatagccaactgaaacacctggaaaccgtcatcggacagatgacccgcttcgaccgcccggccgacgccgtgctgtccgcctatttccgcgagcacaacaagctgggcggcgccgaccgccacctgatcgccgaaaccgccttcggcgcgttgcgccgcctgatccagctgcgcgcgctgatcgcgccggagaaagccacgccgcgccgcctggcgctggtggcgctgatgaaattcaacaagctgaacgtcaaggaattgaccgaagccaccagcgccggcgagcgcgagtggctcggcacggtcaaaggcaagacgctggaagacagcctggaaatccgcgcagagctgccgcaatgggtgatcgagcgcctgggcgagcaggagccgtccgcggtggaggcgctgggccagggcctgatgtcgatggcgccgctggacctgcgcgtcaacacgctgaagatgaagcgcgaagagctgctggaccgcctgaacgccgaaggcatccattgcgaagccacgccgtactcgccgttgggcatccgcctgaaagacaagccggcgctgtccaaacacgagctcttcaaggccggcgcgttcgaggtgcaggacgagggcagccagctcttgggcctgatcaccggcgcgcgccgcggcgaaatggtggtggacttctgcgccggcgccggcggcaaaacgctgctgttgggcgcgcagatgtcatccagcggccgcctgtatgcgttcgacgtgtcggaaaagcgcctggccaacttcaaaccgcgccaagcccgctccggcctgtccaatgtgcacccgcaactgctggcgcacgaaaacgacgccaaggtgaaacgcctggccggcaaggccgaccgcgtgctggtggacgccccctgctccggcctgggcaccctgcgccgcaatccggacctgaaattccgccagagcccggacagcgtcgccgaactgaacgccaagcaggcgtccatcctcgcctccgcctcgcggctggtgaagagcggcggccgcctggtctacgccacctgcagcctgctgccgcaggaaaaccaggccatcgtcgaggccttcctggccgagcacgccgacttccgcctgctgaagatggacgaggtgctggccgagcagaaaatcccgctgcaatgcggcgattacctggagctgaaaccccatctgcataacaccgacggcttcttcgccgcggtactggaacgcagcgccggctaa

SEQ ID NO: 3755 - DNA, 1368 bp, Chromobacterium substugae
atgcaggactacctcagccgccgcaacagccggcagaaaatgaaccgccagctgcgttatctctacctgtccgcggcccaatggcggcggcaactgccggtatggatcgcggccatcctgatcggcgtggtggcttacgtgttcgcgctgggcagccatctgtctcacgacctgttctaccaggcctattcctattcgccatactggagcctcttgatcaccccggcgggcctggcgctggcgatctggatcatgcaccgcttcttccccggctcggccggcggcggcatcccgcaatccatcgccgcgctggagcccggcatggaaaagctgcgcgagacctgtttcacgctgcgcgccgccttcggcaaggtgctgctgacgctgataggcatcagctccggcgccaccttcggctacgaaggccccatcgtccaggtcggcgccgccatcaagtactcgctgaaccgcaaggccgcgctgcgccacgagggcgccgcgcgcagcttcatcctggccggcgccgccgccgcggtggccgccgccttcaacgcgccgctggccggcatcgtgttcgccatcgaggaaatgggccgcaccttcgacatgcgcgccagttccaccattctgctgtcggtgatcgtggccggcctcaccaccttcgccatcaacggcaactacaactatttcggcgtggtgcaggtggcgatggacagcaaccagacctggctggccatcccggtatgcggcgtgatcggcggcctggtcggcggcctggcctgccgggtgctgctggcgctgtctcagcggttgcccggcccgctgcacggctggcgcgtccgctacccgatacgcttcgccgccggctgcggcctggcgctggcggtgataggcatcgccagccacggcagcaccttcggcaccggctacttccgcgcccgcgacatcatcgaaggccacggcgcggcgctacaggattacggcgcgctgaagctgatcagcatgttcgtcagccacatcagcgcggtgcctggcggcatgttcgcgccgtcgctggcggtgggcgccggcttcggcctcaatatgtcacagcttctgccgttcttgccgcagaccatggtggtgctgctgggcatggtcggctttttcgccggcatgacccgagcgccgatgaccggtttcgtcatcgtgatggaaatgaccgacacctcgggcatgatcattccgctgatggccaccgcgctggtcgcggcgtcggtttcgcggctggtcagccgccgcgcgctgtacgagggccaagtgcggctgttcctgccgcaatggcacgccaggcttaggcaaattgaccagcccggtggccgcacgtag

SEQ ID NO: 3756 - DNA, 312 bp, Chromobacterium substugae
atgtcgattcaacaagatattcaacaaaccgtcgccgccaacaccgtggtgctgttcatgaagggctcggcccagttcccgcagtgcggcttctcctcgcgcgcggtgcagatcctcaaagcctgcggcgtcgaggactttctcaccgtcgacgtgctgcgcgacccggacatccgccagggcatcaaggacttctccaactggccgaccattccgcagctgtacgtgaagggcgagttcgtcggcggctccgacatcatgtacgagatgttccagaacggcgaactgcaggaaatgctgaaagacctgtaa

SEQ ID NO: 3757 - DNA, 636 bp, Chromobacterium substugae
ttgaacatcaccatcgtcgatcacccgctggtccagcacaagctgggcctgttgcgcgaagcggacaccagcaccatgaaattccgccagctgacccaggagctggcgcgcctgctcgcttacgaagccacccgcgacttcgagctggaaaccgtctccatcgacggctggtgcggcaagatagacgtcaagcagatcaagggtaagaaagtgaccgtggtgcctatcctgcgcgccggcatcggcatgctggacggcgtgctggacctggtgccgtcggccaagatcagcgtggtgggcctggcccgcaacgaagagacgctggagccggtatcctactttgaaaaattcgtcggcaatctggacgagcgcatcgccatcatcatcgacccgatgctggccaccggcggctcgctggtcgccaccatcgacctcctgaagcgcaacggctgcaaaaccatcaaggcggtggtgatggtggcggcgccggaaggcgtgaagatcgtcaacgacgcccacccggacgtgcaaatctatgccgcttcgctcgacagccatctgaacgagcacggctacatcatccccggcctcggcgatgccggcgacaagatcttcggcaccaagcagcaggcctga

SEQ ID NO: 3758 - DNA, 639 bp, Chromobacterium substugae
atggaccgctacgccgcgatagacgccgactttctcgcccgcttccccggcggcttccaggacccggactggcaaacgctcgcccgccggcacaaaagctacgccaaggccgaggcgctgtgccagagcgagctgacccgcgccaagctggacgcggcgctcgccagcggcaagctggccgacgccacccacgcctgccgccagatcatctcgctggccaccacggtcagcactttcgagaagatcgccttccgcaactacctggacaaccgcgacctgaacctgcccttcgtccaggcgctgcgcgatgtgttgcatgatttcagcccggacagcttcgccgcctatgtggacacgctggcgatggcgcggaccgaccccaaggccaacgccgccaaatggccgatcgtcagctgcttcctggcctgcttcgatccgcaggtccatgtctgcgtcaagccgaccacggtgaagaaagtggcggcgcgcctgggcgtggacattcgctaccaagccaagccgaactatgaatgctacgaggcggtgcagcgtatggtgcaggatttcaagcgccgcagcatggtggctgccgatgtcgacaatgtgctggcgcaggcggtgatgtattgcgccgtctga

SEQ ID NO: 3759 - DNA, 1242 bp, Chromobacterium substugae
atgcaacaactgaagctggcggtgtccggcgcccagatcctgttcgtcgccttcggcgcgctggtgctggtgccgctgctcaccggcctgaatccggcgatggcgctgctgggcgccggcctcggcaccctgctgttccaggcctgcactggccgccaggtgccgattttcctcggctcctccttcgccttcatcggccccatcatctactcgatccacacctggggccagggcgcgaccatgttcggcctgttcgccgccggcttcatgtacttcgtgttcgccgccatcgtgcgctggcgcggcatggcgctggtcaacaagttgctgccgtcggtggtgatcggcccagtgatcatgatcatcggcctgtcggtcgccaccgccgcttccggcatggcgatgggccaggccggcggcaagcaggtgctgccgtatgaaacctcgctgctgctggcggccatttcgctggccaccaccatcgtcgtctccatctacgcccgcggcatgttcaagctggtgcccatcctggccggcgtcgtcgtcggctacatcgcggccgccttcctcggcgcggtggacttcgccaaactggccgccgcgccgtggttcgcggcgcccgccttccacagcccggaagtcaactgggcggcagctgccttcatgctgccggtggccatcgccccggccatcgagcacatcggcggcgtgatggcgataggcggcgtcaccggcaaggattacaccaaagcccccggcctgcaccgcacgctggccggcgacggcctgggcgtgtgcgtggccggcctgatcggcggcccgccggtgaccacctacgccgaagtgaccggcgcggtgatgatcacccgcaacttcaacccggtgaccatgacctgggcggccatcttcgccatctgcatggccttcttcggcaagttcaacgcgctactgcaatcgattccgatgccggtgatgggcggcatcatggtgctgctgttcggcaccatcgcctccatcggcctgaagacgctgatcgaggccaaggtggacctgatggagccgcgcaacctggtgatcatctcggtggtgctgaccgccggcatcggcggcctgacgctgaagctgggcgacttcgcgctggccggcgtcggcctgtgctccttgctggccatcctgctgaacctgatcttgccgcgccaggcggccagccacgacggcatcgtcgaaggccaggacatctag

SEQ ID NO: 3760 - DNA, 177 bp, Chromobacterium substugae
atgttgaagaccatactcgccagttccctgtctctcctgctgctttccgcatcggccatggccggcagcgacggcctgtccgtgatgtgggcgatgcgcggccggatggacgcccagttgcacaaccagccggcgccgatggtgccgcagttcaattccatcccgtccgaccgctaa

SEQ ID NO: 3761 - DNA, 909 bp, Chromobacterium substugae
gtggcgcagatgaaactgactttggaagctctgcaggtattggatgcgatcgagcagcacggcagtttcgccgcggcggcggaggctttgtacaaagtgccgtcggccttgacctacaccattcagaagctggagcagggactgggagtggcgatctacgaccgcagcggccatcgcgcgcggctgacgccggccggcgagcggctgctgcgcgacggccgccatctgctggacgccgcgcgccagctggagctgagggtcagcaagcaggctcagggctgggaggacaagctgcgcatcgtggtgggagacctggtcggtttcgagcagctgttgccatccatcgccgatttcgaccaactgcagtccgacacccggctgcaattcatccgcgaaagcttcggcggcatctgggacgccttgtacgacgaccgcgccgacctggtgataggcgcgcccaaccagccgccgcccggcgattatttcacccgcaatatcggcgactacgacttcgcgctggttgtggcggccggccacccgctggccgacgcgcccaatccgctgccgccgcatctgctgcgccgccatcgcgcggtggcggtcggcgatacctcgcgccgcctgccggcgcgcaccggcggcttgctggaagggcagcaggtgctgaccgtgcacagcagccaggccaaattgaaggcgattctggccgggctgggcagcggccacctgccgcgctcgcatgtgcagcgctggctggacagcggccatctggtggagaaagaggaagaggagaacggcaccttcccgccgatgtgcttcgcctggaaactggagcagccggggcgggcgctgcaatggttcgtgcagcggctggagcgggcggtggcggacggcgagctgacgatctga

SEQ ID NO: 3762 - DNA, 159 bp, Chromobacterium substugae
atgctgaagcaaaccactcttgccgccctgtccctgatcctgctgtccggcgccgccatggccggcagcgacggctacgccaacatgaaggcgatgcgcgaccgcatggccagcgagcaaacccagcaagtgcagcaacaagcgccggcgcaaaagtaa

SEQ ID NO: 3763 - DNA, 507 bp, Chromobacterium substugae
atgagcgaattgcgcatccgccatctggagccggccgacgcggccgatttgcaagagttagcctcggacccgtcggtatacggcaatactctgcagctgcctttcccgtcttccgccaccatggcctcgcgcatgggcaagttgctgtgcgccgggcggtatcagctggtttcccagaacgcggcgggcaaggtggtcggcagcgccggcttgtggcggctggacgaagccaggctggagcatatcgccggtttgggcatcaatgtccaccgcgactggcagcgccgcggcgtcggcacgctgctgatggcggccatgctggacctggccgacagctggataggcttcgaacggatcgagttgacggtttatcccgacaaccaggcggcgcaggccttgtaccgcaagtttggctttgtcgaggaggcgcggatgcgcgcgcattcgttccgcaacggcgcttaccatgatgccttgctgatggggcgtttgcgtcccgactcctga

SEQ ID NO: 3764 - DNA, 510 bp, Chromobacterium substugae
atgaacgattatcgcatccgccatgccgagccatccgacgccgaggccttgaacgcgctgttcagcgacccggcggtattcggttccatgctgggcctgccttgccccgccttgagcaagcgccgcgaatggctgcagaagcacgagccaggacgaaccgtgctggtggcggtggacgcggctggcctggcaatcggctgggccgcgctgatcccggcccgccgcgagcgcctgctgcgcggcgccgaaatcggcatcggcgtcgcttccgcgcagcatggccgcggcgtcggctcgctgctgatggcggcgacgctggatttggccgacaactggcagggactgcgccgcatcgagctgacggtgttcgccgataatctgcgcgcgcaagccctataccgcaaattcggtttcgtcgaagaagcgcggctgcgcgcctatgcgctgcgcgacggcgtttaccacgatgtgctggcgatggcgcggctgcgcgagggggagtggaaatga

SEQ ID NO: 3765 - DNA, 519 bp, Chromobacterium substugae
atgtcccagtccttgtcgattcgttccgtcgaaccttccgacgccgccgccatccatcgcatcacgaccgctcccagcgtgtatcccgacaccctgcaattgccgtatcagcctttgtccgccaccgaaaagcggctgagcgagcggcccgccaacctttaccaactggtggcctgtagcggcgacggcgaggtggtcggcaccgtcggcctgatcgtcaacgagggcatgcgggtgcgccacagcgccagcctgttcctgatcgtgcgcgacgactggcagggcaaaggggtgggtggggccttgatgcgcgccatcgtcgacctggccgacaactggctggggctgatccgcatcgagctgaaggtggtgcatgacaatgcccgcgccatcgcgttgtatgaaaagtgcggcttcgagtacgaggggcggatgcggcaggagcagctgcgcgcaggcaagcttgaagacgtgctggtgatgggccggctgaactggccggggagggcgcaagcatga

SEQ ID NO: 3766 - DNA, 750 bp, Chromobacterium substugae
atggcagcggatgcgttaatggctggcggcgtcaggctgacgccgctgaagcggcgggccggcgaccacaccgccatgcatgcccatgaaggcggccagctgacgctggtccgccgcggcgcgctggagctggtcgccgcggagcggcgcatgctgctgccggcggggtgcctgggctggctgccggccggcttgccgcatggcgcgcattatcacggcgacctggagggctggagcctggaggggcgcggggcggcgctggatcggctgccggcgcagctgcaggcatggagcggcagccccctgctggacggcatcttccagcgcctggccgcctggccggaagcgggcggcgcggcggccgcggcgcgcctgctgcaggtgctggtggatgaactgggctgggccgcgccgcacccgtcctgcctgccgtggccgaagcatccggcgctgcgccggctggcgcaagatctgctgcgggagccggcattggattgggatctgcaacgctgggccggccatatcggcatgtcgcgccgcagcctgatccgccatttccgcgccgaaaccggcctggggctgggcgaatggcgcgagcggctgcggatgatgcgggcgcaggcgctgctggcggaggggagagcggtgggtttctgcgcgctggagctgggctattgcgacagcagcgccttcatcgccgccttccgccgctgtttcggcgcgacgccgggccggtttttgtcgggctga

SEQ ID NO: 3767 - DNA, 342 bp, Chromobacterium substugae
atgaaaccatccatccagaccgtcgcccacaccaacgaactggccgccatcaacagcaaggtgatcgccgacggcgaaaccctgccggcggtgaagctgcgcgacggcagcacggtgcagaccggcaccgtcgccgccatgctggtcaatatcgccgcctataaccgcggcgaacgcggcgaggtggagcgccagctggaattggccgtgccgaccctgttcaaggtcgggctgttcgatctgttcccggttgaggaatggctgcgcggcgataatcccggccgcgccttgctgggcgcgatggccgccctccacctggccgaccaggcaaacaacacatag

SEQ ID NO: 3768 - DNA, 552 bp, Chromobacterium substugae
atgctgatgcaaagacaggacgccgcgctgctggtcgtcgacatccaggacaagctgctgccggcggtgcacgacgccgacggcctgctcaaacgcagccgctggctggtggccgccgcgcgcgatcaccagctgcccatcgtgttttccgagcaatacccgcgcgggctgggcggcacggcggcggcgctgcgcgaggcggcgccggaagcgccaacggtggacaagctgcatttctcctgcgtggcggcggactgtctgccgccgctgctgaccgacaagcgccagatcatcgtctgcggcatggaggcgcatgtctgcgtgctgcagaccgcgttggaactgctgcaggccggcaagcaggtattcgtggtggcggacgcggtgtccagccgcaaggcctccgacgtggagctggcgctggcgcggatgcgcgcggccggcgcgcagatcgtcagccgcgagatggtgctgttcgagctgctgcgccaatccggcagcgatcacttcaaacagatgagccaacgctacctgatgggcgagcagccctga

SEQ ID NO: 3769 - DNA, 330 bp, Chromobacterium substugae
atgaccaccttccaggaacagctgtccaccctgcccgccaccgacggcgtcgccgccatcgtgctgctgaacccggccggcgaagccgtgcaccggctggaaaaccagcccggcaccgccggctcgctgcgcgtctaccacgcgctggtgaaacgccacggccacatcgaccgcaaggccgcgcgcgagggactggaattgttcgccgagcacaccgccgccgcccgcgcgcagccgggcagccatcccaatatcgaccgcctgctggccatcgccgagcaggacgcgcccggcctgcgcgcccgcctggttttggctagcgaggactaa

SEQ ID NO: 3770 - DNA, 1317 bp, Chromobacterium substugae
atggtttacctgcaacttctggtggtgctgggcgccattttcctcggcgtgcgcatgggcggcatcggcctgggcgtcaccggcggcgccggtctgttcatcctgactttcgtcttcggcctcaagcccggccacgcgccgatagacgtgatcctgatcatcatctcggtcatcaccgcctcggcggcgttgcagtcggcccgggggctggactacatggtgggcatcgcggcgcgcttcttgcggcgcaacccgcgccatatcgtgctgctggcgccgctggtgggctggctgtccacttttctcgccggcaccggcttcatcgcgctggcgctgatgcccatcgtggtggaagtggcggagaaaaccggcatccggccggagcggccgttggcgggcctgacggtggcatcgcaaaacgccatcgtcgcctgcccggtttcggcggccacggtggcgctggccacggtgctggcgccgcacggcgtggcgctgaccgacatcatcatgatcagcattccggccactctgatcggcgcgctggccggcagcctggtgatgttgcgctatggccgcgagctggccgatgatccggtgtatcggcaccggctggcatcgggcggcatcgcgcggccgcaggctgccggcgtgcaagcgctgccgcgcaccgcggcctggtcggtgtatgggtttctgttcacggtggcgctgatcgtgctgctggcggccatgccgcagctgcgtcccgcatggcaaggcgcgaagggcctggagccggtggcgatggtggacgtgatccagatgtgcatgctcagctattcggcgttggcggtgctgttgtgcaaggccgacctgcaggcgatggtgtccggcagcatgttccgctccggcgcggtggcggccgtcaccatcctgggcgcggcgtggatgagcgataccttcatccaggccaatctgccgttgttccagcacaatatcgtcagcatcatccaccaggcgccgtggctgttcgccttcgcggtgttcaccatggcggtgatcctgttcagccagggcgccaccaccaaggtgatgatgccgctgggggtgtcgctggggctggctgcgccgacgctgatagccatctttccagcggtggtgggggtgtacgtgttgccgagctatcccagcctgatcgcggcggtggagatggattacaccggcagcacccgcatcggccgctgggtgttcaaccacagcttcatcctgccggggctggcgacgacggcggcgtcgatcgccgccggtttcgcgctgatggcgctgcgcggcgtttag

SEQ ID NO: 3771 - DNA, 912 bp, Chromobacterium substugae
atgcgggagagggagctgcgcgcattgtcgcgcgatgtggtgcgcgcgctgggcatgttgtccagccattgcggcgaagtggcgctgacgccggtggaggcgcatctgctgatcgagctggaaagcggtccggccagcaatcagcagctggcggaccgtttgcgggtggataaatccaatagcagccggccgctgcagcgtttgtccgagcgcgggctgatcgcctggcgcgccgatccggccgacggccgcagcaagcaggccgaattgaccggctccggccgcgactggctggcgcggctgcacgcggcgatggacgccgacatggcgcgggtgctggcgcaactggacgaggcggagcgcgcccggctggaggatggcctgaggttgtaccggcgcgcgctgcgcgacgccgacagccagcagggcttcgcgatccggccgctggcggcggccgacaacggcccgctggcggcgctgatccgccgggtgtcggccgagtacgggctgggcgatggctgcagcttcctggatccgcagttggacgcgttgttcccggcgtacaaccggctggattcgcgctacctggtggtggtggcgccggacgggcggctgttgggcggcggcggcatcgcgccgctggccggcggcgcccagggcgtgtgcgaattgcagaagatgtatttcgacccggccttgcgcggccgcgggctggggcggcgcctgctgcggctgctgctggccaaggccagggcgctgggctaccgccagtgctatctggaaaccaccgctgcgctggccgaggcgacggcgctgtaccgggcggaaggcttcgccctgctggacgagcgctggggcgataccggccatggcggctgcgaaattcgcatggcgctggcgctgcagcgctga

SEQ ID NO: 3772 - DNA, 450 bp, Chromobacterium substugae
atgcaaatcattctgctcgaaaaagttgccaacctgggtcaactgggtgacgtggtcaacgtgaagaacggcttcgcccgcaacttcctgatcccgcaaggcaaagccaagcgcgcgaccgaaaacaacctgaaagagttcgaagctcgccgcgccgaactggaagccaagcaagccgaaatcctggccgacgccaaggttcgcgctgaaaagctggttgacgctgttatcaccatcgctcaaaaagccggtgttgacggtcgtctgttcggctccgtgaccaatgtggacgtggctgaagccgtgaccgcgttcggcgtggaagtgaagcgtttcgaagttcgcctgccgaacggcccgttcaaggccatcggcgagtacgacatcgaaatcgccctgcaccacgacgttgtgagcccgatcaaggttgtcgtagttgctgaagcctaa

SEQ ID NO: 3773 - DNA, 228 bp, Chromobacterium substugae
atggctcgtcaactcttcaagcgcaagaagttctgccgcttcacggcagaaggcatcaaggaaatcgactacaaatccgttgatctcctgaaggatttcatcgccgaaaacggcaaaatcatcccggctcgcatcaccggtaccaaggctcgctaccagcgtcagctgaccaccgctatcaagcgtgctcgcttcctggctttcctgccgtacaccgaccagcactaa

SEQ ID NO: 3774 - DNA, 300 bp, Chromobacterium substugae
ttgcagaaccgtctggtattgaccgtcacggttgaacgcgaggatgcgctgagatacacgcccgccggcttgccggtagtggaaatgtggctcaagcatcagtctagacagacagctggcggattcgagcgtgatgtggcctgcgatatacaggccgtgtggataggcgacgacgcccggaagcattccgggaaactggcggggcaggtgatcaacgtcaccgggttccttggccagcgcagtctgcgcaatccgcggttggtactcaatatcgaatatgttgaatttgtaaaaggttag

SEQ ID NO: 3775 - DNA, 378 bp, Chromobacterium substugae
atgcgccattacgaaatcgtgttcatcgtgcacccggaccagtccgaacaggtcccggccatgatcgaacgctacaagggtatggttctggccgccgaaggcaagatccaccgtctggaagactggggccgtcgccaactggcttacccgatccagaagctgcacaaagctcactacgttctgatgaacgttgagtgccagtcggaaaccctggccgagatcgagcacgccttcaagttcaacgacgctgttctgcgtcacctcagcatcaagctggaccgcgccatcaccgacgcgtccccgatgatgaaggacgaaaaggctaaaaacctgctggacgcccagcagccggcagccgaggccgaagcttctgcctaa

SEQ ID NO: 3776 - DNA, 300 bp, Chromobacterium substugae
atgaaaaccacactcgccatcgcggcgctattgttgaccggcgccgccagcgccgacccgattccgttcgaaaccttcatcaagctgcacaacggcatgctggaggccgagctggtgtcggtggctggcaagcccgactacggcagcgacagcaaccagggcgggctggccagcggcatcgccaccgtctccactacccgccagctgtcctggctggccaacggcaacattccctacaccaccatcgtcaccttgcgcgacggcgtggtggtcaacatcaagcgcagcaagaagttgtaa

SEQ ID NO: 3777 - DNA, 420 bp, Chromobacterium substugae
gtggcgatggcggcttgggcgcgtgtcgagtatgaccaactgaatgccaggcagaaggaaaactacaatttccagaagctggcggcggtgttggcggattacggcttcaactgcctgcgcttgacggatgactggcagggagccgatttcatagcctgccatatcgacggcgagacttttctcaaggtgcagctgaaaggttgtcgactgttgtttgaccgcaagtactgcggcaagaatttccatatcgcttttcgtgatggcgagcagttttacctttatccccatgacgagttgttgaggcaaatgatggagttggggatcattgccgggaccaagtcttgggagtcgggtgggaattaccactttcctcgcatgacagaaaaacaactccgcttgctgcatccctatcgcctctaa

SEQ ID NO: 3778 - DNA, 327 bp, Chromobacterium substugae
atgaccgatacccgtcacccgcatgaggaatgctgccacgacgcccccgccgccgagcgggtggtggtgcagccgggcaaggccgcgctgctgaagcggctggcgcggatagagggccaggtgcgcggtatcggcggcatgatagaggccgaccgctactgcgtcgacgtgctgacgcaggtggcggcggtgaagtcggcgatggacgcggtggcgctgcagttgctggaaaaccacatgaaaggctgcgtggcgcgcgccttgcagcagggcgacgccaccggcatggtgaccgagctgatcgacgtggtgaagaaggtgcgctag

SEQ ID NO: 3779 - DNA, 1461 bp, Chromobacterium substugae
atgcagtggggaggcgcgctggccctctcgtcctggctgggccgcccggccctggccgcttccagccatgccggacacggcggccaggatatcgcggccgcgttgccggcagcggccggcctggagttggcgcgcggccagccgttgccggcgttgccgcgcttgccgctggagggcaaggagggcgcgctcagcggctgcttgaccgccgccgcgttgaatctgcccttgctgcccggcaaggcggccaccgctttctgggcctacaacgacagcgtgccggggcccgccatcgaattgtacgaaggcgatgcgctgcatctgcgcttcgacaaccgcctgccgcaggccaccaccgtgcattggcacggtctgccgattccggccgatcaggacggcaatccgcacgatccagtggcgcccgggcaaacgcgcgactaccgcttcgcgctgccgccaggctgcgccgggacttattggtaccacccgcatccgcacggccataccgccgagcaggtataccgcggtctggccggggtgtttgtggtgaagcgccgcgacgatccgctggcgcatctgcccgaacggtggctggtgctgtccgacctgaagctggacgagcaggggcaaatcgccgccaatagcgaggcggaccaaatggacggccgcgagggccagttcgtgctggtcaacggcgcctggcagccgaagctgacgctgggcgtcggcgagcgccagcgctggcgcgtctggaacgccaccagcgcccgggtgctgaagctggcgctgcctgcgcacgaggtctggctggtgggcaccgacggcgggctgatcgaaaagccgctccgcatcgattcgctattgctgccgccgggagcgcgcgccgagctggccgtcaccggccgcttcgccgccggcaagccggccggcttgttggccttgccgtacgcgcgcggcaagatgatggggccggagcaggacaaggttttgccgctgctggatgttgaggccggaccggcggtcgcgacggcggcgctgccgtccaggctgcggacgatcgcgccgctgccgaagccggcggtgaggcgccgcgtggcgttcagcgaggacatggccaatccggcggcgatgttcctgatcaacggcaagaccttcgatatggaccggatggacttcaccggcaaggtcggcgtggtggaggagtgggaaatcgacaatcaggccgatatggaccaccccttccacctgcacggcacccagttccaggtgaccgagcggcatgacggcaagggctggcggcgcgaaccctaccttgcctggcgcgacgtggtcaatgtgccgccggagcagaaggtgaggctgcgcttccgccaggacctgcctgggccgcgcatgttccactgccacattctggagcacgaggacgccggcatgatgggcatgctggatgtcagcgcctag

SEQ ID NO: 3780 - DNA, 783 bp, Chromobacterium substugae
atgctcaatgtcgcggttaaagccgctcgccgcgctggcagtgttatccagcgcgcgtcgcttaacctcgataccattcgcgtagagaagaagaaacacaatgacttcgttaccgaggtggaccgcgcagccgaagaggctatcatccaaaccatcctcgaggcctacccgaaacacgcgattctagcagaagagtcgggcgccaaaggcgtcggctcctccgaatacgagtggatcatcgaccccatcgacggcaccaccaacttcctgcgcggccaccagcagttcgcgatttccatcgcgctggcgcacaagggccagatccagcaggcggtggtgtacgaccccagccgcaacgacctgttcaccgcctcgcgcggcgtgggttccttcctcaacgaccgccgcatccgcgtgtccaagcgcttcatgatgaacgagtgcgtgatcgccaccggcttcccggtgtcggaccagagttatctggaccagtatatgggcatgctgaaggacgtgatcggcaaggccgccggcgtgcgccgcgaaggcgcggcctcgctcgacctgtgcaatgtggcctgcggccgcgtcgaaggcttcttcgagctgaacctgaagccgtgggacatcgcggccggcagtctgatcgtgcaggaagccggcggcatcgtcaccgacttcaccggcgagcagggttggctggaatcgggcgacatcgtcgccgccaacccgaaagtgctggcgcagctgctgcacactctggcgccgcacgtcggcaagtaa

SEQ ID NO: 3781 - DNA, 765 bp, Chromobacterium substugae
atgaataaaccccaagtacctgattttctgaaaaacatccgcatcgtgctggccaggcccaaccatccgggcaacatcggctcggccgctcgcgcgatgaaaaccatggggctgacccgcctctacctggtggaacccaaggtgtttcccagcgacgaagccaacgcgctggcctccggcgcggtggacgtgctggagagcgccaccgtggtcggctcgctgcaagaggcgctggccgacgtcaccgtcgcctgcgcgctgaccagccgccgccgcgagctgaccaccccgctgtccaccccgcgcgaaaccacgcccgagctggtggcgcgcgcgcgcgacggcgagcaggtggcgctggttttcggcaacgaaaccttcggcctgtcgatcgaggaagtggagcagtgcaaccgcctggtcaccatccccggcaaccccgactacttctcgctgaacctggcgatggcggtgcaggtgatgacctacgagctgttcagccacaccggcgtgaacgtggaatacctgcgcgccgacggcgaagccgccacccagggcgaggtggaaggcatgtgcggccacctggagcaggcgatggacgacatcggctacttccgccgccgcaacagcgagcggctgatgcgccgcatgcgcgcgctgttcaaccgttccggcgtgctgcgcgacgaaatcgacatcctgcgcggcttcttcaagcaggtgcagcgcgccgccgacggcagcctgaaacgggatgaagactga

SEQ ID NO: 3782 - DNA, 906 bp, Chromobacterium substugae
atgaagactgaacagccgttctctctgccctacgcacacccggcggtgcgcgatctcgccttcctgctgacctccccctccccctggccatccggcgccgacctgccgcccgagcggctgctgggcgccgacggcgcggcgctgctgggccggctggagcgcgagccggcgccgctgctggactggctggcggcgtcccatcccaagcggctgggaaaatatgccgaaagactgttttctttctggttccgcaccgcgccgcacattcgcctggcggcggaaaatctcaccgtcatcaacgaaacgcgccgcaccctgggcgaattcgacttcctgctgtggctggacggcgaaccctggcacctggaaaccgccagcaaattctacctgcaactgggcaacgggccggacacgctggtcggccccagcctgcgcgatgcctggcggctgaaagcgaccaaactcgcaacacaattgcaactgagccgccatcccgcggccgccgcgcaactgcccgatggcttcgccgcctgccagaccggcgcgcgcctgagcggctggctgttctaccccgccggccaggcctggccgccaccctccggcgcattgcgcggctggcacgcgccgctgctgccggcctggccgcaaacgctgcccggctcgcgctgggcctggctgccacgcctgtcctggctggcgccggccttgctcgacgcatcccgcgtccacagccaggccgcgctgcgcgaacaactgctggcctgcgccgcgccgcagctggtggcggagctgcagccggccggcggcggcctgtggcgggagacagcgcgcggcttcgtcaccccggacggctggcccgatccggcccggttggcggagctgcaaagcaaactgccgcagccatga

SEQ ID NO: 3783 - DNA, 747 bp, Chromobacterium substugae
atgtctgaacaaaaccatacagcgttacacacactgaaaatttcctgctccagctgcagcctgcgcgagctgtgcctgccggtcggcctcaaccgcgaggagatgagccagctggatacggtgatccgccagagccgccgcctgaagcgcggcgagtacctgttccgcagcggcgagggcttcaagtcgctgtacgcggtgcgcaccggcttcttcaagacctgcgtcgccagccaggatggccgcgagcaggtgaccggcttcttgatgtccggcgagctgatgggcctggacggcatctccaccaacaaccacagctgcgacgccatcgcgctggaggacagcgaggtgtgcgagctgccgttcaaccggatggagtcgctgagccgcgacattcccagcctgcagcatcacttttatcggctgatgagccgcgagatcgtgcgcgaccagaacgtgatgctgctgctcggcaatatgaaggcggaggagcgcatcgccgccttcctgctgaacctgtcgcaacggctgtccacccgcggcttcgccgccaacgacttcatcctgcggatgagccgcgaggaaatcggcagcttcctcggcctgaagctggagacggtcagccgcacgctgtccaagttccagcagcagggctggatcactgtcgatcacaagcacatccagctggtgaaggtggaggagttgaaaaacctgatcgccggctgcgtgcacgccaacggccactga

SEQ ID NO: 3784 - DNA, 1455 bp, Chromobacterium substugae
ttgcgcaaatttaccagtccaccagaagttttaccatccgaatacgacatgaaaaccacccatccgttttcccccgcccatttcgagttcgaccgagagctgatcgaacgcctggatggatcgggaccaagatacacgtcatacccgactgcggatcgctttacgccgggtttctcagcacatgactaccagcacggcctgcagcagcgccgcatcggcgccaaccgcaaacctttatcattgtacgctcatataccattttgcaacacagtttgttattactgcgcctgcaacaagatcatcaccaaaaacaagagcaaggccgaccaatacctgggctacctggaaaaggaaatcctgctggtggccgaacagctgggctgccgggaaaaggtgatacagctgcacttcggcggcggcacccccaccttcctcgacgacggccagttggcgcggctgatgaccatgctcggcacgcatttcgagttcctgagcgacggagaatattccattgagatcgatccgcgcaaggtaaaacgcgaaaccatgttccgcctggcagaatatggcttcaaccggatcagcgtcggcgtgcaggatttcgaccccgcggtgcagcgcgccgtcaaccgcgtgcagagcgaacaggaaacccgccaggtgatagcagccgggcgcgaggccggcatgaagtcggtcagcctggacctgatctacggcctgccgctgcaaagccgcgactcgatgctgcgcacgctggaaaaggccatcgccctcgatcccgaccggctggcgctgtacaactacgcccacctgccgacggtgttcatgccgcagcgccgcatcaacgaagccgacctgcccagcgcagccgccaagctggacatcctgcaggacgcggtcaagatgctgagcgacgccggctacgtgttcatcggcatggaccacttcgccaagccggacgacgagctggcggtggcgctgcgccagggccggctgcaacgcaatttccagggctactccacccacgccgactgcgacatgctggctttcggcgtgtcgtccatcggcaaggtgggctccagctacagccagaacgacaagacgctggaaggctattacgccgcgctggacgaggggcgcctgccggtggtgcgcgggctgacgctggacaaggacgacgtgctgcgccgcaccatcatccaggggctgatgtgccgcttctcgctgtcgatcgaggcgatagaagacatctacgccatcaatttcgcccaatattttgcggcggaaatgccacagatacgcgaattccagcagcaggggctgctgtctttcgatggcgacttcctgatggtggagcccaagggccgcttcctgatccgcaatatcgccatgattttcgaccgccacctgcgcgaacgccgcacccacgcccgctactcgaagaccatctga

SEQ ID NO: 3785 - DNA, 2016 bp, Chromobacterium substugae
atgtccacccccatcgtcaggctgatgcagcgcctgagctatccccagcgcttcgccgtgatcggcctggtcttcgccatcgccctgctctatctggtatacggcttgtaccgcagcaatcaggacaatatcgactccaccgccaaggaaagagtgggcgtggtctacatgcaaccgctggccgcgatgctggcgcaagcccagcaggcccaggagctggcagtgcgcgcggccctgggcgacgcccaggccggcaacgagctgcccgccgccgcccagcagctgcaggccagatggcaggcgttgcaggacagcaacagccggctgggggcggaactggccagcgacgccgcctggaaagacgccgccgcggcctgggacaagctgaaaaccgcgccgtccggctcggccgaacaatggatagccgcctacggcaatctcagcgacaagctgaacaatctgatcggcgccatcagcgacaactccaacctgacgctggaccccgacatcgacacctattacctgatggacgccgccaccgccaagctgaccacgctggtcagccatctgggcgaggccaacgccgtcgccgcgctggcagcggccaaccatccgctcgcccccgcccagcgcgaccggctggtggagctgcggccgctgatcgccgaggtcaacgacggcctggccggcgacatcgccaaggcagtcgcctacaaccccagcctgaagccggacatggcaacccaggcggacaagctggcggcggtgctgaaaaaccagctgccggcgatagacgacgcggtcggcggcaagaccggcgccgccggcctcaaagtggccggccacagcgccgacgccgcccaggccgtctccgcctacatcgccgccggcttgcggcagctggaccagctgctgcaagcgcggatagaccgcaccgccaatcagcgcaacacctatatcgccatcggcgtggcgtcgatgctgctggccattttcctgttccagcagctctatctgtcgatcacgctgcagctgggcggcgagccgctttacgtgcaacaggtggtagagcagctggcggcgggccggctggacacccgcatccaattgcgcgaccgcgatgaaatcagcctgctggcggcgatccgccagatgcgcaaccagctgcgggaaaccgtggcccagctgctggacaccgcgcgcgaaacccaccgcgcggccgacgcgatggcgctgagcgcgcaaagcatcaccgccggcagcgcccagcagaacgaggccgccgccagcatggccgcggcgatagagcagctgagcaccagcctgtcggtatgcgccgagcagtcggaacaggccgaccgcctgtccagcgacgccgccagccgctcatccgacggcaaccgggtgatcgccgccaccgccagcagcatggacggcatcgtccgcgacgtgtcgtcggtgtccgacaccatctccgacctgggccgccaatcccaatccatcgccgggatcgtcgacgtgatccgcgacgtcgccgatcagaccaatctcttggccttgaacgcggcgatcgaggcggcgcgcgccggcgaaatgggccgcggcttcgctgtggtggccgacgaagtgagaaagctggccgagcgcaccgcgctgtccaccaccgagatcagcactatcgtcggccagatccagaacaccgcgcaaaagggcaacgacagcatgcagctgggcatgaaagccatcatgaccggccaggagcgcgctcgcgaggccggctccagcatggacaacatccgccactgcgtcggcgacgtactggacagcatccaccagatcacgtcctcgctgcgcgaacaaagcagcgccagccagacgctggcgctgagcgtggagcaggtggcgcggatgtccgagcaaaacagcctggcgatgcgcgacagcgcgcaaaccgccggcgaactgcaggcgatctcgcagcggctgatggggctggccgagcgcttcaccgtctga

SEQ ID NO: 3786 - DNA, 1416 bp, Chromobacterium substugae
atgcagttgtttcattctttgatcggcgcgatcaacgacgtgctgtggggcaagatcctgatcgccctgctgctggcggtcggcctgtatttcagcctgcgttccggcctgctgcagctgcggctgttttcccgcggctggcgcgagatggtgggcggccgcggcggccatgtcagcaaggacgacatctcgccgttccaggccttcgccaccgggctggccagccgggtcggtaccggcaatatcgccggggtggccatcgccatcgccgctggcggccccggcgcggtgttctggatgtggctgaccgccttgctcggcatgtccagcgcctttgtcgaatcgacgctggcgcagctgttcaagaccagccaccacgacgacaccttccgcggcggcccggcctactacatccagaaaggcctgggccagcgctggctgggggtgttgttcgcgctgtgcctgatcctggctttcggcctggtgttcaacgcggtgcaggccaactccatcgtcgccgccacccagggcgcctggggctggcagccgtgggcggtggggctggcgctggtggcgctgaccgcgccggtgatcttcggcggcgtgcgcgcggtggcgcgggtggcggagtggctggtgccggtgatggcgctgatctatctggcgatggccttctacgtgctggccatccacgcggcggagctgccgggcctggtgctgctgatcgtcaagagcgcgctggggctggagcaggccgccggcggcgtggccggctacgcggtgagccaggcgatgatgctgggcatcaagcgcggcctgttttccaacgaggccggcatgggctcggcgccgaatgccgcggcgacggccacttccaaacatccggccagccagggcgcgatccagatgttcggcgtgttcatcgacaccatggtgatctgcaccgcaaccgccgccatcatcctgctgtccggcgcgcacgaccagggcctgagcggggtggcgctgacgcagaaggccatcgagtcgcagttcggcccgataggcgtgtccttcctagcggtggcgatgttcctgttcgccttctcgtccattctcggcaattacgcttacgccgagggcaacgtcgagttcatccgcaacagcaagaaagcattgctggccttccgcctggtggtgctggcgatggtgctgttcggctcgctggccagcttgccgctggtgtgggacatggccgacctggcgatggggctgatggcgctgatcaatctggcggccatcgcgctgctgtcgcgctatttcttcatcgtgctgggcgattaccagcgccagctgaaggccggcgtcgccgcgccggaattcaaggcggaccagtatccggagctggccgccaaggtggagaagggcatctggtaa

SEQ ID NO: 3787 - DNA, 732 bp, Chromobacterium substugae
atgaaatacggcagcgtcctgttcctgctctggagcctgttctgcatggcggccgcccccgctccctggcggctggtcgccgacgccagcttcgaaccctacagttatctggggcaggacgagcgcacgccgcaagggctggatgtggaactggtgcgggcggtgatgctagaaatcggcgcgccgtttcgcatcagcctgctgccgtgggaaagagtgaaactgcagttggcgcagaaggaagcggatgcaggcttcgtcttcaccggcaccgccgagcggcgcgcgcaatacgatctggtggggccgctgcgcaagggccaaaccgtgttcatcaccctgagccagggcccgctgcaatactggcgcgtgctggacgacctcaagccctacctgataggccaggtgcacggctacgcctacgacaccgatttcgacaaggcggatctggagcgcgatctgcacgccacctcgccgcgccagctggtggcgatgctgctggccggcagggtggatgtcatcgtcggcgacaagctgcagctgctgtatttcatccagcaactacagggggaaagccaggtgcgggtgctgtccaagccgctggtggaaatgccgcgctacgtggccttcgccaagggagatccgcgcgcgcggcagttcgaggcggcgctgaagcggctgcagcagaacggcgcgctgcagccgatattccagcgctggtcgcagcgctga

SEQ ID NO: 3788 - DNA, 753 bp, Chromobacterium substugae
atgccgcagcagaacaagcaagcctggccgtatcctgaattcgtcgcccaccgcggcggcggcacgctggcgccggaaaacaccgtcgccggcttccgcgaaggcattcgctacggctaccgcgccgccgagtgcgatgtgaagctatcggccgacaacgtctgcttcctgctgcacgacgacacggtggaccgcaccagcaacggcaagggcgcggcccagggcaagaccatggccgagctgtcgcagctggacgccggcggctggaagggcggcgctttcgccggcgaggcgttgcctacgctggccaatgtggcggcctattgcctggcgcaggatatgctgctgaatatcgagatcaagccttgcccgggccgtttcgaggaaaccggccggctggtggcgcaagaagccgcgcggctgtgggccggcgcggcggtgccgcctttgctgtcctcgttcgagatcgaggcgctgcgcgcggcccaggccgccgagccggcgctgccgcgcgccttcctgtgcgaggagatcccggccgactggcgcgccattctggcggagctggattgcgtggcgctgcattgcgaccataaaaccctgaccgagccgctggcgcgcggcatcaaggccgccggctaccaattgctgtgctacacggtcaacgacccggccgatgcccgccggctgctggcctggggcgtggacagcctgtgcaccgacaggctggatctgctgccggcgcgcggctag

SEQ ID NO: 3789 - DNA, 1113 bp, Chromobacterium substugae
atggcaaaactaagtctgaagaacatcgccaagcgctatcccggcgctgagcgccgggtgctggaagagatttcggtggagatcgccgacggcgagttcgtggtcatcgtcggcccgtccggctgcggcaagtccacgctgctgcggatggtggccgggctggagagcaccgaggacggcgagatccgcatcggcgagcggctggtgaatcagctggagcccaaggaccgcgacattgcgatggtgttccagaactacgcgctgtatccgcacatgacggtggcggagaacatgggctacgcgctcaagctcaagggcctgaaaaaggccgaggtgatggagcgagtgctgaaggtggcggcggtgctggagctggagcagctgttgcagcgcaagccgcgcgagctgtccggcggccagcgccagcgcgtggcgatgggccgcgccatcgtgcgcgagccggcggtgttcctgttcgacgagccgctgtccaacctcgacgccaagctgcgcggccagatgcggctggaaatccagcgcctgcatcgccggctggccaccaccagcctgtacgtcacccacgaccaggtggaggcgatgacgctggccgaccgcgtgatcgtattgaacaagggccatatcgagcagatcggcgcgccggacgaaatctacgaccggccggccagcgccttcgtcgccggcttcatgggctcgccgggaatgaatctgttcgacgcgcaggcggacgagcgcggcgagcggctgctgctgggcgacggcgtgtcgctggcgctgccggcggccgcgccggcgctggccggccgcaagctgaaggtcggcatccggcccgagcatttgcgcgcggcggacgagggcggcgaggcgctcagcctgcgggtggacagcgtggagatgctgggcgccgacaattacgtttacggcctgatggccggccacaacgtggtggcgcggctggcccatggccaccggcccgagccgggcagccggctggaagtgacggtgcgcgccgaggcgctgcacctgttcgacgcagagaatcaacggagaatcgcgcatgccgcagcagaacaagcaagcctggccgtatcctga

SEQ ID NO: 3790 - DNA, 840 bp, Chromobacterium substugae
atggtggagaaccgcaaagggctggacctgttctgccacgcgatgctgatcgcgggcatgctggtggtggccttccccttgtatctgatgttcgccgccgccagccaggacgccgatcaggtgacgcgggtgccgctgtcgctgctgcccggcagccagctgtggaccaacctctccaccgtgctgtggagcggcagcggcgggttggcggtgccgttggcgcgcacgctgtggaacagcttcgtgatggcgatgctgatcgccgtcggcaagatcgtgatttccttcctgtcggcttacgccatcgtctatttccgcttccccttgcgcaagaccggcttcgcactgatcttcgccacgctgatgctgccggtggaggtgcgcatcttcccgacggtggaagtggtgaccaagatggggctgatcaacagctataccggcctgacgctgcccttgatcgcgtccgccaccgccaccttcctgctgcggcagttcttcatgacgctgcccaaggaattgatggaggcgtcgcgggtggacggcgcggggccgatccgcttcctgattgacgtggtgctgcccttgtcgcgcaccaatatcgcggccttgttcgtgatcaccttcatctacggctggaaccagtatctgtggccgctcttggtcacccacgatccggcgatgtccacttcggtgatcgcgatcaagggcatgctgggcgagggcgcggtgcagtggcacctggtgatggcgtccgcgctcttgaccctgctgccgccgctgctggtggtgatcggcatgcagcgctggttcgtcaagggcctggtggacaacgagaaatga

SEQ ID NO: 3791 - DNA, 882 bp, Chromobacterium substugae
atgcagaatcgcattcatttttccaatcgctggctgggcttcgccttgatggcgccgcagctggcgatcaccttgatcttcttcctgtggccggcgctggaggccttgtggcagtcggtgcagcagcaggacccgttcggcctggacagccagttcgtcggcctggccaatttcagcctgctgttccatgacccgctgtatctgggcaccatccagaccacgctgctgttcagcgcgctggtgaccttgctgggcaccggcagcgcgctgatcctggcggtgatggccaaccagatcacgcgcggccgccgcatctaccagacggtgctgatcgctccgtacgcgatcgcgccgtcggtggtggcggtgctgtggctgttcctgttcaaccccagtctcggctggatcagctatctgctgcgcgaggccggctacgagtggaaccacgcgctcaacggcggccaggcgctgctcttggtggtgctggcttcggcctggaagcagatcagctacaacttcctgttcttctacgccggcctgcaggcgataccggcgtccttgattgaagccgccgcgatagacggcgccggccctctgcgccgcttccgcgacctggtgtttccgctgttgtcgccgaccagtttcttcctgctggtggtcaacctggtgtacgccttcttcgataccttcgcggtgatagacgcggccaccggcggcgggccgggcaagtccaccgagaccatgatcctcaaggtatacctggaaggcttcaagggcctggatctgggcagctcggccgcgcagtcggtggtgctgatggcggtggtcggcctgttgacgctggtccagttccgttacgtggaaagaaaggtgcagtactga

SEQ ID NO: 3792 - DNA, 1329 bp, Chromobacterium substugae
atgtccctagccctttcccgcactttacgccgcgccgccgcgctcgcgccgctgacgctggccttgtcgctgccggctcacgccgccaccgaaatccagttctggcattcgatggaaggctcgctcggcgaccgggtcaacgccatcgccgcgcagttcaacgccagccagaaagactacaaggtggtgccggtgtacaagggccagtacgacgaatcgctggcggccgccatcgccgcctaccgcagcggcaacgcgccggccatcgtgcaggtgttcgaagtgggcaccgccaccatgatccaggccaagaaggcggtcaagccggtgtaccaggtgatggccgacgccggcgagaaactggacgagaaggccttcattccggcggtggccagctattacagcgacgccaagaccggccacctgctgtccttgccgtttaatgcgtccaccccggtgctgtactacaacaaggacgcgttcaagaaagccggcctgccggaggcgccgcccaagacctggccggaactggccgccgccgccgccaagctgaaggcttccggcatgcgctgcggctacagcaccggctggcagggctgggtgcaactggagaacttcagcgcctggcacagcctgccgttcgccagcctggacaacggcttcggcggcgccggcgcgacgctgcagttcaacggcccggtgcaggtcaagcacatcgaattcctggccaagatggccaaggacggtgccttcagctacgccggccgcaaggacgaggccacgctgaagttctacagcggcgagtgcggcatcatgaccggcagctccggctcgctggccaatatccgcaagaacgccaagttcaacttcggcatgggcatgatgccgtacgatccggcggtgaagggcgcgccgcaaaacgccttgatcggcggcgccagcctgtgggtgatggccggcaagtccccggccgagtacaagggcgtggcccgcttcttcaagatgctggtgtcgccggaagtgatggccaaatggcaccaggacaccggctatctgccggtggtgaacgccgcctatgatttgtcgcgcaagcagggcttctacgacaagaacccgggcgccgacatcgccacccgccagatgcagaacaagccgcccaagtcctacacccgcggcctgcgcctgggctatatgccgcagatccgcaccgtgatggacgaggagctggaagaggtgtggaccggcaagaagaccgccaagcaggcgctggacagcgccgtgctgcgcggcaacgagctgctgcgccgtttcgagaaaaccgccaactga

SEQ ID NO: 3793 - DNA, 1011 bp, Chromobacterium substugae
atgaacgaggcatatttcctgccggcgattttcgccggactgatggcgctgtccatgctggtgtacgtggtgctggatggcttcgacctgggcgtcggcatcctgctgccgctggcggacgacgaagagaaagatctgatgatcgcgtcgatcgggccgttctgggacgccaacgagacctggctggtgttgggcgcgggcttgctgctggtggccttcccgctggcgcacggcgtggtgttcggcgcgctctatctaccggtgctggcgatgctggtggggctgatcctgcgcggcgtcgccttcgatttccgcgtcaaggcgcaggacccgcacaagccgtggtggaacgccgcgttcgccggcggctcgctgctggcggcgctggcgcagggggtgatgctgggccgctacctgaccggcttcgccgatagctccacgtcctggctgttctcgctggtggtcggcgtcggcctggccttggcctacgcgctgctgggcgcctgctggctggtgatgaaaacccacggcacgctgcaggccaaggcgatacgttgggcgcaactgagcctatacggcgccggcgccgcggtggcggcggtgtcgctggtgacgccgctggccaatccggccatcgccgccaaatggttcgcgctgccgcagttcctgctgttgttgccgctgccgctgggctcgctggcgctgttcggcctgttgatgctcagcctgccgcggctggcgcggcgccaggcggcgggcaacgatgccttctgctggctgccgttcgccgccagcgtcggcatcgtgctgctgtcgttctgggggctggcttacagcgtgttcccggaagtggtgctggggcagatgaccatctggcaggcggcggccgatccggaggcgctgtgggtgatattgtggggcgccatcgtggtgctgccctgcatcatcggctacacagccttcgcctatcgggtgttctggggcaaggccgacaagctcagctatcagtaa

SEQ ID NO: 3794 - DNA, 1341 bp, Chromobacterium substugae
atggaactcgaccccgtcacgctggcgcgcatccagttcgccaccaacatctcctttcatatcctgtttcccaccatcaatatcgcgatggcctgggtgttgctgttcttcaaggtgcgcttccgccagaccggcgaccagggctggatggacgcctacgccttctgggtgaagatcttcgcgctgtcgttcgcgctgggcgtggtgtccggggtgaccatgagcttccagttcggcaccaactggcccggctatatgcagacggtgggcaatatcgccggcccgctattggcttacgagatcctgacggctttcttcctggaggccggtttcctcggcatcatgctgttcggccgctcccgggtgccggagaaggtgcacacgctggccacgctgctggtggcgggcggcaacacgctgtcggcgttctggatcatcgcgctcaattcctggatgcagaccccggccggcttcgtgatgcgcgacggccgcgcccatgtgctcagctggattgaagtcatcttcaatccgtcgatgccgtaccggctgacccatatgctgctggcctccggcctgactgtggctttcctgatcgcaggcctgtccgcttaccgctacctgcgcggcgaccgcggccgcggcgtgatgctggcgctgaagagcggggtgttcctggcggcgttgctgattccgctgcagatgttcgtcggcgacatgcacggcctcaatacgctgaagcaccagccggccaagctggcggcgatagaaggcatctggcataccgagaagaatgtgccgctgctgttgttcgcgctgcccaacgccgaaacccgcagcaacgattatgcggtcggcgtgcccgaattgggcagcctgatcctcacccataagtggggcggcgagatcaagggcctgaacgagttcgagcagcacccgccggtggccaaggtgttctggagcttccgcgtgatggtggcgatgggcggcctgatgctgttggcctcctggctggcggcctggcagttgaagaagcgcggcgagctggccaagccgctggcgcgcctgctggtgggcatgaccttcgccggctggatcgccacgctggccggctggttcgtcaccgagatcggccgccagccctggctggtgaccggggtgctgaccaccgcccaggcggcgggcaaggccaccgcgccgatgctgttcacttccctgggcacctacctcgcgctgtacgcgctgctgctgctggcctacatctcggtattgttccacctggcgcgcaaggccggcgcgcatgagacggccgacgccaagcaactgaaggagcaactggcatga

SEQ ID NO: 3795 - DNA, 567 bp, Chromobacterium substugae
atgaacacaccacctctggtgcaggccttcgtgctgcacttcggcgagatgggcagccgctggggcatcaaccgcaccgtcggccagatctacgccttgctgtacgtatcggaaaaaccgctgaacgccgacgagatcggcgaggcgataggctgttcccgctccaacgtcagcatggggctgaaggagctgcagtcgtggcggctggtcaagctgcagcattttcccggcgaccgccgcgaatacttctccacgccggaagacgtgtggctgatcttcaagaccctggccgaggagcgcaagaagcgcgaggtggagccgacgctgaccatgctgcgcggcgcgatgatggagcatccggccagcgaggccgagcagcacgcgcaggccaggatgaaggagatgtaccagctgatcgaattggtcaccacctggttttccgacatccagcacatggacgtggagacgctgcagcggctgatgaagctgggctcgcaggtgcagaaggtgctgcagttcactcagtcgctatcgcggctgggccatcgcgaagaagaaaaggagtag

SEQ ID NO: 3796 - DNA, 1263 bp, Chromobacterium substugae
atgtccgatcttgactcgcaatccacgctgcgccgtctgttcgacgcggccgtcgccagcgcgctgccgaaacggctggtcgatcatctgccgccgccgactaaaggccgcaccgtggttgtcggcgccggcaaggccgccgcggcgatggcgcgggagttggagcgggcctggccgggcgaattgtccggcgtggtggcgacgcgttacggccatgcggtggcgaccgagcggatagcagtgctggaggccgcgcacccggtgccggataaggcgggctgcgcggccgcgcagcggatactggaggccgtgagcggattgaccgccgacgatctggtgatctgcctgttgtccggcggcggatcagccttgctgaccctgccagccgatggcgtcagcctggcggacaagcaggaggtcagccggcagttgctggcctgcggcgccggcatcgatgaaatgaacgcggtgcgcaagcatctctccgccatcaagggcggacggctggcgctggcctgcgcgccggccaaactggtgacgctggcgatttccgacgtggtgggcgacgatccggcggtgatcgcctccggcccgacggcggcggacccaagcacctatgccgatgcccgcgcggtggtcgccaaatatggtttgaccttgccgcccgccgcaagggcattgctggcggcggagccggacgagacgcccgcgcccggcgacgccaggctggcgcatgccgaataccggctgatcgcgacgccgcagctggccttgcgggcggcggcggccgaggcgaagcggctggggctgaacgtgctgttgctgggcgacagcatagaaggcgaggcgcgcgaggcggccaaggtccacgccggtatcgcgcgccagatcgccgcgcacggctcgccggtggccaggccggcgctgatcctgtccggcggcgagaccacggtgaccttgaagggcaagggcaggggcgggcgcaacagcgagtttctgttggcgctggccatcgcgctgaacggcttgccgggcgtatacgcgctggcggcggacaccgacggcatagacggcagcgaggacaacgccggcgcttttatttcgccggacacgctggcgcgggcggcggcgctgggcgtggatgccggcgcgcggttggccgacaacgacggctacggtttcttcgcggcgctgggcgatctgctggtcaccgggcccacccacaccaacgtcaacgatttccgcgccatcctgctgttgtga

SEQ ID NO: 3797 - DNA, 2541 bp, Chromobacterium substugae
atgagcacgccccagcacaccccgatgatggcccaatatttctccctgaagcgcgaccacgcagacaagctgctgttctaccgcatgggcgacttctacgagctgttctacgaggatgcggaaaaggcggcgcggctgttggacatcacgctgaccgcgcgcggcgccagcgccggcgtgccgatcaagatggccggcattccctaccacgccgccgagggctatctggcgcggctggtgaagatgggcgaatcggtggccatcgccgagcagatcggcgacccggccctggccaagggcccggtggagcgcaaggtggtgcgcatcgtcacgccgggcacgctgaccgacgccgcgctcttggacgacaagcgagacaacctggtgctggcggtcaatatggtcaagggcgtgctgggcctggcctggctgtctctcgccagcggcgagttcaaggtgatgcaggccgatgtggaagacctctccagcgagctggagcggctgaagccggccgagctggtgatcccggacgacaccggcctggccgccttcgaaggcatctcgacgccgaagaaaaagctgccgccgtggcagttcgacatcgaatcgtcgaagctggcgctgacccgccacttcggcacccgcgacctggccggcttcggcgccgacacgctgccagtggccgtcggcgctgcaggcgccttgctggaatacgtgaagtccacccagggcgtgaacccggcccacatcgccgcgctgtcggtggaggaagccggcgagctgatccgcatggacgccgccacccgccgcaatctggaattgaccgaaaccatacgcggcgaggcctcgccgacgctggcgtccttgctcgacacctgcgccaccagcatgggcagccgcctgctcggccactggctgcaccatccgatgcgcaaccacggcaagctggcccgccgccacggcgcggtgcgcgcgctgctggcgcgctaccaggacatccacgccgagctggaccaggtatcggacatcgaacgcatcacctcgcgggtggcgctccgctccgcccgcccgcgcgacctgtcggcgctgcgcgactccttgaccgcgctctccggcgtcaaggcgctggcggcctcgctggactccgagctgctgaaggaactggccggcgtgctgccggtcgattcgccggtgcaaaagatgctggtcgcgtccatcctgccggaacctgccaccttcctgcgcgacggcggcgtgatcaacaacggtttcagcccgacgctggacgaactgcgcgccatccagaccgattgcggcgacttcctcttgaaactggaagcgcgcgagaaagaacgcaccggcatcaccacgctgaaagtggagttcaaccgcgtgcacggcttctacatcgaggtgtccaaggcgcagtcggacaaggtgccggacgactaccgccgccgccagacgctgaagaacgccgaacgctacatcacgccggaactgaaggaattcgaggacaaggcgctgaccgcgcaggaccgcgcgctggcgctggaaaagcagctgtacgaggcgctgctggacgagttggccccgcacatcgccgagctgaagctgatcgcccaggcggtggcggcgctcgacgtgctgtccgccttcgcccagcgcgccgccatcggcaattacgccgagccgcaattcgtgccggaacccaagctcgacatcgtcgccggccgccacccggtggtggaggcggaagtggagcgcttcatcgccaacgacaccaggctatccgccgagcgcaagctgctcttgatcaccggcccgaacatgggcggtaaatccacctatatgcggcagaacgcgctgatcacgctcttggcccacgtcggcagcttcgtgcccgccgattccgcggtgatcggcccgatagaccgcatcttcacccgcatcggcgccagcgacgacctggccggcggccgctccaccttcatggtggagatgaccgaaaccgccaacatcctcaacaacgccagcgagcactcgctggtgctgatggacgaagtgggccgcgggacgtccacttttgatggcttggcgctggcctgggccatcgcccgcgcattgattgaaaagaaccgcgcctatactttgttcgccacccactatttcgaactgaccacgctggccggcgaatacccggcggtggccaacgtgcacctgtcggcggtggagcacaaggaccgcatcgtattcctgcaccacgtggaggacggcccggccagccagagctacggcctggcggtggcgcagttggccggcgtgccgggcaaggtgatccgcgacgcgcgccgccacctggccgacctggaaaaccagtcggccgcgcgtgtgcagccggacctgttcgccgcgccagcgccagccgccgaaccggagccgcatccggcgctggaaaagctgcaggaactaaacccggacaatctcagtccacgacaggcaatggaaatattgtacgaactcaagaaactgaccgattga

SEQ ID NO: 3798 - DNA, 426 bp, Chromobacterium substugae
atgtcgtttgaaaccgcctccgccgtatccagtctgagccagcttctcggccagatcgaggacgacggaaccatcgccctatccgatatccgggagaaggccaaccaggaactctcctacttcgccaatctggcgcagcaggagttgcaccagttcgacatcagcatgccgccggcgatcagcctggtcagcaatgatcaatgtcagctggtattggaaaatcagcatccgcatgaagccgagatccatgagtggctggatggcaacctgatcctggcccgcaagttcaaggaaattgaggttctgttcgagctggtccgcgccgcggaaagcgccggcgagctgttttcggaaaactcgaacttccacgtcggcctgaccagcgcgggcccgatcgcctacttcgaggatcatcattcccactag

SEQ ID NO: 3799 - DNA, 678 bp, Chromobacterium substugae
atgccccagctgattctgctcaacaagccgtatggcgtgatctgccagttttccgaccaccccacgcatccgacgctgaagtcctgcgtgcagcagcccggcgtctatccagccggccggctggataccgacagcgaaggcctgttgctgctgacaggcgacggcgcgctgcagcaccgcatcgctgacccgcgctggaagctgccgaagacttattgggtgcaggtggagggcgagccgaaagaggaacagctggagctgctgcgccgcggcgtggacctgggcgacttcgtcacccggccggccgaagtgcggcgcatcgataatccggagttgtggccgcgcaatccgccggtgcgttttcgcaagacggtgccggattgctggctggaaatcatcatcagcgaaggcaagaaccgccaggtgcggcggatgaccgccaaggccggactgccgaccctgcgcctggtgcgggtggccatcggcccgtggaaactggacggcctgcagccgggcgagatgcgcgcgctggaggtggatttggcggcgttgccgcggagcgggtccgccggccgcggcggcaagcccggcgacaggacgccgccgcgccaggctcaggcggcggacaggggcggcaaggcgccgactttccgtttcgcccgcggcaagaagccctga

SEQ ID NO: 3800 - DNA, 2238 bp, Chromobacterium substugae
atgcctgcagaacaatcgaaaatcatctataccctcaccgacgaagcgccggcgctggcgaccagctccttcctgcccatcgtccaggccttcgcgggttccgccggcgttcaggtagacaccgccgacatctccgtggcctcccgcgtgctggccgaattccccgactatctgaccgacgcgcagaaagtccccaataccctggccgagctcggcaagctgacgctgcagccggaagccaacatcatcaagctgcccaacatcagcgcctcggtggcccagttggccgcctgcgtcaaggaactgcagtccaagggctacaatgtgccggactacccggaaaatccggccaacgacgccgaaaaggcgatcaaggaccgctactccaagtgtctgggctcggcggtgaacccggtgctgcgcgaaggcaactccgaccgccgcgcgccgctggcggtgaagaactacgccaagaaacacccgcactcgatgggcgaatggaagcagtggtcgcagacccatgtctcccacatgcaccacggcgacttctaccacggcgagaagtccatcacgctggacaaggcgcgcgaagtcaagatggagctgacgaccaagagcggccagaccgtggtgctgaagcccaaggtcgcgctgcaggccggcgagatcatcgactcgatgttcatgagcaagaaggcgctgtgcgacttctacgaacgcgagatggaagactgccgcgaatccggcatcctgttttccttgcacgtgaaggccaccatgatgaaggtgtcccaccccatcgtgttcggccactgcgtcaagatctactacaaggacgcgttcgagaagcacggcaagctgttcgacgagctgggcgtcaacgtcaacaacggcatggccacgctgtacgaaaaaatcgaaaccctgccggcctccaagcgcgaagaaatcatccgcgacctgcacgcctgccaggaacaccgtccgcgcctggcgatggtggactccgccaagggcatcaccaacttccactcgccgaacgacatcatcgtcgacgcgtcgatgccggccatgatccgcgccggcggcaagatgtggggcgccgacggcaagccttacgacgccaaggccgtgatgccggaatcgaccttcgcccgcatttaccaggagatgatcaacttctgcaaatggcacggcaacttcgacccgcgcaccatgggcaccgtgcccaacgtcggcctgatggcgcaaaaagccgaggaatacggctcccacgacaagacctttgaaatccagcaagacggcgtcgccaacatcgtcgacctcgccaccggcgaagtgctgctctcccagaacgtggaagccggcgacatctggcgcatgtgccaggtgaaggatgcgccgatccgcgactgggtgaagctggccgtgacccgcgcccgcaactccggcatgccggcggtgttctggctggacccgtaccgcccgcacgagaacgagctgatcaagaaggtgcacgcctacctgaaggatcacgacaccaacggcctcgacattcacatcatgtcgcaggtgcgcgcgatgcgcttcacgctggagcgcgtggcccgcggcctcgacaccatctcggtcaccggcaacatcctgcgcgactacctgaccgacctgttccctatcatggagctgggcacctcggccaagatgctgtccatcgtgccgctgatggccggcggcggcatgtacgaaaccggcgccggcggttcggcgccgaagcacgtgcagcagctcttggaagagaaccacctgcgctgggacagcctgggcgaattcctggcgctggcggtatcgctggaagacctgggcatcaagaccggcaacgccaaggccaagatcctggccaaaacgctggatctggccaccggcaagctcctggacgagaacaagtccccgtcgcgccgcaccggcgagctggacaaccgcggcagccagttctacctgtccatgtactgggcgcaggcgctggccgagcaggcggaagacaaggatctgcaagcccgcttcgcaccggtagccaagcaactggccgacaacgagcaaacgatcctggccgaactgaaggccgtgcaaggcaagagcgccgacatcggcggctactacctgccggacgccgccaagtgcagcgcggtgatgcgcccgagcgccaccttcaacgccgccatcgcggcggtgcaaggctaa

SEQ ID NO: 3801 - DNA, 246 bp, Chromobacterium substugae
ttggtcggcttcaccagccttttttcccaaggatgtgaaatggcatttggtaccgtgaagtggttcaatgacgcaaaaggcttcggctttattaccccggacgaaggcggcgaagatctgttcgctcacttttcggccatcaacatgcaaggcttcaagaccctgaaagagggtcagcgcgtaagctttgaagtggtgtccggcccgaagggcaagcaagcgtcgaacatccagaacgctgcctaa

SEQ ID NO: 3802 - DNA, 888 bp, Chromobacterium substugae
atgaactcggataaggacggcatcgacgcttttctcgaccaactgtggctgagcgacggcctgtcgcagaacacgctggcggcgtaccggcgcgatctggccaaattgtcaggccgtttgcaggcagcgggcgccacgctggcgcaggccgatgccgagcagctgcggcaagcgctgctggccggcgtcgacagcgaaaagccggcgacgcgggcgcggctgacatcggcgctgcgccgctattaccagcacttggcgcaaagcgggcaaagggccgacgatcccagcgccggactggccacgcccaaacagggactgcggttgcccaagtcgatgtcggagcaggcggtggaggcgctgctgctggcgccggacgtggcgacgccgctgggcctgcgcgaccgggcgatgctggaggtgctatacgccagcggcctgcgggtgtcggagttggtgggcatgacgctgacccagctgaacctgctggacggcgtggtgaaaacgatgggcaagggcagcaaggagcggctggtgccgctgggcgaaatcgcccaggactggctgctgcgctatatgcgcgaagcgcggccgctgctgctggccggcctgccgtgcgacgcggtgttcgtcacccagcgcaaagccggcatgacgcggcagatggcctggcatttgatttcgcaatacgccgcgcgccaagggctggccaaggtcagtccgcacgtgctgcgccacgccttcgccacccacctggtcaaccatggcgccgacctgcgggtggtgcagttgctattgggccatgccgacatttcgactacccagatctacacccacgtcgcgcgcgaacggttaaagcagttgcacgcgcgccatcatccgcgcggctag

SEQ ID NO: 3803 - DNA, 516 bp, Chromobacterium substugae
atgatcaaagcgcaaggctcggccttgcgctttttttattgggagacggggatggagtatccggtggtgatcgccgcgccgttcgggcgcttgggcgtgcgctgcgaagacggcgaattgcgcgggctgcgctttctgccggccggcgcggttttgcggccgcccgcgccgggcagcctggaggctgaggtggagcggcagctggacgcctactacgccgacgcggaccatgcgttcagcgtgccgtggcggctgcttggcacgccgtaccagctgcgggtgtggcagcagatcgcggcgataccgcgcggcgagacccgccgctatttggacctgtcccgcgatctggcgtcgtcgccgcgcgcggtcggcggggcctgcggccgcaatcccattcccatcatcgtgccttgccaccgggtggtggcgagcgcggggctgggcggtttcaaccagtcccgcggcgacgagacgctggacatcaagcgatggctgttgcggcatgaactcggataa

SEQ ID NO: 3804 - DNA, 369 bp, Chromobacterium substugae
atggatctgatccagaaactcgagcaagaagaaatcgcacgcctgggcaaaaccctgccggaattcgctcctggcgataccgtagtggttcaagtcaaggtaaaggaaggcaaccgcgagcgtctgcaggcttacgaaggcgttgtcatcgccaagcgtaaccgcggcctgaacagcgcgttcaccgtgcgcaagatgtccgccggcgaaggcgttgagcgtaccttccagacctactccccgctggtggcttccgttgaagtgaagcgccgcggcgacgtgcgtcgcgccaagctgtactacctgcgtggtcgtaccggcaagtccgcacgcatcaaggaaaagctgccggctcgcaaacagggctaa

SEQ ID NO: 3805 - DNA, 768 bp, Chromobacterium substugae
atgcagatcgacgcggttacgctgtttccggagatgttcgactctatcgcccgctttggcgtcagccagcgggcgcttgacttgaatctctggggcttcaaggcttggaatccgcgggatttcacccacgacaattatcgtcgggtggatgaccggccatatggcggcggtccgggcatggtgatgcagatcgagccgctggagcaggccatcgcttccgcccgcaaccgccaacaggcggccggcgtcgaacgcagccatgtgatctacctgtcgccgcaaggcgctaggctcagccacgccaaggcggtggagctgtcgcagcggccgggattgatcctgctgtgcggacgctacgaaggcatagacgagcgcctgatagaaaccgcggtcgacgaggaaatctccatcggcgactacgtgctgtccggcggcgagttgccggcgatggtgctgaccgacgcggtggtgcgcttgttgcctggcgcgctcaacgatgcgcagtcggcctatgaagactcatttgtggacggtcttttggactgcccgcactatacccgacccgaagagtatcgaggcatgcgggtgccggacgtgctgttgtccggtaatcatgccctgatcgccaaatggcggctcaagcagtcgctgggcaggacgtggaagcgtcggcccgagctgctgcaagaccgcgttttgacaaaacaggaatctcggctgctggcggagtaccagcaggaacaagatatccgcaaaaaaccggagtaa

SEQ ID NO: 3806 - DNA, 507 bp, Chromobacterium substugae
atgcgcgacgaagatctggtggtaatgggctttgtgcgcggcgccttcggtatcaagggctgggtgaaaatccacgccgataccgaacacgctgacggcctgttcgactacccagtctggtggctgggcaaggacggcagctggaagccgcatgcatttgagaacggcaccatccagcccaaggcgcttgccgccaagctggaaggcgtcgaggaccgcgacggggcggaagccctgcgcggcatgcagatcgccgtgccccgcagcgaactgcccgaggctggcgaaggcgaatactactggagcgatctgatcggtctggcggtggtcaaccagcagggcgaaacgctgggcgcggtggacagtctgatggaaaccggcgccaacgacgtgttggtggtgaagggcgagcacggccaaaggctgatccccttcgtcgaccagtacgtgctggaagtgatgccggccgaaggccgcatcctggtggactggggcctggactactga

SEQ ID NO: 3807 - DNA, 252 bp, Chromobacterium substugae
atggtagtgattcgtctggcacgcggcggcgccaagaaccgtccgttctacaacatcgtggtgaccgactcccgcaaccgtcgtgacggtcgcttcatcgagcgcgttggcttctacaatccggtagccaacgaaaagcaagagcgcgttcgcttcaccatggaccgtctgaactactgggttggcgtcggcgctcagctgtccgactccgttgccaagctgctgaaagagcagaaagtcgtagccgcttaa

SEQ ID NO: 3808 - DNA, 2679 bp, Chromobacterium substugae
atgaggccacattatctgaccccgctgttttctccgcgcaccgtggccgtggtgggcgccagcgaccgtcccggctcgatcggccaggcggtgttcgccaatctgctggccagttccttccagggcaagctgtttccggtcaacctcaatcataaggtggtggggggcattccggcggtggcttcggtgcggcagatagacgagccggtggagctggcggtggtggtgaccgccatccgctccttgcccgccatcgtcaaggactgcggcaagaagggcgtcaaggcggtgctgctggccaaggagttttccgacagcgagcagctggagcaggagctgatcaacgaggcgctgtccatcgcccgccatttcggcatccgcatcctggggccgaatgtgctgggcctgatgcggccggtggcgggtttcaacgccagcaattacagcggcaaggtgcggccgggcaatctggcgctggtgtcggagtcgtcggcgctgtgcgcggcgatgctggactgggccgatagcaaggaaatcggcttttccagcgtgatttcgctgggcggcgcgctggatgtcggtttcggcgaaattctcgattacctggtggccgacaacgccacccaggggattttgttgcatgtgcaccacattcacgacgcgcgccgcttcatgtcggcgctgcgcgccgccgcccgcaccaaaccggtggtggtgatcaagtcgggccgcttcgagagcgatgcccgcggcctgactcattccagcaatctggtggccagcggcgaagtcttcgacgcggcgctggcccgcgccggcgtgctcagggtgtcgtcgatcgcccagctgttcaccgccgccaaggtgctggccgccaattaccgcgtcggcggcaagcggctggccatcgtcaccaacggcttcggccccggcatgctggcggccgacagcgccgtcgattacggcgtggagctggcgaagctgggcgagggcaccgtcaagctgctggacagcgtgctgccgcgcaactggtcgcgcggcaatccgctggacatcatcggcgacgccagcccgatgcgttttcgcaccgcggtcaaggcctgcgtcgacgactccggcgtcgacggcgtgatggtgatcttcacgccgcaggccggcaccgaccacctgaccaccgcgcagctgatgataggcctgcagcgcgagaccaccaagccgctgttcctgtcctggctgggcgacgccaaggtgtcggaaagccgcgaactgttctccaaggccaagtgcgcgcattttcgcgcgccggaatacggcatcgaggtgttccgccacctggcggcctaccagcacaaccagcagttgctgctgcagacgccggggccgctggagggcaagcgctccggaccggacgcggcggcggcgcgcaaggtgatagacagagcgctggccgaaggccgcaacatcctgtccgagcgcgaatccaagcaggtgctggcggccttccgcatcccggtcaatcccaccacgctggcgcgcaacgccgacgaggcggtgaagcaggccgacaagataggctatccggtggtgctgaagatcgattcgccggacatcatctataagtccgacgtcggcggggtggagctcaacatcagcaacgaggccacgctgcgggcggcgttcgacgccatcctgtcgcggacccgccaggcgcggccggacgcgcgcatcgacggcatctcggtgcagccgatgcgaaagcgccgcttcgcccgcgaagtgatggtgggcgtggcgcacgacatcgccttcggcccggtgatcgccttcggcgccggcggcatcgcggtggaggtgatgcgcgatctggcgttggcgctgccgccgctcaacgactacctggtcgacaatatggtggcgcagactcgcatcggcgagctgctggggccgttcaagaacctgccgccggtggacctggacgaattgcgccacgtgctgctgcaggtgtcggaaatggtgtgcgagctgccgcagctgcgggaaatggacatcaacccgctggtggccgacgagaaaggcgtgatcgcgctggatgcgcgcatcttcgtcgagccggcgcgcgccgacctcaagcgctacggccatatggccatcatgccttacccttcgcacatggtgatctgcgccaaactgtccgacggcacgccggtgatgatacggccgatccggccggaggacgccgacatgcagcaggccttcgtgcgcaatttgtcggaggaaagccgctacaaccgctacctgtcgagcatcaagcagctgtcgcagagcatgctggtccgcttcacccagctggattacgaccgcgagatggcgctggcgatgacgcgcgacgaccagggtgccgagcagatgctggcggtggcgcgcttcatcaccgatccggacaacgaagcctgcgagttcgcgctggaagtggccgacgactggcaggggcgcggcataggcaatctgttgatgcaggccttgttcgacgcggcgcgcgagcaggggctgaagatcatgcgcggcgaggtgctggcgggcaacaagggcatgctgaaactgatgcataaactgggatttagcatcgaggcccaccccgaagaccgggcgctgagcctggtgctgaagacgctgcaatag

SEQ ID NO: 3809 - DNA, 351 bp, Chromobacterium substugae
atgtggcctcatgcgcgttcatcctcggaaacaatgtctatcggcgccggcgcgctcgggcagccgctccgagcgccagcttacgcgatcccgggcccgcgcggcgcggcagcgcggccggccttgatcatgcgggctaaatcttttcgtcatattgactttgggcaagcggcggacaaatgcatttcatgtcacaggcagcgacgattttccccgccgccgcgcccagccagtagcgcagactttacaatattgctaatctttactattccgcaacaaaccttgttgcgttgcaccattcagccgccgcggcccgcgcgcccggtcaggcaggagccgactcaaccatga

SEQ ID NO: 3810 - DNA, 918 bp, Chromobacterium substugae
atgacgaaacgcgtcgtcaccctcgctcattattacacccagcccgaaatccagcagatggcggacaaggtgggagacagcctggaattatcgttgtacgccaaggaagcccaagccgacatcatcgtgttcgccggcgtgcgcttcatggccgaaaccgccaagatcctgaatccgcaagccacggtgatcctgccggacgccggctccacctgctcgctggtcacccagaccgacgtggcggagctgacgcagtggcgcaagcgctacccggaccacgtccacgtgtcctacatcaactccagcgccgaacacaaagccgtgtccgactggatcgtcaccagccgcaacgtcgacgacatcatcgcccacctgtacgccgaaggtaagaaagtcatcttctcgcccgaccgcaacatgggcggctacctgaacgaccagtacggctacgacatgccgctgtggtcggcggtgtgcgaggtccacgacaagttcaacgaagccgcgctgaacgaggccttcgaggccgtgcccggcgagaaatacctgatcgcccacccggaaagcccgctgccggtgctgaagaaagccgactacgtcggctccacctccggcatgctcaactgggtgaaggcctaccagggcgacgccaaggcggtgatcttcgtcgccaccgaagacggcatcctgtacaacatgggcctggcccgccccgacctcgacctgcgccaggcgccgatctacgccggctgccagtgcaactcctgtccgtacatgaagatgaacaccatcgaggcggtcaagcgcgcgcagcagggccagggtctggagatcgactatctgacgccggcgcagatggacgccgcccgggtgcccatcgagcgcatgctggaattcagccagcgctactacgcctga

SEQ ID NO: 3811 - DNA, 744 bp, Chromobacterium substugae
atgaagtttctgctcagcaacgatgacggttattccgctcccggcctggccatgctggccgccacgctctcgcgttacggcgaagtggtggtggtggcccccgagcgcgaccgcagcggcgccagcaactcgctgacgctggaccggccgctgaccgtccgcaccgccgccaacggcttccactacgtcaatggcacccccaccgactgcgtccacctggccgtgaccggcatgctcgacttcaagccggacatggtgttcagcggcatcaacaacggccccaatatgggcgacgacacgctgtactccggcaccgtcgccgccgccaccgaaggcttcatgctgggcattccctccatcgccgtctcgctggccggctatagcggccggcatttttccaccgccggcaaagtggtggcgcaactggtggagcgctgcctggaacagcccttccagcaaccggtgctgctcaacgtcaatgtgccggatgtgccggaggacgcgttgggtcccttgtccgtgacgcgtctgggccgccgccatgccgcgcagccggcaatcaaatctcagaatccgcgcggagagacgatatactgggtgggaccggtgggcgcggtgcaggatgccgccgcgggcaccgatttcggctgcgtcgcggcctcccaggcttcgatcaccccgctgatgctcgatttgaccgccttcgggcaactggacaggatttccacatggcttcaccgctga

SEQ ID NO: 3812 - DNA, 669 bp, Chromobacterium substugae
atggcttcaccgctgacacagaacggccaggcatacggcatgctttccgagcgcacccgccggcgcatgaccgaccgcctgcgccagaatggcatcagcgacgaaagagtactcaaggccatgcacgaggtgccgcgccacctgttcgtcgaccaggcgctggccacccgcgcctacgacgacgtgtcgctgcccatcggccatggccagaccatctcccagccgctgaccgtggccaggatgacggagttgctgctgcaagggcgccagccggggaaaatcctggaaatcggcaccggttgcggctaccaggccgcggtgctgctgaaaaccggcgccgaggtgtattcgatggaacgactggccgcgattcttgaccaagccagacgcaatcttcgcgcctccaagctggtcaacgcccgcctggtgcatggcgacggcaacgccggcctgcccgaagccgcgccgttcgacggcatcatcgtcgcggccgcggcgcggagcatacccggcgcgctggtcgaccaactggccgaaggcggccggatggtactgccgctgggcgaaaccgagcagcatttgtggctgctggaaaaaacctcgcagggcgtgcagaaaaccaagctcgacccggtgaaattcgttccgctgctgaatgggcgtagttga

SEQ ID NO: 3813 - DNA, 1158 bp, Chromobacterium substugae
ttgaaactgcaaaaacgcaacactatcgctgtcagacaatcaagcaaaactcttattcaacgtttcaacaaaaaaaacatgctaaaaatgcattgcaggtatgcgtatatattagttgccgcgctgggggccggattggccggttgcagcagcatggtgcaacaggccgcgccggtggaaagcgccgcgcccgccccagtgggccagagcaaaccggcgcaaaccgcgccggcggttccggccgcgacgacgggcaatactgtcgccaccccgtaccgggaccagggcagcctggccgtgcagccggtggacagcggcgcggcagccgccggcgagcagacttatgtggtgaaacccggcgacaacctgttccgcatatcgctgaaccatggcttgaagtacaaggacgtggccgcctggaacaatctgccggacaccggcatcaaggtcggccaggtgctgcggctgacgccgccgggcggctcgatgccaagcgccgcagccggcacggcgccggtcacggtcgcgacgagtccggccgccgggcagtccgctgccggcgcaggcgcggtcaaggcctatcccaaagccttgaagctgccatacggcagcgacgcggcgaaagaactggcggctcagagcgagggacgccaggtcggcaagaacaacgctcaggcgtccggctccgccgcggcgccggcgcccggcaaaaagccggaagccagcgcggcggtcatcgcgccggctcccgccaaggatgccagcgcgccggccgccaaggccgacgaagacgcggtggcttgggggtggcctaccgagggcaaggtgtcgaaaggctactcggacagcaataaaggcgtggaaatcgccggccgcatgggccagccggtgctcgccgcaggtgatggcaaggtggtgtacagcggcgccgggcttcgcggctatggcaagctgatcatcatcaaacacaataagaccttcctgtcagcgtatgcgcataacagccagctgctggtaaaggaaggacagtctgtcaagaaagggcagaagattgccgaaatgggcaattccgatgccgaccaagtcaagctgcacttcgagatccgccgtttcggcaagccggtggacccgatgcagtaccttgaacacaagtcctga

SEQ ID NO: 3814 - DNA, 939 bp, Chromobacterium substugae
atggatatcctggacgagaacgaacttctcgacgaggaaggcggcgaggaagccgccgccgaaacggaagcggaagaagccgcggaaagcaccgcggtcttcgaagacgtggtcgccgacgtcacccagatttatctgaacgacatcggcaacaacgcgctgctgaccccgcaggaagaactggcgctggcgcgcagggtggtggccggcgagttcgaagcccgacagaagatgatcgagcacaacctgcggctggtggtgaacatcgccaagcattacatcaaccgcgggctggccctgctcgacctgatcgaggaaggcaatatcggcctgatgcacgcgctggagaaattcgaccccgagcgcggcttccgcttctccacctacgccacctggtggatacgccagagcatcgaacgcgcgatcatgaaccagtcgcgcaccatccgcctgccggtgcacgtgatcaaggagctgaacgtctatctgcgcgcttcgcgccatctggaaagccagatcggccgcgagcccagcatagaggagatcgcccacctggtcggcaagccggtggaggatgtgcgcaaggtgatgaacctcaacgagcgcatggcttcgctggacgcgccgctggacatcgatccgatgctgtcgatcggcgaatccatcccggacgagcagcacgaagagccggagctgcagctgcacaacaaccagctggaaatgttcgtccacgactggctgagccagctcaacgagaaacagcggctggtgatagagcggcgctacgggctcaacggctacgagatctgcacgctggaggaactggccgcctcgctcagcctgacccgcgagcgcgtccggcaaatccagatcgaaggcctggagcaactgcgccgcatcctgcgccgcaagggcatctcgcgcgacttcctgctctga

SEQ ID NO: 3815 - DNA, 951 bp, Chromobacterium substugae
atgtcgccattccgtgagcgcctgcggcgctggctgctggccaggctgccgctggaggagcgctgcgagctgtcccagcgccgcatctacctattgcccacccgcttcggcctgctgctgctggcggtggcgctggcggtgtgggtgggggcgctcaactaccaggtaagcctcgcttacgcgctggcgttctggatcgtcagcctggtgttggtggcggtgctgatggcctatcgccagctgtccggcctgaggctgcgggcggagccgggcgccgcggtgttcgccggcgacgccgcccgcttccgcctgttgctggacaacccgtcgccgctgcagcggcaattgcaggcttatgtccagcagcctggcgcgccaagattgccctgcacgctggatgcgatggcgagcggctgcgtggagctggaactgcgcgccgacagccgcggctggctggcgctgccggcctgcgtggtggcgagcgaggcgcctttcggcctgatccgcgcctgggcggtgctgcggctgcaggcgcggctgctggtgtatccggcgccgctgccggacgcggcgagcggcgtcagcgaaggcgagggcggggaaggcagggaaagcctgcccgacggcgacgatttctcccatctggacgcataccgccatggcgacacgccgcgccggatcgcctggaaagttctggcccagcgggatgtgctggccagcaagcgcttcgccggcgagggcgggggcgaattgatgctgctgcgatggagcgattacgccctggagcccgatgccgagcggcgcttgtcgcggctggcctggcgggtggagcgttgcgagcgccgccgccagccttaccggctgtgcctgccgggcggcgagatcggcccgcagccgcgccagcgcgagcaggcgctgagcgcgctggcgctgtatggagagcggccatga

SEQ ID NO: 3816 - DNA, 903 bp, Chromobacterium substugae
atgcaatcactctcccaggcctatcggcaactgaacacactgattctgggcaagccgcaggcgctgaggctggctttcgcctgtttgatcgcccgcggccacctgctgatcgaggatgtgccaggcgtcggcaagaccacgctggcgcacgggctggccacggtgctgggcctcgactaccgccgggtgcagttcaccagcgacctgctgccggccgatatcctgggcgtcagcatttaccagcgcgacagcggccgcttcgaactgcacaaggggccggtgttcacccaggtgctgctggccgacgaaatcaaccgcgcttcgcccaaggtgcagtcggcgctgctggaggcgatggaggagcgccaggcgtcgatagacggcgacacccacgcgttgccgtcgccgttcttcgtcatcgccacccagaacccgggcgagcagatgggtacctttccgctgcccgaatcgcagctggaccgtttcctgatgcgcatttcgctgggttacccgccgcgggaggccgagcgcgcgctgctgatgggcgaggacaggcgcagcctgctggaacgcttccaggcggtgatgaagcccgacgaattgctggcgctgcagcgcaaggccgcggcggtggtggtgagtccggcgctggcggagtatctgctggcgctgttggaggccacgcggcagtccggcgtgttcgccaccggactcagtccgcgcgccggccaggcgctggcggccgccgcgcgcggctgggcgctgctggcggggcgcgaccatctgctgccggaagacgtgaaggcggtgttcctgccggtggcggcgcatcggctgcaggccgcggccggcggcgtggagcgggaactggagcggctgctgacccatgtcgccattccgtga

SEQ ID NO: 3817 - DNA, 960 bp, Chromobacterium substugae
gtgttcacttggctgaaaaaccgcttgcagcgcaatggcctgaccgcctacgtcacccatgccgactgcctgcagcacaatatgggggcgggccaccccgaatgtccggaaaggctgaccgccatccgcgaccagctgatggcctcgcagatctacgacagcctgcaggaagtggaggcgccggaagccacctacgagcaactggcccgcgtgcacccgccgcgctatgtcgaatacctggaggcctgcgcccccagcgtcggcaccttccgcatggacccggacaccgcgatgtcgcccggcacgctgcaagcggcccgccgcgccgccggcgccgtggtcaaggcggtggagctggtggccgaggacaaggcggccaacgccttctgcgcggtgcgcccgcccggccaccacgccgaaagcgacaaggcgatgggtttctgcttcttcaacaacatcgccgtcggcgtcacccacgcgctgacgcactacaagttcgagcgggtggcggtggtggatttcgacgtccaccacggcaacggcaccgaggaaatcctgcacgacgatccgcgcgtgctgatggtgtccatcttccagcacccgttctacccctattgcggcgacgagcccagcgggccgaacatgcacaacgtgccgctgaaagccggcagcggcggccgcgagttccgcgaggcggtggaaaacgtctggctgccgctgctgcacgacttccagcctcagatgctgttcatttccgccggtttcgacgcccaccgcgaggacgacatgggttcgctcggcctggtcgaatccgactacgaatgggtgacccggcatctgatgcagatcgccgaccagtactgcgccggccgcgtggtgtcggtgctggagggcggctatgacttgtcggcgctgggacgcagcgtcgccgcccatatccgcgcgctgtccgacggctaa

SEQ ID NO: 3818 - DNA, 669 bp, Chromobacterium substugae
atgaagaactggctgcgcaacaatcgtggtttcctggtgttcctgctggtattcggcctgttccgcaccgcggtggccgactggaatccgattccctcggcctcgatgcgccccacgctgctggaaggcgacgtggtgctggtcaaccgcctggcctacgacctcaagctgccgctctccaacatcgtcatccacccgctgggcgagccgcggcgcggcgacatcgtcaccttctcgtctcccaaggacggcacccggctgatcaagcggctggtcgcgctgcccggcgacgtggtcgagatgcgcgacgaggaactgtggatcaacggccgcagcgcccattaccagccgctgcagcggctgatggaaaacgtcgccgccgacaccgcgctgccggcgctgcgcgccgaagaaagcggcgtgctgccggcgcaccgcgtgcaatggctgtccggcgtcgacgcccgcagcagcttcggccccattaccgtgccggccggccaatacctgatgctgggcgacaaccgcgacgacagcgccgactcgcgctacttcggcatggtgccgcgccatctgctgatcggccgcgccgtcggcgtgatcgcctccgccgacatcaccgccaactggatgccgcgctgggagcgcttcgccagcggcttccgctga

SEQ ID NO: 3819 - DNA, 621 bp, Chromobacterium substugae
atgaccacgacagcatttgcttttgtcattgcggcctatctgatcggttcgctgtctttcgccgtgatcgtcagcaaggctatgggcatggccgacccgcgcagctacggctcgggcaacccgggcgccaccaatgtgctgcgcaccggcaaaaaactggcggccgcgctgacgctgctgggcgacggcgccaagggctggctggcggtggcgctggccaactggctggggccgcgctacggcctgggcgagcagggcattgcgctgtgcgcgctggcggtgctgttcggccacatgtggccggtgttcttcggcttcaagggcggcaagggcgtggccaccgcggtgggcatcctgctgggcatcaatgtctggctggcgctggcggcgctggccacctggctgttcatggccttcgtggtgaagatttcttcattgtcggccatcatcgcctgcgtgctggtgccggtgtacgcctttttcatcctggggccgcacagcgtgttcttcggcacctgcatcatcatcgccatcgtggtggtccaccgccacaaatccaacctgatcaagctgatgaccggtcaggaagacaagatcggcaacaagggcgacgccggctga

SEQ ID NO: 3820 - DNA, 360 bp, Chromobacterium substugae
atggacatcatattcctgcgcgaagtgcgcgccgacaccgtgatcggcgtgtacgactgggagcgcaaagccgcacagaccatcgagatcgacctggaaatcggcattcccagcgacacaccctgccatagcgacaatatcggcgataccatccattacggcgtagtggtggagcggctgcgcaaatcgctggcagaacagcacttcctgctgatcgaggcgctggcggagcatatcgccaagctggtgcgcgaggaattcggcgcgccctgggtccgggttgccgtcaccaagctcggcatccttcccggcgtgaagcgtgtgggcgtggagatcgaacgcggccaccggccgcattga

SEQ ID NO: 3821 - DNA, 282 bp, Chromobacterium substugae
atggggcgccgtctgttgttgctgcttgccttgggatgccagagcgcctggggggcgtgtttgccgcaggcgctgatgtgcgcgtcgccgcgcgacgccgccgtccagaagcaggatctcgaccccaagggctttcagcttggcccgatccgcttcgagagcgatccggccagccagacgctgcggctgacgccggcgatggacttgggcaagcacacccatctgtcggtgcgcatgcaccacaaggatgtcggcctgaggctgaaattcaataccgactga

SEQ ID NO: 3822 - DNA, 390 bp, Chromobacterium substugae
atgagcgaagtgcaggaaatgacgccgtaccagttgctgggcggcgagggggtggtgcgttggctgtgcgaccgtttctaccagatcatggacagcgagccggcggtggcgccgctgcgcgccatgcatccggccgatctggccggctccagccagaagctgttcatgttcctgtccggctggctgggcggccccgcgctctacatggaggccttcggccatccgcgtttgcgcatgcgccacatgccgttcgccgtggatgaggcggcgcgcgaccaatggatgtggtgcatgagccgggcggtggatgagctggtggcggaggattggctgaagcaaaagctgctggaggcgttctacaataccgccgatttcatgcgtaatcagtaa

SEQ ID NO: 3823 - DNA, 1251 bp, Chromobacterium substugae
gtggcggtactcggggccggcgtggtgggggtgtccaccgcctggttcctggccaggatggggcatgaggtggtggtgctggagcgcgcctgcggcgcggcccgggagaccagtttcgccaacggcggccagttgtcggtcagccagtcggagccgtgggccaacccgcgcgcgccctggcaggtgctgcgctggctgtggcgcgatgatgcgccgctattgttccggccgcggctggacccgtcgcaatggcgctgggccgccgacttcctgcgcgaatgcctgcccggacgccatctggccaatatgcggcagatggtggcgctgggcctctacagccgcgacgccatgcgccagttgcgcgacgagaccgatatttcctaccgccgcctgtcgcgcggcattctcagcctgcactacgatgccagccaattgcgccgcgccgagcgcagcgccgcgcatttgcaggcgctgggcgtcgacaagcgggtgctgtccccaggccagttgctggcgttggagccggcgctggagccggtgctgccgcagctggccggcgccagctggtgcccggacgacgagtcgggcgacgtgcatctgttcacccgcggcctggccgaggccgccgccggcctgggagtggagtttcgctacaatacccggatcaacgcgctggagaccgccgacggcgcggtggccgcggtgtcggtgacggggccggacggcagctaccagcaagtgaaggccgacgcctatgtgctggcgctgggcagccattcgccgctgctggcggcgccggcgggcctgaggctgccgatctacccggccaagggttattcggcgaccgtgccggtgaaaagcctggtggcggcgccgatggtcagcatcaccgacgaagcctgcaagctggtgttcagccggctgggcaatgagttgcgcatcgccggcaccgccgaactggccggctattccagcagcctcaatccggtgcgctgccaggcgctgatccgccgcggccgcgcgctgtttcccgatgcctgcgactgggacgccgcgcgcttctggagcggcctcaggccggcgacgccgggcaatgtgccgctgataggcaagagcgcgctggacgggctgtatctgaacaccggccatggcacgctgggctggaccgagggcgcgggctcgggccgggcgctggcggaaatcatcagcggcaagcggccgcggctggatttcgccttttgcggcctgtaa

SEQ ID NO: 3824 - DNA, 858 bp, Chromobacterium substugae
atgaacaagctgccgccggtggtattgcccaagatcgaattcaaccgcgagttcgccttcagcgacgccgacttcgaacgcatacgcaagctgatttacaaggaagcgggcatcgccctcaatccgtccaagaaggacatggtctacggccggctggtgcgccgcatccgcgaactgaaactgccgggtttcgccgcctacgtcgattttctggaatcggccggcggcaagcgcgagttcgagcagttcgtcaacgcgctgaccaccaacctgaccttcttcttccgcgaggagcaccatttccccatcctgtccgagcatctgaagaaaaaggcggcggccagcggcgaattgtcgatctggtgcgcggcggcttccaccggggaagagccatactcgctggccatcaccgcgctggaggctttcccgggcatgaccaagcccaatatcagcgtgctggccaccgacctggataccagcgtgctggaaaccggccgcaagggcatttatccggccgacaagatcgctcgcctgccggccgggcacgcggtcaagtatttcgacaagctgccggacggcagctatcaggccaagccggcgctgcgcaatatgatcaccttccagcggctgaacctggtggagggcaactggtcggtgaagaagcagttcgacgccatcttctgccgcaacgtgatgatctacttcgaccgcgacacccagttcggcgtgctcaagcgcttcgcgccgctgttgaagccggacggcctgctgtttgtcggccactcggaaaacttttatttcgcttccgactatttccatctgcgcggcaagacggtttacgagcacgcgaaaaagtag

SEQ ID NO: 3825 - DNA, 354 bp, Chromobacterium substugae
atgacagaagctgctaccgaaatgccgtgcccgatcaacttcaccgacagcgcctgcgccaaggtgcaggacctgatcgccgaagagggcaatcccgacctgaagctgcgcgttttcgtcaccggcggcggctgctcaggcttccagtacgggttcacattcgatgagatcgccaacgaggacgataccgccatcgagcgccagggcgtgaccttcctggtggatccgatgagctaccagtacctggtcggcgccgagatcgactaccaggaaagcctggaaggctctcaattcgtgatccgcaacccgaacgccaccaccacttgtggttgtggttcttcgttctcggtgtga

SEQ ID NO: 3826 - DNA, 1029 bp, Chromobacterium substugae
atggtcaaggttggtatcgttggaggcaccggttacaccggggtggagttgctgcgcttgctggccaagcatccgcaggccagggtgacggcggtcacctcgcgcaaggacgcgggcatccgcgtcgacgagatgttccccagcctgcgcggccgaatcgacctggccttctccacgccggacgaggctcgcctgagcgaatgcgacgtggtgttcttcgccacgcccaacggcatcgcgatgcaggaggcggcggcgctgctggacgccggcgtgcgggtgatagacctggcggccgatttccgcatccagaacgtgtccgagtgggaaaaatggtacggcatgccgcatgccgcgccgcaactggtggagcaggcggtttacggcctgccggaagtcaaccgcgccgcaatccgctcggcccgcttggtggccaatccgggctgctacccgaccgcggtgcagctgggcttcctgcccttgctggaggccggagcggtggacgcgtccagcctgatcgccgattgcaagtcgggcgtgtccggcgccgggcgcaagggcgagatcggcgccttgctggcggaggccggcgattccttcaaggcctatggcgtggccggccaccgtcacctgccggaaatccgccagggcttggcccgggcgacgggcaagccggccggactgaccttcgttccgcacctgacgccgatgatacgcggcatccacgccacgctgtacgcgcgcctgagcaaggatgtggatctgcagcaactgttcgaaaaccgctacgccggcgaagccttcgtcgacgtgctgccggccggcagccacccggagacgcgctcggtgcgcggcgccaatctgtgccgcatcgccgtgcacaggccgcagggcggcgataccgtagtcgtgctgtcggtgatagacaatctggtcaagggcgcggccggccaggcggtgcagaacatgaacctgatgttcggcctgccggagcaggacggcctggacgtggtgcccttgatgccgtaa

SEQ ID NO: 3827 - DNA, 393 bp, Chromobacterium substugae
atgaacggtaaatactactacggcaccggccgtcgcaagagctccgttgctcgcgtgttcatgcaaaagggttccggccagatcatcgttaacggcaagccggttgacgagtattttgcccgcgaaaccggtcgcatggttatccgccagccgctggtcctgaccgaaaacctcgaatccttcgacatcaaggtgaacgtggttggcggtggtgaaaccggccaagccggcgcgatccgccacggcatcacccgcgccctgatcgacttcgacgcagttctgaagccggctctgtcggccgctggctacgtgacccgcgacgctcgtgaagttgagcgtaagaaggtcggcctgcgcaaagcacgccgcgccaagcagttctccaagcgttaa

SEQ ID NO: 3828 - DNA, 429 bp, Chromobacterium substugae
atgaagaccttttctgccaagccgcatgaggtaaagcgcgaatggtacgtggtcgacgccgccgataaggtgctgggtcgccttgctgccgaaatcgcccgccgcctgcgtggcaaacacaagccggaattcactcctcacgttgacaccggcgatttcatcgtcgtggtgaacgtcgagaagctgcgcgttaccggtaccaaagctctggacaaaaagtactaccgtcactccggttacccgggcggtatctacgagcgcaccttcaccgaactgcaaaaccagttcccggagcgcgttctggaaaaagccgttaagggcatgctgccgaagggtccgctgggttacgccatgatcaagaagctcaaggtgtactctggttccgagcatccgcactccgcccaacagcccaaagtgctggaaatctga

SEQ ID NO: 3829 - DNA, 711 bp, Chromobacterium substugae
atggcaaccccgcatatcaacgccaaagacggcgctttcgccgaaaccgtactgatgccgggcgacccgctgcgcgcccagctgatcgccgaaaccttcctggaaggcgcggagctggtcaccaacgtgcgcaacgtgttcggctacaccggcacctacaagggcaagcgcctgtcggtgatggcgcacggcatgggcatcccgtccgccagcatctacaccaccgagctggtgaaggactacggcgtcaagaacatcatccgcatcggctcctgcggcgcggtgacgccggacatcaagctgcgcgagctgttcgtcgccatgggcgcgtccaccgacagcaaggtcaaccgcatgcgcttcaacgaccatgactacgccgccatcgccgactacacgctgctgcgcaccgtggtggacaccgccgccgagcagggcaagaagatcaccgtcggcaacgtgttctccgccgacctgttctacggcgtgcagcccaacatgctggacgtgctgtccaagatgcaggtcaacgtgatcgaaatggagctggccggcatctacagcgtggccgcccagtacggcgcgcgcgcggtcggcattctgaccgtgtccgacattatcccgaccggcgaggctaccagcgcggaggagcgccagacctcgttccgcgacatgatggaagtggcgctggatgccgccatcaagctgtaa

SEQ ID NO: 3830 - DNA, 1218 bp, Chromobacterium substugae
atgaaacgcgcaatcatattaatcctcgactcgctgggcataggcgcggcggccgacgcgccgaagttcggcgatgcaggcagcaacacgctggggcatatcgcgatggaggcggccgccggccgcgccgacatcggccgctgcggtccgctgaatctgcccaatctgtccaagatgggcctgggccacgcctgccagctgtcgtccggctatttcccggaagggatggacccggcggcgccgctggcggcctacggctacgcccgcgaaatctccagcggcaaggacaccccgtccggccactgggagatcgccggcgtgccggtgttgttcgactggggctatttctccgaccacgacgacagcttcccgcagcaactgctggacgccatcgtcgagaaggccggcctgccgggctatctgggcaattgccacgcctccggcaccgagatcctggaccgcctgggcgaggagcacatgaagaccggcaagccgatcttctatacctcggccgattcggtgttccagatcgcctgccacgaagaaacctatggcctcgagcgcttgtacgagctgtgcaagatcacccgcgagctgttggagccttacaatatcggccgcgtgatcgcccggcccttcgtcggcgaaggcaagggcaagttcgcccgcaccggcaaccgcaaggatctggcggtcgagccgccggcggccacggtgctgcagaagctggccgacgccggcggcgatgtggtgtcgatcggcaagatcgccgacatctacgcccacgtcggcatcacccacaagcacaaggccaccggctttgaccaattgtgggacgccacgctgacggcgatggaccagcatcaggacaagccggccatcatcatggccaacttcgtcgatttcgactccagctacggccatcgccgcaataccgccggctacgccgcggcattggaggagttcgacgcgcgcctgcccgaagtgatggccgcgatgggcgacgacgacatcctgatcctgtccgccgaccacggctgcgaccccacctggccgggcaccgaccacacccgcgagcatatcccggtgctgtgctacggcaagaaggtgaaggcgggcgccatcggcgagcgcgctaccttcgccgacatcggccagagcgtcgccgcccacctgggcctgcccaggatggactacggcgcgtccttcctggactga

SEQ ID NO: 3831 - DNA, 1326 bp, Chromobacterium substugae
atgtttttgccgcaggaaatcatccgcaagaaacgcgacggcctgatgctgtcgcagcaggacatccaacaattcgtcgccggcatcaccgatgacagcgtggccgacagccagatcgccgcgctggcgatggcgatctacttcaacggcatggagctggaagaaaacgtgcatctggcgctggcgatgcgcgattccggccgccgcatgcactggaaagacctgaacctgccgggccccatcgtcgacaagcactccaccggcggcgtcggcgacgtggtgtcgctgatgctcgggccgatggtggccgcctgcggcggcttcgtgccgatgatttccggccgcggcctgggccataccggcggcacgctggacaagctgtcggcggtgcccggttataacccgttcccggatccggagctgttccgcaaggtggtgaagggagtcggcgtggccatcatcggccagacttccgacttggcgccggccgatcgccgcttctacgccacccgcgacgtcaccgccactgtggagtcgatcgcgctgatcaccgcctccatcctgtcgaagaagctggcggcgggcctggatgtgctggtgatggacgtgaaggccggcagcggcgctttcatgccgacgatggagaaatcgatcgagctggccagccgcatcgtcaaggtgggcaacggcgccggcgtggccaccaccgcgctgatcaccgaaatgagccagcccctggcctccaccgccggcaacagcatcgaaacccgcgaagcggtgcgctacctgaagggcgacgagcgcaatccgcgcctgcacgaagtgacgatggcgctgtgcgcgcagatgctgatcggcggcaagctggccagcgacgaggccgacgcccgcgctaagctgcaggcgggcctggattccggccgcgccgccgagatcttcggccgcatggtcaccgcgctgggcggcccggccgatttcctggaaaactacgaccgccatctggcgccggcgcccatcgtgcgcccggtgtacgccgacaaggccggctacgtcggcgcgatggacacccgcggcatcggcatggcggtgtgcgcgctgggcggcggccgccgcctggccagcgatgtgctggacttccgcgtgggactgtcgcagttcgccgaactgggccagaatatcggcaaagacaccccgctgatgatgatccacgccgccgacgaggcgagcttcgaagacgcggcgcgccgagtcaaggccgccatccgcatcgatgaaatcgcgccggccgcgctgccgcaggtttaccagatcatccgtggcgaataa

SEQ ID NO: 3832 - DNA, 768 bp, Chromobacterium substugae
atgtctgcactgattgaagccgcgcgccgcgcgctgtcgctgatggacctgaccacccttaacgacgacgataccgacgccaaggtgatcgcgctgtgcaagaaggccaagagccaggacggcaccgtggccgccgtctgcgtctacccgcgcttcgtgcccatcaccaagaagacgctgcgcgaagccggctgcccggaagtgctggtggccaccgtcaccaacttcccgcacggcaatgacgacatcgccatcgcggtggccgaaacccgcgccgccatcgcctacggcgccgacgaagtggacgtggtgttcccgtaccgcgcgctgatggccggcgaccgcgacatcggcttcgagctggtgaaggcctgcaaggaagcctgcggcggcaagctgttgaaagtgatcatcgaaagcggcgagctgaaagacgcggcgctgatccgcgcggccagcgaaatctccatccgcgccggcgccgacttcatcaagacctccactggcaaggtgccggtcaacgccacgctggaagccgcggacgtgatgctgaacgtgatccgcgagcagggcggcaagtgcggcttcaaggccgccggcggcgtgaagagcgcggccgaggccaagcaatacctggaactggccggcggcctgctgggcgacgcctgggtcaatgccgaccatttccgcttcggcgcgtccagcctcttggccaatctgcaggccgagatcgccggcggcgtggccaagccgactgccggctactga

SEQ ID NO: 3833 - DNA, 255 bp, Chromobacterium substugae
gtgacgcttgatgcggccaagccggctgaaatgtccgtctgtcgggcgtttcggccggtttggctttccaggggccgccgcggcgatgccgggcggtttgcgtttaagcaagccgcagttgtttgcgatttgctttcacgtgaagaaattttcataatccatgtcattgcctttggcaaaccgccgtcatgccggccgcggtttttatccattggccgcatttcgagagagatagaccatgtctgcactgattga

SEQ ID NO: 3834 - DNA, 2205 bp, Chromobacterium substugae
atggtttccgtagtccgcaccgttgccgataccctggccgacgccgccgatccggcgcgctggctggaacatatgtccgccgcctttcccgccgaggatggcgcgttgctggcgcgcgccttcgacgccgcgcgcgagctgtacgccggcaagaccgtcgccgccaccggcgaagacctgttcacccacgcggtggccgccgccgcggtcgtcgccgacctcaacctgctgcccgacgccatcgtcgccacgctgatgttcgccgcgcccgacttcaagccggagtggcaggcgtggctgaccgaaaccttcaaccccacggtggcgatgctggtggacggcgtcggcggcgtgcgccgcatcaccgagctggcgcgcatcgacaagatggccacgccggaagacggcgcgcgccaggccgaaaccatgcgcaagatgctgctggcgatggtggccgacatccgcgtggtgctgatcaagctggcctggcgcacccagaccatgcactacctggcgcaggtgccggacgaggcgctgcgccgccgcatcgccggcgagacgctggagctgttcgcgcctttggccaaccggctgggcgtgtggcagatcaagtgggagctggaggatctgggcctcaggcacaccgagccggacacctacaagaagatcgccaaactgctggacgagcggcggctggagcgcatcgactacatcgagagggtgctggacatcctgcgcgaggaactgcgcaaggccggcgtcaaggccgaagtggccggccggcccaagcacatctattccatctggaagaagatgaagaagaaaaagctcgatttcaccgagctttacgacatccgcgcggtgcgcattctggtggacaagctgccggactgctacaccgcgctgggcatcatccacggcatgtggcagccgatacgcggcgagttcgacgactacatctcccaccccaaggccaacaactaccgcagcctgcacaccgcggtgatcggcccggaggaaaaggcgctggaagtgcagatccgcactttcgacatgcacgagcacgccgaattcggcgtggccgcgcactggcgctacaaggagggcggcaagggcgacgccgcctacgaggaaaagatttcctggctgcgccagctcttggattggcgcgaggagatgtccgaccgcgaaggcctggccgaggcgttcaagaccgagctgttcgccgacaccatctacgtgctgacgccgcaaggccgggtgctggcgctgccgcagggcgccacgccgatcgatttcgcctacgcgatccactccggccttggcaaccgctgccgcggcgccaaggtggagggccagatcgtgcccttgtcgacgccgctgcaaaacggccagcgggtggagattctcactgccaaggaaggcggcccgtcggtcaactggctgcacgacggctgggtgaagagccatcgcgccatctcccgcatccgccagtacatccggctacaaaacgccgacaccgtgcgcgaaaccggcaaggcgctgttcgagcgcgaactggcgcgccggccgcacatccagcccaatctgcagcaattggcggagaagctcggctacgacaagctggaggaagtgcacggcgcgctgggccacggcgaattgaccacccgcgcggtggccaacgccatcggcagcttcgcgccgccgccgacggtggaagtgctgccggagagcctggtcaaggccagcaagggcgggccggaaaccggcggcgtgctgatcgagggcgtcgacaacctgatgacggtgctggccaagtgctgcaagccggcgccgcccgaccaggtgatgggcttcgtcaccaagggccgcggcatctccatccaccgcagcagctgcatcaccttgaagaagctgtcgcaggaggtgccggagcggctgatcgccgcggaatggggcaagctgaagaacagcgtgttcccgatcgacatcgaggtgatctcgcaggaccggccgggcctgctgcgcgacctgtccgacaccttgtcgcgcgaaaagctcaacctgataggcgtcaacacgctgtcgcgcgatttgcgcagcaagctgcgcctgacggtggaggtgcgcaatgtgcaggacatcagccgggtgttgtcgcgcttgatggaattgtccggcgtgcaggaagcgcgccgggtgtga

SEQ ID NO: 3835 - DNA, 1047 bp, Chromobacterium substugae
atgttgcacagcagttttgccacccgcctggtggactggcagcggcggcatggccgccacgatttgccctggcaggtcagcgacccttaccgcgtctggctgtccgagatcatgctgcagcagacgcaggtgaagagcgtgctggattattatccgcgctttctcgcccgttttcccgatgtggcgagcctggccgcggcgccggtagacgacgtgctggcgcaatggagcgggctgggctactacagcagggcgcgcaatctgcacaaggccgcgcagatggtgatggccgagttcggcggcagcttcccgcccgagcgcgagcggctggagcagctgcccggcgtcggacgctccaccgccgcggcgatttccgccttcgccttcggccgccgggaaaccattctggacggcaatgtcaaacgggtgctggcgcgctgcttcgggatcgatggctttcccggcgacaaggcgatcgaaaaacggatgtgggcgctggcggaggacatcctgccggccgacgcggcggccatccagccgtatgtgcagggcctgatggacctgggcgccaccgtttgctgccgcggcaagccggcctgcgccgcctgtccgatggttgatggctgcgtggcggcgcgggaagggcgcaccggcgagctgccgacgcccaggccgaaaaaaacggtgccgacccggcagacggtgatgctgctggcgcgccacggcaaccgggtgtggcttgagcggcggccgcccaccggcatctggggcggcctgctgtcgctgccggaattcggcgcgacgctcgaaatagaagactggctgaacgcgcgcggcgatggcgacatgctgcccgcctggccggagctggaacatgtattcacccattttcgcctgatcatcacgccgcagccggtgcgcatcgaccagctgcgggcgcatggcgccgccgaggccgacggccagtggctggcgttggatcaggctgtcgatgccggcgtgccggcgccggttcgccgcttgctgttgaggctggcgcaagtttga

SEQ ID NO: 3836 - DNA, 2547 bp, Chromobacterium substugae
atgtccagtttccgttcccgccagcgcaataaccagcgccgcgatctaaccagccgtgaacgctcggccaactcgccggctggcggaaaccaaagcccgccggcggcaagcggcaaaccgccgcgcgccgacaagcgccaggacgccggccagccgcgcgcgccctactccggccagcgcccaggcccgggcaagccggactggaaacaaacgccgcgccagggcgagcgcagcttcgacaagcgcggcccggccgcgcgcgcgccgcaggaaggcggcttccaggacaagcgttacgaccgcgaccgcggcccctccggccgcaagcctatgcccgccgacgacgcccgcgcgccggccttccgccgcgaagaccagccgcaggacaagcgctacagccgcgaccgcggcccgtccggccgcaagccgctgcacaccgaagacgccccgccgcgccagttcaagccgcgcgccgaaggagaaccgcgccgcgacgacaagccgcaatggcaaaaccgcgaagacagcgcgccgcgcgacgacaacggcccgcgcaagctgttcggcaagggcggcgacaaccgcccgccgcgcgacgacaagccgtggcagccgcgcgaagaacgcgcgccgcgccagttcgataaccgcgacggcgagcgcgacaaccgcttccgccgcgacgacaagccgcaatggcagaaccgcgaggagcgtgccccacgtcagtcccacgaccgcgatggcgagcgcgacaaccgcttccgccgcgacgacaagccgcaatggcagaaccgcgaggagcgtgccccacgtcagtcccacgaccgcgatggcgagcgcgacaaccgcttccgccgcgacgacaaaccgcaatggcagaaccgcgaggagcgcgcgccgcgcgacgacaacggcccgcgcaagctgttcggcaaaggcggagacaaccgcccgccgcgcgaggacaagccgtggcagccgcgcgaagagcgcgcgccgcgccaattcgataaccgcgacggcgaacgcgataaccgcttccgccgcgacgacaagccgcaatggcaaaaccgcgagcagcgagccccgcgcgaagaccagcctgcgcgcaagccgctgttcggcaagccgtccgccgaccgcgacgccgtggagcgcgacaaccgcttccgccgcgaaaaccatcacgacgagcgcccgcgccagcatccgtcgcaaggcctgcaaccgttcggcgacagccatcgcgtcgacagcccggagcgccgccagcagttcgagcagcgccgccatgacaagccgcaatggcaggccagcggcagcaagccggaaatcaccctgaccggccgcctggacagcaagctggcgctgttcgccccctgcccgcgcggcctggaggcgctgctggccgacgaactgaaggcgctgggcgccgacgacatcgccccggccgacggcggcgtggccttcggcggcgacgcccgcctgatgatggcggtcaacctgcactcgcgcaccgccagccgcgtgctgctgcgcctggctcacggcccctaccacgccgagcaggacatctaccggctggcgctgagcgtggactggccgcgctggttcgacgtgtcgcgcaccatcaagctgaaggcggacggcatcgccgcccgcgtcaagagcctggactacatcgcgctgacggtgaaggacgcgatctgcgaccgcttccgccaggcgcagctgggccgcccgaatgtcgacacccgcgcgccggacgtgcgcgtcaacgtgttcctcaccgccgataccgccaccatctacctggacaccagcggcgagcctctgttcaagcgcggctggcgcgaagaggccggcgaggcgccgctgcgcgaaaacctggccgccggcatcctgatgctggccggctacgacggcagccagccgctgatcgacccgatgtgcggcagcggcaccttcctggtggaggccgccgacatcgcgctgaaccgcgcgccgggccgcaaccgccgcttcggcttcgaagcgctggccagcttcgaccaggtcggctgggaaacgctgcgcctagccgcgagccaggctgagaaagcgcccgccgcgctggacatccgcggctccgaccgcgacaagaagatgatcgccatcgcccgcgccaacctgcagcgcgccggcctggccggcctggtggaagccatgcccgccgacatcctggacgtgcgccccggcgcgcaagccggcctgatcgtcagcaacccgccctacggcatccgcctggacgaactggatcagctggccgcctggtatccgctgctgggcgactggctgaaggcccacttctccggctggaccgcctgcctgttcagcggcgacctgcgcctgggcaagctgatccgcctgtctcccaagcgccgcacgccgctgtacaacggttcgctggcctgccgcctgttcgtcatcaatatggtggaaggcagcgcgcgcaagcaaaaggacggcggcgaagcggccgacgacgacgcggccgaagaataa

SEQ ID NO: 3837 - DNA, 588 bp, Chromobacterium substugae
atgcaaaaaatcatcaaactggctatcgtggcgctgctcggcgcgtcttccctgctgctgaccggctgcgcgcagatggtgatgtctccggccaagccgtcgatggaaaacatcgccaagatccgcgagagcaatctgacgccggtggcggtaggcgcgttcaagccggcggccagcctgagcgccgacgctgacaagagcctcagcgtgcgcggcgcgaacagcctgacggcgccgaccgacggctctttctcccagtatctgggcgcgacgctgaaggccgaattgcaggcggcgggcctgctcgacgacaagtcgggcgcgcaagtgagcggcgagttgctggaaaacgcgctggacccggcgatgtcgaccggcacggcggccttggccgcgcgcttcgtggtgacgcgcgacggcgccgtgcgctacgaccgcaaggtggaggcgaagtcgcagtgggagtcgtccttcatcggcgcggtggccattccgctggcggccagccagtacgagggcctgtatcgcaagctggtgagccagttgctggcggacgaggacttccgcaaggccttggcgaagaactga

SEQ ID NO: 3838 - DNA, 624 bp, Chromobacterium substugae
atgatattcaaaaattataagcttttttccggcgcaaatcgctggttcgcagcatgtctgctggcaggcagctccctgctgaccggctgcgccagcgtctatgtcgacaccgccaccaagaatgtgccggtgtcggagctgaaaaaaccggcgtcgccgcagccggtgcaactggtgttcgaattccagaaccagggcatgccggtgccgcgcgccaccgaattcctgcaggccgcggtcaagacccaggtggcggaatcgggcctgttctccgcggtggcaacccagccgaccgctggcgcgccgattctgaacatcagcctgaacaacatcccgctgaaccagggcaatgccggcggcttcgtcaccggactgaccttcggcgcggtcggcaccgcggtgaccgacggctatgtctgcaccgtcagctacctgccggcgggcagcagcaaaccgatagtcaagacggcgcggcacgccatccacaccacgataggcaacgccgagccgccggcgggggcgaaaaagtcggccaatgtcggcgaggcggtgctgcagatgactcatgaagtcttgagcaacgcgctgcgcgatttgtcgcaggacagcggattcggcaattaa

SEQ ID NO: 3839 - DNA, 603 bp, Chromobacterium substugae
atgcaaacttccttcctgtccgccaccatcctgctgatcctgattaccgatccgctgggcaatatcccgctgttcatcgccgcgctcaagcaggtgaagccggaacgccgccgccgcgtggtctaccgcgaatgcctgatcgccttcctggtgctgaccatcttcatgctgttcggccgcaacttcctcgaactgatgcacctgaccgacgagtcgatgcgcatcgccggcggcgtgatcctgttcctgatcgccatcaagatgatcttccccggcgaaggcagcgtgttcggcggcgacaagctgcacggcgagcccttcatcgtgcctatcgccattccgctgatcgccggcccgtcggcgatggccaccgtgctgctgctgtccacgcgcgagccgggccggatgctggagtggatgggcgcgctgaccatctgcatgctggtcaccaccgtcaccttcctgttctccagccggctgcaaaaactgctgggcgaacaggcgatcaccgcgctggagcggctgatgggcctggtgctgacagccatctcggtggagatgctgctcagcggcttcgcctcctatctgaagcagctgcactga

SEQ ID NO: 3840 - DNA, 1326 bp, Chromobacterium substugae
atgcaaaccaagactccgttctattcgcgcctttacgtacaggtgttgatcgccatcgccgccggcgtgctgctgggcagcttcatgcccgatttcgccgccaagatgaaaccgctgggcgacgccttcatcaagctgatcaagatgctgatcgcccccatcatcttttccaccgtggtggtcggcatcgccaagatgggcgatatgaaggaagtcggccgcgtcggcgtcaagtcgctgctgtacttcgaagccgtcaccacgctggcgctggtgatcggcctgatcgtggtcaacctgctgcagcctggcgccggcctcaacatcgacccgcacacgctgcacgccaaggacatcgccaagttcaccgctggcgccaaggacatgaacaccgtggacttcctgctgcacatcattccggacagcgtggtgggtgccttcgccagcggcgagatcctgcaggtgctgaccttctcggtgctgctgggcctggcgctgaccaaaatgggcgacaacggcaagaacatcgtccacatcctggacgagttctcgcacgcgctgttcggcgtgatcaacatgctgatgaagctggccccgatcggcgccttcggcgcgatggccttcaccatcggcaagtacggcatcggctcgctgaaacagctgggcttcctgatggcctgcgtgtatctcacctgcttcgccttcgtcttcatcgtgctgggcgccatcgcccgcttctccggcttcagcctgtggaagttcctggtctacatcaaggaagaaatcctgctggtgctgggcacctcgtcgtcggaatcggcgctgccgggcatcatgaaaaagctggaaaacctgggctgcgcgaaaccggtggtcggcatggtggtgcccaccggctactcgttcaatctggacggcacttccatctacctgaccatggcggccatcttcatcgcccaggccaccaatgtgaacctgacgctgggcgaggagctggccatcatcggcgtgctgctgctcacctccaagggcgcggcggcggtgaccggcggcggcttcatcacgctggccgccacgctggccacgctgggcggcaagctgccggtggagggcctggcgctgctgatcggcatcgaccgcttcatgtccgaagcgcgcgccatcaccaatctgatcggcaacggcgtcgccaccgtggtgatcgccaagtgggaaaaggcgctggacgtggagaagatgcgcctggtgctggaaggcggcgagccgccggccccgcccaaggagcggcgggaagccatgccggagccggcgctgcaaacgcgctga

SEQ ID NO: 3841 - DNA, 663 bp, Chromobacterium substugae
atggaagacttttggatacagtatggcgatgacatgctgcccgtcatcggcgatttcccgcgcaagggaaactacctgcccagcttcatgctggtggacgaccagaaacacgacgccgcgctggagagcttctcccacacgcccaaactgatcgtcaccctgctgtcggtggacgaggacgaacacgccggcctgctgctgctgcgcgaaacccggcgcttcctcgacagctggccgcacctgaagctgatcgtgatcaccgtcgactcgccgtcgtcgctggaacgcgcgcgccacgagcacggcctgcccaatatcgcgctgctgtccacgctgcgcggccgcgatttccacaagcgctacggcgtgctgatcaccgaatacccgctcagcggctacaccgcgccgtccatcatcctggccgacaccgccaacgtggtgcactactcggagcggctggccaatacccgcgacttctttgacttcgacgccatcgagaaactgctgcaagaaggcgaacagcaggcgatggccgccgagcgcgaggccgaggaggcgcggcagcaacaggatgcggagcgggagaaaggcaccgagcggctgttggagaaggccaagcagatccaggaccagctgggcaggaatatcgaccccggccgctga

SEQ ID NO: 3842 - DNA, 2388 bp, Chromobacterium substugae
atggcagagaactacgtcatctggttcgagaagctgcgcatgaccgatgtggaagaggtaggcggcaagaacgcctccctcggtgaaatgatcagtcagctggccggttccggcgtgcgggtaccaggtggcttcgccaccaccgcccaggcttatcgcgattttcttcagcacaacggcctggcggacaagatcagcgccgcgctggccaagctggatatcgacgacgtcagcgagctggcccgcgtcggcaaggaaatccgccagtggatcatcgacaccccgttccctgccaagctggatgccgacatcaaggaagcctgggtccagatggtcgccgatgccggcggcgccgacatctcggtagccgtgcgctcctccgccaccgccgaagacctccccgatgcctcgttcgcaggccagcaagaaaccttcctgaatatccgcggccttgacaacgtcaaggatgcgatgaagcacgtattcgcctccctgtacaacgaccgcgccatctcctaccgcgtgcacaagggcttcgcccacgacgtggtggccctgtccgccggcgtgcagcgcatggtgcgctccgataccggcgcggccggcgtgatgttcaccatcgacaccgaatccggctttgaagacgtggtgttcatcaccgcctcttacggcctgggtgaaaccgtggtgcagggtgccgtgaacccggacgagttctacgtgcacaagccgacgctgcgcgccggccgcccggcggtgctgcgcaagaccatgggctccaagctgatcaagatggagttcaccgacgcttcgcaagccggtcgctcggtcaagaccgtggatgtggcgcccgagctgcgcaagcagttctcgatcaccgacgccgaagtggccgaactggcccagtacgcgctgatcatcgaaaaacactacggccgcccgatggacatcgagtggggccgcgacggcctggacggcaagctgtacatcctgcaggcgcgtccggaaaccgttaagtcgcaggaagaccgcaaggacaccctgcgccgctaccgcctgaacggcaagtccgaaatcctgtgcgaaggccgcgccatcggccagaagatcggccagggcaccgtgcgcaccatccgcgacgcgtccgagatggatcaggtcaagccgggcgacgtgctggtgaccgacatgaccgacccggattgggaaccagtgatgaagcgcgccgccgccatcgtcaccaaccgcggcggccgcacctgccacgccgccatcatcgcgcgcgagctgggcattccggcggtagtgggctgcggcgacgccacccgcgtgctgaaggccggcatggaagtgaccgtgtcctgcgccgagggcgacaccggcaatatctacgacggcctgctggacgtggaaatcatcgatctggaactggacaagatgccgaaggcgccggtcaagatcatgatgaacgtcggcaatccggaactggcgttcgatttcgcccagctgccgaacgaaggcgtaggcctggcgcggatggagtttgtcatcaaccgccagatcggcatccacccgaaggcgctgctggaattcgacaagcagactccggaactgaaggcgaccatcgccgaccgcatcgccggctacgccagcccggtggacttctacgtcgacaagatcgccgaaggcgtgtcgacgctggccgcggctttctatccgaaaaaggtcatcgtgcggatgtcggacttcaagtccaacgagtacgccaacctgatcggcggccagctgtacgagccgcatgaagaaaacccgatgatcggtttccgcggcgcggcgcgctacgtggcggaatcgttccgcgactgtttcgagctggaatgccgcgcgatcaagaaggtgcgcgacgtgatgggcctgaccaacgtggaagtgatgatcccgttcgtccgcacgctggccgaagcggagaaggtggtcgagatcctggccgacaacggcctgaagcgcggcgacaacggcctgcgcctgatcatgatgtgcgagctgccggccaacgccgtgctggccgagcagttcctgcagcacttcgatggcttctcgatcggctccaacgacatgacccagctgacgctgggcgtggaccgcgactccggcggcccgatcgccagcaccttcgacgagcgcaacgaggcggtgaaggcgatgctgcacatgtcgatccaggcttgccgcaagatgggcaagtacgtgggcatctgcggccagggcccgtccgaccatccggacttcgccaagtggctggtggaagagggcatcgagacggtgtcgctgaatccggacaccgtggtggaaacctggctctacctggccaaggaactgaacagctaa

SEQ ID NO: 3843 - DNA, 822 bp, Chromobacterium substugae
atgtcccatcgtcgttccgccttcttcatctccgaccgcaccggcatcaccgccgaatcgctgggccacacgctgctgacccagttcgacgccctggacttcaagcgcgaaaccgtgcccttcgtcgataccgtcgacaaggccaagacgttggcgcagcgcatcagcgacatcgccgagcgcgaccacctgcgtccgctggtgttcaccagcatcgtcaatccggaagtgcgcgaggcgctgcggctggaaaacgtggtgctgatcgatttcttcgaaaccttcatcggccatctggaggcggaaatcggccagaaagcgtcgctgtcggtcggcaaggcgcacggcatggtcaacgaggagaagtacgaccaccgcatggaggcggtcaacttctcgctgaaccacgacgacggcgtcaagctgaaggacctggacgaagccgacgtgatcctggtcggcgtgtcgcgctccggcaaaaccccgacctgcctgtacctggcgctgcagtacggcatccgcgccgccaactatccgctgacgccggaggacctgggcagcccgaccctgcccaagctcttgctgccgttcaaggacaagatcttcggcctgaccatcgacccggcgcggctgcacaatatccgctcggaacgccgccccgactccaaatacgccagcatggacaactgccggcgcgaagtgaacgaagcggaatcgatgttccgccaccacggcgtcaccttcatcagcaccacccacaagtcgatcgaggagatcgcctccaccatcatgcacaaggcggcgctgggacgtaagttttaa

SEQ ID NO: 3844 - DNA, 234 bp, Chromobacterium substugae
atggatgagcaccaggtcgatgtcggacttgccgtggcctggccgcgcacgatggagccggtcatcaacgcgcagccggcatcggggaaacggctgctggccacttgtctggcgacgatgtcgggagcagggcgcacgcggactctttcttgttatgaaaaagacatcttgcatgcgcgcgcggtcggcggcaagccgcttaaaacttacgtcccagcgccgccttgtgcatga

SEQ ID NO: 3845 - DNA, 618 bp, Chromobacterium substugae
gtgctcatccatcgccagctgcccgccgccaggcgcgagtcgctgcgggaacagggttggccggtcgaggccttcatccatgacctgcacacgctgcagtatttcttcgaccatgtagaccggcccagcggcgtgccttcgctggcgtccatggtcaacgacggccggctgctctgcggcgacgaagcgctggccgcccaagccaaggccatggcgcaagccgcgctgcgccgcggcccgccgccatgggacgccgccgcccgcgacgcgtcgcgctacgccctcaccgacctcgtcgacgacatccgcgcgccattctccgatttcgccttgcgcgcggcgctggcccagcttctgccgctgctggccaatcactatctgcgcgggcgcggcctgtggtcggccaagggcaaggccattgccagacgcctggcccaggtcgaccccggctacgccgcccgtttcgacgccgccttccggcttgcgtttcatagcggggaaaccgcgccgctgatacagctggcggcagacaccctgcaagcggacggcggctggctgttccagtcctatcaattcaccgcgcccgccgattggcgctgcgagccggtctacggctag

SEQ ID NO: 3846 - DNA, 540 bp, Chromobacterium substugae
ttgttgtttttgaaagcgagtggtttttattgttcctgtcttaataaaaaatttacaaataaacaaagagatagagttttattgctgattttgtcattggcatatcaaggcgcggggcttgtcggcgcgcggattccccgcaaccatggcggcgatggcgaaaagagatcaatcaagatgaagtcgaaacaaaacgaggcgggcgggctggtgtattccaccgagcatggccggatgtgtccgcaatgccggcagccgctggcgcagtgcgagtgcggcaagccggcggcgccggcgggcgacggcatcgcccgggtggcgcgccagaccaagggcaggggcggcaaggaagtgacggtggtgaagggcttgccgctggccgccgatgcgctggcccgggtgggcaagcagctgcgcacgcgctgcggcagcggcggcacggtcaaggacggcgtgctggaaatccagggcgatcacgtggatacggtgatcgccgaactggaaaagctgggcttcaagagcaagcgggcgggcggctag

SEQ ID NO: 3847 - DNA, 300 bp, Chromobacterium substugae
atgaacatccccgatttcaatctgccccccatcgccgccgcgcgccgctggccgcagcagctggccggcgtgcaggcgggtcggcaactcacatcggaacagcagcacgaattcgccgagatgctgttccgcaccgtgctgcaaaaccccccgcacggcgcatcgccgttcaccctagccggcggccccgtcgaccatcccgcgcggccgcccgcgcgcccggcgcggcaacgctccgccgcccgcgcctacggcaaggatctgccgcaagccggcttcctgctgcaaacccaggcttga

SEQ ID NO: 3848 - DNA, 1023 bp, Chromobacterium substugae
atgaatctggacaacatcagctcgcaagacatcatcctcaccggcgaccgcaccaccggccaactgcacctgggccattacgtcggctcgctgcgcaaccgcgtgatcctgcaggagcgctgcgcgcaattcctgctgctggccgacgcccaagcgctgaccgacaatatgggcaattacttgaaagtgcgcgacaacgtgctgcaggtggcgctggactacctggccgtcggcatcgacccggccaagagcaccatcttcatccagagcctggtgccggaactgaccgagctggcctcctactacctgaacctagtgacggtggcgcggctggagcgcaaccccaccatcaaggacgagatcaagcagcgcggctatgaacgcgacatcccggccggctttctcacctaccccgccgcccaggccgccgacatcaccgcgttcaaggccaccatcgtgccggtcggcgacgaccagatcccgatgatcgagcagaccaacgaaatcgtgcgccgcttcaacgccagcgtcgatcagaccgtgctggtggaagccagggcggtggtgccggaagtgggttcgcggctgcccggcatcgacggcaaggccaaaatgtccaaatcgctgggcaacacgctgacgctgtccgccagcccggatgaaatccgccaggcggtgaagatgatgtacaccgatcccaatcacctgcgcgtggccgaccccggccaggtggaaggcaatgtggtgttcacctatctggacgccttccatcccgaccaggcgctggtggcgcaactgaaagcgcactaccaacgcggcggcctgggcgataccgtgatcaagaagcatctggaagactgcctgcaggagatgctggcgccgatccgcgaacgccgcgagcgctacgcgcaggacccagccgcggtgctggaaatgctgaagagcggcacccgccgcgcccgcgacgtcgccgcccgcacgctggctgaagtgaaggccgcgatgggcctcaactactactga

SEQ ID NO: 3849 - DNA, 309 bp, Chromobacterium substugae
atggaacatctctatcaatgccagagcctggacgaagtacgcgggcagatcgaccgcatcgaccgcgagctggtggcgctgatcgccgagcgcggcatctacgtgcgccaggcggcgcgcttcaaggaaagccgcgccgaagtggaaggcggcaaacgggtggatcaggtgatgcggcgggtggagcggctggcgggcgaaatgggcgccgacgcggcgctgacggcggcgatctatcgcgccatgatcacccatttcgtcgccgacgagctgcaagcctaccggcagcggttcgcaaacagcgattga

SEQ ID NO: 3850 - DNA, 468 bp, Chromobacterium substugae
atgaagaaaaccgcgctgctgctggcctgcctgctggccgccccgttcgcccgcgccgaggaaatcggcgaagtctccaccaccttcaagctgctcagccccaacgacaaggtggtggtggaagccttcgacgatccggcggtgcaaggcgtggcctgctatgtgtcgcgcgccaagaccggcggctacaagggcgcgatcgggctggccaaggatccgtcgcgcttttccgtcgcctgccgccaggtgggacagatccgcttcggccggccgctgccgccgcaggaacaggtgttcaaggagagcgcgtccttcgtgttcaagcacgtgcgggtggtgcgcatcgtcgacgccaaacgcaatgtgctgacctatctcacctattccgacaagctggtggacggcagcccggacaacgccatcagcgcggtggcggtgctggatcagaaaattccgctgaaaaaatag

SEQ ID NO: 3851 - DNA, 777 bp, Chromobacterium substugae
gtgaatacgttagaagtcaccatcctgggctgcggctccagttccggcacgccggcgataggctgccgctgcgccacctgcctgtccgacgagccgcgcaaccagcgcactcgcgccagcgcctatgtccgcgtcggcgagctgggtttcttgatcgacaccggaccggatctgcgccagcaggcgctgcgcgagggtttgtcgcggctggacgcggtgctgtacacccatccccatgccgaccacctgaacggcatcgacgatctgcgcgccttctgctacttgaagcaggggccgatctcgctgtacggcaacgatttcaccatgtccaacatccgcgagcgcttcggctatgcgctgcaggcgccgtcgaagatgtgggacaagccggtgctgctgccggaaacggtgcatggcccgttcgagcaccagggcgtcaagttgacgcccatcccgctgcggcacggcagctggccttgcctgggctggcgcatcggcaatatggcttggctgaccgatctgtccgacatcccggagagcagcctgcccttgttgcaggggctggagctgctgttcctggattgcctgaaccacgacccctacccgtcgcatctgggggtggggcaggcattcgactgggcggcgaggataggcgcccgccgcacggtgctgatccacatgactcaccggctggaataccatgcgctgggcgcgctgtgcccgccgggcgtcgaggtggggttcgatggctggcaggcgaagctggctatgggatga

SEQ ID NO: 3852 - DNA, 390 bp, Chromobacterium substugae
atgcatttgcgccatttcgccgcgggcatgctgatcgggctggcttcgctggccgcggcggccaattgcgtcaatctgggcggccgcagcttctgcgcgccgcccggcggccaggcggtgctgcaccagggcaacgcctattgcggcgccggcgcctgcgtggccgacgaattcggcaacctgttctgctcgccgtaccccggcggcggcgccatccgcgccggcggcgctttctacgccggcccgggcatgtgcctgctggggccggacggctcgccgcgttgcgccgcgcgcccaggcggcagctgccaggtggccgccgacgggcagatacaatgcgacggcggcacggtggcggcgccggcggtgcgcccgctgttgtgccaatga

SEQ ID NO: 3853 - DNA, 771 bp, Chromobacterium substugae
atgcttatcgattcccactgccacatcaattttcccgacctggccgcccgcctgcccgaggtgctgggcaatatgcgcgagaaccgggtcacgcacgcgctggtgataggcgtcagccggcccaagtatccgcaggtgctggcgctggccgaggcgcacgccaatctttacgccactgtcggcgtgcaccctgacgaccccgaggcggaggagtacagcgaggacgagttggtcgagctggccggccatccgcgcgtggtcggcataggcgaaaccggcctcgactaccactggtgcaagggcgacctggcctggcagcaccagcgctttcgcacccatatccgcgccgcccggcgcgtgaatctgccgctggtgatccatacccgcgagtcggccgccgacaccatccgcatcatgcaggaagagcatgccgagcaatgcggcggcgtgatgcactgcttcaccgaaacctgggaagtggccgaggcggcgctggcgctgggcttctacatctccttctccggcgtggtgaccttcaagaacgccaagcaggtgcaggaagtggcgcagaaagtgccgctggagcggatgctgatcgaaaccgattcgccgtacctggcgccggtgccgcaccgcggcaagcagaacgagccggcctacgtccgccatgtggcggaattcatcgccgagctgcgcggtgtgccggtggagcaggtggcggccgccaccacggaaaacttcttccgcctgttcgccaaggcggaacgctga

SEQ ID NO: 3854 - DNA, 378 bp, Chromobacterium substugae
atggatgccgccaacaccaggccggacctgaacaatcccaaccgccccggcgtgctgtcgctgcacatcaaggagcgcagcgcgctgtttgccgcctacatgcccttcgtccgcaacggcggcatcttcattcccaccaacaaggaaatgcagctgggcgaggaagtgttcctgctgctgacgctgatggaagacccgcagcgcatcgcggtgcaggccaaggtggtgtggatcacgccgggcggcgccaacaacagccgcgtgcaaggcgtcggcgtcgagttcgtttccggcgaggcgggcaagcaggccaaggacaagatagaggcgctgttgggcggggtgctcaactccagccgccccacccacaccatgtag

SEQ ID NO: 3855 - DNA, 1005 bp, Chromobacterium substugae
atgttgtacccgtggcagaaccatgactggcggcggctgaacgccgagcggcaacggatgcccggcgcctggctgttcaccggcggcgccggcatcggcaagctggctttcgcccgccacctggcgcagtcgctgctgtgcgaggcgccgcaagcggagcatcagccctgcggccagtgccagggctgccgctggttcgccagcggcacccatcccgacttccgcctgctgtcgccgttcgccgacgaagaggaagagggcaaggaagccaaggcggtgcgcaagctgccgcagatcaagatcgaggcggtgcgcgacgtcatcgacttcgcccacctgtccgcccaccgcgccggccgccgggtgatcctggtggagccggccgaaaacctgaacccggccgcggccaacgccttgctgaaaatcctggaggagccgccggaagcggtgctgttcctgctggtgtcgcacgcgcagcagcgcctgctgccgaccatccgcagccgctgccgccagttcgcgctgacccggccgggcgcggccgccgcgctggcctggctgcgggagcagggcgtggccaacgccgagatcgagttggcgcacaatggcggcgcgccgctgttcgaccacgatccggagctggccgcgctgcgcggccagttcgtcaaggcgctgggccagcccagcttcgccggcatgctgcagctggcggaactggccgacaagaacaagcagctgtcgctgctgcagccgctgaactggctgcagaagtggctgcacgacctggcggcgctgtgcctcgccgggcgggtccgctattatccagatcaggaacgcgcgctgtcggcgctggcgccgcgctgcgacctggcgcagctgatggcctgccagcaggcgttggcggcgctggcgccgttctcgcaacataccttgaacatccgcctgcagctggaggcggtcttgatggactacctgaagattttcgccggcgccaagcccgcttga

SEQ ID NO: 3856 - DNA, 645 bp, Chromobacterium substugae
atgcctatagagcagtccgcccgccgcggccgcttcatcaccctggaggggatagacggcgccggcaagagcacgcatctgggctttatccgcgactggctggccgggcgcgacatcgacgccgcgttcagccgcgagccgggcggcaccccgctgtccgagaagatacgcgagctgctgctggcgccggagacggtggtgtcgctggacgccgaggcgctgctggctttcgccgcgcgccagcagcatatcgctgaggtgatcgaaccggcgctggcagccggccgctggctggtgtccgaccgcttcactgactccacctacgcgttccagggcggcggccgcggcattcccttcgagcgcatccgcgtgctggaagactgggtgcagcggggcctgcagccggacttgaccttgttgttcgacctgccgctggaagtggcggcgcagcggatgtcgggcacgcgccagctggaccgtttcgagcaggaggccgccggcttccaccagcgcgtgcgcgacgcctatctggcgcgcgcggcggcggagccgggccgcttcgccgtgctggactccagccgcggcatcgccgagatccaggccgacatcgcgctgcatctgcagcgcctgctggagcgcggctga

SEQ ID NO: 3857 - DNA, 990 bp, Chromobacterium substugae
atgaaaaaactatccggctttctgttgattgtcctgctgtgcgcggcgggctggctggcctgggccgcgctgctgccggtcgcgctgcccgaaggcggctacaagctgctggtgggcccgaaccgcacgatgaagcagatcgcccgcacgctggaacaggacggcgccatccgcaaccgccagctgatgacggcgttggcgcggctgtccggcgccgaccgcaaggtcaaggccggcctgtaccgcttccagggtccgcagagcatgctggacgtgctgcagcggctggtgcagggccatccggacgaagccagcgtcaccgcgatagagggctggaccttccgccagctgcgccaggcgctggaccgcaaccccgacgtgcagcacgaggcgaagccgctgagcgacgccgaggtgatggcgcagctgggcatgcccggcgccagtcccgaggggctgttcttccccagcacctatctgttcacgccgggcgcgtccgacctcgacatctaccgccaggccttcaatgtgatgcagcagcaattgaacgcggcctgggcggcgcgcaaggccgacttgccctaccgcacgccgtatgagctgctgaccatggccagcctgatcgagaaggaaacctccagcgacgccgaccgcggcatggtggcctcggtgttcgtcaaccggctgaagaagggcatgcggctgcagaccgacccgtcggtgatctacggcatgggcgccagctaccagggcaatatcggcaaggccgacttgcggcgcgatacgccgtacaatacctatacccgcgccggcctgacgccgacgccgatttcgctgccgggcaaggcggcgctgtacgccgccgcccagccggccgagtcggacgcgctgtatttcgtcgcccgcggcgacggcagctcgcaattttccagcaccctggagcaacacaaccaggcggtgcgcaaatacatcctgaagaaaggccagtaa

SEQ ID NO: 3858 - DNA, 639 bp, Chromobacterium substugae
atgaaacctttcttcaattttggctgcgcgctggtcgcctggagcgagctgtgccgggtggcgcgaaccccaggcgccctggccggcgccgacccgctgccgccgcaggccttgtgccagggcagccagagccaccagttcgtctacgccggctcgccgcagtcgctcgcctcctaccaggcggtgctgctcgagccgctatggctgcttgaccagcgccgcgacggccgctggcaactggtgtccaccgcgctgggcaacagcatgaatctgcggctgcaggcgctgttgcgcgcctggatgccggcgctgccgctggcggaggaggccggcccgcgtgtggccaggctgcgcctggctttgcgcagtttccagggcgagatcggcagcctgccggcggcgcgccagtccgatgaccgcgcgccgctgacacgcggcatcgccccgtatctagagcaggtgtccagcatcgtgcagctggaggacgccggcgacggcaggctgctgggcggcggcgtcaatctgcgcggcggccgcgccggccaggccgcggccgccggcaaaggctggccggatctgctggcctgcaattggcagcaagtgctgcaagtcgagcaggcgccgctggcagctggctag

SEQ ID NO: 3859 - DNA, 729 bp, Chromobacterium substugae
atgccccgcctgcgtcttgccctgctttgcctctgcctgtctccgctggccctcgccgacaccgtcaatgtggcggtggccagcaatttccagcaaacgctggacaaaatcgccgccgccttcaaggccgccaccgggcatgagatcaaagccagcgccggcgcatccggcaagctggccgcgcagatccgccagggcgcgccgttcgacgtattcctgtccgccgacgacgagcgtccgaccgaactggtccgcgccggcgtcggccagcccgccagccagttcacctacgcctacggccagttggcgctgtggagcaaaaaacgcgacgacgccggcgaagccgctctgcgccagggcaagttcaacaagctggcggtggccaatcccgccaccgctccctacggccgcgccgcgatggaaacgctggcggcgctgaagctggaggcggcggtgaaagccaagctgctgaccggcgacaatatcggccaaaccatgcaattcgccgaagtcggcggcgccgacttcgccttcgtcgcctactcccaactgctggagcagggcatacgcagccgctactggctggtgccggagaagctgcaccagcctatccgccaggacgcgctgctgatcaagccctcgcccgccgcgaccgccctgatggccttcctcaagggcgagcaggcgcgcgcgctgatggcccaggctggctaccgcttcaagccgtga

SEQ ID NO: 3860 - DNA, 675 bp, Chromobacterium substugae
gtgactccgcaagactggggcgccatcggcctcaccctgaagctggccggcatcagcaccctgctgctgctgctcttgtgcgtgccctgctcctggtggctggcgcgcagccgctcgccgctgcggccgatgctggaagcggcggcgatgctgcccttggtgctgccgcccaccgtgctgggcttttacctgctgctggctttcggcccgcgcgggccgctgggcaagctgacctcggccctggatcttcccggactcgccttcacctttcacggcgtggtgatcgcctcggtgctgtattcgctgcccttcgtgctgcagccgctgctggccagcttccgcgcggtgcggcaggaagagctggagagcgcgctgctgctgggcgcgggacgctggcagcgcatgcgccacgtgattctgccctcctgccgcaacggcgtgctgagcgcggcctgcctgggcttcgcccataccgtcggcgagttcggcgtggtgctgatgataggcggcaatatcgacggcgaaacccgggtgatttcgatcgcgctgtacaatcaggtggagcaggccaattatggcgccgcccaccagctggcgctgatgctgctgctgttcgcgctggcggcgctgaccgccgtctactggctgaacgccaggcgcgacaaagacgcatga

SEQ ID NO: 3861 - DNA, 255 bp, Chromobacterium substugae
atgcgcaaaacgctattgctcgccctgtttgccctgttcagcgccaatctggcgctggccgacgccgcctgcgacgccaaggccgccgacaagaaactggccggcgccgccaagcaaagcttcctgaaaaaatgcgagaaggacaccgccgcggcccaggccagctgcgacgccaaggcggccgacaagaagctggccggcgccgccaagcagagtttcgccaagaagtgcgtgaaggacgcgctggccaaataa

SEQ ID NO: 3862 - DNA, 183 bp, Chromobacterium substugae
atggggtcggcggtggagctggccgaggcgctgccggtgctgctgttggcgcccagcagcaaaccgctggacaacaaactgctcaagttcggcaaaagactgtcgaaagacgagagagaggagttgtatccagacagcgagttcattgccaacactcacaagccataccttgttcaagtgtag

SEQ ID NO: 3863 - DNA, 1374 bp, Chromobacterium substugae
gtggaactgtccggcctcggccagctgatgtccatcctcaataccttccaaagcagcttgcagcaactgtacgctccggagttgcaatacaacaacagcagcgccagcagcagcaatcccggcgtggccagcgtcagcgccgccagcggcgcgcagaacgccaactacctgctgaccgtgtcgcagctggcgcaggcgcaaagcgccagcaccagcttcaccctgccggataccagttccacctcggtgggcaccggcagcctgaccatcaccaccggcagctacacctacaccagctcgacctcggccagcagcttcaccgccaatgacacgccggtaacggtcagcatcaccaacggcacgctgtccggcatcgccagcgccatcaacggcgccaatgccggcgtggtcgccaacgtgatccagaacgcctccggcgcctatcaattgcaggtcagcgcggccagcaccggcagcagcaacaatttccgcatcgccgtcagcgacaacgacggcaccaacaccgaccagagcggcttgtcgcgcctcgccttcgatcagaccctggcagtgggcagcggccagaacctcactcagacccagagcgcgctcaacgccgcctataccgtcaacggcgcatcggcttccagcagcagcaatttcggcatccagctgggcagcggcgtatcggccaacctgctggccaccggcagcagcaccatctcggtcaacatcgacttcggccaactcaataccaacgcccaatcgctggccaccgccttcaataccgcgcagggcagcatcaacagcctgctgggcaaccaggtcagcttcagcaacgatcccatcgccagccagctgccccagctgctgaatcaacaggcgcaaaccacctacagcaacggcagctcgctgctgacctcgctgagccagatcggcctgagctatcaaagcccggcgcaatacggcctgggcggcacgctgaacctgaacgtcagctcgctccaggccgcctacaacagcgactccaccggcaccgccaatctgttgtacgcggtggagcaggcgctgaactcgctggccaacagctataccacctacggcaacggctcgctggtcaacgagaccaacgccttgctgaaacagcaacgcaccaaccagctggccagcaacaccccgctgacgccgaacaccttcccattcaacctgaacgacctgctgcagaccaacagcaatctgtcggcccagcagatcagcggcctggccacctacgcgctggtctactcgctgggcgcgccctacgcgctggactcgctgctggtaggacagggcctgggcctgtctcccaacggcaccttctccgccaccgcctga

SEQ ID NO: 3864 - DNA, 696 bp, Chromobacterium substugae
atgaatccgaaccccgcaatcaaacgctcgctggtggatatcgcgctcgacagcctgggccggcaattggccgacggccggtggccggtgggcagccgcatccccaccgagcccgaattggccgacgagctgggcatcagccgcaacaccgtgcgcgaagccgtgcgcgtgctgctgtacgccggcctgctggaagtgcgccagggcgatggcacctatgtccgcgccaccgtcaatcccggcgaggcgatgcgcgccatcagccgcgccagcctgcgcgagcacctggaagtgcgctgcctgctggaggaaagcgcggcgcgcctggccgccctgcgcgccggcgccgatgacctggtccgcatcgaggcgacgctgcataccctggcccgccaggccgacgatacgcccgaaagctacgccgagcgcgacatcgccttccatctggccatcgccgacgccagcggcaaccaggcgctggccggcctgtaccgctatttctcgcgcgcggtgcagcaaagcgtgcaggacgccatccgcgacgaagcgctgccggatcccggcctcgccgagcacgccgccatcttcgaagccatacggcaaaagcggccggacgccgccggcgacgccgccgccgccatcacccgcccgttgctggccaccttggaccagttgctggccgcgcaaaaccaataa

SEQ ID NO: 3865 - DNA, 1263 bp, Chromobacterium substugae
atgcccgaccgcgatatccaaaatccgcccatcgccgacgaattgctgatcgacgacgacgcgccgcccgccaccagcctgcctgccagccgcggcagcgcgttgttgctgttgctggggctggtgctggtcggcctcaacctgcgtccggcgctatccagcctggccccggtgctggccatggtcagccgcgacaccgggctgaccccggcgctggccggcctgctcaccacgctgcctgtggcctgcttagggctgttcggcccgctggcgccgcatctggcgcgccgcctgggcagcgaaaaaaccatcgcgctggtgctggcgctgctggcggccggcatcgcgctgcgcactcaactgggcgtgttcggcctgttcgccggctcggcgctggccggcgccggcatcggcgtgatcggcgtgctgctgcccggcatcgtcaaacgcgacttcgccagccgcgccggcctgatgaccggcgtctacaccatggcgctgtgcctgggcgcggcgctggcggcgggcttcaccgtgccggtcgccgagcatttcggccgcgactggcgtccggcgctggcgctgtgggcgctgccggcgttgctggccatcgccgtgtggtggccgcagctgaaaacccgccacgccgccgccgccggccaatggcaggtgcgcgggctgctgcgcgacccgctggcctggcaggtgacgctgttcatgggcctgcaatcgtcgctggcctacatcgtgttcggctggctgccgtccatcctgatggaccgcggcctcagcgcgatggaaggcggactgatgctgtcgctgtccaccatggtgcaggtgccggcctccttgctggtgccgatgctggcgcaccgctgccgcaaccagcgcccgcctatcgccatcaccttgctggcggtgatcgccggcttgctgggcatgctgtacgcgccgaccggcagtctgctgctgtgggcgattttgctgggcttcggccaaggcggcctgttcagcaccgcgctgagcctgctggcgcaccgctcgccggaccagcacgtggcggcccacctgtcgggcatggcccagggcatcggctatatgctggcctcgctcggcccgttcgcggtgggcgtgatccgcggccacagccacgcggcctggccgctggcgatgctgttctgcctgatcgccgccgccgcgctcaccgtcggcatgctggccggccgcaagcagctggtgggcgtgcgcgcggtcgccgtctga

SEQ ID NO: 3866 - DNA, 522 bp, Chromobacterium substugae
atggacgcaatggtattggccgcgatggccaaatggcccaatgtgccggcggtgttcggctggctgcggctggacgcgcgcgggcagtggtggatcaaggacgaacggctgcagcacgaggcgatggtggagttcttcaaccgcaactacggccgcgacggccaggggcgctgttatgtgcagaacgggccgcagaaggtgtacgtgacgctggacgcggcgccgctggcggcccggcgcacgcccaggggctggagcaccttgccttacgacgacgatgtcgccgcgcgcaccgcctggctgacgccggacggcatgctgctgctggagataggcggcgaattggcggtggtggacgaccgcgatctgcctgccctgctggacgaggcgctgccggactgggacggcgcggcggacagcctgcccgccagcctgcgtcttggcgaggcggagctgccgctggcgcgcgaagagctggcggcgctgtggcgccgctacggcatcgtcgccaagccgcgctga

SEQ ID NO: 3867 - DNA, 2496 bp, Chromobacterium substugae
atgacgctgcgaggacggctgaccctgctgctgcgcttcatccgccgcgaactggtgtcgggcgagttgaccatactcggcctggcgctgctggtggcggtggcggcgatgagcagcgtcgccttcttttccgaccgggtggagaaggcgctgaccacccaggccacccagttgctggccgccgatctggtgcttagcggcaacgcgccggcgccggaagccatccgcgccgaggcgcgcaggcgcggcctcgcgatggccgacaacatcgtgttcccgtctatggccttcgccggcggccaggccgccttggcccagtacaaggcggtcagcgccggctacccgctgcgcggcgaaaccacggtgcggctggccgacggcagcgaacagagcggccgcctgcagctgcagcctggccaggcctggatggatgcccggctgatgagccggctcaagctgaagctgggcgacgagatcggcgtcggcaatctgcagctgaagctgtccggcctgatcgtgcgtgagccggacggcagcatggacgtctacaacttcattccgcggctgatgttcaacagcgccgacctggccgccaccggcctggtgcaggaaggcagccgcatccgctggcggctgctgttcgccggagaggaccgcaaggtggccgctttccgcggctggctgagcgcgcgcaagccgccgggcagccggctggaggatgtggaagagatgcggccggaaatccgcaccggcctggagcgggcgcggcgcttcctcggcctgaccgcgatgctgacggtggcgctggcggcgtcggcggtggcgctggtggtgcgccgctacctgcagcgccattggcagcaggtggcggtgctgcgctgcctgggcttgggctcgggcgaggtgtgggggctgttcgtcagcctgttcctgctgctgggcctgctggccggcctgctgggcacgctggccggcttcctgatccagctggggctgatgcagctgttcagcggctacgtcggcgagatgctgcccgatcccggctggctgccgtggctgatcggcccgctggcggcgctgctgctgctctccggcctggcgctgccgcccttgatgggcatccgcgacgtgtcgccggcggcggtgctgcgcaatgagctgccgccgacgcggcagggcgtgatcgcgccggtgctggcgctggccacgctgctggggctggcatcctggcaggtgggggagttcgcgctggccggctggctcctggcggcgatgctgggctttctcggcgtggccggcgcgctggcgctgggcatggtgatgctgttgcggcggctgccgcgcggcggcaaggtgggctggcgcttcggcatcgccaatctggcgcggcggcgctggctggcggtgctgcagatcgcctcgctgtcggtcgggctgatggcgctgctgacgctgaccgtcgtgcgcgacgacctgatcggcgcctggcagcgcagcgtgccggccgacgcgcccaacaagttcgtgatcaatatccagcccggccagctggacgcgctgcgcgatgccttcgccgtcgccggcaggccgcagccggagctgtcgccgatggcgcgggcgcggctgatcgccatcaacgagcagccggtgcggccggccgcttacgacagcgagcaggcgcgccggctggccgagcgcgagttcaatctgtcctggcgccgcgacctgccgccgggcaaccaggtgacggccggcaaatggtggccggacgagaagcgggtgaagccgcagttctcggtggagcgcggcctggccgacaagctgggcatccgcctgggcgacacgctggccttcgacctggccggcaccacctaccgggccaaggtcaccagcctgcgcgaagtgccgtgggacagcttccgcgtcaatttcttcgtgatcggcacgccggggcaattccgccagcagccggccagctggatcaccagcttccggctggaggcggcggacgaatccttcgccagcgcgctggtggagcgtttccccaatatcacggtgatagacgtcggcagcatactggcggaggtgagggcgatggtggacaagctgacgcgcggcatcgaggcgatgttcctgctggcgctggccgccggcgtgctggtgctgtgggcgtcgctgacggccacccgcgacgagcggctggccgacatcggcctgatgcgcgcgctgggggcctcgcgccgccagctgcgcagcgtggtgctggccgagctggtgtggctgggcgcggtgtccggcttgctggcggcattgggagcgatgggcataggcgtgctggcggcggtgaagctgttttcgctgccggtgctgatcaattggtggctgttgccgctgggcatgggcggcggcgtgctggtggtgacgctgacgggctggccgctggtgggcagggtgacgcgcgcgccgccgctggccgcgctgcgcgcggcggcttga

SEQ ID NO: 3868 - DNA, 714 bp, Chromobacterium substugae
ttgcaaacgatagagcgcatgagcaatccagagaaaaaggcggtgctggccgccagggagttggccaaacaggtgcatttccgcggcgacgtgctgcacatcctgcgcagcgcctcgctgaccctgtatcccggcgagagcgtggccatcgtcggcacctcgggttccggcaagtccacgctgctgtcgctgctggcggggctggaccatcccagcgatggcgaggtggcgctgttcggcaagccgctctccaggctgagcgaggacgcgcgcgcgctgctccggcgcgaccgggtgggcttcgtgttccagaacttccagctgctgccgcagctgaccgcgctggaaaacgtcatgctgccactggagctggccggacgcaacgacgcgcgcgaggcggcgcggcagatgctagagcgggtggggctggcggcgcgcctcggccactatccgcgccatctgtccggcggcgagcagcagcgggtggccttggcgcgcgccttcgtcattcatcccggcctgctgttcgccgacgagcccaccggcaatctcgatccgcacaccggccgccagatcatagacctgctgttccagctgaacgccgagcaaggcaccgcgctggtgctggtcacccacgacaacgagctggccagccgctgcgacgccatccaccgcttggtggacggcaagctgaacggagcgcgcgccggatga

SEQ ID NO: 3869 - DNA, 564 bp, Chromobacterium substugae
ttgttgctgctgtggcagctgccggcgcacgccgccaccatcctggtgtacggcgacagcctgtcggccggctacggcctggcgcccggccagggttgggcggcgctgctggcccgcgagctggcgccgcgccacaaggtcgtcaacgccagcgtgtccggcgaaaccagcgccggcggcctgtcgcgcctgcccgacgcgctcgcccgccacaaaccggacgtgctgatcctggagctgggcgccaacgacggcctgcgcggcctgccgctggccgacatgcggcgcaatctgcagcaaatggtggacctggccagccagcgcggcgcccgggtgctgctggtgggcatggcgctgccaccgaactatggcccccgttacggcgccgagttccgcgccgcctacgacgaaatcgccaaacgcaaccatctggcctatgtgccgttgctggtggcgggattcgccggcgacctggccagcttccagcccgacggcctgcatccgcgcgccgagaagcagagcaccatgatgcgcacggtgaaggcgaaactgccagtgaaataa

SEQ ID NO: 3870 - DNA, 1224 bp, Chromobacterium substugae
atgcccgatcatcccccctcgctctggcggcgctggctgcggccgtaccgcggcctgccggccggcgtctacatccagacgctgtgcagcttcatcaacaacgtcggcggcatctccaagctgttcctgccgctctacctgcgcgaaagctaccacctgccctacagccagatcggcgcgctgatggccttttacggcgccggcatgctggccggctcgctgaagggcggcagcctgagcgaccgcttcgacagccgggcgctggcggtgctggcgctatcgctgtccggcctgtgcatgctgttgctggcgctgcggattccggtgtggctgttcatgccggtgctggtgctgtccggcatggccgacggcggcttccgcccggtcaaccagcggctggcgctggagccgtgcacgccgcaacagcgtccggtggcgcagggcatgatgcgggtggcgttcaatctgggcgtcgccatcgccggcatcagcagcggctttctcgccgcctacggctaccagtgggtctacgccgccaacgccggcggcacgctgctggccgcctgctggctggcctggtcgtacagccgccgccgcgcgctcaccctccccgtccgccgcgatgaggaaagcggcggcgcgctggcgggcccttggcgcgacgtcagcttcctgcgcagcatcgccgcgctgatcctggtgacgctggctttcgaccagatgtacgtgaccctggcgctgttcctgcgcgaacactaccagctgggcgcgcagtgggtcggctacctgttcaccgtcaacggcctgatggtggtggcgctgcagatcccgatcagccgccgcatcctgcgctgggggctggggcgcagcacccagctgggcatcctgctgaccggctgttccttcctgtggctgaacgccggccacggcgcgccgtgggcggtgctgatgatggtgacgctgacttgcggcgagctgctgctgtcgccgtgctacgcgctgctggtgatgcaccgctccgaaggccggctgcgcggcagctatctgggcctctacaacgccgcctggaacggccgcaccctggtggcgccggcgctgggcaccgcgctgtacggccatttaggcggcgcggcgctgtggtggctgtgcgcgctggccgcctgcctgggcgtggccatccagcacggcgcgctgaagaggatgctgagcccggccgccgcctga

SEQ ID NO: 3871 - DNA, 615 bp, Chromobacterium substugae
atggccgtactcgttggcaagcaagccccgttcttcgctggtgaaaaaaccttctccgccgtgctcggcgatggtcagatcgttgacaactactccttcaagcaagccaccgccggcaagtacgccgtggtgttcttctacccgctggacttcaccttcgtgtgcccgtccgaactgatcgccttcgaccaccgcctggccgacttcaaggccaagaacgtggaggtgatcggcgtgtccatcgacagccagttcacccacgccgcatggcgcaacaccccggtggaaaagggcggcatcggccaagtcggctacaccctggtcgccgacatccagcacgacctgtgcaaggccttcgacgtggaagccgatggcggcgtcgctttccgcggctccttcctgatcgacaagtccggcgtggtgcagcaccaagtggtgaacaacctgccgctgggccgcaacgtcgacgaaatgctgcgcatggttgacgcgctgcaattcaccgaagagcacggcgaagtgtgcccggctggctggaacaagggcaagaagggcatgaagccgtccgccgaaggcgtggcttcctacctggccgaaaacgccaaggacctgtaa

SEQ ID NO: 3872 - DNA, 1794 bp, Chromobacterium substugae
atgcgtaccgattactgtggacttatcgataaaaaatacctcggccagaccgtaaccgtgaagggctgggcgcaccgccgccgcgaccacggcggcgtgatcttcatcgatctgcgcgaccgcgaaggcctggtgcaggtagtgatcgatccggacaccccggaagcattcaagctggctgacagcagccgcggcgagtacgtgctgtcgatcagcggcatcgtgcgcgagcgcccggccggcaccgccaacagcaagatgatctccggcgagatcgaaatcctggccaaggaaatcgagatcctcaacgccgcggccacgccgccgttccagatcgacgacgagaacctgtcggaaaacgtccgcctgaccaaccgcgtgatcgacctgcgccgccctgcgatgcagaagaacctgcgcctgcgctacaaggtggcgatgggcgtgcgcaaccacctggacaagcagggcttcatcgacatcgaaacgccgatgctgacccgctccaccccggaaggcgcccgcgactacctggtgccgtcccgcgtgcatccgggcgagttcttcgcgctgccgcaatcgccgcagctgttcaagcagctgctgatggtggccggcttcgaccgctactaccagatcaccaagtgcttccgcgacgaagacctgcgcgccgaccgccagcctgaattcacccagatcgatatcgaaacctcgttcctgaacgaggaccagatcatggacatcaccgagaccatgacgaaggagatcttcagcgacgtgctgggcgtgacgctgccgaccttcccgcgcatgacctacggcgacgccatgttctactacggctccgacaagccggacatgcgcgtttcgctgaagttcaccgaactgaccgacgtgatgaagtcggaagaattcaaggtgttccgcggcgccgccgatatggccaatggccgcgtggtggccctgcgcgtgccgaacggcgccggcatcagccgcaaggaaatcgacgactacacccagttcgtcgccatctacggcgccaagggcctcgcctacatcaaggtcaatgacatcaccaagctgaacgaagagggcctgcagtcgcctatcgtgaagttcctgtccgccgacggcatcaaggccatcatcgagcgcaccggcgcgcaaaacggcgacatcatcttcttcggcgccgacaaggccaaggtggtgaacgaggcgatcggcgcgctgcgcatcaagatcggccacgagcgcggcgagaaggacggctacttcgtgcgcgaatggcgtccgctgtgggtggtggacttcccgatgttcgaacacgacgaggaagccgaccgctggaccgcctgccaccatccgttcaccagccccaagccgggccacgaagatctgatggctaccgatccgggcaagtgcttggcccgcgcctacgacatggtgctgaacggctgggaaatcggcggcggctccatccgtatccaccgcgccgacatccaggagaaggtgttcggcgcgctgaagatcagcccggaagaacagcagaacaagttcggcttcctgctggacaacctgaagttcggcgcgccgccgcacggcggcctggctttcggcctggatcgtctggtgacgctgatgtgcggcgcggaatcgatccgcgatgtgatcgccttccccaagacccagcgcgcccagtgcctgctgaccaacgcgccgaacgcggtggacgacaagcagttgcgcgaactgaacctgcgcctgcgccagaaggccgagccgagcgcctga

SEQ ID NO: 3873 - DNA, 678 bp, Chromobacterium substugae
atgtcggtatcgccaaagataaaaatgaccctgcgggggtatctgatcgccggcctgctgatctggctgccgctggcggtgaccctgtgggtgctgaacctgatcatcggctcgctggaccagacgctgacgctgctgccggtggagtggcggcccgaggcgctgttcggccgccatgtgccgggcctgggcgtggtgttcgcggtgctggtggtgatgggcaccggcatgctggccgccaatgtgctgggccgcaagctggtggccttctggcacggcctgctgtcgcgcaccccggtggtgcgctcgatctacaacagcgtcaagcaggtcagcgacacgctgttctccgattccggcaacgcgttcaagaacgcgctcttggtgcgctggccgcaccagaacgcctggaccgtggcctttcagaccggcacgccggcccaggaaatcctccgccacgcggagaacggcgaggaactggtcagcgtgtacgtgccgaccacgccgaacccgacttccggctatttcatcgtggtgccgcgcagcgacactcgccaactggacatgagcgtcgacgacgcgctcaagtacgtcatctcgatgggcgtggtggtgcccaatccgccgccgggcgcccagcgtccgcgcctgaatgacgaacataatcggcagggctag

SEQ ID NO: 3874 - DNA, 258 bp, Chromobacterium substugae
atgccgatctatgaatatcgttgcggcgcctgcggcgtcgccaaagagcatctgcaaaaactgagcgacgctccgctcgcggcctgtcccgattgcggcagcgccgactatcacaagcagctgtcggccgccggcttccagctgaagggctcgggctggtacgccaccgacttcaagggcggctcctcctccagcgccgcgggcggcgccgccagttccggcggccatagctgcggcaccggctgcggttgcgattga

SEQ ID NO: 3875 - DNA, 798 bp, Chromobacterium substugae
atggtttaccaagagggtcagatggaaagcattcgcaacattctcgccggcaagaagggactgatcgtcggcatcgccaacgagaacagcatagcctacggctgcgccagcgtgctgcgccagctgggcgcggaatgcgcggtcacctatctgaacgagaaggccgagaaacacgtgcggccgctggccgaggccttgcaggcgccgctgttgctgccgctggacgtggagcagccggagcagatgcgcgcggtgttcgaacgcatcgccggccactggggtgaactcgacttcatcatccactccatcgcctactgtccggccgacgacctgcacggccgcgtggccgattgctcgctggccggcttccagcaggcgatgcgggtatcctgctactcgttcatcgaaatggcgcggctggccgagccgctgatgaaaaagggcggcagcctgatcaccatgagctactacggcgccgacaaggtggtggagaactacaacatcatggggccggtcaaggcggcgctggagagcgtgtcgcgctacctggccaacgagctcggccccaagcgcatccgcgtgcacgcggtatcgcccggcccgctgaaaacccgcgccgcctccggcatcgcccatttcgaccaactgatcgaagacgccatcgcccgcgcgccgcaaaaccgcctggtcgacatcgaagaagtcggcatgacctgcgccttcctgatttccgacgccgccagcggcctgaccggccagaccatttatgtagacggcggccaccacatcaaggcttga

SEQ ID NO: 3876 - DNA, 936 bp, Chromobacterium substugae
atgacccacgacgaccacgctttcgacgacatcctgcagcaagcccgccagctgggcgccctgccaatggcggtggcccacccctgcagccgcgaatcgctgctgggcgcggtggaggccgccgaaaacggcatcgccacccccatcctggtggcgccgctcgccaagctgaaaaaactggccggcgaactggaaatcgacctcaagcgcttcgaatgcatcgatgtcgagcacagccacgccgccgccgaacgggcggttcaactggtgcgcgacggctacgccgacatcctgatgaagggcagcctgcacaccgacgagttcatgagcgcggcgctcgcccgcgataccggcatccgcaccgaccggcgcatcagccatgtctgggtgatgaaggtggaaagctaccctcgctacctgttcatcaccgacgccgcgatcaatatcgaaccggacctggtcaccaagcgcgacatctgccagaacgccatcgacctgacccacgcgctgggcattccctgccccaaagtggcgatactggcggcggtggaaaccatcaatccggacatgcgctcgacgctggacgccgccgcgctgtgcaaaatggccgaccgcggccagatcaccggcgcggtgctggacggtccgctggccttcgacaacgccatctccaaggaagccgcccagagcaagggcatcgtctcggcggtggccggcgatccggacatcctgctggtgccggacctggaggccggcaatatgctgggcaagcagctgacctatctggccaatgccgcctccgccggcatcgtgatgggcgcgcgcgtgccgatggtgctgaccagccgcgccgacgacgccagcggccgcctcgcctccagcgccatcgccaatctgctggcccacactcgccggcaggacggagaacggccatga

SEQ ID NO: 3877 - DNA, 1152 bp, Chromobacterium substugae
atgagcgcctgcctgctggccatcaacgccggctcgtccacgctgaagttccgcgcgttcagcgccgacggacaaacgctgctggcgcgcggcatggtggaccgcttcggcgccaaggacgccaggctgagcctggccgacgccaaaggccagcaactggacgagcgcggtctcggcgatgccgctcacgacaccgcgctggcggcggtgctgcacggcctggccgaccaaggcctggaagcgcgggcgctggcgcaccgggtggtgcacggcggcagccgcttcctgcaagcggtgaagatagacgccgacgtccgcgccgcgctggacgactacatcgcgctggcgccgctgcatcagccggtcagcctggaagtgatcgacgccttcgccggcctggacagccgcctgccgcaaatcgcctgcttcgacaccgccttccacgccggccagcccgccatcgccacccgcttcggcatcgcccgccactggcacgacgaaggcgtgcgccgctacggctttcacggcctctcttacgccgccatcgcccgccgcctgccggaggtgggcctcgcccacgccaaggtggtggtgtgccacctgggcagcggcgccagcgcctgcgcgatcgaatccggccagagcgtggcgtccagcatggggttttccgcggtggacggcctgatgatgggcacccgccccggctatatcgaccccgaggtgatcctgtactggcaggagcacgagggcatgggggtgaaggacgtgcgacgcgagctgtacaagaactccggcctcttgggggtatcgggcatctccgccgacatgcgcgaactgctggccagcgagcagccggccgcgcgcgaagcggtggagctgttctgctaccgcgccgcgcgcgaggcggccagcctggcggcggcgctgcgcgggctggacgcgctggttttcaccgccggcatcggcgagcattccgccgaggtgcgcgccaggatactgcagcagctgtcctggctgggcttcgagctggaccacgccgccaacctggcgcacgcgcgccggctcaccactgccggcagccgcctgccggcctatgtgctgcccaccgacgaagaaggcgaaatggcccgccaggcggcgcggctgctgtag

SEQ ID NO: 3878 - DNA, 162 bp, Chromobacterium substugae
gtgctcaaggcaatcgaagccggtgacaaggctgccgctaaggtagtattccacgcttccgaaaaagtgatcgaccgcattgcagacaagggcgtgttccacaagaacaaggccgctcgtcacaagagccgtctgtccgctcaggtcaaggcaatggcctga

SEQ ID NO: 3879 - DNA, 1536 bp, Chromobacterium substugae
atgaacctgctcaaggctctggctgcagtcagcagcatgaccatggtgtcccgcgtcctcggcctggtccgcgataccctggttgcacgaactttcggcgccggcctgtccgccgacgctttcaacgccgctttcaagattcccaacatgctgcgccggctgttcgccgaaggcgcgttttcccaggccttcgtgccgatactgggcgaatacaagcagaacaagacccacgaggaaacccgcgagttcgtcgccaaggtgaccggcgtgctgggatcggtgctgctgctggtgaccgcgataggcatgctgttcgcgccgctgatcatgtggatctcggcgccgggcttctaccgcgagccggccaaggcggcgctgttcgccgacatcctcagggtgtcctttccttatatctttttcatttcgctgtcgtcgatgaccggcagcatcctcaacagctggggcaagttctcgatcccggctttcacccccaccttcctgaacctcagcttcatcgtgttcacgctggccttcacccactacttccatccgccgatcatggcgctggcctgggcggtgttcctcggcggcttggtgcagctggtatggcagctgcccttcctgaaacagataggcatgctggcgcgtccggtgttcgccttccgcgatcccgaagtctggcgggtgatccgccagatgggcccggccatcttcggcgtgtcggtagcgcagatctcgctgctgatcaactccaccttcgcctccttcctgcccaccggcagcgtgtcgtggatgtattacgccgaccggctgatggaattcccgtccggcgtgctgggcgtggcgctcggcaccatcctgctgccgtccctgtccaagcacgccgccagcaagtccgacgccgagttcagcgtgctgctggactggggcatccgcctgtcgctgctgttggcggtgccggccaccgtcggcctgggcctcttgtccggcccgctgctctacaccatgttcatgtacggcaagttcagcgcccatgacgcgctgatgtcgcagcaggcggtgatcgcctactccttcggcctcctggggctgatcctggtgaaagtgctggcgcccggcttctacgcgcgccaggacatcaagacgccggtgcgcatcgcggtgaccacgctgatcgccacccaggcgatgaacctggccttcgtgtttccgctcaagcacgccggcctggcgctatccatcggcctggcctcctgcctgaacgccggcctgttgatgcacacgctgcaaaaacgcggcatctaccgcccagaggccggctggaaaagcttcctcgccaaattggccaccgccatcgcggcgatggccgccgcgctgctggcggcgcaatggctgctgccgatagactggcacggccacgcctggctgcgcgcgctgtggctgctgctgctggtcgtgatcggcgcggtggtctacttcgccgtgctgttcgcgctgggcttccgcccgcgccaattcatgcgccgcgagcattga

SEQ ID NO: 3880 - DNA, 837 bp, Chromobacterium substugae
atgagcacacacgccactcccgaacattcgccgctgggcaaaaccgtcagctatcaggatcagtacgattccagcctgctgttcccgatcgcgcgccagaccaagcgcgacgagatcggcgtggcggaagccgcgctgccgtttgccggcgtcgacatctggaccggtttcgagctgtcctggctgaacgcgcgcggcaagccgcaagtcggcatcgccaccttccgcatccccgccgccagcccccggctgatcgagtccaaatcgttcaagctgtacctgaacagctacaaccagacgcggatggacagcgtcaacgccctcgccgcccaactggcgcgcgacctgaccgacgccgccggcgcggaagtcgccgtctccatcgcgctgccgcaagccttcgccgccgaacaggtacgcgaactggcaggcgagtacatcgacgacctggacatagaggtcgaccactacgcgccctgccccgagattctcaaagccgacgccgccgacatcgtcagcgaaaccctgtgcagcaatctgttgaaatccaactgcctggtcaccggccagccggactggggcagcgtctccatccgctacaccgggccgaagatagaccgcgaggcgctgctgcgctacctgatcggcttccgccagcacaatgagttccacgagcaatgcgtggagcgcatcttcgtcgacgtgctgcgcgcctgcgcgccgaccgagctcaccgtctacgcccgctacacccgccgcggcggcctggacatcaacccctggcgcagcaacgccgacgccgcgccgacggacaatatccgcaccgcgcggcagtaa

SEQ ID NO: 3881 - DNA, 678 bp, Chromobacterium substugae
atgcaaagacataatctggaacactacaatccgccgccggacaccggcctttccgtgatctacgccgatagctgcctcctggtgctggataagccgagcggcctgctatcggtgccggggcgcggcgaggacaaggccgactgcctgatcagccgcgcgcagaaggcgtatccggacgcgctgaccgtgcaccggctggacatggccacctccggcctggtggtgatggggcgcggccccgagatgcagcgcgcgctgtcgatcgccttcatggagcgcaaggtcaagaagcgctacatcgcggtggtggacggcatcgtcgagaacaatagcggcaccatcgacctgccgctgctcatcgattggccgaaccggccgcggcagaaagtagacctggagcacggcaaggaagccattacccatttccgcgtgatttcgcgcgacaccggccgcgacatcacccgggtggagctggacccgcaaaccggccgcgcccaccagctgcgcatgcacatgctgcacctggacatgggccacccgatcctgggcgacgacatctacgcgccgccggaggcgctggccaaggccgaccgcctgctgctgcacgcgtcccggctggtgttgcgccacccggtgactttcgaggaaatggaattcgaggcgccggcgccgttctga

SEQ ID NO: 3882 - DNA, 708 bp, Chromobacterium substugae
atgacggaacgcttctatcaagacccctaccagacccgcctgtccacccgcgtgctgtcccacgacgacgcgggcttgatcctggaagacacgctgtgctacccgctgggcggcggccagcctggagacagcgccatgctgacgctggccgacggcgccgcgctgcgcgtcgccgacacccgccgcgaccgcgacacccgcgccatccggcaccagaccgagggcgacgtccgcctcgcgccgggaaccgaggtgacgctggagctggactgggaccgccgccatcgccacatgcgcatccatacctgtttgcacctgttgtcggtcgtgatcaaggccggcgtcaccggcggcaatctcaccgccgaatccggccggctcgatttcgatctgccggagggcatggagctggacaaggaccagatagaggccgagctgaaccggctggtggccgccgacctgccgctcgcggtgaaaatgaccagcggcgaggcgctgaaggcgcagccggagctgatcaagaccatgtcggtgacgccgccccttcacctgccggaaatccggctgatcgaagtggaaggcgtggacctgcagccctgcggcggcacccatgtggcgcgcaccggcgaaatcggccgggtgcgggtgaaaaagatagagagcaagggcgcgcgcaacaagcgggtggtggtggaactggcggattaa

SEQ ID NO: 3883 - DNA, 1488 bp, Chromobacterium substugae
atgacgtcgaccgcgctcaaccccctgcggcagcccaagccgttttacctgatcttctcgatcgaattctgggaacgtttcggtttctacggcctgcagggcattctggccgtctacctcgtcaaggcgctgggtctgcgcgaggctgactcgttcacgctgttctcgtccttcatcgcgctggtgtacggcctgatcgccgtcggcggctggctgggcgacaaggtgctgggcaccaagcggaccatactgctgggcgcgctggtgctggccgccggctacgggatggtgaccgcgtcggccgagcatatcggcctgctctacctgggcatgggcaccatcgcggtgggcaacggcctgttcaaggccaacccgtcgtcgctgctgtccaagtgctacgaggaaaacgatccgcggctggatggcgccttcaccatgtactacatggcgatcaacatcggctcgctgctgtcgatgctggccacgccgtggctggccgacaagttcggctacgcccacgccttcgcgttgtcggtggtgggcatgctgatcactgtcgccaacttcctgctgatgcagggctgggtgaagcattacggttccgacgccgacttccgccaacccaagctgtccacctggctggcggtgctggccggggtggtggtcgcctgtggcgccgccgcgctgctgctgaagcacgagatcatcgccaacgtggtgctggccgcgctgtcgatcggcgtggtgggtctgtacgtgaaggaaacgctgctgctgaagggcgccgagcgcaagaagatgattgtggccgccatcctgatgctgcaggcgacggtattcttcgtgctgtacaaccagatgccgctgtcgctgaacttcttcgccatccacaataccgagcacacgctgttcggcatcccggtgcagccggagcagttccaatcgctgaatccgttctggatcatgctggccagccctttgctcgccgtctgctacaacaagctgggcaaccggctgccgatgccgcacaagttcgcgatcggcatggtgctgtgcgccggcgccttcctggtgctgccgctgggcgccaagtacgccaacgcgcaaggcctggtatcgtccaactggatggtgttgagctatctgttgcagagcgtgggcgaattgctgatttccggcctgggcctggcgatggtggcgcaattggtgccgcagcgtctgatgggcttcatcatgggcgcatggttcctgacctcggcagcgtcgtcggtgatcgccggctgggtggcgggcctgaccgccgcgccggacaacgtcaccagcccgctggccacgctggagatctacagccgcgtgttcacccagatcggcgtggtgaccggggcgatcgcgctgctcaccatcatcatcgcgccgtggctgcaccggatgacgctggacgagaagccggagcagccggaacacgaaatggcgctggacgcgcgctga

SEQ ID NO: 3884 - DNA, 972 bp, Chromobacterium substugae
atgccgctgccccgcctcagcctcgcgctgctgtgcctgctcgccttgccagtccgcgccgcgccgaatccgactttcgatcccaccccgctgccctggcaggaactggcggcccgcctgcgccacacctattacaccggcggcgtccacaatgaaaaatggtgcctgccaccgttcaactgcacctatccgcgcagccccggccagcccagcaacccgctgttccccaaatggtgggtcagcgactggaccatgtaccgggtgttcaagaactacgagcaatacccgccgccgtacagctctccaccggccggcctgagccccgacgattatgaagtgtcctacggcgccagctactacgacgccagctacgtaccggccgacggcgacggcaagggcgcgatgatggaacactacgagaagcgctgcttgcccatttttcccggcagcaaccactacagctgcagcttcgtctcgctgggcaacaaggcctatttcctgacctacgccgaccgcctgccgggcatgccgcaatgctgccagttctcgctgaacaaccatccgccgcggcaggacttcatccgccacctgccgtacaacaaggcggaaagcagccaccttgacaacagcctgcaagcctattcgcggctggtcggtccgcagaagatcctgttcggctacgccttctacaagcaggccgcccccgacgccgacggcggcaagccttatcgccatccgcaatcgttctacttctccggcgaccccagcccggagccggacgcgcccatcgtcagccagaactacagccacttccgcgccgaaaagcccgatccggcgcaaacctgggaccaggtggcgcaaatgtgcccggccaagccgcagtggtgctgcctgttcgccagcgactgtccggacaagccggctacgccggacgaaaacaatcccaagtcctgggccaccgcccggccctag

SEQ ID NO: 3885 - DNA, 918 bp, Chromobacterium substugae
gtgtccgtcaatctgcgtcatatcgaagtgttccgcgcggtgatgaccagcggcagcgtcagcggcgccgcgcggctgctgcatacctcgcaacccacggtcagccgcgagctggcgcgttgcgagcaattgctggggctggcgctgttcgaacgcagccggggacggctgcggcccacccagcaagccttgcagctgtttgccgaagtggagcgcagcttcatcggcctggagcgcatcgtcggcagcgcggcggcgatccgccagttcgccggaggccagctcgccatcgcctgcctgccggtgttcgcccagacgctgctgccggcagcgtgcgccgactttgtcgccggatttcccgatgtcggcatagacatcagcccgcaggagtcgccatggctggaggattggctggcggcgcagcgcttcgatctggggctgaccgagcagcagcaggcgccggccggttgccagacgcagacgctgtggcagggcgatgaagtgtgcgtgctgccggctggccatccgctggcggccaagcgcaggctggaggcggccgacttcgccgggctgtccttcatcagcctggccgccagcgacagctaccgccagcaggtggatgcctggttcgcgcgcgagagggtgtcgcggcgcatgcagctgtccagccacagcgcggcctcggtgtgcgcgatggtgaggctggggctgggcgtggccatcgtcaacccgctgaccgcgttggccgaggccggcgatggcctggtggctaggccgctggccgcatccatccccttcagcgtgcaactggccctgccgcaatatcggccggcgtcgccgctgccgggacgcttcgccgattcgctgcggcggcaagcggccgcgcaagagcggctgctggccgccttgctggcctag

SEQ ID NO: 3886 - DNA, 1227 bp, Chromobacterium substugae
atgcacgcattcgacacccgccagctcgccgccatcgcccagcaatacggcgcgccgctgtggatctaccacgccgacaccatacgccggcgcatcgccgaactctcgcacttcgataccatacgctatgcgcagaaagccaactccaacacccacatcctgcgcctgatgcgcgaacagggcgtgaaagtggacgcggtgtcgctgggcgagatcgaacgcgcgctggccgccggctatcagggcggcgcgcaagccgacatcatcttcaccgccgatgtgctggaccgcgccacgctggcgcgggtggcggagcttggcattccggtcaacgccggctcgatagacatgctgagccagctgggcgcggcctcccccggccacccggtatggctgcgcatcaatcccggcttcggccacggccacagccagaaaaccaataccggcggcgaaaacagcaagcacggcatctggcacgccgatctggagctggcgctggcggagattcgccgccaccggctgcaactggtcggcatccacatgcacatcggctccggcgtcgactacggccacctgcagcgggtatgcggcgcgatggtggagctggtgcagcggctggattgcgacatcgaggccatttcggccggcggcggcctgtccatcccctaccgcgacggcgacgcccgcatcgacgccgatcattacttcgagctgtgggacgaggcgcgccgccagatagccgaccggctcggccatccgctgcggctggaaatcgaacccggccgttttctggtagcagaatccggggtgttgctcagcgaggtacgcgcggtaaaaaacatgggcagccgccgcttcgtgctggtggatgccggcttcaacgacctgatgcggccgtcgctttatggcagctaccaccacatcaccgtcctcgatgcgcagggcgcggcgaaatccggcagcgtcgacaccgtggtcgccggcccgctgtgcgaatcgggcgatgtgttcacccagcgcgagggcggcaccgtggaagcccggccgctgccgccggccgcggtcggcgacctgctgctgttccatgacgccggcgcctacggcgcgacgatgtcctccaactacaacagtcggccgctgctggccgaagtgctggtggatggcggcgcggtgcgccagatccgccgccgccagaccatggccgagctgctggcgctggaagcctga

SEQ ID NO: 3887 - DNA, 378 bp, Chromobacterium substugae
gtgtggtgcgccggatgggaattgcgccagccggcatttgtcgcgagaaatctggagaaaatgatgaaacgttttgcaagccaaaccctgctgttggccgcactggccttttcgggcgccttcgccactcaggcttatgccgaaggcgccgttgcggttgccgcgccgaccgacgccgagctggccgcctccgtcaagcaggcgctggatagcgatgccgaactgaaggcgctgggcctgaaagtgagcagcaacaagagcgaagtgacgatcgaaggccaaatgagcgacgaccagcagatgttccgcgccggccagatcgccgagcagattccgggcgtcaagttcgtgatcaacaagatggaactgaagaactga

SEQ ID NO: 3888 - DNA, 1257 bp, Chromobacterium substugae
atgacccatatcctgtccccgaaacgctggccgctatggctggccttgctgcttctcgccggttgcggcaccactacgccgaccggcagcctcccctccctccctagcgccggcggcggcgacgccagcagcctggccgccctgcccgcctggaacacccagacgctgggcgacacgctgcaaggcctgcggcaaagctgcaagagcctgcagaaaaaaccggcttggcgcggcgtgtgccgcgaagccggccagttggccgacaacgatggcgatgcggtgcgccgcttcttcgaaaaccgcttcaccgcctggaagctgcgcgacggcaaccgcgacagcggcctgatcaccggctattacgagccgctgctcagcggcagccgcacccgctccgagcgcacgccgtggccggtatacggcgtgccgcgcgacatggtcagcgtcgacgtgccgataagccagcgcaatcgcggcgcgctgcgggccaggcaaatcggcccgaaccgcctggcgctggccgccggcggcgatatcgaagtcaacccggctgatttcccggccgatccgcgcggcatccgcctgaagggccgcttgtccggctcgcgcctgctgccctacttcacccgcggccagatcaatcagggcagcatcgccggcagcgcgccggtgctggcctgggtggaagacccggtggagctgttcttcctgcaagtgcaaggctccggccgcatccagctggacgacggcagcttcatccacgtcggcttcgccgaccaaaacggctatccctaccagtcgataggcaaatggctggtcgaccagcgccagctgacgctctccgacgcgtcgatgcaaggcatcaaggactggctcgcgcgcaatccgcaacgccgcgacgagctgttcgcggtgaatcccagctacatcttcttcaagaccaccccgggcgacaacggcgggccggtcggcgcgctgggcgtgccgctgaccggcggctacagcatcgcggtcgacccccgctacatcccgctgggcgcgccgatctatctgtccaccacctggccgcactccgccgaaccgctggtgcggctggtccacgctcaggacaccggcagcgccatcaagggcgcgttgcgcgccgacctgttctggggctacggcaccgaggctggcatgtacgccgggcggatgaagcagcaaggcagcttgtggctgctgctgcccaagggcctgtcgccgtcggcgacgctgtaa

SEQ ID NO: 3889 - DNA, 273 bp, Chromobacterium substugae
ttgccgccgctggcggtgtttgatcagcccgaagtgatccgggccttgtttctggcggcgcgggcgctggaaatgatggatggtcgggcgcggcgcgcgccgccagaccatgccggccatccctggtcggagctggaggagacccagttgctgcaggctttcgattccggcttgccgctgaagcagatcgcggccgaccatggccgcagccgcggcgcgatcaatgccaggctgcagcggctgggccgcatcggcgaacaggtggagggctga

SEQ ID NO: 3890 - DNA, 768 bp, Chromobacterium substugae
atgatccgcatattcatcgcctgctgcctgtccgccgcagcgtgggccgcgccggccgcttcgccgccgtgccgggcgcatggcgagtccggccccgcgcgccaggtttccctgttggagctgtatacctcggaaggctgcagcagctgcccgccggccgagcgctggctgtcggccctgccgccggcctttgtcgatgggcggcaggcgctggcgctggcctttcatgtcgattactgggacggcttgggctggcgcgaccgcttcgccagcgccgcttattccgagcgtcagcgccggcatgccgcccaggcgggcggcgcggtggtttacacgccgcagttcttgctcaacggccgcgattggcggcccggcggcgatggcgagctggcgcaggccttgccgcagagcgcgtctggcgcgacgctgcagctggatagccggacgttcgcggatggggtggatgtgacgctgcgcgcgcaaacgccggtgaaaacggggcagaggctgatgctggcactgtttgagaatggcctgcaaagctgggtggaggcgggggagaaccgcggcagcctgctgcggcatgatgcagtggtgcgcggcctgtgggggccgttcgcgctggatggcggcggccatgccgcgctcagcaggcatttggcgttcgccgcgggccagaggccggagttcagcggcgtggcggcttggctggaagacgtggacagcggcgcggtgagccaggcggtggtggccgcttgccggcgctga

SEQ ID NO: 3891 - DNA, 195 bp, Chromobacterium substugae
ttgttagtcgggcggacttgcgcggccttacaggcaaagcggcatccgctccgctcgcggccggcctcctcgccggcgcgcaacgcagcgccggaagcccgccgcatggaatgcgggaaacgcaagcgcggagcttcgccgaaatccgcaggcggcaggatgcaatgccattccatcaagacagcggcagactaa

SEQ ID NO: 3892 - DNA, 76 bp, Chromobacterium substugae
gggcctctagctcatgcctggttagagcagcggactcataatccgttggtgccgagttcgactctcggggggccca

SEQ ID NO: 3893 - DNA, 1977 bp, Chromobacterium substugae
ttgtgttataatcaactgtttttttcggctttttttcaagcaggaagcgaaatggcggcctctcccgaaaaccagaaagatgtgcaggacagccaacaggaggtgatgagcctggaagagcagcggaaacgcttgcgccagctgatcgccctgggcaaggagcgtgggtatctgacctacgccgaaatcaacgaccacctgccggaagacgtatccgacgcggagcagatcgaaaacatcgtgacgatgatttccggtctgggcatccaggtatgcgaagaagcgcctgacgccgaaaccctgctgatgtccgacgccacgccggcggtcgccgacgaggacgcggtggaagaagccgaggcggcgctgtcgtcggtggattccgaattcggccgcaccaccgacccggtgcgcatgtatatgcgcgaaatgggttcggtcgagctgttgacccgcgaaggcgaaatcgaaatcgccaagcggatcgaagacggcctcaagtacatgatccaggccatctccgcctgccccggcaccatcgccgaggtgctggagctgatggaacgcgtggcgcgcgatgaaatccgcgtcgacgaggtggtggatggcttcatcgacctcaacgcgcccagcggcgacgaagccgcctacgccgagccggaagccgaagacgagctgctggaagaggacgaggacgaggaggaggacgccgaggaagtcgacgccgacgccgacgccgccgccaatctggaagagctgaagcaagaagcgctggagcacttcgccggcgtgcgcctgctgttcgacaagatggtcaaggtgctgaacagcaagggccatcagagcaaggaatacctggagctgcaggacgcgatcaccaccgagttcatgctggtgcgcttcgccacccgccaggtggaaagcctctgcgagtcgctgcgcggccgcgtcaacgagatccgcacttacgagcgcgacatccaggacatctgcgtcagccgcgtgcgcatggagcgcgcccacttcatcaaggtgttcccgggcaacgagatcaatcttgactgggtggagagcgaaatctcgtccggcaaggcctggagcgaggcgctgacccgcttcaagcacgcgatcatcgagaagcagacccgcttgtcggacctgcaggaccgcgcgatgctgtcgatcaaggcgctgaaggaaatcaaccgccagatgtcggccggcgagtccaaggcgcgccgcgccaagaaggaaatgatcgaggccaacctgcgtctggtgatttccatcgccaagaagtacaccaaccgcggcctgcagttcctcgacctgatccaggaaggcaacatcggcttgatgaaggctgtggacaagttcgaataccgccgcggctacaagttctcgacttacgccacctggtggattcgccaggcgatcacccgctccatcgcggaccaggcgcgcaccatccgcattccggtgcacatgatcgagaccatcaacaagatgaatcgcatctcgcggcaaatcctgcaggaaagcggccgcgagccggatccggcggagctggccgagaagatggagatgccggaagagaagattcgcaagatcatgaagatttccaaggagcccatctccatggaaaccccgatcggcgacgacgacgattcccatcttggcgacttcatcgaggaccagaacaacctggctccgtccgacgcggcgatgtattccagcctgaaggacgccaccaaggaagtgctggacaccctgaccccgcgcgaggccaaggttctgcgcatgcgtttcggcatcgatatgaacaccgaccacacgctggaagaggtgggcaagcagtttgacgtgacgcgcgagcggattcgccagatcgaagccaaggcgctgcgcaaactgcgtcatccgacccgttcggaacgcctgcgcagcttcctcgacaacgagccgggcggccagtaa

SEQ ID NO: 3894 - DNA, 1788 bp, Chromobacterium substugae
ttgattccgcaggacttcatcgatcaactgctgtcccgcgtcgacatcgtcgacgtggtggaccgctacgtccccttgaagaagggcgggcagaactatatggcctgctgccccttccacaaggaaaaatcgccctcatttacggtaagtcccagcaagcagttttatcactgcttcggttgcggcgcccacggttccgccatcggcttcgtgatggagtaccagggcgtcggcttcgtcgacgccgtcaagctgctggccgaaggcataggcatgcaggtgcccgacgagcgggcggtcaatcccgaggccagccgcaaggcgcgcgagaagcaggtgtcgctggagcaactgatgcaaatggccagcgactactaccgccgcgagctgaaaggcgggcccaacgcggtggcctactgcaagggccgcggcctgtccggcgagatcgccgcccgtttcgggctgggttacgcgccggacggctggcagaacctggaggcgatcaccgccaactaccaggacgaaaaactggtggaggccggcttggtgatcgtggcggaggacagcggccgccgctacgaccgcttccgcgaccggctgatgttcccgatccgcaatcagcgcggcgccatcgtcggctttggcgggcgggtgctgggcaagggcgagccgaagtatctgaactcgccggaaacgccgctgttcgaaaagggccgcgagctgtacggcctgtacgaggcgcgccaggcgatacgggataagaaccgggttttggtggtcgaaggctatatggacgtggtggcgctggcgcagtacggcgtcggctacgcggtggccacgctgggcaccgccaccaccggcgagcatgtgcgcaagctgctcaagcacgccgaccaggtgtacttctgcttcgatggcgacaaggccgggcagaaggcggcctggcgcgcgctggagaacagcctgccgcagctggtggacggcaaggcgctgagcttcctgttcctgccggccgagcacgatccagacagctatgtgcgcgaattcggcaccgatgcgtttgaggaagtgttggagcagcaaagcctgcccttgtcggtgtatttcacccgcgagctgtgcaaggaggtcaatctcagcacgccggaaggcaaggccgacctgatacggcgggcggcgccgctgctggcgcagatcagcgcgccggcgctgggcttcatcatcaagaagcgcctggccgaactggccggcgtggaggtcgacgagttcgacatgctgaccggcggcaagccgcggcaggcaagcggcaagagcggcaggcgagattacaagctgccggccgagtcgcagcgggtgatgaatacctcaatggtcaggaagctgatcaagtggctgttgatgaaccccggctgggcgccggacgtgcggctgccggacagcctggcgctgtcggacgagctggcctgcttcgcgatgctggccgagcgcgtgcaggagcacggcgaagagcccaataccgcgcagctggtggaaggcttgcgcggcacgccctacgagggcttgatcgacagcgtgctgcagcaggcgatgcaggacccggacgagttcgccgaccccggcgcggacgaccggcagcagttccaggacggcaacgccaggctgctgaaaatgctgcatgcggcccagctggagcggctaaaacagaaggaccggcacgaagggctgacctccgaggagaaagccctgctcggccagttgttgcgggaaatgttctcgtcgccgaactaa

SEQ ID NO: 3895 - DNA, 447 bp, Chromobacterium substugae
atgagcctcaaagttcgaatcaccgacgacatgaagtccgccatgaaggcgaaggaagccgacaagctgggcgcgatccgcctgctgctggccgccgtcaagcaaaaggaagtggacgagcgcatcgagctggacgacgccggcatcaccgccgtcatcgacaagatgctcaagcagcgtcgtgactccatcgcccaataccagagcgcgcagcgcctggacctggtggccaaggagcaggccgagatggatgtgttgatggtgtacatgcctcagcagctgagccaggccgagatcgaggcgctgatcgccaaggccgtggccgacaccggcgccgccggcatgcaggacatgggcaaggtgatgggcgcgctgcgccctcaattggccggccgcgccgacatggcgcaggtgtccggttggatcaaggccgcgctcagcgcctga

SEQ ID NO: 3896 - DNA, 147 bp, Chromobacterium substugae
gtggaaaagactggtctgctgaccgaactgcgcgcccgcgagttctacgagaagccgaccaccgagcgcaagcgcaagcacgccgccgcggttaagcgccactacaagcgcatccgcagccaaatgctgccgccgaaactctactaa

SEQ ID NO: 3897 - DNA, 750 bp, Chromobacterium substugae
ttgctggtggggaccggcaaatacaaggatttcgagcagaccgcggcggcgctggacgcgtccggcaccgagatcgtcaccgcggcgatccgccgggtgaacctggggcaaaacgctaacgagccgaatttgttggactttttgccgaaaagccggtataacctgctacccaacacggcgggctgctattccgccgaggatgccatccgcaccttgcggctggcgcgggaattgctcgacgaccaccgtttcgtcaagctggaagtgttgggcgatcccaacaatctgtaccccaatgtgaaggaaaccctcaaggccgccgaggtgctggtggcggagggcttcgatgttctggtttatacctcggacgatcccatcatcgcgcgcgagctggagcagataggctgctgcgcgatcatgccgctggccagcctgatcggctccggcatgggcatcctgaatccgtggaacctgcaactgattatcgagcagtccaaggtccccgttatcgtggacgcaggcgtcggcaccgcttccgacgcggcgatcgcgatggagctgggctgcgacggcgtgctgatgaataccgcgattgccggcgcccgcaatccggtgttgatggcgcgcgcaatgaaactggccgtggaagctggccgcgccgcctatcaggccggccggatgccgaaacgtttttatagtgcaacgccaagttctcctagtgagggggtgatttcttccgtcaagtcgtga

SEQ ID NO: 3898 - DNA, 210 bp, Chromobacterium substugae
atgagtcaattgaatttgcgcatcaacggcgaagaccgcagtttcgccggcatcgccaccttcgccgagctggtcgacgcgctgcagctgggcggcaagcgcatcgccatcgagcgcaacggcgagatcgtcccgcgcagccagcatgcggcggagctgctggcggacggggatgtgctggagatcgtggtggcggtcggcggcggctga

SEQ ID NO: 3899 - DNA, 2157 bp, Chromobacterium substugae
atgggcaccggcatagagacaggcattgattacaacgccctgatcgattccgacgcggcggcattcttcgagaatgccgggcgttacctcaagccggaagacatcgagctgctcaagctggccttcgcggtcagccgcgaggcgcacgaaggccagacccgcaagagcggcgagccctacatcacccatccgctggcggtggccacgatgctggccgagtggcggctggacgtgcagggcctggcggccgccttgctgcatgacgtgctggaggacaccggcgtcaccaagccgacgttgatcgagaaattcggcaagatcgtcgccgatctggtcgacggcctctccaagctggagcggctggaataccagaccaaggaagccgcgcaggcggaaagcttccgcaagatggtgctggcgatggcgcgcgatatccgcgtgatcatcgtcaagctggccgaccggctgcacaatatgcgcacgctggactcgatgcgcgaggacaagcgccgccgcatcgcgctggaaacgctggaaatctacgcgccgatcgccaaccgcatcggcctgaacaaggtctaccgcgaactgcaggacctggcgttcaaacatctgcacccgcaccgctacggcgtattgtcgaaggcggtgcgcgccgcgcgcggcaaccgccgcgaagtggtgaacaagatcctgcaggcggtcagccagcggctggtgcaaagcaatatcgaagccaccatcaagggccgcgagaagaacctctacagcatctacaagaaaatgcaggagaagcacctgtccttctccgaggtgctggacatctacggcttccgcgtggtggtcaacgacatcccggcctgctacctggcgctgggcgccttgcacagcctgtacaagccgattcccggcaagttcaaggattacatcgccatccccaagggcaatggctaccagagcctgcacaccacgctgttcggcccctacggcacgccggtggagatgcagatccgcacccgcgagatgcacagcgtggccgaggccggcgtcgcctcgcactggatgtacaagagcggcggcggcgtcaacaccgcgcagcagcgcacccaccagtggctgcagaagctgctggacatgcaggaggagagcgacgacgccgtcgaattcctcgagcacatcaagatcgacctgttcccggacgaggtctatgtgttcacccccaagggcaagatcatggtgatgccgcaaggcgccaccccggtggatttcgcctacgcggtgcacaccgatgtcggccaccgctgcatcgcggcgcgcgtcaaccacgcgctggtgccgctgcgcaccgtgctgcgcaacggcgacaccgtcgagatcatcacctccacccaggccaagcccaatccgtcgtggctggccttcgtgcaaagcggccgcgcccgctccggcatccgcaactacctgaagagcctgcagcgcgaagaggcggtggcgctgggcgagaagctgctgcgccaggcggtgggcgcgctggccaccacgccgctggcggtcagcgacgacctgcgggtcgagtatttcgccgcctacggcgagaaaatgagcagtttcgacgacgtgctggccgagatcggcaccggcaagctgctgcccatcgtggtggcgcgccggatgctggagctggccggcgagcgcctgggcgagggcgtgcgcgtcggcccgatcaccatccgcggcaacgaggccggcatggtgcagctgtcgccgtgctgcaacccgctgccgggcgacgagatactgggcgtcatcaccaagggccagggcctggtgatacaccgcgtcgattgcccgaacgcccgccgcgccgaccacgacaaattgctggaagtgaactgggaggcgcagcgcgaccggatgttcggcgtcactgtcggcgtgctgtcgcgcaacgagcgcggcgcgctggccgacatcgccaccgccatctcgcaggcgtcggccaatatcgaaagcgccgacacccaggacagcagccgcgacggcgacggcctgttcaacatccacttccgcctgcaggtggaaggcgtcgagcacctggagcgcgtgctgaacgccgtccgccagctggcggtggtgcaacgcgtggagagaagatga

SEQ ID NO: 3900 - DNA, 207 bp, Chromobacterium substugae
atggcccgcattactgttgacgactgcctggaccgcatccagaaccgctttgacctgactctggccgccgcctaccgcgcgcgccaggtggcttccggcgccagcgcctttgtcgagccgggccgccacaagccgaccgtggtcgccctgcgcgagatcgccgccggccacgtcggcaaggaaatcctcaaccgcggcaaggcctga

SEQ ID NO: 3901 - DNA, 633 bp, Chromobacterium substugae
atgagccagcttatcgggaacatttacatcgtggtcgcgccgtccggcgccggcaagacttcgctggtggccgccttgctgcaggccgagcccagcgtcgagctgtcggtgtcctacagcacccgcgcggcgcgcaagggcgagatcgacggcaagcattaccacttcgtcgagcgctcggtgttcgacgccatggtggagcgcggcgatttcctcgagcacgccgaggtgtacggcaactgctacggcaccagcgcgccgtggatccgcggccgcctggaggccggccaggacatcctgctggaaatcgactggcagggcgccgaacaggtgcgcgcggtgtttcccgacgccatcggcatcttcatcgcgccgccctcgatcgaggagctggagcgccgcctgcgcggccgcgacaccgacgccgaggaagtgatcctgcgccggctggcctctgcccgcgccgagatcgacaagatcgccgagtacgactacatcgtggtcaacgacgacttcgagcgcgcccgccaggacctgatcagcatcgtccgcgcgcagcgcctgaagagcgggccgcagtgccgtcgcctggccgagatgttccgccgcatgggcaccgccggcgcgcagtaa

SEQ ID NO: 3902 - DNA, 1299 bp, Chromobacterium substugae
atgcaactgctggaaagcttgttcaagctcaaggaacacggcaccacggtgaagaccgaagtcatcgctggcttcaccaccttcctgaccatggcctacatcatcctggtcaacccgctgatcctgtcgagcaccggcatggacctcaacgcggtattcgtcgccacctgcctcgccgccgcgctcggcaccgccatcatgggcctggtggccaactacccgatcgcgctggcgccgggcatgggcctgaacgcctacttcaccttcagcgtggtcaagggcatgggcctgtcgtgggaaaccgcgctgggcgcggtgttcatctccggcctggtcttcctggcggtcagcctgttcaaggtgcgcgaggccatcgtcaacgccatcccgcaatcgctgaagttcgccatctcggccggcgtcggcatgttcctcgccatcatcgcgctgaagaacgccggcgtgatcgccgcccatccggccacctatctgacgctgggcaacatccacagcccgaccacgctgctggccatcctgggcttcttcctgatcgtggcgctggaataccgcaaggtgccgggctccatcatcatcggcatcctggtggtgaccgtgctgtcgatcgcgctcggcctgtcgccgttcaagggcatcgtcgccccggtgcccagcatggcgcccaccttcatggcgatggacatcaagggcgcgctcaacgccggcctgatcggcgtgatcttcgtgttcttcttcgtcgacctgttcgacaccaccggcaccctggtcggcgtgtcgcaccgcgccggccttttggacaaggacggcaagctgccgcgcctgaagcgcgcgctgatggccgactccatcgccatcaccgccggcgccgtgatgggcacctcgtccaccaccgcctacatcgaatccgccgccggcaccgcggtgggcggccgcaccggcctcaccgccatggtggtggcgctgctgttcctggccgcgctgtggctgtcgccgctggccgccaccgtgcccgcctacgccaccgcgccggcgctgtgctacgtcgccgtgctgatggcgcgcggcctcgccgaaatcgaatggaacgacctgaccgaatccgcgccggcggtgatgaccgcgctggcgatgccgttcaccttctccatcgccgacggcatcgccttcggcttcatcagctacgcggtgatcaagatcctggccggccgcttcgccgacctgaagccggcggtgctggtgatcgccgcgctgtgggtgttcaagctggctttcttcgcctaa

SEQ ID NO: 3903 - DNA, 120 bp, Chromobacterium substugae
atggcgctattgtacttcgaaatcaagagactgcgtggtttgccgacgggcggcgctcagcaaaaaggcctgccgcaaaggcggcaggccagatttgcaagccgattattgtgcttttag

SEQ ID NO: 3904 - DNA, 558 bp, Chromobacterium substugae
atggaaaacctcagcaatctcgactactccagctacctgaagggctggatccgcaccgtgcccaactggccgcaacaaggcgtgatgttccgcgacatcaccccgctgctgcaaaacccgaaaaccttccgcatgctgatcgacatctacgtccatcgctacatgaccgagaaggtggacctggtggccggcctggacgcgcgcggcttcatcatcggctcggtgctggcctacgagctgaacgtcggcttcgtgccgatccgcaagaagggcaagctgccgttcaccacggtggaagaggaatacgaactggaatacggcaacgccgcggtggaaatccacaccgacgcctgcaagcccggcgaccgcgtggtcctgatcgatgacctggtggccaccggcggcaccatgctggccggctacaagctgctcaagcgcatgggcgccgacgtgctggaagccgcggccatcatcgaattgccggaactgggcggcggccagctggtgcgcgacggcggcctggacctgttcaccgtctgcagctacaagggccactga

SEQ ID NO: 3905 - DNA, 762 bp, Chromobacterium substugae
atggatatcgccaagaccgccgcctgcctgctgctgatcggcagcggcgcggcccgggccgaggaggccggcaacatcgaccggctgattttccgcggcgacgccgcccggctggagctgaccgccgacgccgccaaaccgtataaattgagcctggagaagcgcaattggtccgacgccgactgcaaggtggcggccacccgccagggcggcgacctgaccttccggatcgacctgggcgcggtggcggcggagcgctgccggctggtgatacgcggcaacgtcaagccgggcaagaagctggatgtcgacttgaaggcggtggacggcgacgtgtccggccgcttcgaccaggtgcagatgcggggccaggcgctgcatgtcgatttgaacggcgaatacggcgcggtgaggttgtccggcgaggcggtcaagagcgacgtcaagggccaggtcggcgaactgcggctgaagggcaacgcggtgaatctggacttcgacggcgccagccgcgcggtggcgctggatggccaggcgatcaaggcggacatcgcgctgcagggcgcgcagccggcagccagcgtggatgtcaacggccagatggtgaagctggaattcaccggcagcaaggccgccaagctggactaccaggtcagcgggcaggccagcaaggtcagcggcgactgggccaatactcccggcgcgccgctgaagctgcgggtcaagggccaggcggtgaaggtgtcgctggaacagaattga

SEQ ID NO: 3906 - DNA, 294 bp, Chromobacterium substugae
atgaaaaacgatgcctgcctgcagcaattgcaactgaccctggtcgggttgccggaagccgagctgcgcaagattctcaacgactaccgttgctacatccgcgacgcggtatccgaccgcggcagcgaaaaccgcctgctggcgatcctgaccgaaacccggcagctggccgccgccgccttcgcccgccgccgcatcctgcgccacagccgcggccagctggcgatccacgcgctggccgccgccgccgcggtggcggtcaatgtcgccagctactggctgtacctgcactga

SEQ ID NO: 3907 - DNA, 1098 bp, Chromobacterium substugae
atgactcgcaaggactttttacagcagctggagagggcgctgtccgggcagaggccggaaatggtgcgcgaaatcctctccgattacgaagagtatttcaacgacgcgctggccgacggccgcgacgaggccgacgtggtggcggcgctgggcagcccgcagaagctggcgcgcgaactgaaggcgcagaaccactaccggcaatgggagcagcaccgctccttcggcaatctgtcgcgggtggtggcgtcgatcgccgggctgggcgtgctgaatttcttcctcgccatccccttcatggtctacctgatgttcctgaccatcggctacgtggtgtcggtcagcttcctggtggccggcctggcggtggtgctgggctggggcagccatagcttgttcggctggccggagttcagcgtcgacagcctggatatcggccatcgcggcgcgccgggcttggtggacgtcaaggcggacgacggctcggcctcgggcgagttccgcatcgagcatggccgcctggtgctggagccggactccggcagcacgatccggctgactacccgccagggcgatcccatcgtagtgagccgcaacggcgacagcctgaaggtggacgccagccagccggcgcgcctgctgctgcagcagacggacgacgacgaagtcagcatcaacagccatgcggtggcggcgctggcctacagcggcagcggcggcgaccaggccgcgttccgggtcgacgacaacggccggctgaccagtctgcaggcgtcggccggcggccaggaggtgaagatcgaggccagcggcccgcatggattgacggtgctgaaagacggcaacagcgtgctggagatcagcgagaagaagatcacggtgaaggacggcatcagctttgtccatctggacgcgctgccggggatgtcggtggggatgagcgcggccatcgtcggactgggcctgctgctggccggcgcgctgggactggtgttctgcgtgtggctgacccggctgacttggcgcgtgctggtgtcctatgtgaagtatcaaatcgagttggtttccggcaaggaccgcgaaaacgccgcggcttga

SEQ ID NO: 3908 - DNA, 342 bp, Chromobacterium substugae
atgaaaacgcaattgaagaagggcacgctggacatgtgcgtgctggcggtgctgtcgcaggcggacagctacgcctacgaactggtcagcaagctgtcgcagggaatggagatcagcgaaggcaccatttacccgctgatgcgcaggctgcagaacgagtcctgggtcagcacctacctggtggagtcgtcgtcgggcccgtcgcgcaagtattacaagctgacggatatcgggcggcgggagttggcggtgatgcgccaggaatggcaggagtttgtgacggaagtggaaaacgtgctgcgggacgaaccggcggcctcgactgaagggacatcgcaatga

SEQ ID NO: 3909 - DNA, 1173 bp, Chromobacterium substugae
atgccgatggcaatgacgtttttccgccacaacattgtcatccctgctgcattgcaaaaaccggatcagcaaccatacttcagccatgcttttgtcttcgccaacgacatgaaacgggagaaacgcgtaatggctgaatccgcaaaaccctccatcgccctggtgttgggcggcggcgcccccaacgccacgctgatggccggcgcgctggtggcgctcaccgaagccggcgtcagcttcgacatcatctccgcctccggcgccggcgccatcgtcggcctgctctacgccgcgccgcggcagggcgatgccatctcggcgctgagcaagctggccgatctgggcgtgtccgatcccatctacaatctatttccggtcaactacaaggtgttcaacaagccgggcagcctggccgacgcctggcgccggctgcaatcgagcaatccgctgctgcaggccatccagagccaggccgaccaggggccggcgcaaaggctgctggccgattggacctcgctgctgctggccagcttctgccccagcagcctggccagcgacagccagggcctgtgcgcgcacgtgcccttcatcgagcaggtggtggacttcgccaagctcaaggacatccgtcccgagttctacctgaacgcctacaacatcagccacggcgccatgcgttgctgggacaagcgcgaggtcacccacgagcacttcctggccgcgctgtccttccccttcatctatccgccgtacccgctggaggacggctattacatcgaaggcgccgccatcgacaccctcaacttcaagcgcctgttcgaactgcatccacacatcgactacaccgtggtgttcgacgtgctgggcagcgaccggctgctgcacccgccgcgcaatctgtacgacgcctgggttcagtccatcatcgccccgctcaccgccatcgcccgcgacgacctcaggctgttcgaggcgctgcacaaccgcgacgagcagggccagccgcgcaccgaggtgctgagaatcaatttcgacgcccacatcggcaaggaaagcgcgcgcgaagagctggactggtcgtactccaacctggccaggctgtaccaggccggctaccaggccggcaaggacgcctgccggcagcatgcgcggcaattgggcatccaggcctga

SEQ ID NO: 3910 - DNA, 300 bp, Chromobacterium substugae
atggcactacccaccgcagtcaacagccagatcaccgacgccgtcacccaggccaatgtcaaggtggtgggcgatgcccccgccatggcgatgggcgacctctaccagtccctcgcccactccgccggcatcctgtacgaaaacgccgcctcgtcgcagcaacagctcgccatcgcgggccaggccgccagcaaccagggcgtgatccagatttacagcgtggacgccggcgagccggcgctcgggccgatggacgcggccgagctggaggcgctgatccaccagctcaaatccgaatag

SEQ ID NO: 3911 - DNA, 945 bp, Chromobacterium substugae
atgcgagtcgtcgtagccttgggcggcaatgccctgcagcgtcgtggcgaagccatgaccgccgataaccagcgcgccaacgtcaaagtggccgccgagcagctggccgccgtcacccggctgggccacaacctggtgatgtgccacggcaacgggccgcaagtgggcctgttgggcctgcagaacgacgcctacgcgcgccacgtggacggcaaggtgacgccatatccgctggacgtgctgggcgcgcagaccgagggcatgatcggctacatggtggagcaggaactgggcaatgtgctgccgttcgaagtgccgatcgccaccatcctgacccagaccgaagtggacgccaaagatccggcgttcaagaacccgaccaagttcgtcggcccggtgtattccaaggacgaagccgagaagctggcggcggagaagggctgggcggtgaaggccgatggagagtacttccgccgcgtggtgcccagcccgaaaccgaagcgcattttcgagatgcggccgatcaagtggctgatcgagaagggcgtggtggtgatcgcggccggcggcggcggcatccccaccatgtaccagggcgacaagctggtcggcgtggaggcggtgatagacaaggatctggcttcggcgctgttggcgcgcgaagtggacgccgattatttcgtgatcgccaccgacgtgaaaagcgtgttcgtcggctggggcacgccggaagccaaggccatccgccatgcgcatccggacgagatggacaagctgggcttcgccgccggctcgatgggccccaaggtggaggccgcctgcgagttcgcccgcctgaccggcaagaaggcggtgatcggcgcgctggaagacatcgaaaagatcgtcaagggcgaggccggcacggtgatttccaccgcaaaggccggcatagactggtactaa

SEQ ID NO: 3912 - DNA, 1011 bp, Chromobacterium substugae
atggctttcaatctgcgcaaccgtaacttccttcgcatgctggacttcaccccgcgcgagatccgctacatgctggatctggcccgcgatctgaagcgcgccaagtattccggcaccgaacagcagcacctgaagggcaagaacgtcgccctgatcttcgaaaagacctccacccgcacccgctgcgccttcgaggtggcctgctttgaccagggcgccaacgtcacctacctcgggccgtccggctcgcagatcggcatcaaggagtcgatgaaggacaccgcccgcgtattgggccggatgtacgacgccatcgaataccgcggtttcgaccaggacatggtggaaaacgagctggccaagttcgccggcgtgccggtgtacaacggcctgaccgacgaatggcatccgacccagatgctggccgacgtgctgaccatgtgggaaaacagcgacaagccgatctcgcagatccgctacacctatcttggcgacgcccgcaacaatatgggcaactcgctgctggtgatcggcgccaagctgggcatggacgtgcgcatcggcgcgcccaagcacctgtggccgaccgacgagctggtggcggaatgccgcgaaatcgctgccaagaccggcgcccgcatcacgctgaccgaagatgccaaggccgcggtcaagggcaccgatttcatccacaccgacgtctgggtgtcgatgggcgagccggccgaagtgtgggccgagcgcatccgcctgctgaagccgtaccaggtcaacagcgcgctgatggccgccgcggaaaacccgcaggtgaaattcatgcactgcctgccggcctaccacaacagcgaaaccaaggtgggcaaggaaatcgccgcgcagtatccggagctggccaatggcatcgaggtgaccgaggacgtgttcgagtccgaggcctgcatcgctttcgagcaggcggaaaaccgcatgcataccatcaaggccatcctggtggccacgctgggcgaatga

SEQ ID NO: 3913 - DNA, 1233 bp, Chromobacterium substugae
atgaccaagtttggtgttcattccgagtgcggcaagctgcgaaccgtgatggtgtgccgtcccggcctcgcccacaagcgcctgaccccggacaactgccacgacctgctgttcgatgatgtgatctgggtggagcgcgctcagcgcgaccacgcctacatggtggagcagatgcgcgcccgcggcatcgaagtgatcgaagtgcacgacgcgctggccaaggtgctggacgacaaggccgcccgcaactgggtgctggaccgcaaggtcaaggctgacaacgtcggcatcggcatgctgcaggatctgcgcagctggctgaacgagatgccgtcgtcgcagctggccgaccacctggtgggcggcatcgccaagttcgagctgccgttcgacccgaaaggcctgttcggcggctatctcgaccagtccgaattcgtgattccgcctatccccaacagcctgttccagcgcgacccgtcttgctggatctatgaaggcgtgacgctgaacccgatgtactggccggcgcgccgccaggaaacgctgatcctgcaatcgatctaccagttccatccgtacttcgccggcaaggtgaacatctggtggggcggttgcgattccgatcacggcccagccacgctggaaggcggcgacgtgatgccgatcggcaacggcaccgtgctgatcggcatgggcgagcgcaccagcccgcaggcggtggtgcaagtggccaagcgcgtgctgcaccgcgagggcggtgccaagcgcgtgatcgcctgccagatgccgaaatcgcgcgcggcgatgcacctggacaccgtgttcagtttcctcgacatcgacctgctgtcggtgttcccggacgtggttgatgaaatcacctgcaccagcatgtacgccggcgaccgcgagggcgagatccgcttcgagcgccatgaaggcgtgaaactggtggaagtggtgcgccaggcgctggggctgaaggagatccgcgtgatccagaccggcggcgacgcctaccagcgcgaacgcgagcaatgggacgacggcaacaacgtggtggcgctggaccgccgcgtggtggtggcctacgaccgcaacacctacaccaaccgcctgatgcgcgagcacggcgtggaggtgatcgagattccggcttccgaactgggccgcggccgcggcggcggccactgcatgacctgcccgatcatccgcgacgaagtgaagctgtaa

SEQ ID NO: 3914 - DNA, 1452 bp, Chromobacterium substugae
atgtccacagaaactgcaagccaagccggtgtggcggaaggcgccgcacccaggctgaagctgggcgcgctgacggcgctggtcgttggctcgatgataggcgggggcatcttctccctgccgcagaacatggcggccggcgccggcgccggcgccatcttgataggctgggccatcaccttcgtcggcatgctggcgctggccttcgtgttccagatgctggcctcgcgcaagcctgaggtgtcgggcggcgtatatggttacgccaaggccggcttcggcgactacatgggtttcaactcggcctggggctactggatttccgcctggataggcaatgtgtcctacttcgtggtgatgttctcggcgctggccttctggattccggctttcggcgatggcaatacgcccaccgccatcgcctgcgcttcggtgctgctgtggtgcctgcacttcctggtgctgcgcggcgtgcatggcgcagccttcatcaacaccatcaccaccatcgccaagctggtgcccttggccctgttcattctgttgatcgtgttcgccttcaaggtcgataccttcagcctggacttctggggcaacgccaagctcggctccatcgtcgaccaggtgaagagcaccatgctggtgacggtgtgggtgttcatcggcatcgagggcgcttcgatgttctccggccgcgccgaaagcatgaaggatgtgggcaaggccaccgtgatcggcttcctgctgaccatcgcgctgttggtcgccgtgtcggtgctgtcgctgggcgtgatgacccagcctgagctggccgcgctgaagaacccgtccaccgcctacgtgctgcagaaggccttcggcaccttcggcgccaacctgatgaacgcgggcctggtgatctccgtcggcggcgcgctgctggcctggacgctgctggccgccgaagcgccctacctcgccggcaaggacggcgtgatgcccaaggtgttcggcaccgtcaacggcaacgacacgccggccgcctcgctgtggctgaccaacggcctaatccagctgttcctgatcatcacgctgttcagttcggccggctacctggcactgctgtcgctggccacctcgatgattctgattccctacctgctgtgcgccggctactcctggctggtggcgcaacgcggcgaaggctatgcccaaggcgagggccgcggcaaggagctgggcaccgccatcctggccaccgtctacggcggctggctgatctacgccgccggtccgaaatacctgttcctgtcgatggtgctgtacgcccctggcctgctgttctacctgtgggccaagaaggagcagggccagaagccgttcaacctgatcgaagccgcgctggccgccatcgtggtggtgctggcggtgatcgcggcctacatgctggccgtcggcaagatcggcctgtaa

SEQ ID NO: 3915 - DNA, 132 bp, Chromobacterium substugae
atggaattgctgaccctgttgatgtctgacgacgtgggccgtttgagcctgctgactatcgtagtgacgatgctggtggtgctgggcgcgctgtggatgatcttcaagaacatcaacaagcccggcaagtaa

SEQ ID NO: 3916 - DNA, 984 bp, Chromobacterium substugae
gtggaagcgcacgaaaccattctagaagccgcgctgcgccagggcgtgggcctgccgtacggttgtcgagacggcgcctgcggcgcctgcaaaggcaaggtggtggaaggcgaagtgagccaggacggcttccaggagaaggcgctgtcggccggcgaacgcgcccagggcatggccttgttctgttgcgcgcggccgcagggcgatgtcagcatcgaggtgcgcgaagtgaccggcgccggcgacatccagatcaagacgctgccgtgccgcgtggagaagatggacaagatccacgacgtggcggtgctgaagctgaagctgccggtgtcggagcgcctgcagttccgcgccggccaatacatcgacatcctgatgaaggacggcaagaagcgcagcttctccatcgccaacgcgccgcacgacgacgccttccttgagctgcatatccgccaccagcccggcggctcgttctccgactacgtgttcagccagatgaaggagcgcgagatcatgcgcttcaagggcccgctgggatcgttcttcctgcgcgaggagtcggacaaacccatcgtcttcatcgccagcggcaccggcttcgcgccggtgaagggcatcatcgagcatgcgatccatcacggcatccagcgtccgatgctgttctactggggcgcgcgcagcaaggccgacctctacatggccgatctggccgagagctggcaggcggcgcacccgcacatccgctacatcccggtattgtccgaggcgctgccggaagacaactggagcggccgcaccggcttcgtgcaccaggcggtgctggaagacttcgccgacctgtccggccaccaggtttacgcctgcggcgcgccggtgatggtggaggcggcgcatggcagcttcacccgcgagcgcggtttgccggaagacgagttcttctccgacgccttcttcctgtccaaggacatgaatggcggcaagtag

SEQ ID NO: 3917 - DNA, 918 bp, Chromobacterium substugae
atgcgtactttgctgattatcggcgccggcgatgtggcccgccgcgccctgccctctttgctcgcccattggcgggtgctggcgctatgccgccaccccgccgccgccgaatcctggcgggcgctcggtgcccggcccatcctcggcgacctcgaccgcggcgacagcctggcgcggctggccggcatcgccgacgccgtgctgctgtgcgcgccgccgccgccatccggcgcggaagacccgcgaatgcgcaagttattgtacgcgctggcaaaaggcgacagcataccacagcgatttgtctatatcagcaccagcggcgtttacggcaacgccaacggcatgctgataaatgaaactgcggcgctgctgccacaaagcgagcgcgcccggcgccgcgtcgacgccgagcggcaattgcgccgctttgttggccgccacggcggcgcgctgacgatattgcgcgcgcccggcatctacgccgacgacaggctgccgctggcgcgcttcgccaacgcttcgccgctgatcgtcgacgcggaggacagctacagcaaccacatccacgccgacgacctggccagcctgtgcgccgccgcactgcgccgccgccagggcatccgcgtctacaacgcctgcgacgacctgccgctgccggtcagccgctggtaccgccagttgggcgctacgctccagctgcccagcctgcccgagctgccgcgcgccgaagtccaggcgcgggtgacgccgcagcaatggtcgttcctcgccgaatcgcgccggctggacaatctgcgcatcaaacgggaattgggcgtgcggctgcgctggcccagcgtgctcgactatctggcggcgctggcccaggatgagccgcgcaaggcggcaatactcgcaagccaggccaagattcggtaa

SEQ ID NO: 3918 - DNA, 768 bp, Chromobacterium substugae
atgagccgcgcaaggcggcaatactcgcaagccaggccaagattcggtaacatcgcggtttttttgagttttcagcaggccagcaaaatggaaaatccggctttcaatcgcgcgatccgcagctttgtgctgcgccagggccacctgtccgcaggccagcaacgggctatggacgaaggcatgcccaagtggggcatagcctaccatccggagacgatcgatctggaacaggccttcggccgcgccgcgcccaaaatcctggagatcggcttcggcatgggcggcgccaccgccgaaatcgccgccgccaacccgggcaacgactatctgggcattgaagtgcatggccccggcgtaggcaatctgtgcaaattgatcgcagagaaggaattgaccaacctgcggctgatgcgccacgacgcggtggaagtgctggacaatatgctggccgacggctgcctggacggcgtgcacatcttctttcccgacccttggcacaaaaagcgccacaacaagcgccggctgatccaggcgccgctggtggaaaagctgctgcgcaagctgaagccgggcggctatatccatgccgccaccgactgggaagactacgcgatccagattctggaagtgatgaacagcgtcgatggcctggaaaacagcgccgacggctacgcgccgcggccggactaccgtccgctgaccaagttcgaagcccgcggcatcaagcttggccacggcgtgtgggatgtgatcttccgccgcaaataa

SEQ ID NO: 3919 - DNA, 480 bp, Chromobacterium substugae
atggccacgttctacgatttcaccacgcgggccgcggacggcaccgtctgcgacttgtcggcgtatcgcggccaagtgctgctggtggtcaataccgccagcgaatgcggctacacccgccagtacgccggcttgcaggagctgcaggatttcttcgccggccagggattctcggtgctcggctttccctgcaaccaattcggcggccaggagccgggcggcgccgacgagatcctggctttttgccagagccgcttcggcgtcagttttccgctgatggcgaagctggaagtcaacggcgccggcgccgatccgctgtggcgctggctaacccaggcggactccgaccacccgcatccggtgaagtggaacttcaccaaattcctgatcgacgcgcgcggccgggtggtgaagcgttacgaaccggcggtggagccgcatgagctggtagacgacatcaaggctttgctggcgaggtga

SEQ ID NO: 3920 - DNA, 480 bp, Chromobacterium substugae
atgctgttcaatcccagccgccaggacgcccgccgctttttcttcgatacctggagcaagtccaaatccggccaggctttgtccgatctggaacaaatcgtcctatccattcttatagaccaccctgagtatcatcccatcctggaaaacccggaggccttcctggaacaggagtggacgccggacatgggcgagaccaatcccttcctgcacctgggcctgcacgtcgccatcgccgagcagcgctcgatagaccagcccttcggcatccgcgcgctgtacgcgcagctggcgttgcgccacggcgacgagcaccgcgcccagcacgaaatcatggaatgcctgggcgagatgatctggcacgcccaacgctacggcggcggccccgacgtcaaccgctacatttcctgcgtgcgcggcaaactggacatgggcgaagaagaacagccgcgggtcaaccccaacgatgtccctgactaa

SEQ ID NO: 3921 - DNA, 954 bp, Chromobacterium substugae
atgacttctcgcaacattgtatttctggaccgggacagcctgcctgtcccggttcccgttttcagcttccccgcccattaccgcgaatatccggccaccgccgccgagcagctgctggagcacgccgccggcgccgaagtgctgatcagcaacaaagtgccgctcgaccgcgaggcgctggcgcggctgccggggctgaagctggtcgccatcgccgccaccggttacaaccacgtggatgtcgaggcctgccgcgagcgcggcatcgcggtgtgcaatatccgccactacggcgaccacaccgtggccgagcatgcgctgacgctgatgctggcgctgatgaaaaacctgccggcctaccagcgcgacgtggcggccggggtatggagccaggccaagcagttttgccatttcggcgcgccgatacgcgagatgcgcggcgcggtgctggccatcatcggctcgggcggcataggcggcgaactggccgcgatggcgcgcgctttcggcatggaggtgctgttcgccgagcgcaagggcgcgggcctggccagggaaggacgggtgccgttcgacgcggcgctggcgcgcgcggacgtggtgtcgctgcactgtccgctgaccgacgaaacccgcggcatgatcgcgcaggcggaactgatggcgatgaagccgggcgccatcctgatcaacaccgcgcgcggcggcctggtggacgaggcggatctggtggcggcgctgaagtacggccagctgggcggcgccggtttcgacgtgctgagcagcgagccgccggcgccggacaatccgctgttgaaagcgcggctgcccaatctgatcgtcaccccgcatgtgggctgggccagcgccgaagcgatgcgcaggctggcggcgcagctggcggagaatatcgaagcctttgtccgcggcgaggcgcgcaatcggattgtgtaa

SEQ ID NO: 3922 - DNA, 714 bp, Chromobacterium substugae
gtgtggttgaagaaaggattccgcgacttccagaaagcgccggccgactgcctgttctacggcgcggtgttcgtgctgatgggctacttgctgggcgtttacgccgagcaggcgccggagctggtgatcaccttcgccaccatcttcctgctggccggccccttcctcgccatcggcatctacgacatcgccaagcagatggaggcctttgatggccacggccgggtgaagctgctgcacagcatggcggcctggcgcgtcaacatgccgggtttcagcttgtacgcggtgctgttggcggtgctggtgttcggctggttccgcgtgtcgctgctgatgttcgcgctgttttacgacaccgcggcgctgcccaacctcaacgagatcgtcgccgacgcgttcaatccggacaatctggaattcctgatcgcttatttcgccgtcggcttcctgttcgcccaggtcgtgttctcggtcagcgtggtgtcgatcccgctgctgttggacaaggaagtggacaccatcaccgcgatgatagccagcgtgcaggcggtgttccgcaatgtgctgacgatggggctatgggccgttatcattgtggcgatgacggtggtgggcttcgccacctattacctgggcctgatcatcatcatgccggtgctggcgctggccagctggcatgcttatcgggatttgatcactttcgagcgatga

SEQ ID NO: 3923 - DNA, 327 bp, Chromobacterium substugae
atgagcgaactgatcatcgaagaactggttgtcggcgaaggcgccgaagcggtagccggccaggaagtcaccgtccactacaccggctggctgaccgacggcaccaaattcgactccagcaaggaccgcatgcagccgttcagcttcccgctggccgccggctacgtgatcaagggctgggaccagggcgtgcaagggatgaaagtcggcggcaagcgcaagctgaccatcccggccgaactgggctacggcgcccgcggcgccggcggcgtgattccgcccaacgccaccctggtgttcgaagtggaactgctgcaggtgggctga

SEQ ID NO: 3924 - DNA, 618 bp, Chromobacterium substugae
atggatacactgcagatacttctcgactttttcaccggttatggctacctggctgtatttgcggtgttgctggtttgcggtttcggcgtgccgattccagaggacattaccttggtggccggcggcgtgatttccggcctggggtatgccaatgtgcattacatgttcctggtgggcatggccggcgtgctggtgggcgacggcatcatgttcatggccggccgcaccttcggcaacaaggtgctgaaattccgcccgatcgcccgcatccttacccaggagcgtttcgaggcggtgcaggagaagttcgccaagtacggcaactgggtgctgttcgtcgcccgcttcctgccgggcttgcgctcccccatcttcatcactgccggcatgacccggcgcgtgccttactggcgtttcctgctgatggacggcttcgccgcgctgatttcggtgccggtgtgggtatacctcggttattacggcgcggccaaccgcgaatggctgatgacgatggtccatcgcggccaggccggcattctcggcgcggtggcgctgctgctgctggtggtgggcggggtctggctgaagcgccgccgggtgtcctgcgcgaagaagtaa

SEQ ID NO: 3925 - DNA, 1074 bp, Chromobacterium substugae
atgacacgccctatccggctggagatcgacctctccgccatccgccacaatttcctgtttacccgccagcgcgctcaagccaagcgcctgttcgccgtggtcaaggccaatgcctacggccacgggatattggacactgcaaaggcgttggccgacttggccgacggttttgccctgctcaatatcgaagacgccgtcgcgctgcgcgaagccggcatcgatcgccccatcgcgctgctggaaggcccgttcgacgccgccgaagccgccgccatgggcgaatatcggctctgcggcgccgtgcactcactagaacagatggcttggctggccaaaggttccgccgcgcggccggcggaagtctggctgaagatcaacagcggcatgaaccggctgggcttccgccccgagcaagccggcgacgcgctggcccgcttgcgcgccgaacccgccatccgccccgccgccatcatgacccacttcgccaccgcggacgaagcctatggcgtcgacgagcagtggcgcgacttcgcaacgctggcccgcgacagcgccctgccggtcagcgccgccaactccgccgccctgctgcgccatccgcatacccacggcgacatcggccgccccggcatcgtcctgtacggcgcttcgccgtttgaggactccaccggcgcggcgctgggcctgcggccggcgatgacgctgtcggccgacatcatcgccgtgcagcagctgcgcaacggcgacgcggtcggctatggccgccgtttcgtcgcagaccgcgacatgcgcatcggcatcgtcgcctgcggctatgccgacggctatccgcgcatcgccgccaacggcaccccggtggcggtggacggcgcggccagcggcacggtgggccgggtgtcgatggacatgctggcggtggatctcagccatctgccgcaggccggcgtcggcagccgcgtcgagctgtgggggccgcaagcgccgatcgagcgcgtggccgccgccgccggcaccatcagctatgagctgatgtgcgcggtggcggcacgggtgccgcgcagcctgcgcgcttaa

SEQ ID NO: 3926 - DNA, 1989 bp, Chromobacterium substugae
atgaagcgattgttcaccagccaacccgcgcgcggcgggttggctttgttgctggccgcggccagcctgccggccggcgcggcctgttcgacggccgcgacgcaacgcatccaccagatccagggcgcgggcgccgccagtccgctgcagggtcagaccgttgtcgcgcagggcgtggtcagcggcctgctctacggcaaggacggcccggtgggcttcttcatgcaggaagcgccgcaaaaccaggatcaggacccggccacctcggaaggcatctatgtctacaccggcaagctggcggtgcctgcgctgaggcgcggcgatgtggtcggcgtgcgcggcaaggtggtggagttcgcccgcaagggcgacgccggcagcgaaacgcagctgcagccggcggcggccgccgacgtgcaagcctgcggcgcgcaaggcgcgctcgcgttgacgccgctgcgcctgccgctgagcggggatccggctcagctggaggcgctggccggcatggcggtggctttagagcagccgctgtacgtggctgacagctacaactacggccgttacggcgaactgacgctgtccagccagtcgcggcaatggctgccgacccagctgcatccgccgggcagcgccgcggcccaggcgctgcgcgcggccaatctgcgcgaccggctgctgctggacgatggcaaaacctggcagaacgccgacgcctggctgcccggcccgggcggtctgtccgcggcccacacgctgcgggtgggcgaccgtctggacggcttgaccggcgtggtgtccttcagcaacggcggctaccgcatccagcccttggacttgccgcgcgtagtggccgccaatccgcgcccggcgtcgccggcccggctggcgggccaattgcggctcgccagcttcaatgtgctcaacttcttcaacggcgacggactgggcggcggctttcccaccgcgcgcggcgcgaagacccgcgccgatttcctgcggcagaaagccaagatcgtcagcgccatccgcgcgctggacgccgacgcggtggggttgatggagatagagaatgacggtttcggtctgcagtcggcgatccaggaactggcggcggcgctgaacgatggccagcctgcggacaagcagtaccgcttcgccgctcccggcgcggagaggataggcagcgacgccatctcgcccggcatgctgtaccggccggcgcggctgagcccgcaaggcgcggccgaggtggtggcggtgggcgacccggcgcgcaatcggccgatgctggcgcagactttcgctctgggcgacggcagaaagctgacgctggcggtgaatcatctgaaatccaagggcagcagctgcgccgacagccaggtggacggcgtggccgatatcgatctgggcgacggccagggcaattgcaacctcacccgctcgcaggcggcgcgcgatctgctcaaatgggcgcaggcgcgcgcgcaggggccgcagtccggcttgctggtgatgggagacatgaacgcctacgccaaggaagacccgatccggattctggagcagggcgggctagccaaccagctggcgcgtttccagcccgacgcctattcctatgtctacggcggcgagtccggcaatctcgatcacgtgctggccgacgcgacgctggggcaatgggtgagccgggcgggggagtggcatgtcaacgccgacgaacccggcgtcctggaatacggcagcgagttcaaatcggccgcgcaacaacaaaactattacgccgccgatgcctaccgctcgtccgaccacgatcccttgtatgtcgacctgcaggctgccgcgggcgcgccgcagcggcaggatccatcgttgccgccatcgtcggccagtccggggggggccgccggcagcgtagcggccgccgatccgctgctgctggccttgctgggactgggcggcctgctggctgtccgacggcggcggtga

SEQ ID NO: 3927 - DNA, 1335 bp, Chromobacterium substugae
atgagtcgcaaatactttggcaccgatggcgtgcgtggcgaggtcggcaagtttccgatcaacccggaattcgtgatgaagctcggttacgccgccggccgcgtgctggtcaaccacgaccgggacagccgtcccaccgtgctgatcggcaaagatacccgcatctccggctacatgttggaggccgcgctgcaggcgggcttcaccgccgccggcgtcaatgtgctgctgaccggcccgctgccgacgcccggcatcgcctatctgacccgcgcgttgcggctggaagccggcgtggtgatttcggcctcgcataatccgttccaggataacggcatcaagttcttcgccgaaggcggcaacaagctggatgacgcgctggagctggagatcgaagcgatgctggagcagccgatggcgaccaatccgtcgcaggagctgggccgcgcccgccgcatcgacggcgccgccgagcgctacatcgagttctgcaagagcaccttccccaatgagctcagcctgaagggcctgaagctggtggtggactgcgccaacggcgccacctaccacatcgcgcccaaggtgttccacgagctgggcgccgaattggtggaaatcggctgcgaacccaatggctacaacatcaacgacaaggtgggcgccacctatcccaaaaccctgcagctggcggtgctggaacaccatgccgacttcggcatcgcgctggacggcgacggcgaccgcctgatcatggtggacgccgccggccgcgtctacgacggcgaccagctgatctacgtgatcgccaaggcgcgcgcggcgaagggcgaactgaaaggcggcgtggtcggcaccgtgatgaccaatctggcgatggagctggcgctgcaaaagcagggcgtgcccttcggccgcgccaaggtcggcgaccgctacgtgctggaaatgctgcatggcgatggctggcaggtgggcggcgaggcgtccggccacatcctgtgcctggacaagcacagcaccggcgacggcatcatctccagcctgcaggtgctggccagcgtcaagcagctgggccttggcctggcggaaatctgcagcgactggcagccgtttccgcagacgctgatcaatgtgcgccacaacggctgcgactggaagcaggcggcggcggcgccgctggccgaggccgaggcggcgctgcagggccgcggccgcgtggtgctgcgtccgtccggcaccgaaccggtggtgcgggtgatggtggaggccgacgacaagtcgctggctgacaactgggcgcgcgccatcgcgcaggcgatcgagcgggtggcctga

SEQ ID NO: 3928 - DNA, 837 bp, Chromobacterium substugae
atgaaaactttgctgtgcgggcgtttcacgctcgatctgtcgcgcccgctgctgatgggcatcctcaacgtcacgccggactcgttttccgacggcggccgcttcagccgcgtcgacgccgcgctggccagagccgaggcgatgctggccgaaggcgcggacattctggacatcggcggcgaatccacccgccccggcgcgcctttcgtcagcccggaagaagagatggatcgggtgctgccggtgctggagcagctgcgcggcatcggcgcgccgctgtcgctggatacccgccgcgcggcggtgatgcgcgaggcgatcgcattggacgcggtggacctgatcaacgacgtgtcggcgctggaggacgaaggcgccttggcgctggcggcgcgcagccaggcggccatctgcctgatgcacaagcagggcaatccggacagcatgcaggacaagccggcatacgaagacgtggtggccgaggtggcaggctatctgcagcgccgcgtccagctgtgcctggacgccggcatcgcccgcgaacggctgctggtggatccgggcttcggcttcggcaagacgctggcgcacaacctggcgctgctcaagcggctggacgagatcgagcgcatcgccggcgtgccgcagctggtgggtctgtcgcgcaagtccatgctgggcgcgatcaccggcgaggaaacgccggccgagcgcctgggcgctagcgtggcggcggcgctggaatcggcgcggcgcggcgcggcggtgatccgcgcgcacgacgtcaaggccacccgccaggcgctgcaattatggcaagccttgcgggaatcttga

SEQ ID NO: 3929 - DNA, 1914 bp, Chromobacterium substugae
gtgaacaatatcggcaaaaacatcgccatctgggtaatcatcggcctggtgctgatgacagtcttcaatcagttcaacaagcgccaggacacccagaaccagctcgagtactcgcagttcgtcagcgatgtcgagtcgggcaaagtgcaatccctgaccatcgaggggcatccgctgcgcggccaatggctgaagggcaaattgaccgacggcacggctttctccacctatgcgccgtatgatccggagctggtgggcgacctgatcaagaacaacgtgcgcttctccgccaagccggaagaagagccttcgatgctgatgagcatcttcatcagctggttcccgatgctgctgctgatcggcgtgtgggtgttcttcatgcgccagatgcagggcggcggcaagggcggcgcgttctcgttcggcaagagcaaggcgcgcatgctggaccaggacgccaacaccgtggtgttcgccgatgtggccggctgcgacgaggccaaggaagaggttaaggagatcgtcgactacctgcgcgatccttcccgctaccagagcctgggcggccgcatcccgcgcggcatcctgctggcaggcagtcccggcaccggcaagacgctgctggcgaaggccatcgccggcgaagccaaggtgccgttcttcagcatctccggctccgacttcgtggaaatgttcgtcggcgtcggcgcggcccgcgtgcgcgacatgttcgagcaagcgaagaagaactcgccgtgcatcatcttcatcgacgaaatcgacgcggtcggccgccagcgcggcgccggcctcggcggcggcaacgacgagcgcgagcaaacgctgaaccagctcttggtggagatggacggcttcgacaccaattccacggtgatcgtgatcgctgccaccaaccgtccggacgtgctggacccggcgctgcagcggccgggccgtttcgaccgccaggtggtggtgccgctgccggacatccgcggccgcgagcagatcctgaacgtgcacatgcgcaaggtgccgatcgccgccgacgtcaacgccgaggtgatcgcgcgcggcacgccgggcttctccggcgccgacctcgccaacctgatcaacgaggccgccctgttcgccgcccgccgcaacaagcgcctggtggacatggaagacctggaatccgccaaggacaagatcatgatgggcgccgagcgccgcagcatggtgatgaccgaggaagagaagaagaacaccgcctaccacgagtccggccatgcggtggtcgccaagctgctgccgaagtccgacccggtgcacaaggtcaccatcatcccgcgcggccgcgcgctgggcgtgaccatgcagctgccggagcaggaccgcttcgcctacgaccgcggctacctgatggaccgtctggccattttgttcggcggccgcatcgccgaagagctgttcatgaaccagatgaccaccggcgccagcaacgacttcgaacgcgcgacgcagatggcgcgcgacatggtcacccgctacggcatgtcggacaagctgggcccgatggtgtatggcgaaaacgagggcgaagtgttcctcggccgctcgatcaccacccacaagaacctgtcggaagcgacgctgcagcaggtggaccaggaaatccgccgcatcatcgacgagcagtacgcgctggcgcgccgcctgctggacgagaaccgcgacaaggtggaggcgatgaccgccgcgctgctggagttcgagaccatcgacgccgagcagatcaacgacatcatggacggcaagccgccgcgtccgccgaagccgggcagcagtttcgccgccaagcctgaggacaagccggccgagccgacggctccggtcgaggcgacgtccgatccggcccaggaagtctga

SEQ ID NO: 3930 - DNA, 588 bp, Chromobacterium substugae
ttgcaggaacacgtcaacgatcaatatgtgcagatggcgcaaaaggatggctaccgcgcccgcgccgcctacaagctgctggaaatcaacgacaaggacaagctgattcgtcccggcaccgtgctggccgacctcggctccacgccgggcagctggtcgcaggtggcggcgcgcattgtcggcgagcagggcaaggtgttcgcgctcgacatcctggatatggacccggtgccgggcgtcagcttcatccagggcgacttccgcgaagaggacgtgctcagacaattcgaagctttgctggacggccgggcgcttgaccttgtaatttccgacatggcgcccaatatgtcaggaatgagcgccatcgatcaggccagaagcttcctgctttgcgaactggctctggattttgcgcgcgatcatttgaaacccggcggccactttctcgtcaaagtgttccagggcagcgattttcagtcctacctcaaggccatgcgcgagctgttcgacgaggtggtcacccgcaaacccaaggcatcgcgcgatcgttccagtgaaatctatctgctgggcaagggtcgccgctga

SEQ ID NO: 3931 - DNA, 321 bp, Chromobacterium substugae
atgaaaattgacctcaagccgtttcagcgcaagtacctgcaaggcctggcgcacggcatcgacccggtggtgatggtaggcaacaacggcctgaccgaagccgtagtccgcgaaatcgccatcagcctggacgcccatgaattgatcaaggtgcgcgtgcaaggcgacgaccgcgaagcccgcgtcgccatgttcgagcagatctgcgaagaactgggcgccgccccggttcagcacatcggcaagctgctggtgctgtggcgccccagcgacaagcagcgcatcgcgctgccgaagaacaagcaggcgctcaagggctga

SEQ ID NO: 3932 - DNA, 387 bp, Chromobacterium substugae
ttgtgggtgatcggcatcatcgtggcgccggtcttgttcaagtcgctggacgcggccacggccggcatggtggcgggcaggttgttcgccgtcatcgcctgggtgggcctggtgtgcggcgtgatcctgctggtggaccaggtgtggcgcaacggcgtggccgggctcaagcacggcggcttctggctgatcgtcggcatgctggtctgcacgctgatcaaccagttcggcgtggcccccatcatcgtcacgctgaagcagcagatgaaccacgcggccgaaggcctgttcggcggcggcttcgccacctggcacgcgatctccagcctgatctacctgctgcagagcctgctgggcctggcctacgtctggcaggaccgcggctag

SEQ ID NO: 3933 - DNA, 477 bp, Chromobacterium substugae
atgatcaaagtcccgttgactgtacgcggcgccgagcttctgaaggaagaactgcaacgcctgaagagcatcgagcgtccggcggtgatcgaggccattgccgaagcgcgttcgcatggcgacctgtcggaaaacgccgagtacgacgccgccaaggagcgccaggctttcgtggagggccggatcgccgagctggaagccaagctgtccaacgccgtgatcatcaatccgtccgaactggacgccgatggccgcgtggtgttcggcgccacggtcgacctgatggacctggaaaccgaagagagcgtcacctaccagatcgtcggcgacgacgaagccgacatcaaggtcagcaaggtgtcggtcaattcgccgatctcgcgcgcgctgatcggcaaggaagccggcgacgtggccgaagtggtggcgccgggcggcatccgcgaatacgaagtactggacgtcaaatacatctga

SEQ ID NO: 3934 - DNA, 3210 bp, Chromobacterium substugae
atgccaaagcgtaccgacattaaaagcatcctgatcattggcgccggccccatcgtcatcggccaggcctgcgaattcgactattccggcgcccaggcgtgcaaggccctgcgcgaggagggctacaaggtagtcctggtgaactccaacccggccaccatcatgaccgacccggacatggccgacgtcacctacatcgagcccatcacctggaaagtggtggagaagatcatcgccaaggagcgtccggacgccatcctgccgaccatgggcggccagactgcgctgaactgcgcgctggacctggccaagcacggcgtgctggaaaaatacaaagtcgagctgatcggcgccaccgaagacgccatcgacaaggctgaagaccgcggccgcttcaaggaggcgatggccaagatcggcctgtcctgcccgctgtccttcgtctgccacacgatggaagagtcgctggaagcgcagaccaaggtgggcttcccgacgctgatccgcccgtccttcaccatgggcggctccggcggcggcatcgcctacaacaaggaagaattcctggcgatctgcgagcgcggcttcgaagcctcccccacccatgagctgctgatcgagcagtcggtgctgggctggaaggaatacgagatggaagtcgttcgcgacaagaacgacaactgcatcatcatctgttcgatcgaaaacttcgacccgatgggcgtgcacaccggcgactccatcaccgtggccccggcgcagacgctgaccgacaaggaataccagatcatgcgcaacgcctccctggcggtgctgcgcgagatcggcgtggataccggcggctccaatgtgcagttcgccaccaatccggccaccggcgagatgatcgtcatcgagatgaacccgcgcgtcagccgttcctccgcgctggcgtccaaggccaccggcttcccgatcgccaagatcgccgccaagctggcggtgggcttcacgctggacgagctgaagaacgacatcaccggcggcgccaccccggcttcgttcgagccgtcgatcgactacgtggtcaccaagatcccgcgtttcgcgtttgaaaaattcccacaggccgacgaccgtctgaccacccagatgaagtcggtgggcgaagtgatggcgatgggccgcacgctgcaggaatcgatgcagaaagcgctgcgcggcctggagaccggcttgtccggcttcgaccctgtcaccaccgacgaagccgccatccgccacgagctgggcaccccagggccggagcgcatcctatacgtcgccgacgccttccgcatcggcatgagccgcgacgacatccacgccgtcagcaagatcgacccgtggttcctggcgcagatcgaggacctgatcggcgaggaaaaagcgctgggcggccgcaagatcgaggaactggactacgccgagctgcgccgcctgaagcgcaagggcttctccgaccgccgcctgggcgaattgttgggctctgatcaggccgcggtgcgcgccaagcgctgggcgctgggcctgcatccggtgtacaagcgcgtcgacacctgcgcggcggagttcgccaccaacaccgcctacatgtactccacctatgaggaagagtgcgaatcccagcccaccgaccgcaagaaggtgatggtgctgggcggcgggccgaaccgcatcggccagggcatcgagttcgactactgctgcgtgcacgcggcattgagcctgcgcgaatccggcttcgagaccatcatggtcaactgcaatccggaaaccgtgtccaccgactatgacacctccgaccgcctgtacttcgagccgctgacgctggaagacgtgctggagatctgccgcatcgagaagccgttcggcgtcatcgtccagtacggcggccagacgccgctgaagctggcgcgcgcgctggaggccaacggcgtgcccatcatcggcaccacgcctgacatgatcgacgccgccgaagaccgcgagcgcttccagaagctgttgcaggagctgggcctgaagcagccgccgaaccgcaccgcgcgcgcgccggccgaggcgatgacgctggccgaggagatcggctacccgctggtggtgcgtccgtcttacgtgctgggcggccgcgcgatggaaatcgtccacgagccggccgatctggagcgctacatgcgcgaggcggtgaaggtgtccaacgacagcccggtgctgctggaccgcttcctcaacgacgccatcgaagtggacgtcgactgcgtgtccgacggcgagcaggtggtgatcggcggcatcatgcagcacgtcgagcaagccggcgtccactccggcgactcggcctgctcgctgccgccgtacagcctgttcccggcgctgcaggatgaaatccgccgccagaccgtggcgatggcccgcgcgctgaatgtggttggcctgatgaacgtgcagttcgcgattcagggcgaaaccatctacgtgctggaagtgaacccgcgcgcctcgcgcaccgtgcccttcgtctccaaggtgacctcggcgccgctggccaagatcgccgcccgcgcgatggccggcatcaagctggccgatcaaggcttcaccagcgaggtgattccgccgttctacgcggtgaaggaagcggtgttccccttcatcaagttcccgggcgtcgacaccatcctggggccggaaatgaagtccaccggcgaggtgatgggcgtgggcaagaccttcgccgaagcctacgtcaaggcgcagctgggcgccggcgaccgcctgcccaagaccggcaaggtgttcctgtcggtgcgcgactccgacaagaacggcgcggtggacgtggcgcgcgaactgcaacggctgggcttcggcatctgcgcgacgcgcggcaccgccaagcatctgaccgaggccggcctgatcgtgcaggtggtgaacaaggtgaacgaaggccgtccgcacatcgtcgacatgatcaagaacggcgaagtggatctggtggtcaacaccgtggatgaaaagcgcctggcgatccaggacagccactccatccgccgctcggccctgcaggcgcgggtgccgcaatacaccacgctgtccgccgccaaggcggtgtgcgtggggatgaagcacgccgaagccttcgacgtctacagcgtgcaagagctgcacgcgcagatccgcggctga

SEQ ID NO: 3935 - DNA, 654 bp, Chromobacterium substugae
atgttaggcattaccgacctcactacctatctgatcggcacgctgatcatcgtcctgctgccggggccgaacatgatgttcgtgctgtcggtggcggcgcagcgcggcatccgcgccggcttttccgccgccgccggcgtgatgagcggcgacttcaccctgatgacgctggccgccatcggcgcggcgggcctgctgcaggccaatccggcgctgttcgcggtgatcaagtacctgggcggcggctatctcgcctggctgggcttcaatatggtgaagggcgccatcgtcggctggcggcgcatgcggcgcggcgaggaagcgtcggcggcgccgtcggcgctggccagcggccatccgtaccgcaaggcgctgctgatcagcctgatgaatccgaaggccatcctgttcttcgtgtccttcttcgtccagttcgtcgatccgggctacccgtacccggcgctgactttcgccggcctgggcctgatcgtgcaggtgtgcagcctgagctacatgacgctgctgatcctggccggcaaccgcctggccgcggccttccgccgccgccgcaagctgtcggcggcgctgggcggctcggtgggcgcggtgttcgtcggcttcggcgccaagctggcggcggcggggctgggttga

SEQ ID NO: 3936 - DNA, 1038 bp, Chromobacterium substugae
gtggtattcaataccgccatcaccggttaccaggaaatcctcacggatccttcctataccaggcagatcgtcactctgacctatccccatatcggaaacgtcggcgcgaattcggaagataccgaatccagcgccgtttttgcatccggcctgatcatccgcgatctgccgctgctgcacagcaacttccgcgccgaagactcgctgtccgactacctgaaaaagcataacgtcgtcgccatcgccgatatcgacacccgccgcctgacgcgcatcctgcgcgagaagggcgcgcaagccggctgcatcatggccggcgacatcgacgaggccaaggcgctggaactggcccgcggtttcggcagcatggccggccaggacctggccaaggttgtcagctgccgtaaaccgtacgcctggaccgagaaacaatggcagctgggcgccggctaccaggtgcagtcgtccacccgtttccacgtggtggcctacgacttcggcgtcaagcacaacatcctgcgcatgctggccgagcgcggctgccagctgaccatcgtgccggcccagaccccggccaaggacgtgctggcgctcaatccgcacggcgtgttcctgtccaacggcccgggcgatccggaaccgtgcgactacgcgatcgacgccatccgcgaaatcctggaaaccaagctgccggtattcggcatctgcctcggccaccagttgttgggcctggcttccggcgccaagacctccaagatgaagttcggccaccacggcgccaaccacccggtgcaggacctggactccggccgcgtgatgatcaccagccagaaccacggcttccaggtcgatgaaaccagcctgccggccaatgtccgcgtcacccaccgttcgctgttcgacggcacggtgcagggcatcgcgctgaccgatcgtccggcgttctcgttccagggccacccggaagcgagcccgggaccggaggacgtggcttacctgttcgaccgtttcatcggcgcgatgaccgagcgcaagtga

SEQ ID NO: 3937 - DNA, 738 bp, Chromobacterium substugae
atgatcaagtggctggggctggctgtcctgctgctggccggcgcgctgtcggcgctgccggccagcctgctggcggtgccggtggcgcgctggagcgatggccgctggggcgtcagcgacgccaggggcacggtctggaacggcggcgcccagctggtgtacctggggccggccggcgaagtgcagggcatgagcccgctaggctggcaatggcagcccaaggccttgttgtccggcctgttggtctggcatctggacagcgccggccagccgggcttgctgcagctgggcttgggcaagcaggaagtgcgcggcctggcgttgtcgatgccggtggcggcgctggccaatctgtccaaaacttggcaggtggccaggctgggtggcgaattgcagctgaacattccccaattggcgcgccaaggcaaggaagtcagcggcgcggtgcagctggcttggcgcggcgcggcgtcgccgctgaccacggtgctgcctttcggcagctaccagctggacgccgccggcacgccgcaggggctgaacttcacgctgtccacgctggaagggccgctgatgatcaacggccagggcagctggccagccggcggcgccttcagcatggcgggcaccgccgatagcccgccggaacagtacgacgcgctcaagccgttgttgctgatgctgggccagccggcgggccccaccagcgtcagctggcaggtgaagccggggatgtga

SEQ ID NO: 3938 - DNA, 510 bp, Chromobacterium substugae
atgacagcctacaagcaacaatttctcgactactggcagcaacgcagcgcgcgcgagcagcgcctgctggcggcgatggcgctggtgctgggcgcggcgctgctgtacctggcggtatgggagccggccagcgcctcgctgcagcgcaaccgcgcgtcggtggcgcggctgcaggccgagctgggcgcggtgcgcagcctggccgccgaggccgacaagctcaagcgccagccggcgcagacgccgctgccggccaaggaactgattccgctattgcagcagaccgccaagagccagggcctggcggtcgccgcgctgcagttcagccaggacggcgagtccggcgtcgacatggaaggcgtggtggggttcgacgcctgggtgcgtttcgccggcgtgttggcggcgcagcagcaggtgcgggtggtgaacgtgaagatggaggcgcagccggtgccgggccaggtcaagatcaaggcgctgctggcgcacgcgggagcggcggcatga

SEQ ID NO: 3939 - DNA, 1191 bp, Chromobacterium substugae
atgacgacgctgcgactctatctgcgggcgggctggcccgatagcgagccgggcttgccctgggcgctgctgggcgcccgcggcgagctgagcgcccagggcgacagcgcgccggggggctggcccaaggccgaccattgcgaactggtgctgccggccggccgcaccctgttcgccgaagccaggctgccggacgcggtgaagcagccgacgccggcggtgatgggcttcgcgctggaagaggggctgggcaacgatccgggcgccaatctgtacgcgccggggccgacgctggccgacggccgccgcctggtggcggtgaccgaggcggcggcgctgcgccgagcggtggcgatgctgaaaagcctgggccgcttgtgcgaccgcatcgtaccggaggagtgcctgctgccgccgccgccggccgacggctggagcgtgacggcgctggccgaccgctatctggtgcgcgcggcctcgccgtacgccgcttgcctgccgcgcggcggcgcggcggtggagcaggcgctgttcgcctcgctgctggcgctgtcgccgccggcgcggctgcaactgcacggcgtggagcgtcccgaggagctgctgagccgcctgccgggctggcagggcgacagcgcgcgcggcgaagcccacgactggaaacaagggaaacgcgagggcggcttcgacttcgcccagggcgagctggcggccaaccgccgctggcgcgactgggcgccgtcgctgaagcgggccggctggctgctgggcggcctgctggcggcgcaattgctgctgacgctgtgccagtccggctggtacgcctggcagaagcacagcttgtcgcagcagatcaagagcgccgccgcgccgtggaccggcggccaggcgatgccgggcagcagcgcgctgctgatgacgcgcgcggtcgacaagctgcggctcagccacggcttgccggcgcgcgacgacatgctggagctgatgggcgcgctggccgcggccagcggccgcgatctgcaagcgcgctcgctggagtacgaggccggccggctgaagctgcaggtgaacgaggtgccggcggaaagcctggcgcgctggcgcaaagtgctggcggcgcgccagatcatgctggatgcgacgagcagccagcctggcagcaaacaactggtggtggcgcgggagccgtga

SEQ ID NO: 3940 - DNA, 993 bp, Chromobacterium substugae
atgagacggcggcaatccggcatggcggtgatcatggcgctgctgatcgtggcgctggccaccaccgcggccagcctggtgctgtggcagcaggggctgtggtggcaccagctggaaaacgacaagagccgcgcgcagctgcggctggtggccgacgccggcctgggctgggcgatggagattctgcgcttcaacagcgggccggccggcaacggcgtggtggcgctgtcgcagctgtgggcgcagcccttgccgcaaaccgaggcccagggagtgaaggtgagcggctcgctgtccgacctgcaaggccgcttcaatctcaattcgctggtggcgaacggccagaccaatacccgccaggtggtgttctacaagcgcctgctggtgacgctggggctgcctagcaagctgtcggagccgctgctcaagtcgctgcgcggcggccgggaggacgatggccgccagccggcggcagacagcggcaacgcggccgcgccgcagcccaaccatccgctgctgcgggtggaaatgctgcgctggctgcccggctacacgccggaagtgatggagaagctggcgccgcatgtggcggcgctgccgcccggcgtcagccagatcaacgtcaataccgccaccgacatggtgatgaagacgctgctgccggggataggcgacggcaatctgctggtgctgttgaaccagcgcaagagcaattatttcaaggacgcggccgacttcaaggcccgcttgccgggcgcggtggccgtcgccgacaccgactacggcgccgcgtccagttatttccagctcgacagccgctccagcttcggcaaggcgcgcctgcagatgcgagcgatgatttacagtagcccgaacgccgtcaagctgttgtggcggcaggacggcaatgacggccgcagccagtcggcgcggcccggtggagaaaaacatgacgacgctgcgactctatctgcgggcgggctggcccgatag

SEQ ID NO: 3941 - DNA, 585 bp, Chromobacterium substugae
ttgagcgcgcgcgggcagggcggcatgacgctgctggaaatcctggtggcgatgagcctgctggccatcttgtcggtgatgggttacaaggcgttcggttcgctgctgatcgcgcgggagcggctgatgcagaccggcgagcaatgggtggacgcggcgcgcgccttccgccggctggagagcgacctgagcggccagcagccgcagcccagcgccggagaccagcagcaggggctggcgctgggcgccagcagcctgacgctgttgcaggacggcaagggccagtcgctggtgctggagtcggtgtccgcccgttatccgagcggcatggagcggatttcctatcacgccggcggcggcgtactcagctggtcggccggcgacgccgccggcggcgagccgatccgctacgcgctgctggggccggacatgaaggtgagctggcgggtgatgttgaacgacggcagttggcaggacgcctggccgatgggcgacgccgcccagggccgggtggcgcgggcgctggaaatgcgggtgctgatgccgggccagcagccggtgcgccgcatctggagcctgccatga

SEQ ID NO: 3942 - DNA, 381 bp, Chromobacterium substugae
atgaggcggcagcaaggtttcactctgttcgaagtgctggtggcgctggccatcatcgcggtggcgctgggagcgttgctgcgcgccaccggcctcgccgccgacaacgccgaaggcatggagcggcggatgcaggccaattgggaggcgcagaaccagatcgccgcgctgcaggcgctgcggcagttccccgaacccgggcagcaggccggcgagagcaaggaggacggcatcgcctggcgctgggagcgcgatatcacgccgactcccaatcccaatttccgcaaggtggtggtgcgcatcctggcgccgggcagcggccattacgtgttggccgaagtcaccggctacctgcgccagacggccgggagcggcggttga

SEQ ID NO: 3943 - DNA, 474 bp, Chromobacterium substugae
atgatgcgcccgcgccagcgcggcttcacgctgatcgaggtgatggtggtgatgctgatcatcggcgtcctggccaccaccgtgaccctcagcctgcggcccgacacccatcgtctgctgaacgacgaggcctatcgcttcgcgcgggtgctggagcaagccggcgacgccgccgaaatgggcgacacgctggccttgagctggaacgccaagggctatgccttcagccggcaggacgacgacggcaactgggtggcggccggcgacgacctgctggctgagcatccttggccggacggcatccagggcgagggcgtgctgttggacggcaagccctggccggcgggcaggcccctgctgttgtggcaggacggccgggcggcgacgctggcgctcaggctgggcggcgcgggccggcgcttgacgatattgcagtcgccgctgggccgggtgacggtggcggacggctcatga

SEQ ID NO: 3944 - DNA, 444 bp, Chromobacterium substugae
atgaaacagttgaaacgtaccgcccagcgcggtttcaccctgatcgagatcatggtggtgatcgtcatcctcggcgtgctggccgcgctggtggtgcccaaggtgatgagccgtccggacgaggcgcgcatcgtcgccgccaagcaggacatcggcgccatcagtcaggcgctgaagctgtaccggctggacaatggccgctatcccagctctgaccagggcttgtcggcgctggtgcagaaaccgaccgcggcgccggagccgaagaactggaagccgggcggctacctggagcgcctgccgaaagacccgtggggcaacgcctaccagtacgccaacccgggcacgcacggcgaaatcgacatctggagcttcggcgccgacggcgagccgggcggcgagggcaacgacgccgacatcggcaactgggacagcggcaagtaa

SEQ ID NO: 3945 - DNA, 339 bp, Chromobacterium substugae
atggcgaaagacaagatgctggacgccgacccgatccgcaaccgcgaataccggaaattgctggacgcggtggcggatagggacaaggcgcgcgccgcgctggcggcgcggcggcccttgcccatccaggcctggcatccggcgctatggctggcggttgccgccagcatcggcgccgtggtttttcttcagtcgggagcgtggatggccttgctggccctgacggccatcgcgggctatctgtttgccgtgtcggccttgcgcgagtgcatcagcctgcgccggcgcgtcgacgcgctgcagacgctgctgcaacaggcgctcgatcaggaaaaatga

SEQ ID NO: 3946 - DNA, 1212 bp, Chromobacterium substugae
atggccgccttccgatacaccgcctacgatgcggccggcaaggagcagaatggcctgctggaggccgactccgcccgcgccgcccgcgcgcagctgcgcgagcgcggcctgctgccggtggcggtggacagcgtcaacgccaagaccggcaactccggcagcaatgtgttgcgccgcggcctgccgcgcgccgagctggtgatgctcaccgagcagctgtcgacgctgctcaacgccggcctgaccctggagaaggcgctgaccgcggtgaccgagcaggcggaaagcccgcgcgcccgcaccgtgctggcggcgctgcgcagcgacatcctggaaggcaagagcttcgcccaggcgctgtccgccgcgcccggcgtgttctcgcccttgtaccgctcgctggtgcaggccggcgagcagtccggccacctcgacatggtgatggcgcggctggcggaatacctggataagcggcagaacacccagcagaaagtgacgctggcgctcgcctacccggcggtggtgaccttcgtcgccatcctggtggtgtccggcctgatgacctatgtggtgccgcaggtggtcagcgtgttcgcgcagaccaagcaatcgctgcctttcctcacccgcgcgctggtggcgtgcagcgatttcctgcgccaatggggcctgctgctgctggcgtccatcgtcgcggcggtggcgctgacggtgcgcgccttgcgcgcgccgctgctcaagcgccgtttccatgcctgggtgctgaggctgccggtgttcggccgcctgttccgcgcgctcaacaccgcgcgcatggccagcaccatgtccattctggtgggttcgggcgtgccgctcttgaccgcgctggagaccgcgcgcggcctgatgaccatgctgccgatgcaggacgcggtggccgacgcgatggccaaggtgcgcgaaggcgtgtcgctgtcgcgcgcgctcaacgccagcaagcagttcccgccggtgctgatccacctgatttccagcggcgaggccagcggcacgctgtcgcagatgctggaccgcgccgcgcagcagcaggaacaggaggtggagcgcaagctggccaccttcaccacgctgatggagcccttgctgatcctggtgatgggcggcatggtgctgctgatcgtgctggcgatcatgatgcccatcatcgacatgaaccagatggtgcattga

SEQ ID NO: 3947 - DNA, 1461 bp, Chromobacterium substugae
atgaacaagcccacgctgatgccgctgctggccttcccctttgcccgcgccaacggtgtgatcctgctggacggcgaaagcggccgccagctgctgctgcgcgaagacgcgcggccggcggcgtgggcggaggcgctgcgcctgcacggcggcacgctggtgggggtggagacgctgacgcaggcccagttcgagaagcggctgtccgagcactacgccagccgcgacggcgcggcggcggagatggtggacgacatcggccaggacatggacctcaaccagatggtggagtcgctgccgacggtggaggacctgctggaaagcgagggcgacgcgcccatcatccgcatgatcaacgcgctgctgacccaggcgctgcgcgacggcgcgtccgacatccacatcgaggccttcgaggatcgctcggtggtgcgcttccgtctggacggcacgctgcgcgacgtggtcagcccgcaccgcgcgctgcacgcggcgatggtgtcgcggatcaagatcatgtccggcatggacatcgccgagaagcgcatcccgcaggacggccgcatctcgctgcggctgggcggccggcccgtggacgtgcgggtgtcgacgctgccgaccagccacggcgaacgggtggtgctgcgtttgctggacaaggaaaacgcgcggctggacctggccaccctgggcatggccgccgacacgctggcctcggtggacaagctgatcaaccagccgcacggcatcctgctggtcaccggccccaccggctccggcaagaccaccacgctgtacgcggccttgtcgcggctggacgccagccacaccaacatcatgacggtggaagacccggtggagtaccacctggacggcgtcggccagacccaggtcaaccccaagatagacatgagcttcgccaaggcgctgcgcgccatcctgcgccaagacccggacgtggtgatgataggcgagatccgcgatctggaaaccgcgcagatcgcggtgcaggcgtcgctgaccggccacctggtgttggccaccttgcacaccaacgacgccgccagcgcggtgacccgcctcaccgacatgggggtggagcccttcctgctggcttccagcctgctgggcgtgatggcgcagcggctggtgcggcgcgtctgcccgcagtgcaaggcgccgcatccggtgccgctggaagacgagccggatgccattcattaccgtccggtgggctgcccggcctgcggcaactccggctacaaggggcgctacggcgtgtatgaattgatgctggtggacgacaccatgcagcggctgatccacgaccgcgcctccgagcagcggctgcgcgaccacgcgcagcgccacggcatgcgcagcctgcgcgacgacggcctgcgctgggtcaaggccggcgaaaccagcctggaagaaatcctgcgggtgacgagaagctga

SEQ ID NO: 3948 - DNA, 2046 bp, Chromobacterium substugae
atgctcaatttcgtcaacgccgacatcgagaccgtggtcaaggcgataggcgagatcagcggcaagaatttcatcatcgacccgcgcgtcaagggcacggtcaacatcgtctccagccggccggtgccgcgcgcgatgtcctaccaggtgctgctgtcgtcgctgcggctgcagggcttcgccgctgtggagggcaacggcgtggtcaagatcgtgccggaggccgacgccaagctgcatgccaaggcgagccgcggcattccgcgtggcgacggcgaccggctgatcaccaaggtgttcgcgttgaagaacagcaacgccaaccagctggtgccggtgatccgccccatcgtctcgcccaacaacaccgtggcggcctatccgcaatccaacgcgctgatcgtcaccgactacgcggacaacatccagcgcatcgaatccatcatcgaatcggtggagtccgccgccgccggcgacaccgtggtgctgccggtgctgttcggctcggcggtggagttgtccaacaccctgaacaagctgatgcaggaaggcggcgccgacggcggcaagaccaccatcctggccgacccgcgcgccaatgtgctgatggtgcgcgccgacaccccgggcaaaataggcaagatcaagagcctgctgaaaatgctggatcaacctagccaggccggctccaacgtccgggtggtgtacctgaagaacgccgaggccggcaaggtggcgcagacgctgcgcgcgctgctgaccggcgatccgggcccgctgcagggccgcaccgcggtcaccaccaacggcggcagctcggccggcagcagcgcgctgagcggcaacacttccagctccggcttgggcagcagcgccagcaataatgcggtaggcggcgcgccggccaacgccaacgcgccggcggcggccagcccgctggtcaacgacagcgccagcagcggcgccggcggcggcggctcgatgatccaggccgaccccaccaacaacgcgctgatcctcaacgtgccggacagcatgtaccagaacctgcgcaacgtgatcgacatgctggacaagcgccgcgcccaggtattggtcgaagcgctggtggtcgaggtgtcggccacccgggcgatggaactaggcgtgcagtggcaggcggccggcggcgcggtgataggcggcaccaacttctccggcgcgaccaccagcggcaccagcggcacctccatcatcggcgccggcgcggcgctggccgccggcggcgtcggcggactggccaccagcctggcgggctccggcggggtgaacctgggctggatccggcacggcaatctggccgcgctggccaaggcgctggaaagcgagagcggcagcaatgtggtggccagcccctccttgctggccaccgacaatgaaaaggcgcgcatcctgatcggccaggaagtgccgatcccgatcggcaaccagagcacgcccagcagcagcaccagcggccagccggtgataaccaccagctacgaccgcaagaccataggcttcaacctggaaatcacgccgcagatttccgagggcggcagcatccggctgaagatcctgcaggaaaccgccagcctggtggcgtccagccccaatctgaacgccgggagcaacgccggccccaccaccaaccgccgcgtgctggaaaccatcgccaatgtcgacgacggcagcatcctggcgataggcggcctgctgcaggaccaggtggacgacgccgaacagaaggtgccgctcttgggcgacatcccctggctgggcgcgctgttccgctacagcgccaagacccataacaagaccaacctgatgatattcctcaagccgaccatcctgcgcggcgagcaggacggccgcgtcatcgcgcaggatcgctaccagtacatcctgggagatctcaagcgcgacgggaaaaaactgccgctggacttggagtcggcgatccagtcgctgccggaaggcgggatcaaggccagcctggagcgggacgtgaaggccgtgccgaaatga

SEQ ID NO: 3949 - DNA, 618 bp, Chromobacterium substugae
ttgggtcgcaagccggatttcagccgctggacgctgcctggccggcaatggcacaagggactgccggtcctggccatggggctggccgcgttctggctgggccagcagctgaccgccctgttggcgccgtcggcgcagacctaccgcaccctcgccccggcccagccgcaaaccgcggcggccgccgccgcgcaggcgcactggtttggcgaggcgccgcagcagccggtggccgcgccgccgccgatacgcttgctgggcgtgtacgcgccgacccggcccggcgtggagggcttcgccatcatagacagcaacggccacagccagccgctgttgcagggcaagcagaccgccgacggctgggagctggtgaaggtcgcgcctaatggcgtcaccatccgctccggcggcaatgagcaattcgtgccgttgcaggcgcgcagcggcggcgcggttgccggcgacggcgatgccggacagccgctgccgcccccgcaacccggccaggcgccgcaggccggtcccggcgccgtgccggtgcctgtccccagccagaattccgtacccgatactccgccccaacccgcggtcgatcctgccgcgatgattcgccaataa

SEQ ID NO: 3950 - DNA, 156 bp, Chromobacterium substugae
ttgccggccaggcagcgtccagcggctgaaatccggcttgcgacccaatcttgtcttatccccagaacccatcggcttcccgttataaaaattatgctgaacagctgtggctgcaggcttgctagattaagcagcaagagggtgcttttgcaatag

SEQ ID NO: 3951 - DNA, 1782 bp, Chromobacterium substugae
atgatttaccaagcacccgtcaaagacatgcgtttcgtactgaacgagctggccgagctgccggcgatctgcggcctgccgggctacggcgaatgctcggtggagctggtggacgccgtgctggaggaaggggccaagttcgccgagggcgtgctggcgccgatcaacaagcagggcgaccagggcgccaagtggcacgatggcgacgtgaccgccgcgccgggcttcaaggacgcttggcagcaatatgtcgaatccggctgggtgggcctgcgcgcgccggaggagttcggcggccagggcatgccggcgctggtggcggccgcggtggaggaaatgtggtgcgcgtccaacctggcgttttcgctggcgccgctgttgacgctgggcgcggtggaggccatccatcaccacgcctccgatgaactgaaacagatctacctgccgatgatggccggcggccagtggaccggcaccatgaacctgaccgaaccgcaagccggctccgacctggcccaggtgcgttcgcgcgccgtgccggcggcggacggcagctaccgcgtgagcggccagaagatcttcatcacctggggtgagcacgacatggccgagaacatcgtccatctggtgctggcgcgcctgccggacgcgccggccggggtgaagggcatctcgctgttcatcgtgcccaagttcctggtgaacgccgacggctcgctcggcgcgcgcaacgacgtgcgctgcgtgtcgctggagcacaagctgggcatccatggcagcccgaccgctgtgatgagcttcggcgacaacgacggcgcggtcggctacctggtgggcgagcccaacaagggcctcaactacatgttcaccatgatgaaccacgcccggctgggcgtgggcatcgagggcatggcggtgtcggagcgcgcctatcagaaagcggtggagtacgcgcgcgatcgggtgcagagccgcgccgtcggctcgccggacccggccggcgtgcccatcatccagcacccggacgtgcgccgcatgctgatgaccatgcgcgcccagatcgaggcgcagcgcgcgctgaccttctataccgccgccgcgctggaccgcgccggccgccacccggcgccgggcgaagccgcgcgcaaccaggcgctgctgaatttcctgattcccatcgtcaagggctggaataccgagcaggccaacgagatcaccagcctggccatccaggtgcacggcggcatgggcttcatcgaggaaaccggcgtcgcccagtactatcgcgacgcccgcatcaccgccatttacgaaggcaccaccggcatccaggcgctggacctgatcggccgcaagacggctgccgatcacggcgtcgccgcgcgcgcgctgctgggcgaggcgcatgccacggtcgccaagctgcaggcggcggggttcgccagcatcgctgccaatcttgaagcggccagcgccgacgccgagcgctgcgtggccttcatcctggagaccttcggcagccagccgcagctggcggccgccggctcggtgccgttcctgaagctgatgggcatcgttctgggcggctggcagctgggccgcgccgcattgatcgccaaggacaaattgcaggaggccgacgccgacgtcgaattcctcaatgccaagatcgtcaccgcgcgcttcttcgccgagcatctgctgccgcaggtatccggtttggccgccgccatcctgcatggcgcggacagcgcgctggcgctggatgacagccagttctga

SEQ ID NO: 3952 - DNA, 933 bp, Chromobacterium substugae
atggctattctcgttatcgctgaacacgacaaccagagcctgaaagcaggcaccctgaacaccatcaccgccgccgccaagctcggcgaagtgcacgtgctggtggccggccacaacgccgccgccgccgccgacgccgccaagagcgtggccggcgtggccaaggtgctgctggccgacgccgcccactacgcgcacggcctggccgaaagcctgtccgcgctggcggtggacctggccaagggctacagccacgtgctggccccggcttcgtccttcggcaagaacctgctgccgcgcgtcgccgcgctgctggatgtcgcccagatttccgaaatcgtcgccatcgaatcggccgacaccttcgtgcgcccgatctacgccggcaacgtgctggccaccgtgcagtcggctgacgccatcaaggtgatcaccgtgcgcaccacggccttcgacgccgccggccagggcggctccgccgccgtggaaagcatcgccgccgcggccgacggccagctgtccgccttcgtcggccaggagctgaccaagtccgaccgcccggagctgggctcggccaaggtcatcgtctccggcggccgcgcgctgggctcggaggagcagttcaaggcggtgatcgagccgctggccgacaagctgtccgccgccgtcggcgcctcccgcgccgctgtcgatgccggctacgcgccgaacgactaccaggttggccaaaccggcaaggtggtggcgccgcaactgtacttcgcggtcggcatttccggcgcgatccagcacctggccggcatgaaggactccaaggtgatcgtcgcgatcaacaaggacgaagaggccccgatcttccaggtggccgattacggcatcgtcggcgacctgttcacggtggtgccggagctgatcgccgagctgtcgaaataa

SEQ ID NO: 3953 - DNA, 732 bp, Chromobacterium substugae
gtgaagcgcgttgtcgattacaacgtgaaagtccgcgtcaaagccgacggcagtgacgtagacatcgccaacgtcaagatgtcgatgaacccgttcgacgaaatcgccgtggaagaggctgtgcgtctgaaggaagccggcaaggtcagcgagatcgtcgtcgtttcgatgggcgtcaagcagtgcgaggaaaccctgcgcaccgcgctggcgatgggagccgaccgcgccattctggtggaaaccgacaccgaactgcagccgctggcggtggccaagctgctgaaggcggtggccgacaaagaacagccgcaactggtgattctgggcaagcaagcgatcgacgacgacgccaaccagaccggccagatgactgccgcgctgttgggctgggcgcaaggcactttcgcctccaaggtggacgtggcggccgaaaccgtcgaagtgatccgcgagatcgacggcggcctggaaaccgtcaagctgcgcctgccggcggtggtcaccgccgacctgcgcctgaacgagccgcgcttcatcaagctgcccaacatcatggccgccaagaaaaagccgctggacaagaccacgccggccgatctgggcgtcgacgccgctccgcgcctgaagacgctgaaagtggccgagccggccaagcgttccgccggcatcaaggtggccaacgccgccgaactggtcgccaaactcaagaacgaagcaaaggtgctgtaa

SEQ ID NO: 3954 - DNA, 417 bp, Chromobacterium substugae
atgaccgtctatttcgaagacatcgccgtcggcgacagcgccgaagccggcagaaccctcaccgaagccgacgtgctgctgttctccgccgtcagcggcgacaacaacccggtgcacctgaaccaggtttacgccgccgccaccaagttcgaaacccgcatcgtccacggcatgctgaccgccagcctgatctccggcgtgatcggcacccagctgcccggctacggcaccatctacctgtcgcaatccacccgcttcaaatccgcggtgcgcataggcgaaaccgtcaccacccgggtcagcgtggtggagctgtttccggaaaagaagcgggtcaagctggccacccagtgcctggtgggcgacaaggtggtgttggaaggcgagtcgctggtgatcgcgccgtcgcgcggctga

SEQ ID NO: 3955 - DNA, 1077 bp, Chromobacterium substugae
atgactgagaatcctcctcaaaaaccggattatcccgaattgtcgcgccaaatcaaagcctgggccgtcgaggccggcttcgccgaggcgcgcatcactcgcgccagcctgccggccgaggccgagcagcggctggcggcttggctggcggcgggcttccatggcgagatggagtatatggaacgccatggcgcgctgcgcctgcggcccgccgagctggtgccgggcacgctgtcggtgatctcgctgcggatgaactattggccggcggcgcgggccgccgagcaagtgctggccgacccgtcgcgcgcctacctgtcgcgctacgcgctgggccgcgactaccacaaggtgctgcgcaaccggctgcagaagctggctgaacgcatcgaagccgccgccggggctttcggctaccgggtgttcaccgacagcgcgccgctggccgaggtggcgctggcgtcgcaggccggccttggctggcgcggcaagcataccttgctgctgaccaagcgccagggctcactgttcttcctgggggaaatcctcaccgatctgccgctgccggccgacgacaccgaggacggccactgcggccgctgccgcaagtgcctggacgtctgtcccaccggcgccatcgtcgagccgtactcagtggatgcccgccgctgcatttcctacctgactatagaattgaaggccgcgattccccaggcattgcgccctttgattggtaaccgagtgtacggctgcgacgactgtcagctgttctgtccatggaaccgtttcgcggtgcagacggcggaaaccgattttgcggtgcgtcatggtttggacgacgtgagtctggtagaactgttcggctggagcgcggacgattttcgcgagcggatggcgggcagtcccatttaccgcatcggctatcacaaatggctgtccaatctggcggtggggctgggcaatgcgcctagctctgcggaagtgatcgccgccttgcggcggcggctggattttcccgacgagctggtggccgaaccggtgcgctgggcgctggcccggcacggcgagtcctgttga

SEQ ID NO: 3956 - DNA, 495 bp, Chromobacterium substugae
atggcgatggatgataccagcgttcacagcggcagcttgccggacgagggcgcgaccctggcgctgggcgcggccttcgccgccgccgcagcccccggcctgaccgtccagctgcacggcgacctgggcgccggcaagaccaccttcacccgcggcctgctgcgcgcgctggggcatgccggcaaggtgaaaagtcccacctataccctggtggaaagctacgcccttaacgaatatagtgtccaccatttcgatctgtaccgcttcgccgatccggaagagtggaacgacgccggcttcagcgaatacttcggccaggacagcctgtgcctggtggaatggccggacaaggccggcgacctgctgccgcccgccgacatcgtgctggaacttgccgtagccggcgagggtcgcacttatcatttcaaagcccagactcaaaccggacagtcatgcctcaatcgactttcgaccccaagcgccgcgcgctgctag

SEQ ID NO: 3957 - DNA, 1242 bp, Chromobacterium substugae
atgcctcaatcgactttcgaccccaagcgccgcgcgctgctaggcgcagccgccgccacctttttgctcgccgtcagccgcaatggtttcgctgccggcagccagatcgtcgccctgcgcatctggccctcctccacttacacccgcatcacgctggagtccagcgccgccatccagtacaagcagttcacgctggccaatcccagccggctggtgatagatctgcaaggcgtgcagctgaacggcgtgctgaaggacatcagcggccagatcgccgccgccgatccctatatcgccaccgcccgcgccggccagttcgaccaggacaccgtgcggctggtgctggaactgaaaaccgacgtcaagccgcaggccttctcgctgacgccggtcgccgaataccagcaccggctggtggtggacctgtacccggccagcggccagcaggacgacccgctgctggcgctcttgcaggactacaacaagggcaagctggaacagccgccggcgcaagtgaagcccaaggccaagaacaacggccgccccatcatcgtgatgctggaccccggccatggcggcgaggaccccggcgccatcggcatggtcggcacccgcgaaaaggacgtggtgttgaagataggtcatcagctcaagcagctgatcgacgccgagccgaatatgcgcgcctacatgacgcgcagcgacgacgtcttcatcccgctgggcgtgcgggtggcaaaagcgcgcaagctcaacgccgacctgttcgtctccatccacgccgacgccgcgcccaaccgcgccgcccgcggctcgtcggtgttcgcgctgtcggaaaagggcgccaccagcgccttcgccaaggcgctggcgcagacgcagaacgactccgacctgatcggcggcgtcaagataggcagcaaggacaaatacctggcccacaccttgctggacctgacccagaccgccaccatcaacgacagcctgaaactgggcaagacggtgctgggccagctgggaggcctcaacaagctgcacaagaacgcggtggaacaagccggcttcgcggtgctgaaagcgccggacattccgtccatcctggtggaaaccgccttcatctccaatccggacgaagaacagcgcttgctgaccgccgaattccagcagcagatggccaacgccatcttcagcggcgtcaagcactacttcgcctccggcgccgcgctggccgcccgcgcctga

SEQ ID NO: 3958 - DNA, 195 bp, Chromobacterium substugae
atgtccgattccgtccgcatcgtcgcctgtcccacctgccgcgcagaagtgcgctgggagccgcaaagccgctaccgtccgttctgcagcgagcgctgccgtctgatcgacctggggcaatgggccagcgagtcgtacaaggtgccggccgaggaagagtcgccgtcaggcgacgccctgccgccggcgcattga

SEQ ID NO: 3959 - DNA, 759 bp, Chromobacterium substugae
gtgatcagttttgaatttcctgtcaccgagcgcacccgtattctgcttcgcctggaatacctgtatgggcggctgtcctacttcgtcggcaaggatgacccttacgatcaccacgccgcgctgctggtgttgttcgagctgatggagaccgcctcgcgcgccgatctcaaagcggatctgctgcaggagctggagcggcagaagcaggtgctggaggcgctgcgcgagaatcccaacgtggccgaggagacgctggaaggcgtgctggaggaaatcgaacgggcgtcgggcaagctgctggcattgacagggaaattcggccagaacctgcgcgagaacgaatggctgatggccatcaagcagcgcgccggcattcccggcggcacctgccagttcgacctgccgtcctatcacctgtggcagcagcgctcggcggagacgcgccgccaggacctgctgcgctgggcggcgccgctgatgcccaccgccgacgcgtcggacatcctgctgcggctgttgcgcgacagcggcaagacccatcattacgtcgcgcgcaagggcgcgttccagcagatgtcgggcggcaaggtggtgcagctgatccgcgtcgcctacgatgacaatctcgaattgctgcccgagctgtcggccaacaaatacgcgctcaacatccgcttcatcaacgcggtcaccggcgaagcccggccgcgccagatcgagcaggatgtcgagttttacctcaccaattgcaaattctga

SEQ ID NO: 3960 - DNA, 615 bp, Chromobacterium substugae
atggctatcccggtagtcggtttgaccggcggcataggctcaggcaagagcgccgcggccgacaggtttgccgagctgggcgtgccggtggtggataccgaccgcatcgcgcatcagctgaccggcccgcaaggcgcggcgatggcggcgatcgcgcgcgaattcggcgccgcggcgctgacggcggacggcgcgctggaccgggcggcgatgcgcgaattggccttcgccgatccggcttgccggcgccggctggaggcgatcctccatcccgccatccatgaggaaagcctgcggcagctggcggcggcgcgcggcgattacgcgctgctggtggtgccgctgctgttcgagagcgagcgctacacgcccttgctggcgcgcagcctggtggtggattgtcgcgaggagatccagttggaaagggtgatgcggcgcagcggcctggaggaaagcgcggtgcgcgcgatcatggccgcgcagctgccgcgggagcgtcggcgccagttggccgacgatatcatcgacaacaatggcggcttggcagaattgaggcttcaagttgatgccaaacacagttattatctggcaaatcttgtcaatgcattgttatag

SEQ ID NO: 3961 - DNA, 900 bp, Chromobacterium substugae
ttgctggccacgcatccgggttgtctgacgggcgtggcgctggtgttgggcttattggtgggcagctttctcaatgtggtgatccaccggctgccgcagatgctggatggcgagtttttggcggacagcgtcgaatacctggcggaaaaccgccgctttcccgaattgcggctggcggcgcagggcgcggcggcggcgatggagggcgaggcgggctgcaatctgtggcggcccggctcgcattgtccggcttgcggcgcgccggtgcggccctggcagaacgtgccgctgctgagctttgttttgctgcgcggccgttgccgcgcttgcggcgtcgcgatcagcctgcgctacccgctggtggaggcattgtgcgcggcgatgttcggttttctggcctggacgctgggctggggctggccgctggccggcgctttggcgctgacggcttgcctgctggccttggctttcatcgatctggacaccaagctgctgccggatagcctgactctgccgctgctgtggggcggcttgcttttcaacctgcacaccggcttggtgccgctgagcgatgcgatatggggcgcggcattcggctatctgtcgctgtggctggtgttccatggcttccggctgctgaccggcaagaatggcttcggctacggcgacttcaagctgctggcggcgctgggggcctggctgggatggggcatgctgccgctgatcgtgctgctgtcgtcgctggtgggcgcggtgtgcgggctggcgatgcgctgcgcctcgcggatcggccccggtcaggaaatcccgtttggcccctatctcgccgccgccggctggatcgcgctggtgtgggggccgcaaatcgtaaatggatatttgacatggctatcccggtag

SEQ ID NO: 3962 - DNA, 1224 bp, Chromobacterium substugae
atggcgacgacagctgcgaaaaagacgaatcccggctacatctgggaatgggaagggaaagaccgggccggcaaggcgatacgcggagaattgcgcgccgagtcggaaaccgtggccaagactcaattgcggcgccaaggcatcaacgtatccaaaatccgcaagcgccgcaccggcttcggcaagcggatcaccgaaaaggacattgcgttgttcacgcgccaactgtcgacgatgatgcgggcgggggtgccgctgctgcaggctttcgacatcgcggcgaaaggccacagcaatccggcggtgacgcggatgctgctggaggtgcgcgccgacgtggaaaccgggctgtcgctggccgaggccttccgcaagcgcccgctgtatttcgacaagctgttctgcaacatcatcgccgccggcgaaaccggcggcgtgctggacacgctgctggacaagctcgccacctacaaggaaaaggtgatggcgatcaaggccaagatcaagtcggcgatgatctacccgtcggccatcgtcggcaccgctttcatcatcaccgcggtgatcatgatctacgtgatcccggccttcaaggacttgttctccagcttcggcgccaatctgccggcgccgacgctgttcgtgatctggctgtccgatcagttcgtccatttctggtggctgatcttcggcacgattttcggcggcctgttcgccttcttttacgcgttcaagcgcacccccaagatgcaggagcagatggaccgcatcctgctgcggctgccggtgataggcgacatcatccgcaaggccaccatcgcgcgctgggcgcgcacgctgtccacgctgttttccgccggcgtgccgctggtggaggcgctggattcggtgggcggcgccgccggcaaccaggtgtacgccgaggccacgcgccggatccaggctgatgtcagcaccggatccagtctcaactattcgatgcagcgcaccgatctgttccccaatatggtgctgcagatgacctcgataggcgaggagtccggctctctggaccagatgctggacaaggtggccgacttttacgaagaagaagtggataatgcggtggccgcgctgtccagcctgctggagccggccatcatggtgatactgggggtattgatcggcggtctggtgatcgcgatgtacatgcctatcttcaaaatgggtcaggtggtgggttga

SEQ ID NO: 3963 - DNA, 1707 bp, Chromobacterium substugae
atggaagcttcggcagggatttccggcctgggtagggccctggttcagcacaatatgctgctgcagcaggacgcggacgccatcatgcgccaggcgggcgcttcgcatatcacttttgtcgagcaactgatactcagcaagaaaatgagcgcgcgggacatcgcggtattcgcgtcgcgggttttcggctaccccttgctggacatgagctctctggataccgaacagctgcccaaggggctgatcgacgacgagttgatcgccagccggcgcctgctgccgctgctcaagcgcggcaacaagctctatatcggcacttccgaccccacccagacttccgcttatcacgcgatcaccttcaagaccggtctgacggtggaaatcgtcgtggtcgaggatgacaagctgtccaagacgctgggacgctatcaggacaattccacctcggcgctgaaggagctggaaaacgaggatttcggcgacctggagttcgccgatccggacgcccaggtagacagcggtccccaggtggaggtggacgacgcgccggtggtcaaattcatccacaagatgctgctggacgccattgccggcagcgcgtcggacatccacttcgaaccgtatgaaaagtattaccgcatacgctaccggatagacggcgagttgaaggaggtggcgcagccgccgctgatcctgaaggaaaagatcgcctcgcgcatcaaggtgatttccaagctcgacatttcggaaaagcgtctgccgcaggatggccgcctcaagctggtgatctccaagagccgcgccatcgatttccgcgtcagcacgctgccgacgctgtatggcgaaaagatcgtgatgcggatactggattcgtcggcggcgacgctggacatcgagcagctgggcttcgagccggaacaaaaacagctgctgatgacgacgatagcgcgtccctacggcatggtgctggtgaccgggccgaccggcagcggcaaaacggtgtcgctgtatactttccttaaccttttgaaccggccggacaccaatatttccaccgcggaggacccggtggagatcaacctgcccggcatcaaccaggtcaacgtcaacgagcgggcgggcctgactttcgcttcggcgctgaaggctttcctgcggcaggacccggatgtgatcatggtgggcgagatccgcgactttgaaaccgccgacatcgcgatcaaggcggcgcagaccggccatatggtattttccaccctgcacaccaataatgcgccggcgacgctgacccggatgctgaacatgggggtggcgccgttcaatatcgccagctcggtgctgctgatcatggcgcagcggctggcgcgccgcctgtgcagccattgcaagaagccggtcgacattccggaggaggcgctgctgcgcgccggctttcgcaaggaagacctggacggcagctggcagccctatggcccggtcggctgcgaggagtgccgcaataccggctatcgcgggcgcaccggcatttacgaggtgatgccgatcaccgacgcgatgacgcggctgatcatgaaaaacggcaccgcggtcgatatttccgacctggccctgcaggagggcatggttgatttgcgccacgccggcttgctcaaggtcaagcgcggggtgacctcgctggcggaaatcgaagcggtgaccaacgactga

SEQ ID NO: 3964 - DNA, 1182 bp, Chromobacterium substugae
atgaacaagaagctcatcgcactcgcactggccgccctgcctgccgccgccatggcggacgtcaccatctacggcaccatcgcggccggcgtcgaatccctgaaaacctacaacgccaacaccacgtcgttcggcggcgcgctgcaggccggcggcctgcaatcccgcaccgagatcaatgactgggtctcctacatcggcttcaagggcaatgaggacctgggcagcggcctgaaggcgatctggcaggtggaaagccgcctgaacatggacggcagcaacagcaccggcttcggcacccgcgacagcttcatcggcctggccggcgacagctggggcaaggtgcgcgtcggcaaactgtccgactacgcgaactccgacatggagcaggttgacccgggccattactccaacaatggcggcgcgacattcggcggcgcgcccagcgtgggcggcctggcgatgttcacccgcgtggacggtcgccacaacaacgccgtccgctacgacggccccgagttctacggcttcaacatctccgtgctgtacgcggcggacgaggctcgcaagaacgtagccggcatcgtgaccaacggccagttctccaacatcggcctgagctatgaaaactccggcttcttcggcaagtacaacttcggcagctggggttccccgagcgagctggcctcgctgaaggactggcaccgcttcgagggcggctataacgccaacaacatctacgtagccttgggcttccagcaagtgcgcggctatgtaggcatcaactcggcgggcggcgtggctaccagcattaccgacaatggcgggctgctgtacaacggcaacgccgcgagcgcgaacttggctggcctggttgcgcagaatccggggctggtgaattccaagacggtgcaactggggcgcacgcgtgaaatcgcgctgaccggcggctacaccttcggcgctttcactccgtacctcagctatgccaagggttacaatgtcaacttggcgaacttcggcgacgtgagcaactccggctacgaccaatgggtgctgggccttgattacgcggtgtccaagcgcaccgacgtctacacctcctacggccacgtcaactggaagctgcaaggcgcgcaaaacgaaagctccttcggcctcggcctgattcaccacttctga

SEQ ID NO: 3965 - DNA, 300 bp, Chromobacterium substugae
atgaagaagctgttcgctgcctttgccggcctgatgctgctgtgcaatttcgcctgggccgccgtcaacctgaacaccgccaccgcgccgcaactggaggcgctgcagggaatcggcccggccaaggccaaggctatcatcgactaccgcgccaaaaacggtccgttcaagacggtggatgatttgaagaaggtttccggcatcggcgacaagacgctggataagctgcgcaaggacctgaccgtgggcggcgcggcgccggccgccaaaccgggcgccaagccggtggccgccaagtag

SEQ ID NO: 3966 - DNA, 822 bp, Chromobacterium substugae
atgaccagcatcctgctcgttttgtcgctgttcctgatcctgtcctacggggcgtttacctggcactacctggccaactggcggggcacggcccgctggccgcgcaatccgagggtggagcacagcctgcttggcgtgctgttgctggtgcaggcgctggtggtggtggcgccgctcagcgtcagcggcggtctgtcgctgggcgtcggccacgcgctgggggtgatggtatggatcatgctgctgatttactggacctgcagcttcttttatcgagtggaaggcctgcagctgttcatgatgccgctggcgatggccgcgctggccttcgccatcgccttccccggccggcacatggtgagcgacctgtccaatccggccttcgtgctgcacatcctggtgtcgatgctggcctacagcctgttcgccatcggcgcgctgatcgcggtgctgatgctgttgctggagcgttcgctgcaccataagcggatgtcgctgctggcgcggcagttgccgccgctgctgacgctggaaaaaatgatgttccaggtgatcgccgtcggcttcctgctgctgaccgtggcgctggtgacgggggtggtgttctccgaagaggtgttcggcaaggccgccgcgctgacccacaaaaccgtgttcagcgtgatttcctggctgttgttcgcggctttgctgctggggcgccgcctgcagggatggcgcggcagggtggcgatacgctggacgctggccggtttcctgtcattgatgctggcatacgtgggcagcaaggtggttttagaattgatcctgcagcgcggctga

SEQ ID NO: 3967 - DNA, 1356 bp, Chromobacterium substugae
atgctagacaacctgaccaaccgcctgtccggcgtgatgaaaaccttgcgcggcaacgcgcggctgaccgaatccaacatccaggacgcgatgcgcgaagtgcgcatggcgctgttggaagccgatgtggcgctgcccgtcgtcaaaacctttatcgcccaggtgaaagagcgcgcgctgggccaggacgtgatgggcagcctgaccccgggccaggcgctggtcggcgtggtcaacgaagagctcgtcaagctgatgggcgacaagaacgacgagcttaacctggccgccgttccccccgccatcgtactgatggccggcctgcagggcgccggcaagaccaccaccgtcggcaaactggccaaaaggctgaaggaaacccagaaaaagaaggtgctggtggtttcggccgacgtctatcgtccggccgccatcgagcagctgaaactgctggccgcgcaggtcggcgtcgaatggttcccgtccgacgcggcgcaaaagccggtcgacatcgcccgcgccgcgatagaccatgcccgccgccacttcttcgacgtgctgctggtggataccgccggccgcctcgccatcgacgaagcgatgatggacgagatcaaggcgctgcacgccgcggtcaatccgatcgaaacgctgttcgtggtcgacgcgatgcagggccaggacgcggtcaacaccgccaaggccttcaatgaagcgctgccgctgaccggcgtgatcctcaccaagatggacggcgactcgcgcggcggcgccgcgctgtcggtgcgacacgtcaccggcaaaccgatcaagttcatcggcgtcggcgagaaggtcgccgccatcgagcccttccaccccgaccggatcgccagccgcatcctgggcatgggcgacgtgctgtcgctgatcgaggaagtgcagaagggcatcgatcaggacgaagccgcggcgatggccaagaagctgaagtccggcaagggtttcgacctggaagacttcaaggcccagatgcagcagatgaagaagatgggcggcatgtccaatctcttggaaaagatgcctgggcagatcggccagatggccaagggcatccagggcgccgaggcggaaaaatcgatgcgccgcatcgaaggcatcatcaactcgatgacgccggacgagcgccgcaagccggaactgatcaaggccagccgcaagcgccgcatcgccaccggctccggcgtgacggtgcaggaggtgaaccgtctgctggcccagttcgagcagatgcagaaaatgatgaagcagttctcctccaagggcgggctgatgaaaatgatgcgcggcatgaagggcatgatgcccggcatgtaa

SEQ ID NO: 3968 - DNA, 1371 bp, Chromobacterium substugae
atgaatctgactacgttgaccgccctgagcccgctggatggccgctacgccagccaggtcgaagccctgcgcaacctgttctccgagttcggtttgatgaaatgccgcgtcaaggtggagctggaatggctgaagatgctggccgccgagccgggcatcgaagaggtcaagccgttctccgacgccaccatccgcgaaatcgacgacgtgatcgccaacttcagcgtcgagcacggcgaagaggtgaaggcgatcgaagtccgcaccaaccacgacgtcaaggcgatcgagtactggctgaaggaacgcctgtcgggcaacccggaagtgatggccgccagcgaattcatccacttcgcctgcacctccgaagacatcaacaacctcagccacgcgctgatgctgaaaaccgcgcgcaacaccgtgctgctgccgacgctggacgaagtcatccacaagctgcagaagctggcgcacgagctggcgaatgtgccgatgatgtgtcgcacccacggccagccggccaccccgtcgaccatgggcaaggaactggccaacgccgttcaccgcctgaagcgccagcgcgaacagctggtgcaccaggaaatcctgggcaagatcaacggcgcggtgggcaactacaacgcccacctggtggcctacccggacatcgactgggaaagcctgtgcggccgcttcgtcaccggcctcggcatcaccttcaatccgtacaccatccagatcgagccgcatgactacatggccgagctgtaccaggtggcgatgcgggtcaacaccatcctgatcgacctcaaccgcgacatctggggctacatctcgctgggctacttcaagcaaaaggtgaagaaagacgaagtgggcagctccaccatgccgcacaaggtcaacccgatcgacttcgaaaactccgaaggcaatctgggcatggccaacgccatcatgggccacctggcggaaaaactgccgctttcccgctggcagcgcgacctgaccgactccaccgtgctgcgcaatatgggcgtcggcttcggctacaccatgctgggcctgaagtcctgcctgaagggcctgaacaagctggagatcaacccggcgctgatcgccgccgagctggacaatgcctgggagctgctggccgagccggtgcaaaccgtgatgcgccgctacggcatcgccaacccgtacgagcagctgaaagagctgacccgcggcaagggcggcatcacccgcgagacgctgcacgccttcatcaagagcctggacctgccggaaagcgtcaaggcctcgctgctggagctgaccccggccaactacctgggcaaggccgaggagctggcgcgccgcatctga

SEQ ID NO: 3969 - DNA, 2169 bp, Chromobacterium substugae
atgatcatgcaatcaatgtacgaccaatcctcgaacaccccatccaccgacgacaacgacgccgcgaccgcctccccgccgccggtgtccgcccgtcacctgctcagcctgaacgagcgcggccatgccgggctgtaccagtacttcatcgagcacgacaccaaccgcatcctgcagcatctggacacgctgcgcggcatggccttcacccaggacgccgaagacggccaggtcggcccgccggagcggccgttcccgtcggtctgcctgatcggcctcggccgctgcggctccaatatcgcgctggacgtggcgacgctggtctacaacgcccgcaagttctacctgaacgagttcaaccaggacgacaagagcgcgccggaacaggagcagcggccgcggcgctggatacgccgcaacctgctgtcgccgcacaaggcggccaagccggccttcctgatcgagccgatggtgatgctgggcgacctggacaaggacatcaagggccgcatccgcttctcgcgccgcggcgagcagggcgacttcatcaacaactacaacaagctgaagatcatggacctggccgaggtccacgccggcggcgccggcaacgcgccgatactgggccaatacctggccaagatcatcctcaacaaggacacgctgagcttctccgatccggactggacgctgatccattcctatctggtggactcctgcggcatcaaggccaaccagtcgcggctgtacttctacatcttcagcgccggcggcggcaccggctcgggcatggcctcggaattcggcctggcccagcagtacgcctacatgagcaagaccttcgaaacccgcagcgaaggcaagccggagcaagccgacgactacagcttcgtattcgagcccatcttcaccagcggcatctgcatcctgcccaatatctccggccagcacgccgagggctcggaagcgctgcacatcaacgccggccggctgctgtgcaaatacctgtcggaagagtgggacttctcctacaacttcgacaacgaggaagccggcgccgaaagcgtgatgcgtcggatccggccgtggaacgcgatgatgctgatctccaacgacatcatgcgctacgccgaggaaaacgacgccggcagcatcgaaaacctcgacgtcaacgcgatggagcgccacgccaaccagtacatctcgcagcagatcttcaacatcctcaccgcccaggccgtcaccagcgactacgacgaaaactacttcctgcgcgccggcatcgacatgggcgaaaccatacggctggacgccaacgacctgttcatgagcctggccggcccggtggcggtggcttacgccgaatcggtggtatccgacccgctgggatcggacggcttcgtcaacaagctggacatcgacgacctgttcttccgctcgatcgacctgccgcacttcaaccagcagacccaggcgatagaaggcatcagcctgctgccgatagaatcggccagctaccgcgcggcgctggccgactacaagcagtccggctacgcggcggaaaaactgaaccagctgttcttcttccagaactgctcgtcggtggtggccatcctgtcgctgcccaagggctacaagctgtcctacctggacctgaaccgcctgaagcgccacctgaacgacctgttccccagcaccacgctgaagcgctacgcgctggtgataggcgcgtccaccaatctgtccctgaccacgctggtggcgaagagcccctgcctgagcgacgacttcctcacgctgatcgtcgccttcatcaagcgctgcttcgcccacggcaaccaccgtttcgacgacagcctggacaagacgatactggacctgatcaccgccgagcatttcgatgaaacggtgctggagcggctgctgaacgagtacgagaatccggccaagatcctcgacaccaactggttcgccatcaagccgatgtacgagaagaaataccgcgagctgatccgcgactccaagaagttcgtctcgatcaacgacatccgcctgacccgcgagcacgtgcaaaaagcggtgtgttatctgcgcgagatctaccgccaccgcatcggcaagacccgggtggtttcgctcaacacctacgcccacagcaagcacgcctga

SEQ ID NO: 3970 - DNA, 3180 bp, Chromobacterium substugae
atgtggattgtagaaacggccctgaaacggccctataccttcatcgtgatggccatcatcatcctgctggccacgccgctggcgatcatgcgcacgccggtggacgtgctgccggaaatcgacattccggtgatcagcgtgatctggggctatggcggcttgccgccgcagcagatggccgaccgcatcacccagattcatgaacgggtgctgaccaccaccgtcaacgacatcgagcacatcgagtcgcaatcgctgtccggcatcgccatcatcaagatcttcttccagcccggcgtcaacatccagaccgccatcgcccaggtggtggcggtgtcgcaggcggtggtcaagcagatgccgcccggagccaccgcgccgctgatcatcaagtacaccgcctccagcgtgccggtgatccagctggggctgtccagcaagacgctgtcggaacaggacgtgttcgacaccgccgtcaacacgctgcggccgcagctggtgacgataccgggcgtcgccatcacctatccctacggcggcaaggtgcgcctgctgtcggtggacctggacacccgcgccatcgccgccaaggggctgacgcccgccgacgtggtcaacgcggtcaacgcgcaaaacctggccctgccctccggcaccgccaagatcggcggcaccgaatacgatgtggcgctgaacggctcgcccgacagcatcgccggcctcaacaacatcccggtgaagacgacgaacggcgccacggtattcctgcgcgaagtggcgcacgtgcgcgacggcttctcgccacagaccaatatcgtcaagcaaaacggccagcgcggcctgatgatgtcgatctacaaaaacggcggcgcctccacgctggacgtggtcggccacctgaaggaaaagctgcccggcctgttgccgctgctgccgaagggcatccaggtcagcctgctggccgaccagtcgatcttcgtcaaaaccgcggtggaaggcgtgatccacgaggcgctggtggccgccgcgctgaccgcggtgatgctgctgctgttcctcggcaactggcgcaccacctccatcatcgccgtctccatcccgctgtccatcttctcgtccatcgtcgcgctgcacgcgataggcgagaccatcaacgtgatgacgctgggcggcctggcgctggcggtgggcatcctggtggacgacgccacggtgacgatagaaaacatcgagcgccacctgcacatgggctcgccgctgtacaccgccattctggacggcgccggcgaaatcgccatcccggctttcgtctccacgctgtgcatctgcatcgtgttcgtgccgatgttcttcctggaaggggtggcgcgctatctgttcgtgccgatggccgaggccgtggtgttcgcgatgctggcttcctacgtgctgtcgcgcacgctggtgccgacgctggcgctgctgctgatggggcaccagcaccgcggcggccgcgtcgacgcctggatccaccgcgtgcacgagcgcttcaatgcccgcttcgagcggctgcgcgaaacctatgtgcacctgctcagccacctcttgacccaccgcaagcgcttcatcgccggcttcctcggcttctgcctggcctcctgcgcgctatacctgctgctgggccgcgacctgttcccggaagtggacaccggccagatcaagctgcacgtgcgcgcgcccaccggcacccgcatcgagaacaccgccatcctggccgaccaggtggacgccgaaatccgcaaggcgatcccgccggaagacctggactccatcatcgacaacatcggcctgccctacagcggcatcaacctgtcctacagcaactccggcaccataggcacgctggacgacgaagtgctgatctcgctgaagcccggccaccgccccagcgcaggctatgtcgacgcgctgcccaaggcgctggaaaagcgcttccccggcgtggagttcttcttccagccggccgacatcatcacccagatcctcaacttcggctcgccggccgccatcgacgtgcaaatcgtcggcaagagccaggccgacaacgccgccttcgccggccggctgctgacccggatccaggcggtgccgggcgccgccgacgtccacgtgcaccagcggctggacgcgccgtcgattcggctgaacatggaccggacccggctgcagggcatgggcatcgcgccgttcgacgtggcgcagaacctgctgctgccgctgtccggcagccagcagacccagccggcgttctggctgaatccggccaacagcatcgtctacaacatgcaggcgcagacgccgcagtaccagatcggcaccctggaccagttgatgcagctgccgatcaacccgcccggcggccacgccgccagccagcagacgctgggcaatctggtcaccgccgcgccgggacgcgaagccgccatcgtcacccgctacaacatcctgccgtcgatcgacatctacgccagcgcgcgcggccgtgacctgggctcggtggccgccgccatccagcgcatcatcgacgaggaaaaggcccacctgcccaagggcagccagatccacatgcgcggccaggtggaaaccatgcagtcctcctacctgggcctgtcggtcggcattctcggcgccatcgtgctggtctacctgctgatcgtggtgaatttccagtcctggctcgaccccttcatcatcgtcagcgcgctgccggcagcgctggccggcatcgcctggatgctgattctcaccggcaccgacctgtcggtgccggcgctgaccggcgccatcatgaccatgggggtggccaccgccaacagcatcctggtggtgtccttcgcccgccagcggctggacgagggcctgccgccgctgtcggccgcgctggaagccggcgccacccggctgcgcccggtgctgatgacggcgctggcgatgatcataggcatgatcccgatggccatcggcttcggcgaaggcgccgagcagaacgcgccgctgggccgcgcggtgataggcggcctcctgttcgccaccgtctccacgctgctgttcgtgccggtggtgttcgccagcttccaccgccatctggccaaacgcaaacaacaggcggccgacgcgccggctgccgcacaggacgcatga

SEQ ID NO: 3971 - DNA, 1155 bp, Chromobacterium substugae
atgaccgaatcccgccatgcccaccagggcctgcccgaactgcatttgcaccatgaacgccgcggcgcggtggcgcgcaaggcccgcgtcgccgccgccgtgatcgtgatcctgctgctggccggcctcgcccgcacgctgctggtgcgccacgccgacgccgcggcgctggcccgggaggccgagcgccgcgcggtgctgaccgtcagcgtggtcacgccgtcgcccgcccgcgccgacgcccgcctcaccctgcccgccacgctgcaaggcatggccgaggcgcagatctacgcccgcaccaacggctacatcaagcgctggtacaaggacatcggccagccggtgaaaaagggcgagctgctggccgagctggacattcccgacatcgacaagcaggtgcaggaagcccaggccaatttcggcctggccaaaaccgcctacctgcgctggaagacgctgcgcgcgcaggacgcggtgtcgcagcaggaactggatgagaaggaaagcgcctaccgccagaccgaggccgagctgaagcgcctgcgcgaccagcaagacttcgcccgcgtcgtcgcgccgttcgacggcatcgtcacccgccgcaacatcgacaccggcagcctggtcaacgccggcaacggcggcagcgcgcaggccctgttcgccaccgcccagatcgaccgcctgcatctgtacgcctacgtgccgcaagcccaggccggcgccatccgcgtcggcgacaaggccgacatcgcgcgccaggaagcgcccggccagcctagcgtcggcagggtggcgcgcaccgccggcgccatcgaccccgccacccgcacgctgcaagtggaggtggaagtggccaacgccggccatggcctgctgccgggccaatacgtcgacgtgtcgttcaagctgcccaacggcggcaagctgaccctgcccaccaacaccctgcaattcggcgccaagggcagccgcgtcgcgctggtggacgcccaccaccgggtcaagctgcaaaccgtggcgctgggcaccgactacggccacgaggtggaaatcaaggccgggctgcaagccggcgacaaggtgatcgtcaatccgccggactcgatccgcgacggccaggcggtcgccatcgccgccgccggggagtga

SEQ ID NO: 3972 - DNA, 1416 bp, Chromobacterium substugae
atgcgcgcccttcccctgctgatcgcgctgagccttggcgcctgctccgccgtcggacccgattacgtccgcccgcccagcgaactgccggcgcaatggaaaagcggcgacggctggctgccggccgcccccgccgacgccgagcccaaaaccgaatggtggcgcaccttcggcgacgacgagctgaaccggctggaagccgaggcgctggcgcgcagcccgacgctgcaggcggcgctggcccggctggaccaggccgaagcgcaaagccgcgtccatggcgcggccgcgctgccggccgtcagcctgggcgccgccgccgcgcgcagccgcgtctcggccgaccggccgctgtccagctacggcagcgtcaacagcagcgccgtgcagaacgacctgaagccgacgctcagcgtcagctatgagatcgactggctgggccgggtgcgccgcgacatcgaaagcgcgcgcgccggcgccgaacaagccgccgccgaccgcgccaacgtcgagctgctgctcaccgcccagctggccagcgcctacctgcagctgcgccaagaggacgaggaaatccggctgttggacggcaccatcgccgcgcagcagcgcgtgctggagctgacccgcatccgccatcaggccggactggccgccgccggcgacgaagcgctgcaagcggcggcggtgagcgccagccgcgcccagcgagaattgctgctgaaccagcgccgcgtcggcgaagacctgctggccacgctgagcggcgcgcccgctcccgcctttcgcctggcgcccggcgcgctgccggcggccatgccggcggcgccggccggcgcccccagccagttgctgcagcgccggccggacatcgcctcggccgaacgcgcgatggcggcggccaatgcccagatcggcgtggccaaggcggcctatttcccgcaattgacgctgacgccgacctacgccggcagcgaatcggcgtcgctggccggcctgttctccaccccggcgctgatctggtccatcggcctgcaagccagccagaccgtgttcgacaacggcaagacccgcgccaatgtcggctacgccgaagccggctaccgcgccgcgctggccaattaccgccagaccgtgctgcaggcggtgcaggaagcccaggacgcgctgggcgcgctgcgcggcctggacgaggcgcgccggcagcaggacatcgccgtccgcaatcaggaccaggcctatgccatcacccaactgcgctaccgcgaggggctggacagcgcgctgacgctggccatcgcccagcaaagccagctggcggcccggcggacgctggcgcaactgcgcggcagccagttgatcgccagcgtcagcctgctgaaggccctgggcggcggctggcaaagcggcgattga

SEQ ID NO: 3973 - DNA, 3057 bp, Chromobacterium substugae
atggaagtcacccgacgccagctgttcaagctgaccgccgcgcagctgggagcatccagcctggtcgccatgggtttcgcgccgcagctggcgctggccgaagtgaggcagttcaagctgatgggcgcgcgcgaaacccgcaacacctgtacctactgttccgtcggctgcggcctgatcctgtacggcctgggcgacggtgccaagaacacgcacggcgagatctaccatatcgagggcgatccggaccatccggtcagccgcggctcgctctgtccgaagggcgccggcctgctcgacttcatccacagccccaagcggctgaaataccccgaagtgcgcgaagccggcagcggcgagtggaagcgaatcagctgggacgaggcggtttcccgcatcgcccggctgatgaaggacgaccgcgacgcgcatatcgtcgagaagaacgccgccggcgtgccgatcaaccgctggctgtccaccgcgatgctgaccgcctcggccggctccaacgaaaccggcatcatctcgcagaaattcatccgcagcctgggcatcgtcgccaccgacgcccaggcccgtgtctgccacggcccgacggtgtcggcgctggcctccaccttcggccgcggcgccatgaccaacagctgggtggacatcaagaacgccgacttcatcctggtgatgggcggcaatgccgccgaggcgcacccggtgggcttcaagtgggcgatagaggcgaaaaagacccgcggcacgcggctgatcgtggtggacccgcgctacaaccgcaccgcctcggtgtccgacctctacctgccgatccgcgtcggctcggacatcgccttcctgggcggcgtgatcaactggctgatccaaaacgacaagattcactgggactacgtcaaggcctacaccaacgccgcgctgatcgtgcgcgaggattatcatttcgacgatggcctgttctccggctacgacgccgccaaaggcaagtacgacaagagcagctggaactacgagctgggcgacgacggctacgccaagaccgaccccacgctgcaacacccgcgctgcgtctggcagctgttgaagcagcactacgcgcgctacacgccggaagtagtcaacaatatctgcggcacgccggtggacggctttctgcaggtgtgcaaggaactgggcgagaccgcccgccccgacaaggccggcaccatcctgtacgcgctgggctggacccagcacaccaccggcacgcagaacatccgcaccatggcgatgatccagctcttgctcggcaacgtcggcatgcccggcggcggcgtcaacgcgctgcgcggccactccaacatccagggcctgtccgacctgggcctgttgtccaccagtctgcccggctacctgacgctgccgagcgaagccgaccatcccgacctggccacttatctggccaagaccacgcccaagagcctgcaggccaaccagttcaactactggagcaacacgccgaagttcttcgtcagcctgatgaaatggatgtggggcgacaacgcgagcaaggaaaacgactggggctacgattggctgcccaagtgggacaagatgtacgacgtgctgcacatggcggagctgatgtaccagggcaagatgaacggcttcatcgtgcagggcttcaacccgctggccagcttccctgacgccgccaaggtgaccgaggccttctccaagctcaagtacatggtgatcatcgacccgatcgccaccgagacctccaccttctggcaaaaccacggcgaggcgcatgacgtcgacccggccaagatccagaccacggtgttccggctgccctccacctgtttcgccgaagaggacggctccatcgtcaactccgcgcgctggctgcaatggcactggaaaggcgccgaaccgccgggcgaggcccgcggcgacaacgagatcatcggcgaattgttcgtcgccatccgcgacctctaccgcaaggaaggcggcaagctggccgaaccgatcctgaaagtgaactggaactaccgcgacccgaaggccccgacgccgagcgagctggcgatggaaatgaacggcaaagcgctggccgacctgccggacccggccgaccccagcaagaccttggtgaagaagggcgagcagattcccggcttcgccgtactgcaggacgacggccgcaccgcctgcgcctgttggatcttctccggctgctggccgcaggccggcaaccagatggcgcgccgcgacaacaccgacaccggcctcggcaatacgccgggctggtcgtggtcgtggccggccaaccgccgcatcctgtacaaccgcgcctcctgcgatccgtccggcaagccgtgggacccgaagcgcaagctgatcagctggaacggcgacaaatgggtgggcggcgacgtgccggacttcaaggccgacgccgcgccggactccggcatgatgcccttcatcatgaaccccgagggcgtgggccggctgttctgcgccgacaagctggtggacggccccttccccgaacactacgagccgatggaaagcccgatcggcaccaacccgctgcatcctaaagttgtctccagcccggcggtgcggctgttcgacagcgacaagaagcggctgggcacgcacaaagacttcccctatgtcgggaccacgtaccggctgaccgagcacttccaattctggaccaagtcggtgctcttgagcgccatcgcccagcccgagcagttcgtcgaaatcggcgaggcgctggcccgcgaaaaaggcatcgtccagggcgacatggtcaaggtcagctccaaccgcggcttcgtcaaggccaaggcggtggtcaccaagcggctgatggcgctgaaggtcaacggccagaccgtgcaccaaatcggcatcccgctgcactggggctgggagggcgtggcgcggccgggctatctgaccaatgcgctgccgcccgcggtcggcgactgcaacacccagacgcccgagtacaaggccttcctggtcaaactggaaaaactgtaa

SEQ ID NO: 3974 - DNA, 888 bp, Chromobacterium substugae
atgccattgcaatccctggatatcaagcgccgctccgccagcccgaccgaaagccccaaggtccgccagacgctggaagtggccaagctgatcgacacctccacctgcataggctgcaaggcgtgccaggtggcctgttccgaatggaacgacatccgcgaggaggtcggccacaacatcggcgtctacgacaatcccaccgacctgtccgccaaggcctggacggtgatgcgcttcgccgaggaggaaagcaacggcaagctggaatggctgatccgcaaggacggctgcatgcactgcgccgacccgggctgtctgaaagcctgtccgtcgccgggcgccatcgtccagtacagcaacggcatcgtcgatttccaccaggaaaactgcataggctgcggctactgcatcgccggctgtccgttcgacatcccgcgcatcagcaaggaagacaacaaagcctacaagtgcacgctgtgctcggatcgcgtcgccgtcggcctggagccggcctgcgtcaagacctgtcccaccggagccatccagttcggctccaaggaggacatgaaggaagtggcggcggaacgggtggccgacctgcagcggcgcggctatcagcatgccggcctgtacgatccgcaaggcgtaggcggcacccacgtgatgtacgtgctgcaccacgccgacaagccggagcagtactccggcctgcccaacaacccggagatcagccccaccgtgcaattgtggaagggctggctcaagccgctggcgacgataggcatcgccgccgccggcctgttcggcttcctgcactacatcaccgtcggccccaaccgcgccgacggcgatgaggaaaacgaaacccgcgaggaggataagcgatga

SEQ ID NO: 3975 - DNA, 618 bp, Chromobacterium substugae
atgaaggaaaaactgctgcaacgctacagcgccgccgagcggatcaaccattggatcgtcgccatctgcttcgtgctgctggcgctgtcgggactggcgctgttctacccggccttcttctggctgaccggcgtgttcggcacgccgcagctggcgcgcatggtgcaccccttcgtcggcgtgctgatgttcgtcggcttcttcgtccagtttttccgctactggcggcgcaacctgatcaacggccaggacatccagtggatgctggcggtgaaggacgtgctgcgcggccatgagacggtggaggtgggcaagtacaacggcggccagaaggcgatgttctggaccatgaccctgtgcgtggccaccatgctggtcaccggcgtcatcgcctggcgccagtacttttccggctattttcccatcccggtgatccggctggcgctgctgctgcacgcctgggccgccaccgcgctgatcgccagcatcatcgtccacgtctacgccgcgctgtgggtgaagggcacgatacgggcgatggtggagggggtggtcacccatgcctgggccaagaagcaccatcccggctggtataaggaaatgacggggaagaaatag

SEQ ID NO: 3976 - DNA, 891 bp, Chromobacterium substugae
atgacacccacccaacccatcctccccgccgagcagatccgcgccggcgacgccccgctgatgagcctgcccgtgctgcggccgccgcccgacatcttcgcccgccgcgccgcgcggctgctgcaattggccgacggccacgcgatggccgattttctgcggctgtgcgccgccatctgccagcaacagcaggcgctgcacgacgcctcccggctggatccgcgctccgcgctggaaaaactgctccagtcgctggagtcggaactgcccgatccggtccggggctctgcgggcctcttgctggcgcaggacgccgccgcgctcagccggctggcggaacatctgctcaacggcgagtatccgacggacggcccgctgttcgccgccttgccgctgctgggcgccgcgctgcaggcgcaggccacgcgcagcatccgccagcgcccgctgcccgagccgcaaagccaacaggcgaggtgcccgtgctgcggcggcctgcccttggcctcgctgctgctgcgcggcgacagcggccatgcccagcgctacgtgctgtgctcgatgtgcagccatgcctggccggtggggcgggtgcgctgcctgtcctgcggcaacagccgggacctgcattactactcgctggcggcgcaggaccatgtccccgccgcgcccgaccatcagcaaccgcaccaggcgcgcggcgcgcgcgaagtggaagcctgcggcgagtgccatggcgcgctgaagcagatctcgctgctgctggacaccagcgcggaagccggcgccgacgacctggccagcctggcgctggacctgctggccggcgaggccggcttcgcccgcatcggcttcaatccgctgtttctgcctggccgggagccggcttga

SEQ ID NO: 3977 - DNA, 732 bp, Chromobacterium substugae
atggacgcacgcatgacccaccgcatcgtatttgtagaagacgacgccgatctggcggaactgatcagcgacttcctgtcgcgccatgaaatggaagtggtggtggagccgcgcggcgacgccgcgctggacaccatcgcgcgccaagcgccggacatggtgctgctggacatcatgctgcccggcaaggacggcctgtcgatctgccgcgagctgcgccccaagttcgacggccccatcatcatgctgacctcgctggacagcgacatgaaccagatcttgggcctggagctgggcgccaacgactacatcctgaaaaccacgccgccgtcggtgctggtggcgcggctgcgcgcgcagctgcgcaatctgcgcccggcgcaaacggccgcggaagcgcagcagccggccaagggctcgcgcaaggcggtgttcggccagctgtcgatcgacccggtcagccgcgacgtggtgctggccggcgagaagatcccgctgtccacctcggacttcgacctgctgtggctgttggccagccacgccggcgaaacgctgaaccgcgacgtgctgctgaaggaaatgcgcggcgtcagctacgacggcctcgaccgcagcatagacgtggccatctcgcggctgcgcaagaagctgggcgacaaccccagcgaaccgttccgcatcaagacggtgcgcaaccgcggctatctgttctcgctgtccggctgggagtaa

SEQ ID NO: 3978 - DNA, 1323 bp, Chromobacterium substugae
gtgcgcaaccgcggctatctgttctcgctgtccggctgggaggcgcggatgcgccgtcttttcatccagttctacctgctgctgatgtcctgtttcctggtggcggtgatcatggttggcgtggtttacaagcaggcggtggacgatgtcggcgaacgctacctggccgacctgctgcgcaccacgctgtcgctgatcgaggccgacctgcgcggcgtgccggaggaccgctggagcgaaaccctggccaacgccgactacggcttcaccttccgcgtcaaagtggaaaagatgagcaactacatcctggacgacgagtccaggcaggcgctggaccgcggcgaaatcgtgatgctggaggacaaatacctgttcctgcaaaagctgcaggacagcaattacctgctggtggccggcccgctgcgctacctgttcttcctgcataggctcaagtggttcgactacgcgctgctgggcctgttgggcctgtcgctggcgataccggtgttcctgtggatgcggccgcactggcgcgacctggtggcgctggagcgcgcctccggccggctggccaacggcgacctctccgcccgcgtcgacctgccgccgcactccggcgtccagcacctggccgtggcgttcaaccacatggccgacaacatcggcgcgctgatcaacagcaagaaaacgctgaccaacgccgtcgcccatgagctgcgcacgccgctggcgcggttgcgctaccggctggcgctgctggagggcgacgaggagtccaaggagcgccaggcgatagaacgcgacctcaccgccatcgacaagctggtggaagagctgctgttccacgcccggctggaccgcccggaagcgccgctgaagctgaccagcttcaacgccatcccctgggcgcgcgaccgcatcgccggccaggcggcgctggcgcaggaaatccactggatagaaccagtgggcgacacgctggaaatcatcgccgacgagcacctgatcacccgcgcgctggacaatctgctgtccaacgcccgccgccacgccggctccatcgtcgccacccatatcctgatcgacaagcagcactactgcatcatcgtcgacgacgatggccccggcattccggccgaagaccgcgagcgggtgttcgaccccttcgtgcggctggacgagagccgcggccgcaagaccggcggccacggcctgggcctcgccatcgtcgccggcattgcccgcgcccatggcggcgacgtcaaagtggaaagctcgccgatgggcggcgcgcgctttttgcttcgctggccgacagcctga

SEQ ID NO: 3979 - DNA, 957 bp, Chromobacterium substugae
atgaaaaagctggctctgctcgccctgaccgctgctttcagcctggtatccgctaacggtttcgccgctgaaaaagctgctgcttccgctccggccatccacaaggccaaaaaagttgaaaagaaaaaagtagcttccgctgctcaaaaagctcaagccgccaaggctgacgcttccgctccggctaaaaaagctgccaaaaagcacgctaaaaagcacgtagccaagaaagacgcttccgccgctcagaaagcccaagccgccaaggccgacgcttccgctccgaaagccaagaaggctcacaagcacgccgctaaaaagcacgctgtgaagaaagaagcttccgctgctcaaaaagctcaagccgccaaggccgacgcttccgctccgaaagccaagaaggctcacaagcacgccgctaaaaagcacgctgtgaagaaagaagcttccgctgctcaaaaagcccaagccgccaaggccgacgcttccgctccggtagccaagaaggctcacaagcaccacgccaagaagcacgctgccaagaaagaagcttccgctgctcaaaaagcccaagccgccaaggccgacgcttccgctccgaaagccaagaaggccaagaagcacgtagccaagaaagaagcttccgctcagaaagcccaagccgccaaggccgacgcttccgctccggtagccaagaaggctcacaagcaccacgctaaaaagcacgctgccaagaaagaagcttccgctgctcaaaaagcacaagctgccaaggcagacgcttccgctccggctaaaaaagctgcccacaagcacgctaaaaagcacgtagccaagaaagaagcttccgctgctcagaaagctcaagcagccaagaaagaagcttccgctccggccaaaaaagccgctgctaaaaagcacgctggcaagaaagccgctgcttccgccgccaagtaa

SEQ ID NO: 3980 - DNA, 687 bp, Chromobacterium substugae
atgcgcgtcgtgcggctgacccgaggctacaccaagcacgccgaaggctcggtgctggtggagtttggcgacaccaaggtgatctgcaccgccagcgtggaggagacggtgccgtccttcctcaagggcaagggccagggctgggtgacggcggaatacggcatgctgccgcgctccaccggcagccgcatgcggcgcgaatccgccgccggcaagcaatccggccgcacccaggaaatccagcgcctgatcggccgctcgctgcgcgcggtgatcgatctggccaggttgggcgagcgccagatcgtcatcgactgcgacgtgatccaggccgacggcggcacccgcaccgccagcatcaccggcgcctacgtggcgctggccgacgcgatccaggggctgatccgggcaggcaagctggacgccagcccgctgcgcgaccaggtggcggccatctcggtgggcgtctatcagggacagccggtgctggatctcgattatccggaagattcgtcctgcgaaacggacatgaacgtggtgatgaccggcagcggccgcttcgtcgaagtgcagggcaccgccgaaggcgagccgttcagcgaagaggagatgctggcgatgctggcgctggcgcgcaagggcataggcgaattgctggcgctgcagcgccaggcgctggccggctga

SEQ ID NO: 3981 - DNA, 879 bp, Chromobacterium substugae
atgaaactgtcgattttccaggagagcaggataggagggcgcagctacaaccaggacaggctggcgctggcgcattcgcgcgatacggtgatgctggtggtggcggacggcatgggcgggcatatgcgcggcgaagtggccgcgcagatcacggtggacctgctcagcgagctgttctaccagcaggccgcgccgacgctcagccatcccaaccgcttcctggtcaacgccatcagttcggtgcatcaggtgatcctggaatacgccgccgaccaccggctgcccgacgtgcccagcaccaccgtggtggtggccatcatccagcagggccagctgtattggtgccatgtcggcgactccaggctctacttgctggacgggcagggcatgcggctgcgctcgcgcgaccattcgcaggtgcagcgcctgatcgaccaaggcctgctcagcgaggagggcgccaaaacccacccggaccgcaacaagatctacaactgcctgggggcgaccagcgacccggacatcgacatcggcgagcgccaggaagtggggccgggctgttccatcgtgttgtgcaccgacggcctgtggtcgcaggtgcaggacggcgagatggaaaaggtgttcgccggccgccacgtcaaccaggtgttgccggcgctgatcaatgtggcggagcggcgcgccggcgccggcggcgacaatctgtccgcgctggcggtcacgctgctggacgattcggtggagcttggcgatcgcgacgatgtgctggataccgagaagacgccgccgcagaagggcgggcggctgattctggagtccaatctggaaaccatgcatcaggaaatcctggccagccaggtgggcaagggcagctga

SEQ ID NO: 3982 - DNA, 972 bp, Chromobacterium substugae
atgactcaatccagcaagcaaaccgcgctgccggcaggctaccgcctcgctgagtacaccatagtgcgccaactttcggttggcggcttcagcgtggtctatctggctttggatgatgacgaccacaagttcgccatcaaggaatatctgccgcgcaacctggccgaccgcaaccgcgagggcgaggtgacggtgccgcacgaaatggaccgggacgccttcaacctgggcttgaagtgtttcttcgaggaagggcgggtgttgtcgggcatcgcgcatccgaccgtggtgcgggtgagcaattttttccgcgccaaccagacggtgtacatggtgatggagtacgccgacggccgctcgttggggcgcgagctggagctggcgggggggcggatggaggaaaggctgatccgcaagtggttcaccgcgctgctgtccggcctgcgcgaggtgcatagccagcgcctgctgcatctggacatcaagccggccaatatctatttgcggcgcaacggcgtgccgctgctgctggacttcggcgcggcgcggcagacgctgtcgcgccgcgacaagcatttcgccgcgatgtacacgccgggtttcgccgccccggagcagtatgagaaagaccagccgctggggccgtggaccgatatctacgcgatcggcgcctgtctgtacgtttgcatgggcggcgccacgccgccgaatgccagggagaggctggagcgggatgggctggagccggccggcaaggcgttccggcacttgtattcgcgcgagctgaccgaattgtgcgaccgctgcctggcgctggcgccggatctgcggccggccacggtgatggaggtgcaaaagcggctgcaggagacggaatacagccagccggagccgccgcccggcgacggcaacaagctggtcggctggatccgcggcctgaccggcgggcgccatcgagaggggaccgaatga

SEQ ID NO: 3983 - DNA, 867 bp, Chromobacterium substugae
atgattctgagcatgaccggctttgccgccgctacccgggaattccctggcggcatgttgagcctcgaagttcgcgccgtcaatcaccgttacctggacgtgcagatgcgcctgccggaagagctgcgcatcatcgaaccgcaactgcgcgagcagatcgccgcccgcgtcacccgcggcaaactggagtgccgcgtcggcctcaaccaggtggacagcgccgcccccacgctggaactgaaccaggccttcctgagccgcctgctcgaggtctcccgcgaagtgcagcagcaaagcggcgagaacaaaggcttgtccgtcggcgaactgatgcgctggcccggcgtattgaaaagcaacgaactggcgcccgaagtgctgcaacagctgtgcctggcggcgctgcaaaccgcgctggccgacttcaacgcctcgcgcggccgcgaaggcgaaaaactgaaggcggtgctgatcgagcgcatcgagtcgatggaggccatcgtcgccgccatcaaaccgaagctgccgcaaatcctggacaactacatggccaagctgtccggccgtctgcaggaagccctgggcagcgtcgacgaagaccggctgaagcaggagttcgcgctgttcgcgcagaagatagacgtggacgaggagctgtcgcgcctcaccacccacctgtccgaagtgcgccgcatcctgaaatccggcggccaatccggcaagcgcctggactttttgatgcaggaactgaaccgcgaagccaacaccctgggctccaaatcggtctccaccgacaccacccaggcctcggtggaactgaaggtgctgatcgagcaaatgcgcgagcagattcaaaacatcgagtaa

SEQ ID NO: 3984 - DNA, 417 bp, Chromobacterium substugae
atgagcgtaagcagcatcggtggcggcgcatccaactggcccgtccagaacagcggttccgccacttggcagcagaaccagcaaaacttccagcagctggcttccgcgctgcagtccggcaacctcggccaggcgcaatcggcctactccagcctgaccgccaacctgccgaatggcggcaacggctccggctcgcagagcaacagcccgttcgcccagcttggccaggcgctgcaaagcggcaatctgcaaagcgcgcagcaagccttccagacgctgcaaagccaccactccggccaccaccatcgccatggcggcggcggcggcgaatcgagcggcgccgacgcttcgacctccaccagcgcttccagcaatagcggcggcactgtcggctcgctgctcgacaccactgcttga

SEQ ID NO: 3985 - DNA, 1683 bp, Chromobacterium substugae
atgttcgcgaggtcaacaatgtcttccaagtgtttattgattatcccgcctaacattacctttgaggcttttgtcaatccatccgccaatagcaagtattggactcacgcgaacggcaagagatatggcgtgctgattaccgacgtcccgcttggcgtgttgaccatcagcgcatggctgaaggaaaaatgcgatgctgaagtcaaggtaatcgatttcaacacggaaatacaccagacttgggatgatcctgacgccacttcctttcatgactggtttgaaagagtgctgtcctctgtgaagaagtctggttttgagccggatctgataggtttttcctccttgttcatcaccgggtatgaaaatcttttgagcttggcggatatttcgaagcagattttccctcaggcattccggatttgcggtggcaacctccccacaaccatgtatcgcgaagtgtttgcggatagtccagaggcttttgacgcgctttgtttcggagaaggggagttgcccctgtcggagctgatggcggcggaaaacaagcaggattactgcaatgcctccgcccagtgggtgactcgggagagcgtgaaggccggcgccctctaccagcataacttcatctccaatctcgatgaaattcccgatcttgattacgattgcatcgatctggaggcgtatcatcttaaccctaccatcaaagcctatacctcgattggggatagaacaaactatataacctatatgggtagccgcggctgcccattccattgcaccttctgcgccgcgcataccgtgcatggtcgcaagatgcgcagcttttccatcgagagaatcgagcgcgaacttttcgatttatgcgaacggtattcgcccaataccttggtgatagaggacgatatgttcctgtgggacaaggactgggcgaaaagcgtgctgaagatcgcgcaaaagctgaacctggtttgctttttccccaatgccttggccttgtacgctttggatcggccgatgctggaggagctgtaccgaaccggcgtgcgtcaattgacgctggcggtcgagtctggcagcgcgcgggtgttgaaagaggtaatgaaaaaaccgctgaagctgtcgattaccaatcgggtggtcgaggattgccgggatttgggcatttataccgactgcaacatcattatcggcatgccgggcgaaacgctgcgcgatatcgacgataccagggagtttttgcgctctttggatgcgaattggtatcgaatcaatgtcgccacgccgttggccggcagcgagatgtatatcaatgcggtgaagaatggccagatcaagggcgatatccggatggcaggctacaagaaatgcgtcgtcgaaaccaaggacttcacgccggcgcagatagaggccgtcgcctacgatatcaatctggagatgaacttcctgcgcaactccgatttgaagtacggcaattacgagcgggcgctggaaaccttcagcaatgtcttgctgctgcgcaatgaccatgctttggcgatgtacaaggtgatcgagtgcaaaaacctgatgggcaagtttgacgaaagcgaggcgctagcgcggcggctggatgaaatgatccaggccagcccgttctggacccgctacttccaggagcatggcctggaagtcgcttcctgttga

SEQ ID NO: 3986 - DNA, 270 bp, Chromobacterium substugae
atgaccaaagccgaactgattgcccttctctccgacaagtccggcctcaacaaggccgatgtactgcgtgttctgggcgccttcgacgaagtgctgctggacaccctggccaacaacggcgagctgagcatcgttgccggcaagttcaaggtgaaggaaagcgccgcccgcaccggccgcaatccgaaaaccggcgaaaccattcaaatcgccgccaagcgcaaagtggcgtttgttgccagcaagcagctgaaagaccgcatcgcctaa

SEQ ID NO: 3987 - DNA, 867 bp, Chromobacterium substugae
atgcatatcggatacatcggcttgggcatcatgggccgcccttgcgtcatcaacctgctgaaagccggccatcaggtcagcgtatgggcgcggcgcaaggagagcgccgccgaggcgctggcggccggcgcatcctgggccgatagcccggcggagctggctgggcaggtggaagtgctggtgaccaatgtgtcggataccgctgacgtcgagtccgtattgttgggcgagggcggcgcggcgcaaggcgcgcggcccggcttggtatgcgtggacatgagcaccatcgcccccaacggcgcgcgccggatcgccgcgcggctagccgaacatggcgtcgaatttctcgactgcccggtatccggtggcgaagtcggcgcgatcaacggcacgctcaccatcatggcgggcggcaacgctcaggcgctggagaaagccaggccggcgctgcaggcgatggggcagaccatcacccacatcggcgccagcggcgccggccaggtggcgaaagcgtgcaatcagatcgcggtggcggtgggggtggcggcggtggcggaaatcgtcaagctggcgcgggcctgcgacgttgacccggcgccggtgcgcgcggcgctgttgggcggtttcgcccagagccgggtgctggacgtgcatggccagcggatgatagacgacaattacgcgccgggcttcaaagccaagctgcacgccaaggacatgcacatcgtgatggataccgcgcgcgagcagggcatcagcctgccggcggcggaacggacgatgcaactgatagaccaactggtggggcaaggcgagggggagttggactcttccgctatcgcccgcctgatctggcagcagaactga

SEQ ID NO: 3988 - DNA, 336 bp, Chromobacterium substugae
atgaacccgcagaatgacgacaagcgccgctcggcggtggcgctttcctatcaagatggccagcgctcgccgcgcgtggtggcgaaaggctacggccagatggcgcagcgcatcatcgaatgcgcgcaggaggccggcgtgttcgttcacgattcgccggaactggtgtccttgctgatgcaggtcgacatggacaagcacattccccccgaactctaccgcgcggtggctgaaatcctggccttcgtctattacctggaacggcaggccggcgatggccaggccgagttcgaagactggctggcgggccgcaaaaccccggtcagcaatccctga

SEQ ID NO: 3989 - DNA, 1041 bp, Chromobacterium substugae
atgattccttcactgcccaatgcgatcgccatcaccacgcaaggcgcgcaaaccctgaaccagctgagggccccggtagacggcgcccgcttgctggaggcgctggttcagccttcccgcctgccatcgctgatgataggcgagttgctgactgccaaagtggccgatcaactgggcaataaccagctggcggtgctgatcaagaatgggctgttcaccctcagcctgccgccgggcgtcaatccatccggcgatacgctgaatctgaaagtggtttcgctggagccggctctcaccttcgccctgcaagagggcggcaaggatgcgccgccggcgcaggacggctcggtggcggtcaagctcagccaggcgtcgcgctacctcaccaccctgcttggcgcttccgacgaatccgccgcgcccagcaagccgttgcaactggatgccgccgagcatccgcccgcggtgctggccaagcagctgcagcaggacgtcaagcaaagcggtttgttttacgagtcgcatctgaaggatttcagcaacggcctgcatccgatcgagcagctcaagcaggagccgcaagccaagttgacgctgaccttgcatgcgctggcgctggacgatggctcgaagaccagccagtcgcagacccggccccagctgcaggagctgggcggcctggtgcagcggcaactggatggtttggagaaccgcgcggtgcagttccagggcatggcctggcctgggcagccgatgcagctgcaaatcgagcaggaggcgctgcagaacgagcgccgcggcgatggccaggaagatatcccggtctggaacaccagcctggcgctggagctgccggccttgggcggcatggcggtgcgggtgcggatggtcggccagtcggtccaggtttcattcagcgccgacgaaggcgaaaccggacagagaattcagcagaacgcggcccggctgcaaaacggcatggcggccgccggtttgacgctggccagcttggtggtgaatcagaatgaacccgcagaatga

SEQ ID NO: 3990 - DNA, 354 bp, Chromobacterium substugae
atgtccggcgccttcttcccatatctgatggtcgtgctctggctgacgctggcggttgccatggtctaccttttcggcaggctgcagcggctggaaagcaagcgcgacagcctcacttcgctgtacctggatcagcagcagcagcagatcagctcgctgcagcgcgaggtggcccggctgcaatcgcggagcgagcaccaggcgcaggcggagccgggactcagcccgtacaatcaggcgatcgaaatgatacgccaggggctcaccgcgtccgaagtggcgtcgcgttgcggcatttcccgcagcgaagcggagttgatcgtctcactttatcgtaacagtcccacttcatga

SEQ ID NO: 3991 - DNA, 339 bp, Chromobacterium substugae
atggagcagcaattcgcgatgagcgccgaggggctggcagatttgatcgacgcgctggagccgctggcggcgcaaacgctggaggtggcgcgcagccatgatcggccccgattcgtggagttgtaccgcagccaggaagcctacacccagcaattgctgaagcggctcgaggccggcgaatcgcagcaattgagcggcgcacaacgcgataccttgcgccgggtgcttggcttgcgggtgcaaacccagcagcaaatcgcttcctgggccgagcaggtcaagcatgagctgagggcgttgagccagagttccaagctaagccggcaatacaaggcgtga

SEQ ID NO: 3992 - DNA, 423 bp, Chromobacterium substugae
atgctcaagcagttcaatcaggcttacgccaatgacgccttgaaaactgcggtatacggagcgagcccggttggcatagttgtgatgctgtatgaaggggccatcaaggcgctgggcgcggcgagcatcgcgatggatgccggccgtttcgacgagaaggcgcggatgatctccaagaccgtggatatcctggaagggctgcggatcgccctggacctggatcaggcgtccgaggccgcggccaacctcaacgatctctacctgtacatgaagcttcgcctggccaaggccagcctgaagaacgacaaggaaatcatcgccgaagtccgcggcctgctggaaaccatcctgccggcatggcagcaggtggataaggccaacgcggcgaagcagcacgacgctagcgcgcaatcgggagcgtga

SEQ ID NO: 3993 - DNA, 1299 bp, Chromobacterium substugae
atgattgaaagacagccgttgacggcaagccagggccgggcggaccaatacaacacccagctcagcaccgtcggcaagctcagttcgtcgttgtcggccctgcagaccgccatgacgagcctgtcgtccggccgttttctgcaagtgttcaaggcgtcggtcagcgatgcgtcgatggcggcggtttccaccaccagcggcggcaatgccggcacctaccagatttcggtaagcaatctggcgaccaaccggcaactggtgttcgaccagtccggcgggaagaatattaccgatccgaaagcgacgatagccggcgcgccggaccagctgaccttccagatcaatggcaagacgcagaccgtgaagctgcgcgacaagccggacgaagcggtgtcgctgcagacgatcaacgacaagatcaacgcggccggcatcggtttgaacgccaccatcgtgcagaacggcagccagtacaagctggtgctggcttcgtcggaatcgggcaacgacaacaagttcaccatcaccggcggcggcacagatagcggcaagaccggcggttcgacgctggcggggctgtcgcaaagcgacaatggcgccaaggaatcgcaggatgcccaggatgccagcctgacggtgaatggcgtggccatcaccgccggcagcaacaaggtgtccaacgcggttcccggcgcggaagtcgacttgtacaaggccggcacgttcacggtgtcgctggcgccggacagcgccggggtcggcaagaacctccaggcttttgtcgacgcgtacaaccaggtggtcggcgacgtcaaggccgcccgttccggcgcgatgaaaggcaatgcgtcgatactggacatccagacccggctgcagcaggtattgtccacgccggtggcgggcgcggatccggtcaattcggtggcgttcctgtcgcaggcgggcatctcgttgcagaaggacggcaccctgaagctggaccagaccgcgttcaacgacgcgctgaaaaaagacaagcaagcggtgaccaatctgttcggcaacccggccaacaccggcttcgcccagcgtttcaataccgagatcaacggcatgctggggccgacagggttgattgaaaccagccgggccacgatcaagagcaaggtcagcaccgaaacccagctgcagagttcgcttcaggccaggctggactccaagcaaacccagctgattcagcaatacacggcgctgaacaagactttggcccagatgcagtcgggttcgaacagcctgttcaacctgatttccaagtaa

SEQ ID NO: 3994 - DNA, 438 bp, Chromobacterium substugae
atgaggagcgtgatcatgcaaatcccttctgttttgtcgccttccatcaacacggcgaacgccccggcgccacgtcaacaactggtagagttggcgcaggcgccttcctccgacccgaaccaatcggttctggcggattccgcgcaggctgtcgctgcggctgggcagagccagcagcaacagtcgtccgccgatgcgcagaagcagcagaccgatcccaagcaactgcaggattcggtcaaccagctgaacactgcggcatcgttgtacaatagctccctgcagttctccgtcgacaaggacaccggcgcgaccgtggtcaaggtcgtcgacaaggcgaacaaccaggtgattcgtcagattccgtccgaggaagcgctgcgcatcgcgaaggcgatcggtgacttcaaaggacttttgctgaaggacaaagcctga

SEQ ID NO: 3995 - DNA, 849 bp, Chromobacterium substugae
atggccattaccgtcaacactaatatagcgtcgctgcaagcccagctgaaccttaacaattcccagatgtcgctgaccacgtcgctgcaacgtctgtcctccggcctgcgcatcaacagcgccaaggacgacgccgcaggtctggccatttcgcagactctgacttccgccatcaacggcaacaaccaggcgatcaacaacgccaacgacggtatttccgtcgggcagaccgctgaaggcgcgttgggacagatcgccaacaacctgcagcgtatccgcgaaatcgcggtgcaggcgtccaacggcgccgtcagcaacactaaccgttcgcagctgcaaagcgaagtggaccagctgacccaggaaatttcgcgtatcgtgcaaaccacccagttcaacggcacccagctgttgtcgggcagcgcgattctgaccttccaggtgggttcgtccggcgccagcagcaaccaggtttcgatttcctcggtggacatgacgtctgccggcgtgctgtgcagctacaactcgtcgctgaccgccaccggcaccatcaacatcacctcgcagtccggcgcgtcggccatcctgtcgacgctggacagcgacatcgcggaaatctctaccgtgcgttcgacctggggttcggtgcagaaccggtttgacgctgttgtggccaacctgcacaactacgtacaaaacctgaccgcagccaacagccgtatcgtggatgtggacttcgcctcggaaacggctaacctgactaagaaccagattctgcaacaggccggcgcatcgattctgaaacaagccaataccctgccccagtccgcgctgacgctgctgcagtaa

SEQ ID NO: 3996 - DNA, 879 bp, Chromobacterium substugae
atggtcctctgggccgataaggggaatgaaatggcaatcaccgtcaataccaacctggcctcgctgcaggcccagatcaacctgaacaactccagcacctcgctgaatcagtcgctgcagcgcctgtcttccggtctgcgcgtgaacagcgccaaggatgacgccgccggtctggccatttcccagaccctgacttcggccatccgcggcaacaaccaggcgatgaagaacgccaacgacggcatctccgtcggccagactgccgaaggcgcgctgggccagatcgccaacaatatgcagcgcatccgcgaaatcgcggtacaggcgtccaacggctcggtcagcaacaccaaccgttcgcagctgcagaacgaagtggaccagctgacccaggaaatctcgcgcatcgtgcagaccaccgagttcaacggcaccaagctgttgtccggcggcgccacgctgactttccaggtgggttcgtccggctcgtcggacaaccaggtttcggtatccgccaccgacctgacctccggcggcacgctgcattcgtacaacacctccttgagcgcggtgaagaccatcgacgtgaccacccagggcggcgcctccgcggtgctgtcctcgctggacgccgacatctcgcagatctccaacgtgcgttccactttcggcgcggtgcagaaccgcttcgacgcggtggtggccaacctgcagaactacaccgccaacctgactgccgccaacagccgcatcatggacgtggacttcgcgtcggaaaccgccaacctgaccaagaaccagattctgcagcaggccggcggctccatcctgaagcaggccaactcgctgccgcaagccgcgctgaccctgctgcaataa

SEQ ID NO: 3997 - DNA, 3858 bp, Chromobacterium substugae
gtggaaccatcccaaatccgtaaaccgcgcgtcggcgttctgacgcgagatctgcaggatgccgcctgctacaaactgagacttggcgatccgctctgcctgatgtcgccggtgctggaagcctaccatttcaagaaccaggccgatcacagctacgagggcgtgtacccgttcaaggaggaccgcgatttcgtcgacgcgatggacatgttcatcgtccagcgcctgtttccctatccggagttccggcccttgctggaaatgatcgtcgcgtcgggcaagcccatcgtctacgaagtggatgactggctgctggacatgtccgagcagcatgtgatgtacagcatctgcgagccgtcgttcaaggggatcgagtggctgctgccgcagtgctcgctggtgacggtgtcgaccgaagcgctggttgagaaggtcaagccttacaacgacaaggtcttcgtgttccataaccatctggcgaccgaacgggtggtggagccgctgccgcatagcggccaggtcaccatcggcttcgccggcaccagcactcacgccaaagacgttgaaatgatttcgtcggcgctgctgcggatctaccacgagtatgccggccaggtgaagttcgtgttttggggagatgtgcctcccgatttcgtcggcatcaaggatgtgcgcaaggtgccggaattcgtcacctacaacgaatacctgtccgaactggccaagctcaagatcgacatcggcatcgcgccgctggtgcagagcgaattcaatgattacaaatcggacatcaagtggctggagtacgcgctggtcggcgcggccgcggtggtgtccgatgtcaccgcctacgccggtttgaaggacagcgggctggcgatggtggcggacaataccgaagaaggctgggtggccgggatcagcaagctgatcgacgatgccgcgctgcgcgccgagcaagccgccgccgcgcgccgccatgtgctggagaaccggctgctggagccgcgggtgggcgatttgctggcccagtacgcggcgctgctgcccgaagcgctcaagccgcagccgctggcgcagccgggccgcatcgtcacgcacgcattggccgaaaacgacgtggatggcctgaaggcctaccgcaagtgggtgaaacgccgccagatccgcgaagtgcacgccgaacagctggcggagcggatgatgatggcctggaagcaggtgccggtgttcaacctgattctgctggcgccgagcaaccgcctgacgcgcttgtcggaaagcttcaccgcgatggaaaacctgctgtaccgccattggcggctgatcgtggtgtccgacgcgccggagccggacccggtgttcagcagcagcccgaacctgggctgggtgcaactggcgagcatggacgacgagcaacaggtttccgaggtgatcaacagcatcatcgccgacgtgccggcagactgggtgatgctgctgccggccggcgcgcgcctgcagccgaacgcgctggcgcggctgggcgaggagatccacgcgcatccggaatacggcgcgatctataccgaccatgacgtggtgtcgccgatgggcaagcgcttccgcccgtccttcctgccggatttctcgccggagtacctgcggtcgatggattacaccagctacgcggtggcgttccagcgcgagaccctggccaagatcggcggcatgcagccgtatccgcgcgcgcattgctacgacgcgctgctgcggatatacgaaaattgggaccgcggcgccatcggccatgtcgacgatgtgctggtgtcgctgccgtgggtggatcccaagatggacagcctgggcaatgcctcgcgccgggtggcgctggaaagccatatcggccgctgcggcctgccggcgtcggtggacgagggcctggtggcgggaaccttctactacgaataccagctgctggcctcgccgctggtgtcggtgatcatcccgagcaaggacaagctcgaatgcctggagccttgcctgagcagcctgttcggcatcaccggctaccagaatttcgaagtgctgatcgtcgacaacgcctcgcaggatccggaaaccttcgagttctacgaaaaggtccaggcgcgctatccggggcggatccgcatcctcagctacgacgcgccgttcaacttctccgcgcaatgcaacctcggcgcgcgcgaggcgcgcggcgaatatctgctgctgctgaacaacgacaccgaagtggtgttcccgcactggctggagcgcatgctggctaccgcccagcagccgggcgtcggcgcggtgggcgcgcgcctgctctatccggagatcggccgcgtgcagcatgcgggcatcgtgctgggcatgcccggcggcatgtattcggtggcggaccacgtattcgaggatatggactacctgtacccgggctatctgaatcgcagcctgaccatgcagaactattccgcggtgaccgcggcgtgcctgatggtggagaagcagatctacgaagcggtgggcggcatggacgaagaggtgttccaggtctgcttcaacgacgtcgacttctgcctcaagatccaggccggcggcctgcgcaacgtctacactccttacgcggtgctgtaccaccaccacgccaagagcataggccgggtcaccaccgatccccgccccgcgctgaaggcggcggtgcgcgagcgcgaggagatggaggcgatgctggcgcgctggctgccggtgatgggcaacgatccgggcttcaaccggcacttgtcgctgcgcaccaagcgagtggcgatcgagtccgaccgcatcgtcgcctgggacgccaagctgcctgggcgcaaaaaggtgctgggcatcccggtgccgggcggcagcggcgaataccgcttgagccagcctttgcaggtgctgcaggagaaaggcaagctggacggcgaaatccaccagccctctgccggcattcccaccgtggtggagctggtgcgccagggaccggacgcgctgttgctgcataccggcatcagcgactacatctatgaaaccatggaggcttatcgccgctatatccccgatctgcgcatcgtgttcggcctggacgacctggtcggcggcgtgccggagaaaagcagcctgtatgaccactggtcgcgccactatccggacgccaagcagcgtttgcgccgcgtgctgaagctgtgcgacgcggcggtggtgtccacccagccgctggccgatctcatccagaagatggtgggtgaggtggcggtggtgcccaaccggctgcgccgctcgatctggggcgatctgaagtcggaacgccgcgtcggcgacaagccgcgcgtgggttgggtcggcgccggccagcaccgtggcgacctggagttgatccacgaggtgatccgcgccacgcacaaggaagtggactgggtcttcatgggcatgtgcctgccgcagttccgtccttacgtcgccgaagtgcatcatgcggtcaccttcgccgactacgccgccaaggtggccagtctgaacctggatctggcggtggcgccgctggagatcaacccgttcaacgaggccaagagcaatctgcggctgctggagtatggggtgctgggctggccggtggtgtgttccgacatttatccctaccagaccaacgacgcgccggtctgccgggtgcccaaccaggccgaagcctggatcgaggccatccgcgcccgcgcccacgatatggacgccaccgcgcgcgagggcgacgcgctgcgcgactggttcaaccgccattactggctggaagaccattacgaagactggttccgcatcttgcacggctag

SEQ ID NO: 3998 - DNA, 234 bp, Chromobacterium substugae
ttgggatggttccacgttattttcctgagattccatggcggcagctcgccaggtcatgaattgaatcgggtccgcagccggacaccccggacggcaatacagcaagaacgcactcgaagcgaacgaaagaaaagggcctgccggcccttgagcgaaaaccgcgccgcggcgaagccccgcgctcccatcggagcggagccgccgcggccgtcaggccgatcagcgccactatag

SEQ ID NO: 3999 - DNA, 1755 bp, Chromobacterium substugae
atgaaaaaactgttgtttgtcgtgcccatgcacatttcctgggactcgttcaccaagcccgagttctacaatgtgcagctggccaaggccgatgggaaggtctacaacatcccgcgcacggatttgcccctggggcccttgtccatctcggcgtacttgaagaagttcctgccgctggatgtgaagctgatcgacttcaacgccgaggtcaacgcgctggacgcggtgcccttcgattcgttcgaagcgctgtgccgccatttcttccggcagatcgaggatttcgcgccggacttcgtcggcgtctcctcgctgttcagcccctcgttcgccaacttcatggattgcggccggatggcgcgcgaggtatggccggacagcatcgtggtcggcggcggcaatatccccaccaacagctacgagcagatctaccgcgacatgggttgcaccttcttcgacggcctgtgcttcggcgaaggcgaaaagccgatgctgaacctgttgcaggcggaagatccgctggccttcctggccagctcgtcggcatggatcacgcgcagcaatgtgatggatgaggcgctgctggttcccaagcacgacttcatcgacgacctggatgaaatcccgttcttcgattatgacttgtgcgacatcgacaagcatgaaatcaaccaggtggtggcctcctaccacaatctggacaagacgcgcggcttccatgtgatgacatcgcgcggctgtcccttcctgtgcaccttctgcgcctcgcaccgcacccacggcaggtcgatgcgctatcactcgctggagcgggtcaaggaggactttacccggctggtcaagcattacggcgccgaaaccgtcatcttccaggacgaccacctgatggccgattccgaccgggtgtacaagatactggacatcgtgaagtcgctgaacctgcagtcggtgtatcagaacggcctgacgctttacgcgctggaccgtccgatgctgcaggccttctgggacgccggcgtgcggcacctggtgctgccggtggaaagcggcagcgagaaggtgctgaagaagcagatgaagaagccgctgaagatgaagatctcggagagggtggccagggattgccgcgagctgggcatctacaccaataccaatattttgatcggcatgccgggcgagaccaaggaagatctggaagaagcgcgccgcaatctgcgcgagatcgcctccaactggttcaacatcgcttgcgccagccccatcgtcggcagcgagatccacgaaatctcgaaagagaagggctatatcaagatcaatagcctggggtcggactaccgcaccgcggtcatcaataccgaggacttctcggccgagttcatccaggaataccagtacttcatgaacctggatctgaatttcgtccataactacgatctgcgctgcggcaattacgaatgggcggaacgggggctcaagaacgttcttcgcctgaagagcgaccacgccttcgcccactattacctggcggagtgttaccgcgggctgggccggcttgacctggcccaacaccaccgcgattgctacctgcagtcggtgcagagctcgttctggggacgctgggcctggatcttcggcctggatggcgtcaatcccgacgactggtcggaggagaactacggcttgctggccgaaatcctgctgccgcgcgccgcgccggaaggcgacgcgccgatcgcgctggccgcccaggcttga

SEQ ID NO: 4000 - DNA, 3468 bp, Chromobacterium substugae
atgcacctgctgtgccattacctgaacaagctgggggaggaggcctatgtcttctcccccgaaaccgatcccaagctcagaacgccgtatctgacccaggacatcgtcgatcgccataaagccagcgggcgttcccccatcgtcgtctaccctgaagtggtgcatggcaatccgctcaacggcaaggcggtggcgcgctacattctcaaccaccccggcctgttgggcggccccaaggattacgatccgtcggacctgctggtgttctggcaccaggattatgtcgattacgccaagtatcccgacccgtccttcattttcatcccatcgatcgacaccgccatcttcaacaacgacgacaacccgcacgacgacagccgccaccgggtgctggtttacccgggacgctacaagcacgcggagcgggatttcccggcgttgttccagaacaccgacgtcatcacctacgagtggccgcaaagccatgaggagctggccgcgctgttgaggcagggcaaggtgctgtacaccttcgccaattcggcgatcatctccgaggcgctgctgtgcggctgcccggtggtggtgatggaaacggtgttttccaaaaaaccggaagagcgggcggggctggcgctggggctggcgctgccgggcgtgaccttcgaggacacgccgcaggcgatcgccgccgcccatggcaaggtggtggactatcagcaggtttatcaccaataccagctcgagctgctgcagcagctcgagggcttcatcgccgcgtcgcaaaagatgccgcagggcggtccgaacgagattgtcttcccttcgctgaagcccgcgcaggccagcccggagcaggcccgctacgacgcctggatcgcgcgcaatgagttgcggccgtggcaggccgaaatccacgccgaaagaatggtgcgcagctggggcagccagccccgcttcatcgttctgatgccgctgaccgccgatcgccagcaggaggcgttgaagtccatcggctcgatggggcagcagctgtacaagcattggcaactgatcttcatcgccgacttcgactggccgcacgcggctttccagggctccgacgtgctgggttggctgcgcatagacgacgcccgcgatcccagccagctgacccaggctttcgccgcggtgataggggcgttgccgtgcgactggatcacggtgctgccggcaggcgccgaattggcggtcaacgcgctgctgtcgctgggcgatcacgcctcgctgcatccggaatggcaagccatctacagcgactgcgacgagttgggcgcggacggcaagcgctgccggccggtgttcaagccggacttcaatctcgacctgcagcgcggtgccgactacatcagcccaagcgtctggttccgccgcgaggcgctgcaggagaccggggctttcgccgaagcgccggcggccgatggctgcgacgccttgtggcggctgcatgacgcctacggcggccgggtcatcggccatatcgccgacatgctggtgcatttgccagcggcggcggccgagccggccgacgccgccgccgcgcgcgagcgggcattggccgcgcacctggagcggcagggcggcgcggccgtcatccagccgggggcggcagtcggcagcttccatatccgctatctggcggccggccagtgcaaggtttccgtcatcatcgccgacgccggcgacggcgtcagcctgtcgtccagcatcgacgccgtgttggcggcggactgggagcaggtttgcgagattctggcggtgacgccggcggcggccgagctgcctgccgcggcgcggcgggtggcgtgcgcctccgagttgtcgctggccggacgctatcaattgggcgccgaggcggcgagcggcgattacctgctgttcctcgacagccgggtggaagtgggccggagcgactggttgccggacctgcttggcctggcctcgcgccaaggcgtcggcgccgcggcgccgcgcctgctgcgagccgacggcaaaacggtctggcgcggtccgctgctgctgggcgcggacgccggcgccgcatcggtgttcgacggcgccgacgcggcggcgcccggcgatctgggccgccagctgatcgagcacaatccgggagccgtgccgctggactgcctgctgatgtccagcgcgctgtatgaggaaatcggcgggctcgacgcctcgctggaggatgccgacagcgccgccgtcgatctatgcctgaagatccgcgccgccgacaagctgctggtctggacgccgttcgtgtccgcgctgcggcagcccgatgcggcccctctcgcggcgaggctggacgaggaggcgttgtcccggcgctggtatggctggctgcggcatgacgcggcgtacaaccggcacttgagtctggacagccggcaggctttccaggtggagaacgtctactccgccgagtgggaccccgatttctacgagcgcgcccgcgtgctgatgctgccgggcacgtcgccggccggcgccgcccgcttgcgggcgccgctgctgcgcttgatggatgacggcaagctgctggccaccatgcttccggccgggcagcgcctgcccagcgccggcgagctcgaacgcctggcgcccgatgtcctggtgcaagccgcgcgcttcgagcctggcttcctcgattggctgcgtctgagccgccgcagccggccggacatgctgtccatcctggtgttggacgatctggacgccggcggcgctgtcagcgaccgttacgccagaacgatgttgcgggcgctggcgcgggaggcggacaggatcatcgtgccgaccgaagcgctgcgggcgctggccggcgcgttctgcgaggatgtgcgcctggtgccggaggcgctggacgaggcgcgctgggaagggttgatttcgctgcgcggcatgggcaagaagccgcgcgtggcttggagcggcacggaggccgaggtggaggacctgatgctgctcactgggatcatcctcgccaccggcggcgagatcgactggatcgtattcggccactgtccggatgcgctgcatccctacctggcggaataccatcccttcgacctggcaagcgaggattacccgcgcaagctggccagcctgggaatagacttggcggtgatgcccaagcacgccgatggccgccgcgaggcggcggggcggcgacggctgctcgaatacggcgctttgggcatcccggtggcgtgcagcgcgctggatgactggccgggactggcgcaagcgccggtggcgcgggcggacaacgaggccgcggcgtggagccaggtcttgctcgaacgcgcgcgcgatctggagcgggccggccgcgaaggcgagcggttgaaggcctgggtcaaggaaaattgcatgctcggcccgcatttgccctcatggctggaggcgcttggccgataa

SEQ ID NO: 4001 - DNA, 117 bp, Chromobacterium substugae
gtgcatggcgcgcacgccattggagacccgggtatagcctggcgcgcatatgtagtagggctggtgacgctcattgtagaattttttttcgatctgcatattcgcttgctttcatga

SEQ ID NO: 4002 - DNA, 162 bp, Chromobacterium substugae
atgcgtttgccggagcctgaacggcggctgcgcgcgatgcccatccgcggcgccgccgctgattcggaaacccggccgcgccgcggcggctggccctggtttccatgcttggaattcatgaaagcaagcgaatatgcagatcgaaaaaaaattctacaatga

SEQ ID NO: 4003 - DNA, 1050 bp, Chromobacterium substugae
atgccgccgcgcacgttggagcaggatctcgacgccattctgggccgcaaacccgagctctgggacagcctgcgcggcgcgtcgctgttcatcagcggcgggaccggctggttcggccgctggatcctggagtccatcgcccatgccaacgccaggctggacgccggcatccgggtgctggcgctcagccgcaatccggaggccttcacccggcaggcgccgcatctggcggcgaatccggccatccgtttccatgtcggcgacgtgcgcgacttctcctttcccagggagcgtttcagccacttcattcatgccgccaccacctcggcgcatgaaaccttccgcggcgagacttcgctgaacaaattcgacacgctggtcagcggcacccgccgcgtgctcgactttgccgccgaggcccagcccgagcattttctgttcaccagctccggcgcggcctacgggccgtcgctcgccggccggccgctgcgcgaggacgacccgttcgcgccggacacgatggacccgatcaccgcgctgggccaggccaagcgcgcggccgagtttctttgcgccgcctatgcgcagcagcatggctggcatttgagcgtcgcgcgctgcttcgccttcgtcggccccttcatgccgctggacatccattacgcgataggcaatttcatccagtgtgcgatgcgcggtcatcctatcatcataacgggggacggcagtccgtcgcgctcctatctgtacatgggagatctggtggtctggatgctggcgctgttgcagcgcgaggggggggccagggtcttcaatgtgggatcggatgccgcgatcacgatcgccgaattggcgcgcgaggtcagggaccgggtgtgtcccgccgccgaagtccgtattctggggcaatccgacgccagcgtcggcaatccggcgcgcaacctgtacctgccggatatcggccgcgcccgcgcggagctgggcctcgcgccctggacgccgctgggcgacgcgatacggttttccgtcgatgcgtttgccggagcctga

SEQ ID NO: 4004 - DNA, 792 bp, Chromobacterium substugae
atgaccccggccgtcgagagcgcgccgcgcttcgacgacaacggccgctgcctgccgcatacggccacccaggccgcctgccaccgccagacccggcgctatttcctgccgcaccagccgcggatagactacgcggccatccaccagcgcatcagccgccatctgggcgcggcggaaggcctggacgccgcggctttcgagcagcgcgcccgcgcgatcttggccaagctggagagcgacgccgacggccgccggctgctgaacggcgcgcatgtgccgttcttcctgccgcaggcggcgcacgacgatatcggccaggcgctggacgagcgttacctgccggcggtgaaaagcgtgtacgacgccgagctgccgcagtacagcttcgtcaaccatcacaagcccagcctctccggcctgttgacgccggcggaaggggcgcgccatgaccgcctgatagaggcgatgcgccaaggcccggtggtcggtttctatttcccctgcctgctggaatattcggtgccggccgcgatcgagcagctggaaacgctgcccgcgccattcctgctggcaggcggctacgatagctgcgccgccttcatcggctcgccggacctgctgctgcgcaaggcaggctatccgccgctattgtggctgtctggcctggaggcggagcgcgacggcgtcggctatcacttcgaagcctatggctacgacctgaccttcaaccgccgcgtccacaacgaccaggcggcggaatactgggccagcgcgctggtcgtgctgggttag

SEQ ID NO: 4005 - DNA, 1113 bp, Chromobacterium substugae
atgaacgctcctctggacaccaccaacctggcgctgagccaggcagagcaggcgaaacgaaacgacctcgcccggcgcaagccttatgtcgcggccaagttggcgcgcatcgccgaaatggaagaacgcggcgagatcagcccgatcatccgcctggaaaagagctatctgtgcaatttcaagtgcacgcactgctcggctgaatactatatggaccgccacctgaagaatgtgatcaaggtggtggatacccgcagcaagatggattacgacgacattcgcaatctgtcgcgccaggccgacgaactggggctggcccgtttcgtgatcaccggcggcgagccgctggtgatgaaggatttcgatcaggtgatcgaagccctcgatccggaaaagcattacatcatcaccgacagcaacggctggttcctagatctggagcgcgccaagcatctgaaggcgatcggcgtcgagaaagtgcagatctcgctggacagcttcgtcgagaaggaccacgacaacttccgcaacaagcccggctcgtacaagcgggtgatgcgcgccgtcgacgcctgtctggacgccgggctgaacctgatcctgtcgaccgtgctggtcaagggccgcgccaagaccgaagaattccgccggatgtgcgaatacgtcacccagcgcggcatcggcctctacgtgtcctacgccaagccgaccggctcgtgcaccgagcacccggaattcgtcatcgagaaagaggacgccgacatcctgcggcagctggagaaggagtacaacgtcttctcgcacatgacgccgtcttatggttcgcacaagggctgcatcacggtcaagggcatcatcaccgtcacttcgacgatggaagtgacgccgtgcccatacatcgatttctccatcggcaacctgcgcgagacatcgctgaaggaagtgctggcgcgcggcatgcgcaacccgtggctggggccgcaccggcccgattgcctgatcggcgaagatcccaagttcatcaagatccacacggaaaagaccgcgggcgccaagttcctgccgctgccgtgggggcagggtttctccgaccaggactccctgtacgattga

SEQ ID NO: 4006 - DNA, 594 bp, Chromobacterium substugae
atgcataaacacccggcagaccggcaacaggcgatactcgacgcgatagacacgctgcggcaggcggtcggctcggcgcgcgaagggctgcctgaggagattttcctattcgtcagcagcctgacgccgatgatcaatgtcgacctgctgatccgcgacgaacaggggcggacgctgctgacctggcgcgacgaccgcttctgcggccccggctggcatatcccgggcggcatcatccgcttcaaggaaagctcggccgaccgcatcgccgccgtcgccgcgcacgagctgggcgccgaggtcagcttcgacccgcatcccttgtgccggcacgagatgctgattcccaagcgcgacgtccgcggccatttcatctcgctgctgcacgcctgccggctgaccacgccgcccgactccgcgcgccgcttcgacccggcggcgccgcgcgccggcgattgggcgtggcacgcgcgttgtccggacgacctgctgccggtgcagcaggtctaccgcggctatatcgacgacgaccccgccatgcggcaaagcccgccgattcaagttttggccgaaaatgccgaagaccatcagtag

SEQ ID NO: 4007 - DNA, 1161 bp, Chromobacterium substugae
atggctgccatcacgcattgccgcatctgcgcgcagcggctgttcgatgagccgctgctggtgcagcgcgacatgccggccgccgcccagggcctgccggcggctgagcggctggccgacgaccgcggcgtcgagctggcactgcgccagtgcggcggctgcgggctgctgcaactggacgccgagccggtgccgtactggcgcgacgtgatccgcgccgccggcatctcgccggaaatgcgcgccttccggctggcgcagttcggcgcttggctggccgggcacggcctggccgggcgcaaggtgctggaggtgggctgcggccgcggcgaatacctgtcgctgctggccgaggccggcgcggacgcttatggcgtcgagcatctgccggcctcggtggaagcctgcggccaggccggcctgcgggtggagcggggcttcgtggacagtccggaaacgaggctggcggacggtccattcgacggcttcatgatcctgaacttcctcgaacacatcccggccgcgcacctgacgctgcagggcatcgccgccaatctggccgacggcgccgtcggcatggtggaagtgccgaatttcgacatgatcgtcgaaaagggcttgttcgccgaattcatcccggaccacctgttctacttcaccgagcgcacgctgaccggcctgctggaggccaacggcttcgaagtgctggactgccgagccgcctggcacgactacgtgttgtcggccacggtccgcaaacgcgcgccgcagcggctgtcggcgctggtcgcctgcgagacggcgctgcgcgcgtcgttcgacgaattcctgggccgcttcgcgccgggccgggtggcgatctggggcgcgggccaccaggcgctggccttgatcagcctgatgggcgtcgccggccgcatccgctatgtgctggattcggcgccgttcaagcagggccgctacacgccggccacccatctgcccatcgtcgcgccggagcggctgcaggacggagaggtggacgcggtgatcgtgctggcggccagctattccgccgaggtggtgcgccagatccaggcccgccacggcgcgcgcttcgccgtcgccttcctggccgacaaccgcctgcaaaccgttgacccggaggctggcgatgcataa

SEQ ID NO: 4008 - DNA, 1830 bp, Chromobacterium substugae
atgagcgcaaaacttgtccgcctggcggactacgtgatggattttctggccgcgcgcggcgtgcgccacgtgtttttgctgcccggcggcggcgcgatgcatctgaacgacgcgctggcgctgcagccggatctgaccgccgtgcattgccaccacgagcaggcctgcggcatcgccgccgaggcctacggccggttggccgagcgcaccggcgtcgccatggtgaccaccggccccggcgccaccaacatcctgacgccggtggccggcgcctggatcgaatcgctgccgctgctggtgatctccggccaggtgaagcgcgccgacctgctgcaaggcagcggcctgcgccagaagggcgtgcaggaagtggacgtggtgtccatggcgcgcccggtgaccaagcacgcggtcacagtcaccgacccgcaggccatccgccagcacctggagcaggcgctgcacctggcgcacagcgaccgtcccggcccggtgtggctggacatcccgctggacgtgcaggcggcgcgcatcgacccggacagcctgcctggctggcagccggaagcggacgccgcgccggccgcccagaactatgttgccgccatcgccgatttgctgaagcaggccgagcggccgctgatcctggccggccacggcgtgcgcatttccggcggcgccgacgcgctgcgccggttgagcgaagcgctgcaggtgccggtggccgccacctggaacgcgatggacctgatcccgtgggacagcccgctgtgcgccggccgccccggcgtggtggcgctgcggcccggcaacttcgcggtgcagaactgcgacctgttgatcgccatcggcagccggctggacaacattctcaccgcctacaaccccaaaggcttcgcccgcgccgcgcgcaaggtggtggtggacgtcgacgccgccgagatcgccaagctggagatggaaatcgacctgccgctggcgatggacgccaaagcctgtctggagggcctgctggcggccgcagaccatctgcccaagtccaggtggcagccgtggctggaccgctgcgccggctggaagcgccgctacccggtgcaggacggcgcgccgttcccggcgagcggccagatcagccactaccatttcgtcgacgcgctgtccgacgccgcaccggaaaacacgctgatttccaccggcagctccggcctggcggtcgaggtgttctataccgtgttccgcaacaagccgggccagcgggtgttcctgacttccggcctcggttcgatgggctatggcctgccggcggcgataggcgcctgcctgggcaatggctcccagccgatgatcgcgctggaaagcgacggcagcctgcagctgaacctgcaggagctggccacgctgaaggccctgcgactgccgatccgcctgttcatcatgaacaacaacggctacgcgtcgatccgcaacacccagcgcaattatttcgatagccgctacatcggcaccggcccggaggccggggtggcgattccggacctgctggcgctggccgaggcttatggcctgccggcggtgcgcatcgagcgcgtcgaggagctggccgaaggcctggccaaggtgctggcccacccaggcccgatactgtgcgacgtgcggctgaacgagaacgagacgctgcagcccaaagccgccgcgctgccgcagccggacggctcgatgctgtcgatgccgctggaggacatgtcgccgctgctgccgctggagcaactgcgcgcggaaatgctgattcctttgctgccggcgtccgaagccgcccagcggggcggctga

SEQ ID NO: 4009 - DNA, 1488 bp, Chromobacterium substugae
atgcgaaagccgttattcatcttcgagatggccaacaaccacatgggcgacgtcgagcacggcatcgcgctgatccgcgccatccgcgaatcctgccagggcttcgatttcgacttcggcttcaagctgcagtaccgcaatctggacaccttcatccaccccagcttcaagggccgcgacgacgtcaaatacatcaagcgcttcgaggaaacccggctggcgccggagcagatgctgcggctggtgcgggagatgaaggccaatggcttcaagaccatctgcacgccgttcgatgaggagtcggtggacctgatcgaagcgcatggcatcgagatcatcaaggtggccagctgctcgttcaccgactggccgctgctggagcgcatcgctcgcagcgacaagccggtggtggcctccaccgccggcgcgcggcgcgaggacatcgacaacgtggtcagcttcatgctgcaccgggacaaggacctgaccatcatgcactgcgtggccgagtacccgaccccgaacgagaatctgcacctggcgcggatacgccagctgcgcgaccagtacgccggcgtgcgcatcggctattccacccacgaagacccggagctgatggagccggtgatgctggccatcgcccagggcgccacggtgttcgaaaagcacgtcggcctgccgaccggcgcatacggcgtcaacaattactcggccacgccggagcagatccggcgctggatccaggccgccgcgcgcgccttcgccatgctgggcgacggcggctgcgacccggcgtcgacggtggagcaggccagcctgcgctcgctgcgccgcggcgtgttcgccacccggccgatcaaggcgggggagagcctgaccgaagacaacgtcaccttcgccttcccgccggtggaagggcaactgaccgccaatgaatggtcgaagtacacccattacaccgccgcggccgacatcgccgccgacgcgccggtgctgagcgcgcaattgcagccgcagcacctgcgcgacagggtgatgaagacggtggatgccgtgaaggcgctgttcaagaccgccaacatcgtggtgcccgggcgttccgacctggagatttcccatcattacggcatggagcgtttcagcgagttcggcctgaccatggtgacggtgatcaaccgcgagtactgcaagaaactgatcgtgatgctgccggagcagacccatccggagcagtaccacctgaagaaggaagaaaccttcatcgtgctgtacggcgacatcaccatctggctggacgacgaggagcgccaggcgcaggccggcgacgtgatcaccgtgcagcgcggcgtgcgccaccgcttccatacccggggcggggtggtgttcgaggagatctcgtccacccactacgtcgacgattcctactataccgacgagcggatcagcgccaacaaggaccgcaagacccgcctgacctactggatgtaa

SEQ ID NO: 4010 - DNA, 1314 bp, Chromobacterium substugae
atgaccgatattagccgagaggccgtcctcgccctggcgcgtcaacacgccgaagcgcgcctggcccaggctgacttcctgccggggcagaccgcggtgccgccctcgggcaaggtgataggcgccgatgaaatcgtcaatatggtggatgccgcgctggatggctggctgactaccgggcgcttcaacgcggctttcgaggctcgcctggccgagttcatcggcctgccgcacgtgctgaccgtcaactccggctcgtcggccaatctggtggccttcaccgcgctgacctcgcccaagctcggcgcgcgcgcgatccagccgggcgacgaagtgatcaccgtggcggccggcttccccaccacagtcaatcccatcatccagaatggcgcggtgccggtgttcgtcgacgtgcaactgccgacctacaatatcgacgccgagctgctggaagcggcgctgtcgccgcgcaccaaggccatcatgatcgcccacacgctgggcaacccgttcgatctggaaaaagtagccgccttcgcccgcaagcacggcttgtggctggtggaggactgctgcgacgcgctcggctccaccttcaacggccagaaggtcggcaccttcggcgacatcggcacgctcagcttctacccggcccaccacatcaccatgggagagggcggcgcggtgttcaccgccgatccgctgctcaggcagatcatggaatcggtgcgcgactggggccgcgactgctattgcgcgccgggcaaggacaacacctgcggcaagcgcttcgactggcagctgggacagctgccctgcggctatgatcacaagtacacctattcccatatggggtacaacctgaagatcagcgacatgcaggccgcttgcggcctggcgcagatggaccggctggaaggcttcatcgccgcgcgcaagcgcaatttcgcctacctgtcggagcggctgcaaagctgcgccgaattcctgacgctgccgcaggcgacgccgggttcggagccatcctggttcggttttccgctgacgctgaagccggaggcgcaggtcagccgcgtggagttgctgcattacctggatcagcaccggatcggcacccgtctcttgttcgccggcaacctgacccggcaaccttatatgcaaggccgcaattaccgctgcgccacgccgttgccggtgaccgaccgcatcatgaacgacaccttctggatcggcctgtatccgggcctgagccagcagatgctggatttcgccgccgggaagctggaaaccttcctcggcgccaattttgattga

SEQ ID NO: 4011 - DNA, 1044 bp, Chromobacterium substugae
gtgaacgccgcgttctggtccggccgccgcgtcttcctgaccggccacaccggcttcaagggcggctggctcagcctgtggctggacagcctgggcgcccgggtgcatggctatgccttgccgccgtcggcgcggccgtcgctgttcgacgccgcgcgcgtaggcgacgcggcggcgtcggaactggcggacatccgcgactccgccgcgctatccgccgcgctggctcgcgccgaaccctccatcgtcttccacctggcggcgcagccgctggtgcggcaaagctatgacgacccgctgggcaccctctccaccaatgtgatgggcaccgccaatctgctggaggccgcgcgccgctgtcccggcgtcgaagccgtcgtcgtggtcaccaccgacaaatgctatgaaaaccacgagtggccgtgggcctaccgcgagagcgacgcgctgggcggccacgacccgtacagcagcagcaaggcctgcgccgagctggtgtgcgcggcgtaccgcagctcttatccgggcggcgcgccgatcgccaccgcccgcgccggcaacgtgatcggcggcggtgactggtcggccgaccggctggtgccagacttgctgcaggccttcgcggaaggccgctccctggccatccgcagccccgacgcggtgcgtccctggcagcatgtgctggagtcgctggccggctatctgcgcctggccgagcggctggcggcggggcagccggacgccgcctccgcctggaatttcggcccggccgacgacagcaaccgtccggtgtcctgggtcgccgacacgctggccggattatggggcggcggcggctggcaccgcgacggcgccgatcatccgcacgaggcgggcatcctcaggctggacagcgccaaggcgcgccggcgcctgggctggacgccgcgctggagcctggaagaggccttgtcggccacgctggactggcatcgcgcctggcggcgcggcgcggacatgcgggccttcaccattgaacaaatcgcggcctactcgcgtgtttaa

SEQ ID NO: 4012 - DNA, 699 bp, Chromobacterium substugae
atgattgaggtcggcggcaaaccgatcatctggcatatcttgaaaatctattccgcgcacgggatcaatgatttcatcatctgcctgggatatcgtggctatgtgataaaagaatatttcgcgaattactttctccacaattccgatgtcaccctggatctgtgcaataaccagatgctggtgcatgagcgccatgccgagccctggcgcgtgacgctggtcgacaccggcgaaggcacccagaccggcggtcgcctgcggcgggtgcgcaagcacctggagagcgagcgggacttctgcttcacctacggcgacggcgtcagcgacgtcgacatcggcgcagccatcgcctatcaccgcagccagaacgtggacgccaccgtgacggcggtgcatccgcccggccgtttcggcgcgctggacatccgcaacgagcgcgtcgaatgcttcaaggaaaaaccgcgcggcgacggcggcatgatcaatggcggcttcttcgtattgaaccccgcggtgctggatctgatagacggcgacgagtgcgtctgggagaccgagccgctggaaacgctggccagccgcggccaactggccgcctacgagcacaacggcttctggcagcctatggacacgctgcgcgacaagaacctgctcgaggagctgtggcagagcggggaggcaccgtggaaaaagtggtga

SEQ ID NO: 4013 - DNA, 729 bp, Chromobacterium substugae
atgttggcaatcatcggcggcagcgggctggcccagctgtcggtattggaagtgacgcaccggcaggtggtgcgcacgccttacggcgatccctcctgcgcgctgactttcggcaagctggccaagcaaaacgtggtgttcatcgccaggcacggctacggccattcgctggcgccgcacgaaatcaactaccgcgccaacctgtgggcgctgcataaccagggcgtgaagggcgtgatcgccatcggcaccgtcggcggcatccgtcccgacatggcgcccggccggctggtggtgccgcacgacatcatcgattacagctggggccgcaagcacacttatttcgaaggcccggagcggccggtggtgcatgcggagttcacttcgccctacgacgacagcctgcgccagcggctgcgcgcggcgatccaggcctccggcatcagcggcgtgcatgacggcgtctatgcctgcacgcaggggccgcggctggagagcgcggcggaaatctcccggctggagcgcgacggcgccgacatcgtcggcatgaccggcatgccggaggcggcgctggcgcgcgagttggacctgccgtacgcccacctgtgcctggtgagcaactgggcggcgggcaagggaagcaacgcgcgggtggagttcgacccggcggtggcggccaagagcgtgcaagatctgatgcacaccctgcaggcgtgtttcgccaactga

SEQ ID NO: 4014 - DNA, 171 bp, Chromobacterium substugae
atgaactcgaaccacaataaatccacgcccaaaacggacccgccggccgcgccgcagctgctgcacagccggcagctgttcggcgccgggcgggaaatcctgatcgagcatcagggcgagatctaccgtctgcagctcacccgcaacggcaagctgatactgatcaagtaa

SEQ ID NO: 4015 - DNA, 2202 bp, Chromobacterium substugae
atggccctgttccgcgccacccccttgatgctgagcctggcggcagcctggccggccttcgccgaccccgcggcgccaacgctggacgccgtgcaggtgaccgcccaccgcagcgagaagccgctggccgaaaccgcgcccaacgccagcgtggtgtcgggccacaagctggacgaccgcctgatcaacgacatcgccgacgccgccaaatacgagcccggcgtcgaagtggccaccgaccccaaccgccgcggcaacgccggctggaccatacgcggcatcgacggcaaccgcatcctgatgctgatcgacggcgagcgcctgccggaagcctacgccggcggcggcaacggcaacggcgccatttccggacgcgacttcgtcgaactggaaaccctgcgcgcgatcgacatcgtcaaaggccccacctccagcctgtacggctccgacgccatcggcggggtgataggctaccgcaccaagaccgtcgacgatttcgtgcccgaggacaagggcgtgggcggcagcttcaagggcttcggcgccagcgccgacaacagctggggcggcaccgccggcgtcggcgtcaagggcgagcgcgccgacgcgatgctgatctacacccaccgcaatggccatcaggccgacaatcagggcggcaacgacagcggcagcgccgcccgcaccacgccgaacccgcagaactggcacagcgacaacgtgctggccaagctcggctacaaactgaccgagcagcagcggctggagctgacgctggagcattatcgccgcgacaccgacaccaatctgctgaacaccctctacccggcctatgtctccaggggccgcccggtgccggcgcagctggcccagaccgccgcagaccgcacccagcgcgaccgcgtgtcattgggctgggaaggcaagcagctggggccattcgaacgcctgtccgccaaggtctaccagcagaagctggacaacgccgacgacagcttcgcacgctacggcgacggcagcagcgtcgcctccaactacggcttcgaacagaaaatccttggcctgagcctggacgccgagcagcgctttgccgcgctggcggccgagcaccagctgctgtggggcgtggacttgtcccgcaccgacaccagccggccgcggatgaagacgcagtacaacgccaacggcagcaccagcaacgtcatcggcggcgaaaccttccccagcaagaccttcccggacagcacctccgaccgcgtcggcctgttcatccaggacgagatgaaattcgccaacggcatcgcgctgtcgccgtcgctgcgctgggaccactacaagatgaacacccagcccgaccaggcctatgccaacagcggcggccaggcggtgccgtcgttcagcgacggcgccttctcgcccaagctggggctgagcatccccttcgccggccactacaccggcttcgcccagctgtcgtctggcttccgcgcgccgccgttcgacgacgccaacatggccttcgtcaaccgcgcctacggctaccaggtgatcgccaacccgaatctgaaatcggaaaccagccgcggcgtcgaactggggctgaagggccagtgggacagcttcgacttcggcctgaccgcctaccagaaccgctaccgcgacttcatcgaacagcaaagcctgggcacgataggcggcttgctgacctaccagtaccagaacatcggccgcgtcgacatcaagggcgccgaagcgcgcgccgcctggcgcttcgcccccggctggcagacccaggcctccatcgcctacgcccacggcgaggacctggacagccatgcgccgctcgcctcgatcgcgccgctgtcggcggtgctgggcctgcgctacgaccagtccggtttcggcggcgaggcgctgctgcgcgccgccgcgcgcaacacccgcgcgccggcggtagcgctgccgccgccgtccaccgcgcagaccgccggcttccaggcgccgggctacgccaccctggacctgaccgcctactggaaaccggccaagggcaccaccgtgcgcgccggcgtgttcaacgtgttcgaccgcaagtactggaaagccgccgacgtgcgcggcctggccgcaggcgacgccacgctggaccgctacacccagcctggccgcaacgtcagcgccagcgtcgaataccagttctga

SEQ ID NO: 4016 - DNA, 1035 bp, Chromobacterium substugae
atgagccagctatgggaccgctaccagacgctcaaagccagccaaccccgactgcgcgcgcgcgacgccgccgccgcgctgcaggtcagcgaatgcgagctgaccgccgccgatccggccgccaccccgctcagggccgaatggccggaaatcctggccgcgctggcgccgctgggccgggtgatggcgctgacccgcaaccacgcctgcgtgcatgagaccaagggcgactacgccaacgtcgagatcgacggcaaggtcggcctggccatcaacccggtgatagacctgcgcatcttcctgttccactggcgccacggcttcgcgctgcgcagcgagacgccccgcggcgtccagcgcagcctgcagttcttcgaccgccacggcgaagcggtgcacaaggtctacctgaccgaagccagcgacatcgccgcctacgacgatctggtcgcgcgcttcgccgcgcccgccgccgcgctggagcttgagccggtcgcggccgccggcgccgaacagcccgacgaagccatcgaccgcgacgccttccagaacgaatggcaaagcctgagcgacgtccacgccttccaccccttcctgcgccgctggcaggtatcgcggcgccagggtttccgcctggcgccgccgggccaggcctggcgcgtgcgcgaggacgcggtggaacagctgttgcgccgcgccgccgccaccgcgacccccatcatggtgttcgccggcaaccgcggcatgatccagatccacaccgggacgatagtcaacgtgcaagtggtgggcgactggctcaatgtgctggaccccgatttcaacctgcacctgcgcaccgacctgatcgccgaagcctggatcacccgcaagcccggcgacaacggcgtggtcacctcgctggagctgttcgacgagcagggagagtcgctggccaccttcttcggcgaacgcaagcccggccgtgccgagcgggccgaatgggtgaagctgctgggcgagctgccgccgctggagcaagaagatgtcgcgtaa

SEQ ID NO: 4017 - DNA, 792 bp, Chromobacterium substugae
atgtcgcgtaagaccatgctggccggcgcgctgctggcaatgctggccctgcccggccacgccgccgagcggctggtggtggtgacgcccgacatcgccgagatcgtcgtcgcgctgggcgccgccggcgacgtggtcggccgcgaccgcagcagcaaggagccgcaactggcccatgctcaggtggtgggcttttcgcgcgcgctgaacgcggaaaccatcgccggcctcaagcccaccctggtgttgggcagcgccgccgcccagccgccgacgctgtggccgcaattgaagcagctgaagctgcgggccgaagaggtgtccgcccgcgaggacggccgcgacttcgccgacgccatccgcaaggtgggccaactgctcggccgcgccgacgccgccgccaggctggcggccgactggcagcagcggatgcagccgcggccggcgcgcgccgtccgttacttggtcagctacgacggcagcctggtggccggcaaggacaccgcgccggataccctgatccgcgccgccggcggcgtcaacgccgcggccggcatcagcggcttcaagccgctgggccgcgacgcctggcaagcgctgcggccgaacgtgatcatcctgggcagccacacagccgcggtttacggcggcaaggaccttttcgccaagcggccggaagtcgccgcgaccccggccggcaaaaccggccgcatctatctgctgccgccgcagcaggcgatgctgatcggcctggacagcccggcggtggtcgaacggatggtgaggatgtga

SEQ ID NO: 4018 - DNA, 960 bp, Chromobacterium substugae
gtgagcgccgcccgccgcttgttgtggccgggcctgatactggccagcgtcgcgctgccgttgctggcgctgtccagctccgccggccagttggcctggccggatctggccgacccgctggtcagccagctgcggctgccgcgcatcgccgccgcgctgggcgtgggcgcggcgctggccgccagcggcgccgcgctgcaggcgctgttccgcaatccgctggccgatcccggcctgatcggcacctccagcggcgccgcgctggcggtgatcgccgtgctggcgctgggcttgtccggcctgacgctgccgttggcggctttcggcggcggcctgctcgccacctggctgatcctgctgctggcgcggctggtcaagggaggcatcgccggcctgctgctgatggggctggtggtgggcgccttctgcggcgcgctctccagcttgatcctgtttctgtccgacgacctgaccctgcgctccgccagcagctggctggccggcaacctgggctcggcgctgcccggccggctcggcctctgcctggccgtatccgcgttgggcatcgcgctgttgtgcgcgataggccgcgacctagactgcctgctgctgggcgaggaaagcgcccgctcgctgggcatcgacacccgccgcacccgccggctggccgccatcggcgccgcgctggccacaggcggcgcggtggcgctgtccggcgtgatcggcttcgtcggcatgatgatccccaacgcgctggcgctgctggtgggcggctgccgccgccggctgatcctgctgtccgcctgggccggcgcgctgtttttgctggcggtggacaccctggcgcgcaacctcgcctggccgctggacctgccggtgggcctgatggccgccttcgccggcccgcccttcttcatctggattttccgccgccaacaagggagccgctccgatgcctga

SEQ ID NO: 4019 - DNA, 765 bp, Chromobacterium substugae
atgcctgacacctacacgctgaaagtccgcgaactggattaccggataggcggacgcgcgctgctgagcgacatccgcctggaccttcccgccggccaggtatccgcgctgctggggcccaacggcgccggcaagaccaccctgctgcgcctgctggccggcctggccgcgcccagccgcggcgcggtgcggctggccggccagtgcgtgtgccggatggacgcgctacagcgcgcgcgccgcatcgcctgggtgccgcagcaactgccggccgacattccgctgacggtggccgaattcgtcgcgctagggcgcatgccccacctcggcgccttcgcccgcccgggcgcggacgaccgcgcggcggtcgcggcggcgctcgccaccgtggaaatggagccatacgccggcaagcggctggagcagctgtccggcggagaaaggcaaagggcggccatcgcccgcgcgctggcgcagcaggcgccggtgatcctgctggacgagccgaccaaccacctggacctgcgccatcaacaccagctgcaacagctgctgcgccagttggcggggcaaggccggacagtggtgcaggtgctgcacgacctgacgctggccgccgactacgccgaccgggtggcgctgctggagggcggccggctggtggccgccggcgcgccgtcccaggcgctgacgccggagcggctgctggcggtgtaccgctggccggtgcggctgcgccaccacgcgccgccgcaagcggcctga

SEQ ID NO: 4020 - DNA, 543 bp, Chromobacterium substugae
atgcctaatatttccgaagcccgcgggctgatcaacagcgccgacgtgctgttcagcgccgaggaagtcagcaccgccgtcgaccggatggcggtggaaatcaccgagaagctgggcgaggaatacccgctggtgttgtcggtgatgggcggcgcggtggtgttcaccggccaactgctgccgcgtctggccttcccgctggacttcgactacgtccatgtttcccgctacggcgacaagacccacggcggcgaattggtatggcgccaggcgccgaaggaagacgtgcgcgaccgcgtggtgctggtgctggacgacatcctggacgaaggccacaccatggccgccatccgcgacaaagtgatggagatgggcgccaaggcctgcttcagcgcggtgttcgccaacaagctgatctcgaaggaaaagccgatgcaggcggacttcgtcggcctggacgtgccggaccgctacgtgttcggctatggcatggacgtgcgcggcgcctggcgcaacctgccggccatctacgcgctgaagtaa

SEQ ID NO: 4021 - DNA, 873 bp, Chromobacterium substugae
atgaaaaagatcaccaaagccgtgtttccggttgccggtctaggcacccgcttcttgccggccaccaaggccagtccgaaagagatgctccccatcgtggacaagccgctgatccagtatgcggtggaggaggcgatcgccgccggcatgaccgagttgatcttcatcaccggccgcaacaagcgctcgatcgaagatcacttcgacaaggcttacgagctggaaaccgaactcgaatacaagaacaagcacaagctgctggagctggtgcaggaaatcattccgccgtcggtgtcgtgcatctatatccgccagaccgaggcgctgggcctggggcacgcggtgctgtgcgcccgtccggtggtgggcgaagagccgttcgcggtgatcctggccgacgacctgatcgaaggcgcgccgggcgcgatggagcagatggtgcggctgttcgacgaaacccactcctcggtgctgggggtggagacggtggcgccgcaggacaccagctcctacggcatcgtcaaggtcaagaccgatgcgcatggccatcaggccgtcgagcacatcgtcgagaagccgcgtccggaagacgcgccgtccaacctggcggtggtggggcgctacatcctgacgccgcgcattttcgacaagttggtcaacaccggcgccggcgccggcggcgaaatccagctgaccgacggcatcgccgcgctgctgaagagcgagccggtgctggcgctgccgttcaagggcacccgttacgattgcggctccaagctgggttacctgaaagccaccgtcaattacggcctgaagcaccacgaggtggccgacgagttcgccgccttcctggacggcctgaagcgcaactga

SEQ ID NO: 4022 - DNA, 1422 bp, Chromobacterium substugae
atgatggcgacagcggatttcgaggtaggcaatcaatgcgccgcccatggcgactgggccggcgccatcgcggcgttcgaccgctgcctgtcgctgaacccccaggattggcaggcgctggccaaccgcggcaacgccaggctgcagctggaggacacgcccggcgcgctggatgattatctggcggccgccgcgctgaacccgacgtcgtgcaacatcaagagcaatctcgcggtgctgctgaaggagctgggcgagctggacatctcggcggccttgctgcaagaggtgctggccgcggagccgggccatctcgacgcctgggtcaatctcggcatcgtccgccagcaccagcagcgctatcgcgacgccatcgactgccaattgcgcgcgctggtactgggcgggccgtcggtggcgcgctacagcaacctgggcaacgcctacagctgcgcgctgctgctggacgaggcgatcgcggtgcagcaaaaagggctggcgctggcgccggacgacgccaccttgcagttcaatcagtcgatcacgctgttgacggccggccgatacgccgaggcctggcccctgtacgaagcgcgctggcgctgcgtgctgcggccaaggctgacggcaaggcgctggcagggagacgcgctgggcgcgcgcaccctgctgttgtggaccgagcaaggcctgggcgacactttgcagatggcgagattcctgccgcagctgcggcgcgcccatccgcaggccaggctgctgttcgcttgcccgcgctcgttccaccgcctgttcgcgcagttcgagggcctgaccttgctggaggcggacgccgcgcccgagcacgattgccagctgccgctgatgtcattgccgggtttgctgggcgtcacgctggagaatttgccgaccgcgccgtacctgcgtttgccggacggggcgccgccggttttgccggccggcaagcggcgccgggtgggcgtggtgtgggaaagcggccattggggcgtcggcgtggcggatctcggacgccagcataaatcgattccgcccgcgcagttcgccgaaatctgccaagcgccggatatcgatttcatcgccttgcagcccggcgcggtgccggacgagctgcgtggatgcgtccgcgccagccgcatcgacgatttcgccgataccgccgcgctgctggcgcaggtggatctggtggtttgcgtggataccgccatcctgcatctggccggcgcgatgggcaagccggtgtgggcgctgctgcgcgccgaaagcgcgccattcttcctggcggaagcgccggtcgcgccgtggtatccctcggtgcgcctatggcggcaggctcagcccggaaactggcagccgctggtccgcgaactgagcgaggccttgtcgaagcaatgggcattttga

SEQ ID NO: 4023 - DNA, 2412 bp, Chromobacterium substugae
atgaccgcaaaccaactgcgcgccgccgaattgcgcgagctgctgaaccgctacggccgcgaatactacgtgctggacgcgccgaccgtgccggacgccgaatacgaccgcctgttccgagaactgcaggcgctggaggaggccgatccggaactggcgctctccgattccccgacccgccgcgtcggcggcgcgccgctggccgaattcgacagcgtcgtgcacgcggtgccgatgctgtcgctggccaacgccttttccgacatgcagctggccgacccggcagagcgccatgccgagctgatccagttcgacgagcgggtgcgcaagggcctggacgcggccgaggttgagtacgccaccgagcccaagttcgacggtctggccatttcgctgctgtatgaaaacggcgtgctgacgcgcgccgccacccgcggcgacggcgtggccggagagcaggtgaccgagaacgtgcgcacgatacgcgccattcccttgaagctggacggcgcggctccgccggcgctgctggaggtgcgcggcgaggtgctgatgctgaagcgcgacttcgagcgcctgaacgccgatcagatcgagcgcggcgacaagactttcgccaatccgcgcaacgccgccgccggcagcctgcgccagctcgactcgcgcatcaccgcgcagcgccggctgtcgttcttcgcctacgccatcgcccaggtggcgggcgcggactggccggacacccacgccggcgaaatggcctggctgaagcagctgggcttcccggtggtggaagaaagcttgcggccggtggtcaagggcgtggcggggctgtccgcttactacgaagcggtgcaggcgcgccgcgccggcctgccgttcgagatcgacggggtggtgtacaaggtgaaccgccgcgaccagcaggacgcgctgggcttcgtgtcgcgcgcgccgcgctgggccatcgcccataaattcccggccgaggaggcgctgacggtggtcgaggccatcgaggagcaggtgggccgcaccggcgccatcaccccggtggcgcggctgcagccggtcttcgtcggcggcgtcaccgtcaccaacgccacgctgcacaatgaggacgaagtgcggcgcaaggacgtgcgcgtcggcgacacggtgatcgtgcgccgcgccggcgacgtgattcccgaggtggtgtcggtggtgctggagcgccggccgatgcagccggccgagggcggcgatctgttcagcgccggcgaggcgccgcaatacccggcctaccgtttgccgagcgcctgcccggtgtgcggcagccacgtggcgcgcgaagaaggcgaggcgatcgcccgctgctccggcggcctgtcctgccgcgcccagcgcagccaggcgatccagcatttcgccggccggcgcatgatggacatcgacggcctgggcgagcgctatatcgacaagctggtcgaatacgattacgtgaaaggcgtggccgacctgtaccggctgaagctggaagacttgctggagatgaagcgccgcgccgacgaggacgagggcgtcacgccggaaacggtgaaggccggcaaggtggccagcaagtgggcggaaaacctgatcgcggcgatagacgccagccgcgcgccgccgctggcgcggctgctgttcgcgctgggcatccgccatgtcggcgaatccaccgccaagacgctggcggactggctgggcggcatggcgttgatccgccgctgcccggcggcgctgttcgccgccttgcccgacatcggcgcggtggtggcggaatcgctggcggacttcttcgccgaagacaacaatgaaaaggcgctggacgcgctgctggccgaggtgcgcccggccgacgagcatgcgccgtcgcccagattgcgcgagcggctggacgacgcggccttgctggcgcggctgggcattccgcgcttgaccgaagtgcgcagccagcaactggcggcgcagcgcagcctggcctggctggccgccagcgaacggcgcgcgctgctggagctggatctgccggccgaggtggtgaacgcgttggccgactggctggacgagccgggccggcgcgagtcgctgagccgtctggccggcttgcgcgaagccatcctggccgaactgccgcaggccgccgaggcggcggcgctgccgctggacggcaagacgctggtgctgaccggcaccttgccgacgctgagccgcgaccaggccaaggccttgatcgaggcggccggcggcaaggtgtcgggcagcgtatcgaagaaaacgcattacgtggtggcgggagaggaggcgggcagcaagctcgccaaggcgcaggaactgggcgtcgcggtagtggacgaagccggcctgcaggcgttgttgtcgggcaactga

SEQ ID NO: 4024 - DNA, 1203 bp, Chromobacterium substugae
atgagcgaattgcagattggtgttttgattttgggcggcggcgtgatcgccctggtgctgggtttcaacatgtttcaggaatggcgcttccgcaagcggacgcaccaggccttcgcgcgcccgcatggcgacgtgctgctggatgtgccgaagaacaatgtccgcgacggcgtgaaagccgaccggatggagccggtgctgctggatgcggaactggagccggagagggcgccggaagaggacgacgagccgttgttcgagattccgccggcggaagcgccggtccgcgagccgccgccggcgccgcgccgcgaaccggcgctgcaggaagtggaagtgccggtgatggacgaggaggacgaggccgagctggcgatggactccgccgaccaccaggcgctggtggtggcgatgctggacccgtcgctggatttcatcgccgaggtgatgttccatgagccgcacgagctggcggcgatgccgcgcttcaatgtcggcaagcgcacccagctgatcggccgcaccgagcgcggcctgtggaaagtggccgaggcgctgcccggcacccgctacaagcagatcaacgtcagcatgcagatggtggaccgctccggcgcggtgggcgagcaggaactggccgccttctgccagcaggtgtcgcgcttcgccgaggaccacgacgcggcggtgagcttcccgcagcgccagcaaaagctggtggcggcgcgggaactggaccgcttctgcgccgacgtcgacgtgctgatcggcatcaacatcgtgcctcaggcttcgatcgagggcgcgcgcctgcgcagcttcgccgaagccgccgggctgcagctggagccggacggcgccttccattacctggccgactccggcaacacgctgtattcgctggtggcggccgaccagatgccgttcactttccataccttgctggacaagtcgttcccggcgctgacgctgctgttcgacgtgccgcgcgtggccggcggcgtagacgtgttcgaccgcgccgtgcacttcgccaagcacctggcccaggaattcgacgcgcagctggtggacgacaaccgccgggtgctgaccgaaaccggcctggcccgcatccgcgaccaactgctgcacatttacggcagcatggacgacaggggcatcgcgccgggcagcgtcgccgccctgcgcctgttcgcctga

SEQ ID NO: 4025 - DNA, 468 bp, Chromobacterium substugae
atgaaaaaatccgaccaagccagtttcctgcctgtcgtacgcgaattgtcgcgcacttaccaggcctttgaacagttcgccagcttcaacatccgccggctgggactgacaccgccacagttcgacgtggttaccaccctgggcaacagccagggcatgaattgcaaggagctgtccgaccacaccctgatcaccaaaggcaccctgaccggcgtgctcgaccgcctggaagacaagggcatcgtcacccgcagcatgcagcccaacgaccgccgcagcgtattcgtggctttgacaccccacggccagcaattgttcagtcaagcctttccggcccacctcgactacatgcacaacgctttcctgcatttcggcgagcaagacctatccggcttctgcaacgaactgggccgcctgcgcgccagcttcagccaggcattggagcaacaggagaacgagccggcctaa

SEQ ID NO: 4026 - DNA, 312 bp, Chromobacterium substugae
atggaggcaaaggacgaaggccagagcgatggcgaccatgaggcgctttaccgtccagcctatctggagaatccgcagcccccttacccggagcggtcgctgcagctgggagaagagggcgaggtcttgctcagcgtcagagtcggcgtcaatggccgggctctgaaggtgacgctggcgcgcagcagcggcttccggcgcctggaccaggcggcgatggacgccgtggcgcgctggcgattcgcgccggccaggcgcggcggagcggccgcggaatcggtgctgaccatcccggtgagcttccggcagtga

SEQ ID NO: 4027 - DNA, 1380 bp, Chromobacterium substugae
atgaccgtaagcatcaaacgctgggagccggaaaacgtcattttctggctgagccgcggccgcggcatcgcccggcgcaatctgtggctgtccaccttctcgctgcatctgaatttcaacatctggatgatgtggagcatggtggtggtcaatctgccggcggtgggctttctcatttccgaccaacagcagttcctgctggtgtccatcccgccactggtgggggcgctgatgcggctgatctattcctgggcctggagctgggtcggcggcggattgtggctgggcctgtcgacgctgttgctgttgctgccggcctggggcgtgggcgcggtggtgcaggacatcgccgcgccattctggcaattgctgctggtggccggcttgtgcggcgtcggcggcggcgccagcgcttcgcatttgtccaataccagcttctttttccccaagtcggaaaaggggctggcgatgggcatcaacgcggggctgggcaatctcggcgtgtcggtggcgcaattgctgattccgctgtgcatcctctatccgctgttcggcctgcatgccggcgagccgcaggtatggggccggggcggcgacgtgcattacgtctggctgcagaacgccgcctatgtctggctgccgctggtgctgctggcggcgctggcctgtctgctgtacgcgcacgatctgcccaagctgcgcatcaccccgcgcgaccagctggacgcgatgcgcgacgcccacacctggtacatctgtttgctgtacatgggcagctacggcaccttcctggggttttccgccgcttttccgctgctggcgcgcagcatgtttccgcaagtggacgccagcccctatctgttcgtcggcccgatggcctgcgcgctggcgcggccgctgggcggctggatgggcgaccggatcggcggcggcatcgccaccgtggccagcaatctcctgatggcgctgggcaccgtcggggtgtatctcagcctgccgtcggccggcagcggcggctcgttctggctgtttctcggcatgttccagctgattttcctcgcggccggcgtcggcaacggctcgtcctatcaattggcgcccaaggtgtttctgttgctggccgggcgcgaggcgcagcggcgcggcgaaagcctgttgcaggcctatgcccgcggcggcaggcgcggcgcgtcggcgatgaatgtcagttcggtgatggcggcgttcggcggtttcgtcattcccaaggccttcggctcgtcgctgagctggttcggcggctttttgccggcgttcgcgatgtttttcctgttttacctgctgtgcatggcgctggcctggtggcattacagccggctgggcgctgccatgcgctgctga

SEQ ID NO: 4028 - DNA, 3489 bp, Chromobacterium substugae
ttgcgcctgacccatatcaagcttgccggtttcaagtcatttgtcgaccccaccagcatcgcggtgccgggccaactggtggcggtgatcggccccaacggctgcggcaagtccaatgtgatcgacgccgtgcgctgggtattgggcgaatcgtccgccaagcagttgcgcggcgagtcgatgcaggacgtgatcttcaacggctcgtccactcgcaagccggtgtcgcgggcgtcggtcgagctggtgttcgacaacgccgacggccagttgaccggcccctggggccagtacgccgaagtggcgatcaagcgggtgctgacccgccagggcgaatccagctactacatcaacaaccagcaggtgcggcggcgcgacatcaccgacctgttcctcggcaccggcgtcggcgcgcgcggctacgcggtgatcgagcagggcatgatctcgcgcatcatcgaggcgcggccggaagagctgcgcgcctatctggaagaggcggccggcgtgtccaagtacaaggagcgccgccgcgagacagaaaaccgcctgaccgacacccgcgccaacctggagcgcatcgccgacctgcagcaggagctggagcgccaagtggagcgcctgtcggagcaggctgaagtggcgtcccagtatcacgacctcaagggcgcgctgacccacaagcagaacctgctggcgctggcgcggcgcgaggaggcggcgcgcaacgaggcggccgcccgcgccgagctggcgcgcatcgaaaccgaggaggcggcgctggagagcgcggccacccacctggaaaccgaacaggagacggtgcgcgaaagccatttcgccgccagcgacgcggtgcacgaggcgcagcagcagctgttcgaggccaacgcgcagctggcgcggctggaagaggcgcagcgccaccgcgagcagagccggcagcggctggagcgcgacctggcggcggcgcgcagcgaacgccagcaactggccgacaaccgccagcaggtggaggccgagctggacgattggctgccgcggctggaagaggcgcagctcaggcaggaagaggcgcagatggcgctggaggacggcgccgacgaactgccgggcgccgaggccgccttccgcgtgctggaccagcggcagtcgcagatggtggcccagcaggccaacctcacccgcgagcgcgacctgtcgcggcagaagatcgaacactggcagcgcggcatgcagcaactggccggccgcgacgccgcgctgacgcgcgaattgtcggacctgaacctgccggagcacgccgcgctggaagcggcgcagcaggaagtggccaaggccagggccgcgctggacgcggtgcgggcgcggctggtggccgacgaggccaaacaggccgacctggctgccgagcgcgaaaaactggaccagcagctggcggccaagcgcaccgagctggcgcgcgccgaggcagaggccgccgcgctggcggcgctgctgcagcgcgaggcggccggcgagcaactggccggctggctggaacagcatggcctggccgacgcgccgcaactgtggcagtcgctgcagatcgacgcgcgctggcagcaggcgctggaagcggcgctgggcgaacgcctgtccgcccgcgccgccgcgctgccggccgggcagccgcccgccgcgctggttctggtggacggcaagcgcgcggccgccgccggattgccggcgcgaagctggccggctctattggccgaggtcaaggcgcaagcgccgttcgatgccgcgctgggcgactggctggccggcgtgtacctggccgacacgctggatgccgctttggcgcgccgcggcgaattggcggccggcgaatgctggctgacgccggagggccatcgtgtcgatgccgccagcgtgcgctaccacgccgaagccagcggcgacggcctgatggcgcgcaagcggcagctggacgaagccagcgcccgcgccgaggcctggcggccggaaatcgaagcgatgcagaagaagcgcgacagcctcttgagcatgggcaatatgctggccgaggcggtgcgcggccagaagggctcgctgacccggctggaggcggagctgaacgccgccacgctggagcacgtcaagctggaccaggcggcgcgccagggcgcggcgcgcttgtcggcgatcgaggccgagcgccagcgcatcgcggaagagcgcgcgcacgccgacgacggcatcgccgaggccgaactgatgggcgaggaagcggcgctgacgctggaggaactggcgctgcagctggaagaggtgaggctggaccggctgaatgccgaaaccggcctgcaactggcgcgcaacaaggcgcgcgacgccgagcgcgtgctgcacgagatcaagctggcgcttcacagcgccgagcagaaggtggccgaactgtcgcgccgcggccgcgagctggccgaccgcgacgagcagctgcaggaacggctggagacgctggccgccgagtcggaaaccgtcgacgaggcggtgccggaagaggcgctgcagcaggcgctggccgagcgcgagtcccgcgaaggcggcctcgcggccgcgcgcgaccggctcaaccagctgaccgagcggctgcgcgagctgggccagcgccagcaggaagccaacgccgcgctgccggcgctgcgccaggcgcgttcagactggctgctcaagcaccaggaggccaggctggcgatggagcgcttcgccgaggagctggcccaggccgaggccgacgaggcggcgttgctggccgatctcaacgaaggggtgaagccgaacgcgctggcggcggaaatcgcccgcctggcgcgggcgctggaggggctgggggcggtcaacctggctgcgctgcaagagctggaagaggcgaaaaagcgcggcgagtatctggccagccagtccgacgacctcaaccaggcgatggcgacgctggaggaggccatcgccaagatcgacggcgaaacccgcgagatgctgcaagccacctacgaggcggtcaacgccaagatgcgcgaattcttccccacgctgttcggcggcggccgcgccgagttggtgctgaccggcgaagacttgctggacgccggcgtgcagatcatcgcccagccgccgggcaagaagaacagcaccatccacctgctgtcaggcggcgaaaaggcgctgaccgcgatgagcctggtgttctcgctgttttctctgaacccggcgccgttctgcctgctggacgaggtggacgcgccgctggacgacgccaacaccagccgcttctgcgacctggtcaagcaaatgtcggagcgcacccagttcctctatatttcccataaccgcctgaccatggaaatggccgagcaactggtgggggtgaccatgcaggaacagggcgtcagccgcatcgtcgcggtggacatcgtcgaagcgctgaagatgcgcgagaccgcctga

SEQ ID NO: 4029 - DNA, 561 bp, Chromobacterium substugae
atggaacccttatcgctgtgcaatcatttcctgatcgccatgcccggcatgggcgatccgctgtttgccaagtcgctggtctacctgtgcgagcacggcgaacacggcgccatgggcctgatcgtcaacaagccgtccggcatcgccatggcgcagctgttcgaccagatcgatctgccgctggacgacgaggacacccgcaccggggtggtctacttcggcggcccggtgcagccggaccgcggcttcgtgctgcaccaaccctccggcaactggcagtccagcctgatggtcaccgacgacatcgcgctgaccacctccaaggacgtgctggcggcggtgtccgaaggccgcaagcccgagcggctgctgatctcgctgggttacgccggctggtcggaaggccagctggagcaggaaatcgccgacaacggctggctgacggtgccggccgaccccgccatcatcttcgaactgccctgcgaagcccgctacgacgccgcgatggcgctgctgggcatcgaccccaccctgctgtcgtcggaagtcggccatgcctga

SEQ ID NO: 4030 - DNA, 432 bp, Chromobacterium substugae
atgcctgaaggttgcgtgctggcttttgatttcggcgagcgccgcatcggcgtcgccgtcggcgacgcgatgctgggcatcccccacccgctggctaccatagacaccgccgtcaccgacgagcgcttcgccgccatcggcaaactgataggcgaatggcagccggctcagttggtggtgggcctgcccatgcacccggacggcgtcgaacacgaaatgagcgcgctggcgcgccgcttcgccaaccggctcaaaggccgcttcggcctgccggtatggctggtggacgagcgctatacctcggtgatcgccgagcagctgctggaagaggccggcgtcaagaaaggacgcaagcaaaaaccggcgctggaccaggtggccgcgcaggccatcctcgccggctggttcgagcagccgggcaccgcagtttga

SEQ ID NO: 4031 - DNA, 459 bp, Chromobacterium substugae
atgccggccaggctcttcgccctgctgctgctcgccgccagcgtcgccggcttctgctggttgtggcgccaggcgcagctggccaacgcggcgcgcgattggccgatcgcggccggcgtcgtggagcgcagcgcggtggaatggcggcagcgccgcggcggcgacaacagcgatcagcgcgagtaccgcgccgacgtcgtctaccgctaccaggccggcggccagcactaccgcgccggcaatatccgcatccccgacgccggcttcggcggcagccagacgctggcccaggataccgtcagccgctatcccgccggcgcggcggtgcaggtgcgctacaaccccgccaaaccgcagcaagcctgcctggagaccggcgcgcactggagcctgagcgccggccagttgctgatgctgctgttcgccgccgccggcgtcgccctgctgctccgccgctga

SEQ ID NO: 4032 - DNA, 441 bp, Chromobacterium substugae
atgagcatcagtcaaaccacgcagatttcactggcgagcgccgccttgctcaacggcggcaccgtgccgtcgccggtggtgcaaaacggcaacgccacgcaggcgctggccgcccaggcggcccagctgtcgcaggagtccagcgtggtgacgctgctgggcggcggcgacagcagcggcgccacctacgaccccgccggcatgctcaacggcttcgccaccgccggcgtgctgcaaggcagcgcgctgagcccgagcagcggcgaaagcgcgcaggacagcaccgatcagcaggtgctggaccaaacgctgggcgtcagcggcgccgcatcgtccggcctcaacggcaactgggcgacggtgctgcaaagcaatccggcgctggccggccaggcggtggcggacagcaccaacggcaatatcgtcgacaccctggcctag

SEQ ID NO: 4033 - DNA, 936 bp, Chromobacterium substugae
atggcaatccaatggttccccggccatatgaacaaggcgcgcaaggatattaccgagcgcctgaaagaaatcgatgtcgtgatcgagctgctggacgcccgcctgccggcttccagcgccaatccgatgctggcccgcatggcgaagggcaagccgcggctgatgatcttgaacaagcaggacctggccgacccggccatcacccagcagtggctggcctggtacaacgccaagccccatacccaggcgctgggcatggacgccggcgagcgcgcgccggcgcagaagctggtggcggcctgccgcgagctggcgcccaaccgcggcggcctggaaaagccgctcagggtgctgatctgcggcattcccaacgtagggaaatccacgctgatcaacagcatgtccagccgcaagatcgccaagaccggtaatatgccgggcgtcaccaagaacgagcagcgcatcatcctggccgacgacttcgaactgttcgacacccccggcatgctgtggccgaagatcgaggtggaggagggcggctacaatttggccgccagcggcgcggtgggccgcaacgcgatggacgaggaagaggtgacgctggagctgctgaagtatctgctggtccattacgcgccggaattgagcgcgcgctacaagctggacgacgtggagggccggcaggactggcaggtgctggaaatgataggcaggaagcgcggcgcggtgctgtccggcggccgcatcaatatgcagaaggcggcggagatcgtgctgaccgacttccgcgacggccaggtcggccgcatcacgctggagcgcccggatgaatggctggcgtgggaaaagcgcgcgaaggccatcgccgccgagcgcgcgatcctgcgcgaggaaaagctgaaagagaaggaaagccgcaagcagggcagccgctga

SEQ ID NO: 4034 - DNA, 213 bp, Chromobacterium substugae
atgcaagccgaagacctgctcagcctcaccacccgcgtcatgcctttcggcaagcacaagggcaccctgatttgcgaactgccgggcaactacctgaactggttcgcccgcgaaggctttccgcccggcgagatcggccggctgctgcaactgatgcaagaactcgaccacaatggtctgacttatctgctggacccgattagaaagcgttga

SEQ ID NO: 4035 - DNA, 345 bp, Chromobacterium substugae
atggagctggagctgcacgacgaaggcgaacgcaagctgaacaatctgacgctggcggtgtacatcctgcaggcggtcagcctgctggtcggcgtcaccgcgctggtcggcgtgatcatcaactacgtgaagcgcgacgatgtgcgcggcaccttgtacgaaagccatttcgaatggcagatccgcaccttctggctggccctgctcggctatgtcgtcggcttcgccacgctgtggctgttggtgggcggcgtagtgctgttcgcggtgtgggtttggtacatctaccgcgtggtgaagggcttcctgtatttcaacgaccgcaagcccatgccgcagccgtga

SEQ ID NO: 4036 - DNA, 582 bp, Chromobacterium substugae
atgaacgaagtcagagacgccttttcccttgcccgcagccaggccgccacgatggcggagtccacgctgtacccggtcgccctggtgaccgacggcgagtggctggcttatcgctccgggccgccggccgggcagttgtcttcctggctggcggcttgcgatggcggcgcgccgctgctggagtccatgctgccggaaatccgcctgctggccttgcgcctggcgctgcggcgcggcttgccggcgcagggcctgccgccgcgcctggccgaaccggccgattggttggcggcgcgcattctgctgctggaatggcggcaggtggcgctggggctggacgagctggcggcgctggatgacgccaaccgccgcgcggcggagctggcggcggctgccggcctggcgtggcggccggcgctgccggtcttgctgtccgggggccgcggcgaaggcggtttgcagggctggagcccgcggccggctcagcctggcgccggccgcggcgtcgccgcggcgctggacgccagccgccgcgcgcgcgccggcctggccgggcgtttcgaaaaattgctgaattgctaa

SEQ ID NO: 4037 - DNA, 1635 bp, Chromobacterium substugae
gtgcaacgcgaatacatggaatacgatgtggtgatcgtcggcggcgggccttccggcctgtccgcggcgatccgtctgaaacagctggcggccgagcagggccgcgaagtcagcgtctgcctgctggagaagggctcggaaatcggcgcccacatcctgtccggcgcggtgatagaaaccggcgcgctcagcgagctgctgccgaactggaaagagctggacgccccgctgaacacgccggcgctgtccgaccgtttcctctacctgaccgaaaccgaatccatccagctgccgacgccgccgcagatgcacaatgccggcaactacatcgtcagcctgggcaacttctgccgctggctgggccagcaggcggaaaacctgggtgtggagatctacccgggcttcgccgcggccgaggtgctgtaccacgccgacggctcggtcaagggtgtggccaccggcgcggtcggcaccggcaagaacggcgaccaggaaggcgagccgggcatggagctgtgggcgaagcaaaccctgttcgccgaaggctgtaggggctcgctgaccaagacgctgttcgagcgcttcaagctgcgcgacggcgccgatccgcagactttcggcatcggcatcaaggaattgtgggaagtgaagccggagcatcaccagcccggccacatcacccataccgtgggctggccgctggacaccgccacctatggcggctccttcctctaccacctggaagacaatctggtggcggtcggcttcgtggtcggcctggattaccagaatccctacctgtcgccgttcgaggagttccagcgcttcaagacccacccggcgatcaagaaaaccttcgagggcggccgccgcgtctcctacggcgcccgcgcgctgaccgagggcgggctgcagagcctgcccaagctgaccttcccgggcggcgcgctgatcggcgacaccgccggcttcctcaacgtgcccaagatcaagggcacccacaccgcgatgaaatccgcgatgctggcggccgaggcggtgttcgagctgttgggcgacgaggcgcgggcgcagggcggcgaagccaaggcctattcggccaagttccagcagagctgggcgcatgccgaactctacaaggtgcgcaacatccgcccgtcgttccgctggggcctgtggccggcgatgatctattcggcgctggacaccttcctgttccgcggccgcgcgccgtggacgctgcgccacaagcacgccgacaacgagtcgctgcggcaggcctatgagttcagcccgatcgcctatccgaagccggacggcaagctgaccttcgaccgcctgtcctcggtgttcatctccaacgccaaccacagcgaagaccagccggcgcacctgaagctgaaggacgcgtcggtgccggtggcggtcaacctggcgctgtacgatgcgccggagcagcgctactgcccggccggcgtgtacgaaatcgtcggccaggacgaaggcaagccgcggctgcagatcaacgcgcaaaactgcgtgcattgcaagacctgcgacatcaaggaccccacccagaacatcaactgggtgacgccggagggcggcggcgggcctaactaccccaatatgtaa

SEQ ID NO: 4038 - DNA, 1224 bp, Chromobacterium substugae
atggatcttggcggccagaacaaggagagcgcgatggcaggagcgttggcgggtatcaaggttgtggatttgagccgggtgctggccgggccatgggccagccagctgctggccgatctgggcgcggatgtggtcaagatagaaaagccgggcagcggcgacgatacccggcaatgggcgccgcccagcctgcccgacggcaaggcagcctatttcctgtgcgccaaccgcggcaagcgttcgctgacggtggacatcagccagccggccggccaggaaatcgtgcgcaagctggcggccgaggccgatgtgctgctggaaaactacaaggtgggcggcttggcgaagtacgggctggattacgccagcctgaaagccgtcaatccgcggctggtgtactgctcgatcaccggcttcggccagagcgggccctatgccggcctggccggctacgactatatcgtgcagggcatgtccggcctgatgagcatcaccggcccggccgacggcgagccgcacaaggtgggggtggcggtgtccgacctgttcaccggcctctacgccgccaatgcggtgcaggcggcgttgatcgcccgcgaacgcagcggcgccggccagcatatcgacatggccttgttcgactgctcgctggcgatgctggccaatgtggcgtccaactggctggtggggcgcaaggtgccgccgcggctaggcaacgcccacgccaacatcgtgccctaccaggtgttcgccgcgtcggatggccatttcatcctggcttgcggcaacgacaagcagttcgccgaggtatgccggctgatcggccagccgcagtgggcgcgcgacgcccgttacgccaccaatccgcagcgggtggcgaaccgcgcccagctggtgccgctgctggcgatggcgttccgccaccattcgcgcgagcactggctgaaggagctggacaaggccggcgtgccctgcggcccgatcaacgacgtggaggaggctttcgccgatccgcaggccgaggcgcgcggcatgcagctggctttggaggataatgtcggacaagaagtgccgctggtagggtgtccgatcaaactttccggcacgccagtcgagtacaatctagcccctcccgctctgggagaacatactgagcagatcttgcgcacgctaggttatggcgaatcggacattgtcgcattgcgcaacagtggcaccgtttaa

SEQ ID NO: 4039 - DNA, 1188 bp, Chromobacterium substugae
atggcagcatcctcgcagcgcgcgcccttcgtctgggaagaccccctgttgttgctggaccaattgagcgacgaagagcggctggtgcagcaaagcgcgcacgactactgccagcagcggctgctgccgcgggtgctgaccgccaaccgcgcagagcgcttcgaccgcgagatcatcaacgagatgggcgagctgggcttcctcggctgcaccatagaaggctacggctgcgccggcctcagccatgtcgcctacggcctggtggcgcgcgaggtggagcgggtggattccggctaccgctcggcgatgagcgtgcagtcgtccctggtgatgcacccgatctgggcctacggctccgacgcgcaaaaagacaaatacctgcccaagctcgccagcggcgagtggctgggctgtttcggcctgaccgagcccgattccggctccgacccggccagcatgaagacccgcgcccgcaaggtggacggcggctacctgctgtccggcagcaagatgtggatcaccaacagcccggcggccgacgtgttcgtggtctgggccaaggatgacgacgacgaaatccgcggcttcatcctggagaagggcatgcagggcctgtcggccccggccatccacggcaagttctccttgcgcgcctccatcaccggcgaaatcgtgatggacgacgtgctggtgtcggacgagcagctgttgcccggcgtcaagggtttgaaagggccgttcggctgcctgaacaaggcgcgctacggcatcgcctggggcgcgatgggcgccgccgagttctgctggcaggccgcccgccagtacacgctggagcgcgagcagttcggccggccgctggccgccaaccagctgatccagctgaaactggccaatatgcagaccgagatcgcgctgggcctgcaagccgcgctgcgggtggggcggctgatggacgaaggccgcgccgcgccggaaatgatctcgctgatcaagcgcaacaactgcggcaaggcgttggacatcgcccgcgtcgcccgcgacatgcacggcggcaacggcatcagcgacgaattccatgtgatccgccacgtgatgaatctggaggcggtcaacacttatgagggcacgcatgacgtgcatgccctgattctgggccgagcccagaccggtattcaggcgtttgcctga

SEQ ID NO: 4040 - DNA, 768 bp, Chromobacterium substugae
atgcaacaaacagaagaccggcaattcgtcaccgcgctggcgcgcggtctggaaatgctggcggcgttccgccccggcgagggcgcgttgtccaaccaggagctggcgcgccgcaccggcctgcccaaatccacggtgtcgcggctgagctacacgctgacccggctcggttatttgcagcaggaaggcgacggcggcccgtaccggctggggctggcgttgctggcgctgggctcggcggcgctggccggctacgatctgcgcgcggcggcggcgcccttgatgcgcgaattcgcgctggccaacaatgtgtcggtgagcctggccctgctggacggcagcgatatggtgtatctggaaacctgccgcagccaggcgcgggtatcggtgcagcttgccaccggctcgcgggtgccgctggccaccaccgcgatcgggcgcgcctatttcgccggcttgccggccgccgagcggcaagcgctgctgccgcggctggccgagcgctacggcgcggaatggccgcaactggagcaaaggctggagcaggcctgcgccgactactcgcggcacggctactcggcgtctttcggcgaatacgaagcggatgtgatggcggtgggcacccacctgccggcgctcttgcccggccagccggcgatggcgctcaacgccagcggcccggccttcgccttcgacgcggcggcgatgcgcgaacggatcgcgccggccttgctggcgctgcgccagcgcatcgcgccgacggtctga

SEQ ID NO: 4041 - DNA, 435 bp, Chromobacterium substugae
atgcaaaccgtaagacaattgctggatggcaaaccggtgcgggcgctggtgtacgtcagtccggacagcaccgtgttccaggcgctgcaggtgatggcggaaaacgatatcggcgcggtgctggtgatggagtccggcgacatcgtcggcatcttttccgaacgcgactacgcgcgccgcatcgtgctgcagggccgcacctcggccgggaccaaggtgcgcgacatcatgaccagccgcgtggtgtacgtgacgccgctgcagacgctggacgactgcatgagcctgatgacggaaaagcgcatccgccacctgccggtgatggaagaccagaccgtactgggcatgctgtcgatcggcgatctggtgcgggcgacgatagacgagcaggcgcaggtgatcaaccacctggtgcattacatccagtcagcctga

SEQ ID NO: 4042 - DNA, 870 bp, Chromobacterium substugae
gtggcaacagacgcagccgaaaaggcgaacatcctggccgaggccctgccgtatatccgccagttcgccggcaagaccatcgtgatcaagtacggcggcaacgcgatgaccgacgaggccctgaaagagggcttcgccaaggacgtggtgctgctgaagctggtggggatgaatccggtggtggtgcacggcggcggcccgcagatcaacgacttgctggcgcgcgtaggcaagcagggcgaattcatccagggcatgcgggtgaccgacaaggaaaccatggaagtggtggagatggtgctgggcggcctggtcaacaaggaaatcgtgtcgctgatcaacaagcacggcggcaaggcggtgggcttgaccggcaaggatggccatttcatccgcgcccgcaagctgttcctgaaggccgacggcgacgaggcggtggacatcggccaggtcggcgagatcgaagccatcgacccgtcgctggtgtcgctgctggacagccgcgacttcatcccggtggtggcgccgatcggcgtcggcgcagacggcgaggcctacaacatcaacgccgacctggtggccggcaagctggcggaaacgctgcaggcggaaaagctggtgctgatgaccaacacgcccggcgtgctggacaagcagggcaagctgctgaccgggctgaccgcgcagcgcatcgacgagctgttcgccgacggcaccatttccggcggcatgctgccgaagatcagctcggcgctggacgcggccaagaacggcgtcggcgcggtccacatcatagacggccgcgtcaagcacgcgctgctgctggaaatcctgaccgccgccggcgtcggcaccatgatccgcgcctga

SEQ ID NO: 4043 - DNA, 666 bp, Chromobacterium substugae
atgaccgacaccggcaacagccgctggcagcgcaagaaggacgccaggcccagcgaaatcctggacgccgcgctgaccttattcgtcgaaaagggctatctcgccaccaagatggaagacatcgcccgcgccgccggcgtcaccaagggcacgccttacctgtatttccagaacaaggaagacatcttcaaggcggtggtgcgcgaaaccatcgtcgcccgcgtccacgcgatgagcgcgcaactggcccaagtgcacggcgtcggcagcagcgaactgctgtttctggcgctggacgattggtggactcatatcggctccacccgcgccgccggcctgtgcaagctgatggccgccgaggccaccaatttcccggagctgacgcgcttttattacgacgaagccatcctgccggcgcgccagttgctcggccacatcatccagcgcggcatggacagcggcgaattccgcccggtccatctcgattacgcgatcgacgcgctgaccgcgccgatgatgatgacgatgatcctcagccactcgttcgccctggtgcccggctgttgcgacagcatcaaggacaatccgctcgaattcctcaagacctcgctgcggttgacgctgcaaggcatgcaccagcccgcgccccaggacgcccgcccatga

SEQ ID NO: 4044 - DNA, 975 bp, Chromobacterium substugae
gtgcgctacgcggtcgccggcggccatgccgaaaccggcggcgacagctacgccggcgaaatccgcgcccgccacgagacccagctggcgttccgcgtcgccggcaaggtggtggccaagctggtcaacagcggcgagcgcgtgaaaaagggccagccgctggcgcggctggaccccagcgactaccagctcgacctcgccggcaaacaggcgcagctggcggcagccgaatccgacctagcccaacagcagctgaacctgaagcgttaccgcgagctgctggccaaacagttcatcagccaggcccaggtggacggccagcagaacggcgtcaacgccgcccaggccaaggtcaaccaggcgcgcgccgcgctgtccgccagccgcaatcaaaccgcttactcgacgctgacggccgacgccgacggcgtggtcagccagatgcaggccgaacccggcctggtggtggccgccggccagccggtggccaagctgtcgcaggacggcgcgcgcgaagtggcgatccaggtgccggaaaacgcgctggagcggctgcgcgccgccggcgtgttccaggtcagcctgtggaagggtggcgcgccgctgcaaggcaagctgcgcgaactggccgccgacgccgatccggccacccgcacctatccggcccgcatcgcgctgtccggcgacagccgcgcgctgcagctgggcatgaccgccaatgtgcgcgcccccggccaggccgccgccggcgcgctgcgcctgccgctgaccgcggtgctggacctgcagggcaaacactatgtctggaccatagacgcgcaaagcctgcgcgtcagccgcaagccggtcagcgtcggcgcggcggacaacgacagcatcgccgtcaccgacggcgtgcgcgccggcgacaaggtggtgaccgccggcgtgcatctgctgcgcgaaggccagcgcgtcaagctgctggatcggtga

SEQ ID NO: 4045 - DNA, 3075 bp, Chromobacterium substugae
atgaagaaactgaatctctccgaatgggcgctgcaccaccaggcgctggtgcgctacctgatggtgatgctgatgctggccggcgcctgggcctacacccagctgggccagaaggaagacccggaattcaccttcaaggcgatgctggtgcaagccaactggccgggcgccaccaccttgcagatggagcagcaggtcaccgacaagctggaggaaaagctgcaggagatgggcgagatcgactacgtgcaaagctataccaagccgggcgaaagcctgctggtggtgtcgctgcgcgagaacgtgccgcccaagaacgtgccgcagctgtggtaccaggtgcgcaagaagctgggcgacatcgcctacaccctgcccgccggcgcgcaagggccgttcttcaacgacgagttcggcgacaccttcggcaatatctacgccttcagcggcgacggcttcagctatgaggagctgcgccgctacgtggaagcctccaagcaggaactgctgcgcgtgcccgacgtagccaaggtgcaggtgctgggcaagcaggagcaacgcatctacgtcgacctgtccagcgccaagctggccagcctgggcctcgatacccgcgtggtctggcaggcgctgcagcagcaaaatggcatgacgccggccggcaccttcgaaaccgcctccgaccgcatctgggtgcgccccagcggccagtacggctcggtggaagcggtcgccgccacgccggtcagcgtcggcggcaaatcgttccggctgggcgacatcgccagcgtcaagcgcggctacatcgacccgcccgccaccagcgtgcgcttcaacggccagccggcgctggcgctggccatcagcatgaagagcggcggcgacgtgctgaagctgggcgccaacctcgaccaggccatcgccggcatccagggcaagctgccgctgggcgtggaaatccacgcggtgtcggaccagcccaaggtggtgcacgacgcggtgggcgaattcatgcgctcgctggtggaggcggtggtgatcgtgctggcggtcagcttcttcagcctgggcctgcgcaccggcgtggtggtggcgctgtccattccgctggtgctggcgatgaccttcctcgccatgtattgcttcaacatcgatctgcagcgcatctcgctgggctcgctgatcatcgcgctgggcctcttggtggacgacgccatcatcgcggtggaaatgatggcgctgaagctggagcaaggctggaacaagttccaggccgccacctacgcctacagcagcacggccttcccgatgctgaccggcacgctgatcaccgccgccaccttcctgccggtgggcctggccaaatcgatggccggcgagtacgtgttcagcctgttcgcggtggtcggcatcgcgctggtgctgtcgtggatagtcgcggtggtgttcaccccctatctgggctacaagctgctgtccagccatgcccgccacgaagaggtcgacgtctaccagaaaccgttctacctgcgcttccgcgcgctgctgggctggtgcctggaccaccgcaagacggtgatcgccgccaccctggccgccttcgtcgtgtccttgttcgcgttcaagctgttcgtcgcccagcagttcttcccctcgtccaaccggcctgagctgatggtggacatgtggctgccgcgcggcgccagctaccacgccacgctggagcaggtggaaaagatggaaaagctggcccgcgccgatcccggcgtggccagcgtcaccagctatgtcggcagcggcagcccgcgcttctacctgccgctggaccagcagcagcagcacaccaattacgcgcagctgatggtgatgacccgcgacgagcatgtgcgcgaagcggtgaaggcgcggctggaaaagattttcgacaacgacttcccgctggtgcgcggccgcgtcacccggctggaaaacggcccgccggtcggctacccggtgcagttccgcgtgatgggccccgaccacgaccaggtgcgcaagatcgccgaccaggtggaagcgctggtgcgcaagcacccgtccacgctgcacgtcaaccagaactggggcgagcaggtgaaggcgctgcgcatagacatcgaccaggacaaggccgccacgctggggctgtcgtcgcaacagctgtcgcagcagctgcagatgctgatctccggcagcgccgtcagcgattaccgcgaaggcaaccagagcatcgccatcgtcgggcgcctgaaccccggcgagcaaagagacgtcgccgcgctgggcaacctgatggtgcagaccgccagcggccgcttcgtgccggtatcgcagatcggccatatccgctacgaaccggaggaaggcatcatctggcgccgcaatcgcctgcccaccatcaccgtcagcgccgacgtggtcgacggcgtgcagggcgccgacgtttccacccagctgtcgccgggcatggccgcgctggagaagatgctgccgctgggctaccacatcgaggccggcggcacgctggagtccagcggcaagtcgcagcaggcgatcgccgccgtcgcgccgttgatgattgttgtagttctgacactcctgatgctgcagctgcagagcttccaacgcacgctgatggtggtgctgaccgcgccgctcggcatgataggcgtcaccttgacgctgatcttgttccgcgcgcctttcggcttcgtcgccatgctgggcgtgatcgcgctgtccggcatgatcatgcgcaactcggtgatcctggtggaccagatcgagcatgacatccgcgaaggcatagaccgcttcgaggccatcatcggttccaccgtgcggcgttttaggcccataatgctgacggcattggcggccattttggcaatgattccgttgacccgcagcacgttctggggtccgatggcggtggccatcatggggggcctgctggtggccaccgtgctgaccctgctgttcctgccggccctgtacgcccaatggttccgcgtgtcgcgcgacgagcggcagccaacacttccacagcaagaataa

SEQ ID NO: 4046 - DNA, 1335 bp, Chromobacterium substugae
atgaagaatacccgcctcaccttattgggcagcctgctgatgctgggcctcgccgcgcccagccaggctttcgacctggtcggcgcctggcaggccgcccgcgactacaacgccgatttcgccgccgcgcgcgcgcaacgcgaagccggccaggaaaaacgggtgcagggccgctcgcaactgctgccgcaggtcagcctgaacggcagctacgcgtacaacaacccgctgcagcccaaccgcatcgccgacgccttcggcaacgtggtgggcaacaccccctacgaaacccacggctacacgctggggctgcagcagcccttgttcgacgccggcaaatacaccggctacaaaaaaggcgagatcggcacccgcctggccgacaccaccttcgacgccgccgaacagcagctgatcctggacatcgcccaggcctatttcgacgtgctgcgcgcccaggacacgctggccgccacccgcgccagcaagaaaacttatctgaacctgctgcagcaggccaaaaccgcgttcgaggtcggcaccgccaccatcaccgacaccaacgaggcgcaggccggctacgacggcgccgtcgcccaggaaatcaacgacgccaacaacctggagctggcgcagcacaatctgcagcggctgaccggcctggagcccggcgccatccagaccgtgcgcgaccagctgccgctggacccgcccaagcccgccggcctggacgcctggcaagacctggcgctgcgcaacagcctgcgcatcagaagcgccgagcaaaacctgcagctggccgagcagaccgtcaccgagaaacgcggcaaccacctgcccaccgtcaccctcaatgccggctacgccgacaatgtcagcaaccagtacggcaactatccgcatacccgcggcagcaatgtcggcgtcaccgtcagcgtgccgctgttcgccggcggcggcatcaattcccaggtgcgcgaagcggtggcgcagcgcgaagccgctcgcgatcagctggaatccacccgccgccaagtgcgggaggacgtgcgcaaggcattcctgggcgtgaccaacggcgcggcgctggtgcgcgcccagcagcaactgctgctgtcggccaaaagcaaggtggactccacccggctgggcaaggaagtgggcatccgcaccagcatcgacctgctgcaggctgagcaggcctactacaccgcggtcaccagcctggccaacgccaaatacagctacctcaccgccaagctggcgctggcccaatccgccggccagctggcgccgcaggtgctgaacgaggtcaaccaggtcatcgtccgctaa

SEQ ID NO: 4047 - DNA, 1266 bp, Chromobacterium substugae
atgagccagcagcaactgatgcaacgcaaagccgacgccaccccgcgcggcgtgggcgtgatgtgcggtttcttcgccgaacgggcgaagaacgcggaagtgtgggacaccgaaggccggcgctacatcgatttcgccggcggcatcggcgtgctcaacaccggccacctgcacccgaaagtggaagccgcggtggcggagcagctgtcccgcttcagccatacctgctatcaggtggtgccttatgaatcgtacatccgcctggcggagaagctgaacgggctgaccccgggccagcacgccaagaaaaccgcgctgttcaccaccggcgccgaagcggtggaaaacgccgtcaaggtggcgcgcgccttcaccggccgcccgggcatcatcgccttcggcggcgccttccacggccgcagcctgctgggcatggcgctcaccggcaaagtggcgccgtacaagcttaacttcggccccttcccctccgacatctatcacgcgccctatcccagcgcgctgcacggcgtgtcgatagcggaatcgctgaccgggctggagcggctgttcaagtacgatatcgatccggcccgtgtcgccgccatcatctacgaaccggtgcagggcgaaggcggcttctacccggccccggcggaatgggtgaaagcgctgcgcgcgctgtgcgaccgccacggcatcctgctgatcgccgacgaagtgcaatccggcttcgcccgcaccggcaagctgctggccagcgagcatttcgacgcggtgcccgacctgatcaccatggccaaatcgctggccggcggctttacgctgtcggcgctcaccggccgcgccgaagtgatggacgcgccggcgccgggcggcctgggcggcacctatgccggcaacccgctggcggtggccgcggcgctggcggtattggatgtgatcgaaagcgagaagctggtggagcgcgcccagcgcctgggcgacgcgctgaaggaaaaactgagcggactgaaaaccgcggtgccgcaaatcgccgaagtgcgcggcctgggcgcgatgatcgccgtggaattcaaccagcccggcagccacacgcccgaccctgacttcgccaagaaggtgcaacagcacgcgctggccaacggcctgatcctgctgacctgcggcgtctacgccaatgtggtgcgcttcctgttcccgctgaccatcgaagacgagatcttcgccgaggcgctgggcaagctggaagcggcgctgaaagcctga

SEQ ID NO: 4048 - DNA, 1461 bp, Chromobacterium substugae
atgctcactctgcaagacgccaagctgctgcgccagcaatgctatctggacggccaatggctggatgccgacaaccgccaagccatcgccgtgcaaaaccctgccaccggcgaaaccataggacaggtgccgaaaatgggcgcagccgaagccgagcgcgcagtggccgccgccgcgcgcgccttcccggcctggaaggccaagagcgccaaggagcgcgccgccatcctgcgccgctggttcgacctgatcatcgcgcaccagcaggatctggccgtgatcctgacctccgaacaaggcaaacctctggccgaggccaagggggagatcgcctacggcgccagctacatcgagtggtacgccgaggaagccaagcgcgtctatggcgacatcgtgcccggcccggccggcgaccgccgcgtgctggtgaccaaggagccgatcggcgtcaccgccgccatcacgccgtggaacttccccagcgcgatgataacccgcaaggccgcgccggcgctggccgccggctgcaccatggtggtccgcccggccagccagaccccgctgtcggcgctggcgctggccgagctggccgagcgcgccggcattccgcccggcgtgttctccgtcatcactggcggctccagcgaaatcggcgcggtgctgaccggcagcgatacggtgaagaagttctccttcaccggctccaccgaagtcggccgcaagctgatcgcccagtgcgccggcacggtgaagaaggtatcgatggagctgggcggcaacgcgccgttcatcgtattcgacgacgccgacctggacgccgcggtggaaggcgcgctgatctccaaataccgcaacgccggccaaacctgcgtttgcgccaaccgcctctacgtgcaggacggcgtctacgacgccttcgccgaaaagttcgccgccgccgtcgccaccttgaaagtcggcaacggcctggaagccggcgtcagccaaggtccgctgatcgaccagaacgccgtcgccaaggtggaagagcacatcgccgacgctctggccaagggcggcaagctgatcgccggcggcaagcgccacgcgctgggccacaccttcttcgagccgacgctgatcgccgacgtcaccagcaatatgaaggtggcgcgcgaggaaaccttcggcccgctggcgccgctgttccgcttccagaccgaggaagaagcgatccgcctggccaacgacaccgagttcggcctggccagctatttctacgcccgcgacgtcggccgcatcttccgcgtcgccgaaggcctggagtacggcatggtggcggtcaacagcggcctcttgtccaacgaggccgcgccgttcggcggcgtcaaacaatccggcctcggccgcgaaggctccaagtacggcatcgaagactatctggaaatcaaatacgtgctgctgggcggactggaccgctga

SEQ ID NO: 4049 - DNA, 1548 bp, Chromobacterium substugae
atgagtgcagctgcccaaacgacgccgctgaccggcatgaggctggtgctggcctccatcgcgctggcgatggcgacattcatgaacgtgctggacatcacgatcgccaacgtatccattccctccatcgccggcgatatcggcgtcagcgccagccagggaacgtgggtgatcacctcgtttgcggtggcgaacgccatcgcggtgccgctgaccggctggctgacccagcgctacggccaggtgcggctgttcgtggcctcggtggtgctgttcgtcatcgcgtcgctgctgtgcgggatggccagcagcctggagtcgttgatcctgttccgcatcatgcaaggcgcggtggcggggccgatgattccgctgtcccaggccctgctgctgcaggcttaccccaaggaaaaatccggcatggcgctggcgatgtgggcgatgaccaccatgatcgcgccggtgctggggcctattctgggcggctggatttcggacaatatctcctggccgtggattttctatatcaacgtgcctaccggcctgttcgccgcctggctcacctgggtgctgctgcgcgattacgagtcgccgcgggtgaagaagccgatagaccgcatgggcctgggcctgttgatcatctgggtcggctgcctgcaggtgatgctggacaagggcaaggagctggactggttcggttccggcgagatcgtggcgctcgcgctggcggccctggtcgcattcatcttgttcgtgatctgggaaatcaccgaagagcatcccatcgtcgacctgaccttgttcaagagccgcaatttcgccatcggttcgctggcgctgtcgctgggctacggcatcttcttcgccaacctggtgctgctgccgctgtggctgcagcagttcgccggctacaccgccacctgggccggcattgtcagcgcgccggtgggcattctggcgctgctgctgtcgccgacgataggcaagaacatcggccgcttcgacgcccgcgtgctggccagcttcgctttcctggtgttcgccatcgtttgctacctgcgctcgcgcttcaatatgcaggccgacgtggccaccatcatgctgccgcagttcatccagggcgcggcgatggccaccttcttcgtgcctttgaccgcgctgaccctgtccggcctgccgccgcaacgcttggccgcggcttccggtctggccaatttcgcccgcatcaccgcgggggcgttcggcgcgtcggcggccagcaccttgtgggacagccgcgccagcctgcatcacgtgcagttgggcgaatcggtgtcgtcgttctcggcggccacccgcatcagcttgaatcagctgtcggacatggggtatggcctgagccagtcctaccagctgctggagcgtcagatcagcacccaggcctatatgctggcggccaatgacatattctggggatcggcggtgatgttcctgggtctgatcggcgtggtgtggctggccaagccgggcgcgccgcagggcaaggtggacaccagcggcgcgcattga

SEQ ID NO: 4050 - DNA, 1182 bp, Chromobacterium substugae
atgaccactcaaaccgccaccctgccggcctccaaccaacccgccgccaatctgcaggcccgccgcaagagcctggtgctgatgctggccgccggcctcgccgtgtcggcggtggcttacggcagctactggttcgcttccgcccgctatctggaaagcaccgacgacgcctatgtggccggcaacgtggtgcaactgactccgcaaaccgccggcaccgtggtggcgatccgcgccgacgataccaatttcgtcaaggccggcagcgtgatggtgcagttggaccagtccgacgccaagctggcggtggaccaagccaagtcgcagctggcgcaggtggtgcgccagacccagaccctgtacacgacccaagcgtcccgcgccgccgatgtggccggcaagaccgccgaactggcccgggccaaggccgacctggccagccggcaggagctgacgggcagcggcgcggtatcggccgaggaaatccgccacgcccagggcacggtgcagaccgccgaggcggcgttgaattcgacgcaagagcaactggccagcagccgcgcgctgtccggcgccggcggcatccagcagcatccggcggtggtgcaggcggtggccaaattgaaggaggctgagctggcgctggcgcgcaccgccatcgtcgccccggtgagcggctatgtggcgcgccgcagcgcccaggtggggcagcgcgtcagcgtcggcgcgccgctgatggcggtggtgccgctggatcaactgtgggtggacgccaacttcaaggaaagccagctgcgccatatgcgcatcggccagccggtgaccctgagcgccgatctgttcggcaaggacgtggtgtaccacggcaaagtggtggggatgggagcgggcaccggcagcgccttctcgctgttgccggcccagaacgccaccggcaactggatcaaggtggtgcagcggctgccggtgcgggtggcgttggatccggccgaggtgaaggcgcatccgctgcgcgtgggcttgtcgatgcaggccgaggtggaggtcaaggaccagagcggcgcgcagctgtccagcgcagcgccggcgcgcgcggtggcggaaacccgcgtgtaccaggagcaggccgccgccgccgacgacatggccaagcacatcatcgccgccaacctgagccgttaa

SEQ ID NO: 4051 - DNA, 1446 bp, Chromobacterium substugae
atgaacaagaaactgtggttgaccacgctgtgcgccagcctgctgctggcaggctgcgccagcgatcatggcctggcgccgcaagcgcggccgctggccgcggaaacgctcaagctgggcgcggcgtcggcggcggcggcggtcgctgagcaagcggcctggccagaggccgcctggtggggacgcttccaggatgcgcaattgtccgatctgatccagcgcgcgctgagcgcctctcccacgatgattcaggcgcaagccaggctggagcgagccggggccttcctggccggacaaagcgcagccgaagggccgcagctggatctgaacggcgtggcgtcgcgccatcgtttcagcgcgcatggcgccttcccggcgccgctggccggcagcagctacaactcggtcgagctggggctggatttccactatgagttcgatttctggggccgcaaccgcgaacgcaccctgtccgagctgaaccgccgcgacgcggcccggctggaggcgcaggccgtgggcttggcgctggccagctcggtcagccagagctatgtcgaactggcccggctggagcagcaaaaagcgctggcggaacagcgcgtgcagctgcgggagcgcgaagtggcgctgcgcgagtcgcggctcaaggctggcctggattcggacgtggagctgaaacagtccggcgcgtcggtgtcgatggcccgggcggacgtggaggcgctgggcaaccaggcggtgctgctgcggcaccggctggcggtgctggcgggaatggatccggccgctggcgaggctctggcccggccgacgctgaagatgggcggcgagctgcgcctgcccgcccggctggaaagcgatttgctggcccggcggccggaggtggcggcgcaaaagctgcgtctcgaggccgccagccacgatatccaggcggccaaggccgatttctacccgaacatcgacctgatggcgggcgtgggcggcgacgcgctgaacgcgtccgatctgttcaagggcggcagccagatcttcaatctggggccggcgatccatctgcccctgttcgacgccggcaggctgcgggcgggcctggcgctgcgcaacgccgactacgacgccgaagtggctttgtacaaccaactggtgctggatgcgctgcgcgatgtcgccgatcaggtcggcaactggcgctcgctggccaatcgccagggccagcacgaggcggcgttgcgccagctcgaatccgccgaccaggcggcgcagagccgttatcgcaagggcctgtccagctatctggcggtgatcggcgccgaagaccggctgctggcgcagaaggccgcggacatcgatctgcaggctctgcggctgcaaaccgcgatccgtctcaatcatgcgctggggggcggtctggatctgtccctcgccgaatccaagcaagcctga

SEQ ID NO: 4052 - DNA, 474 bp, Chromobacterium substugae
atggaacacgcagcgacctcgccgctcttcaccccttacagcgcggaaacctaccgcatcgacaccagcctgggccagcagatcgccagtctgcaccaccagctgctgcggcagatcgaccagcgcatggagccgctcgaactcaccgccgcgcaatggaaggtgttgatgagggtgctgagcggcgaggttcgcagcgcctcggatctgtgccggcagctggaatgcgataccgggtcgatgacccggatgctggatcgcctggaggagaagggcttcatccaccgtctgcgcagcaaggatgaccggcgcgtggtgctggtcaagcccaccagcatctgccggcagctgcggccggagctggtggacgcggcggtggaggtgctcaaccgggcgctggtcaacttccaccccgacgatttcgcggcgctgagacgtttgttggcgcagctgagcgcgaatctcaacccctga

SEQ ID NO: 4053 - DNA, 519 bp, Chromobacterium substugae
atgtctattcgcattgccgcaatcagccgcctgctgctgctggccggcctcgccgcctggctcagcatcgcggtgttcaacaacatcaccgatccgggcaccaaccaggtactgctgggccacatgctgtcgatggatttgctgtcgatggatcatcaactggggcagggcctggtctggcatgcctggccggccaaatgggtgcccagcctgctgcacgcggtgatcggcttccagctgtgcgtggccgccggattgtgggcggcggcgctggcctttgcccgcgcggtggtcagcaatgagctgcgccgattccgccaggccagggtggtggccatcgccgcgttgtcctgcttcctgttgctgtggctgtggttcgcctgcggcggcctgtggttcggctactggatcaagcaaggcgcggtgcaggtggtgcacatgacgctgatcctgatcacgctgtcgtctctgctgtatgtccaaagcggtttgccgtccgaagccggcaaaacgctctga

SEQ ID NO: 4054 - DNA, 684 bp, Chromobacterium substugae
atggatactgcccgcttcgcgtttttcgatgtcgacgaaacgctgatcgatatgaaaagcatgttcagctttcgccgctactactttctgcgccgcttcggccccgtgctgggccgcctgcaggaatggcgcgcccgccgccggctgcaggacctgctggattgcggctgcgaccgcagcgaggtgaatcgcgccttcttccgcgagtttgccggccatgcgcccgagcaactggccgccgccgccaaggcgtggttcgccgaagtgtcgagccgggatggcttttacatccgcccggcgctgaacgccctgcaaagacatatcgaccatggcgtcgagccggtcttcgtttccggctcgtcggtggacatcctgcagccgctggcggaggcgctgggagtgcgccatgtgctggccaaccgcctggaggtcagaaacgggcgctactccggcgaactgctgtcgccgcagaccataggcgccggcaagcaggccgcggtactggccttcctggcgcgttgcggctccgatgccgccgtctgctacggctacggcgaccacatttccgacttgccattgctggaaaccgtcggccacccatcggtggtggcccgcgatccggaactggtgcgcgcggccaatcaacgcggttggccggtgctcaagccttccgtttctttctaa

SEQ ID NO: 4055 - DNA, 789 bp, Chromobacterium substugae
atgaccattcaactgatcgtagccgacgaattcgccactttcgcgcaactggaaggcgtgcaaacgctgggaaccttgctggcgcagctgcgcagcaaccagctggaggagctgaggggcagccgcctggtggccggccagggactgaaccaggcgcagcgcgaccaagtgtacgcgctgggcagcagcctcggcctgcttgaggaattgtcgcactggcggctgtggagctgcgaagcgccggccggccgcgcgctctcccacaagcacaaggcggagaacatcctgatttcgacgccgcgccgggtcgatgcccatcacttcgaggccgacctgctgctcgacgcgcatggcgaactgctgctggaccatctgaccgggttccatgtgcagggcatggtcttgaccgaggcttgccgccagatgttcatcgccaccaccgaagcgcattgcctggatgagaatgcgccgtccaaacgttatttcgtgatcaacgaaatgaatatgagcttcctcgagttcgccttcccgctgccggccagcatccgctacacggtgctgaccagcgagcagccgcgccccggccgctacaacttcagcgcgaacatggaggtgtggcagaacggcaagccggcggccagcatggcggtcaagttcgcggtctttgacgatgcctatctggcgccccgcgagaggcagctggctgagaaagcgctgaacgcggttctggaagaggcgcgccaggcgttgagcctggccccggccgaagccaaggcgctggctgcctga

SEQ ID NO: 4056 - DNA, 585 bp, Chromobacterium substugae
atgcaagcacttctgcaacatgtcctgcccgcttcggttggcgagtggctgacgccgccggcaggttttgacagcttggccaaggttcagcaagtccgcgtggatggccgctccgcctggcacctgcgctatgagcgcgaagatggattgaacacgggtctgggcggcgagcatttcagcttgcttatcgcggaagagggcggcttgctgggggccacgcattttgcgcaagacctgatttccgcggcgctgcccgacgagcgcgaggcatatcggcatgcagtggcttatctggacgagcatgcgcccgatctgatcgatggcttgtcgctgcagtggatcaagccgcatggcgagatgttcctggtcgatgacggccacggcggcaagagcgcccggacgctgaccggcatgaaggtgaaatgccgcaatagcaaggatggccgctatttctgggtgatagtcggcgcgcaaggccaggtgctgactttcgaacgggatgtggtgtgggatttcctcagggcgcagcgccagaccgaaaaatggctgcatgacagctgggtcgtcgagcgtttgaccgcctga

SEQ ID NO: 4057 - DNA, 156 bp, Chromobacterium substugae
atgccttgcttggcaagctgcgcttcagggctgggtggtccagccgcccgcttcctgctgttgaaatatcctggtcaagagtcgcccgcggcctttgacgccgccactgccggccgccgctatcctggcgtgattcccatcaccgctttgccgtga

SEQ ID NO: 4058 - DNA, 531 bp, Chromobacterium substugae
atgtttgagttgaaagacctgcccagtttcgaaaccttgtccaagtttgccaaggaataccataacccggacctggagggggtgcagacttggttgcaggtcgccaaggcgaccagcgacatgatgctggcgtttgaggctaatctggctcgccatggcctgtcgcagaccaaattctttgttttgctgctgctaaagcgcaatccgtccggcttgggcctggggaagttggcggaaggcgtcagcgtctcctctcctacgatgacaggcatcatcgatcgcatggaaagatcggatctatgccggcgcgaacaagacgccaatgataggcgagcctggatcgtgcgcttgctgccggagggagagaccttgctggcgcaggtgctgcctgatcactatttgtgggtggcgcgcttgatgagtgatttcaacacggccgatcgtctgcaactatgcgagttgatggcgcgcttgactcaagcgttgagtcacgccgagtctgctcgggaagccgctgcgctgtcgaattga

SEQ ID NO: 4059 - DNA, 118 bp, Chromobacterium substugae; identical to SEQ ID NO: 426

SEQ ID NO: 4060 - DNA, 118 bp, Chromobacterium substugae; identical to SEQ ID NO: 426

SEQ ID NO: 4061 - DNA, 480 bp, Chromobacterium substugae
atgagcggcaaccgccacgcgcagattctgccatcggtgctggaccgtttgctggacgacgctccggacctgagccacatcgaagcgatcagcctgtttgagctctcgcagttcaagcaggcgttggcgcgcgacctggaagccttgctcaacacccggctgatgccgctggacgagctgttcgagcccttcccgcgggcccgcgacagcctgctcagctacggcatccccgacctgtccggcatcagcctgctcaacccggacgaccgcgaaacgctgcgcgaacagctgcgccgctcgatagaactgcacgagcccaggctgtcgcgcgtgcgcgtcaacctggacgcgccgcgcgagctggagcgccacctgcgctttcgcgtggacgcggtgctgaaagtgcacccgcaccggccgccggtgacattcgacgccaccctgcaactctcctccaacgtttacaaggtgcagggctga

SEQ ID NO: 4062 - DNA, 702 bp, Chromobacterium substugae
atgaaccaagcaagcatccaaaccgcggaacgcgccttgagcgtagccgcccccgccgcgcccagcctgcgcgaaatgctggaagacggcatctatctgctgttcctgctgaaggaaggcaacgcccccagcagcgcggtggagttcaaccgccgcgtcgaccacttcctcggccagttcgagcgcaacgcgcgcaatttcggcaaggacggcaacgccatcagccattccaaatacgcgttctgcgcgctgatggacgaaatcatcctgtcgtccgatttcgcgctgcgcgacgaatgggaacgcatgccgctgcagctgcgcttgttcggcgaacacctggccggcgagggcttcttcaatcgcctggaacagctgcgcgacgcgccggctgaaaacatcgaggcgctggaggtgttctacacctgcctgctgctgggcttccagggcaagtacttgctggaaggcgaggagaaactgggctacctgctgcacaagctcggccaggaaatccagcaaatccgcggcggcaaggccgatttcgcgcccaactggcagctgccgcaacgcttccaggcctttgtccgccatgagctgccgctgtggctgtatttcgcgctgctggccgtcgcaggcgccggcatcttcatcgccttccgctggatgctggcgcgccaggcggcttccgtattcggcttatga

SEQ ID NO: 4063 - DNA, 1311 bp, Chromobacterium substugae
atgttccttcgcccgcagcactttcagcaacaggctttatttctggagcaagcccaatccagcctgctgcggctgacccatcgccacgcctggggcatccaaaagctgtcgctggatgaagcggcgctgaaaggcggcatcatccgcgtcgacgagctgactgcgctgttccgcgacggctcgctgtgccaggcgcccgccagcgccccgctgccgctcagccgcgacctcgcctccatgccgcagatcggcatcaagaccacgttgtacgcctgtctcgcgcaactgcagccctatggcggcaacacccgcggcggcgaggccagcgcccggccgacccgcttccacagcgaccacagcgaagtctccgatctgtacacccaggcgctggcggccgacctctccaccctgcagctcgacatcaaactgatgctggaggaggaaaaccgcgacggctacgactccatcccgctgtgccagctggaaaaggacgccaccggccaatggacggtaggcaaggagttcctgccgccgctgctggcgatcgagggttccggcgaaatgatgcagatgctgcgccggctgctcgacatattgctggtgaagagccaggcactgtccggtgcccaccgcgagcgcgccaagagcgtgatggagttcggctcggccgacatcagctcgttctggctgctgcacaccgtcaatcgcaacttcgcccgcctgcgccacctgtcgcaatgccagccgctgcatccggaagagctgtacatggccttggccgagttctgcggcgaactgcagactttcgccacgctgtacacgctgtccgacatcccggcctaccgccacgaccagctgcacctggtattcccgccgctggacctgcaaatccgcgaactgctggaaaccgtggtatcggcccgctacaaggtgattccgctgcactcgccgcggccctccttccatatcggccggctggaaagcgaccggctgctggacaatgtcgacttctacctgtcggtgcaaagcgaccaacccgccagctacatcctcgacaacgtgccgctcaagctcaagatcggcgcgccggacgatgtcgaacgcatcctcaactcggcgatgcgcggcgtcagcctggcgcactcggcgcaaacgccgtcggccatcccggtgcgcgtgggcaaccactacttcgcgctggagccgggcagcgagatctacagccgcatgctgcagtcccgcagcatctgcatctacgtgccgcagacgctggccaatatttccatagaactgatagcggtcttccgctga

SEQ ID NO: 4064 - DNA, 498 bp, Chromobacterium substugae
atgatcgcggcgctggccttgccgctgctgggcggctgcgcaggcccgaaaaacatcactctcagcagcgaagccaccaccgcgctgaaccgcgacaagcatggcaaaccattgtctgtggtagtacaagtttatcaattgaaatcggaccaaggatttaaactactcacacctgaccttttggccagtggaaagccgatagcagatgtgttaggcgcttcggtaatatccagcaaagaattgatattcgttccgggcggcaagcaggaactggatatgacaatcctggaagacgccaattatgttggcgtaatcggttatttccgtcagccgaatccccacttctggcgtttgctttatgatgccggccgcgtgcgcagcaaggacctcaaattcaaagtcgacgactgctatttgcaggcgatcaaacccgaagcgattcagctgccagaccagcccaataccggcgcagtcgattgttccaccgcgcgcaactag

SEQ ID NO: 4065 - DNA, 762 bp, Chromobacterium substugae
gtggttcaggcgccgattgagattcctcaaaatccggcctttgccgcagttgaggaaagccggaatgacgaggcgtcttcgcgtttgtccggaacggtttcggctgcgcgcggctgggtgaatagacgctcgctgacgttgtttctgcctttgttgtcgctaatgttggtcggggccgttgtggcaattacgctgcactttggcggctatcatcaggacccccaattcaccccgaatgaatatgcccacggcagccagatccggcaggcgctgctggaggaaaagctcgtgccgccgccgccgctgccgcccagcgcctttgtcgacgcggtggccgagaagccgcaattggcgctggacaaggccgaccgcgattggagccggatggaccccgctttcgtacaggatgtgctgcgggtgatggaaaagatgaaggcccgcggttttccgatggtgctgctggagggctatcgcagcgccgagcggcagaaccgcctggccggcggcagcgccaaagtgacgcaggccaagggcggggagagcaagcaccagtacggcctggctgccgaccttgccccggtgagaaacggcaaggtggtgatctcggagcgcgatccgtgggcgatgcaggcctataccgcgctgggcgaggaggccaaggcacaggggctgggctggggcggcgtgtggagcttccgcgactacggccatatcgagcgcaccggctccttgcgggcattgctggcgcacaagaacaaatga

SEQ ID NO: 4066 - DNA, 3798 bp, Chromobacterium substugae
gtgtttaacaaaggttggctacgcaatgccaaggtggcgtccgccatcgggtttttgatcctgatcgccttgatctggtggctgggaccctggctgggcctcaagtcgctggaggcgcgcttggggtggatcgtcgtggtgatgatcgtatgggtgctggccttgctggtcggccaggtgttggcgcgccgggcgggcgggctgctggagggcatgttgcggcgccaggcggatgaggcggtgatcaacgccagcgccgacaagcgcgccgaagtgaccttgctgcgccagcgcatgctgggcgcgatcgacacgctgaaaaagtcgaatatcggcaacgcgcgcggcagcgcggcgctgtatgagctgccttggtacatgatcatcgggcacccggcggcgggtaaaagttccgcgatcctgcaatccggcttgagtttcccgttcagcgacaagagcggcatccagggcgtgggcggcacccgcaactgcgactggttcttctccaccgagggcgtgctgctggataccgccggccgctacgccaccgagagcgaagaccgcggcgagtggctggccttcctcaagctgctgaagcaataccgcgccaaggcgccggtcaacggcatcatggtggcgatcagcctgccggagctggcgcagcacaatagcgaaggcttcgtgctgtacgcgcgccaggtgcgcgagcgcatccacgaagtgtgcaataccttcggcctgatggtgccgatctacctggtgttcaccaagctagacctgttgggcggcttcgcccagttcttcaacgaggccggcgaggaggagcgctcccgcgtctggggcgccacgctgtcggccgaccaaggcaccggcttcgatgcctccgccgtggtgtcgcagcagttcgagcagttgtaccgcggcttggtgcaaatgggcgaggagcagctgtcgcaggcgcgcggcgacgcggtcaagtcggcgcacttcgccttcccgatcgagttccatggcctgcaggaggcggtggtcaagttcgtccgcctgctgttcgaggaagacccgtaccattcgcgcccgttgctgcgcggcttctatttcaccagcgcgctgcaagaaggcgtgccgcgcatcgtcaccgccggccgcgtgcaggggcagttcgacctgtccgccggcgggttggacaagcatcaggcgccggcttcatacagttacttcctgcgcggcctgttccgcgaagtgctgttccccgaccaacacctgattttccagcagaccaagcccagcggcagccgctggcgcctggccggcatgatcgccggcgtggtcagcctggcggcggtggccggtctgtggacctggtcgttcgtcggcaaccagcaattgatcgcgcaggtcagcgccgagcgcgcgcaggcgcagaaactggccgcttccggccagctgtacgaccgcctgaagggcctgctgatcctgcagaaccggctggaagagctgcagaactaccgccgcaacggcgagccgtggcagatcggcatgggcctctaccagggcgaagaactcgagcgcaatctgcgcaaggcctacttcgccggcgtcaaggacgtgatgctgcgcccggtgcagaaaaacctggaaaccacgctggcggcgcttaagcccggcgtgccgcagccggtggcggtcagcgagccgccgaagccgcagcccaagccggaagccaaacccgagcccaagccgcagccggccaagccgatcaaacagtacaagccgcgtccgaagggccatgcgctgcccaatatcaacctgagcgcgctggagctgccgcaacgcgcgaccaccgccaagctggacgcctcggcgccggccatcggcggcgaaaccgccggcaagccgcagaatccgcagcagctggatgtcggctacaacgcgctgaaaacctatctgatgctgcatgagcagcgccgtatggaagaggcgcagctggccgaccaactgccgcgctactggcggccgtggctggagagccagcgcggcgagtacccggtcaacgaggtgatgggccaggccgagaagctggtggcgttctatgtcagccagatcaaggagccggacctgccgctgatcgacaacgatcccaaggtggtggccgacgcccgcgacgtgctgcgcggctcgttcaagcgcctgtcggcgcaggagcgcgtgttcagcgagatcaaggcgcgcgccaacacccgtttcgcgccgttgaccgtggcccgcatcctcgacaaccgcgacatggacatcatggccagcagccagatggtggagggcgcctacacccgcgaggcgtggaacacctatgtgcgcgccgccatcgacgaggcgagcaagggcgagatccgcagcgacgactgggtgctggcctccagcagccaggacaacctgggcaaggacggcgacgccgagaagaaccgcgccgcgctggaagcgctgtaccgcgcccaatacatcgccgcctggcacaaattcctgcagggcgtggtggtgcgcgacatcaccaatccggcgcagtcggcgtcggcgatgacccgcctctccgacaagcagaactcgccgatcaggctgatcctggcgcgcgcggcgcaggaaaccgcctgggacaatccgtccgagctgaaccgctcgctggagaccgccaagcgctcggtgctggaaaaaaccaccgaactgttcaagggcgcggatagcccggccgacgccaagagcgacaagcagttcggcgtggtgggcgcgcagttcgccggcgtggccgcgctggtcaagggcgacaatccgccgatcaacggttacctcgaccagctggccaagctgaaagtgaagatggcggccatcgccaccaccgacgagcccggcccgcaggcgcgcaccgcgctgcagtcgacgttgaacggctccggttccgaactgggcgacacgctgtcctatgtcgacaacaccctgctgaacggcgcgacgccggacaccatcgagatggtgcggccgatgctggtgcggccgctgtcgcagtcgtacagcgccttgctgggcccggtggcgcaggacatcaaccaggcctgggccaacgaagtgctgccgcagtggaaacagctggccggcaagtacccgttcagcgactccagcagcagcgcctcggtggcggacatcaaccgcttcgtcaaggccaatgacggcacgctggacaagttcgtcaacaaatacctgaacggcctggtgcagaagaagggcgacagcctggtgccgcgcgcctggggcaaccagggcgtgcgcttcaatccggaattcctcaccggcgtcagccggctgatggcgctggccaacagccagttgcaggatggcgagaacagccgcttcgagctgcagccgctgccgaccccgggcctgtccgaaaccgtgctcagcatagacggccaggagctgcgctaccgcaacggcccgcagccgtggcagccgttcaactggccgggcagtggcggcggcgaaggcgcccgcatccaggtggtcaactacgccggcgccagcaccgtggtgggcaaccagtctggccgcatgggcctgatgcgcctgctggccagcgccaaggtgcaggacggcggcgacggctcggcccaactgagctggaacctgcccaagggcagcggcgccgaggcgcaaaccgtgcgcttcaatttccgcatgctgggcggcgtcaatccgctgcagttgaaccggctttacaaactgacgttgcccgaacgcgtgacgttgtaa

SEQ ID NO: 4067 - DNA, 1020 bp, Chromobacterium substugae
atggcgttcaatttcaagcgcacccaggaagtgcccccgcagttctgcattttcggcaagctgccgcggcgcgccgacttcgtgcgggtcaatgccacccacccggcggcgatgcagctggatcaactgctggcgcagagcctgcagcggatggagttcaacgaggacagcacccgccgctatctggcgatgccggccacctccttcgtgctgcaaagccgcgaccagaactggctgtcgctgggcgtgatccagcccagccgcgatgaaggcggccgcaactatccgctggtggcggcgtcgctggtggcgatagacaccgccttgccgccgacggcgatcctgctgctggccaacgagctgttcttcaccggcctgaaggaccaactggccagcgccatcgacaattcggtggagatgctggcctgcaagcagtttctggaagagcagctgcgcttcggcgcctcgtcggtggccgacatcgatctggcgcagcaactgctggaaaaacacctggcggtgacgccggcgtcggagctggggcgaagcctgagccaggcgggcagcggcgatctggagtcggtgctgctggccttcgtgttccatcaccgcctgctgcgcaaattccgcgacagcctgccggtgcaggcctacttcctgccgctgccggcggtggagggcgagaacgtgttggccgccgtcacctggctggcgctgtatcacgccgccacttacgacaacggcgacgcgcaggagcagtgcctgatcctgcgccggccggaaggccatttcctggtgctgctgccggccgggctcaacgagcagatcgccagccagtgctggggcagccagccggacgccaagttcgtcgtcgacatcaacgacgccaaggcgccgtggcgcagccaccaggcctatgccgaggcggcgtacgtgctgggccggcaactgaacgatccgggcctgtcgctggcgcagctgcggacggttttaaccagtctgtcgcgcaatatcgcgtag

SEQ ID NO: 4068 - DNA, 465 bp, Chromobacterium substugae
gtgcagatcacctatgacgtcgaaattggcgacgcgatcgaaaccaaggaactgccgttcgtgctgggcgtgctgggcgactactccggccacagcaaggagccgctgccgaagatgaaggagcgcaagttcgtccagatcgaccgcgataacttcgacgaagtgctgaaaggcatggcgccgcgcctgaccatgaaggtggacaacgcgctgaaggacgacggcagccagctgtcggtggagctgaattttgacaacctggccgacttcgaaccgcagaacgtggtgcgccagatcgacccgctgaaccaattgctggaagcgcgcacccgcctggccgacctgcgcaacaagctggccggcaacgacaagctggaagaactgctggacgaagtggtgcgcgataccgagaagctgcgccagatcggccagcaggccggcaagcaggaagggggcgagcaatga

SEQ ID NO: 4069 - DNA, 1479 bp, Chromobacterium substugae
atgagcgcggaactgcagcaacaggcggctccggccgcggcggaaggcggtagcctgctcgacagcatcatcgagcaaagccgcatcgccaccaatgacagcgaaaagaaccatacccgcgacctgatcggcgaactggtcgaccaggtgctgaagggcagcgtgacggtatcgcgcgacctgtccgccagcattgacgcccgcatcgccgagatcgaccagctgatcaccgaccagctgaacaatgtgatgcatcatggcgacttccagaagctggaagcctcctggcgcggcctgaagtacctggtgatggagtcggaaaccagcacccagctgaaaatcaaggtgctgaacgcgtcgaagaaggacctggtcaaggacttcaaggcggcggccgagttcgaccagagcgcgctgttcaagaaaatctacgaagaagagtacggcaccttcggcggcgcgccctacgccgcgctggtcggcgattacgaattcacccgccatccggaagacttctacctgatggacgagctgtcgcacgtggcggcctccgcccatgcgccgctgatttccgccgccgcgccgggcctgttcggcctggaaaccttcgccgacatcggcaagccgcgcgatctggccaagatcttcgacaccgtcgaatacgcgaagtggaaatcgttccgcgaatccgaagactcccgctacgtcggcctggtgctgccgcacgtgctgggccgcctgccgtacggcaaggacaatgtgccggtggaggagttcgacttcgaggaaaacgtcgatggcagcaaccacgacaaatacctgtggaccaacgccgcctacgcctatgcggcgcgcctgaccgacgccttcgcccagtacggctggctggcggccatccgcggcgtggaaggcggcggcttggtggaaggcctgccggcgcacaccttcaagaccgacgacggcgaagtggcgctgaagtgcccgaccgaagtggcgatcaccgatcgcaccgaaaaactgctgtccgatctgggcctgatctcgctggtgcactgcaaaaacaccgactacgcggccttcttcggcggccagtcggtgcagaaggccaagacctacaacaccgattcggccaacgccaacgcgcgtctgtccacccagctgccgtacatcttcgcggtttcccgcatcgcgcattacatgaaatccatcatgcgcgacaagatcggcagcttcgcctcgcgccagaacgtgcaggactacctgaacacctggctggcccaatacgtgctgctggacgattccgccagccaggaagccaaggccaagtatccgctgcgcgaagcgcgcgtcgacgtggtggaagtgccgggcaagccgggcgtctaccgcgccgccgccttcctgcgtccgcatttccagctggacgagctgaccatttcattgcgtctggtagccgagttgccgcaaccggcgggctga

SEQ ID NO: 4070 - DNA, 498 bp, Chromobacterium substugae
atggcttttgatgcattcctgaaaattgatggcattcctggtgaaagcggcgacgacaagcacaaagactggatcgaaatccagtcgttcagccacaagctggaacaaccggcccaggcttccgccagcaccgccggcggcgcgaccgccgagcgcgtgaaccatggcgtgtacgaaatcacccacttcctggacaaagccagcccgaagatctacgaagcttgctgcaccggcaagcacatcaaggacatcaccatcgagctgtgccgcgcgggtggcgacaaggtgaagtacatggaaatcaagatggaacaagtcctgatctccaaggttgagccgcaaggttccgctaccgattccggcttcccgtcggagaaggttagcttcagctacggcaagatcaagtggacctacactcagcagaagcgcgccgacggcgccggcggcggcaatgtcagcgccggctgggacctgaccgcgaacaaagttatcgcctaa

SEQ ID NO: 4071 - DNA, 438 bp, Chromobacterium substugae
atgaaacgtttgttgataaccgtggctgtcgccgtgctgtgcagcgcttgtcagacggcacccaccaaggctcaacaggccgaaatgcaggctgcagccgccgccaatgaggccaaagctgaaatcgccaaagccgccgccgccaattacgccgccgactccacgctggttccgtttgagaaaatgagcggcaagctgactcccgtgggcgaagcccagctggacctgctgctgccgagcttgaaatccgccaaatccatcatcattcgcggccactgctaccgcaacgatatcggcaacgccaaggccgccgcccaggcgcgcgccgccgcggtaaggcaatacctgctgatggccgacatcccgtccagcaagatcaccgtgcgcttcgacaccgaacgcccgctgcacgccgtccgcctgctggtcagcaactaa

SEQ ID NO: 4072 - DNA, 1122 bp, Chromobacterium substugae
gtgcgcgccaagctatccagcgaagcgggcaagacccagctcaaccagggctacctcgcccacccaagaagcaacggcaaagcccagccgcgcggcgacggcttcgaactcagaaccgaccagcacggcgccatccgcgccgcccacggtctgctgctgtccaccgaagcgcaaaacggcgcatccggcaaacagctggcgcgcgagcacgcgcagagccagctcgacgccgccctcagcctctcccaggcgctggccgaaaccgccaccggccaactggccgacagcatggaaaccggccccgacgaaatcagcgcggacaacgccaaaaccggcaagaaatcccaaggccacctgcaacaccacgccgacgcgctgaaggcctgggaagccggcagcaacaccgacaaagacggcaaaaccgcccaggaccaagccggccaacagccgctgctggtgctgtccggcccggccggcatcgccgccctgaccgagcagagccagacgatatcggccggccagaacctcaacctggtcgcccaacgcgacgccaaccacacgacgggccggcgctggatccacaacgtcggccagcacctcagcctgttcgtggcgggggtgaaggacaaggtggcgctgaagctgatcgcggcgaagggcaaggtgcaagtgcaggcgcagagcgacgcgatggagctgacggcggagaaggatgtgaccatcacgtcctgcaaggacaagatcatcgtccacgccggcgatgaaatcctgctgaccgccggcggcgcctacattcgcatcaaaggcggcaatatcgaggtccatgcccccggcaaagtgacggtaaagggcgccagccacacgctcgacggcccagccagcatggattggtcacagccgcaatacaagaagatcgtctgcaccgagcagatcgatgcgcagttgctgaccgaggcgcaccccgagttcatcggcaaaaaatacgtctactactccgccgataccggcaagaagatcgcgtccggcgcgctggacggcagcggcatgaccgaccgcatccatctgcccggcgtcaacaacatcaaggccctgatcgggtccggtgaatgggaaatcctgtaa

SEQ ID NO: 4073 - DNA, 1251 bp, Chromobacterium substugae
atgaaccatcgctatgcttttatcgccattggcgtgctggcgctgtctgctgcccgcgccgacgccgccaaccaggctgaggacgcctcggtagacctgggttggaacacgctgcagcttcatgccagccagacgctggccggcttgacgccggggcaatattcggtgaagaacctgttcgacccgagtccagccaaggcctgggtcttccacggcgagcagacatttcgctattccgagcaaatctccaatccggcaacgctgacgctgacgttggcgaagccgagctcgctgttcgccgtcgcgctgacgccaggctacgccaagtcggcggccacccagttccagaacgcctcgccgaagagcgtcaccatcagcctgtaccggccgcatgaagacaaaccattcgaaacgcgccgtttcgccctcagctaccatgcgcgcgagtattcgctgccgcagttgcagcgcgagctgaaaacggtagccttcaccaaccagacggatgacaagatcaccggcaaatcggacaacgcgttgaactcggccgaaaggctgctgctgatcaacgctggcgacgccgaaatcgccaagctggagctgaaaatctccaccattgagccgggagcgaaattcaccgatgtcgccgtcagcaagctccgcctgctggaccggcaagccagtcagaatagcgcggaactgcggctggcgcgcttcatcgcgcgcgacctggacaacgccgccaagcaactggccgccacgccgcgctgcttggtttacaccgaacagaacgcctggccgcagctgaccaaccgcgcctgcaccggcccggccgcgcaactgcaacaaggccaggccgatcaaggcgtcgacgatatcatcctgacacgcaaagacgctgccagccggcaataccaggttccgttcgccgtcgcgctgcgcgacgcgcaaaccactggctccggccgcaacagacagctgcggctgtccgccgccgacatggcgggcagtgaactgatactcggcaaaaacgccaacggccagttgcaggcgctgtccggcctagcgctgacccaggccttcctggccaaccgcgccgatggcttcggcaaggcgtacctgcaaccccaggacagcccctacttcttcttcgcctactcccgcccgcagttcacaccggacaaggacggctaccagttgagcatctacggcccggccggacgccaggaggcgcaatgggcaaccaggtag

SEQ ID NO: 4074 - DNA, 1758 bp, Chromobacterium substugae
atgggcaaccaggtagaaaagtacaaggatttcaacttcggcaaatacagcgaagaacagaaatacgacatcctgcagcggctgttcgaacatcacgccgccgccaacggcaagaataatgtcgacggtttcgcgttcgagaccgccaacggccgggtcaacctgataggcgcgcgcggcttcgaccacggcaaagtcgtcaaagacagcaacaaggtgttcgacgacacattgttcgtcgtctacaaggacgcatccggcgagaaaaaagtcgccgaattcgaattcaacaccgaaccctacagcaagcagaacggccagctggccggccgggtgctgatcaacggtctataccagtacaaactgggcaatcacaagatatcgtcgtaccacgaccatgccagcctggcggaaatgcaaagcacgcaccatttcgcccagcaccacaactaccgggcgctgaggatagtcaaaggccttgcttttcacgcccaaaacaccggcacggccaaggccccggagtatgagttcagtccggaccagcccggcacgccgtcaacaacctacgaacacaacatccactacggcggcgaaggcccgagcaaccgcaccagcaactggagcgaaggctgccagacggtcaagggcctggataactacatccggctgctgaaaattctggaacaggactacagcctgttcggcaccatccacaacgagctgatcgccaagccggctgtcgatggcaagcgagcggtggtctacgcgctgctggacggccaccaggtcgccgatgaaaccaagattcaggtcaaattcctcgaccgcatcctgcagccgatgaaagacgtctggtatgagatccgccacggcgaccaaaccattaccggcaagaccgaccatgacggtgacaccggcgcgctgttcggccacaacccaaaggacaaaatagacgtcaagctgcaagggccggtcggcgacgccaagaagctgccgccggtgcaggccggcgagagcgtgttccacaaatacctatgcgtggtcagccccaaggtgctgtgtgatggtctgtcgcgtcccgacgccgatcataaggaaccggaaatcgacaagacccagtccaagacccacaaacatcacaacaagcaacgcaagccggtttccaaggtggaggtaccgaaagaccgcaacccgctggaggcaccaatttcggattccgaatttgaggactgcaacgcgctaagccaggaacagatcaccaccatcatcaggtccaacaatccggtgctgatcgaccaataccaggccgacgtgctggtctacaaggcggcgcagaactacaagctgaacccaaaggcgctgctggcgacaatgaagcaggaacaaggctgggccaagaataacaataaatacaacaagctgatgggcgtcggtcctggcggccagcccacaccgatgggagttgaggcctcgatcaacacgtcggctggcacctatcgcaggctgttcgacgagggcaagaaaaagctgtcttcgttcaaaatcaactacgaccccaaatcccatgaagtcgccgcggtaggcagcggcggcgcctccgtcagcgaagaggaggccgcggcgatgaaggcaggctatctgtacacgccgcgcaccgcctctgaatacgccaagctgcattacacgccgtggacctactttcctccccaacgcagccgaccttacgacacctgggtaaaaactttccggagcttctga

SEQ ID NO: 4075 - DNA, 552 bp, Chromobacterium substugae
atgaaaatcaattttctgctaagcgtggccgcgctgctgttggcacagcacgcgtcggccgcttgcgacaaagacgactggcaacagctgctgcgccacgccgacgcgcctaccgtcagcgcttacatcaagagccagcactgcgacgtcgaccaatcgctggatgatgtttcgaaaacgccgctcgtttacgcaatagatgccggcaaccggggcgccgtgcaagtattgctgcaagccggcgccaatcctaacgtcgacggctacgatggcaacaccccgctgttctacgcggtgtctgccaaaaatctgaatatcgtgcaggacttgatcgccaaaggagccgatgtcaacgccgccacccgcaccagcgaaatcaccgtgttgatgaccgcggtgctggactcgactcccgccgtcgcgtcatatctgatcgcccacggcgcatcgctgagcgataccgacaaatacggccacaagcctatcgactacgtcgccaagctcccagccaagaaacaagcggccatgcgcgccgcgctgaaaccgcactga

SEQ ID NO: 4076 - DNA, 909 bp, Chromobacterium substugae
ttgaagctcaagcgttatcttcaggtcaccaagcccggcatcatcttcggcaacctgatctcggccgccggcggttttctgctggcggcgcagggggcgatagactggtggctgcttgcggccaccgtcatcggcctgtcgctagtggtggcctccggctgcgcgatcaacaactgcatcgatcaggacatcgacgccaagatggcccgcacccagaaacgggtgctggtcaccggcgcgatgagcaccaaggccgcgctggcgcacggcgtggtgctgggcctggcgggcttcgccctgctgtggttcggcaccaatccgctggccaccggctgcgtgctgttcggctttgtgatctatgtcggcgtgtacagcctgtacatgaagcgcaactcggtgtacggcaccctggtgggcagcctgtccggcgcggtgccgccggtggcgggctactgcgccgtcaccggccgcttcgacatgggcgctgccattttgctggtgatgttcagcctgtggcagatgccgcactcgtacgcgatcgccattttccgcttcaaggactacgaggcggccggcatcccggtgctgccggtggtgaagggcatctccgccgccaagcagcagatcgtgctctacatcctggctttcgccgcggcgaccgtgatgttggtgtacggcggctacgccggctacggctacctggcggtggcggtggccaccagcctgtggtggctgaagatggcgctgtccggctacaagcgcgaaaccgacgacagggcctgggcgcgccaagtgttcttcttctccatcattaccatcacctcgctgagcgtgatgatggcggtggatgggcagacgccgccgcacagccgcgcggtggctgccgcgaatgcgggccactacggctaa

SEQ ID NO: 4077 - DNA, 321 bp, Chromobacterium substugae
atgagccaagcgcatgagcacaacagccacggcagcgtgaaaagctacgccatcggtttcctactgtcggtgatcctcaccgccatcccgttctggatggtaatgggcggcgccttcaccaagcaggccaccttcttcggcatcttcgcgctggcggtggtgcagatcatcgtgcacctgaagtatttcctgcacctggacttcagcaaggaaggcaagctcaacagcatttccttcctgttcaccggcatggtgatcgtgctgctggtcggcctgtcgatctggatcatctacaccgccgacgcgctgatgatgcgctga

SEQ ID NO: 4078 - DNA, 612 bp, Chromobacterium substugae
atgacgacttatgtagagcaagcgcacgacgcgcatgacgaccatgagcaccacgacagcggcaagcagactgtcctgggcttctggttctatctgatgaccgactgcatcctgttcgcgacggcgttcgcggcttatgcagtgctgttccgcaacgtggccgaaggcgtttccggcaaggaaatcttcgagctgccgtacgtgctggtggaaaccgcggcgctgctgctgtcttccatcacctacggcttcgcgatgatcgccggccacaagggcaacaagtcggccgttctcggctggctggccgtcactttcctgttcggcgcggcgttcatcggcctggaaatcaatgaattccaccacctgatcgccgagggccacggcccgcagaagagcgccttcctgtcggccttcttcggcctggtgggcctgcacggcctacacgtgaccgccggcctgctgtggatgggcgtgatgatgctggaagtggccaagaccggcctgaccggccgcgccatgacccgcctgaactgcctgtcgctgttctggcacttcctggacatcgtgtggatctgcgtgttcaccgttgtgtatctgaaaggagccatgtga

SEQ ID NO: 4079 - DNA, 2046 bp, Chromobacterium substugae
atgtggttaggtaaactgactctggacgcgatcccgtaccatgagcccatcatcatgggggcgctgggaggcgccggcctgatggggctgatgctgttcgcgctcatcaccaagttcggcaagtggggctatctctggaaagagtggctgacttcggtcgatcacaagaaaatcggcgtgatgtacatcatcgtcgccatgatcatgctgctgcgcggcttcgccgacgcgctgatgatgcgtacccaattggcagtcgccaccggcggcggccacggcattttcccgccggaacactatgatcagatcttcaccgcccacggcgtgatcatgatcatcttcatggcgatgccgttcatgaccggcctgatgaacatcgtggtgccgctgcagatcggcgcgcgcgacgtggccttccccttcctgaactcgctgagcttctggctgctggtttcggcggtgatcctggtcaacctgtcgctgggcgtcggcaacttcgcccgcaccggctgggtggcctatccgccgctggccgagctgggattcagccctgacgtgggggtggattactacatctgggccttgcagttgtcaggcttgggcacgacgctgacggccatcaacttcctggtgaccgtgatcaagatgcgcgccccgggcatgaagctgatggaaatgccgatcttcacctggacctgcacctgggccaacgtgctgatcgccacctcgttcccgatcctgaccggcgcgctggcgatgttgacgctggaccgctacctggacttccacttcttcaccgcggaagccggcggcaacgccatgatgtacctgaacctgttctgggcctggggccaccccgaggtttacattctggttctgcccgccttcggcattttctcggaagtggtgtccaccttctccggcaagcgcctgttcggccacaagtcgatgatctacgccagcggcgcgatctcgatcctgggcttcatggtttggctgcaccacttcttcacgatgggctccggcgccaacgtgaacgccttcttcggcatcgcgacaatgatcatctcgattccgaccggcgtgaagctgttcaactggctgttcaccatctacaagggccgcctgcgctttgaaaccccgatcctgtggacgctgggcttcatggtgaccttctccatcggcggcatgaccggcgtgctgctggcggtgccgggcgccgattacgtgctgcacaacagcttgttcctgatcgcccacttccacaacaccatcatcggcggcgcggtgttcggctacctggccggcttcgccttctggttcccgaaagtgttcggcttcaaactggagcccaagctgggcaaggctgctttctggttctggcagatcggcttcatgttcgccttcatgccgctgtacgtgctgggcttcatgggcatgacccgtcgcctgaactacaccaccaatcctgaatacgagccgtggctgtacgtggccctgttcggcgcgctgctgatcgccgccggcatcggctgccagctgctgcagatcgtggtgagcgtgatcaagcgcaatgagctgaaggacgaaaccggcgacccgtggaacggccataccctggaatggtccacttcgtccccggcgccgtactacaacttcgccaagctgccgcaggtgcacgacatcgacgccttcaccgatatgaaggaaaagggcgtggcttacgcggtgccgaagtcgtacgaacccatccacatgccgagaaacacttcggccggcgtcttcatcggcctgttctccaccgtgtttggcttcgcgatgatctggcacatctggtggctggccatcgtcggcctcgtcggcatcatcggcttcatgctggcgcgcgcctacgacaacgacctggactactacgtgccggttgacgaagtggaggccatcgagcgcgcccgcttcgagaagctgggcatcgatgtcgacaactacaccgagcgtgatcagcaggccaagccgaagaaggccgcccgtccgaccaccaccgtgtaa

SEQ ID NO: 4080 - DNA, 897 bp, Chromobacterium substugae
gtggtgttagccctgctttcgggatgccaaggcggcattctcgatcccaagggccatatcgccgctgagcagaagtccctgatcctgacggcaaccgcgctgatgctgctggtggtgatcccggtaatcgtgatgaccctggtattcgcgtggaagtaccgcgccagcaacaaggatgccgcttacgagccgaaatggtcgcactcgaccaagatcgagatcgtggtatggctgatcccctgcatcatcatcgccttcctggccgcgctgacctggaagagcacccatgaactggatccgtatcgtccgctgcagtcggagaagaaggcgatccaggtgcaggtagtcgcgctgaactggaaatggttgttcatctatccggagcagcagatcgcttccgtcaacgaactggtgttcccggccgatacgccggtgagcttcaagatcacctccgacgcggcgatgaactccttcttcattccgcagctgggcggccagatctacgcgatggcgggcatgcagacgcaactgcacctgatcgccaacgagccgggcacctacaagggcttctcgtccaactacagcggcgccggcttctcgggcatgaaattcaacgctgtcgccaccaagaccccggccgagttcgacgcctgggtggccaaggtgaaggcttccggccaaaccttggacgcgcctgcctacctgaagttgctcaagcctagcgagaacaacccggtggctcactacgcttcgaccacgccttacctgttcgaagccgttgtgcacaagtacatggccgcccgtccgtcgctggctgacagcgacgacgccatcaagctggccaagatgaccaaagaactgtgcgccgcgatcaccccgccggttgtcaaggagtaa

SEQ ID NO: 4081 - DNA, 74 bp, Chromobacterium substugae; identical to SEQ ID NO: 1296

SEQ ID NO: 4082 - DNA, 74 bp, Chromobacterium substugae; identical to SEQ ID NO: 1296

SEQ ID NO: 4083 - DNA, 74 bp, Chromobacterium substugae; identical to SEQ ID NO: 1296

SEQ ID NO: 4084 - DNA, 612 bp, Chromobacterium substugae
atgaagaaatggttgctgatggtgttgctggcggtgagcggcgcggcgaatgccgccatcgagctgggcaaggattacacactgctgagcacgcctcagccggtggccaatcccaagaaggtggaagtgatcgagttcttttcctaccactgcattcactgctatgacgatgatccggctttccaggcctgggcgggcaagctgcctgccgacgtaagcttccgcaaggagcagatcgtatggcagaagtcgatggaaggcttcgcgcggatgttcgccaccttcaacgccacaggcaccttcgacaagctgcaccgcccggccttcgacgcgcagatcaagcagcgcatcgatttgtccaacccggagcagttcaccaagtgggtcaagctgcagaagggcgtcgacagcggcaagctgctgcagacctacaactccttcggcatcaatgcccaggtggcgcgcgcgaccaagatcacccgcgattaccagatccagggcacgccgaccgtgatcgtcaacggcaagtacgtggtgaccaccagcacgccggagcggatgatcgtggtgatgaacgagctgatcgccaaggcgcgcagcgagaagaagtaa

SEQ ID NO: 4085 - DNA, 675 bp, Chromobacterium substugae
atgatggcgggcatcatcatcggcctgatcgtgggcgtggcggtggcggtggggttggcgatgtatctcaaccgctcgccggcgccgttccaggccaagggcgagcgcaagccggaggcggcttcgcaggcgccgaccgagctgctggctccgggcacccgcatttccgatgccgcgtcggctaccgcgcccgctgccgcgcagccgcagcccaagcaggcgacgctggactccgacaccgtggcgttgccgccgccggccgcgccagcgcccgcgccgcatgaggccaagcccaaggcggcgcccgccggccagcaggccaagagcgacaagaacgatcagcgctttgatttctacaagatattgcccggccaagtggatgcggtgacgtccgatgccaagggcagccgtgccgcggaaccttccgcgtcggcgcctgccaaaaaggtctatctgcaattgggcgcgttccagaaccaggacgacgccgacaacctgaaagccaagctggcgttattgggggtggaggcgaagatccagtccgtcaatgtgccggacaaggggatggtgcaccgggtgcgagtgggcccgctcagccggcaggatgaggtggatcgcgtgcgcgcccaattgaaacaggacggcatcaacgccaatgtggtgaaagccgagtag

SEQ ID NO: 4086 - DNA, 1449 bp, Chromobacterium substugae
gtggccgtcgaggtccacctcgccaatggcctgccggcgttcaatatcgtcggcttgcccgataccgaggtcaaggaaagccgcgaccgcgtgcgcgccgccatcttgacctcgggcttcgaatttcccgcgcgcaagatcacggtcaatctggccccggccgatctgcccaaggattccggccgtttcgacctgccgatcgccatcggcatcctgctggcgtccggccaagtgcaaaatcctgacatttcccgctatgaattcgccggcgagctggcgctgagcggcgccgtgcgcccggtgcgcggcgcgttggcgatggcctgccagtgccatgcggcccgccgcgccttcgtgctgccggctgccagcgcggcagaggccgcggtggtggccgaggcgcagatttacggggtgcgctcgctgctggaggcctgcgcgtttctcaacgggctgcaaaccttgcagccctcggttccggctgacggcggagcctggccgaactatccggatctgcaggatgtcaaaggccagtcagcggctcgcggcgcgctggagatcgcggccgccggcggtcacagcctgctgctgatggggccgccgggcaccggcaagtcgatgctggcggcgcggctgcctggcttgttgccgcggctgtccgaacaggaggcgctggagtccgctgcgctgctgtcgttgggctcgcaagggtttctggcctcgaactggcgtttgcgtccgtttcgggcgccgcaccacaccgcttccgcggtggcgctggtgggcggcggcagcgacccgcggcctggcgagatcagcctggcgcaccacggcgtgctgtttctcgacgagttgccggagttcgaccgccgcgtgctggaagtgctgcgcgagccgatggaaagcggggtgatccatatctcgcgcgcggcgcgccaggccagctttccggcgcgcttccagctggtggcggcgatgaacccatgcccctgcggctatcatgggcacccatcggggcgctgccagtgcacgcccgagcaggtggggcgatatcgcggtaaaatctccggccccttgctggacagaatcgacctgcatatagaggtgccggcgctgacggcggccgaattgcagtcggccagtccgggcgaaagcagcgagcaggtgaggttgcgggtgcatgccgccaggacttgccagctggaacgccagggcggcctgaattcggccttgcaaggcgcggagctggagcggcactgcgaggcgagcgcggatgccttggccgtgctgggcaaggctttgcagcagcttggcttgtcggcgcgcgcttatcatcggatactgcgggtttcgcgcaccatcgcggacttgcaaggcgaggcgaagataggccgcagccatgtattgcaggcgatccagctccgacgcgtgatgcagggcaacgcctga

SEQ ID NO: 4087 - DNA, 288 bp, Chromobacterium substugae
atgttgagccagaaactgtttgaagaaatcagcgccaagatcagcgaaaccatcgccgccagcccggccaaagacctggaaaagaatgtgaaggccatgatggcctccaccttctccaggatggatctggtgacgcgcgaggaattcgatgtccagcaggcggtgctggcgcgtacccgcgagcagctggcggcgctggaggcgcgcctggcgcgggtggaggcggcggccttccctgaagaggcggctgcccgggtggaggagcagtcggaactcggccactcctga

SEQ ID NO: 4088 - DNA, 321 bp, Chromobacterium substugae
gtgatcaagccgttcaagcttgacgaagtccgcgaagccctgtccgccattggcgtgcaaggcgtcactgtatccgaggtaaaaggtttcggtcgccagaaaggccataccgagctctaccgcggcgccgaatacgtcgtggacttcctgcccaaggtaaagctggaaatcgccatcgacgacgccctgctggaccaggtggtggaagccatcgagaaatccgcccgcaccggcaagatcggcgacggcaagatcttcgtctacgacctggagcaggtgatccgcatccgcaccggcgaaaccggcgccgacgcggtctga

SEQ ID NO: 4089 - DNA, 1311 bp, Chromobacterium substugae
atgaaaaagatactcgctgcaatgtgcggcggccttgccgccctgtctctgccggccctggccgacgcgcccgccggcccggccgtagccgccgccaaggtgatcaattccggcgacaccgcctggatgctgacctccaccgccctggtgctgttcatgaccattcccggcctggcgctgttctacggcggcatggtccgcaagaagaacgtgctggccaccctgatgcaaagcttcgccatcaccgcgctggtgaccgtgctgtgggcggtcatcggctacagcctggccttcaccgtcggcacgccctacctgggcgacctgtcgcgcttcatgctggacggcatggtgtacatgaaggacgccggcaaactggccgtgcacccgctggccggcaccataccggaatcggtgttcatgaccttccagatgaccttcgccatcatcaccccggcgttgatcaccggcgccttcgccgagcggatgaagttctcggcgatgctggtgttcatggcgctgtggtcgctgctggtatacgtgccggtggcgcactgggtgtgggcgcctggcggatggatgggcgacaagggcgtgctggacttcgccggcggcacagtagtgcacatcaacgccggcgtcgccggcctggtgaccgcgctggtgctgggtaagcgcgtcggcttcggcaaggaagcgatgccgccgcataacctgatcctgaccctggtaggcgcctcgatgctgtgggtgggctggttcggcttcaacgccggctccgccggcgccgccgacggccgcgccgggatggcgatggtgaccacccaggtcgccaccgcgatggccgcgctggcctggatgttcgccgaatgggtgaccaagaagaagccgtcggtgctgggcatcgcctccggcgcggtggccggcctggtggcaatcaccccggccgccggcttcgtcgacgtcaagggcgcgctgatcatcggcctggccgccggcgtggtgtgcttctggggcgccaccggcctgaagcacgcgctgggttacgacgactcgctggacgccttcggcgtgcacggcgtcggcggcatcctgggcgcgctgctgaccggcgtgttcgcggtcaaggacatcggcggcgccgacggcagcctggctacccaggcgctgggggtcggcgtcaccatcgtctactgcggcgtcgtcaccttcatcctgctgaagctggtgaatctggcgatcggcctgcgcgtggcggaagacgaagaacgcgaaggactggatgtggtgctgcacggcgagcgcgtggaataa

SEQ ID NO: 4090 - DNA, 603 bp, Chromobacterium substugae
atgatgaccctctactccggaatcacctgccccttcagccagcgctgtcgtatcgtgctcttcgaaaagggcatggatttcgaaatcatcgacgtggatatccacaacaagccggaagatctggccgtgatgaacccgtacaacgaagtgccggttctggtggagcgcgatctgatcctgcacgaatccaacatcatcaacgaatacatcgacgagcgcttcccgcacccgcagctgatgccggccgacccggtgatgcgcgcgcgcgcgcgtctgttcctgcaccgtttcgagaacgagctgttcatctacgtgaaaacgctggaagctggcgccaccggcaaggaggcgaccaaagcgcgcgaagcgatccgcgacggcctgaccaccatcgcgcctatcttctccaagcaaaaattcatgctgggcgacgatttctcgatgatagacgtggccatcgcgccgctgatgtggcgtctggagcactacaacatcgatctgggcaagagcgccgcgcctatcctgaaatacgcggaacgcattttccagcgccagtccttcatcgactcgctgactccgtccgagaaggccatgcgcaagtaa

SEQ ID NO: 4091 - DNA, 771 bp, Chromobacterium substugae
atgaacaacacgatccgcaacctgatcgccgccgccgcgctggcgctggcgctgccgttggcggctcctgcgctggccaacgagggcggcccggcgctggccaaggccgacatcgacatccaggacaccgaaagcctgcagcgcggcgcgcagatcttcgtcaactactgcctgtcctgccactcggccagcatgctgcgctacaaccggctggaggacatcggcctgaccgaagagcagatcaaggccaacctgctgccggagggcgccaagatcggcgaccagatgaatatcgcgatggacaagaaggacgccaagaactggttcggcgccacgccgccggatctgtcgctgatcgcccgctcgcgcggcgccgattacctgtacagctatttgcgcagcttttatcgcgatccatcccgccccaccggctggaacaatctggtgttcgacaaggtgggcatgccgcacgtcttctgggaatggcaaggcgagcaggtgctgaagaccgagaaggacgccgagggcaacgaggtgcacaagctgcagttggtgaaagccggcaccctgaccaagctggaaaacggcaaggccaacaccgtcgagtacgacaagcggatgaccgatctgaccaactttctggtgttcatgggcgagcccgcccaggtgcagcgccagcagatcggctacgtggtgctgatgttcctcggcctgctgctgttcccgctggtttacctgctgaagaaggaatactggcgcgacgtgcattaa

SEQ ID NO: 4092 - DNA, 1344 bp, Chromobacterium substugae
atgaacaaagcacaaaagctgctcaactgggtggatgcgcggttcccgctgaccgccctgtgggaaagccaatggggcaaatacgtcgcccccaagaatttcaacttctggtacttcttcggctcgctggcgatgctggtgctggtgctgcaaatcgtcaccggcatcttcctcaccatgaactacaagccggacggcacgctgaacgccgccggcatcccggtcgccttcgcctcggtcgaatacatcatgcgcgacgtggcgggcggctggatcatccgctacatgcactccaccggcgcttcgatgttcttcgtggtggtgtacctgcacatgttccgcggcctgatctacggctcgtacaagcagccgcgcgaactggtctgggtgttcggcacgctgatcttcctgtgcctgatggcggaagccttcatgggctacctgctgccctgggggcagatgtcgttctggggcgcgcaggtgatcgtcaacctgttcggctccatcccggtgatcggccccgacctgtcggtatggatccgcggcgactacgtggtgtccgacgccacgctgaaccgcttcttcgcgctgcacgtgatcgcggtgccgctggtgctgctggcgctggtggtggcccacctgatggcgctgcacgaagtgggctccaacaacccggacggcgtggaaatcaagcagcaacccaaggatccgaacactggcctgtatctggacggcatctactcccatccttattactcgatcaaggacatcctgggcgtggtggtattcatgatcgtgttctccgcgatcgtgtttttcctgccggaaatgggcggctacttcctcgagcacccaaatttcgaccaggctgacccgctgaaaacgccgccgcacatcgcgccggtatggtatttcaccccgttctacgccattctgcgcgcggtgccgtcgtttgccggcacccaggtgtggggcgtgctggcgatgggcgcggcggtggtgctgatcgccttcctgccgtggctggaccgctcgccgatcaaatccatccgctaccgcggacccaagttcaagatcgcgctggcgctgttcatcgccgccttcatcggcctgggcatcctgggcgcgatgccgccgactggtttgcgcaccgcgctgtcgcagattttctcggtggtctacttcgccttcttcctgggcatgccgttctacaccaagaacgatgtcggcagcatcccggtgccggagcgcgtcaccgacaccaacgccaagcggcagatccagttcgtggtgctggtgctgctgaccgtgttcctggcggcgctgttcgccatgaacgtgtaa

SEQ ID NO: 4093 - DNA, 516 bp, Chromobacterium substugae
gtggcggtggtcggcgcggccacgccgtttttcctgagtttcttcccgtccgagcgggccaaggcggccggcgcgccggtcgaggtcgacatcggcaagatcgaggcgggacagaagatcaacgtcgaatggcgcggcaagccggtgtggattctcaaccgcacgccagagcagctgaagaacctgccgaagaacgaccccaagctggtcgatccgcaatccgaggtggatcagcaacctaagtactgccagaacgagcatcgctcgatcaaacccgaatacctggtggctgtgggcatctgcacccacctgggctgttcccccactttccgtcccgatctcgcgcccgcggatctggggccggaatggctgggcggcttctactgcccctgtcatggttccaagttcgacctcgccgcccgcgtgttcaagggcgtgccggcgccgaagaacctggaaatccccccgcacaagtatctgtccgacacccgcctgttgattggcgacgacaaataa

SEQ ID NO: 4094 - DNA, 747 bp, Chromobacterium substugae
atgttgttgagcgaaatgcagagtctgctggacggctggctggagccgtggcgttacaaggattacgcgcccaatggcttgcaggtggagggcagggcggaagtggccaaggtcgtgaccggcgtgacggcgtcgcaggcattgatcgatgcggcggcggcgcgcggcgccgacgcgatcctggtgcaccacggctatttctggaaaggcgaggacgcgcgcgtttgcggcatgaagaagcagcgcatccgcaccctgctgcagcacgacatcagcctgctggcctaccacctgccgcttgatgggcacctgtcgctgggcaacaacgcgcagctggggcaggtgctggggctggagcccgtcggccaggcgggggagcagggcctgctgtggcatggcgactggcgcggtggtggcgctgcccaggccttcgccagccatgtttcggcggctctggggcgggatgcgcagctgttggggcgcggcgacaagccggtgcgcaaagtggcctggtgcaccggcggcgcgcagggatttttcgccgacgccatcgcgctgggggtggacgccttcattaccggggaagcgtcggaacagaattaccacatggcgatcgagtgcgatgtcgcattcatcgcagccgggcatcatgccacggaacgcttcggcatccaggcacttgggcagcatttggcgcaattctctggcataaatgtcgaatttattgatgttttaaacccagtttaa

SEQ ID NO: 4095 - DNA, 1644 bp, Chromobacterium substugae
atggctgctaaagacgtaaaattcggtgattccgcgcgtagcaaaatggttgctggcgtcaacatcctggccgacgccgtcaaggttaccctgggcccgaaaggccgcaacgtggtgctggaccgctcgttcggcgcgccgactatcaccaaggacggcgtatccgtcgccaaggaaatcgaactgaaggacaagttcgagaacatgggcgcgcaaatggttaaggaagtggcttccaagacttccgacgtggccggcgacggcaccaccaccgccaccgtgctggcgcaagccatcgtgcaggaaggcatgaagtacgttgccgccggcatgaacccgatggatctgaaacgcggcatcgacaaggctgtggtatcgctggtcggcgaaatcgccaagatcgccaagccctgctccacctccaaggaaatcgcccaggtcggctccatttccgccaactccgacagcgacatcggcgaaatcatcgccaacgcgatggacaaggtcggcaaggaaggcgtgatcaccgttgaagacggcaagagcctgaacaacgagctggacgtggtggaaggcatgcagttcgaccgcggctacctgtccccgtacttcatcaacaaccaagacaaacagattgccgctctggacaatccgttcgtgctgcttttcgacaagaagatctccaacatccgcgatctgctgccggtgctggagcaagtggccaagtcgggccgcccgctgctgatcatcgctgaagacgtcgaaggcgaagcgctggccaccctggtggtcaacaccatccgcggcatcctgaaagtggttgccgtcaaggctccgggcttcggcgaccgccgcaaggccatgctgcaggatatcgccgtgctgaccggcggcaccgtcatcgccgaagagctgggcctgactctggaaaaagccacgctggacatgctgggccaagccaagcgcatcgaagtgggcaaggaaaacaccatcatcatcgacggcgccggcgaagctgccgccatccagacccgcgtcggtgaaatccgccgccagatcgaagaagcttcttccgattacgaccgcgaaaagctgcaagagcgcgtggccaagctggctggcggcgttgccgtgatcaaggttggcgccgccaccgaagtggaaatgaaagagaagaaggctcgcgtcgaagacgcgctgcacgccacccgcgccgcggttgaagaaggcgtggtagccggcggcggcgtggctctgctgcgcgcccgcgctacgctggacagcctgaagaccgacaacgccgaacaggaagccggcgtgaagatcgtgctgcgcgccatcgaggctccgctgcgccagatcgtcaagaacgccggcgacgagccgtcggtcgtggtcaacaaggtgctggaaggcaagggcaacttcggttacaacgccgccaccggcgaatacggcgacatgctggaaatgggcgtgctggacccggccaaggtgacccgctccgctctgcagcatgcggcttccgtagccggcctgatgctgaccaccgactgcatgatcgccgaactgccggaagacaagccggctgccggcggcatgccggacatgggcggcatgggtggcatgggcggcatgatgtaa

SEQ ID NO: 4096 - DNA, 288 bp, Chromobacterium substugae
atggcaatccgtcccctgcacgaccgtgttgttatcaagcgcctcgaggctgaagaaaagaccgcttccggcatcgttctgccgggcgccgctgcagagaagccggacatgggcgaggttctcgctgtcggcaacggcaagatcctggagaacggcgagcgtcgttcgctggatctgaaagttggcgacaaagtgatttttggcaagtattccggtcagaccgtcaaggtcgacggcgacgaagtcctcgtgatgcgcgaggaagacgtaatgggcatcgttgagtaa

SEQ ID NO: 4097 - DNA, 1107 bp, Chromobacterium substugae
atgctgcagatcttgataatttcaactttcctgtctctgttcatggcgatgttcctgatccacttcagccatttgcatgagcgcttcacgtctgatcacgatcttggaggagtgcaaaaattccatgcgatgccggttcccagggtgggaggggttcccctggcggcgggcttgttggccggatgcggtgtgctgtcctggtcgctgtcggatgccacggcgctgttgctgttgttggtgtccgtaccggcgttcgcggctggactgatggaggacatgaccaagcaagtgggaccgctgccgcgtctgctcgccacttttgtgtcggcgggacttggctatttttcgttgcaggctgggctccatcggctggacatcccggtgattgacagccttctggtcaatttcaccctgttttccttcgtcttgacggtgatagccgtaggcggcgtggcgcacgcggtcaacatcatagatggctacaacggcctatccggtgtggtcgccgtcttcattttcctggcgatggcctatgtcgctttcaaagtgcaggatacgatgctgctgggggtttgttttgcgatgatcggcgccatcgccggtttcctgttttggaacttcccgcgcgggctgatttttgccggcgacggcggcgcctatctggtcggtttcatgatcgccgaagtggcggtgctgctggtgacgcggcatccgcaggtgtcgccttggtttcccttgctgtgcgtgatctatccggtgttcgaaaccctgtattcgatctaccgcaagaagattctgcgcggcatgtcgcctggcctgcccgacggcctgcatctgcacatgctggtgtacaagcggttggtgcgctggatggtgggttcgaaggatgccggccacctcaccttgcgcaacagtctgacttctccctacttatgggcgctgtcatcggcttcggtggcgccggcgatgttgttctggcgtcacacctatgtgctgatggggttctgcctgctgttcgccgtggcatacgtgatggtgtaccggatgatcatccgctttcgcacgccgcgctggctggtgttgcgccgctcggctccctcccgttga

SEQ ID NO: 4098 - DNA, 132 bp, Chromobacterium substugae
gtgaatggtgatttctccgacattattttttgtgattttaattctatgggcgtggacgcttttcgcatgatattttgtaaatggcacgagattggctttggcctggcgtcgagccagatgccgatggtttga

SEQ ID NO: 4099 - DNA, 774 bp, Chromobacterium substugae
atgaaagccgtcattcttgcaggtggattgggtacccgtatcagtgaagaaaccaccgctcggcccaagccgatggtggaaatcggcggcaagcccattctgtggcacatcatgaaaatctattcccactacgggataaacgatttcatcatttgctgcggctatcggggctacgtgatcaaggagtacttcgccaactacttcctgcatatgtccgatgtcaccatcgacatgtcgagcaatcacatggaagtgcatcaacgctacgccgaaccatggcgcgtcaccctggtcgacaccggcgaacacaccatgaccggcggccgcctgaaacgtgtgaggaaatacctgcagggcgaggacgcgttctgtttcacttatggcgatggcgtagctgacatccacatcggccaactcatcgacttccacaaaacctatggcgcagcagccacgctgaccgccgtctatccgcccgcccgtttcggcgtgctggacatcaaggacaacctggtgtcgaacttccaggaaaaaccccagggcgatggcggcatgatcaacggcggctttttcgtattgtcgccgtcggtcatcgacctgatcccagacgatggctgcgtatgggagcgggagcctctggaaacgctggcccagcgcggccagctggccgccttctcccatgaaggcttctggcaaccgatggacacgctgcgcgacaagcttcacttggaaaacctgtggaaatccggccaggcgccatggaaagtatgggaatga

SEQ ID NO: 4100 - DNA, 1086 bp, Chromobacterium substugae
atgaaccgcgacttctggaaggggaagcgggtctttctcacgggtcataccggcttcaagggcagttggctcacgctgtggctgcaagcgctcggcgccgaggtgtccggctatgcgcgcgaaccggcgaccgagcccagcctgttttccgccgccggcctcgcgcaaaccatgcactcctcgttcatcggcgacattcgcgaccccgaccgcctgcgcgccgcgcttgaccgcgctcgtccggatatcgtcttccacctggcggcgcaggcgatcgtgcgccgctcgtatgccgatccggtggaaacctatgccgcgaacgtgatgggcaccgtccacctgctcgaagccgtgcgggccacgccgacagtacgcgccgtggtgtgcgtcaccagcgataaatgctacgaaaaccgagagtggccatggggctatcgcgagaacgaggccatgggcggctacgatccatacagcagcagcaaaggctgcgccgagttggtcgccggcgcctaccgcaattcctttttcaatccggccgaccacgagcggcacggcgtggcgctggccaccgctcgggctggcaatgtcatcggcggcggcgattgggcgcaagaccggctgattcccgatttcatccgcgccatggccgccggcgaagcgctggcgatccgcaatccgaacgccattcgtccctggcagcatgtgcttgagccattggccggttaccttctgctggcggaaaaactgcatcaatccggcccaagcttctcttccgcctggaatttcggcccgcatgagcaagacgcgcgtccggtcgaatggatagccgcgcagctgacccagctgtgggggcaaggcagccgttaccaggtgcagcgcgaggccggagccgcgcatgaggcccactacctgaagctggattgctccaaggccaatcaagaactgggctggcgaccgcgctggtcgctgcgggaggccttgcagcgcatctgcgactggcacctgcagcaccgggcaggcgccgacatgcgcgcggtatgcctgcagcagatacgcgcttatcaagaaaccgtcatagccgaataa

SEQ ID NO: 4101 - DNA, 1317 bp, Chromobacterium substugae
atggaaaagactcaacagcttcgtcagcaaattgcccaactggtggccgaatacgcggaaatcgcgctcgcccccaagcccttcgagcccggcaagaccgtgattccgccgtccggcaaggtgatagacggcgccgagctgcagcacatggtcgaggcgtcgctggacggctggctgaccactggccgcttcaacacccaattcgaaaaacaactggcggaattcctgggcgtcaaacacctgctgaccaccaactccggctcctccgccaacctgctggcctttaccgcgctgacctccccgcagctgggcgagcgcgccatccgcaaaggcgatgaagtgataggcgtggccgccggcttccccaccaccgtcaaccccatcatccagttcggcgcagtgccggttctgatcgatgtagacatccccacctacaacatcgacgcggcgcgcatcgagtcggcgatcaccgacaaaaccaaggcgattatgctggcccacaccctgggcaacccatacaacctgcgagtggtgcgcgacatctgcaaccgccacggactatggctgatcgaggactgctgcgacgcgctgggctccacctacgacggccaactggtcggcaccttcggcgatatcggcacgctcagcttctatccggcgcatcacatcaccatgggcgaaggcggcgcggtcttcaccaacagcgaccaattgaagaaaatcgtggagtccttccgcgactggggccgcgactgctactgcgcgcccggctgcgacaacacctgcggcaagcgtttcaactggcagctcggctcgctgccgcacggctacgaccacaaatacacttacagccacctgggctacaacctgaagatcaccgacatgcaggccgcctgcgcgttggcgcagcttggcaagctcgaacagttcatcgccgcgcggcgcagcaacttcggctacctcagcgagcggctgaagacctgtgaggaattcctgatcctgcccaaggcgaccgagcgcgccaacccgtcgtggttcggcttcccgatcaccatccgccccggcagcggcatcgaacgggtggacgtgctgaagtacctggacgaacacaaggtcggcacccggctgctgttcgccggcaacctgacccgccagccctatatgcacgggcagaatttccgcgtgcacggcgaactcgtcaataccgacctgatcatgaacaacaccttctggatcggcgtgcacccaggcctgacccgcgacatgctcgactacgccgtcgagaagatcgaaaccatcattggcgtgaatttttaa

SEQ ID NO: 4102 - DNA, 1779 bp, Chromobacterium substugae
atggaaaagaccagactctctgtctacaccgcggcggtcagcgaaaacttctccttcctgaagcgggctgccaccattcaggaagcctacctgcgcgcgattccgatcgccggcggcggctacctgctgccggtatgcgaaatgcacaagcaggatgccgccctgatccggctcttgaccgaatggcgcaaccgcaatgtccaggcctatccgacccaattcatcgccactgagcaaagcacccgcgactggctggagcagcagctgctggccgtcaacgaccggatgctgttcctggtggtgagcgccaccggcgcgacgctgggccacctgggcttcacccgctgccataattccgacatgatgttcgagatcgacaatatggtgcgcggcgccgccgacgccgaagcgggcctgttctcccgcgcgctggccgcgttgatcgaatgggccaggaaaaccatcaacgtcaacggctttttcctgcgcgtgctggacgacaatcccgacgcgatcgccttctacaagaaaaaccatttcacggtcgaatccaatattccgctggtggcggtgaaaaacggcgacagcctccagtaccgcgaggcgctgccgacggaaaccgccagcaaacaattcgtccgcatggcgtacaaagccccgtcgcaaggggtgggcgagaagatgatcctcaccgcgggtccgtcgatctccgccaaggaggccgcctattcgttcgatgccgcgctcaacggctggaacagcgattggtcgaaatatctgactcgcttcgagaaaagcttcgccgaatatgtcggcgtcaaatacgcgctggccacctccagctgcaccggcgcgctgcagatcgcgctgatggcgttggacatcggccccggcgacgaagtgatcgtaccggaccagacctgggtcgccaccgccaacgccgtccgttataccggcgccatcccggtgttcgccgacatcgagctggacacctggaacatcgacgcccgttcggtggagtcgctgatcaccagcaagaccaaggccattgtcgccgtccacatgtatggccacccggcccgcatgagcgccatcctggcggtggcggagaaatacggcctgaaggtggtggaagacgccgcccccgcgatcggcgccgaatggcagggcaagcgttgcggcagcttcggctccttcgccgccttcagcttccaaggcgccaagctgatggtcaccggcgaaggcggcatgctggtcaccgatgacgacgcgctgtacgccaaggcttacaaggtttgggaccaagggcgcaacccgtcgcgcaccttctggatcgacgaggacggcgtcaagttcaagatgtccaatatccaggccgcgctcggcctgggccagctggagcgcgtcgacgaactgatcgagatgaagcgccgcattttcgagtggtaccaggaaggcctggaaggcgtgcctcatctcagcctcaaccgcgaagtggaaggcgcccgcagcatctactggatgagcagcatcctgctggacaaggacgcccgcatcagccgcgatcaattgatgcagcaattgaagtccagaaacgtcgacacccggccggtctttcccgccatcagccagtatccgatctggcccaggcagcagcaaccgcaacccaacgcgatgcatgtcggcctgcaggcgatcaatctgccaagcggcgtctgcttgagccgcgacgaagtggcttacgcctgcaagcagatcagaagcattctgctggggtaa

SEQ ID NO: 4103 - DNA, 813 bp, Chromobacterium substugae
atggaaaactcgatcacgctggcgcgcgccatccgcgccaccgccctgcaaatggtgcatgacgcgcgggcttcgcacatcggcagcgcgctgtcgatcgccgacatcctggcggtgctgtatcgcaatcatctgcgcttcgaccccgccgcgactcgggatccgctgcgcgaccgcttcattctcagcaaggggcacgcctgcgtcgcgctctacgccgcgttgggcgcgctgggcgcgctgagtccggaggagattgccagctacggccaggatttctcgccgctgatgaaccatatcagccacaaggtgaatggggtcgagttttccaccggttcgctcggccatggcctgccgttcgccgccggcaaggccatggccgccaagctgcgaggacagccttggaaaaactacgtgctgcttggcgacggcgaaatggacgaaggcagcaactgggaggcgctgatgttcgccgcccaccaccgcctggacaatctggtggccatcatcgactgcaacaatctgcaaagcttggacaccgtgcgcgcgacattgaatatcgagccgctggaccaaaagctggccgccttcggctgccgcgtattcgaggccgacggccacgaccaccaggcgctggaccaggccttgcttgccatcgccgaggtccgcggccaaccgtcggtattgatcgcgcgcaccgtcaagggaaaaggcgtcagcttcatggaaaacagcgtggactggcactaccgcagcccggacaaacagcagctgcggcaggcattggaagaactgggagtccagcatgcgtaa

SEQ ID NO: 4104 - DNA, 873 bp, Chromobacterium substugae
atgcgtaacgctttcatcgatgaactggtcaaactcgccgccgtccaccccgacatcgtgctgatggtaggcgacctgggatacggagtagtcgaaccgttcgccgagcggtttcccgaccgtttcatcaacgccggcatcgccgaacagaacatgatgggcatggcggcaggcatggcgtccgagggctgccacgtcttcacctacagcatcgccaacttcccgactttccgttgcgcggaacagatacgcaacgatgtcgactatcacaatttggcggtgaccgtggtcagcgtcggcggcggcctggcctacggcaacctcggctactcccatcatgcggtgcaggattacggcctgatgcggatgatgccgaacatgactatcgccgcccccggcgacccgatggaagtccgcgcctgcctgcgttacctggccagccaccccggcccgtcctacctgcgcctaggcaaggccggcgaaccctgcctgcacccgcaggtgccggatgtcgtccccggccaatggctgcccatcagacaacgcgacagcgccgccgccctgctcaccaccggagccgccgtcagcagcgccatcgaatggctggacacgcctgatttcgccgcccattcgctatacacgatgccgctgtggagcatggccgccaaacaaaagcagccgcagcagctgtccgactgggatctggtcgtcaccgtcgaagaccatatccacgacgccggcttcggcagctggctgatggaggcagccgcgccggccggcatgagcggcaagatacgcaaccgcgcgctgtcgactgagatattcggcaaggtcggcagccaaaaaaccctcaacaagctgggtgggctgtag

SEQ ID NO: 4105 - DNA, 1350 bp, Chromobacterium substugae
gtgatactggcactgaagaagacgctggggctggacagggcgatactgtatgtattgctcaaccgcggctggaccctgctggccggcttcgtcacgctctatctgatctccgccaccatgagcaaggcggaacagggctactactacaccttctccagcattctggcgctgcagatctttttcgagctgggcttcagcggcatcatcgcccaattcgccagccacgagatggccaagctccactggcgcggcggcgacatcgtcggcgactcccagtcccgccagcgcctgctgtcgctattccggctggcgatcaaatggtatggcgtgatttcgctgctcaccgttttcctgctcaataccgcgggcttctatttcttcagcagctccgccaggcagtccggcgtcgactggcaccttccctggatgctgctgacgctgggcgcgaccttgaacctgtttctcagcccgctgctggcgctgttcgaaggcagcggcctggtcgccaatgtcagcgcgctgcgcctgatgcaatcgatggtcgcctacagcagcggctggctgttgctgctcaatgacggcaagctgtataccgcggcggccatttccatcatgaccgccgccgtcgggttttactggctgggcaagcattacggcgcctttctcaaatccttgctgcaaaacctgcctggcaaagacgatgccggcatttgctggcggcgcgaaatctggccgatgcaatggcggatcgcgttgagctggctaagcggctacttcatctcccagttgttcacgccgctggccttccgctaccagggcaccgaagccgccggccagctcggcatgtcgctcagcatcgtcaccactatgtccaccgtcgccagcgcctggctaaccaccaagctgccaagcttcggcatgctgattgccggccgccaagccgctcaattgatggcgctgttccgcaagagcagcttgcagtccatcgctgtgctgctggcccaacacagcctgtttttcatcctgctgctggccatgcgccattaccagttcgccttcgccagccgcctgctggagcctatcgacatcttgtggctgctgctcgccgcccaagcctgccacatcgtgtttttgcaggccgcctatatccgcgcccacaagatcgagccctatcttaagcatgcgattctgttggcgctgctgatttccagttccagctattatttgattcagcattactcgatccgggaaatgctcgccctctacgccatcatttgcgggacggtaggcgttggatattccagctatatctatgcaagcttcaataaaagaaaaatggcggggcaatga

SEQ ID NO: 4106 - DNA, 903 bp, Chromobacterium substugae
ttgctggacgatctattgccggcaattgcgcgccatcatcaactcatcaacattttcatcatcgacaacgcctccaccgatcagacggcggcgttgtgcgatagctatatccaagccggccatgccttgaactacgtccgcaatgaaagcaatatcggcgcggatgccaatgcggttcgagcattcgaatgtgtaaacgggatatatggctggatactaggcgacgatgaatatgtctatggccaaaccgtcgacaccatcatcgccaccttgaccaaacagcctctggccttgctgtatctgaaaagcgagccctgcaccgccagcgccatcgcgcaaaaaaaaccgcgcagccaagccctgtcctattacatgtccaatgtggaattttcccgcaagatagggatttacttcacattcatctcggcaatcatattcaacaagcagcaagccatgcaggatgacgcgctttgcgcgaatatccgctatggcaccttcattccccagctggcctgggtgctgcctttgttgaaacagggcaagcatttcgccagcagccaggcctgcctgatcgcggccgaacccaacaacaccaccggctacaagctgttcgaggttttcggcatcaacctgcgcgccttggtggacgcgtttctgccggaccaaccccggctgagaaaagccatcctcagttcgtcgatgtggtttctggcaagctttttttatggcaaccgcggcaacttcaagcaggaaaacccaaaaccggcattcgaccaggcctttggagaattgcgcgtctaccgtttgatcgtccgccccttgctgacctaccagaacctcatgtccaagctatgcgtaaaaacgatctgccgttttagaaaaaacatactgcagcaagcatga

SEQ ID NO: 4107 - DNA, 1038 bp, Chromobacterium substugae
atgaagatactggtcatcaaactatcggcgttgggagatatcctcgccaccagccccttgtttcggctgatcaaggaggccaatcccggatgcgaaatccatcatctggtgatgcggcaatgcgcggccgcatccgaaagcaacccgcatatcgaccggcagatcgtcatcgatctgatcccgtccggcaatcgcctgaaggacgcccgaatcctgctgcggctatggtggcggctgctgaccggcggctacgacatcgccgtcatcctgcatcgcaacgctctgttccaactgttatgcaaagcggcgggcatcggcaaactggtgggcttcaccgcgccgcggctcgatctgctgcaacatgggcaggcgttcacgatgcagggcaaccgcacgctgcaagaagcccgcctgctgcagcgcgccggcctgatcgacaaaatgcccgatcgtctggagtttcatctggcccccggcaaagtggatcgggaaaagcttgccggcctgccgcgcgactacatcgcgatcaacccgggcggcggcaatccccatgcgccggccgacaacaagatctggccggccgacaactatatccggctgatacaggcgctggacctgccggtcgtattgctgggcagcggcggcaaggaccaggaaatctgcgcgtccatcgcccgcgcctgcggcacgcgcgccgtcaatctggtcaatcggctgaacctgcacgaagcggcgcaagccattcgccaatcgcggctctacataggcaatgacagcgccttgctgtacatcgccgccgcgctgaatgtgccgctgatcggcctgtacgggccgaccccggctgatgcttttctcccgctgggcggaccattgcatcatctcagcggcaaaaccgagtgctccccatgctacagctcgctggagggcgcgcgctcgcctatgtattcatgtgtgaacaatatttgcatgcaaggcatttccaccgaacaagtcctggccaaaaccagacagctcctgacccttggaaagcaggcctga

SEQ ID NO: 4108 - DNA, 1164 bp, Chromobacterium substugae
atgaaattacagacgctgaaattcctggacaagctgctatccaccacaatcgcctggctgccgcgccgccgcaagccatcgactcaagctcctcgccggatattgctgatcaaactatccgcgatgggcgacgcgttctgcctgcaccccgtcgcccgcaggctggccgcggcctttcccgccgccagcatcgactggctgacgaccggccgctccaatcctggcctattccggaatttgccgtttctgcacgacacgctgattgttcccacccaggtccgcgccttgctggcatggctgcccaggctgctcttcgcgatacgcaagtacgacatcgtgatggacttcgatcagtactaccatttatccgaactgctctcccgctgcggcaaaaccagcgcgggcttcagcaccgcgctgaaagggaaaacgttttccctctccatcccctatgatccgcagctcaatgaaaaagtcctgttccacaagcttgccgagcgcgtgatggagcattatggcgtgacccacgcgcctccccgcgacttttatctacccgaattgctggatgcgttcactccttcattgccgttgcagcaattggcagcggagatcaagacacaccaattgccggtggtggttctctacgccggctccagcgccaacgccgcattccggcgcctggacatagacaaatatctggccatcatcgagcagacccgcaaccgccataccttcgtgatcgccggcggaccggatgaactggcgctgaaaacgcatttccagcttcagcacccaaacgtgtacgaactgataggcagcttgaacctgctggagtgggcctggctgttccgccatgtcgccgacctgctgctgggcaacgacggcggcctgctgcacgtcgcggaaagccagtccacgccgatgctggccatcttcggccccagcctgttccgcaaatggggatcgatcaacccggaatcgcgcggcatcgaaaccgatctgccgtgcaggccatgtctgaaaaactatctcggcatcgttccgacccgctgccagttttccacggtcaaatgcctggacgccatcgaggtggccaccatcattgccaatatggaaagcatgctggaaaagaaacagcgccaacacatgctgatcagtccctga

SEQ ID NO: 4109 - DNA, 474 bp, Chromobacterium substugae
atgaacaaggtttacggcgttgaaaacatccacttgggcagcagggtatcgataggcgacttctgctggctggaggccgtcgagcgctatggcggccagcaattcgcgccccggctggaattgcgcgccgggaccagcttgtccgacgccgtccacatcagcgcggttgcccgcatcgtcatcggcgagaattgcctgctcggcagccgcatctacatcggcgaccattcgcatggcaccggccggctggacaccgcatcgctgcagaccccgccggggcagcgcccgctagccaacatcgccgaaatcgacatcggcgccaactgctggatctgcgacggcgccgtcatcctggccggcagccgcattcatccgggctccatcgtcgccgccaacgccgtcgtccgcttgcagaccgacgaagccgcgttgatcgccggcaacccggccaaagtcatacactatttcaggtaa

SEQ ID NO: 4110 - DNA, 1020 bp, Chromobacterium substugae
gtgcccgcctattcgcgccccgatgagctgggccaactgatcgattcggtcctgtccgccgatgtcctgcccgatgaattgctgatctgcgaagacaagtcgcctcgccgcgcggagatccgagccgtgattgaaagcatgcgcccgcgcttcgccgccggcgcctgcgcgctgacttacatcgaaaacgaggaaaacctcggctatgacggcaatatccgcaagatcatcacctcgtccgcttcggactacgtgctgatcctgggcgacgacgacgtcctgttcaaggaagccatccccaaaatacgcgcgttcgtgcagcagcatccgcaagcgaatttcatctcccgcaccttcagccgcttcgccgaacaaccgcaaaacatcatcaacaccacctggatacgcacgagcgattgcgtcatcaaacgcgacgacgccgatccgaacatcatcttccgcctatgcggcttcgtcggggggctggtgatcaatcgccgctgggcatcgcagctggcgacagaggaatacgacggctacctgtactaccagttctatcttgcctgcctcgcctacctgggcgatggcataggctatatctcggccgccatcgtcggcggccgcgccggcaatccgcctctgttcggctcggccgacagcgaaaaggacacccatattcccgggtcgtaccgccccaaaggccgcgccaaaatgtggcagggactgctggccatcgcggcggacatcgacaaggcccatggttcgaacatttatccctacatccgcaacgagctagccggcaggcaggcctaccacatattcgaaatgatgccggcgcaaggccgcgcggccaccctggacctgtttcacgagctccggagactgaagctgacccacaaggcgatgccgtggcttctaaccagctacattctggttttcggtccctacgcccgcatcggcttcgcccttagcagacgcctgcaattcgctatcgagcagcatgccggcctaaagctgtaa

SEQ ID NO: 4111 - DNA, 1086 bp, Chromobacterium substugae
atgagaaaaatcgcgttgttctacttctacttcgtcagcctgtactggtatccggtcaccgtcatgcaatggggcagctatggcgcagtggaagagagcactcccatatggttcaagctcctgcgcgtgatcctggtcgcgctgctgctgctattgctggccgcgcggccaagcatcagcaagaaaatcgcctttccgctgcttttcgcgctgtactgcatcttttccgcgccggatatcgtcacgatcaccaatgccatcaccttcatcgtctgcatcgccatctgcctgaaaatcgatatccgcgccgtcaattggagacgccatatcggcatagccagcggcatcggctacctgaccgctctgctcgagatattggggattgtcgtttcgcctcactcctacgacggcaccttgcgcatcgtcgcgactttcggcggacccaataacgccgcgatcatcttatccggttttgcgctgtaccatttcatgcagctgcggaaaacccgcagcatcgccgatttactccacttcctggcctgctcggtgctggtgctgctcaccgggtcactgagcgcactgatcgctttcctgctttgcatgatttcgctgtcgccgcgactgttgctattggtgccgcccgccgcgatcgccgcgaacttcatcagcgacttcatctcgttcaaagtcgagcagttcgccaatctattcagcaataactcgcaaaccatcggcaccttcagcgaccgcctcgaaaacatccagctgatatggcgctctttcaatgcatcgcttggcaatgcgctgttcggcaccacgctgacttcggaaagcgactatttgaatattatttcgcaacacggtttatttggattggctctttttctgctagccatcctggcactgggtatcgatatctttttggcgctgggactattgcagggcatcttcacccccttcttgtttccatttcctagttttgccattctgtttctactcagcaaaatataccaaactgaaaaggaagcgaaacctacgcttattgctaaaaaatctgagcaaaacagttccgttcagcccatataa

SEQ ID NO: 4112 - DNA, 1128 bp, Chromobacterium substugae
atgaataaaaaaattatttatttcgtcacagttgattggtttttttgttcacattttcttgctagagcagtcgccgcaaaagcacaagggtatgaagtctatgtactgaccaatattgacaaacataaagacaaaatattggctgcaggattaaatattattgatataaagactgatagaaagactttaaatccattttcgtggctacaaaccttattaaaagtttaccaagtctatcgcactgtaaaaccagacatcgttcatcacatagcgctgaaaccaattttactaggcagcttggctgccagaatgtccagtactagaaatgtaatcaacgccattgtaggcggtggctatgcattcatctcaaatgatatatcgatgagaatgctccgccccattattcgttttacattgggcaagttgcttaatcccgctggcagtaaagtagtatttgaaaataccgatgatttagatacgtttacaaaatctggtcaagtgcgtagagactgtgccgtcttgattcgtggtgcaggtgtggatccaaatcttttccataccaaccgaacaaagccctctaagcctatcgttcttcttaccgctaggcttctctgggataaaggcattggagagtttgttgaagctgcccgcttgctgcgacagcgcaacatcaacgcgcgctttgtcatcgttggcggccaagatccaggaaatcgtgcatctatcgaccaagagactttatcaagctggcaccaggaaggagccgtagaactttggggatttagcgaagacattccgaatattctggctcaatccagcatcatgtgcctgccgtcctatcgagaaggcttaccaaaatctttaatagaagcaatggcagcaaagttgccatgcgtaacaacggatgtgccgggatgtcgtgaagctgtcaggcataatgacaatggtcttttggttcctccaaaaaatattgccgctttagcaaaggccattgaaaccttgctgctaaaccatgaattaagccataaaatggggctacgtggatacgaacggctagtaactgaattttcttcggaaatagttatcaaagacaccatatgtctatataaagaattgctagaactatga

SEQ ID NO: 4113 - DNA, 117 bp, Chromobacterium substugae
ttgagtaatgtgctgctgtacaaagtcaaatttatcaattcgattgaggcaaagatatttaaacgctttgtgcagaactggcgatttccctatcgcctcattaccgttattatttaa

SEQ ID NO: 4114 - DNA, 1233 bp, Chromobacterium substugae
ttgaaattacttgtcaaaaatttttccgcgcaaggtctaaataccttacttggcctagtatttactattgctggcgcacgtttgatgagcttggctgattatggcgaacttcgctatatgatgacattacttccattactgatggcttgtactctgccaggattcgattcgatcatacttagaaaagccaacctgcgtgagcaggttccattgcggaatatattctatatccgcttggttacaggttgcgtcggtgcactgagtgtttccgttgcactgtacttcttttcgcctgcactcagtgcgtcattgaaatttctcctcctcattaccgccctacttttgcctttctttgaaactgcaacaggatataaaaactacttgataggcattggactacgtaatcaaagcttgaacctagtatttttttctaggcttactagcatgttgctgttcctcttgctaggactattgatttactcccattaccttagtcctctgtggatctatccatcctacttgcttgctattatattgcctactatctggactttttccctgatcgctcggaaaatccgacatgcggagaatttcttcccgataaaatggcacgcactcattttaccagcagctgtctcaaccatagctagtttaacgtacacatacgcttattcgatggataagctctggatacgtaatttatccggcgcgcaagccttggccatatattctattttggttatggttcctcaggagctggcgaaattatgcgatgcctcttttcctttgtactataaacgcttattttttgatcacaatactgaaaagaggaaaatccatagaagccgcacactatttttcttgctggcggcaatcattgtattatttctttacgcaagcgctttcgaagttttttcaccatggatattcggggaaaagtatagttacccattttatttatgcttattatccgggatgttgatatttgggcaagcctttgaatactttaatagccataaaatttttgcccatcatggatctcgtggccaatttatttacacattgcttaacttggctctatgttctattttcatcccgattggtataaagcttggcggtctaagtggccttctgcttgctttgctcttcaagcaattgctactccctattttttactactctggggtatctattacctcgaagttgcatttcgacagtcgaaaatttttctaa

SEQ ID NO: 4115 - DNA, 855 bp, Chromobacterium substugae
atgagtttgttattccgcagcatcagcgtcttcggtcgcttccccttcgtaagactcatacaagtaatcgacaacccgcgctatctgttgcacataattaaaaaaaacttaatttataaaagatccaagattgactacaccgataaatattcagcattcacttttatgagtgggcaagaatcacttgaggacttgataaaaaataagaaaagtttagcacgtttcagcgatggtgaatttgaacagattgtcggcgctggtgagtacccccctgattctgactggtgtcaaaaatggtccaagccattaattgatgacatgctgaaaaccctttcctctgaggatgatcgcttacttgttgccgtagacccaccatcgacattccttgggacgcgggattcaactcacagcattcgctttgaatacaatatgtgggtagatatgcgccggctgatgtggacattcctctgcccgggaaggtcatatggccatagccatttattcatagaggccaactccccagactttaattgggcgcaatttaaagaccatttacgcgaaaaacatgtcattgttgccacaggaaataccgacaaaataagcgatcttaacttagggttaaaaacatacttcgtagagtgcggcacagaaaatgcctacgagcgaaaatctatcataaaagataatatatcgaatcttatcaagaacaatgggcttgataaaaataatgtacttgttttattgagcctaggacccactgctggtattttggcgcgtgaatttattgatgatgacatttgtgcttgggataccggtcatatgtttaaatttgcagctaaaaaattttctgcgtga

SEQ ID NO: 4116 - DNA, 882 bp, Chromobacterium substugae
atgtcttggggaaagggctacgattatgtgctcaacttatcggcattgaagcatgtccgtagcgaaaaagacccattcaccttgatgaggctgataaaggtcaatatcctcaatactatcagcacgttgaaacatgctaaaaatagtggcgccaaaaaatatttctgcgtgtccaccgataaggccgctaacccagtcaatatgatgggggccagcaagcgcatcatggaaaaatttttgatgcgcgagagccttgacctagctatttctaccgcccgctttgccaatgtagcattttcggatgggtcgctactgcacggattcaatcagcgctttacaaaacgccagcctatttctgcacctagcgatattcagcgatatttcgtcacgccgcaagaatctggggagctttgcttgatgtcttgcttgctaggtcaaaaccgggagattttctttcccaaaccaagtcatgatcttcagctgactagtttttctgatatcgcaagccgatatctggagcagctgggatacaccccctacccatgcagctcggaagaagaagccagagagaaagcctccgcgctaattgctgacaagaaatggccctgctactttttctctagcgatacgaccggagaaaagagttatgaagaatttttcactgaaagagaaattctcgacatggcacgattccaaaacattgggattattaaaaatgaccccgctttcgatgagcaggcactgaattcattcctggatggtatccagaaattgaatcaaaacggccgctgggaaaaaattgaaatcgtatcgctttttgaagcaatcctgcctgagttttcacacttggagactgggaaatatctggacggaagaatgtaa

SEQ ID NO: 4117 - DNA, 666 bp, Chromobacterium substugae
atgcagcgtttttttgacatatttttttcagcaatagcattgctgattttatctcccttgctgatacccatcatgatcgctttgcggctgacaggcgaaggtgagattttttacaagcaaaaccgaataggtcacggcgggaaaagctttggcctgttgaagtttgcaaccatgttgaagaatagccctaatataggttcaggcaatataactctcaagaatgatccgagagtgctgccgatggggaattttctcagaaaaacaaaaatcaatgaactgcctcaactaattaatattttgactggagacatgagtgttatcggccctcgccctttgactaaagataattttgatatttaccctgtgtcggtaaaatccgccttatataaaatacggccaggtctttcaggaattggttcaatcgtgttccgagctgaagaaaacatgctggacaatcgagaagatccacgggattactactgtaaattcatcgctccttacaaaggcgagctggaacgctggtataccgagaaaaagaatgggattttatactttactttgattttccttaccgtgtgggtcgtattatttccgaattcaaagataatctggaaaaccttcccagacttgcctttaccaccgcaagagctgaaagagtttatttaa

SEQ ID NO: 4118 - DNA, 1419 bp, Chromobacterium substugae
atgtccgatgtattccagttcatgaagttgtcgcgcaatcccggcgacaaggttgaagcatccgtgcgcaagattgaattcaaggaaatctaccagccgctgcacgctgtggacgccgccgaccaggccggccgctgcctgtcttgcggcaacccctattgcgaatgggaatgcccggtgcacaactacatccccaactggctgaaactggtggaggagggccgcttgttcgaggcggcggagttgtcgcaccagaccaacagcctgccggagatctgcggccgcgtctgcccgcaagaccgtttgtgcgaaggcgcctgtacgctgaaccagggcggtttcggcgcggtgtcgatcggcagcatcgaaaagtacatcaccgacgaggcgttcaaggccggctggcggccggacatgtccagggtggtatggaccgacaagacggtggcggtgataggcgccgggccggccggcctggcctgcgccgatgtgttggcgcgcaacggcgtgaagccggtggtgtacgaccgctatgaagagatcggcggcctgctgacattcggcatcccggaattcaagctggagaaggacgtggtccgccgccggcgcgagatactggagggcatgggcgtgcgcttcgtgctcaataccgaagtcggcaaggatatttccatcgacaagctgctcaagcagcacgacgcggttttcatgggcatgggtgcctaccagtacatgaagggcggtttccagggcgaagacagtccgggggtgctggaggccttgccttacttgatcaataacgtgcggcagaatctgggcacgctgcccaagggcgaggcgccgctgtccatgcgcggcaagcgggtgatggtgctgggcggcggcgataccgcgatggactgcaaccgcaccgcgatccgccagggcgccaagcgcgtgatctgcgcttaccgccgcgatgaggccaatatgcccggctccaagcgcgaagtcgccaacgccagggaggagggggtggagtttctgtggaaccgccagcccatcgccatcgaaccgatgataggcggcacgttggcggtcaagctagcggagacgcgcctgggcgcgccagatgccaaggggcggcgaaaggcggaggtcattcccggctcggaagaagtggtggagtgcgatcatgtgctgattgcttttggctttcaggcttccgcggcgccatggttctccagccaggggatcgaggtggatggcagcggacggacgatggtgtcgtcgcgagtagccaagggcttcaaatatcagacagccaaccccaaaattttcgctggcggcgatatggtaagaggcgcggacttggtggtgagagcggtgttcgaaggcagggaggctgctgagggcatcttggccagttttgaaaagtga

SEQ ID NO: 4119 - DNA, 4449 bp, Chromobacterium substugae
atggacagacagagccgcctgcaaggcacattgtataaaccggagttcgagcaggacagctgcggcttcggcctgatcgcccaactggacgacaagcccagccactggctggtggccaccgccatttcctcgctggccaagctgacccaccgcggcgcggtggccgcggacggcaagtctggcgacggctgcggcctgctgttcaagaaaccggacggctttttgcgcgaggtggccctggaggccggcatcgcgctgaagtcagtgtacgccgcgggcctggtgttccaccacccggagcgggcgctgggcgaacgcagcctggcgcgtctgcgcgaacagctggaagctcagcaactggaagtggccggtttccgcgtggtgcccaccgacgtgagcgcctgcggcgaggcggcgctggcgtcgctgccggccatcgtccaggtgttcgtgaactgtccgttcggcatggacgagctggctttccagcgtcggctctacatgggccgccggctggcggagaaggccaaccgccaggacgacccgcatttctatctgcccacgctgtcgccgcataccatctcctataaaggcttggtgacgccggatcacctggcagtgtttttccccgatctcgccgacccgcgcttcgagtccagcctggcggtgttccaccagcgcttctccaccaacacctggccgcaatggaagctggcgcagccgttccgcttcctcgcccacaacggcgagatcaacaccgtgcagggcaaccgcaactgggcgcgcgcgcgcgagcgcatcatggcttcgccgcatctggacatggacgcggtgcggcccatcgtccagaccgacggttcggactcgatgagcctggacaatatgctggaaggcttgctgatgggcggcatcccgctgttccgcgccttgcgcctgttggtgccgccggcctggcagaacgtcgatagcaccgacaaggacctgcgcgccttctacgaattcaactcgatgcatatggagccctgggacggtccggctggcatcgtgctgaccgacggccgctacgccgcctgcatgctggaccgcaacggcctgcgcccggcgcgctgggtgctgaccaaggacaatattctcaccatcgcctccgaagtgggcgtgtgggactaccgcgcgcaggacgtggtgaagaagggccgggtcaagccgggccaactgttcggcgccgacctggccaacggcgaattgctgctgccggaagagatagacgcccagctgaaaagcgccaaaccctatcggcagtggatcaaggacagcgccaagtacctggagctgtcgatagaggacgacgccggcgtcgagccgctgtccaaggatgagttggcgcggctgcagaagatgttcaacttcagccgcgaggagcgcgaccagatcctgcgcgtgctggccgaggacggccaggaggcggtgggctcgatgggcgacgacacgccgatggcggtgctgagccagaaggcccgctcgccgttcgattacctgcgccagcagttcgctcaggtgaccaacccgcctatcgacccgatccgcgaggcggtggtgatgtcgctgaacacggtgttcggtccggaacgcaatatgttcgaggagagcgccgaacacgcgaagcggctggaggtgcgcagcccggtgctcagccacgagaaattcacccgcgtcaccacccggccggagagctatctgaaggccaccaatttcgacctgtgctacgacccgggcgagaccacgctgcgcgaggcgctttgctgtctgacccggcacgtggtggaggcggtgcaggagggcacggtggtggtggtgctgtccgaccgccacgccaccggccagcgcctgcccatccacgccttgttcgccaccggcgcggtccaccacgccttgattgacgccggcctgcgctgcaagaccaatatcgtggtggaaaccgcggcggtgcgcgacgcgcaccagatggcctgcgtgctgggctacggcgccaccgcggtctacccctacctggcctaccaaagcatcatcgacctggtgaacagcggcgaggtggcgctgaaggccaacgaggcgctgcagcactaccgcaagggcatcaacaagggcctgctcaaggtgctgtccaaaatgggcatctccaccatcgcctcctaccgcggcgcgcagctgttcgaggcggtgggcattcacgaggacgtggtcgcgcagtgcctgaagggcacggtgtcgcgggtgtccggcgccaatttcgaagacttcgaggccgaccagaagcaactggcgcggctggctttcaatccgatgcgcggcatcgcccaaggcggcctgctcaagtacgtgcacggcgaggaataccacgcctacaaccccgacgtggtgcagctgctgcaaaaggcggtgcagaacgacgactacgacgcctacctgcaatacgccgaaacggtgaacacccgcccggtggcgatgctgcgcgacctgatgagcctgaagctggccgagcaagcgctggagatcgacgcggtggagccggtggaggccatcgtcaagcgcttcgattcggccggcatgtcgctgggagcgctgagcccggaagcgcacgaggcgctggccatcgcgatgaaccggctgggcggccgctccaattccggcgagggcggcgaggacgcggcgcgctatggcaccgagaagatgtccaagatcaagcaggtggcgtccgggcgcttcggcgtcacaccgcactatctggtcaacgccgaggtgctgcagatcaaggtggcgcagggcgccaagccgggcgagggcggccagttgcccggcgacaaggtgtccggcctgatcgcgcggctgcgccatgccaaggagggcgtcagcctgatctcgccgccgccgcaccacgacatctattccatcgaagacctggcgcagctgattttcgacctgaagcaggtgaacccgacggcgctggtgtcggtgaagctggtggccgagccgggggtcggcaccgtcgccgccggcgtggccaaggcctatgccgacttgatcaccatctccggctacgacggcggcaccggcgcctcgccgctgacttcggtcaagtacgccggctcgccgtgggagctgggcctgtccgaggcgcagcaggtgctgcgcgccaacggcctgcgcggccgggtgcgggtgcagaccgacggcggcctgaaaaccggcctggatgtcgtcaaggccgccatcctgggcgccgagagcttcggcttcggcaccgggccgatggtggcgctgggctgcaaatacctgcgcatctgccacctgaacaactgcgccaccggcgtggcgacacaggaagtcaagctgcgctccaagtacttcaccggcttgccggacatggtggtcaactacttcctgttcatcgcgcgcgaaacccgcgagtggatggccaagctgggcgtgcgctccatggaggagttgatcggccgcatggatctgctggaattgctggagggcgagagcgacaagcagcacaagctggacctgcgtccgctgctgtcgcaaggcacggtgccggacagcgagccgcgcttctgcgtggcggacagcaacccgtcgttcgacaagggcgaactggccgagcagatcctgcaagacgcgctgccggccatccgcaacaggcagatgctggagctggaatacccgatcgaaaacacccaccgctcgataggcgcgcggctgtccggcgagatcgcccgcgtccacggcgcggccggcttgccgttcggctgtctgaaagtgaaattcaccggcagcgccggccagagcttcggcgtgtggaacgcggccggcctgcacctggagctggagggagacgccaacgattacgtaggcaagggcatggccggcggccgcgtcaccatctatccgcccaaggatgccggctacaaggccagcgaatccatcatcatcggcaatacctgcctgtacggcgccaccggcggccagctgttcgccgccggcatcgccggcgaacgcttcggcgtgcgcaactccggcgccttggcggtgatcgagggcgccggcgaccactgctgcgaatacatgaccggcggcacggtcgtggtgctgggcgaaaccggctacaacttcggcgcggggatgaccggcggcttcgccttcgtctacgacccgggcgagaagttcgcttaccgctacaacaacgagctgatcgacatccacttgatcaatggcgaggcgatgggcatgtatcgcgccttcctgctggagaagatcgccaagcacgtggaactgaccggctcggaaaccggccgcgcgatgctgcagaacttcgacgactacgtcgactacttctggctggtgaagcccaaggccgccaagctggaaagcctgctgaaagactaa

SEQ ID NO: 4120 - DNA, 1623 bp, Chromobacterium substugae
gtgaattttcaaaaaaacgacagtcaatcaggtctgaaagcagatacaaactggtatttttcgcaatattttgtattttgtcagacaaaattcgaaaataaaatgaaccacgacgacgcctccgcatccacgctgcaattcgtccgccaactggccgaacaggccttgtcccgctccgccggcgcgccgctgatcggcggaaaccaggtggatttgctgtacgacagcgccgacaacttcccggcctgggaaaacgccatcgccgccagccaggattcggtgttcatcgaaatgtatattttcgccaatgaccaatttggcggaaaaatcagaaatatcctgatagataaagccaagcaaggcatccaaatttgcctgctctacgactggctgggcagctggcgcgcgcatctgtcgagttttttcaagcccttgcacgaagccggcgccgaggtgcgcgcctatcatccgcccagcctgggcggcggactgagcctcctgggacgcaaccaccgcaagatgatcatcgtcgaccgccggctgctgttcgtgtccggcctgtgcatcagcgacagctggcgcggccggccggacaaggggctggctccctggcgcgacaccggcctggcgctgcgcggccctttgctcgcgccggcgctggccgccttcgccgacagctgggccagctgcggcgccgcgctggacaaccgctggctgcaaccgctggcggtgaaagccgaaggcggcgcggcggcggcgcggctgatcgccaccacgccgtccaccgccaagatgatgcggctggacctgctggtcgccagcttcgcccgccgcacgctgtggctgaccgacgcctacttcatggccaccagcctgtatctgtcggcgctgaagcaggcggcgcgcgacggcgtcgacgtgcgcctcttggtgccgcgctccagcgacatccgctggatcgccgccgtttcgcgcacccagtaccgaccgctgctggaagccggggtgcgggtgttcgaatggaacgggccgatgatccacgccaagaccgccgtcgccgacggccgctgggcgcgcatcggctccaccaacctcaatctgtccagctggctggtcaaccgcgagctggacatcgcgctggaagacgagggcttggccggcgagctggcggagcgcttcctgcgggatctggagcaatccaccgaaatcgtgctgcgccaggagcgccgccggccggtgccgcggccggtgggcaagccggaaaaacgcccccgcggcacgcccaaggagatggcgctcagcggcgccagcgccgccgcccgccaggcgatacgcatcggcgacgcgctgggcgcggtggtgcacggcagccgcatggtggaaagcagcgaggcgccggccttcctcagcataggcttggccttgtgcctgctggcgctggcgataggttatttcccttggctggcggccgcgccgctcaccctgctgctgggcataggcggcctgggggtggtattccgcgccatcggcctgtacctggccaagcggagaaaaaaacaacagtccgcgccgcgcgccggcacagatcaaacgcaatcgccgccgccgcccgactgccaatga

SEQ ID NO: 4121 - DNA, 117 bp, Chromobacterium substugae
atgaaaacagccgcttacccgaccagaggatcgccgcggcgggcagccgccccgcttcggcaagcggctaattggtcacaccccgaagttttttgcgcatccggccatgctgcataa

SEQ ID NO: 4122 - DNA, 2259 bp, Chromobacterium substugae
atgcgttttcatttccccatcgtgatcatcgacgaggatttccgctcggaaaacaccagcggctccggcatccgcgaactggccgccgccatggaggcggaaggcatgagcgtgatcggctacaccagctacggcgacctcacctctttcgcccagcagcaaagccgcgccgccggcttcatcctgtcgatagacgatgaagaattccagaccgaggactcggcccaagagtcgctgggcaatctgtacggcttcgtcgccgagatccgccgccgcaacccggacatcccggtctacctgtacggcgaaacccgcaccgcgcgccacatccccaacgacatcctgcgcgagctgcacggcttcatccacatgcacgaggacacgccggagttcgtcgcccgccacatcatccgcgaagccaagagctacctggacaacctggcgccgccgttcttccgcgcgctggtcgactacgcgcatgacggctcctactcctggcactgccccggccactccggcggcgtcgccttcctgaagagcccggtcggccagatgttccaccagttcttcggcgaaaacatgctgcgcgccgacgtctgcaacgcggtggacgagctgggccagctgctggaccacaccggcccgatcgcggcctccgagcgcaacgccgcccgcatcttcaacgccgaccacctgttcttcgtcaccaacggcacctcgacctcgaacaagatcgtctggcacagctgcgtcgccgccggcgacatcgtgctggtggaccgcaactgccacaagtccaatctgcacgccatcatcatgaccggcgccatcccggtgttcctgatgccgacgcgcaaccactacggcatcatcggcccgattccgaagtccgaattccagccggacaccatcaagaagaagatcctggccaacccgttcgcgcgcgagatgctggaaaagcaccccaaccgcaagccgcgcatcctgacgctgacccaatccacctacgacggcatcctctacaacgtcgaggagatcaagggcctgctggacggcgaggtggacaccctgcacttcgacgaagcctggctgccgcacgcctgcttccatgacttctaccgcgacttccacgccatcggcgaaggccgtccgcgctgcgaagacagcctggtgttctccacccaatccacccacaagctgttggccggcatcagccaggcctcgcaaatcctggtgcaggacccgcagaaccgccagctggacaccgcctggttcaacgaggcttacctgatgcacacctcgaccagcccgcaatactcgatcatcgccagctgcgacgtggcggccgcgatgatggagcagccgggcggccagtcgctggtggaagagtcgctggtggaggcgatggaattccgccgcgcgatgcgcaaggtggacgaggaatacggccgcgattggtggttcagcgtatggggcccggacaacctgtccgacgacggcatctgcgaccagaccgactggacgctgcgcccgaacgagcgctggcacggcttcgccggcatcgaggacggcttcaacatgctggacccgatcaaggccaccgtgctgaccccgggcctggacgtggacggcagcttcgaggaaatgggcatcccggccgccatcgtcaccaagtacctgaccgagcacggcgtggtggtggaaaagactggcctgtacagcttcttcatcatgttcaccatcggcatcaccaaaggccgctggaacacgctgatctcgctgctgcagcagttcaaggacgatttcgacaagaaccagccgatgtggcgcgtgatgccggagttcatcgccaaatacccgcaatacgagcgtgtcggcttgcaagacctgtgccagcgcatccacggcttgtacgccaagcacgacgtggcgcggctgaccaccgacatctacctgtccgacatggagccggcgatgcgcccggccgacgccttcgccaagatggcgcaccgcgagatcgaacgggtgccggtggaccagttggaaggccgcgtcaccgcggtgctgctgactccgtatccgccgggcatcccgctactgatcccgggcgagcgcttcaacaagaccatcgtcgactacctgcgcttcgcccaggccttcaaccgcgagctgccgggcttcgaaaccgacgtccacggcctggtggcggtggaagtgcaagaccgcaaggtttactgcgtcgactgcgtcaagcaataa

SEQ ID NO: 4123 - DNA, 924 bp, Chromobacterium substugae
atgaagcctgccgatgaagaccaagacatcgccgcccgcctgctgtcgttgcagctggacagcccgttgctgatcgccctgttcgacgaacgcgatggcctgcgttacgccaatccggccttctgcgccgcgctggatgtggcgccggacgagcgcatttgctgggtggagctgatgcggcgcaattaccgcaacggccgcggcaccttgatccagacccgggacttcgaagcttggctcgcttcggcgaaatcgcggcgcgccaagctgccgtttcgcgccttcgagaccgacctggccgacggccgctggatctggatgaccgaaaccacccagccgggcggctggatgctgtgcgtcggcagcgatatcaccgacctgcgcgtcggcgagcgtgagctgaggcaggcgcgcgacctggcgcagcgcgcggcgctgaccgaccctttgaccggcctgggcaaccgcggccacatcctgcagcaactggaaggcatgctggcgcagtttggccatggcgcctgccaagcggcagccattgccatcctggacctggaccatttcaaattgatcaacgacgtgcagggccatctggccggcgacgcggtgctgcgcgatttcgcgcaccggctgcagccgctgctgaagccgcacgacagcctgggcaggctcggcggcgaggagtttctgctgctggccccgggcagcggcctggagcaggcggaggcgctgctgcaggcgatcttgatcgaggtgcaggcctcgcggccgttggccgaggcgccggcctttacctatacctgttcggccggcatgaccctgctgcgcggcggcgacgacctgatggcggcgctggccagggccgacgaggcgctgtaccaggccaaggccggcggccgcaacacctggcgcgtgcggctgtag

SEQ ID NO: 4124 - DNA, 651 bp, Chromobacterium substugae
atggaagaaatcgaacggcgcgagccggcgctgacgccgcaggacaaggcgaagcgggcattgctggccgccgccacggctggctacgccggtttcagctgctggcaacgcgatttctacgtgcccggcaaacatgggcctggcgtgcatctgcatggctgggccagctatatgctggaggcggccttgctgatcgccgcgctgctcttgctgctgcccttggcgacgcggcggccgttgagtaccctggcttggggtttgttcctgtacgggctgttcggcggtttgctgctgcaaggcttgtccggcaatggcgcttacggcgtcaaggcgctgctgctggtcctggctctgttgccgggcgcgctggccgtgttgctgggtcggctgccgacgattgaggcgtatcgcgacacgcgcaaacgggtagggcagcagtcgcagtcggcgcagacgccgctgccggcggcgttgggatggctggctgcggcgttgctgggcctgcttggcctgatattgacgctggcggcgctgctgctgttgctgggagggacattcgtcgcagccgcggtgctgctgctgatcggcgccgcgacgctggcgtggacctacttcatcatccagcgcttgcgcgccggcgcgcgccgttag

SEQ ID NO: 4125 - DNA, 735 bp, Chromobacterium substugae
atgccggaaatggcgatgcgtttcaaaccgtatgctcacggttgttcgactcctgacgatgtcggtatgatgaatgccttcgtgaccgattgcggagcctcgcccatgcccaccttgtccaccctgctgctattctccctcgcctgtctcgcgttggccgccacgccaggccccgacatgctgctgatcgccagccgcagcgccggccaggggctgcgcgccggcttcgccacgctgttcggcattcagctcggcacctattgccacgccctgttggcggcgctgggcctggcccagctgttcatgctggtgccgatggcctatgacgcggtgcgcatcgccggcgccgcctatttgctgtacctggcctggaccaccttgaagagcaagagcgtgctgcgcgcggccggctccgccgaacccggccggccgctggcgcgcatcgcgctgcaggggctgaccaccaatctgctcaatcccaagatggcgctgttcgtgctggcgctgtttccgcagttcgtgcagccgcaggccggcccggtggcgctgcagatcatgctgttggccacggtgctgaacgcggtgggttttgccgtcaacgcgctggtgatcgtcgccagcagcaggatgggcagggccttgtcgggccagggcgcggggcgctggccgcaatacctgctggcgacggtgttcggcgggttggcgctgcgcttgctggcggccggccagcgttga

SEQ ID NO: 4126 - DNA, 555 bp, Chromobacterium substugae
atggactttcccacgcttcgcaccgaacgcctgacgctgcgcgagatcacgcagcgcgacgcgcccgcgctgctggccatccacggcgacgccgatgcgatgcgctggtacggcaccgacccgatttccagcctggagcaagcgcgcgcgatggtggagacattcgccggctggagaagcttgcccgcgcccggcgtgcgctggggactggcgcgccgggaggatgacgcgctgatcggcagcctcggcctgttcaaatggaaccggggctggcgcagctgcacgctgggctacgaactggcgcgcgcctgccaagggcagggcctaatgggcgaggcgctgcgcgccgcgctggcctggggcttcgagcatatggagctgaaccggatcgaggctcaggtgcaccccgacaaccaggcctcgctcacgctgctggaacggcttgatttcaaggtggaaggccgcgcgcgccaggccggcttctggctgggccgccatcaggacttgatcacacactcgctgttgcgagaggacagcgcgctggccaccgcgtaa

SEQ ID NO: 4127 - DNA, 792 bp, Chromobacterium substugae
atgaatgccgaactggaagccgagatccaacaaaaatacaccaccgaaaccatactcgacatgcggcgctggaccgacaagctgatcagcttccgcctgacgcggccggccggcttccgcttcgcggccggccagttcgcccggctcggcctgccgctggcgaacggcggccaggtgtggcgcgcgtattcgatgtgttcggcggtgtacgacgagcatctggagttctactccatcgtggtggaggccggccagttcagccccttgctggccaagctcgcgcccggcggccaggtgatgctggacaagaaggcgctcggcttcttccaggaggacaggctgccggccggccgcgacctgtggctgctggccaccggcaccggcatcgcgccctatctgtcgatattgcgccagccggacgcctggcagcgtttcgagcgcatcatcctgtcgcactgcgtgcgcgatgccgcggagttgtcgttccagcgcgaaatcgccgaactgcgcgagcacccgctgtggcgcgagcacggccacaagctgcactacctgccggtggtgacccgggacgcgccggcggacatgctggacgcccgctacccgcaattgctggccgacggccggctggcgcggcgggccggggtggagatgtcgccggagcatagccgcttcatgctgtgcggcaatccgcagatggtggaggacacccaccgccagttgatgaaaatgggctaccggatgacccggcagaacgcgccgggccacatcgtgctggaaaacggctggtag

SEQ ID NO: 4128 - DNA, 405 bp, Chromobacterium substugae
atggatgttgcagccaccagtgtactgattttcctgcgcgacgatagccaatgctggtggcagcgccgcgcctgggacgacgacagccatccggggcggctggatttcgccgctggaggcggcatcgaggctggcgagacgccggcggcggccgcggcccgcgaattggaggaggaactgggcatcgcggacctgccgctcaggcctttggggcggatgaagctggacggagaagtctgcgaattgttcgacgcgccgctgccggcgcgctggcgtctcggcccggaggtggcggcgctgctgcccttgccgctggcggccttgacggcgctggcggcggacgagctgcatccgcagctggcggactggcttggcagacaggagccggcggcgcataattgttga

SEQ ID NO: 4129 - DNA, 936 bp, Chromobacterium substugae
atgcccatcgccatcgccctgcacggcggcgcaggaaccctgcgccgcagcgaaatggacgccgccgccgaacaagcttaccgcgccggcctagcccgcgcgctggaggccggccatgcggtattgcgcgccggcggcagcgcgctcgacgcggtgtgcgccagcgtctgcgcgctggaggacgatccgctgttcaacgccggccgcggctcggtgtacacgctggacggcaagcaggaaatggaggctgcggtgatggacggcagccgccaggatgccggcagcgtcaccggccttggctgcgtgcaaaacccggtgctgctggcgcgcgcggtgatggagcgcagcccccatgtgacgctgggcttcgccgccgccgaagacttcgcccgccgggaaggtttggacatgcggccgccggaatacttccacaccgacaagcgctggcaagcgctgctgctggagaaagagcggctggccagcggcggcaaggacgaggacattcccgaagaccgcaaacacggcacggtgggcgcggtggcgctggatgaccagggccgcctggccgccgccacctccaccggcggccgcaccgccaagtggccgggccgcatcggcgacacgccggtgataggcgccggcacctgggccgacggcgactgcgcggtatcggccaccggccatggcgaatacttcgtccgcgccgccgccggccatgaaatctcggcccggatccgctatctgggggaaacgctggaacaagcctgcgccgcggtggtgcaagacgacctgccgcggctgggcggcaccggcggggtagtggcggtggacaagaacggccgggtggcgctgcccttcaattgcgaaggcatgtaccgcgccgccatcgacggccagggccgcgccacgctggccatctaccgcggggaaggctag

SEQ ID NO: 4130 - DNA, 1056 bp, Chromobacterium substugae
atgtcttcagcattctggcagaagtcgcagctcaagctgccggtgatacaggcgccgatggcgggcggcgcgaccacgccgcaattggtggcggcggtgtccggcgccggcggcctgggctttctggccggcgccatgctgtcgccggagcagatcggcgaggagacggcgcgcatccgcgccctgaccgaccggccgttcggcgtcaatctgttcgttcaggcccctccggcgccggcggtggccgagctggagccggcgctgaagctgctggcgccgtggcatgcggagctggggttggcgccgccatcggttccggccagtttctgccagccgttcgatcgccagttcgacgcgctgctggcgttgcggccggctttcgccagcttcactttcgacattctggacgccgcgcggatgcaggcgttgaagcaagccggcatccaggtgataggcaccgccaccaacctggccgaagggctggcctgggcgcagctgggcgcggacgcggtgtgcgcgcaagggcgcgaggcgggcggccaccgcggcaccttcatcgggccgcaggagcagtcgctgcggcctatgttgtcgctggtgtacgagctggcgcaaaacctgccggtgccggtgctggccgccggcggcatcatgaacggcaaggacatcgccggcgcgatgcgccacggcgcgcaagcctgcttgctgggcacggcttttctgcgttgcccggagtccggcatttccgcgccgtggaagcaggcgctggcggcggcgcagagcggggcgacccggctgacgcgcgctttttccggccggatggcgcgcgggctggacaaccgctacatggaagagatggccaagtcgcaggaccagttgccggcctatccggtgaccaacgcgctgaccggcccgctgcgcgccgccgcggtccaggccgggcgccgggacctgatgtcgctgtgggccggcgaaggcgtggccctggcgcgcgagctgccggcggcggaattggtcgcccagctgctggccgaatggcaggcggcttaccgctag

SEQ ID NO: 4131 - DNA, 1146 bp, Chromobacterium substugae
gtgaaattcgcgacccgcgccatccatgtcggctaccacagcgccgatcacaaccgggcggtcatgcctccgctgtaccagacatcggcgtttgcgtatgagcacatcggcgagagcatgccttatgtctacgcccgcagcggcaaccccacccgcagcgcgctggagagctgcctggccagcctggaggacgccaagcacggcctggctttctccagcggcatggcggcgatagacgcggtgttgcgggcctgcctgaaaccgggcgacgaggtggtggcggtggccgacctctacggcggcgcctaccggctgctgacgcggctgctggcgccggctggcgtcaaggtgaccttcgccgacctgcgcgagccggccgaactggaggccgccatcactgcgcagacgcgcctgctgtggctggagtcgccgaccaatccgctgctgggcatggttgacatcgcggccttgtcggccatcgcccatcgccatgatgtcaaggtggcggtggacaataccttcgccacgccttacctgcagcagccgctgtcgctcggcgccgacatcgtcgtgcattcggccaccaagtatctggccggccattccgacgtgctgctggggctggtggcggtcagcgacgacaagctctaccacgatatccgcttcgtgcagaacgccgccggcgcggtgccggggccgcaggactgcttcctgaccttgcgcggcatcaagacgctggccttgcggatggagagacactgcgacaatgcggaaaaagtggctgcctggctgtgcggccaggagcggatcgcccaggtgttctatccgggcttgcccggccacccgggccatgagctggccaagacgcagatgaagcgtttcggcggcatcatcagcatccgcctgcgagacgacagccgcgaggccgccagccgtttcgccagccggctgcggctgttcgtgctggcggagtcgctgggcggagtggagtcgctgatcaaccacagctataccatgtcgcacggcagcatgccggccgacaacaaggccgcgctgggcatcgtcgagggcggcttgcgcctgtcgataggcatcgaggacatagacgacctgctggccgacctggaacaggcgctgcgcgactga

SEQ ID NO: 4132 - DNA, 129 bp, Chromobacterium substugae
atggatggcgcgggtcgcgaatttcacaaaaactcctcaaaatcatcaacttgggcaaattgcccgacaatcgaacgcaaacggccggcaaagcatgcatttgccatgaccatttcatcacaaagctaa

SEQ ID NO: 4133 - DNA, 1755 bp, Chromobacterium substugae
atgaagacaaaacgcgttttcgacatcctgtatcaccagttggccacccatccccgccaggattgcctggccgccaaatccggcaaggcatggcggcaactgtccaccaccgaggtacgggacacggtcaaccgcgtcagtctgggcttgcttgagctgggcatcggccccggcgacaaggtggccatcgcagccgacaacagcatcgaatgggtgctggcggacctggcgctgcagcaagtgggcgccgtcagcgtgccgctgtatcccaccatcaccctcgatgatgcacgctatatcctgtctcatgccgaggtcaagctggcttttgccggcagtgctgcattgcaacgaaaactgcacgaggcattgggcaagctcgcttgccccatttacggcctggccgatatcgacggcgtgccctcctggcgcgaaatccgcgatctgggccgcatcgagcgcatggccgaactggaagcgctgcgcgacggcatccgcgccgacgatgtttacaccattatctacacctccggcaccaccggccgttccaaaggcgtgatgctgtcgcaccgcaatgtggtcagcaccgtcaccgccaccgccgaattcaccggcctgccgcatggcagctgccgcgcgttgagcttcctgccgctgtcgcacatcttcgagcgcgccggcgtctactactatctgtacagcggcaccggcatctacttctccagcgtggagtgcctgtcgtcggcgatggccgacgtcaagccgcacaccttcagcgccgtgccgcgagtgctggagaaggtgcatgaaaagctggtggccaaggcccgcgacctgtccggcgccaagcgccgcatctacctgtgggcggtcgctcgcgccgagaatttcaatcccaaccgcaagctgtcgccgctggaggcgatcaagcacgcgctggccgacaagctggtgtacagcaaatggcgcgcggcgatgggcggccagctgatctcgatcaacgtcggctccgccgcgctgcagccgcggctggcgcggatgttctgggccgccggcgtggccgtggccgagggctacggcatgaccgagagctcgccggtgatttccgccaatccgttcaacgcccgcggcgtgcgcatcggcagcgtgggcctgccgctgcccggcgtggaagtgcgcctggccgacgacggcgaaatcctggtgcgcggcgacaacgtgatggtcggctattacaaggaagcgcagctgagcgcggaagcgctgcaggacggctggctgcacaccggcgacatcggcgtgctggaaaacggctacctgcgcatcaccgaccgcaagaaggaaatgttcaagaccagcaacggcaaatacatcgcgccgcaagcgctggagaacaagctgaaggaatcggccttcatcgaccagatcatggtggtgggcgacggccagaaatacgcggccgcgctgatcgtgccgctgtacgaaaagctgaaggaatggtgcagcgaacacggcatcgcctacaccaccgacagcgaaatgcgcagccaccccaagatcgtcgatctgatagaccgcgaggtgaaacgtttcaaccgctacttcggcagttgggagcacatcaagaaattcgcgctggtcgacaagccctggtgcgtggacgccggcgagctggcgccgacgctgaagctgcgccgcaaagtcatcgccgagcgctgccgcgcgctgatcgacaatctgtacgtgcacgcctga

SEQ ID NO: 4134 - DNA, 663 bp, Chromobacterium substugae
atgagcgattggatgacgctgttcgagtcggcgttgccggtgctgctgaagggcgcgggctacacgctggccttcgccttggtggcgatggtgctggggctggccttgggctttgcggtggcgatggtgcgggtggcgaaactgccgctgctgtcgcagctggccgcgttctacgtcagcgcgatgcgcggcacgccgctgttggtgcagattttcgtcatctactacggcctgccgggcgtggggctggaactggagccggtgccggcgggggtgctggcgctgacgctgaacgtcgccgcctacctgtcggaaagcctgcgcggcggcatcgccggcgtcgccaaggggcagtgggacgccgcgttctcgctgggcctgtcgtggtggcagaccatgcgccacatcatcgcgccgcaggcgctgcgcttgtcggtgcccagcttgtccaacagcctgatctcgctgatcaaggatacttcgctggtgtcggtgatcacggtcaccgagctgatgctggcgaccaaagaggtgatcgcccagaccttccagcccttgccgctgtacctggccgccgccgccatctactggctgctgagcgccgctttcgagcgcatccagcgccgggtggaggacaggctggagttggcgcaccggcgctga

SEQ ID NO: 4135 - DNA, 801 bp, Chromobacterium substugae
ttgggttatattgatatgcgcaagctgatgacggtattgctgctggcggggctgagctgccaggcgctggcggcggatctgctggatgcggtgaagcagcgcggcacgctgaagatcgcgctggagggaacctacccgccgttcaacttcaaggacgccaagcaacagctgaccggcttcgatgtcgagatcgccagcgagatcgcgcgccggatgaaggtgaagccggagttcaccaccgcggagtggagcggcctcttggccggcctgcaaagcggcaagttcgatatcgtggtcaaccaggtgggcgtgaccgagcagcgcaaggcggtgttcgacttcagccagccttacacctattccagcgcgcagctgatcgtgcgcaagaatgaaagccgcgccttcaagggcctggccgacctgaagggcaagaagctgggtgtcggccagggcagcaactacgccgacatggccaaggccgcggccggcgtggaagtgaaaacctacccgggcgcgccggaatacctgcaggacctggccaccggccgcctggacgcggcgctgaacgacagcctgctgatcccgttcgccatcaaacaggccaagctgccgttgaaggcgggcgcgccggtcggcgaagtggcgacgatggcgattccgttcgccaagggcaatccgcagttcaaggcggccatcgaccaagcgctgtccggcatgaaggccgacggcaccttcaagaagatttcggtcaagtggttcggcatcgacgtgtcgaaggcgccggcggcggccaagaagtaa

SEQ ID NO: 4136 - DNA, 933 bp, Chromobacterium substugae
ttgttgaaaatcggccagttcggttcgcgcaattggcgagttttgctggccggtttttgtttgtccgcgttgtcgggcttggccgcgagtctggcaatgcccaatctgtataccgccagaaccttgctgacgatcgccgcgccgatcggcgcccaagggggcgccagcgtgttgcagagcgatggcgtgctgcagcggatggtggataagtttgctttggtcgatcattatcagtcggcttcgccgcgggaagccaagctggagttggtgaacagccggctgaagctctccccgaccaaggaagggctgctcgaggtctcggtgaccgatgccagcccggaattggcggcgcaattggccaacggcctggcggagatcagcaggcagcagatactggacgcgcatattaccgagcaaggccggaagcagtatgtgctgcaggagaagctggctgcggcgcgggcgcaactgaagcaggccgaagcggaagtggcggccagggtgccgggcggcgaagcgtcgctggacatggccacagtcggcatcatcagcgggttcgcaggactggaagggcagctcgagggcggccagtccagcaatctgggcagcgcgatcctgcaaatgcgcaaggagctggagggaagcaaccgcgtgatacggcagttgccgagcgggcagatgctggccctgcgcaatctttacttcaatcgggcgctgatccgcgagctgcagcagcagcttcaggttgcccgggtggtggcgtcgcaggatgtgcaggtggtgttgcccgcggcgccgccgctggaaaagtcggcgccgaaacggatcatcattgtcctgttgtccggcatggccggtttgctgcttgtcgcattggccgtcatcgcgctgcagcaccgcggcaggagtttcagcagaagagccggcgcgtag

SEQ ID NO: 4137 - DNA, 1092 bp, Chromobacterium substugae
atgagtctgaaatgcggtatcgtcggtttgcccaatgtcggcaagtccaccctgttcaatgcgctgaccaaggccggcatcgaagccgccaactacccgttctgcaccatcgagcccaatgtcggcatcgtggaagtgccggaccagcgcctggctgaactggccaagatcatcaatccgcagaagatccagccggccatcgtcgaattcgtcgatatcgccggcctggtggcgggcgcctccaagggcgagggcctgggcaaccagttcctggccaacattcgcgagactgacgccattgtcaacgtggtgcgctgcttcgaggacgacaatatcgtccacgtcgccggcaaggtcgatccgatcgccgatattgaaaccatcctgaccgagctggcgctggccgacctgtccgcggtggaaaaggcgatgcagcgcgaaggcaagaaggccaagtccggcgacaaggacgcgcgcgcgctgatcgaggtgctggaaaagctggcgccgcatctggaccagggcaagccggcgcgctcgctggatctgtccgatgaggaaaagacgctgatcaagccgctgtgcctgctcaccatcaagccggcgatgtatgtcgccaatgtggccgaagacggcttcagcggcaatccgctgctggagcgggtgcaagcgctggccgacagcgaaggcgcgccggtggtggcgctgtgcgcggccatcgagtccgaaatcgccgagctggacgacgccgacaaagccgaattcctggagacgctgggcctggaagagccgggtttggaccgcctgatccgcgccggctacaagctgctgggcctgcagacctacttcaccgccggggtgaaggaagtccgcgcctggaccatccatgtgggcgataccgcgccgcaggcggccggcgtgatccacaccgacttcgaacgcggcttcattcgcgcgcaaaccatcgcctacgccgacttcatcgcgctgggcggcgaagccaaggccaaggaggccggcaagatgcgggccgagggcaaggactacgtcgttcaggatggcgacgtgatgaacttcctgttcaacgtctaa

SEQ ID NO: 4138 - DNA, 582 bp, Chromobacterium substugae
atgtccggcattcgcctgattgtcggcctgggcaacccgggccccgaatacgaaaaaacgcgccacaacgccggtttctggctggtggacgaattatgctggcagttcaagggcaactggcgcagcgaaggcaaattccatggcgacgtcgccagggtggacatcaacggccaggacgtctggctgctgaagccgatgacctatatgaatctgtcgggccaggccgtgctggcgctggcgcagttttacaagatcctgccggaccagatcctggtggtgcacgacgaactggacctgcagcccggcaccgcccgcttcaagcagggcggcggccatggcggccataacggcctgaaggacatcgccgctcgtctgagctcgccggcattctggcgcctgcgcctgggcatcggccatcccggcgaccgcaacgaagtggccaacttcgtgctgaagaagccgcgcggcgaagagcagcaggcgctggacgaggccatcctggcatcgttgcgcgaattgccgcgcgcgatcgccggcaaaatggccgaggcgatgaaggccctgcataccgaggccaagtga

SEQ ID NO: 4139 - DNA, 201 bp, Chromobacterium substugae
gtggtttacggcgccggcaaagaagccgtttccctggtgctggatcacaacaccatgtactacgctctgaagaacgaagccttccacgcctccgtgctggatctggtcatcgacggtcagaaagagcaagtcaaagtggctgcattccagatgcacccgtacaaacagcaagtcatgcacatcgacttcactcgtgtgtga

SEQ ID NO: 4140 - DNA, 984 bp, Chromobacterium substugae
atggcggcatacgacagtttgatggtatttaccggtacggctaatccggaacttgctcaaaacgtagtcaaacatttggatatctcgttggggcgcgccgacgtcggcaagttcagcgatggcgaagtggcggttgagttgctggaaaacgtgcgcggccgcgacgttttcatcctgcagtccacctgtgcgccgaccaatgacaacctgatggaaatcctgaccatggccgacgcgctcaagcgcgcttccgccggtcgtatcaccgcagcgattccctatttcggctatgcccgccaggaccgtcgtccgcgttccgcacgggtgccgatttccgccaagctggtggccaatatgctgaccagcgccggcatcgaccgcgtgctgaccgtcgatctgcacgccgaccagatccagggctttttcgacatcccggtggacaacgtctacgcgacgccggtactgttgaaggacatccgcgcccagcgcttcgacgatctgatcgtggtgagccccgacgtcggcggcgtggtgcgcgcccgcgcggtggccaaggcgctgaacactgatctggcgatcatcgacaagcgtcgccccaaggccaatgtggccgaggtgatgaacatcatcggcgacgtgtccggccgcacctgcctgatcgtcgacgacatgatcgacaccgccaacacgctgtgcaaggcggcttccgcgctgaaagagcgcggcgcccaacgcgtgctggcctatgcgacccacccgatcttctccggtcaagcggtggaccgcatcaagaattccgacatcgatatggtggtggtgaccgacaccatcccgttgaccgccgcggccaaggcctgcccgaacatccgggtggcttcgatcgccggcctgctggcggagacgctgcgcaggatcaacaacgaagaatcggtgtcctacctcttcaatgaggaactggttgcgacgggcgcctgcctgccgtaa

SEQ ID NO: 4141 - DNA, 72 bp, Chromobacterium substugae
tggggagtcgccaagtggtaaggcaccggattttgattccggcattcgtaggttcgatccctacctccccag

SEQ ID NO: 4142 - DNA, 855 bp, Chromobacterium substugae
atgtcgttccagtttcaatcgttcccggcgccggccaaactcaatctgctgctgcacgtggtcggcaagcgcgccgatggctaccacctgctggagacggtgttccgtttcatcgatttcggcgatacgctggagatcgccgcgcgcggcgacggcatgatcgaattgctgacgcccaccgacggcgtgccggctgagcaggatctgaccgtccgcgccgcgcggctgctgcagcgcgagagcggctgcgcgctgggcgccagcatccgcctggacaagcgcattccgatgggtggcggcttgggcggcggcagttccgacgccgctacggtgctgatcgcgctgaaccggttgtgggggctgggttggccgcgcgagcggctgcaggcgctgagcctgcagcttggcgccgacgtgccggttttcatcttcggccgcagcgcgctggccaccggcgtcggcgaggttttggcgccgatcgccttgcagccggcctggtatttggtaattcacccacaggttcatgtgccgaccgcggcgatattccgcaatttttcgcagagcatgttgacagaggtaggggtcgacggcataatgcgaatcctcgaaacaacgcagcagcgacgaaacgatctgcaaaacgttgtttcaggcatgtttccagcggtgaatgaagtactgagcgagctgagaaaatatggttcgccgctgatgactggttccggagcctgcgtgttcatggaattcaagtcgaaagacgaagccgataaagtttaccgggtgttgtcggaaaagtatcagggatttgtagcgcaaggactcgatgtccaccccctgttcgacagcgctgaataa

SEQ ID NO: 4143 - DNA, 543 bp, Chromobacterium substugae
atgatggcgaggtgcctggccttgctgctggcgctgctgctggccggctgcgccaacgaggcgctgtttcggccgccgcagtcgcctgccgcggcggcggatcagcctttcaatgtcagcggcaggctgtcggccaatctggacggcaaggggcatgtcgccaacttcgattggcggcatgaaccgccgcgcgacgaagtggcgatcaattccccgctaggcaacaccgtggccaaggtgctgcgggagccgggcggcgtcacgctgctggccgatggcaagagctggcaggccgacgacgtggaaagcctgacccaacaggtgatgggctggccgctgccgctgtccaacctggtgtggtggatacgcggcctgccggctcccggggtcgacagcagcgtcgatgccgacggcaatctacagcagcagggttggcatatccgcttcatccgcgacgccgatgtcgaggccgaccatcccaagcgggtggaaatgcagcgcgaagggctgacagtgaaggtcgtggtgcaaagctggcgctag

SEQ ID NO: 4144 - DNA, 1725 bp, Chromobacterium substugae
ttgctgctggcgctgctgctgccggcttgcgccagcgtcaagccgccgctgccccagcctgtcgccgccgcgcaggacaacgccgacggcgatgcctccgccaaggccgacgaggccaagctgcccaagcaggaactgacgcccgagatcctttacggcgtgctggccggcgaggtcgccgcccgccgcggcggcgccggctccgccggcctgacctaccttgacctggcgcgccagacccgcgatccgcggatggcgcagcgcgccgccgaattctgcctgctgtccggccagttgaaggaagccgcggaggccttgtcgctgtggatccagctggatccggattcgctgccggcgcgcgagcagctgttcattacgctgatgcgcggcggcaagctggccgaaagcaagccgctgatcgaggacctgctgcaaagggaaccggcgcgcgcgccggccatcttcgtgcagctggccaggctgagcgcccgccaggacggcggttcggccgagtcctacaagctggtggccgacctggccagccgctatcccgacctgcccgaggcgcgcttcgcggtgctggccgcggcggcggataataacgatcaaaaggcggtggaccgcgagttcgaccgcctggcgcagatcgcgccgaaatgggatctgccggtggcctggcaggtggatcggctgcgccgccaggacatcccgggcgcggccgacttcctgcggcgcgaattggcgcgccgcccggacgccggcctggagctgcaggcggcctatccgcgcctgctggtcggcgccaagcgcttcgtcgaggcgcgggtggctttcgaggcgctgctgaaaacccatcccgacaatccggacctgctgtatgcgaccggcctactggcctaccagatgcgcgacctgaaggtggcggatcagcggctgcagcgcgcgctggcgcagcaatacccggaccaggattttgtccgctacacgctgggccagatcgccgaagacgatcacgacgcggcgcgcgcggagggctggtaccgccaggtcgggcagggccagcaatacctgccggcgcagtcgcggctggcgctgctggaagcgggcgaaggacagctggaccaggccttgagccggctgggccagctgggcggcaccgagcaggagcgggtgtcgttggcgctgctgcagtcgcagctggcgcgcgacgccaagcagccgcgcaaggcttacgagctgctgaccaaggccctgcagagccatcccaagtcgggcgagctgctgtacgagcgctcgctggtgtccgacctgctgggcaatgccggcaacgccgagcgcgatctgcgcttggtgctgaaggacaagccgaacgacacccaggcgctcaatgcgctgggctacacgctggccaaccgcaccacccgctacaaggaagcttacggctatatcgaaaaggcgctgaaggcggagccggacaatccggtgatcctggacagcatgggctgggtgcaattcaagctgggccggctggaagccgcccgcaagaatctggacaaggcctaccaggcgatgccggacccggaagtggccgcccacctgggcgaggtgctgtggcggctgggccgccaggatgaggcgcgcgcgctatggaacaaggagctggcggcgcatcccggccatgaagtgctgaccgagaccgtgcagcgcctgggcgtcaagctatga

SEQ ID NO: 4145 - DNA, 861 bp, Chromobacterium substugae
atgtccggttttcatctttacaccatttgcgagccacgcttcccgatgccagaactgccagaagtcgaaaccacccgccgcggcgtgcaatcccatcttgagggccgcgccctgcgcggcgccatagtgcgcaacggcagcctgcgctggccggtgccgccggacctgtccgcgcgcctcgccggagaaaccgtgcgggcggtcagccgccgcgccaaatacctgctgctggagtgcgacagcggcaccttgctgatccacctgggcatgtccggcagtctgcgcatcctggcggcggacaccccggcgcaaaaacatgaccacatcgacctgctgttggacgggcagctgctgcgctaccgcgacccgcgccgcttcggcgcggtgctgtggcacatcggcccgatagaaacgcatccgctgctgcaagcgctggggccggagccgctgtccgccgatttcgacggcgccaccctccaccaggccatcggcaagcgcggcagcccgatcaagctggcgctgatggacaaccatgtggtggtgggcgtcggcaatatctacgccaacgaatcgctgttctacgccggcatcgccccaacccgcccggcctccagcctcagccgcgaagaatgcgagcggctggcggccgaaatcaaggcggtgctggcccgcgccatcgaggctggcggcagcacgctgcgcgacttcgtcgacagcgaaggcaagcccggctacttccagcaaagctatatggtgtacaaccgccaggaggagccctgccgccagtgcggcacgccgatccggcaaattcgccagggacagcgcagcacttactattgcccactgtgccagccatgttag

SEQ ID NO: 4146 - DNA, 771 bp, Chromobacterium substugae
ttgcgcctgctgagccacttggccgtcggcgtgctcatcgtcgccacccgctactcccgcctggcccaggccgagcgcgcggtggtcacccgccgctgggcgcagcaggcgttgaagatcctgggcgtcagcatcaaggtgcagggcgtcaatccgggcttttatccgcccaacaccctgctggtggccaatcacgtgtcctggctggacatcgcggcgctcaacagctgcacggtgtcgcgcttcgtcgccaagcgcgagatccgcagctggccgctgataggctggctggcctatgtcgccggcaccctgttcatcgatcgcagcaaccgccgcgacgccagtcgcgtcaaccagatcctggccgacgcgatgagcaacggcggctgcatggcggtgttcccggagtccaccacctcggacggcagcagcctgctgccgttcaaggcctcgctgttcgaagccgcgctgctgtccggcggcacggtgcagccggtgtcgctgcgctaccagcggccagacggcagcctgctgctggaggcggcctatatcggccagatttcgctgttccagagcataggcaaggtgctgagcgtgccgcagatcgaagtggagatttgctacggccaggcgctgcgcgccggcgacgccggcctcgacaaccgcttcctgctggccgaacaggcccggcgcgaagtggcccgcggcctgcgcatcagcctggaagacgcgccgcaggccgccgcgccggcggaaaccagccgggcctga

SEQ ID NO: 4147 - DNA, 1158 bp, Chromobacterium substugae
atgacagctaaattcattgtgggctggctgctggccggcgcgctggcgggccaggcccaggccgcgccggtgcaggatttcggcgaacccaacctgagccggctggcggcgcgcctgagcttgcaggctgatgcgcagcagccagtgcgcatcatccagttcggcgattcgcataccgccgccgactacctcagcggcgagttgcgcgcgcggctgcaagcccgtttcggcgacgccggcataggctggctgccgccgctcaacgtgccgggccagcgcaacgcgctggggctggtgcgcagcgagggctggagcctgcgtaacagccgccgcgacgacgaccccgactttccgctgggcggctacatcggcgcggcgcagcgtccgggcgcgctggtgagcgtgcaggcccgcgccgcggacaatagcttgtggcgggtgcgggtctggctgcgccaggcaagcgacgcggcatcgctgactgtggacgacggcaatgggccgcggcgcatccaggccgccgccggcgccggctggcagcgggtggaaatgaagctgaagctgccgttcacgctgcgggcggacagcctgccggcgccggaactgggcgggttcgaactggaaaagctggcgccgggagtggtgctggacagcgtaggcagcaatggcgccgaactggcgctatggcggcgctggggcggaatatggggccggcagatggcagcgcgcgacgccgacctggtgatcctggcctacggcaccaacgaggctttcgacgccaaattggacctggacgaataccgcgccaccttgcagggcgccatcggcctggtgcgagcgcagctgccgcaggctgccattctgctgctgggcgcgcctgactccgcgcgccgcaagggcggggcggtcagtcaggaatgcgcggggcccaagcgtccgctgatgctggcagcggtgcagcagacgcagcgccagttggcgcgcgacaatcatctgttgtattgggattgggagcaggcgatgggcgggccgtgcagcatgcggctgtggcagcagcaccagctgggccggcccgatctggtgcacttcaccgcgccgggctacacccgcctggctgacgacctttacctgaacctgatgcagcgcctggggcgctga

SEQ ID NO: 4148 - DNA, 987 bp, Chromobacterium substugae
atgctagccgcctatccgcaccgccgcatcctcgtcatcctgctcagctccatgctgctgctgttctgggtggaacaggccgccatcaatgcttactggcggcagactttccatagtcccagcctgctggagaagctggaggaactgtcgccgtggcgcgagggcggcgaattgggcggcggcctgcgccagcaaagcgtggctttgcagcaacaggtgggcatgtgggaccgccggatggtggagcgtttgaacgcctgctgcctggcccagacgcccgcgccggttgccgctgccgccaagaagccgccgcaggcttcggcgccggccgccgccgccaaggcgctggatccccggctggcgttgcagccgggcctgccggtgttgctggccggcgattccatgatgcagggggtggcgctgcatttgctgccgccgctgttccgccagcaccaggtgaaggcgatagacgtcagcaagcagagcaccggcctcacctatccggacttcttcaactggccggctaccatagagcggcaattgacggccaatcccaaagtacagctgctggtgatgttcatcggcgccaatgatacttgggacatggtaggcggcagccattacatccgcttcgcctcgccggagtgggagcagcgttaccgcgagcgcatccgcagcatttacgcgagcgcgaataaacgcaagatcaaggtgttgtggctgggcctgcccaatatgggccgggacaagctgaacgacggcgcgcactacttgaaccgcttgtaccgcgaggaagccgcggccgccggccagcgcttcatcgccacccgcgaggtgctgggcagccgcgacgacagtttcaacaaattcatgacattgcccgaccagggcgaggtggcggtgcgcaccgccgacggcgtgcatttcacccggcaaggccagctgctgctggcgcgccgcgtcctggcggaattgaggtttgaatga

SEQ ID NO: 4149 - DNA, 1401 bp, Chromobacterium substugae
atgagctatctgtccattgaattcgccctggcatttgtcggctttttcgccgcctactggggctgccgccgcatgcccagcttgcagaacttgctgctgctggtcgccagctacctgttctacatcaagctggactggcgcttcgccgccatcctggcctgctacacgctggtccagcatgctctgagccgcaagatgctggcctcggcccatccgcggcgctggctgcaattggcgctggccctggcggtgttcaatctggccctgttcaagtatttcgactttttccgcgaaagcgcgcaggccggcctgcacgcgctggggatatcggcgatgctgccggcgctggacatcctgatgccggtggggatttctttctataccttccagtcggtcagctatctggtttcggtgtaccgcaaggagatggcgccggcgcgcctgccgcagttcgcgctgttcctggtgtttttccccaccttgctggctgggccgatctgccgcgcgcgcgacctgctggagcaattgcgcagcccggctctgcgccaggcggcgaatttcgaccgcgcgctgggcctgatcgtgctggccttgctgaagaagctgtggctggccggctggctggccagcgcctgggtcgacccggtattcgccgcgccggacaccttccatacgctggaagtgtgggcggcgttctatgcctacgcgctgcagatttacctggacttctccggctataccgacctggtcaccgcgctggcgctgctgctgggcatccagctgccgcgcaatttcgacagtccctacctggcgctcaacctgcgcgatttctggcggcgctggcatatttcgctgtccagctggatccgcgactacatctatattccgctgggcgggaaccgtggcggcttcgcccgcggccaggcgaatctgctggcggcgatgctgttgtccggcctgtggcacggcgccagcctgaagtatctggcgtggggggcgatgcatggcctgggcgtggtggggctgaacatcggcgacaaactgtggcggcgcgacggcgtcagccagcgctggccgtggctggcgcggctgatcaccttccactacgtctgcctggcctgggtgttcttccgcgcccagtcgctggatgaggcgatggactttctgcgcgcgatggctggcaccggccagacgctgacgctgaacgcgccgggcctgctgttgctgctggccttgtggctggcggcgctgcccaggctggcgccgctgcgcgaacgctgcatcgtccagttggcggccttgccctggtggggcaagccgctattgctcagcgcctgcgcgctgctggtgatttcgctggcgccgtcgggcattcccgccttcatttactaccaattctga

SEQ ID NO: 4150 - DNA, 834 bp, Chromobacterium substugae
atggccatctacgcaatcggcgacatccaggggtgtttcgcgccgttccagcagctgctgcggcaaatcgacttcaatcccggcaaggataccttgtggctgaccggagacctggtcaaccgcggcccgcagtcgctggacgtgctgcgctgggtctatcagcaccaggaccaggtggagatggtgctgggcaatcatgatctgcatctgctggcggtgtcggaaggcttcggcaagctgcatcgcgacgacaccataggcgatattctcaatgccgccgacggcaaggtgctgctggactggctgcgttgccagccgatgatgctggagggacagggctatgcgatggtgcacgccggcctgttgccggagtggagcatctccaagtcgctccggctggcggaggaggtcgagttcggcttgtccggcgcgcgccaccgcgagtttctcggccgtttgtacggcaacaagccggtgcgctggagcgatgatctgaaaggggctgaccgcttgcggctgatcgtcaacgtgatgacgcggatgcgtttcctgacccgcgacggcgagctcgacctgagctacaagggcgagctggacggcgcgccggccaacctgattccgtggttcgaggcgccgaaccgccgccatggcggcacgcccatcgtctgcggccactggtcagcgctgggggtgcatctggacgatgatgtgctggcgatagactccggctgcctgtggggcggcagcctgtcggcgctgcggctggatgacaggcagctgttttctctgccatgcccggcttaccgggagattttgcttcccgccggcagataa

SEQ ID NO: 4151 - DNA, 2025 bp, Chromobacterium substugae
atgtccgcacccctgctcaatccgccgcaacgcgcggccatccattacctagacggcccgctgctggtgctcgccggcgccggatccggcaaaacccgggtgatcacctacaagatcgcccatctggtgcgcgaaggcggcatcccggcgcgacacatcgccgccatcaccttcaccaacaaggccgcgcgcgaaatgctggagcgggtgagcaagctgatgacgccggccgagatccgcggcatcaccgtctccaccttccactcgctgggcatgcacatcctgcggcaggaggcgccgcacctgggctacaagacccagttctccatcctggacgcctacgatgccggcaagatcatcgccgacatcctgaacaccacttccaaggacgagatccgcaaggtgcaaagccagatctcgctgtggaaaaacgacctgaaaaccgcggacgacatgatggtgagcgcggatggccagtgggagagcgtctgcgcccgcacctacctcgcctatcaggacaccctcaccgcctaccaggcgatggacttcgacgacctgatccggctgccggtgcagctgttccgcacccaccctgaagtgctgctgaaatggcagggcaagctgcgctacctgctgctggacgaatatcaggacaccaacacctgccagtaccagatggtgaagctgctggccggcgtgcgcggcctgttcaccgcggtgggcgacgacgaccagtccatctacgcctggcgcggcgccaatatggaaaacctgcgcttgctgcagcaggacttcccggcattgaaggtgatcaagctggagcagaactaccgctccaccgcccgcatcctgcgcgccgccaacagcgtgatctccaacaaccccaagctgttcgaaaagcagctgtggagcgagctgggcctgggcgagccgatacacgtggtgcaatgcaaggacgaggagcacgaggcggaaaccgtggtgcagcgcctgctggcccacaagttcgagcaccgcaccgacttcaaggactacgccatcctctaccgcggcaactaccaggcgcgcatcttcgagcaatcgctgcgcaaccaacgcatcccctaccagatggcgggcggccagagcttcttcgacaagccggagatcaaggacctgctgtcctacatgcgcctgatcaccaaccccgacgacgacccggccttcatccgcgccatcaccacgcccaagcgcggcgtcggcgccggcacgctggaaaagctgggcgcctggtccggccagtacggcaagagcctgttcgccgccgcccatgatgccggcctgcgggtgcagatccaggccgcccagttggcgccgctggagcaattctgcgaattcatcaaccaactgcagtaccgcgccacccgcgagccggcaggccagctgtcgctggagctgttgcaggcgataggctacgaagcctggctgtacgacagcgaggacagccccaagatcgccgaaaccaagtggaagaacatgctggacatggtgggctggctggcgaaaaagggcgaggccgacggcaagaacctgatcgagctgacccagaccatcgcgctgatcaccatgctggaaggccgcgacgaaggcgaggtggacgcggtgaagatgtccacgctgcacgcgtccaaggggctggagtacccgcatgtgtttctggtcggctgcgaggaaggcatcctgccgcacagcgaatcggtggacaacggcatggtggaggaagagcggcggctgatgtacgtcggcatcacccgcgcgcagcgcagcctgacattgagctactgcgtcaagcgccgccgcgccggcgaatggcagttcatcgaaccgtcgcgcttcatcaacgaaatcgacggcgaggatctgcgccacttcggcaagcccggcgccgagcctttggtcagcaagagcgagggcaagagcaagctggccagcctgaccgcgatgctggccagcaaggacaagtccggggagccgccggcacagtga

SEQ ID NO: 4152 - DNA, 726 bp, Chromobacterium substugae
atggcccccggccagatcataaaggttctggtcagcatcgttgtctttcttgtcgtggcgatttggcttctggccaaactggcgaccagtggtttcaatgtggatgccgaggtgatgaccaaggaggcggtcgccgctcgtctgaagcctgtcggcgaatccagagccagcgacgcgccgccgggcatgcgcaccggcgagcaggtgtacaagggcatctgcatttcctgtcatggcgcgggcttggcgggttcgcccaagttcggcgacgccggcgcttgggcgccgcatatcgccaagggctgggagacgctggtggatcacgcgctgcacggcttcaacgcgatgccggccaagggcggcgcaaccgacctgaccgatgacgaagtgaagcgcgcggtcgcctatatgggcaatgccggcggcgccaagttcaccgagcctgcggtgggcggcgcggcgggcgccacggccgccgccgacccggcggtggtgggcaagaagatttatgacaccgtgtgcaccacctgccatgcggcaggcatagccggcgcgccgaagttcggcgacaaggcggcctgggcggtcaggctgaagccgggtttggacgaagcggtgaaaatcgccaccaagggcctgaacgcgatgccgccgaagggcggctacaccggcagcgacgccgagtttcgcgccgcggtggagtatatggtcaataactccaagtaa

SEQ ID NO: 4153 - DNA, 74 bp, Chromobacterium substugae
gcacccgtagctcagttggatagagtgtcagtttccgaagctgaaggtcacaggttcgatccctgtcgggtgcg

SEQ ID NO: 4154 - DNA, 114 bp, Chromobacterium substugae
ttggacaaaccttgcgtcgtcaccagccaggcagacgccagcgaaaaatcgtccgacatcccgccatcggcgctgcgacgcggccctcaccgccagaaaaactcgacgcgctga

SEQ ID NO: 4155 - DNA, 1863 bp, Chromobacterium substugae
atgttttcctggtttgaacgccggatatctccctatccggacacgcctccggcccagcctccgcagggcttcttttccttcatctggttctgcacccaaggtttgcgcggcctgatcctgtgcatgacgctgctgaccgcctgcatcggcgctttcgaagccttgctgttctcgatgctgggatcggtggtggattggctgtccaaggtcccgcctgatcaactgctgcaacgcgagagcggccacttatggctgttggcggccatcctgctcggcagcgtgctgctggtggcgctgcaggcgatgagcaagtaccagggcctgttctccaactttccgatgcggctgcgctggaatttccaccgccacctgctggggcagagcctcagcttctaccaggacgaattcgccggccgggtgtcggccaaagtgatgcagaccgcgctggcggtgcgcgacaccgtgctgatcatcaccgacatcctggtgttcgtggtgatctacttcgtcaccatgatcgcggtgctcggccatttcgacgcccacctgctgccgcctttcctcggctggctggcgttctacgtcgccacgctgtggttcttcgtgccgcggctgggcaaggccgccagccgccaggccgacgcgcgcagcctgatgaccggccgcatcaccgacgcctacaccaatatcgccaccgtgaagctgttttcgcatggccagcgcgaggcgcgcttcgccaagggcgcgatgcaggagttcctggccaccgcctaccgccagatgcgcctggtcagcggcttcgagatcgtcaaccagctcagcagcatgctgctgatcggcgtcaccgccggctcggccttgtggctgtggagccagggccaggtcggcatcggcgcggtggccgcctccagcgcgatggcgctgcggctgaacggcatctcgcactggatcatgtgggagatgtccagcctgttcgagaacatcggcacggtgcaggacggcatctccaccttgtcgcgcaaggtggcggtggtggacaagccggacgcggtcaagctgcaggtgccgcgcggcgagatccgcttcgacaatgtcgactttgcctatggcggcgccaggaacgtgatcagcgggctgaacctgacgatacggccgggcgagaagatcggcctggtcggccgctccggcgccggcaagtccaccatcgtcaatctgctgctgcgcttctacgatctggacggcggccgcatcctgatcgacggccaggatatcgccgacgtcactcaggacagcctgcgcggcaaggtgggcatggtgactcaggacacctcgctgctgcaccgctcggtgcgcgaaaacctgctgtacggccgtcccgacgccgacgacgcggacatggtcgccgcggcgcgccgcgccgaggccgacgatttcatccagacgctgaccgatccgaagggccgcgtcggatacgacgcccatgtcggcgagcgcggcgtcaagctgtccggcggccagcgccagcgcatcgccatcgcccgggtgatgttgaaggacgcgcctatcctgctgctggacgaagccaccagcgcgctggactccgaagtggaagcggcgatccagagcagcctgtaccggctgatggaaggcaagaccgtggtggcgatcgcccaccggctgtccaccatcgcggcgatggaccgcttgatcgtgctggaccgcggttgcgtggtggaggagggcagccatcagcagctgctggcccgcggcggcctgtatgccaggctgtggtcgcaccagagcggcggcttcctcggcgaagaggacgacgatcaggacgagcaagtctcgttgatgggatga

SEQ ID NO: 4156 - DNA, 210 bp, Chromobacterium substugae
atgtatcggttgaaactgatctctccggatttcggcatagacgacagcggtccgctgcaccccacccaggagcaggcgcgcagggccgccgaattgatgctgcaggtctacaaggggcgcgtgcgggccgaggtgcacaaggtggacctgaaggccaggacctcggagaagctggaggaggtctacgtcaaaatggtgccgatggcatga

SEQ ID NO: 4157 - DNA, 882 bp, Chromobacterium substugae
atgcaggtggatgccgtattgggctatctggacaaggtaagccgtttcgatgcgcaacagttcacgccgctctacatcggcaccgagcgcatgggttgcgtcaacgcgcaatggaaggagcgcttgctccggcacgaggcggcgctgttcgaggaaaactatcagggcatgctctgccggcttgacggcagctaccgcagcatcagccatgcgctggcgcaggcggcgcggcgctggcagcaggccggctggctcaacggctggcgcaacgagaatttcaccgcctttcgccatgacggctccgcttatttcgagctggagcgcgcggctttccgcccgctgggcctgaccagccgcgcggtccacgtcaacggtctgtgccggctggacgatggcgaaatccggatgtgggtggggcggcgcagcccgcacaaggcggtggaccccaaccgcatggacaatctggtgggcggcggcgtggccgccggcgagacgctggagctggcgttggagcgcgagggctgggaagaggccggcatcgcgcgcgaggcgttgctgggcttgcggccggagtcgctgctgctggccgagcggccggtggcgcgcgggctgcaccgggaatggctgcatgcctacgatctgtggctgccgcaggggcagcggccggcttgtcaggacggcgaggtggccgagcatctgttgctgccgctggccgaggtggagcagctcttggtggcggagcgcttcatgatagacgccgcgctggtcagcctagactgtttgtgccggctgggttactggcagcagggcaacggccaggtggcggcggcgctcgcgcggatacgccacgggcagtcacgcgatctggcgacgccggcctaa

SEQ ID NO: 4158 - DNA, 1695 bp, Chromobacterium substugae
atgaattccgccatctccctgttgcccgaccaactttccagcctgttcctgcggctgtttcccgacgccgacgacgcggtgctggcgctggtgcgcgagttgagcgccgccaaccaggccggccacgtctgcctgccgctcgcgcatcgcgccgagcgcaaagccctgcagcgcagccagctggtcggcaggcccggcgattacgcgccgctgatcctggacgacgccggccggctgtatttcgcccgccattggcacgatgaagacatcctggcgcgggacctggcccggctggccgagccgctgccgccgccggacgagtccgcgctggcggcgctgctggcgcggctgtttcccggcggcgacaccgggccggaccggcagaagctggccgccgcgctggcggcgcggcagcggctgatggtgatttccggcgggccgggcaccggcaagaccacgaccgtggtgcgcttgctggccctgctggcggcgctgtcgccgcggccgctggtgatggcgatggcggcgcccaccggcaaggcggcggcgcggctgtccgaatcggtgcgcggcgcgcgcgaccggctggatgtcgacgaggcggtgcggcgccaattgccggcgcaggcggaaaccctgcaccgcctgctgggcctgcgtcccggcgcggaggcgccgcgccatcacgccggcaatccgctgccgctggacgtgctggtggtggacgaggcgtcgatgatagacctggcgctgatggcgcgcgcggtggcggcgctgccgtcgcaggcgcggctgatcctgctgggcgatcgcgaccagctgtcgtcggtggaggccggcgcggtgttgggcgagttgtgcggccggatcgcctaccgcgaggagacgcggcaatggctgcggcgggtgtgcggcgacagcctgccggacgacggcgcggaaggcggacggctcaccgattgcgtggccttgctgacccacagccaccgcttcggcgccgattccggcatcggcgaactggcgcgcctggtcaacggcggcgacgggcggggctcgctggatttgctgcaggcgggcggccatccggacatcggcctgcagccggcggtggcggccgcggcgctattggacaagcgccgcggctatctgcaggcggcgaccgccggcgccgagccggacgcggtgcagcgcgccttttccgccttcatgctgctggcggcggagcggcgccaggtggcggactgcaaccgcgagctggagcggcagctggagctggccggattgaagcagccgggacgggactggtatgccggccggccggtgatgatagccgagaacgattacggcctgggcctgttcaacggcgacatcggtttcgcgctgccgcgcgcccaggggctgcgggtggtgttcccggcgggcgacggaggctggcgcgaattcgcccccggccggctgccggcgcacgacacggttttcgcgatgacggttcacaagagccagggctcggagtacgacgaagtgtggctgcaattgccgtcgcagccgggcgcgctgctgaaccgggccttgttgtacaccgccatcacccgggcgcgccagcgcttcgccgcggcgggaagcggggaggtgtggctgcgcggcgtcgagctggcgccgcagcgccattccggcctggccgaccgcctgcgctga

SEQ ID NO: 4159 - DNA, 714 bp, Chromobacterium substugae
gtgaataggctgtgcggtctgctgctgctgttgtcgtgcgcgtcggcgccggcgcaaaccctgcgcgccggcgtggccaacgacaccaccgaacccctgcgccaggcggaggagggcggcttgctgcaaacctaccgccaggcgctggcgctgatcgcccagcaaagcggcatccgcttccagctggattactatccgacccagcggctggagcagctgttccaggtggggcggctggacatggaggccggcgtcaatccggcctggcgcgcgttgtcgccggtggccggcttctacacccagccgttcggcgaagtggagttcgtgttgtgcctgccgctggccaaggggaggacgccggccgcggagctgaaaagcggaacggtgggcaccttgcccggccagcagtaccctctgctggagccggccttccagagccagcgtttgcggcgcgacgtgtccggcaacgaagaggaactgctggacaagctgcgcgaaggccgggtgcaggcggtggtgctggagcgcggccgcgcgcgctactggagccgccagaccgaaggccggcgctgccagccgggcgagtcggccggcagcctgccggtgatgctgcgcctgcatccgcaataccgcgagctgctgcccaggctgaaccgcgccatccagaccctgaacggccaaggcaagctcaagccgctgttcgccgcgaaataa

SEQ ID NO: 4160 - DNA, 1485 bp, Chromobacterium substugae
atgtttgaatccgccgagatcggccaccgcatcgacaaggaaacctttcgcaagatgatgccctcgctgcgagaggcattgctggatgtgcagtacgatttgaaggaaaaggccgacttcccggtattgatcctgatccacggtttcgacggcgccggccgcggcgagacgatgaatctgattaacgagtggctggacccgcggctgatccacaccgtggccttcgacgcacccaatgacgaggcgagggcgcggccatggatgtggcgctactggcgcgagctgccggccaaaggccgcatcggcatgtttttcggctcttattattccgacaccctgttcgaccgggtgttcaatcgcagcgaccgcgacgccttcgaccggcagatcttcgacatcctgcgcttcgagcgcatgctgacgctggacggcgcggtggtgttgaagttctggttccacctgagccgcgacaagcagaaacagcggctgaagcagctggagcaggaccaggcgaccagctggcgcgtcaccaagagcgactgggagcactacgagcgctacgacaagatacgcaaatacggcgagcacatgctcaggctgaccaacacctcgcacgcgccgtggatcgtgatagacggcgaggacgccaattaccgcagcctgacggtggccaacaccatcctggaagcgatgcgcaaccgcatcggccagccgatgctgagcaccgaccgcgtcgaggcgccgccgctgctggcgccgatagacaacaagctggtgctggacgcgctggagctggaccgcaagctggacaaggacgcctaccgcgccaagctggagcagctgcagggccggctcaacaagctgacgcgcgacgcccgcttcgcccgccattcgctggtgctggtgttcgaaggcaacgacgccgccggcaagggcggcagcatccgccgcatcacccaggcgctggacgcgcgccgctaccgggtggtgccggtggcggcgccgacccaggaggaaagggacaagccgtggttgtggcgcttctggcgcaatgtgccgggcaagggcggcatcaccatcttcgaccgcagctggtacggccgggtgctggtggagcgggtggagggcttcgcgccggaagccgattggctgcgggcgtattacgagatcaacgatttcgagcaccagttgtcggaaaacggcgccatcgtgctgaagttctggctggcgatcagcaaggacgagcagctgcagcgtttcaagggccgggaggaaaccggcttcaagcgcttcaagatcaccgacgaggactggcgcaaccgcgacaagtgggatctttaccgccaggcggtcagcgacatggtcgaccgcaccagcaccagcaaggtgccgtggacgctggtggaggccaataacaagtatttcgcgcgcatcaagatattgaccaccatctgcgacgcgctggaggcgagactgagtgaatag

SEQ ID NO: 4161 - DNA, 3567 bp, Chromobacterium substugae
atgacgacgatggaagccacggcgctggacgcgctcaattgtccgctgggcggcgtcaacctgatcgaggcctcggccggcaccggcaagacctggaccatcgccgcgctgttcgccaggctgctgttggaggacagcgacggccagccgccgccgacgatagaccggctgctggtggtgacctacaccaaggccgccaccgccgagttgcgcgaacgcctgcgccgccggctgggcgagatgctggcggcgcttgaggacaaggccgggggcgacgacttcctgcgggcgctggccgcgcgctttcccgccggcgccgcgcgcgaactggcgcggcagcggctggccgccgccatcgccggtttcgacgccgccgccatctataccatccacggcttctgccagcgggtgctgaccgacgcggccttcgaaagcggccagaccttccaggccgaactgatggaggacgacgccggccggctggtggagatcgtcgacgacttctggcgccgccgcatcgtgtcgaagccgctgctggcgcaggtgctggtggaacagcgcgccacgccggagcagtggttggcggaaatccgcccctatctgtccaagccctacctcaacttgcaggcgccggacgccgccggcctagaggccgcgcagcggctggcgcaaagccgctggcaggcgctggcggccgaacccgagctggcggaggagggactgcggctgttcgccgaacatgccggctacaagggcaatgtctacagcgccgccattctcgaacgcgcggcggcggcgctgcgcggctggctggcgcagccggacggcctgccggagctggacagcgacagccgcaagacgctggacaagctcaggccggaggcgctggccaagggcatgaagaaggattgcgcgccgccggcccaccctttgttcgagcgggttgacgcctggctcgcggcctgggacggctatatggcgcaggtggccaactcgctggccggcctcaagctggagctgatcgcctgggccgatgaagagctggcgcggcggcgcggcgtcgagcgcagccgcagcttcgacgacctgctcaccgacctgggcgcggcgctggcgcatccggacagcggcccgctgctggcggcccaggtggcgcgcagcttcagcgcggcgctgatcgacgaattccaggacaccgaccccacccagtacgcgatcttccgccgctgcttcgtcgagcaggcgcggccggtgttcctggtcggcgaccccaagcaggcgatctacagcttccgcggtgccgacatcttcgcctacctggccgcccgcggcgacgccgagcgccattacacgctggacaccaaccgccgttccgacgcgccgctggtgtccaccgtcaacgcgctgttcggccgcgagctgcctttcctgatcgagggcatcgcctaccagccggtggcggcgcagccttcatccggcggccgcctggaggtggaggacgaccgcgcgccgttcaacgcgcaatggctggccgccggggacaaggcgttgagcaaggaggcggccgaggaggccgccgccgtcgcctgcgccaacgagatcgcccgcttgctgagcctggcagtcgccgaccgcgcttccatcgtcaagggcgatgcgcgccggcgcttgaagggcggcgacatcgcggtgctggtggccacccacaagcagggcgaccggatccggctggcgctgcgcgaacgcggcgtggccagcgtggcgctgacccaggagagcgtgttcgccagcgtcgaagccggcgagatgctggcgctgctgcacgcctgggcagagccggccagcgagtcgcggctgcggctggcgctggccaccgagctgggcggcctggatgccgccgaactgaaggcgcggctggaggacgaagccagttgggaggcggagctgctgcgaaacgccggcgaccatcagcgctggcgcgaacacggcttcatggccgcctggcgccattatttcgcccgcgaacagctggcggcgcggctgctgccgcttcccgacggcgagcgccggctgaccaatctgggccacctggccgagctgatccagcaggaaagcgaaagccgccagggcatggcgccgctgctggcctggttcgccgcgcgggtggccgacccgccgcgcggcgaggaggcggtgctgcggctggagagcgacgccgcgctggtgaagatcgtcaccgtgcatacctccaagggcctgcagtacccggtggtgttctgccccttcctgtggcacggcgcgctggagcggcgcggcgccagcttctggagctaccaccgcggcgacgcgccctggctcgcgccggacgtggtggcgaacgagggcgtgcggctggcggcgcgcagcgagatgctggcggagaagctgcgcttgctgtacgtggcgctgacccgcgcgcagtaccggcaatacctgggctggggctgggtcaaggacatgcagaccgcggcgctgtcctggctgctgcacgcgccgggcgcggcggacctggccgcgctggagcaattgaagctggatggtccggaggtggagggccagctgcgcgctttcgccgccggccgcggcggcgcgatggcggtgctggccgacgagggctggcacgcgctggcggctgcggaggcggccgagcgtcgctacgccgcgcggccgtttgcgcgcaaactgtatacgccgtggaaaatcgccagcttcacctcgctgacccacgcggccggcggccacctggccgaagcgccagaccacgaccgcgagccgcggcccgagccggcgtcgccgaccgaggcgccggcgcgcgaccgcttcagttttccgcgcggggccaaggccggcatctgcctgcacgaaatcttcgagcgcatcagcttcggcgccgatccggcagccatccgcgaggcggtggcgacggcgctggcgcgccatggcttcggcgaggaatggctggacgccggctgcgagctgatcgtttccacgctggaggcggagctggcgccgggcgcgcgcctgcgcgaggtggcggacggtaagcggctgatcgaactggaattcacgctgccggtgacgcggctggacgtggcggcgctgatcgcggcgctgcaggacccggcgcacggcctggcggagccgctgcgccaggcggcggcggggctggatttcgccgccgtgcagggtttcctcaagggtttcattgacctggtgtgcgagatgggcgggcgcttctacctgatcgactacaagtccaaccacctgggcggcgagttcggcgattaccgcggcgacagcctggccgccgcggtggcgcgcgagcactactatctgcagtacctgatctacctggtggcgctgcggcgctacctgcgcgcgcgcggcgtcgattgggacagccgcttcggtggcgtgcgctacctgtttttgcgcggcatgggcgcggagggcggcggcggaatatgggccgatgcgccttgcgccgcgctgctggacgcgttggacggcctgctgggcgggcattga

SEQ ID NO: 4162 - DNA, 3198 bp, Chromobacterium substugae
atgctgtttctctaccaatccaaccgtctggagcaactgggcgagctgttctgcggcatgacccaggcgatgccgctcgccgacccgttcgcggcggagacggtgatcgtgcaaagccgcggcatggggcgctggatcacgctggacctggcgcgcaaggccggggtggcggccaatgtcgatttcgtgctgccggcggccttcgcctggcggctgatgcagaaggtgatgccggatttgccgaggaaatccgccttcgtgcccgaagtgctggcctggcggctgctggcgctgctgccgacgctggacggcgagcccttcggcccggtgcgccattacttggaaggcggcgagagcgcagctttcgagctggccggcaagatcgccgacattttcgaccaatacctggtgttccgccccgactggatccgggcctgggagagcggcgcgctgctgggcctgggcgaggacgaagcctggcaggcggcgctgtggcgtcggctggccgagagcgaccccggccgccaccgggtacggatgctggacgaattcttctcccagctcaaaagcgagcacctgccggcgcgggtgacgctgttcggcatcgccagcctggcgccgatgtacctggcgctggtcaagcggctgtccgaactgaccgacgtctgcctgttcaccctcaatccctgcgaggcctactggggcgacatcgtcgacgcccgccgcaagctcaggctgcgccaggccggcgacctgttcgccagcgaaggccacccgctgctggcctcgctgggcaagcaggggcgcgatttcttcgagctgatcgccgaggacgccgagctggacgccaagccgctgttcgccgcgcccaagggaagcagcctgctggcgcggctgcagcgcgatatcctggagctgaacgacccggccgccgcgccagcgccgatggcggcggacgatcactcggtgcagctgcacgcctgccacggtccgatgcgcgagctggaggtattgaaggaccggctgttggcgatgttcgccgacgaccccaagctcagcccggccgacgtggcggtgctgacgccggacatcaaccgctacgcgccgtatatcgacgcggtgttcggccgccgcgacgacgcccccaatatcccctacagcatcgccgaccgccgggtggagcgcgaacagccgctgctgtccaccttcgccgcggtgctgcggctggccgattcgcgcttcgccgccgacgcggtgctggcattgctggacagcccggcgctgctggcgcgtttcgacctctccgaagccgatctgcccttcatccaggactgggtgcgcgacgccggcatccgctggggtcgcgacgccgggcacaaggcgcagctgggcctgccggccgacccgctctacacctggcgctgggggctggataggctgctgctgggcacggtgctgccgccggcgctggccggcgacgccgccggcctgttcgccgggctgctgccccacggcggcgcgcaggggcagttgggcgaggcgctggcgcgtttcgccaactgctacgacgcgctggacgcgctggcgcgcgaatggcaagccccggcttcgccgcggcaatgggccgagcgcctgcaccaggcctgcgagcggctgttcctggccgatggcgacgacgaggccgcgctggagacgctgcgcggcgtcttcgccgaactggccgaagacgccgagctggccggcttcgacgccgcggtgggcttgccggtggcgcgcgactggctgctgcgccagctgggcgtggcctcggcgcagggcttcctgtccggcggcgtcactttctgcgcgatggtgccgatgcgctccatccccttcaaggcgctgtgcctgatcggcatgaacgacggcgcctacccgcgcgacgagcgcccggtcagcttcgacctggtggcgcgccacccgcgccgcggcgaccgctcgcgccgcttcgacgaccgctacctgttcctggaagccattctgtcggcgcggcagacgctgtacctgtcttatgtcggccagtcggcgcgcagcggcgaaacgctgccgccgtcgccgctggtggcggagttgatggatagcctgtcggcgatgtgcggcgaggacctggccgccaggctgacgctgcgccatccgctgcagccgttcgcgccgcaagcctatgacggcgccgacgcgcggctggccagcttcgagccggccttcgccgccgcgctggcggcgccgcaggccgagccgcggcccttcctcgcgccgctgccgccggaggagccggccagcgtgctcaacctgcacgatttcatccgtttctggaaacatccgccgcgcgcctggctggccgagcggctggcgatccggctgtccggccgcgaggacgagctggccgcgcgcgagccgttcagcatggaggccgacgccagccgggcgctgcgccagcaattggtggaggcgatgctgcaccgccggccgcaggccccgctgcgcgagcgggccgccgccgccggcctgctgccctgcggcgagctgggccaggcctggctgcaggaggaaggccgcgccagcgtgcggctggccggcagactgccgcgcgcgctggcggaggaaaccctgccgccgcagccggtgcacctgagcctgggcggcttcaccctggtgggggagctgtacgggctgcggccggagggccggctcagcttcatcgtcggcaagctcaacgccgcccagcgcatcgaattgtggctgactcacctgatcctgtgcgcggcgcggccggcgggcatcgcctgccacagcgcggtttacgacgacgccggcagcaccgcgctggccgatgagatcgacgccgccggcctgctggcgccgtggctggcgcgctggcgccagggccaagcgcagccgctgccctttttcggccgcaccagctgggcctacgccgaggcgctggccaaggcgccggacgcgcgcgaggcggcgctggccgccgcctggcagaaatggcaacccggcttcgtgctggagggcggcatggcgcagcgcgacgagccggcgctggcgctggccttccgccatcaacagccgctggacgacccgctgttcgcccagctggcggaaaccctgttattgccgctggccgagcgcctgggcggaaaagagcgatga

SEQ ID NO: 4163 - DNA, 387 bp, Chromobacterium substugae
atgtatccgtacctgatcgtcaaacacgcccacatgggcttcgcctttctgtccatcctgctgttcgccgcccgcggcggactggtgctgagcggccggcaacacctgctggcgaccaagccgctgcgcattctgccgcacctgatcgacaccctgctgctggcctgcgccatcgcgctggtggtgatgggcggctggccgatactgcacagcccttggctgctggccaagatcgccggcctggtcgcctacatcgcgctgggcagcatcgcgctgcgctacggcgccacgcccaagacccgctggctggcctttgtcgccgcgctggcggtggtggcctacatcctgctggtggccgccaccaaaacggcgctgcccacgctgtaa

SEQ ID NO: 4164 - DNA, 444 bp, Chromobacterium substugae
atgatttccccggcacgccccttccttccccgcgcgcgcggtttttcgctgctggaattgctgatcgcgctggcgctggccgcgctgatcgtcggcttcgccgtgcccggctaccaaagccatatgcagcgcagccggcgcggcgacgcgctggaggcgctgtaccagctgcagcaggcgcaactgcgctaccgcggcttccatcccggctacgccaagagcctggcggaactgaacaccccgttcggcaatggcatcagccgccagggctactaccagttgagcaccggcatcgtcgacgacgacgcctccggctatttcgtccaggccgccgtccgcgccggcggcgcccaggccggcgacggcgagtgccggcagatcgtcctcacccagcgcaagcacacgctgagcctgacgccgctgccctgctggggcaagcgatga

SEQ ID NO: 4165 - DNA, 510 bp, Chromobacterium substugae
atgagggcggccgcgcgtggcatcacgctgatcgagctgatgatggtgatcgtcctggcctcgctgctgctgacgctggcgctgccggcgctggggcgctggatcgccggccaacagctgcagggcgcgctggacgacgtaggcagccagctggagctggcgcgcaaaaccgccaccacccgccagcagcgggtgtgggtggagttcagccaggacggccccggctggatgatgcgagtgtcggagctgcgcgacggcaaaggctgcgagccgggccgcgacctgagctgcgtcggcagcgcccagcatgccggcatcgccctcagcctgccgggcaagccgctggcgctgaagctggccttctcgccgatgcgaggcctgccgcaaaaccccgacggcaccctgctgagcgaaaccgtgctgcagctgggccggccggcctgccgccccgcccggctgcgactcttggccaccgggctgatcagcagcgaggccggctcatgctcctga

SEQ ID NO: 4166 - DNA, 609 bp, Chromobacterium substugae
atgctcctgaaacctgcgcgcggcatcagcctgctggagctgctggtgggcatgaccgtcagcctgctgctgctgctggcgatatccagcctgctggccggcctgctgggcaaccaggcgcgcgaacggcgccaggccaggctgggcgcgatgatggacgcctcgctgtcgctgatggcgatggagctgcgccgcgccggctactggaacagcaatggcgaaaccggcgtcaatccctacggccgcatctatatcgagcaaaaaggcggctgcctgcgctacggctacgacaccccgccgggacagaccggcggcggccctcgctacttcgctttccggctaacaagcgacagcgccggccgcggccgcatccagcgccgcgcgtcgaacgcggccggctggagctgcgatgccgacgccgccggctgggacgacctgagcaaacccgacatcggcgtgatcgacacgctgcgcttccgccgggacggcgccggccaggccatcgcgctggaggtggcggcgcgcaccccgccgggcggcgaggaggaaacgctgaacatccacaccagcatcgcgctgcgcaaccatcccgcggtggaaaaccaatga

SEQ ID NO: 4167 - DNA, 1809 bp, Chromobacterium substugae
atgaccgccccgcgccagcgcggcctggccacgctgttcaccgtgctgaccttgctggccatcgccagcctggcgctgatcgccgcttcgcgccagctgctgctggcccacgccaacgcgcagaaccagcaccgctaccaccaggcgctggattacgccgaagaagggctgaaccaggcgcaagcggcgctggccgccggcgcgccgctgctcgacacgccgcgctaccaactgaagcggaccgacatcgcgcctgacctggtgcgcctggccagcaccggcctgtacgatcagcaccgcgtcacggtgcagcgcatgctccgcctgggccgcgctggcggcgactccccggtggcgctggccatcgtcggcgatctcgacctcagcggcgcggtgaatctgctcagcgacaagccggtggacatgacggtggacggcaaggtcaggctcagcggctcggtcaacggcatcggcacgctgcaaagcaccggcgacatcttcgtcagcggcccgcagaccatcggcgcgctgcactccaacggcaatatcgagctggccaacggcagctacggaacggtgaaggcggcgggcgacctgacgctgcgcggcgacgccgccatcacccgattggcgcgggtcaacggcaacgcccgctttttctccagccccggcgcggagccggcggtgcgcgcggcagaagtgaagggcgacgtggaaatcaatatgggcggcgcccgcttcggccggctggacagcgaaggcaaggtggacatccgccagttcggcggcatggaggcgctgcaggcgctgggcgacctgagcatccagggttggggcgcgccgctggccggcgtcgtcgccggccgcgccaatttcaacgccaataatcccgacatccgcgtcaatcaggaccccaagctgcgcctgaaactggagccggtgccgctgctgcaggtgggccgtccgcgcatcgacgcgttcgacttcaaaaacgaagcgcattaccgcttcgagttcgaccgcgccggccgcatcctggtgacggtgcgcaagatacacggcctggccgacggcgcttaccggctggggctgtcgcccgacagccagctgcccaactacctgtgccgcgacgccgacagccagggccgctgccggagcggcgcgccggcgcaactgatctgcaagggccattcgccgcagaacgactgcttcgccggcagccgccccggccactggaagctggacggccagaccatggcgccgggcgtgctgtggttcgacggcgatctggaagtgggcagcggcgtctaccacaacagcttcctcgccagcggcgacatcgccaccagcggccagcatgtcagctacgcggtgaactacgccggcgcggtgggcgtctgccgcaacagcgacttccccgcgctctacccggaagacgattgccgccagggcctgttcaagggccggccgataggcaacgcggccctgctggccggcggctattccgccgggcgctaccagggcggcaacatcacgctgggcgcgtccagccagatccacggcaacgtttgggccggcaacatgctgttttccggcggcagcaccaccatacacggctacatcgccgccgcgctgcaaggcgccgcggcggcggagccgcaccgctggggcgccagcaccaccatagacctgcgcggcctgcccgaaaccttccagcccggcagccagcccggcgatccgggaagcggcggcaagcgcggggtggaggcgctgccctacagctggatggacagcggagccgactcgtga

SEQ ID NO: 4168 - DNA, 369 bp, Chromobacterium substugae
gtgagcgcgcgccggcaccgcggcttcacgctgctggaaatgatgatcagcctgctggtgctggcggtcggcgcgctcggcctgctgcggctggagaccgagctgctgcacagccagatcgccgccaacgactacaactccgccaccaatctggcccaggccgcgctggagcagcagcatgtcggcagcggcgccgactgccgccgggcggacttcgccccggccgccgccagcggcacgctggcgcgcttccagtgccgcagccgcgtcgccagcggcacggtcagcgtcgacgtgcaatggcgggacagccagggcgatggcgaaaccctcagcctgagcgcgccgcagcatctggccggagactga

SEQ ID NO: 4169 - DNA, 429 bp, Chromobacterium substugae
atgcgcatccctgaactgaccctgcccgcaggcgccgccgccctgctgtcgcggctgcccgccgcgccgcccgcctggctgctggccgccggcctcaaccagctgctccggcgcggcatcctgcctgccgatatggcgcagctggccggcaagcgtttccgcgtccggctggaagacgccgggctgcagctggacttccgcgccgatggggggcgctttcaccccagtcgcggcgagcccgacctcagcctggccgccaactgttgtgatttcgcgcgcatgctgctgcgggaggaagacccagacaccctgtttttccaccgcaaactgcgcatcgagggcgacaccgagctggggctgatcgtcaaaaacctgctggacagcatagattggagccagaccccgctggccggcatgatggccaactga

SEQ ID NO: 4170 - DNA, 762 bp, Chromobacterium substugae
atgaagcactggccgttcagcacgcggcgggtaaagatcgaactggcctgggtcgtgcttttcaatctgctcagcttcctgctgttcgtgcacttcgaactgttcgacaagctggacgactggttccacagccatccggacagcgcgctggacgaagtgctgctggtgggattcacgctggccatctccatgtcggtgttcgccgcgcgtcgcctgcgggaggcgctcatcctgctcaaggcgctgcggcgccaggccgagcgcgacgacatcaccggcttggccaaccgccgccgcgccaaccagatgctgcagcgggaaaccgaacgcagctaccgctccaatcggctgtattcggtgctgctgatcgacctcgaccacttcaagagcatcaacgacacccacggccaccagataggcgacgcggtgctgcagcgcttcggcaaggtgctgcagaagcgggcgcgccagctggacaccatcgcccgctggggcggcgaggaattcatcgtgatctgtccggaaaccgagcaacccggcgcgctgacgctggcggaaagcatccgccagctgctgaaggaaaccgacttcgcgccggtgccgcaggtcaccgccagcataggcgtggccacgctgtccgacgacgacaccccagacagcctggtgcaccgcgccgacatgtatctttacgccgccaagcaggccggccgcaaccgggtggtcggcgacgcccagaccgcctccgcgccgctgcaggcatga

SEQ ID NO: 4171 - DNA, 966 bp, Chromobacterium substugae
atggataccttaaaagcactcatggtcttcatgaccacggccgaaaacggcagcttctcggacgccgcgcgcaagctcggcgtctcgcccgccgccatcagccagagcattgcccgcctggaacaggagcttgaagtccgcctgttcaaccgcaccacccggcagttgacgctgaccgaggacgggcgccgtttctacgcgcaatgccgcggcccagtcaacaatctggactcggcgatcaaccagctgaaggccagccgcgacgagccggccggccatctgcgggtcagcatgccgaactccttcggccgccgcttcattctccccatcatgggcgaattttgcgagcgttatcccaaggtcagggtgttcttcggcctggacgaccatttcagcgacctgatcgaggacggctacgatgtcggcgtgcgcaccggcatgatgccggacagccggatggtggcgcgcaatctggcgcagatgccgctatacgtggtggcgtcgccggagtattgggaccgccacggccggccgtcgtcgccggaggagttgggcggctacgactgcatcaacttccagtttccgacttcgggccggctgttcaagtgggagttcgaccgcaagggcgagcgcatcccgctggaggtcaacggcacctacacgctgaacgacatggaggcggtggccgaactggcccgcctgggcatgggggtggcgcagctgcccggccacgaggtggtgcacctgatccgcagcggcgaactggagccggtgctgaccgacatggtgtcgctggagcggtcgatctacatctgcttcccgcaccgcgaccacatcgcgccgcgcacgcgggtgttcgtcgacttcgtggtggaaaagctggccgaccatccggacatcatggccgatctgccgggcctggatttgtccgccaagcgcagcgcgctgctgcagacggtggcctga

SEQ ID NO: 4172 - DNA, 798 bp, Chromobacterium substugae
atggtgatctcgaaacccatcaacgcaagaccgctcccggccggcctgaccgcgtcgcagcaatggactttgctggagtggatccacatggccggtcacatcgagaccgagaacgaactcaaggccttccttgatcaggtgttgtcccaagccccttccgagcggctgctgctggccttgggccgcctcaacaaccagaaccagatccagcggctggaacgcgtgctgaacgtcagctaccccagcgactggctggaccagtacatgaaggaaaacaacgcccagcatgacccgatactgcgaatccatctcggccagggaccggtcatgtgggaagaacgcttcaaccgcgcgaaaggcgccgaggaaaagcgcttcatcgccgaagccacccaaaacggcatgggcagcggcatcaccttcagcgccgcgtcggaacgcaacaacatcggcagcatcctgtccatcgccggacgcgagcccggccgcaacgccgcgctggtcgccatgctcaactgcctgacgccccatctgcaccaggcggcgatccgcgtcgccaacctgccgccggcctcgcccagcaacatgccgctatcccagcgcgaatacgacattttccactggatgagccgcggcaaaaccaactgggaaatcgccaccatcctggacatcagcgaaaggacggtgaagtttcacgtcgccaacgtgatacgcaagctcaatgcgaataatcgtactcacgccattgtgctgggcatgcatctggcaatgccaccctcgaccgtagcgaacgaatga

SEQ ID NO: 4173 - DNA, 1356 bp, Chromobacterium substugae
atgaccgccttcactagctgcaatcccgccaccggagaagtctccttcacccgccccgcctggagcgaaaccaccctggcacacagccaggccgcgctgcgccgggcccagcaaacttgggcgcgcatgacggtggaccagcgcgccgaccaactgctgcacttcgccgaccggctatcgctccagcgcgaggccctggccgagctcgtcacccaggaagtgggcaagcgcacgcccgagtgcctggctgaaatcgacaagtccgtgcaattagtgcgttattacgccgaattggcgccatctttgctcaagtcccagctgattcccacccaggccagccgcagcggcgtggcgtttgagccgctggggctggtgcttgccgtgatgccgtggaactacccggtatggcaggtattgcgcttcgcgattcccgcgctgatggccggcaatgcctgcctggtcaaacccgccccctcggtgccgcaatgcagccagctgttgctggatatcgcgcgcgaagccggcctgtcggtgctggagatggcctggattgaaccagacctggtggaagaggcgatacgcggctgcgatgccgtcgccttcaccggctccacccacaccggccgcgtcatcgccgcgctggcaggcaagcatctgaagaaaaccgtgctggaactgggcggcagcaatcctttcatcgtgctggccgacgccgatatcgccgccgccgcgcgcgatgccgccaactcccgtttccgcgacgcaggccagagctgcaacgccgccaagcggatgatcgtggtgccggaagtcgccgaagcgtttgtcgaagccttctgcgccgcagctgcccaactccgcgccggcgatccgcacgaccccgccaccacgctgtcgccgctgacccgcgccgaccttcgcgaagcgctgcacgcgcaggtgttggatgcctgcgcgcatggggcggaactgaaactaggcggccagatgccgcataccccgggcttcttctacccggccacggtgctagaccatgtcaacccatcctgccgcgtctatcacgaggaagtcttcggtccggtggccagcattctgcgcgcccgcgacgaagccgatgcgctgcgcctggccaacgacacgcctttcggcctgggcgccagcatctacagcgccgacagcgagcgcgcctggcaattggcccgccagatagaagccggcagcgtattcatcaaccgccacaccagttcggacctgcgcctgccattcggcggcgtcaaggcctcaggctatggccgggaattgtccgaattcggcctatatgaattcgtcaacgtgaaaacctactggcagaaatag

SEQ ID NO: 4174 - DNA, 1446 bp, Chromobacterium substugae
atgaaatctttgccgcgcaatgcccgtatccggggagagcctttcctgcccaaccgcttcattttcggcgacgccgtcgatgagcaagggttggaaggcgccgagtacctggtgcataccgagtcccccgccttcatctgcaggctggtgggcaatgacgataccgacttccccggccgcgaacgcgacggcttggcgagcgcggtattgttcgatgaggcggagaacctgaccgtctatgtctgcaatctgcgcttgcgcctgttcgatttcaatttctatggcgagatcgagcccagcgtcggtgagttgcaggaaatctgcgacgaggcgatgcggacctaccagaagctgcacaaggcttacgccgagcgcgacgccgccggcccggagccgcgcgagatgcgcaccggcccgaccaagcccttgccgccggccgagcgccagcaggctatcagccagttggtggacaaggcgcgccaggcggtgggcaagccgatggaaggcatgcaattggccgccgcggtgcagatggccttgatggccggcgaccaggcggtgttcaccgaggcgcagctttccttgctggccgagccggctgcgcgccagctgctggtggacagcgcgcgcgacgcggtggccttccccgaggtgatccgccaggatggcaccgtggtgtcgttcgagctgtgggcgctgccgttcgcgttttcgcgcagccaaggcggcgtgtggtggcatttcccgcggctggagcagctggaggtggcgctggccgacgcgctggaagtgccggagaaatcgatattgtggatttcgcccaccttgttcaccgtggacatgctcaatgagcgcgcctgccaggacatggtgcaactggcgcccatcatggatgccggctgcgatttcgcgccgctgaatcccgaagcttcgcgcgccacctacgaggctgcgcgcaagaccagcgagccgcaattggtgatggcctggattcccttcctggtggagcgcggcgcgctgccgccggaccgggcgcggcgcttggcgcgcaaggcgctggacgcgtcgatgccgctggtgcagcaggcgatcgccgccgaaatggaatacggcgaggccgagctgttcgcgccgctgccgtggtgggatgccttggccagcggcatgcacgcgtggaaccgcaagcgcctgggcgtgtcggcggccttgctggccaccagccagggcggcatagacaagctggaggcggtggccgaataccagccggaaatccagggctacgaagtggcgctgcgggtgaagggcagcgaagagatcgcggcgcgggtgccgtggctgctggtgcccgatgtggcgccggaccgtgacgcctgctggaaggatttgtccgactgcctgcgcgaggccggcgtgccgctgtcgcaaaacgtggcgcggctgcactag

SEQ ID NO: 4175 - DNA, 822 bp, Chromobacterium substugae
atgaacgcgcaggcctggccgcgggccgagtggcgggagctgtcggcagcccggaagcggaatgcgctggggctggcggttggcttgccgctgccggattgggcgggcgccgcgcctctgccgggcggcaccctggctggccgttactgccggctggcgccgctggatgcggcgcgccatggccgggatttgttcgatgctttgtgccggagcgaggaggcggccggctggacctatctgaaccaggggccgttcgcctgcctcgaggattggctggcctggctgcgcgggcagccggcgcgcgtcgacgcccgttactacgcgattgtcgatgcgggggatgggcaggcgcttggcctggccggttttctcggcattgcgccggcggatggctgcatcgagctgggcggcttgcatttctccgcgcgcctgcggcgcagccggctggcgaccgaggcgatctacctgatgctgcggcatgttttcgaactgggctatcgccgttgcgaatggcgctgcgacgcgcagaaccaggcttcgctgcgcgcggccctgcggctgggcttcacgtttgaggccttgtggcggcagcggcgggtggctaaggggcgcaaccgcgacgccgcctgtttttccatcatcgaccaggaatggccggcgcgtcgggcggcgctggcggcctggctgcgggaggacaattttgacggcggcggcgcgcaacgttgcactctggcgcagattgttgcaatgcaggagcgaaatcgcgccgcgggcttcatgccggcggtgggcggcgctacaatgggtgcctgtaaccgttga

SEQ ID NO: 4176 - DNA, 744 bp, Chromobacterium substugae
atgcttgctgatgcgcgccaattgatgcagccggccgagctcaatgcgctggggcagtcggtgggtttgccggtgcctggctgggatggcgccttgcatccgccgcggcgcacgctggccggcgcttgctgccgggtggagccgctggatgcggccaagcatgccggccagttgttcgatgccttgcaccagatgccgggcggcgccaactggacttatcttggccatggaccattcttggtcttcgaggactggctggcgtggttgggcgacaacgtcgaacgcgacgatccgcagttttacgccatcgtcgattcggccgacggcgtggcggtgggcctggccagctatctgcgcatcgccccggccgatggctgcatcgaggtggggtttctcaatttctcgccgcggctgcagcgcagccggcaagcgaccgaggcgatgtatctgatgatgcgcgaagcgttcgcgctcggctaccgccgctacgaatggaagtgcgacgcgcagaacgagccgtctatccaggccgccctgcggctgggcttcactttcgaggggctgttccgccaggcgcggaccaataagggccgcaatcgcgataccgcctggttctccatcctggaccacgaatggccggcgcggcgacaggcgctggagcgttggctggctgcggacaatttcgatgagcagggccggcagcgtcagtctttggccgacatcgccgctggcggcggcgcatga

SEQ ID NO: 4177 - DNA, 393 bp, Chromobacterium substugae
atgttgagtcaacaagcgttttacgccgccaagctggcgtatgagatcgatgccgccgacgtggcgcaggcgctggccagcggcgatccatccttggtgctgatcgatacccgcagcgccggcgcgcatgccgaggaaacgatacccggcgcgctcagccgcccgcaccgcctgatgaccgaggagagctgcgccgatctgccgcgcgatgcgacgctggtggctttctgcgacggcatcggctgcaatggctccaccaagggcgcgctgaagctgtcgcaactgggcttcaaggtgaaggagctgcagggcgggctggactggtggaaacgggacggctacgccacaacccgggacgccggttgcggcaaggaggtgtgcgatgcttgctga

SEQ ID NO: 4178 - DNA, 1455 bp, Chromobacterium substugae
ttgaactccgcctggatctgcgagtacctgcagccgcgcttgcgccgcgatggcggcgaccatctggcgcgccagctctatcggctgctgcgcgaactgatacgccagcgcaaactggccagcggcagcgcgctgccggcaagccgggcgctggccgccgatctggcgatcggccgcaataccgtactggcagcctacgatcagctggccgccgaaggttatctggaaagccgccatggctcaggcacctatgttggccaagccttcagcgccgctgccattcccctcgcgcagccccgcactcaaatgaggcaactatcggcgcgcggccaacgcctagccgaagccagccggctgcccaccggccgcctgggcgccttcgtgcccggcctgccggaactggagcagtttccgcatcggcaatggcggcaatgcctaagccggcggcaaagacaggcgccgctggaatggctgcattaccagcatcagggcggcttgccccagttgcgccgagtcctgagccaatacctgcacctgacccgctcggtcaactgcagcccggagcagctggtgatcacctcaggcgcgcaaaacgctttgacccttttagcccaattgctggccgagcccggcgacaccgcctggctggaagagcccggctacaccggcgcgcaggccgccatgcaggcggcggcgctgcactgccagccggtgccggttgacccacagggaatggtgctggatagcgccgcgccgccgccgcagctgatctacgtcaccccctcgcatcaatatccgaccggcgcggtgatgagcctgccgcgccggctggagttgctggcgctggcggcccgccacgacagctggatcatcgaagacgattacgacagcgaattctgctacacctccgcgccgctggccgcgctgcaagggctggatcaggacaagcgggtgatttatgtcggcaccttcagcaaggtgatgtttcccggcctgaagctcgcctatctggtgttgccgccggagctggtcgacccgtaccggcgctgccaggccagactgcagggcgaaagcaattatctgcagcaggccgccgtcgccgatttcatcgagcaaggccacttcgcgcgccacatccgcaatatgcgcgaactctatctgcgccggcagcagctgctgcgcctcgcgctgcaacagcatctgggcgacgcgctgcctctgcatggcggcgaagccggcatgcacctgttggcggatctgccacgggggttcgacgaatgggaattgcagcaggcggcggcagaacaacagctatggctgcgcccgctggcgcgccacttcctggaaatgcccgaccgcaacggcctggtgctgggctatgccggcatcgccgaccacaccatccacccggccgtgcgccaattggcagcgttattggagacaagactgaaatga

SEQ ID NO: 4179 - DNA, 507 bp, Chromobacterium substugae
atgaaaaaaccgcgcctgctggtcagcgcctgcctgctggggcagccagtccgttacgatggccaggccaaagccatggcccgctccgactgggaagccctgcgccagcgcttcgagatcgtcccggcctgtcccgaatgcctgggcggcctgccgacaccacggccaccggccgaaatccgtcatggcgatggcaccgcggtgttgcaagggctcgccagcgttcagacccgacagggccaggatgtcagccaggctttcgtaaacggcgctcgacgcgcgctggagatcgcgcgccgacaaggctgccaagccgccctcctcaaagccaacagcccatcctgcggcaaccttcagatctatgatggcagctttgccgccgtactaagcgacggccaaggcgtggccgccagcctgctggaacagcacggcatccgcgtctggaacgaaacccaaatgggagacttgcttgcatggcaggcaggcggctctctttccgcgccttga

SEQ ID NO: 4180 - DNA, 118 bp, Chromobacterium substugae; identical to SEQ ID NO: 426

SEQ ID NO: 4181 - DNA, 118 bp, Chromobacterium substugae; identical to SEQ ID NO: 426

SEQ ID NO: 4182 - DNA, 4563 bp, Chromobacterium substugae
atgctggagagcggtttgcgcaagcatcgggcgcggccggaggagctgttgctggcggccgcgctgttggcggcttgccgctggtcgggcgagagggcgcttactctgcggctggcgcaagatggccgcgcggccgacgccgagctggcggccacggtcggccagttcgatgtcgaacgcggtttgacgctggcgctggcggccggcgagcttgcgccgggggcggcgatcctggcggccaaggaaggctgccgcgcgcagacccaagagctgggcgacgctggccgaaccgcgcgcctggcattccgttacgacggcgatttcgacgcgccggcagcggcgcgcgccggcatcgcgcggctggcgctgccgaacgacgatgacgacgccggcgggccgccgttgcggctgcgcggcgagcggcgcgacggctgcttgcggctgacgctgagctgccgcgcggcggccgtgccggcgcaagggctggacgtgctggcggcgcggctggacgaggcgctgcgcgagctggcggagcactgcgccgacccggcgcaagccgccagcctgagtccgtccgacttccccggcctgggcctgacggcggccgaactggccggctggcggcaacgctttccggcgctggagcagttgagcccggccaccggcatgcagatcggcatggttttccacagccagttgcccggccatgccgacgcttataccaaccaggcctatctgaccctggagggcgagctggatgccggctggttccgcgaggcttggcgcatcgtcatcgaacgccacccggcgctgcgcgccggcttcgtcggtttcgagcgcgagcagccgctgcagctggcggtggcggcgccggcgctggactggcgcgaggaagacctccgcgggcaggcgccggacgcgttcgagcgctggcgccaggccgatcgccagacgccgttcgatttcgggcggccgccgttgatgcgcttcctgctggcgcgggtgggcgagcaaagccaccgtttttgctggacccatcaccacagcatcatcgacggctggagcgtgacgctggtgtgggacgaggtgttcgaggcttaccgcgccttgcgggcagggcaggaaccggcgctgccgccggcgccgtctttcgccgaggcggcgttctggcggcatggccagccgcgggaagagggcttgcgctactggcgcgagacgctggccggcatcggcccgcgcgcggcgctgcggatagagcagccgggcctgccgccgctgggcggcgaggcgtccaagtcgcggcgccggctgagcgagcaggcgacccgccggctgacggagatggcgcgcgccggccagacgacgctggccgcgacgatgcaggcggcctgggcgttgctgctggcgcattacagcggccagtccgacgtggttttcggcgtgacttcggcggggcggaccatcgatctgcccggcgtcgagcgcatcgtcgggccgctgatcaacaccgtgcccgcccgatttgcgctagaccccggcgccaggctgggtgactggctgcggaccgtgcgcgacatgcatctgctgcgcgaccggcatgccagcatcgacctgatcgacatccagcgccagagcggcctgcgcgccgaccagccgctgttcgacagcgtggtgattgtagacaactacccggccgccgattacggcgcggcgacggccctgcgcgtatcggaacgcggctacgccggagaaacccattacgggctcaccttgtcggtaatgcccggggcgcggctggccttcgacattgaatttgactcatcgcggtttcacaaaaaggacattgacgccatggccgataaactcgaatcggtgcttacccgcatgccccagaacctggccgagccgctgagcgcggcggtcggcgccgccgcgcgcgccgaagccgcaagcgacgccgccggcctcagcatggcgcggcgccagggcgacctgcggctgggacgggatctggtgccgcatctggtggaaaaccacgcccaggacacgccggagcagatcgcgctgatctgcaacgagcgcagctacagctacgaacagttgaaccgcgccgccaaccggctggccaatcacctgctggagcagtttccgcagttgggcgcggacagcctggtgggcgtgcgcatcccgcgcggggacaagctggtcatcgccatcctggccttgtggaaggccggcgccgcctatatcccgctcgaccccgtcctgccggcgcagcgggtgcgggacatgctggaaaccgccggcgcggcgttcgtgatcgccgacagcgtcgaggcggctgccgacaacgccgccgcgctgggtatgcgcgcggtgtcttacgacgccgtcgaacagttgccgggactggacgagcgcaatccggatgtgcacatctccggcaacgacctgagctacgtgctgtacacctcgggctccaccggcaagcccaagggggcgatggtcgagcatatcggcatgctcaacaacatcgtcaacaaggcgatcgactgcaaggtgaccgaatccagccgggtggcgcagaacgcgtcgatgagtttcgacgtgtcggtctggcagatgttcatcgcgctggcgcgcggcggcgccaccgtggtgtacgacgatcgcgcggtcaacgatgtcgccggcctgctggcgcggctcgccgccgaccgggtcaccgtgctggaagtggtgccgacctatctgtcggtgctggtcgagcatatcgaggacaagcacccgggtgggctggcgctgagcgtccagtaccttttggtgaccggcgagacgatagaggcgtcgctgctcaagcgctggttcaagctgttcccgcacactcacgcggtgaacgcctatgggccgaccgaggcgtcggacgacatcacccatcacctgatgtcggcgggcgatgcgctggagaatccggtgccgatcggccgcgcgctggccaacttcgacgtgtacatcgtcgacgacgaattgcggccgctgccgtacggcgagatgggtgaaatcgtcgtcaccggcgtcggcgtcggccgcggctacgtcggcatggccggcgccaccgcgcaggccttcctggacagcccattcccggacaagtaccgcggccggctgtacaaaaccggcgacctgggcgtgatgcggccggacggcgtgctgctttatcacggccgcaaggacaagcaggtcaagatccgcggcatgcgcatcgagctggaagacgtggagctggcgctgcaggccttgccggcggtgcggcaggcggcggtgctggaaatccgcccggcggggcgcgaggctttcctgtgcgccttcgcggtggcgcgcgccgacggcgagcgcgaagccatcgtcgccgaactgaaggaaaaactgccgccctatatggtgccgtcggtcttccgctttgaaagcgagctgccgcagctgcccagcggcaagatagaccgccgcgcgctgctggccggttacgaagagacggcgccgcgcgccgcctgcgtcgagccgaccaacgaggtcgagcgccggctggcggatatctggcgcgaggtgatcggcagccaggccataggcatcagcgacgacttcttcgatgtcggcggcgactccttcaaggcgatccgcatcgcggccaagtacggcgcgccgctggaggtcacccatctttacgactacccgacgatagcggcactggccgaacatctggccgggctggacggcgacgcgcaaaagacgctgacgccgatcgccggcgatccggtgcaagccgaggcgatgctgctgtgcatcgccaattcgggcggcggaccggtcagcttcatcgagatgggccgggcattctccgccgctggcgtgccgttggcggcatgcgcggtgaacctgccgcgcaacgaggtggacgacgatgccgcgatggtggcggaggtggagcggctggcggcggaggtctgcgacgaattgggccggatgtcgtctttgccgctgatggtgttcgcgcagtgcaacggttcggcgctggcgctcggcgtcgtgcgcgaatggaagcggcgcggcgccgacctgcgcgcgctgtgcataggcggggccttgctgcgcaccgagccgacgccgaaggatgtgcgcagcgacgagcagatcgtggcctttctcggctccatcggctccacgctgccggccgaggccgacgagcgggcgttcttcctgcacgacttcagctacgactgccacatggcggacagctactacaaccacttggtgcgggagcgggccgctgaggccggcgagcgcatcggcgcgccggtgttctgcctggtgggcaccgaggaccccatcgtgtccggctacgccgagcgttatcgcgactggggcctgctctccgacgaggtgagcctgatcgagtatccgggcatcggccattacctgctgcgcgattgcccggccgaactggccgcctcgctggccgacatctggcgccgcgtcggcggcaaggaggcgagaaatggccgctga

SEQ ID NO: 4183 - DNA, 783 bp, Chromobacterium substugae
atggccgctgagctgccgaaactggcattcgtgcatattccccgcaccgccggcaccgcgttcggccatgctctggaccagctgtaccagggccgccggacggcgaagttctacgccgacgaggaggtcaaggtggccaatggcaagatcgaggccttctgccggctggatggcgcggacaagcagggcttcgatctgctgcgcggccatttcgtccacggcttcgacccggcgctgcgcggcttcgactacgtcgcgctgctgcgcgagccggtgcggcggctgatttcctattacttctacgcgctgaaggacaagcgcaactacctgcattcctatctgctgaagcggcggctgggcctggagcccttcctgctcagcgacgccagcatagacctggacaactaccaggtgcgggcgatatcgggcgcgcaattcgcctcggtgcgcgaaccggtgtcgcagcagcattgcgacgaagccaagcgcaagctggccgaggagttcgccgccttcggcttgaccgagcgcttcgacgagtcgatggcgcgcttcgcgcgcaagttcggctggaacttgccggcgcccggcaagatgaacgccggcagctacggccccgaactggagctgtcggccgcctgcagggagcgggtgctggagaagaatcgtttcgacgtcgagttgtaccagttcgcctgccgcctgttcgaggccggcggcgcggcggcggaacaggccgggatacccattgcacaggagaggacagaagatggctacgcttga

SEQ ID NO: 4184 - DNA, 870 bp, Chromobacterium substugae
atggctacgcttgaaattcgcccgctcagcggcaccataggcgcggaagtgcgcggctgcgacgtcagcctgacgccgtcgccggagttggccggcgaaatccgccgcgcgctgctgcaatacaaggtgctgctgttccgcggccagccggccttgtcgatggcgcggcagatcgccttcgcccaggctttcggcgagatcgagaccgagttcccgtcgttcgcgcccaaactggccgagaacccggaaatcacgctgttcgacagccgcaacggcagcggccgcgccgaaatgtggcataccgacctgacggtgtcggagacgccgaccgctttcggcgtgctgtgcgtgaaggagcgtccggcgcgcggcggcgacacgatgtgggcggattccgaggccgcctacgcctcgctgtcgcccggcatgcgcgcctttctggaaggccagcgcgcggtgcacgacatgtactcgccggagtacgccgcgcggccgggcggcaacaagcgcaccgatctcgacatgtcgcggatttcccgcgccgagcatccgctggtgcgggtccatccggaaaccggccgcaaatgcctgttcgtcaatcccttcttcacgtcccacatcgtcggcttcagttcggaagagagcgccaacatcctcaacttcctgtacgcccggatggagcggccggagttcatcgtccgctggcattggtcggaaggcgatgtcgcgatgtgggacaaccgctgcaccacccacgtggcggtcaacgactacggcgacgcgcatcggctggcgcagcgggtgtgcgtgaagggcgacgcgccgttcggcgtgggcgaagcccggcgcgccgcgctggaaacggcctga

SEQ ID NO: 4185 - DNA, 888 bp, Chromobacterium substugae
gtggttttcactcacttcaatatgggtagcaagatgtcgaaccaagcaggcgtggcagtcgttgacttcaatggatcgatattcctcgaatccagcaatgtgcgggcgcaggccaatcggttgaattggcgctccgaggtgttgatgggccgcaaccccgattgtttcaagggcaagcgcgtgctcgacctggccagccatgacggccgcttcatgcacgcggcgctcaagcacggcgccagcaaggtgataggggtggaggcgcgcgaagagcacgtgatccacgcgcgccacaatctgagccgcgccggacacgcgccggacagctaccaggtgctgtgcggcgacctggtcgagcacctgaagcagatcgagaccggttcggtggacaccgtgctgtgcttcggcgtgttcagccacctgatcgagcaggtggagatcattcgcgagatccgccgcatcgcgccgggcgccttcattctggacacctgggtggcgaaggagcagtggaacctgcgcgagcggctgcgcaaccacaaggtcaacctgtgggtgcgcgacacccagcagggcggcgaccgcggcctgtccttgctggcgcgcttcaagcggctgatggccagcgtgttgccggggccgggcagcaaggtgggcagcatggtgctgctgtacgaggacccgcaggcgccgggcgcgacggtgcgccccagcgggctgatggcctgggccaaccgctcggcgctggaaatgctgttcgagcactttggcctggagcatgcgcgggtggactggatggcgcagcgggtcagcgactggaccgacctggaagactaccgcaacggctcgcgcgagagctgggtggtgcggccgggacgccgcgcgtcctga

SEQ ID NO: 4186 - DNA, 999 bp, Chromobacterium substugae
atgagaaagatatacctgcgccgcgtgagcggcgtgacgcatggcgagagcaccaggatggtgcggccggacgatttcgccagcgatatcgtcgccgcggtggatgcggcggcgcagatagaggacttcggccgctacctgccgctatgcgtggactggcgcgccgagcgcctgcgctacagccgctgggaggacgcgtcgccgctgtcggacgcgccgttcctgtaccagcggcagcgacggcaggcggccatgctggccgacatcccgttcgagcggctgcctgaactgggacaggccgaaggcatgacgccgaccttcatcttctcgatcggccgctgcggctccacgctgctgtccaggatgctggccgcggtcggcgagcaggcggtgtcggagccggacgcgctgaccaatatcgccctggtcgacaacgccgaacagggccggcaggcggccgaggcgggcgagctcatcgtgcgcagctgcgtcgaggcgttgcgccgcgcctgcggcccgtcgccggtgatcaagctgagggcggtgtgcaatctggcggcggcggcgtttgtccgcgcgctgcccaacgcccgctatgtgttcatgttccgcgggcgggaggactgggtgcgttcctattcgcgcgcgttcggcgacagcgcggccgagctggaggccctgctgcggcagtcggcgcaggcgtttcagcacctgcgcgcggccggggccgagccggagctggtgtggtacgaggacctgctggccgacccggccgccgcgctgcggcgcatcttgccgcaccgcgccgacctggcggcgttcgaggcgccattggcggaggccttgcgcgccgacgcgcagcaaggctccatcctggcgcgctcgacgctggcggcgcgcccggtggcggatggcatcgtcgaggagttcgaggatttgtggcggcagtcgcggccggagggcttgttgcgggaggcggggctcgcgcgcctgctgtga

SEQ ID NO: 4187 - DNA, 74 bp, Chromobacterium substugae
ggcgaattagctcagtcggttagagcgacggaatcataatccgcaggtccggggttcgagtccctgattcgcca

SEQ ID NO: 4188 - DNA, 74 bp, Chromobacterium substugae; identical to SEQ ID NO: 4187

SEQ ID NO: 4189 - DNA, 1158 bp, Chromobacterium substugae
atgagcaccctacccgccgccagccccgaggcgctggccatcagccaggccctgagcggccgcatcagccaggccatcgccgacgccggcggctggatacctttttcgcattatatggaactggcgctgtacgcgtcgggaatgggctattacgccgccggcagcagcaagctgggcgaggccggcgacttcatcaccgcgccggagctgacgccgctgttcggccaggcgctggcgcgccagctggccgagctgctgccgcagaccgccggcgcgatctacgaattcggcgctggcaccggcaagctggcgatagacgtgctcgccgagctggaggcgctgggctgcctgccgcaaaaatacgtgatcctagacctgtcgccggacctgatcgagcggcaacggcaaaacatccgcgccgcgctgcctcacctggccgaccgcgtcgaatgggccagccgcctgccggacgcgatcgacggcgtcgtcatcggcaatgagctgctggacgcgatgccctgcgaaatggtgttccgcgatgaaagccgccggctgcgccagcgcggcgtcaccgtccgcgacggcgcgctggcctacgaggaccgcgacttcgccgacgcccggctggccgagctggccgcgcaactggtgccggacattccgcgctacgaaaccgaaatcagcctggccaaccgcgccttcgtcgccaccgtggccggcgcgctgagccgcggcgccatcctgctgatcgactacggccacgccgcgtccgagtactatcacccggagcgcagcatgggcacgctgctgggccactaccgccaccacacggtgcaggacccgttctacctgcccggcctgatggacctgacctgccacgtcgacttcagcgcggtcgcgcaaagcggcctcgacgccgggctggacctgataggctacgccagccaggcgcagttcctgcttaactgcggcatcgtcgaggcgctgcagcggctggatcccaacgacgtcaaggcctacctgccggtggccaaggccgtgcagcggctgctgtcgccgcaggaaatgggcgaaaccttcaaggcgataggcttcggcaagggcgtggacatagactggcagggcttcgcccgcggcgaccgctgctacacgctgtga

SEQ ID NO: 4190 - DNA, 759 bp, Chromobacterium substugae
atgctgacagagcgacaacaagatgagcgcgtgattctggtcaccggcgccgcgcgccgggtgggggcgggcattgtcaggctgctgcatgcgcgcggcttgaggctggtattgcactaccgcggctcgcaggccgatgccgaggcgctggcggcggaattgaacgcggcgcggcctggcagcgccaagctggtccgggccgatctgctggacaccgcggcgctgccggagttggcggcgcgcgcgctggcggcgttcggccgcatcgacggcctggtcaacaacgcctccagcttttccccgaccgaggtcgggcggatagacgaggccgcctggcacgacttgatgggcagcaatttgaaggcgccgctgtttctcagccaggcgttggcgccggagctggcgcgccgcggcggcgccatcgtcggcatcgccgacatccatgcggagcggccgatggcgcgccacgtggtgtacaacctggccaaggccggccacgcccagttgatccgcagcctggcgatagagctggcgccggcggtgcgcgtcaacggcgtggcgccgggcgtcaacctgtggccggaagacgagacgtcgttcagcgccgaggcccgcgccaggatagaggaaaccatccctttgcggcgcgccggcgtgccggaagacatcgcccgggcggtggctttcttgctgctggacgcgacgtatgtcaccgggcagatcctggcggtggacggcggccgcggcatcgtgttgtga

SEQ ID NO: 4191 - DNA, 972 bp, Chromobacterium substugae
atgtccgaactgaacgccgcgctcgacgacaaggccaagaaggccgcgtttgaaggcaacaaactggccaagcgcctgcgccaccatgtcggtgacgccatcaatgatttcaacatgatcgaagagggcgaccgcgtgatggtctgcctgtcgggcggcaaggacagctacaccctgctcgacatcctgctgggcctgcagaagtccgcgccgatcgacttttccatcgtcgcggtcaacctcgaccagaagcagccgggcttccccgagcatgtgctgccggaatacctcaagtccatcggcgtcgaataccgcatcgtcgaggaagacacctattccatcgtcaagcgcctggtgccggaaggcaagaccacctgcagcctgtgctcgcgcctgcgccgcggcatcctgtaccgcgtggcggacgaactgggcgccaccaagatcgcgctgggccaccaccgcgacgacatcctgcacacgctgttcctgaacatgttctacggcggcaagctgaagtccatgccgcccaagctggtgtccgacgacggccgccacatggtgatccgcccgctggcctactgccgcgagaaggacatcgaacgttacgcccagctgcgcgaattcccgatcattccgtgcaatctgtgcggctcgcagcccaatctgcagcgccaggtggtgaaggagatggtcaacgactgggacaagcgtttccccggccgcgtcgagagcatgttccgcgcgctgcaaaacgtcgttccgtcgcatctggccgacaccaagctgtacgatttcgcgtccttgacgaccggcgacgcgccgttcgccggcggcgataccgccttcgacaaggaagagttccgcgatccggcgccgcacgaggacgacgcggccgaggccgcgcccaagaagcgcaccatcagcattctcgactcgcgcaagccggagggcagcggctgtggcgcgtag

SEQ ID NO: 4192 - DNA, 801 bp, Chromobacterium substugae
gtggcgcgtagggcgctgcacccgttccgccgccgcgtgaggccggcggtggaggcgatgccggaggtggaaatctcggaagagggcaatatccgctcgctgcacctggggtcggaaaccatccaaagctcgatggatctggacgatccgccggagctggtgctcagctacagccgcgcgatgatgggtttcctgctgtggaacgacgatcccaagcatatcctgcagatcggcctgggcggtggatcgttcgcccgcttcatcgacgaatacctgccggacgcggtcagcgtggcggtggatatcaatccgcaggtgatcgcggtggcgcgcgccttcttccagttgccggaggagggcgatttcttcgagatcgtcgaggccgacggcgccgactatgtgaaaattttccgcggctccaccgacgccatcctggtcgacggtttcgacggcctgcagatcgtcgacgcgctgaccaccgaggacttcttcgaggactgcaagcgggccttgagccccaagggcgtgttcgtcaccaactggtggagcggcgacaagcgctatcaggctttcatcgagcgtttgttgaacgttttcgagggccgggtgatcgaactgcctgcggccacccatggcaatgtcgcggtgatcgccttccgccagagcccgagcctgacgcagtgggaggcgctgaaaaagcgcgccgacgagctggaatatcgcttcggcctggagttcggcgagttcgtcaaccgcatcaagcagaccaaccagcagaccgccggccacttgctgatctga

SEQ ID NO: 4193 - DNA, 1308 bp, Chromobacterium substugae
gtgatcaagcagcaactgctcaatcgtatcgcggacaaatccgctgtgatcggcatcgtgggcctgggctatgtcggcctgcccctgatgctgcgtttcgccgaagtcggctacaaggtgctgggtttcgacatcgaccagagcaaggtcgatgccctgatggccggcaaaagctatatcgagcacatttccgccgacagcatcgccaccgcgctggagcgcggcttcgaggccaccaccgacttcagccgcgtgccggaagccgataccctgatcctgtgcgtgccgacgccgctgaacaagtaccgcgagcccgacctcagcttcgtgctggacaccatggacagcctggtgccctacctgcgcgaaggccagctggtgtcgctggaatccaccacctacccgggcaccaccgacgaagagctgctgccgcggatggagtcgcgcggcctgaaggtcggcgacaacgccttcctggtgttctcgccggagcgcgaggatccgggcaacccgaacttcaccacccgcaccattcccaaggtgtgcggcggcgtgaccgaggcctgtcaggaaatcggcgtcgcgctctacagcgcggtgatcgacaaggtggtgccggtgtcgtccacccgcgccgccgaaatgaccaagctgctggagaacatccaccgcgcggtcaacatcggcctggtcaacgagatgaagatcgtcgccgacaagatgggcatcgacatccacgaagtgatccgcgccgcggccaccaagccgttcggcttcgtgccctactacccgggcccgggcctgggcggccactgcatcccgatcgacccgttctacctgacctggaaagcgcgcgaatacggcgtcaacacccgtttcatcgaactggccggcgaagtgaacagcaatatgcccgactacgtggtgtccaaggtggccgccgcgctgaaccagcgcaagaagtccatcaacggcagccgcgtgctggtgctgggcatcgcctacaagaagaacgtcgacgacatgcgcgagagcccgtcggtgttcctgatggaaaaactgcgcgacctgggcgccgaagtggcgtacagcgatccgcacgtgccggtgttcccgaagatgcgcgagcacaagttcgacctgaagagcgtggcgctgaatgccgaaaccgtggccggctacgactgcgtgctgctggccaccgaccacgacaagttcgactacgcgatgctgaaggccaacgcccagttgctggtggatagccgcggcaagtacctggagccggccgggcacatcgtcaaggcctga

SEQ ID NO: 4194 - DNA, 582 bp, Chromobacterium substugae
atgtggcagcgctttccccgtctgggcgcgtggctggcggcagtgggcggcatcgccctgctggccgcgctggcgctggcgccgctgatccgctattccaagaccctgctggtggcggaaacgccgcagcagcgcgccgactggatcgtggtgctgggcggggagagcgggcaaagggtaatcggcgcggcggaactgtttcatcagggccgcgcgccgttcgtgtttgtcagcggcgagggcgattgcaggctgatcgtcaagcggctggtgatggcgggcgtgccgcgctcgcgcatcggctacgagtgcctgtcgaaaagcacttaccagaacgcgcagttcacccggcattacctggccgcgcagcaacccaggcgcatcacgctggtgacctcgtggttccattcctggcgcgcgctggaaaccttccgccaggcctggcccggcgtggagtggggcatgcacgcggtgtaccccggcgacgacctgtaccacagcctggcgctcaatgaagccggcgcggtgctgtccgaatatttgaagatactggtgtattcagtacgttactggactttctga

SEQ ID NO: 4195 - DNA, 1053 bp, Chromobacterium substugae
gtgactcctccgattaccgatcgcaagatccgcttcgccctggtgggctgcggccgcatcgccaacaaccacttcggctcgctggaaaagcacgccgaccgcgccgagctggtagacgtctgcgacatcgacccggccgcgctgcgggccgctgtcgagcgcaccggcgcccgcggccacgacaacctcaccgcgatgctggcgcagaccaacgccgacatcgtcattctcaccacgccgtccggcctgcacccgcgccagagcatcgagtgctcggaagccggcttccacgtgatgaccgaaaagccgatggccacccgctgggaagacggcctggaaatggtcaaggcggccgacaaggcgcagaagcacctgttcgtggtcaagcagaaccgccgcaacgacacgctgcagctgctcaagcgcgcgatgacggaaaagcgcttcggccgcatctacatggtcaacgtcaatgtgttctggacccgtccgcaggagtattacgacgcggccggctggcgcggcacctgggaattcgacggcggcgccttcatgaaccaggccagccactatgtcgacctgctggactggctgatcggcccggttgagagcgtgcaggcctacaccgccactttggcgcgcaatatcgaggtggaagacaccggcaccgtcagcgtcaagtggcgctccggcgcgctgggcagcatgaacgtcaccatgctgacctacccgaagaacctggaaggcagcatcaccatcctgggcgaaaagggctcggtgcgcgtgggcggcatggccgtcaacgaaatccagcactgggaattcgccgagccgcacgcgatggacgacgaaatcaagaacgccagctacgcgacgaccagcgtgtatggcttcggccacccgctgtactacgacaacgtgatcaagaccatgcgcggcgaagccacgccggaaaccgacggccgcgaaggcctgaagtcgctggagctgctgatcgcgatgtacctgtcggcgcgcgacggccgccgcgtcagcctgccgctggattattga

SEQ ID NO: 4196 - DNA, 531 bp, Chromobacterium substugae
atggctgaagagaaaaaagaaccctggcttaactatttggcgctcaccacggtgatactcgcggtgtgcgccacgctgtcgaccttcaagggcggcggctattccacccgcagcgtcatcgcccaggcccaggcatcggaccagtgggcgtattaccaggccaagggcatcaagggcaatctgtacgagatggagcgcgaccggctgcagttcgagcgcgacaacctgccggcgggcgatgcgcagcgccggcgctacgatgcggccatcgaccaggcggccaagcgcgcggagcgctacagtgcagagcgcaaggcgattgaaaagagcgcccgccagctggaagacgagcgcaaccaggcgcagcgccagggcaagccgttcggcatggcagtgatcttcctgcaggtggcgatcctgatttcgtcgatcgccggcctgttcaagcgcaagcgcatctggctggcggcgctgccggtggccggcctcggcctggtgtatttcgccgacggctttttcctgtttttctga

SEQ ID NO: 4197 - DNA, 567 bp, Chromobacterium substugae
atggaatacacggtccatagctccgccatcgtcgacgaaggcgcgcagatcggcgcgggcacccgcgtctggcactgggtccacatctgcggcggcgccaggatcggcgccggctgttcgttcggccagaacgtgttcgtcggcaacgacgtgctgatcggcgacaacgtcaaggtgcagaacaatgtgtcgatctacgacgcggtgacgctggaagacgacgtgttctgcggcccgtccatggtgttcaccaacgtcaacaatccgcgcagccacgtcaaccgcaagaacgaataccgccgcaccgtggtgaagaagggcgcgtcgatcggcgccaacgccaccatagtctgcggccacaccgtcggcgagtacgcgttcatcggcgccggggcggtggtgacgcgcgacgtgccggcctacgcgctgatggtgggcgcgccggccaagcgcatcggctggatgtgcggctgcggcgagcgcctgcccaacgacatcggcacccattcctgcgcgtcttgcggcatccattacgaagtcggcggcaatcactgcacgccggtgtga

SEQ ID NO: 4198 - DNA, 1098 bp, Chromobacterium substugae
atgtccatccagtttattgatctgaaagcgcagtaccagcacctgaaggccgacatcgacgcgcgcatccacgcggtgctggaccacggccagtacatcatggggccggaagtgaaggaattggaggagcaactggcggcctacaccggcgccaagcacgccatcggcgtctgcgacggcaccaaggcgctgctgatcgcgatgatggcgctggacatcggtccgggcgacgaagtgatcaccacgccgttcaccttcatctccaccggcgagatgatcgcgctgttgggcgccaagccggtgttcgtcgatatcgacccgatcagctacaacctggacccgaacctgctggaagcggcgatcacgccggccacccgcgccatcatgccggtcagcctgtacggccaggccgccgatttcgccgccatcaacgccatcgccgccaagcatggcatcgcggtgatcgaggacggcgcgcaaagcttcggcgccagccagcatggcaagaagtcgggcaatctgtccaccatcgccaccaccagcttcttcccgagcaagccgctgggctgctacggcgacggcggcgcctgcttcaccaacgacgacgcgctggcgaagaagatgcgcgaaatccgcatccacggccaggaccgccgctaccaccacccgtccatcggcatcaacggccggctggacaccatccaggccgcggtgttgctggccaagatgcccagcttccccgacgaagtggccgcgcgcgagcgcatcggcgcgcgctacagccagctgttgaaggatgtggcccgggtgccggtggtcggcgcgggcaacacccacgtctacgcccaatacaccatagaagtggacgaccgcgacgcggtgcaggcgcgcttgaaagagctgggcgtgcccaccgccgtgcattacccgattccgctgcacctgcagccggctttcgcccacctggaccagggcgagggcagcttcccgctggccgaggccgccggcaagcgcgtgatgagcctgccgatgcatccgttcctgacggaagccgcgcaggacgccatcgtcgccgcggtgaagcaggcgctgggttga

SEQ ID NO: 4199 - DNA, 1272 bp, Chromobacterium substugae
atgctgacgctggcttccctgcgcatgcctaaaagcggcttcatccgccacatcatcaccctggtcaccggcgccgccgtggcccaggtggtgccgctgctggcgtcgccgctgatcacccggctgtacaacccgcacgaggtgggcatccagaccgtgtacgtgtcgtggatgtcgacgctggcggtgctggccaccgcccgttacgaaatggccatcgtgctgccggccgacgagaagcgcgccagcaacctgatgggcctgtccttgctgtgcgccagcgcgctggccctgctgatcggcctggtggtgctgctgggcgggcattcgcacatcgccgcccatctgggggcgccggagctggagtcctggctgctgttgctgccgctgtcggtatggctggccgggctgatgcaggcctggaccaactggaacaaccgccaccgccgctaccaggccaacgccaacggccgcatgacgcagtcgctgggcatggccggcacccaggtgctggccggctggctgggcgccggcgctggcgggttgatcctgggccagctggcggggcagctgggctcgctgctgtcgcaagcctgggccgacttcaagtcgcgcatgccctggcgccgcgagctcagccgccagggcatgcgcgaggccgccgccgcctatatcgagtttcccaagatcaacgcgccgcacgcgctgagcaccgcgatgctggattcggtcacgctggtggtgctggcgatgctggccagcacctcggccgtcggcttttacgggctgatgatgcgggtgctgaagctgccggcggcgctgatcggccaggcggtggcgcaggtggcctaccgcgagctggccgaggcgcggaacctgggcaagcccttgcgccccatcctgcgcaagatgatgctgacgctgtttggcatggcgctgtttcccttcctggtgatccagatcttcggcgagccgctgttcacgctggtgttcggccacaattgggccgacgccggccgctacgccgaggcgatgtcgctgtacatcctgttccacttcgtcgcctcgccgctgggcatggtgccgccggtgatcaatcgccagcgcttcgcgtttttcctgtccctggtgcaggccgtgctgttcctgggatcgctgtggctgggtttccacatctggcaggatgccgtacccactttccagctggtgtcggtggtgatggccggctatttcattgcatatttcacctggctttataaggcagctcgatga

SEQ ID NO: 4200 - DNA, 582 bp, Chromobacterium substugae
atgaactggaatggatttttcagccgcatccgctttcggctgtcggcgtgggtgcggccgcggatggtgtacggcttccagcgcggcgacggcgttttcctcaagcgcacccgcgtctccaacatgacgcggatcgaacatatcgacaagctgatggtcgaggacaatgtctatatcggccatttcaacctgatcgactcttccggcggcctttacatcggcgagggctgccagatcaccaactacgtgtctttgctgacccactccagccatgtcgccatccggctgtacggccgcgagtatctggaccgcgacaaccacgccggctacctgaaaaagcccaccaagcttggcaagtacagctttgtcggcccgcattcggtgctgatgccgggcgtgacgctgggcaagggcagcatcgtatcggcgtacagcttcgtgccggccggcgagtatccggatttcgccatcctggccggcaatccggcgcgggtggtcggcgatacccgcgacatggacgccgaatggctggcgcagcacccggacctgcatccgctgtacgaggcctgggccgatgagtga

SEQ ID NO: 4201 - DNA, 1092 bp, Chromobacterium substugae
atgagtgaagcgatacgccgcctgctggtggtgggctcggcctcggtgcatacctggcgcttcctcgccggcatcgcgccgcacgtgggcgaaatctacctggcctgcaacggcgagccgccggcggacaagtgcccggccaatctgaagggcgagctgcgcgtcgatttcagcctgaaggcgctgggaagcgccggcaagctcaaggcctggatccagcagatccagccggacgtggttcatgtccaccaggccaacagcgtggcctggcacgcgcgccgcgcgctggcgggctcggacgttccgacgctgctgaccgcctggggctcggacgtgctgctgctgccgcggcagaaccggctgctgcgcgcgatggtgcgcggcaacctccaggccgccgccgcggtgacgtcggattcgctgtacatggcggcgcaaatccgcgagctggccggcgactgccgcatcgcgctgctcaattacggcatagacgcgctgccgccggaacccgctgtcgccgccaagaaaaagcaggtgctgtcctgccggctgcacaagccgctgtaccggatagacgccatcctcaagggctgggccgaagtggagaggagcggccgctgcgccgactggaacctggtggtcgccgccagcggcggcgagaccgacaatttgaaacaactggcggcggcgctggggctcaagcgggtcgagttcgccggtttcgtcgacagcgccactctgggcaagctgtacgccgattcccgcgtgttcgtcagcgtgccgcgctccgacgccaccagcatcagcctgctggaggcgatgggccatggctgcctgccgctgctgtccaatctgccggccaacggcgaatgggtgatagacggcctcaacggcgccatcgccgaggacgtgagccggctggggccggaactgctgcgagcgatggcgcaagccgaagacgacgccgccctgcaaagcctggcggcgaccaatcgcggcctggtggcggccaaggcgctgcaccaggccaatatggccggtttcgccgatctgtaccgcgagctggccgccgacaagggtagaaaaatatga

SEQ ID NO: 4202 - DNA, 1110 bp, Chromobacterium substugae
atgaagatagcccatctgacctccgcccatccgcgccacgacatccgcatcttcgtcaaggagtgcagctcgttggcggcggccggccatgaggtgaccttgatcgtcgccgacggccagggcgaggaaatccggggcggcgtgcgcatccacgacgtcggccccaagaccggcggacgcctgtcgcgaatgaccggcaccgtcaagcgcgtctaccaggccgcgttgaagctgcgtccggacgtggtgcatttccacgatccggagctgattccggccggcgtgcgcctgaagcaggccggcatcaaggtggtgtacgacgtgcacgaggatgtgccgcgccagattctggccaagcactggatacccggcgcggtgcgcccgctggtgtccggcggcttcgagacgctggaggactgggcggcgcgccgcttcgacgccatcgtcacctccaccccgcacatccgcaaacgcttcgagaagctgggggccaatgcgctggacgtgtgcaacttcccgatactggaagagctggtgcgcgacacgccgtgggaaagccgccgcaacgaggtgtgctatatcggcggcatcagccgcatccgcggcatcgaacccatcgtcgccgctttgccgggcaccgccacccggctgaacctggccgggccgtggagcgagagcgatctgcgcgccaaggtgcaggccgagcccggctgggcgcgggtcaacgacctgggcgtgctggaccgcaagggcgtggccgaggtgctggcgaaaagcaagatcggcctggtgaccttgttccccacgcccaactacgtcgacgcgctgccgatcaagctgtttgaatacatggccgccggcatgccggtgatcgccagcgacttcccggtgtggcgcgagatcgtcgacgacgccggctgcggcgtgctggtggacccgcaggacgccgcagccatttccgccgccatcaacgaactgctgggcgacgaggcgcggatgcgcgcgctcggcgaagccggcaagcaggcagtgctgggcaaatacagctgggcggccgaggcggaaaagctggtcggcctgtaccgccagctggaaggccgcgcgcaatga

SEQ ID NO: 4203 - DNA, 432 bp, Chromobacterium substugae
atgacgtggcgtaccgccgcgctgagcttgctgttggcgctgccgttgggcgcgctgatggcggcgatcaactggcaattcaagggcacgcccttttccgcgcagacggtatggctgcacagcctggtggccttgctggcggcggcgccgctgttggcgcagagcgtctggctgcgaagcatgctggccagcggtcgctggccgcaagtggcggcgggcgggcaaatgcgctttttgctgctgcatggggcgataggccggggcggaccgatgctggctttcgtgctgggtatggagtggctgggcagcgggcgtttgccgttgttgaacggctcgctgttcaccctggcgttctggatggccttcggcgcctatttcgccagccgcgactggcggcggctgcaacgcgccgcaatggaaaacaagcaatag

SEQ ID NO: 4204 - DNA, 1230 bp, Chromobacterium substugae
atgcgcattctctacatcaatcactacgccggcagtccgcgccacggcatggaattccgtccctattacctggcgcgcgaatgggtgcaggccgggcacgaagtcaacatgctggcggccgacgtgtcgcacctgcggcagactcatccgcaagtggacggcaagtaccgcgacgaggacatcgacggcatccgctacacctggtgcaagacccgcccctacgcaggcaacggcttgggccgggtgttgaacatcttcagcttcctcgccaaggtgatgggcctgtccggccgctatttgaaacagtggaagccggacgtggtgatcgcctcgtctacctatccgctggacaccatcccggcggcctggatcgccggcaagaccggcgcgcggctggtgtacgaggtgcacgacctgtggccgctgacgccggtggaagtgggcggcatgtcgccgaaacacccgttcatccgcctgctgcagtgggcggaggacttcggttacagaaaagcggacaccgtggtgtcgatgctgccctgcgccagggactacatgatggcgcatggcatggtgccggaaaaatacgcggtgatccccaacggcgtggatgtgggcgaatggcagggcgaggcgcagcctttgtccgccgagcaccggatgcggctggcggagctgaagtcccacggccgcttcatcgtcggctacgccggcggccacggcctggccaacgcgctggattacctgctggaagcggcggccttgatgcaggacgcgccggtgactttcgtgttggttggcgacggcccggacaaggcagcgctggtggcgcgcgccgccgagctgaaattgaacaatgtgatgttcctgcccgccatcgccaagcgcagcgtgccggccttcctggcagaatgcgacgcgctgtacataggctggcgcaagctgccgatctaccgtttcggcatcaacccgaacaagctgttcgactacatgatggccggcaagccggtgatccactcggtggaggccggcaacgacatggtgaaggatgccggcgcgggcttgagcataggcgtggaagacccagccgtcatcgccgacgcggtcaaacgcatggcggtgctgcccttggccgagcgcgaagcgatgggcgcggccggcaaggcctatgtgctggccaaccacgattacgcggtgctggcgcgacgctttctggcggcggtgaagctgtga

SEQ ID NO: 4205 - DNA, 1164 bp, Chromobacterium substugae
atgagcgaacagaaatttttgccgtttgccttgccggacatcggcgaggaagagatcaacgaagtggtcgacgcgctgcgttccggttgggtcaccaccggccccaagaccaagcagttcgaggctgacttcgcgcaattcctcggcgacggcgtcgaggcgatcgcggtgaactccgccaccgccggcctgcatctggcgctggaggccatcggcatccgcgagggcgacgaagtgatcgtgccgtcctataccttcaccgccaccgccgaagtggtgcgctatctgggcgcgcacccggtgtgcgtggacgtggacgcggccaccttcaacatccgcccggacgccatccgcgcggcgatcaccggcaagaccaaagccattatcccggttcacttcgccggcctcgcttgcgagatggacgaaatcatcgccatcgcccgcgagcatggcctgaagatcgtcgaggacgccgcccacgcgatgcccacctactacaagggcaagctggtgggcacgctggattccgacgtgaccgtgttcagcttctacgccaacaagaccatgaccaccggcgaaggcggcatggtggtgtcgaagaacaaggacatcatcgcccgctgcaaggtgatgcgcctgcacggcatcagccgcgacgccttcgaccgctatgtgtccaagacgccggcctggttctatgaggtggtggctccaggctacaagtacaatatgccggacaccgccgcggcgatgggcattcaccagctgaagaaaatccgcggcttttacgacaagcgcgaagtcatggcccagcgcttcgaccgcgagctggccggcctgccgctgatcctgccggcgcgcgccaaggacgagggcagcaaccacgcctggcacttgtacccggtgcggatcaaaccggaagccggcgtcagccgcgacgacttcatcgccaagatggcggagaagggcatcggctgctcggtgcacttcatcccgctgcaccgccagccggtatggcgcgacggctaccagctgacgcgcgagcaattcccggtggctgacgccgcgttcgaggccgaggtgacgctgccgctgtacaccaagatgaccgacgacgaccagacccgcgtcatcgccgcggtgcgcgagatcctgggcgcatga

SEQ ID NO: 4206 - DNA, 657 bp, Chromobacterium substugae
ttggaaaaagagggcggcgagttgttgccgccttgctgccagccgcgccgccatggctcgcgtttgctgaagcggctgttcgacatcgccgctgccggcgcgggtctcgccgtgctggcgctgccgcttatggcggtggcgctgtgggtgaagctggattcgccggggccggtgtttttccgccaggtgcgggtggggcgcggcggcgcgctgttccgcatccacaaattccgcaccatgcaggtggataccgaacgccatggccaattgacggtgggcgccgacagccgcgtcaccggcgccggccgagtgctgcgcaagaccaagctggacgagctgccgcagctgctggacgtgctgttcggcgacatgagcctggtcggcccgcggccggaggtgcccaaatacgtcgcgcactatccggccgaggtgaaggacatcgtgctgtcggtgcgcccaggcatcaccgactgggcgtcgataaagatgatcgatgaaaacgagatactgggccgcgccgccgatccggagcgcgcctatatcgacgaggtgctgccggagaagctgggctattacgtccgctacgccgaaacccatagcctgctcgaagacatccgcatcattgtcgccaccctgatgaagatcgtcagccgatga

SEQ ID NO: 4207 - DNA, 468 bp, Chromobacterium substugae
atgaccatcacgatccgcgccgccatgcccgccgacgccgatgcattggccggcatctacctggattgccgccgcgcgatgccctatgcgccgttggcgcatggcgaggccgccgtgcggacctggttcgccgaggccttgctgccggcgggcgatgtctggctggcggagcggggcggcgagatcgccggcttcgccgcctgttcggcgcaagatggcctcaggtggctggatcagctgtatgtcgccgcgcggcatcaaggcgcgggcataggcgcggctttgttgcagcgggttgtggtggagcgggcgcaggcttgccgcctgcatgtgttccaggccaatgccggcgcgcggcgcttttacgaggcgcatggcttcgcattgctgagcctgggcgatggactggataacgaggaacgctgtccggacgcgctgtatcaatggcggccggataggaaagaatga

SEQ ID NO: 4208 - DNA, 1881 bp, Chromobacterium substugae
atgtttgaaaaactgctagccttctcccgacacaacaagatggcgatgctggcgctgatggacgcgctgctgctgccgctggcgttgtggagcgcggtattcctgcgcctgggcggttattgggaccccaagctcaatccgcacctgtggatcttcatcgtgccgcccttgtgggcgattcccatcttcatcaagctgggcctgtaccgcgcggtgctgaaatacctggacgacaagatcatcttcaccgtgtttagcggcgtgacgctgtcggtgctggtattgcaggcggtgatccagatggcccacgtctgggcgatgccgcgcgcgtcggtgatcatcttctgggtgttcgcgatggcctatattggcggcagccgcttcctgctgcgcggtctggtcaggcgcatcgacgccaccgaggcgccgcgcgatccggtgatcatctacggcgccggccaggccggcgtgcagctgatgctggccttgcaggccggccgcgagtaccggccgatggccttcgtcgacgacaaccccgagctgcgccgccgcacctatcgcggcgtggcggtgcatgcgccggacgagctgccggcgctggtcaaggatacccaggccaagtgcatcctgctggccatgccttcggtcggccgcggccgccagcgcgaaatcctggagtcgctggagcggctgcgggtgccgatcaagcgcctgcccggcatggccgacctggtgtccggcgaagcgcgggtggaggaattgaaggaggtggagatcgaggatctgctgggccgcgatccggtgccgccgaaggccgaactgttggcgcgcaacatccgcgacaaggtagtgctggtcaccggcgccggcggctccatcggctccgaactggcgcgccagatcgtcaagaaccgcccggcgcgcatcgtattgttcgagttgtcggaattcgcgctgtacagcatagaccaggaactggcgcagatcgcgccgcgcatcccgcgcacgccgatattgggctctgtcaccgactatgcgcggctgacccaggtgatgcgcgccttccaggtggagacggtgtaccacgccgccgcctacaagcacgtgccgatggtggagcacaatccggtggccggcatcgtcaacaacgccttcggcaccgacaccaccgcccgcgcggcggaggactgcggcgtcgacaccttcgtgctgatttccaccgataaagccgtgcgccccaccaatgtgatgggcgccaccaagcggctggccgagctgaccctgcagacccgccacgcccgcggcagccgcacccgcttcgtgatggtgcgcttcggcaatgtgctgggcagctcgggatcggtcgttccgctgttccgccgccagatcaaggccggcggcccgatcacgctgacccatgccgacatcacccgctacttcatgaccatcccggaagcggcgcagctggtgatccaggctggcgcgatgggcgacggcggcgacgtgttcgtgctggacatgggcgagccggtgaagatcatcgatctggcgcggcgcatggtgcacctgtccggcctggaggtgaaggatgcggatcatccgggcggcgatatcgaaatccgcgtcaccggcctcaggcccggcgagaagctgtacgaggagctgttgatcggcgacaacgtgctggccaccgaccacgcccgcatcctgcgcgcgcaggagtaccacctgtccgacgccgaaatggcatcgttgctgcagcggctggccgacgcctgccagcggctggacgcgccggccgccttcgccctgatgcaggaggcggtgcatgagttccaggccgcggaggcgacgcaggactgggtgacgctgcagggctga

SEQ ID NO: 4209 - DNA, 192 bp, Chromobacterium substugae
atgcggcagctggaaccggaaaacgccaacgccaaacctctgcgcgaggatccggaaaaggcccggctggcgcgcaatatcaatcgcgccgagcgcgccgactgcgccaaggcctatgccaacctgggcttgctcgccgcccccatgctgctgaaagacgccttcgataaagacaacggctgcaagtggtag

SEQ ID NO: 4210 - DNA, 147 bp, Chromobacterium substugae
atgccagatggtacaccgccggggcactttgcggcgcgcgcgcactctaccatgagtcccgccgccgcaatgtcacaagccatgcaccaaacgcaaacaacaatgccatcaacatggcaaaggtccgcatttattttacagatatga

SEQ ID NO: 4211 - DNA, 909 bp, Chromobacterium substugae
atggaaacccgctggctggaagactttctggtgctggccgataccggcagcttcacccgctccgccgagctgcgccacctgacgcagccggctttctcccggcgcatccgcgcgctcgagagctggctgggcgcggacctgatagaccgcaccacttatccgaccaagctgaccgcggccggcaagctgctgcagcagcaagcggtgccgctgttggctcagctcaacaccacccgcaccatgctgcgcggcctgcagcccttgccgcagggcacgctggagttcgcggtgccgcacacgctgtcgttctcgtattttcccaagtggctgaccgcggtggaggacggtttcggccagttgtcctgccgactgcaggccagcaatgtgcacgacgcggtgctggccttcgtcgaaggcggcagcgatttcctgatgtgctaccaccatcccaagcagccggtagagttgcatgacgcgcgctacggcggcttgcggctgggcgtcgagcgcctgcggccgtacgccatcgccgcggacggcgcgcccgtgtatgccctgccggggcggcaggaggcgccgctgccgtttttgggttacgccagcaacgcctatttccgcttgatgagcgatttgctgctggtcagcgggccgcagccggcgcacctgtcgctgcgctacgaaaccgatatggccgaagggctgaagcagatggccttggccggccacggcctggctttcctgccggaaagctcggtggcggcggagtgccaggccggcttgctgctgccggccggcggcgacgagtggagcgtggaaatggagatccagctgtattgcgatctgcgccacgccaagccggaacaagaggctttgtgggcgtatctggcggcgcgccacccggcggtgtga

SEQ ID NO: 4212 - DNA, 1404 bp, Chromobacterium substugae
atgaccacccgcatcgaacacgatttgcttggtaaccgcgacgtgccggccaccgcctattggggcgtgcacaccttgcgcgccatcgagaatttcccgatcaccggccagaccataggcagctatggcgatctgatccgcgcgctggcctgcatcaagcaagccgccgcccaggccaaccgcgacctcggcattctcgactccaagctggcccaggccatcgtcgacgcctgcgaggaaatccgcgccggcaagctgcatgaagagttcgtcgtcgacgtgatccagggcggcgcgggcacctccaccaatatgaacgccaacgaggtgatcgccaaccgcgcgctggagctgctgggccacgccaagggcgagtaccaatacctgcacccgaacgagcacgtcaacctgtgccaaagcaccaacgacgtctacccgaccgcgctgcgcctggccgccttttggggcgtgctgaagctggtgtcgcggatggaagtgctgcgcaaggctttcgaggacaaggccggggagttcaaggacatcctgaagatgggccgcacccagctgcaggacgcggtgccgatgaccctgggccaggaattccagacctacgccgtgatgctgggcgaagatgaacaacgcctgaaggaagccagcgcgctgatgctggagatcaacctcggcgccaccgccatcggcaccggcatcaccgcccatccggattacgccaagctggtttgcctgcacttgtccgagctggtgggcagccagctgatcaccgcgccgaatctgatcgaagccacccaggactgcggcgccttcgtgcagctgtccggcgtgctcaagcgcgtggcggtcaagctgtccaagacctgcaacgacctgcgtctgctgtcgtccggcccgcgcgccggcttcggcgagatcaatctgccggcgcgccaggccggttcgtccatcatgccgggcaaggtcaatccggtgattccggaagtggtgagccaggtggcgtatgaagtcatcggcaacgacatgaccatcaccatggccgccgaagccggccagctgcagctgaacgccttcgagccggtgatcgcctacagcctgttccgcagcgccggccacctggccaacgcctgcgacaccctgaccgagcattgcgtgaaaggcatcaccgccaaccgcgagcgcctgcgccagagcgtggaaagctcgatcggcctggtgaccgcgctgaacccggtgatcggctacgaagccgccacccgcgtggccgccgaagcgcacgccaacggcagcagcgtggccgaggtggtgctggcccatggcctgctgacccgcgagcagttggacgacatcctgcagcccgacatgttgacccggccgcgctgggtgacgctgtaa

SEQ ID NO: 4213 - DNA, 360 bp, Chromobacterium substugae
atgagtccgatgctgtggtggagttgcgaattcccggcctgcgcctggtcctgcctgcaggacggctggcgctgccagcagcgctattggcgctccagcctgtttcacggcgctcgcgtttggctgagtccggcgcccttgccggacaagctggcgcgtttggcgcggcgcggctgcgccgacggcatcgcgttatggcacgacagcagcccggctggtttcgcatggctggagcaggccggcgcgcatgcgctgccatacgaaggagcgcgccgccaatggcaggactgcctgcggcacagccagcgggtctggcagcgcggcttgctgttgctggggcgggaatggtcgaggatataa

SEQ ID NO: 4214 - DNA, 993 bp, Chromobacterium substugae
atgatgcgcaaggcgttttttgtgattggactgtttgccgcgggctgggcgcaggcggattggtcgccaacactggtgtcggaccagtaccgggcaaccatcaattacggcggcgggtcgctcagctacagcgaggatgccaagtcgatggggcaattgcggcagaccgccatggatttgcaaaccgtgccctataccttgcagcagggcttgaacggacgagtgtcgcaactggtggcgcagaacggcgcgacctttctaggcggggtggtcagcggcaacgcgttggcaacgatacgcccggatgccagcggcgtggtctacatgaccttgtccgggctcagttaccaggtgcgtaaccagtattccggccataaatggggcgtaatcagctatacctgcaccaacacgctgacgctgagcaatattgtcattaccggccagtacggagccgcgaatggcgccatcgccggcgacaagaccggcatgacggcgacttccagttcgtccaccgattgcgactcgaacttgagctggattctgccggtattgggcgacgcgctgatcagcaaggccgaaggcaagatagacagcacggtgcagagcagcgtgcaggcggccctggccaaggtcaaggatactttgctgtacaagcccgaccagaacttgctgattggcctgaaccggctggttccgcccggcaaggtggtggccttgcccggcggcggcagttttccgttgggtcagtacatccagaacaatatcgcttacctgctggccaacagccagttgagcatacagctgggcagtccgatcgcgctcaagacggtggccggcaccagcgaaccgatgaccacgagcttcagcagcgatttggcgacgatttccttgtcatcgccggcgatggcgttttctatcaagttggctgagactgccgaggtcaactggttgtggcgttgcccggctggcgcgccgaggtgccaaatcccctag

SEQ ID NO: 4215 - DNA, 240 bp, Chromobacterium substugae
atggccacccaattccttctcagcgagcagcaactgcaacacctggccccgcaagtgcaggcttatctggcggaccagctcgggctggagatcggcagcttcgacgcccgcttcctgctggatttcctggccgacaagatgggacgcgacatctacaacaaggccttgcaggatgcgcagaccgcgctggcggagcgcatggaaaccctgcaggcggcgatctgggagctggagcgctag

SEQ ID NO: 4216 - DNA, 600 bp, Chromobacterium substugae
atgctctatttgcgtttgatgatgaaaggctttttgctggcggtgctgctggtggtgctcggtttcgcctacatcgcctggaccatcgtcgactacggcgacggggacgagcagaacggcgccgacgcggcgctggtgctgggcgccgcggcctggggcaacaagccgtcgccggtgttccgcgagcgcatcaaccacgcggtgaagctttaccagggcggcaaggtgcgctggatcgtgttcaccggcggcacgccgcagccgggctatccgtccgaggccgatgtcggccgcgagttcgccgcgcgccagggcgtgccgatgacggcgatgctggtggagaccgagtcgcgcaccacctggcagaatctgtccaacgcccgcgatctgggccgccagtttggcatccgctcctatctgctggtcagcgatccgctgcatatgcgccgggcggtgctgatggccgctgatctgggcctgcgcgcctacccggcgcccacccagtccagccgtttccgcacgctgtccagctggtcgcgcttcctggcgcgggagacctggctatacgtcggttatcgggcgtttcgccagttgtcgtga

SEQ ID NO: 4217 - DNA, 360 bp, Chromobacterium substugae
atggccttcccgcgcaatcccaactccgtccaacgcctgaaacgcctcaacaaccgccagcgcaagaaaatgcgcgtcggcgagttccgcgaactgggtttccacctggtggcccaactgcgcgaaggcgtggacaccgacgcgctgctggatggctggctgacccgcttcgacgaagccggcatcagcttcggcggccatttcgacggcaagagccgattggaaggcgtggccttcccggtgagcggcagccaaatcaccgatgcggtgcgcggcgagctggtcgcctggctgcaggcgcgcgccgaggtgcaatcgctggaagccagcgagctgatcgatctgtggcacgccgcctga

SEQ ID NO: 4218 - DNA, 1806 bp, Chromobacterium substugae
ttgactggacggatattccgtctttattcttggcaatgttgcgatcattttacaaatccacggtttaatttacacttaattaataaaatgttgaataacaagcaaaacattctcgttctgtccgtgatggctgcgctgctgtccgcctgcggcggcggcggcggcgactcctcttcttccacgacgtccggcaatcaggtggcgacgaccctcaatccgccgcagaaggccgccgtcactggcgacctgagctgccaggccggcgtttgcgcgctgcctgccagcgccaacgcggatgcggtcggcaaggtataccagctgcagaacaataccggccaggacatgcagatcaccgtcaacggcccgctgacagcccgctgggacgcggtgatgacccaggtggacagcgatcccctcggttacggcggcagcagcggcgccgcgcgcggcaacaatgcggcggcggaggcagtgctggaacagaagatgcagcagttctacgcgcatgcggcaagctacggcgccgtcgccagccgggcgcaggcgcggatgcgcctggagaaacgcgtccagatcgccgcgcggagttacgcgctcaacgatagccgttcgtggtatgacagcatcggcagccgcgcgttgaacgccacgatgaaggcaagccaggcgctgccgaatggcggaaccgtctatgtctgggcgcaaaacgacgcggccgcggtgacgcagcagcaggcggctttcctggccgagcgcttcgccaacagcgtgttcccgatcgaggcggcggtgatcagcgagccgtggggcccggtgcattcgacctggcagggcatcaccctggatgccggcaccaaggatgtgcatctggtgctggcgcagctgaatcagccggccaacgctttccagggcttgctgggctatgcgtaccctctcaacgctatcctgaagtccgctgcgtcggaccccacttgcggcagcgattgcagcgagttcgccaacagcaatgaagcgctggtgaccttcctcaacgtggacacgctggtggccgccgacgatggccagagctggagcccgagcggcaaaggcccggcgctgacgctgtcgacgctggggcatgagtaccagcacttgctgtacagctacaataagctgttccgccgcatggtgggctccccgcgcaccacgacttgggagaacgagctggcggcgcagaccatgggctacctggtggcggccgatacctatggcggcggccgcggcgacagcgcgacctcgcatcccgatttgcgctcgggcggcgacttcagccagttcctgaagcagccggcttgcgatttgaagcgctggtcggcgatgagcggcgacagtttcggcaccacttgctatccgaaagcgctggccaccggcatgttgatgctgcatcagtacggcgccggcgtgatgaagccctgggtcaccggcgccaatgtcggcgagcgggcgttggacgacggcctggcggcggtaggcggcggcgactacggcagcctgatgcagcagctgtataccagcctggcgctggcggacttctccacctggcctgccggctacggcttcccggccaagcagctgggcttgccagccagccgctatttcccggccggcaagaccatcgcgctgccgcagatcaacattaaccccagcgaagtccagctgtcggcagactccgctcaggaagcataccgcttgaccctggcgccggtagccggccaggtgagcatcacggtgcctgccaactcgcgcctgagcctggtgaagcgatga

SEQ ID NO: 4219 - DNA, 303 bp, Chromobacterium substugae
ttggcgggcgtcttggcggcctgcggcctgctggcctcgctgggcatggccaaggtgccgtgggaacacggcaagctggtcagcgtcggcaacgcgccgttcaaccagctggcgatccagcgcagcgacggcgccttgctgaccatactgccgagcgatgaaaccggcgcgctggataagcgccagctggcgccgttcgcggcgcgcgccggcgacaaggtgcgctttcgcgcgctgcgcagcgcgcagagcaagctgtcgggcgaaatggtggtcttgagccagatggagctggagcgctag

SEQ ID NO: 4220 - DNA, 150 bp, Chromobacterium substugae
gtgtatagccgcatgcggcaagctcctgtccaggctgaagacagccatcttgcagagacgcgccgccgccgtccacaccccggcggcgcgccgatgaaaaaacccggcatcgtcgccgatgccgggctggtccgccagaaacgcggctag

SEQ ID NO: 4221 - DNA, 567 bp, Chromobacterium substugae
atgcggctatacacccaagatgctttccgcccgatgccgtgggccaatggcggcggccagacctgcgaattgttccggctgccgcacccgcgccggcaggacgccttcgccgcgcggctgtccatcgccgatgtggcgcggggcgggccgttttcgcattttcccggcgtcgaccggctgctgggcctgctggagggagagggcatggagctgcgcctggacgatggccgcctgttgcggctggcgcaggccggccaggtggcggcctttcccggcgaggccggggtggattgccgtctgctcggcgggccgctgcgcgattgcaacctgatgctggcgcgcgactggggccggggagagctggagcgcttgcaactgccggccggcggcgtgttgcgggcgccggcggccgacttgaccctgctgtatctgcaacaaggggaatggcattgcgacggaagcgcattgccgccgggctgcctgctggcggccgaggacgaagcgatggagttgcgcgccagcggcggcggcgtcgcctggctggcgcgggtcagccggctggattga

SEQ ID NO: 4222 - DNA, 1476 bp, Chromobacterium substugae
atgaaatatgccgatctacgggaattcatcgcccaacttgaacaaaaacagctgctgaagcgcatcgcctcgccggtatcccctcatctggaaatgacggaaatcggcgaccgcgtgctgaaggccggcggccccgcgctgctgttcgaacagccgcgcagcccggaccggggctatgacttcccggtgctggccaatctgttcggcacgccggagcgcgtggcgatgggcatgggcgccagcgaggtgatgcagctcagggagataggcaaaacgctggcctacctgaaagagccggagccgccgaagggcctgaaagacgcctgggacaagctgccgttgttgaagcaggtattgtcgatggcgccgaaggaagtgaaaaaggcgccgtgccaggacatcgtctgggaaggcgacgcggtcgatctgggaaagctgccgatccagcactgctggcccggcgacgtcgcgcccttgatcacctggggcctcaccgtcacccgcggcccgaacaagaaacggcagaacctgggcatctaccgccagcaggtgataggcaagaaccgcgtgatcatgcgctggctggcccaccgcggcggcgcgctggactaccgcgaattccgccagcagaacccggaccagccttacccggtggcggtggtgctgggctgcgatccggcgacgatactgggcgcggtgacgccggtgccggacacgctgtccgaataccagttcgccggcctgttgcgcggcagccgcaccgagctggtcaaatgcatcggctcctacctgcaagtgccggcgcgcgccgaaatcgtgctggaaggccacatccacccgaacgatatggcgatggaaggcccgtacggcgaccacaccggctattacaacgagcaggacagcttcccggtgctgaccatagaccgcatcacgatgcgcgagaatgccatctaccacagcacctacaccggcaagccgcctgacgagccggcgatcctgggcgtggcgctgaacgaggtgttcgtgcccatcctgcaaaagcagtttccggagatcgtcgatttctacctgccgccggaaggctgcagctaccggatggccatcatcagcatcaagaagcagtaccccggccacgccaagcgggtgatgatgggctgctggagcttcctgcgccagttcatgtacaccaagttcatcgtggtggtggacgacgacgtcgacacccgcgactggaaggaagtgatctgggcgatcaccacccggatggacccggtgcgcgacaccacgctgatcgacaacacgccgatcgactacctggacttcgccagcccgatttccggcctgggcggcaaaatgggcctggacgccaccaacaagctgccgggcgagaccaatcgcgaatggggcacccctatcgtgatggacgccgccacccgccagcgcgtcgacgccatctggagcgaactggggctgtaa

SEQ ID NO: 4223 - DNA, 591 bp, Chromobacterium substugae
atgaagaagctcgctctcgccgccgcgatcggcatgatttccgccagcgcttttgccgcccagggcgacattctggcccgcttccgcgtgatcgacgtggacccgtccgccagctggagcaacggcgcggccggcacccatgtggacgccaaatcgtccgccgcgccggagctggatttcacctatatgatcaccaacaatatcggcgccgagctgatcctgggcacttcgcgccacaagatcaccaataacggcgtcgatatcggcaaggtgtcggtgctgccgccgaccgtgaccgtgcaataccacttcgcgccggaagcgactttccgtccgtacgtcggcgccggcctcaactacacccgtttctacaatgacgggctggccaacggcgcgatcaccgtgaagaagaacagcttcggcccggcgctgcaagccggcgcggacatcgcgatcaacaagagctggttcgtcaacttcgacgtgaagaagctgtgggtgcagaccgacgtcagcgccggcaacgtcaagctgggcacgctgcatgtcgacccgtgggtgttcggcgtgggtgtaggcaccaagttctga

SEQ ID NO: 4224 - DNA, 1086 bp, Chromobacterium substugae
atggctctccttgaaatcaaaaacgtggtcaaacgcttcggcgactacacggcggtcaacgacgtcagcctgtcggtccaggcgggcgagttcttcaccctgctggggccgtccggttgcggcaagaccaccttgctgcgcatgctggccggcttcgaacagccggacgccggccagattctgctggatggccaggacatgtcgcaggtggcgccggagaagcgcccggtgcataccgtgttccagagctacgcgctgttcccgcacatgacggtgcgcgagaacatcgccttccccttgaaaatggccaagtgggacaaggcgaagatcgaggcgcaagtggacaagcttctggccgacgtgcgcctgacgccgttcggcagccgctacccgcacgaaatgtccggcggccagcgccagcgcgtggccatcgcccgcgcgctggtggaccgcccgcgcctgctgctgctggatgagccgctgtcggcgctcgacgccaagctgcgcgaggagatgcagatcgaactgatcaatctgcagaaggaagtgggcatcaccttcgtctacgtcactcatgaccagggcgaggcgctggcgctgtcgcaccgcatcgcggtgatgagccacggccaggtggagcaattggatgcgccggagcagctgtacagctacccgaagaatcgtttcgtcgccgacttcctcggccagtgcaatgtgctggagtccacggtcaagtcgctggacggcggcgcgatgacggtggacatcaagggctgcggcgaggtgaagtgcctggcggtcgacggcgtcaagcccggccagcagggctggctggcgctgcggccggagaaggtgcggctggacaagtcgctggccgcgcagccggacgaggcgcatctgaagggccgcgtgcatgattgcctgtacctgggcgacgtcaccctctacgtggtggaagtggccgacggcgtgcgtatcgaggcgatgcaggccaacaacatccccggcgtcgccaagttcttcgacgacggcgacatcgtcgaaatcgcctggcgcttcgacgccggcagcttcctgacggagtaa

SEQ ID NO: 4225 - DNA, 894 bp, Chromobacterium substugae
atggccatccgtgatcgtttcggcaagtgggcgctatcctggccccccttgctgtacttggtattgttctttctgattccgtcgctgatcatgctggtggccgctttccgccagcccggcgactacggcggcctggcgcccctgttcaccatcgaggacggccagcgtgtctggcagctgacgctggacaacttccaccgcctggtggaggagccgctgtacctggagctgttcgtcaaatcggccggctacgccgccatcaccaccgcggtgtgcctggtgatggcttatccgctggcctggctgatcgcgcgctccggcaagaaataccgcgacctgatgctgctgctggtgatcctgccgttctggtccaacttcctgatccgcatctacgcctggatgatcatcctcggcccgcagtcggcgttcaccaaggcgctgaacctggtgctcacttcgctgggcttcgagccagtgcgcttgctgttcacctcgttcgcggtgatcgtcggcctggtctacgtgcatctgcccttcatggtgctgccgctgtacgccaatctggaaaagcacgacatggcgctgctggacgccgcgcaggacctgggcgccaacgcctggcagcgcttctggcgcgtcacctggccgcagtcgctgcccggcgtgttcgccggctcggcgctggtgttcattccggcgctgggcatgttcgccatcccggacatcctgggcggcaccgaatccatcatgataggcaacctgatcaagcagcagattctggatacccgcgactggccgttcggctcggtgctgtcgatcatgctgaccggcggcgtgctgctgatcgccgccttgggggccgtggtggccagaagggggaagggccgtggctaa

SEQ ID NO: 4226 - DNA, 795 bp, Chromobacterium substugae
gtggctaagaaacaatcgaagtggctgtgggcgtcggctatcgtcacctacctgttcctgtacctgccgctggtgatcgtggtgctgtactcgttcaacgattcgcgcctgaacgccgagtgggtgggcttcacgctgaagtggtacgacaagctgttccataaccagaaaatgttgaccgccgccggcaactcgctgctgatcggcgtcatcgccagcttcttcgccaccattctgggcacgctggccggcgtcgcgctgcatcgctacaagctgaggctgctgcccttcctggtgctgacgccgatcgccatccccgaattgctgatgggcgtgtcgctggtgattttcttcgtcatcgtcaaccagctgatcggcattctggagctgggcttcatcactatcctgctgtcgcacatcgccttctgcatcggctttgtcgccatcgtggtgcgtgcgcggatgcagggcatggacgacagcctggtggaggcggcgcgcgatctgggcgccaccccgttccaggctttccgcctgatcacgctgccggtgatcaagcccggcatcatcgccggcgccttgatggcgttcacgctgtcgatcgacgacttcgtgatcaccttcttcaccgccggcgccggcgccagcatgctgccgctggagatctactcgatgatcaagatcgcggtgacgccggaagtgaacgcggtatccagcttgctgatgctgctgacgctggcgctgatcgtcatcgcctcccgggtgtcgcccagcgcgctgcgcgccaacggctga

SEQ ID NO: 4227 - DNA, 1065 bp, Chromobacterium substugae
atgaagaagattctcgcgatgctggcgctggcggcctccacccaggcgttcgccgccgatgagctgcatctctataactggaacaactatttgtccgaagcggcagccaaaaactttgaagcctactgcaagtgcaagctggtgcaggactactacggcgacaacgaagaaatgctggccaagctggccgccggcgccaagggctacgacatggtggtgcccaccggcttcgcggtggacgcgctgatcaagcagggcaaggcccagccgctggacaagacgcagctgcccaacttcaagaacctgaacccgggctatctgaacagcttcttcgacaagggcaacaagtactccgccccgtacgcgttcaccaccaccctgatcggctacaacgaaaccaagctgaagcagctgggcctgggcgacaaggtcaacacctgggcgctgatcttcgatccggcgctgctggccaagatcaagggcaaggtcaccgtgctggattcacagcgcgagctggtgtccgcggcgctgatgtacctgggcaagccggccaactccaccaatccggcggactggaaagccgcgcgcgacgtgatcctgaaggccaagccgtactgggccgccttcaacaaccagtcgtacatcaaggagctgactgtcggcaacatctacgtcgccttcggctactccaacgatatgttccaggcgcagcaggacgccaagaaggccaagcgcaacttcgcgctgaacttcagcctgcaaaaagagggcaacacgctgtcgctggataacttcgtggtgctgaaggacgcgccgcgcaaggacctggcctacaagttcatcaacttcatgttggacggcaagaacgccgccggcctgaccaacgagctgggcaacggcaaccccaacgccgccgccggcaagttcgtcaagaccgagctgaccaagatcccggccatcttcccgagcgccaccgatctgccgcgcctgcagcagctgcatgacctgaacgccaaggaccgccgcgaactgaacaaggtgtggtcggagatcaagctgaaataa

SEQ ID NO: 4228 - DNA, 1475 bp, Chromobacterium substugae
tacggtcccccactttccccctcagggcgtatgcggtattaatccggctttcgccgagctatcccccattacacggtacattccgatgcgttactcacccgttcgccagagtaacgcatcggaatgtaccgtgtaatgggggatagctcggcgaaagccggattaataccgcatacgccctgagggggaaagtgggggaccgtaaggcctcacgttatacgccttacggtcccccactttccccctcagggcgtatgcggtattaatccggctttcgccgagctatcccccattacacggtacattccgatgcgttactcacccgttcgccactcgtcagcggtgcaagcaccctgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgtcatcaccggaaccgtttcgtttccgctgtttcgttcgctgcgtcagctgaggaggcgaactatacgcccgggacccacacccgtcaacacctttcgcgacaaaaattgaaagattttcggcggaaatcgctaagtggctgatatgtaacaaaaccataacttcagcaggccgcaaaaagtctccctctggcacccgagccgccgggaatggataatctgcgtcccaccttcatcaccgcatgcagtcccaacgtgaaccataaaacctggattttcgatctcgacgacaccttgcaccacgccagcggcggcatcttcgaccacatcaacaagctgatgaccgaatacatgatgcgccacctcggcgtgggcgaagaagaagcctgcgcgctgcgctcgcgctactgggcgcagtacggcgccaccatgcacgggctgactacccaccacggcatcgacccgcagcagttcctggtggatacccacccggtggatgtgctggctcaatggctgcagtttgaagaccggctggccgacagcctgacggcgctgcccggccgcaagatcatcctgtccaacggccccaaccattacgtggaaggcattttgcagcgaatgagcattcgccatcatttcgaatcggtatacggcgtcgacaatctcaattacgtgcccaagcctcatgtagacgctttccatacggtgctggcccgcgaggggctgcgcgccgagcattgcatcatggtggaggattcgctgcccaatctgctgaccgccaaggaattgggcatgacgacgatctgggtcagcaaggagccgcgccggccggcgcatgtcgatttccgcatcgagcgcatcagccagttgaagcggctgcaattgggctgaaacgctctata

SEQ ID NO: 4229 - DNA, 1475 bp, Chromobacterium substugae
  modified_base (108)..(108): a, c, t, g, unknown or other
ctctgaccgcagcgatcaccaccattctgtcgaagaagttcggtggcgaagctaaagactactcccagatcgatagcgcgccggaagaaaaggctcgtggtattaccngagtaacgcatcggaatgtaccgtgtaatgggggatagctcggcgaaagccggattaataccgcatacgccctgagggggaaagtgggggaccgtaaggcctcacgttatacgccttacggtcccccactttccccctcagggcgtatgcggtattaatccggctttcgccgagctatcccccattacacggtacattccgatgcgttactcacccgttcgccagagtaacgcatcggaatgtaccgtgtaatgggggatagctcggcgaaagccggattaataccgcatacgccctgagggggaaagtgggggaccgtaaggcctcacgttatacgccttacggtcccccactttccccctcagggcgtatgcggtattaatccggctttcgccgagctatcccccattacacggtacattccgatgcgttactcacccgttcgccactcgtcagcggtgcaagcaccctgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgtcatcaccggaaccgtttcgtttccgctgtttcgttcgctgcgtcagctgaggaggcgaactatacgcccgggacccacacccgtcaacacctttcgcgacaaaaattgaaagattttcggcggaaatcgctaagtggctgatatgtaacaaaaccataacttcagcaggccgcaaaaagtctccctctggcacccgagccgccgggaatggataatctgcgtcccaccttcatcaccgcatgcagtcccaacgtgaaccataaaacctggattttcgatctcgacgacaccttgcaccacgccagcggcggcatcttcgaccacatcaacaagctgatgaccgaatacatgatgcgccacctcggcgtgggcgaagaagaagcctgcgcgctgcgctcgcgctactgggcgcagtacggcgccaccatgcacgggctgactacccaccacggcatcgacccgcagcagttcctggtggatacccacccggtggatgtgctggctcaatggctgcagtttgaagaccggctggccgacagcctgacggcgctgcccggccgcaagatcatcctgtccaacggccccaaccattacgtggaaggcattttgcagcgaatgagcattcgccatcatttcgaatcggtatacggcgtcgacaatctcaattacgtgccc

SEQ ID NO: 4230 - DNA, 1475 bp, Chromobacterium substugae
  modified_base (545)..(545): a, c, t, g, unknown or other
gaactgaagagtttgatcctggctcagattgaacgctggcggcatgctttacacatgcaagtcgaacggtaacagggtgcttgcaccgctgacgagtggcgaacgggtgagtaacgcatcggaatgtaccgtgtaatgggggatagctcggcgaaagccggattaataccgcatacgccctgagggggaaagtgggggaccgtaaggcgtataacgtgaggccttacggtcccccactttccccctcagggcgtatgcggtattaatccggctttcgccgagctatcccccattacacggtacattccgatgcgttactctggcgaacgggtgagtaacgcatcggaatgtaccgtgtaatgggggatagctcggcgaaagccggattaataccgcatacgccctgagggggaaagtgggggaccgtaaggcgtataacgtgaggccttacggtcccccactttccccctcagggcgtatgcggtattaatccggctttcgccgagctatcccccattacacggtacattccgatgcgttactcnggtaataccacgagccttttcttccggcgcgctatcgatctgggagtagtctttagcttcgccaccgaacttcttcgacagaatggtggtgatcgctgcggtcagagtggttttaccatggtcaacgtgaccgatggtgccgacgtttacgtgcggcttagtccgcgcaaacttttccttagcccgcacgtaaacgtcggcaccatcggtcacgttgaccatggtaaaaccactctgaccgcagcgatcaccaccattctgtcgaagaagttcggtggcgaagctaaagactactcccagatcgatagcgcgccggaagaaaaggctcgtggtattaccatcaataccgcgcacgttgaatacgaaaccgaatcccgccactacgctcacgtagactgcccgggccacgccgactatgtgaagaacatgatcaccggcgcagcccagatggacggcgcgattctggtttgctcggccgctgacggtccgatgccgcaaacccgcgaacacatcctgctgtcccgtcaggttggcgtaccgtacatcatcgtttacctgaacaaggctgacctggttgacgacgccgagctgctggaactggttgaaatggaagtgcgcgatctgctgtcttcctacgacttcccgggcgacgacaccccgatcgtaaccggctccgctcgtctggcgctggaaggcgaccagtccgaaatgggcgagccgtcgatcttccgtctggccgacgcgctggactcctacatcccgactccggagcgcgcggttgacaagccgttcctgctgccgatcgaagacgtgttctcgatctccggccgcggcaccgtggtgaccggtcgtgttgagcgcggcatcgtgaaagtcggcgaagagctggaaatcgttggcctgaaagaaaccgccaagaccacctgcacc

SEQ ID NO: 4231 - DNA, 1475 bp, Chromobacterium substugae
  modified_base (321)..(321): a, c, t, g, unknown or other
tacggtcccccactttccccctcagggcgtatgcggtattaatccggctttcgccgagctatcccccattacacggtacattccgatgcgttactctggcgaacgggtgagtaacgcatcggaatgtaccgtgtaatgggggatagctcggcgaaagccggattaataccgcatacgccctgagggggaaagtgggggaccgtaaggcgtataacgtgaggccttacggtcccccactttccccctcagggcgtatgcggtattaatccggctttcgccgagctatcccccattacacggtacattccgatgcgttactcnggtaataccacgagccttttcttccggcgcgctatcgatctgggagtagtctttagcttcgccaccgaacttcttcgacagaatggtggtgatcgctgcggtcagagtggttttaccatggtcaacgtgaccgatggtgccgacgtttacgtgcggcttagtccgcgcaaacttttccttagcccgcacgtaaacgtcggcaccatcggtcacgttgaccatggtaaaaccactctgaccgcagcgatcaccaccattctgtcgaagaagttcggtggcgaagctaaagactactcccagatcgatagcgcgccggaagaaaaggctcgtggtattaccatcaataccgcgcacgttgaatacgaaaccgaatcccgccactacgctcacgtagactgcccgggccacgccgactatgtgaagaacatgatcaccggcgcagcccagatggacggcgcgattctggtttgctcggccgctgacggtccgatgccgcaaacccgcgaacacatcctgctgtcccgtcaggttggcgtaccgtacatcatcgtttacctgaacaaggctgacctggttgacgacgccgagctgctggaactggttgaaatggaagtgcgcgatctgctgtcttcctacgacttcccgggcgacgacaccccgatcgtaaccggctccgctcgtctggcgctggaaggcgaccagtccgaaatgggcgagccgtcgatcttccgtctggccgacgcgctggactcctacatcccgactccggagcgcgcggttgacaagccgttcctgctgccgatcgaagacgtgttctcgatctccggccgcggcaccgtggtgaccggtcgtgttgagcgcggcatcgtgaaagtcggcgaagagctggaaatcgttggcctgaaagaaaccgccaagaccacctgcaccggcgtggaaatgttccgcaagctgctggaccaaggtcaggctggcgacaacgtgggcgtgctgctgcgcggcaccaagcgtgaagaagttgagcgtggccaagtactggtgaagccgggctcgatcaagccgcacaccgagttcagcggttcggtatacgtgctgagcaaggaagagggcggccgtcacaccccgttcttcgctaactaccgtccgcagttcta

SEQ ID NO: 4232 - DNA, 312 bp, Chromobacterium substugae
atgtctagccaaaaaatccgcatccgtctgaaggcgttcgattacaacctgatcgaccgttccgcccaggaaatcgttgaaaccgccaagcgcactggcgccgtggtcaagggtccggttccgctgccgaccaagatcgagcgtttcaacgttctgcgttcgccgcacgtgaacaagacttcccgcgaccagctggaaatccgcactcacctgcgcctgatggacatcgtagatccgaccgacaagactgttgatgctctgatgaagctcgacctgccggccggtgtggatgtggaaatcaagctgcagtaa

SEQ ID NO: 4233 - DNA, 687 bp, Chromobacterium substugae
atgccggtcaatcgcaatcggcgcctgaaaaaggaaataaacatgagtttaggtcttgtcggtcgcaaagtcggcatgacccgcatttttgccgaagatggcgcaaccatcccggtaactgtgctggacatgtccgctaaccgcgtcacgcaaatcaaaactgcagaaaccgacggctacaacgccgtgcaggttacttttggctccaagaaagccaatcgcgtcaacaaggcagcagccggtcacttcgccaaagctggcgttgaggcaggcgaagtcctggtagagttcgctctgtcggccgacgctgtttccagcttcaagctgggcgacgcagtcgcagttgaaaccctctccgttggccagctggttgatgtaaccggcacctccaagggtaagggcttctccggcgtgatcaagcgtcacaacttctcttccaaccgtgcttcccacggtaactcgcgttcgcacaatacgccgggttccatcggtcaggctcaggatccgggccgtgtattcccgggtaagcgcatggccggtcagtacggtaacgtcaagagcactgtacagtgcctcgagatcgttcgtatcgacgccgagcgtcagctgattctggtcaagggcgcagtcccgggcgccaagaacggcgacgtagtcgtgcgtcccagcgtgaaagcgggtgcgtga

SEQ ID NO: 4234 - DNA, 621 bp, Chromobacterium substugae
atggaattgaatgtaatcaatacccaaggcaaggctgttggcagcctgcaagtgtccgactccctgttcggccgcgactacaacgaagctctggttcaccaagttgtgaccgcgttcctggcgaacgctcgcagcggcaaccgtgcccagctgactcgtgctgaagtgaagcactcgaccaagaagccgttccgtcagaagggcactggtaacgctcgtgccggtatgacttccaccccgaaccgtcgtggtggtggccgtgccttcccgaacaagccggacgagaacttcacccagaaggtcaaccgcaagatgttccgcgccggcatggcggccatcctgtcgcaactggtgcgcgacgagcgcctgatcatcgtggacgagctgaatgtagccagcccgaagaccaaggaattcgtaggtactgttcagccgatgggtctggaacaggctctgttcatcactggtgaactgaacgaaaacctctatctctcttcgcgtaacctgccgaacgtgctggttatcgaagctcaacaagctgacccgtacagcctgctgcgcttcaagaagaccgtgatcacccgcgacgccgtgaagcaactggaggagcagtgggcatga

SEQ ID NO: 4235 - DNA, 309 bp, Chromobacterium substugae
atgaaccaagaacgtctgttgcaagtaatccttgctcccatcgtttccgaaaagagcaccatgatcgctgagaagcatcagcaaatggcgttccgtgttgctaccaacgcaaccaagccggaaatcaaggcggccgtcgaaatgctgttcaacgtaaaagttgaaggcgtttccactgtgaacgtcaagggcaaggttaagcgtttcggccgttccaccggtcgtcgcagtgactggaaaaaggcctacgttagcttggtcgaaggtcaagaaatcgacctgaccgctaccccggccgcggcggagtaa

SEQ ID NO: 4236 - DNA, 1227 bp, Chromobacterium substugae
ttgagccgacaggcgaacacttttcagatttgcagatactctcatcgcttcaccttacttcttcttcgccttcttatcggcagcatggcctttgaaagtgcgagtcagcgagaattcacccagtttgtggccgaccatgttttcagaaacatagacgggaacgtgagtgcgaccgttgtgtacagcgatggtcaagccaatgaagtccggcaggatggtcgaacgacgggaccaggtcttgatcggacgcttgtcgctggttgcccgtaccgcatctacctttttcaggagatgcaggtcaacgaacgggccttttttctgcgaacgtgccattgtcaattaccctttgttggaatagcgacggcgtacgatcatgttgtcggtacgcttgttgcgacgggtacggaagcccttggccggagtgccccacgggctaaccggtacgcggccttcgccagtgcggccttcaccaccaccgtgcgggtgatcgatcgggttcatcgccgtaccgcgaacggtcgggcggatgccgcgccaacgagtagcacctgctttacccagcttgcgcagggagtgctcttcattacccacttcaccaacggtcgcacggcaatcgacgtgcaccaggcggatttcgcccgagcgcagacgcagttgagcgtatacgccttcgcgagccagcagcattgcggaagcaccagcggagcgaaccatctgggcacccttgccaggttgcagttccacgcagtggatagtagtacccaccgggatgttgcggatcggcagggtgttgccggccttgatcggggcttccgagccggacagcagcacggcgccaaccttcacgccgcgcggcgcgatgatgtagcgacgttcgccatcggcgtagcacaggagggcgatgtgggcagtgcggttcggatcgtattcgatgcgttccacttttgccgggatgccatccttgttgcgacggaagtcgatcagacggtagtgcttcttgtgaccgccaccacgatgacgcgtggtgatgtggccattgttgttacggccgccggtcgagtttttcttctcaaccagggctgcgtgcggagcacctttgtacaggtcagggtgtactaccttgacaacggcacggcgacccgcggaagtcggttttaccttaacgataggcatgctctatctccttactccgccgcggccggggtagcggtcaggtcgatttcttga

SEQ ID NO: 4237 - DNA, 273 bp, Chromobacterium substugae
gtggccgatctggtccgcggtcaatccgtagcccaggcgctgaatatcctggccttctccccgaagaagggcgcggtaatcatcaagaaagtgctggaatctgcaatcgctaacgccgagcacaacgaaggcgctgacatcgacaccctgcgtgtcaccagcatcttcgttgacaagggcgctagtctgaagcgtttcactgcccgtgctaagggtcgtggcaaccgcatcgaaaagcagacctgccacatctcgttgaccgttggcaattaa

SEQ ID NO: 4238 - DNA, 702 bp, Chromobacterium substugae
atgggtcagaagattcatccgacgggattccgtcttgccgttaacaaaaactggtcttccaagtggttcgcgtcctcgcagaacttcccggaaatgctgaagcaggacatcgaagttcgcgaattcctgaagaagcgtctgggtcatgcttcggttggccgcgtcaccatcgagcgtccggccaagtccgcccgcatcaccattcacagcgcccgtccgggtgttgtgatcggtaagaagggcgaagacattgaagttctgaagcaagaactgcaaaagcgcctgggcgtcccggttcacgtgaacatcgaagaagttcgcaagccggaactggacgcgcaaatcatcgccgacggcatcgcttcccagctggagaagcgcgtgatgttccgtcgcgccatgaagcgcgccatgcagaacgccatgcgtctgggtgccgaaggcatcaagatcatgtcgtccggccgtctgaacggtatcgacatcgctcgtagcgaatggtaccgcgaaggccgcgtgccgctgcataccctgcgcgccgacgtggattacgctacctcggaagccaagaccacctacggtatcatcggcatcaaggtatgggtatacaaaggcgagctgaagccgggccaagttgtggccgcgccggcagctcccgagaagaaaatgagaaagggtgcccgcaatgctgcagccaactag

SEQ ID NO: 4239 - DNA, 138 bp, Chromobacterium substugae
gtggctgaaattcagcctggcaagatgctgtacgaaatggatggcgtatccgaggaactcgctcgcgaagctttccgtctggccgcagctaagttgccgatcgccactgtgttcgtaaccaaacaggtaggtcagtaa

SEQ ID NO: 4240 - DNA, 189 bp, Chromobacterium substugae
atgaaagcgtccgaactgaaagccaaaactgttgatgagctgaaggtggaactgctgagcctgctgaaggcccagtttgcgctgcgcatgcagcacgctactcagcaactcgccaagacctctgaactgaagaaagtgcgtcgcgacatcgctcgcgttcgcaccgttctgaaagaaaaggcagtttaa

SEQ ID NO: 4241 - DNA, 264 bp, Chromobacterium substugae
atgagcgaaaccaaagtagtacgtacgctgaccggcgttgtggtcagcgacaagatggataagactgtaaccgttctggtcgagcgcaaggttaagcacccgatctacggcaagattatccgtcgctccaagaagttccacgcacacgacgagaacaacgagttcaaggcaggcgacctggtagtcatcagcgagtcccgtccgctctcgaagaccaagtcgtgggtggtaactggcctggttgagaaatctcgccaggtataa

SEQ ID NO: 4242 - DNA, 663 bp, Chromobacterium substugae
gtgtttcttggcgacgttaacgccttcaacaaccagcttctcatccagaacacgcaggacggtgccgcgcttacccttgtctttgccggtgattactacgacttcatcacctttacgaattttgcgcatgtgacctccttacagcacttcaggagccagcgaaacgatcttcatgaagcgttcggtacgcagttcacgcgtaacgggcccgaagatacgagtgccgatcggctcaagcttgttgttgagcagaacagcagcgttgctgtcaaacttgatcaaagagccatccggacggcgcacgcctttggcagtgcgaaccacgaccgcattgtagacgtcgccttttttgacgcgaccacgcggagcggcatccttgatgctcaccttgataatgtcacctacgctagcatagcgacgcttggagccacccaacaccttgatgcacataacgtgacgcgcaccagtgttgtcagcgacctcaagcatggtctgcatttggatcatttgatgattacctttctaatccaactttatccgtcactttcacctgccggtttctcgcataagagcaagaccaaacagacgaaacgccacagacaacctgtggcgtgtcaaacggccagttttggaccccgtaagggcggaactcttgcaaagtag

SEQ ID NO: 4243 - DNA, 135 bp, Chromobacterium substugae
atgcctgtggacgcatcgaacgtcgcgattttcaatccggcaagccaaaaggctgaccgcgtgggcttcaaggttcttgaagacggccgtaaggtacgcgtgttcaagtccagcggcgaagttatcggcgcctaa

SEQ ID NO: 4244 - DNA, 540 bp, Chromobacterium substugae
atggcacgtctctacgatttctacaaagacagcgtagtgccggaactgatgaaacagttcggctacaagtcgatcatgcaagttccgcgtatcgagaagatcaccgtgaacatgggcgtgggcgaagccgttgccgataaaaaggtaatggaattcgccgtgggcgatatggaaaagatcgccggtcaaaagccggttgtcaccaccgctcgcaagtccatcgccggcttcaagatccgcgacaactacccggtaggttgcaaggtaactctgcgtcgcgaacgcatgtacgagttcctggaccgcctggtaaccatcgcgctgccgcgcgttcgcgatttccgtggtgtatccgccaagtccttcgacggccgcggcaactacaacatgggcgtcaaagaacagatcatcttcccggaaatcgagtacgacaagatcgatgctctgcgtggtatgaacatcactgtcaccactacggcgaagactgacgaagaggcccgcgcactgctggccgcgttcaagttcccgttcaagggttaa

SEQ ID NO: 4245 - DNA, 306 bp, Chromobacterium substugae
atggcacgacttgcactgattaaccgtgaagaaaagcgcgtcaagctggctgagaagttctccgccaagcgtgaagccctgatcgccaccatcaacaaccagagcctctcggaagaagagcgtttcgccgcccgcctgcaactgcagcaactgccgcgcaatgcttccccggtacgccagcgtcgtcgctgcgccatcaccggtcgtccgcgtggcgtattccgcaaattcggtttgggtcgcaacaagctgcgtgagatcgccatgaagggcgagattccgggcgttgtgaaggccagctggtaa

SEQ ID NO: 4246 - DNA, 396 bp, Chromobacterium substugae
atgagcatgcacgatcctatttccgatatgttgacccgcatccgcaacggccaacgcgcttccaaggtggctgtttccatgccgtcttccaagctgaaggttgcgctggcgcaggtgctgaaagaagaaggctacatcgaagacttcgccgttgccggcgaagccaagaagcctgttctcgatatccagctcaagtactacgctggccgtccggtgattgagcgcatcgaccgcgtttcccgtcctggcctgcgcgtgtacaagggctccaccgaaatcccgaaggtcatgaatggtctgggcgtggcgatcctgtccacttccaagggcatcatgactgaccgtaaggcacgctccaccggcatcggtggcgagctgctctgcgtcgtggcttaa

SEQ ID NO: 4247 - DNA, 459 bp, Chromobacterium substugae
gtgaagggcgccctgggcaccctgagcaccgctctgtgcgaagaagttgaaatcaagctggacaacggccagctgactttcgctgccaagaacgacagcaagttcgcacgtgccatgtccggcaccctgcgcgctctgttgaacaacatggttaacggcgtatccaagggcttcgagaagaagctgcagctggtaggcgtgggctatcgtgcccaagcccaaggcgacacgctgaacctgtctcttggtttctcccacccggtggcccacaagatgcccgaaggcatcaaagtggaaaccccgactcagaccgagatcctggttaagggcgctaacaagcagctcgtaggccagatcgcagctgaaatccgcgcttaccgcgctcccgagccgtacaagggcaagggcgttcgctacgctgatgaagttgtggttctgaaagaaaccaagaagaagtaa

SEQ ID NO: 4248 - DNA, 288 bp, Chromobacterium substugae
atggtgcgtctcactgtgtaccgcaccaacagccacatttacgcccagatcgttgacgagaccggcagcaaggtactggctagcgcttcctcgctggaagccgatgtacgcgctgaactctccaacggcggcaacgtggcagctgcggccgtgatcggcaagcgcattgccgaaaaggcaaaggctgctggcatcgagaaagtggctttcgatcgttccggtttcaaataccacggtcgcatgaaggcactggctgacgccgctcgcgaacacggcctcgtattctaa

SEQ ID NO: 4249 - DNA, 519 bp, Chromobacterium substugae
atggctaagcacgaaatggaagatcgcggcgacggtctggtcgagaaaatgatcagcgtcaaccgcgtcaccaaagtggtcaagggcggccgtatcatggctttctctgccctgaccgtagttggtgatggcgatggcggtatcggcatgggtaagggccgttccaaggaagttccggttgccgtacaaaaggcaatggaacaagcccgccacaccatggtcaagatcccgctgaaaaacggcacgctgcagcacactgtagtgggtaagcacggtgctaccaccgtcttcatccagccggctaaagaaggtaccggcgtgaaggccggcggcccgatgcgcgcgatcttcgacgcaatgggtgttcacaatgtttcggccaagattcatggttccaccaacccgtacaacgtggttcgtgcaactctgaacggcctgagcaacatcaacactccggcgcaaatcgccgccaagcgtggcctgagcgtcgaggacatcctgggggtgggtcatgagtaa

SEQ ID NO: 4250 - DNA, 186 bp, Chromobacterium substugae
atgagtaacgccaagactgtcaaggtcactctggtaaagagcctgatcggtcgcctggagtctcacaaggcctgcgcccgtggtctgggtctgaagaagattcgccagactgttgaagtgctcgatacccctgaaaaccgtggcatgatcaacaagatcagctacctgctcaaattcgagggctaa

SEQ ID NO: 4251 - DNA, 432 bp, Chromobacterium substugae
atgctgctgaacaccgtacaaccgggcgtcggcgccaagcatgccaagcgccgtgtaggccgtggcatcggctccggcctgggcaagacttgcggccgcggccacaagggtcagaagagccgcgctggtggtttccacaaggtcggcttcgaaggcggtcaaatgccgctgcaacgtcgtctgccgaagcgcggcttcaagtcgctgacggctcgcttcgtttgcgaagttcgcctgtccgaactgaacctgctgccggtcgatgaaatcgatctgctggctctcaagcaagccggtctggtatctgcccaggcacaagttgccaaggtagtgctgtccggtaaggttgagcgcgcggtcaaactgcgtggtatcagcgttaccgctggcgcccgcgctgccatcgaggctgccggcggcagcattgaataa

SEQ ID NO: 4252 - DNA, 1143 bp, Chromobacterium substugae
atgttcaacatgttctcgggcggcgccttgtcgaggttcacggtgtttgccttgggcatcacgccgtacatctcggcctccatcattctgcagcttgcggccgaggcattgcccagcctgaagcagttgaagaaggaaggtgatgcgggacgtcgcaaaataacccagtacacgcgctatgcaaccgtgctgctcgcgactttccaaagtttcggcatcgcggcaatgttgtataggcagcccaacctggtgatgaccgctcagtgggagttttacctgacgtcggtggtgtcgctggtcaccggaacgatgttcctgatgtggctcggcgagcaaatcaccgagcggggcatcggcaacggtatctcgctgatcatctgcgcaggtatcgcttcgggcgtgccgggcgccatcggcaaaaccctgactcaaacgagcctgggtgcgatgaacgctctggtcgccatcgcgctgttcgtcggcgtgatcctcgtcacctacgtggtggtgtttgcggagcgcggccagcgcaaggtgttggtgaactatgccaagcgtcaggtcggcaaccgcgtcatgcagggtcagagcacgcatctgccgctcaaactcaacatggcgggcgtgatccctccgatcttcgcgtcgagcatcatcctgttcccggccaccattcttggttggttcggtcagggcgaacatatgtcgtggctgaagggcgtggctgacaagctgcatccgggtcagccgatctatgtgctgctgtatgccgccgcgatcgtcttcttctgctatttctacacggcgctggtattcagcccgaaggaaacggcggataacctgaagaagagcggggcgttcattcccggcatccgtccgggtgagcagacttctcggtacatcgagaagatcatcctgcggttgacgctgatcggtgcgatctacatcacgctggtctgcctgctgcctgagttcctgatcctgaagtggcacgtgccgttctactttggtggtacgtcgctgctgatcatggtggtggtaaccatggacttcatggcgcaagtgcagtcctatgtgttgtcgcatcagtacgagagcttgttgaagaaggctaacttcaaaggcaacgctctcacccgctga

SEQ ID NO: 4253 - DNA, 1056 bp, Chromobacterium substugae
atgctgaccaggaggggtatccagtttgcacttggaatccagtgcacgacgcgcgctcttcaggaaaaggtcggtgccttcacgacgagcgagcttgcacttcgggccaatataacgtgccatgttctcacactctccgaattagatacgacgttttttgggcggacggcaaccgttgtgcggtaccggcgtcacgtcggagatgctggtgatcttgaagcccagcgagttgagtgcgcgaacagcggattcacgacccgggcccgggcctttaatacgaacttccaggttcttcacaccgtattcttgggcaactttaccagcgtgctctgcagctacctgagcggcaaagggtgtactcttgcgcgagcccttaaaaccagcgccgccagaggtagcccaagacagtgcattgccttgacggtcggtgatagtgatgatggtgttgttgaacgaagcgtgaacgtgcacgataccttcgctaacagacttgcgcacttttttacgtacacggacagctgtgtttgctttagccattctctgtgttccttaagattacttcttgccggcgatcgccttacgcggtcccttgcgggtacgagcgttagtgcgagtgcgctgaccgcggcacggcaagccacgacgatggcgcatgccgcggtagcagcccatgtccatcagacgtttgatgctcatggtgatttcgcggcgcaggtcaccttcaacggtgaacttggcaacttgatcacgcagagcttccatttcagcttcagtcagatccttcaccttggtggagggattcacgctggctgcagcacagatgtgctgagcgcgagtctgaccgacgccgaagattgcctgcaggccgataacggcatgcgcatgattggggatgtttacccctgcaatacgggccatactctttccttaagccttaagaccttgaaaagtttgcgattgtatcacgcaaatccaggtctaacaaatgttagccttgtttttgcttgtgacgcgggtccgtgcagatcacgcgtactacgcgattgcgacgaatga

SEQ ID NO: 4254 - DNA, 384 bp, Chromobacterium substugae
gtgcgccgcaagggctccacgggcgaaaacctgctgaagctgcttgagtcccgcctggacaacgttgtatatcgcatgggctttggctccactcgcgccgaagcgcgccagctggttagccacaaggctattgttgtgaatggccaggttgtgaacattccgtcctaccaggttaaagccggtgacgtagtgtccgtccgcgaaaaggccaagaagcaggcccgtatcgctgaaggcctggctctggccgagcaaggcggcttcccgtcttgggtgtcggttgactccaagaaaatggaaggcgtcttcaaatccgcaccggaacgttccgaactgtctagcgatatcaacgaacaactcgttgtggaattctactccaagtaa

SEQ ID NO: 4255 - DNA, 984 bp, Chromobacterium substugae
atgcaaaacagcgcttcggaatttctgaaaccccgtctcatcgacgtacagccggtttccgcaactcacgctcgtgtgtcgatggagccgttcgagcgcggctatgcccataccctgggcaactcgctgcgccgtattctgctgtcgtcgatgccgggctacgctccgaccgaagtgactatcgctggcgttttgcatgagtattccgcgcttgatggcgtgcgcgaggatgtcgtcgacatcctcctcaacctcaagggcgtagtgcttaagctgcatggtcgcgacagtgtcgtgctgaccttgaaaaaggacggtgaaggcgctgtcttggctagcgatatcgagctgccgcatgatgtggaagtgatcaatccggaacacgtgatttgtcacctctcctccggcggcaagatcgacatggagatcaagatcgaaaagggccgcggctatcagccggtgtccgttcgatccagccatgatgacaaccgttccatcggtaccatccaactggacgcttccttctcgccggttcgccgcgtgagcttcgctgtggaaagcgcccgtgtggaacaacgtaccgacctcgaccgcctggttctcgacatcgagaccaatggcgtcatcgagccggagcaggctgtgcgcaacgcagcccgcatcctgatggaccagctgtcgatctttgctgatctccagggcacagcggttgaagaagtcgttgaaaaggcgccgccgatcgatccgatcctgctgcgtccggtagacgatcttgaactgacggttcgttcggccaactgcctgaaagctgagaacatttattacatcggcgatctgatccagcgtactgaaaccgagcttctgaaaactccgaacctcggccgcaagtcgctgaacgagatcaaggaagttctcgcttccaagggcctgactctcggcatgaagctggagaactggccgcctgctggcctcgaaaagccgtaa

SEQ ID NO: 4256 - DNA, 339 bp, Chromobacterium substugae
atgctgcgcaacatggctaactcgctgctgaagcacgaagtaatcgtgaccacgctgccgaaagccaaggaactgcgtcgtgtggccgagccgctcatcacgctcggcaaaaagccgtcgctcgccaaccgtcgtctggcgttcgaccgcacccgtgaccgcgatatcgtggttaaactcttcgacgtgctcggcccgcgcttctccgcccgcaatggcggttacgtgcgtatcctgaagtacggtttccgcaagggcgacaacgccccgatggctctggtagagctggtggaccgcgctgaagatgccgttgccgttgtagacgactccgccgagtaa

SEQ ID NO: 4257 - DNA, 915 bp, Chromobacterium substugae
atgaatctgcaagcactcattgaagatatccggcagcagacgctgccgttctacgaccacggccaggtggccgactacatcccggcgctggcatcggtgccgccgcaccaattcggcatggccatcagcacgctggatggccggcactacgcctgcggcgacgccgaacagccattctccatccagagcatcagcaaggccttcatgctggcgctgacgctgcaggccgatggcgaagccctgtggcagcacgtcggcaaggagccctccggcaatcctttcaattcgctggtgcagctggagtacgagcacggcattccgcgcaatcccttcatcaacgccggcgccttggtggtgaccgaccgcgccatccgccacttcggcgacgcccaccgccagctgctggactggctccgcgaggaaagcggcgcgcccgggctggcggccaacgagcgcatcgccgcttccgagcgcgagcacggcgaccgcaacgccgcgctggcgcacttcatgaagagctacggcaatctgcgacatccggttgagcaggttctggagcaatacttccataactgcagcatcgaaatgagttgccgacagctggcccgcgccggcctgttcctggccaaccatggcgtctcgcccgtcaccacgcgacaatacctgagccgcagccaggccaaacaggtgaacgctgtcatgctgacctgcggcacctacgacgcggccggcgaattcgcctatcgggtgggcttgccggtgaagagcggcgtgggaggaggtttgctggcggtgataccgggcaagatgagcatcgcggtgtggagcccgcaactggattcgcgcggcaattcggtattggggctggaggcgctggatcgcttcaccacccgcaccgggctatccatcttttga

SEQ ID NO: 4258 - DNA, 798 bp, Chromobacterium substugae
atgcaattgaccagcatgttcgttcatcctctcaaatcgacccgcggcatcgccttcgagcgcgccttcgccggcaagctcggcctgctgcacgaccgcgagtggatactgaccacccccgacggcgaccagatcaccgcccgctcccacccgcagctggttcgcgtcggcgtggagctgatgcctggcggcatcctgctgcattacgagggcaaggcgccgatcttcgcgatggccaccgcctacacccgaccgcatcgcgcccaggtatggaaggacgaattccaggcctggcacggcgaccaacggctggatgcctggttcgccgacatactgggccaggagtgccggctgttgtggctgggcgctcaatccggccgcgccttcaaaggcggcgcggagaaaatgagctttgccgacggctaccccttcctgctggtcaaccaggcttcgctcgacgacctgaaccgccagctgcaacgcccggtcacgctgcgccacttccgccccaatctggtgatagacggcgactacccgtggatggaggacgaatggcaagtcatccgcatcggcgaagtggaattcgatgtgatgaagccctgcacccgctgcgtgctgactacggtagaccccgacaccggcagcaaggatgccgacggcgaaccgttgcgcacgctggtgcgcacccgcaggctggaagaaggtgtctgcttcggcatgaacctgcgcgcccgcaacgagggcatgctggaaatcggcgcgccgctggaggtattgcaggagcgctatagcttctag

SEQ ID NO: 4259 - DNA, 192 bp, Chromobacterium substugae
atgaacgaacatgctggtcaattgcattgctatctccacattgcattccagcgggatgctaccaccgcaaggccgtggagtgttgccgagtgggcgccgagttgtccgacgaagcggtttttaagcgctggccacagtaagcgctgcgctgtttgtaagggggccattgcatatattcgcccggcaatttaa

SEQ ID NO: 4260 - DNA, 1878 bp, Chromobacterium substugae
atgcgctctttgcgtgtgaaactgattgcttttattgccttgttgttggtggtgctgggcgtggtgattacgattctggtctacggccagatgcgtaacgagatcatccatggcgtggaaaacgagctggacggcacttcgaaagggtatgccagccttgtgagcggctggtacaagagcaaggtgggggtggtgatcgcggccaatcctttggttggcgaaaccgacccgcgccagaccctggcccggctgagccaggctggcggcttcgacatgacctatatcggcaccgcgcagcacgtgatgctgcgctccgacatgaagccgcaaccgcaaggctacgacccggtggcgcggccgtggtaccagcaagcggccgccagcggcaatcccggcgtgtctgacccctatgtcgatttcgacaccaagaagctggtggtgaccttcgtgtcgccggtgaaagacggcagcggcctgaaggcggtggtcggcggcgacatcttcatcgatgatctggtcaagactgtgctgtcggtgaagttgcgcggcaacggctacgccttcctcaccgacaagagcggcaaggtgatcgcccaccccgacaacagcctgaccttgaagccgctgacggagaaagtgcccgagctgaccgcagaccgcctgacgcagctggccaacagcaacgaaatgggccgcatcagcgtcggcggcgaagagaaactggtggaagtgcagccggttgacggcaccaactggctgctgggcgtggtgaccgacgagtcggtggtgtccagcccgctgcacaccttgctgatgaccatcgtcggcctgggcgcgctgtgcgtgctgattctgatcccggtcgccagcgtgatgctgagcaagatgctggccggcctcggccgcctgcgcagcgcgatgctggagatttcccagggcgagggcgacctgacccgccgcatcgaggtgaccggccaggacgagatcgccgaaaccgccaccgccttcaaccgcttcatcggccaactgcagaagatgttcatcgcagtgaaggaagaggccgagaaagtcaccggcggggtggagagcgtcacccagaccgtggacaaggtggcgcacgattcgcgccagatcgccgacgtgtccagttccaacgccgctacgctggagcagatcaccgtcagcatctcgcacatcgccgacgccgcgcgggaagcggacggcctggtgacccataccggagacgtgtccagcgagagcgccagcggcatgcagcggatctccagcgagatgaacagcacggtggaggcggtgaagggcttgtccggcatgctgtcgtcgctggatcagcgttcgcagcagatcagcggcatcaccaatgtgatcaaggacatcgccgaccagaccaacctgctggcgctgaacgcggcgatcgaagcagcgcgcgccggcgaaatgggccgcggcttcgcggtggtggccgacgaagtgcgcaagctggccgaacgcaccggccaggccacggtggagatctccggcatggtcagcacgatccgcgaggaaaccagccaggcggtcagcaatatgcagcgcaccgtcaactcggtggatggcggcgtcgagctgacgatgggcgcggtggagcgcatcgagcagatccagaaggcgatggaagaagtgatggccaagatgaacgaaatcaccttgtccaccagcgagcagcacaaggccaccacgctgatcgcgcagagcaccgagcagatcaacggccgcatcgtcgacagcgacgatgcgctgcagaccgtccgcgacacgctgagcgagttgtcgcattcggccagcagcatgcgccagctgttctccagcttccgcgtgtaa

SEQ ID NO: 4261 - DNA, 1638 bp, Chromobacterium substugae
atgagcctgaagaccaggctgttcggcttgatggcgctggtggtgctggtggtgtgcgcattgggggtggcgacggtgttcagccagcgccaggcgatgatgcaggaccgccaggacaaggtgcgcaatctggtggagagcgcggtgaccctggtgtccacctacgagcgcttggcgcaaagcggcaagatcagcgaggccgacgccaagcgcacggtgtcacaggtgctcagttcgatgcactatgaccagcgcgagtattttttcgcctatgacgccgactggaactatgtcgcccacggcgccaagccggaattgataggcaagaacctggccggcgtcaaagaccccaacggcgtggagctgaaggatctgttcgccagggccatcgcctcgccgggcggaggcggtttcggcgaatacgtgtggaacaagccaggcttcgacaagccgcagcccaagatgtcatacgtcaccaccacgccgggttggcattgggtggtgggcactggcatctacctggacgacgtcaacgcggccttccgcgatcagctgctgaccctgggcgtggtgctggcggtggcgttgctgctgctgttggggctgggcggcctggtgctgcgcaatgtgctggggcagctgggggccgatcccttggagacggtggcggtggtcaagcgcatcgcctccggccaattggccgagccggtcagcctgaagcgcggcgaccagaccagcctgatggccgcggtcagcggcatgcaggaggagctcaggcggctggtgcgcgacatcgtcgccgacgccaaccagctgtcgcggatgagcggcgaggtgaccagcgaagcggcggtggtcggcaagggctcggaacagcagagcgaggcggccaccgcgatggcggcgtcgatcgagcaattgacggtcagcgtcaatcacatcgccgatcgttcgcaggacgcgcgcgacctggccagcgagtccggcagccgctccaagagcggcagcgcggtgatcgccgaggcggtgagcgagatgcgccgcatcaacgaggcggtggaccagacttccggcatcatcaccagcctggccgacaagaccgatactatctccagcatcatgcaggtgatccgcgacatcgccgaccagaccaatctgctggccttgaacgcggcgatcgaggcggcgcgcgccggcgagatgggccgcggcttcgcggtggtggccgacgaggtgcgcaagctgtcggagcgcaccgcgcaggcgacgcaggaaatcgccaccatgatccaggacgtgcagcagggcgcgcagaattcgcgcagcagcatggaggaggcggtggcgcgggtgaaggcgggcttggggctggccgaacaggccggcgacgagatcgcccgcatccaggacagcgccaacggcgtgatcgcggtggtcggcgacatctccttcgctttgcaggagcagagcgtggccagccagaccatcgcccagcatgtcgagcagatcgcccacagcgccagcagcaacgccgtcgccacccaggcggcggcgcgcgccatccagaatatggaccagctggcatcgaatctgcgccagctggtggcgcgcttctcggtgggcgagcgctccgcctag

SEQ ID NO: 4262 - DNA, 1491 bp, Chromobacterium substugae
atgcgaatactgatcctgctcctggccgccgcgctagccggcgccctcaccgtgttttccttcgcgccctaccggctgttctggctgatgccgctgtgcctggccgcgctgctggagctgatacagcgcgagccgcgccgcgccttctggataggctatgtctggggcctggccgcctacaccagcaacttccactggctgtacgccagcctgcacgatgtcgccggcctgccggccctgatcgccgcgccgctggtgctgctgctgccggcctatctggcgctgtacccgggcctggccgcctgggtggcctgccgcgtcgaccctcgcccctgggtgcgctacctggtggccttccccgccgcctgggagctgggcgaatggctgcgcagctgggtgatgaccggcttcccctgggccgccgccggctattcgcaaatcaccgaaagcccgctgtccggctacgcgccgatcggcggcatccacttggtcagctatctggtggcgctgtccgccggcgcgctgatgatgctggcgcgcagcggcatgcgcttgcggctgggcatcgtgatcgccacctcgctgctgtggctgagcggcttctggctgcgcgatgtggagtggaccgcgcctcagggcaagccgatcagcgtggcgctggcccagggcaatatcgcccaggaattgaagtggacgccggaaaacctggagcagtcgctgctcacttactaccgccaggtggcgatgacccgcgccgatctgatgatactgccggaaaccgcgctgccgctattcctggacgacctgccttccggctatctgtcgatgatgcgcggcgaggccagccgcgccggcatggcgctggccagcggcattccgcgccgcaccaacgatggccgcggctatctgaacgcggtggtggcgttgtccgatccgaaaatgccgtactacgccaaggaccacctggtgccgttcggcgagttcatcccgctgcccggcctgataggctggatctaccagtatatgaacatgccgctgtccggcttcagccgcggcggcgccaaccagccgccgctgctgctggccggccagaaagtggccttcaacgtctgctacgaggatagtttcggcgaagagctgtccggcccggcggcgcaggccggcatgctggccaacgtcagcaacctggcctggttcggcaagagcgaggcgatgagccagcacctgcagctgtcgcaggcccgttcgctggaaaccggccgctacatgctgcgcgccaccaataacggcatgaccgccatcatccggccggacggcgaaatttccgccatcgccgcgccgttcaccgcccaggtgctgaccggcttcgcccagagccgccagggcctgaccccatacatgcgcgtcggcaacctgccggtggcgctgggctgcggcttgctgctgctggcggcgctggcgctgggctggcgccgccgcggccagcactag

SEQ ID NO: 4263 - DNA, 852 bp, Chromobacterium substugae
atggaagaccccagtaaaccgcggcccagttggcttgaacgcctgtccaccatgctcttgcgcgagccggaagaccgcgaggagttgatcgagctgctgcacaacgccttcgagcgcaacctgctggatgccgaggccctcggcatgatagaaggcgtgctggaagtgagcgaactgaccgtccgggacgtgatgatcccgcgcagccagatgcacgtgctcaacatcgacgacccgatctcccgcttcctgccgaccgtcatcgactccggccactcgcgcttcccggtgataggcgaaagcaaggatgacgtgcaaggcatcctgctggccaaggagttgctgcgttacttccatgcgcccgccaccttcaatttgaagaacgtgctgcgcccggcggtgttcgtgccggaatcgaaaccgctgaacgtgctgctgcgcgacttccgcgccacccacaaccacatggcggtggtggtcgacgaatacggcggcgtctgcggcctggtcaccatcgaagacgtgattgaacagatcgtcggcgacatcgaggacgaatacgacatcgaggacgacgaggacgacatcgtgccggtgcgcggcaacgagcgttaccgcgtcaaggcgctgaccgagatcgaagacttcaatcactacttcggcaccgactacgccgacgacgatgtcgacaccgtcggcggcctggtgatctcgctcaccggccatttgcccaagcgcggcgaaaaaatcgaggccgccggcctgcgcttcaccgtgctgcgcgccgacagccgccgcctggacagcctgctggtggaacgcatccagctgagcgccggccaggccgaataa

SEQ ID NO: 4264 - DNA, 504 bp, Chromobacterium substugae
atgaaacaagctaaacgccaccccctgctggcccgcctgcgcgcgcggctggagctgaccctggacgtgcgcagcgatgccgcgctgccgccgccggcgctgatccgccgcgcctgccaggccgcgctgcagcgcggcgtcgaaaaagcgcagatcagcatcgtcatcgtcgacgccgctgaaggccgtcagctcaacaacgactaccgcggcaaggattatgcgaccaatgtcctgtccttcgcgctgaacgaaggcgagccggtggccggcctgccgctgttcggcgacctggtgctgtgcgcgccggtggtggagaaggaagccgcggagcagaacaaggacctgatggcccattacgcgcacctcttggtgcacggcatgctgcacctgcaaggcttcgaccacgaagaagacgacgaagccgaggcgatggaagcgcttgaaaccgtcatcgttaaacagctaggatatcccgacccctaccacgaggagcagttctaa

SEQ ID NO: 4265 - DNA, 960 bp, Chromobacterium substugae
atgagcacaaccgaacccctgagcttcaatccggtggacaacgaacggctggcccgcctggccggcccgctggacgaaaacctgaaacagatcgaaaccggcctggacgtggtggtgcaacgccgcggcgaaaccttccgcgtgcagggcgaacaggccaagctggcggtggaggcgctgacccggctctacttgctggccgcccagcaggacgtatcgatagacgacgtgcagctgtcgctggtggagctgcgccagcgccagaccagcggcgagcaggaagagtcgccggtgctggccacccgccgcggcgacctcaagggccgcacgccgaatcaggcgcgctatatcaaggccattctgcaacacgacgtcaccttcggcatcggcccggccggcaccggcaaaacctatctggccgtcgcctgcgcggtggacgcgatggagcgcgacgcggtcaagcgcatcgtgctggtgcgcccggcggtggaggcaggcgagaagctgggcttcctgcctggcgacctggcgcagaaggtggacccttacctgcgcccgctgtacgacgcgctgtacgacctgatgggcttcgaccgcgtcacccggctgttcgaaaagaacctgatcgagatcgcgcccttggcctatatgcgcggccgcacgctgaaccacgccttcatcattctggacgaggcgcagaacaccacgccggagcagatgaaaatgttcctcacccgcatcggcttcggctcgcgcgcggtgatcaccggcgacgtcacccagatcgacctggcccgccaccagaagagcggcctggtcgaggtggagcgcatcctcggccaggtgcgcggcatccatttccatcatttcaatagccaagatgtggtgcgccacccgctggtgcagaaaatcgtcgacgcctacgacacttaccaaagcaagcaagatgaaacaagctaa

SEQ ID NO: 4266 - DNA, 672 bp, Chromobacterium substugae
atgaagccgcagggcatccgggcgatactgctggatctggacgacacgctgttcgacgacgcttacgccagcgcgcaggcgttcgcagcgttcatcggcccgcatgcctcgcgcttctcccaaccgcccgacgcgctgcaggcgcgctggcgcggctgcatcgaccgccactggcgccgcttcgagctgggcgaactgagcctcgcgcagcaacgccacgagcgcctgcgcgacttcctcggcgcgccggacatgagcgaagccgaagccgccctgctgttccagccttatatggacgcctaccgccgccaccgccggctcacccccggcgcggcggattttctcgacgccacccgccacctggtccgcatcgtggtcagcaacggcggcgccgagcagcaacgcgccaagctggagcacctgggcatcgcccatcatttccgccacctgctcacctgcgacgccgtcggcgccgccaagcccgacgcgcgcatcttccgccgggcgctggagctggctggacaagaagcgcgcgcctgcctgatggtgggcgacgacctcgaacgcgacatagaaccggcgcggcggctgggcatggcggtgcgccatgtcgcgcccggcagccacgccgccatttttgcaacgcttagccaacagctgcgaaacgcatga

SEQ ID NO: 4267 - DNA, 288 bp, Chromobacterium substugae
atgtacgtcgtctcgctgagttacaccgccccgctgtcagacatcgacgcgctgctgcccgcccacgtggcatggctgaaccaggcttacgccgacgggctgttcctggcctccggccgcaaggtgccgcgcagcggcggcgtgatcctggcccgtggcgagcgcgctgcgctggaagcccgcctggcggacgacccgttcgccaaagccggcgtggcccgctacgacatcatcgaattcgtcccgagcatgaccgccgccggactggaaggattgaaggaagcatga

SEQ ID NO: 4268 - DNA, 1335 bp, Chromobacterium substugae
atgaagaaggtatacatcaagaccttcggctgccagatgaacgagtacgattccgacaagatggcggacgtgctgggcagcaccgaagacatggtcaagacggatactccggaagacgccgacatcatcctgttcaacacctgcagcgtgcgcgagaaggcccaggagaaagtgttctccgatctgggccgcgtgcgcccgctgaaggaagccaaacccggcctgatcataggcgtgggcggctgcgtggccagccaggaaggcgacgccatcgtcaagcgcgcgccctacgtcgacgtggtgttcggcccgcagacgctgcaccgcctgccggaaatgatccgcgccaagcgcgacagcggccgcgctcaggtcgacatctccttcccggaaatcgagaaattcgaccatatcccgccggccaaggtagacggcgccgccgccatggtgtccatcatggaaggctgttccaaatactgctcgttctgcgtggtgccctacacccgcggcgaggaggtgtcgcggccgttcgaggacgtgctgaccgaaatcgccggcctggcggcgcagggggtcaaggaaatcacgctcctgggccagaacgtcaacgcctaccgcggcctgatggccgacggcgagatcgccgacttcgcgctgctgctggaatacgtgcacgaggtgccgggcgtggagcgcatccgcttcaccaccagccatccgcgcgaattttcccaacgcatcatcgactgctacgccaaactgcccaaactggtttcccacctgcacctgccggtgcagtccggcgccgaccgcgtgctgatggcgatgaagcgcggctacaccagcctggaatacaaatccatcatccgcaagctgcgcgcgatccgcccggacctgtgcctgtcgtccgacttcatcgtcggcttccccggcgaaaccgaggccgacttcgaacagacgctgaagctggtgaccgacctggcattcgacttcagctacgtgttcatctacagcccgcgccccggcaccccggccgccaatctggcggacgacaccccgcacgcggagaaagtgcgccggctggaagccttgaacgccgtcatcgaagcccgcggcttcgaaatcaacaaggcgatggtcggcagcgtgcagagggtgctggtggaaaacgtgtcgcgcaaggacgacgccatgctggcggcgcgcaccgccaacaaccgcgtggtcaacttcgccggccatccgcggctgctgggccagatgatcgacgtgcgcatcaccgaggcgcggccgcactcgctggccggcgaggcgttggttcacgaaagcgtttga

SEQ ID NO: 4269 - DNA, 378 bp, Chromobacterium substugae
atgaaaaagcccatcgccgccctctgtctatgcctcgccctgcccgcagccgccggcaggctgctgcccgacagcctggtgatgggcaagttgggcgaccagaacgccgccggcatcgccttcgtccgcgccgaccaaaccttcctgcagcggctaggggggctgatcgccgtgccgccgccgcgtttcgcgctggcccccggcctgcgcatcttcgatggcggcaaccgctttctgctgagcgggcaattgaatgatctcaggggcaaaaccgtaggcgtgaccttcgatccgcaaggcagcatcaaccgcatctgggtgctgggcgacgatgagatcgaggcgctgaagcagcgccaggcccggaccaccccttaa

SEQ ID NO: 4270 - DNA, 1203 bp, Chromobacterium substugae
atgccccacgacacccccctgatcaccaccatcgtcggcggcctggtattcgccttcgccttcggcatgctggcgctgcgcctgcgcctgccgccgctggtgggttatctgtgcgccggcatcctggtggggccgttcacgcccggcttccaggccgacaccgcgctggcgccggaattggccgagctgggggtgattctattgatgttcggcgtcggccagcacttctcgatcaaggacctgatggcggtgaaggccatcgccgtgccgggcgcgctggcgcaaatcgcggtggccactttgctgggcatggggctgtcccacttcctgggctggccgctgggcgaaggcctggtgttcggcctggcgctgtcggtggccagcacggtggtgctgctgcgcgcgctggaagagcacggctggctggaaaccgaggatggcaagatcgccgtcggctggctggtggtggaagacctggtgatggtgctgaccctggtgctgctgccggcggtggccggcgcgctgggcggcgcccaggccgcgccgtcgctcgagcaactgggctggacgctgatgctgacggtgggcaaggtggcggccttcgtcgcgttgatgctggtggtcgggcgccgcttcattccctggatgctggagcgcgtcgtccacaccggcagccgcgagctgttccgcctgggcgtgctggccaccgcgctgggcgtggcctacggcgccacccagctgttccagatttcgttcgcgctgggcgccttcttcgccggcatggtgatggcggaatcgccgttcagccaccgcgcggccgaggagtcgctgccgctgcgggaggcgttcgcggtgctgttcttcgtgtcggtcggcatgctgctgaatccgcaagtgctgctcaacgacgcgccgacgctgctggccaccgtgctgatcatcgtgctgggcaaatcgctggccgcctacggcatcgtgcggctgttccgccgcggccgcgccaccagcctgcgcatcgccgccagcctgtcgcagatcggcgaattctcgttcatcctggccgggctgggcatgtcgctgggcttgctcagcccgcgcggccaggcgctgatcctggccggctccatcgtttccatcctgctcaacccgatgatgttcgcgttggccgaacgctttcggcctgcggcgctggcggccgagtag

SEQ ID NO: 4271 - DNA, 150 bp, Chromobacterium substugae
ttgcccgcgccagccagcccgactccgccgcgcgggctggcgcctccggctttccatttgatggcgctgcgccttgctccgccgccgcggacgcctcatcgcgagcagatcaaggctcgcggcctggcttcgcgccatgatgaaagctga

SEQ ID NO: 4272 - DNA, 702 bp, Chromobacterium substugae
atggatgatacaagcgtgcgcctgtccaagcgcatggtggaactgggcctgtgctcgcgccgcgaggccgatgcctgcatcgagcagggcctggtgaaagtggatggcaaagtcgtcaatacgctgggcgcgcgggtgcggccggagcaagagatcacgctggccggcaagccgcaggccttggccgcgctgccggtgacgatgctgctgcaccgcccggcaggcgaggacgcgccgccggcgcaactgctggggcaagacagccgttcgccgcaggacgcgtcggagcaagtctggctggcgcgccaccgccagcacctgagcgccttcggcgccgtggatgagcaatgccacggcctgctggtgctgacccaggataaaaaactgccccgccatctggccgagtgcgagatggaattcctgctgcaagtggagcaggcgccggcggccgacgagcttaaagcgcgcgtcgcagccatccgcctggacggcaaaccgttgcgccaatgcaagatcagccgccagagcgaccatcagctgcgctgcgcggtttacgcgccgcgcgccggtttcttcgccgaaatcagccgccagctcggcgtccgcctgcaaagcgcgcgctgcatccgcatcggccgcctggccttggccggactgcagccgggacaatggcgctatctgcagccgttcgaacgcttctga

SEQ ID NO: 4273 - DNA, 522 bp, Chromobacterium substugae
atggccgcggagaatgaggggccggaagtcactttcacctctctggggcagacggccttggctgatggcagcgtttgcgtggcgggcggcgaaaccgaggacttcgtcgacagcaagtcggtggtgctggtgaaaaagaacggggcggtccggcagagaatcgctctgccgttgccggatcccaattacagcgatgggagggccatggcctgcttgcagaaaggcgcggccttgtacgtcgtcgaagagctggataccagttccatcatgaccgacaagcggacattgctgtttgtcgatcgcatcgagcatggccgcctgcagaagcgggtcatgttgccggtgcgatacagcagccagaatttcggcgtggccagagtgggggaggggcctgccgccttcatgtgggacggcgcgggccaactggtggtgcgcggcaaagtttatcgagacgcgatgggcggcaagccgggcaaggcattctccgtgaaattgcaggctgatctgacggtcgccaagtaa

SEQ ID NO: 4274 - DNA, 2337 bp, Chromobacterium substugae
atggcagaaaagaagcattactctcaacaggacaagatcaatttcatcgtttccctctatccggcggcgagagaggcctcgcgcaagagcggcatgtcgtgggagctgattcttgcccaggcggcgcaggagaccggctggggcgagaaggtgctgccgggcagcaacaacgtcttcaatatcaagacggggtcgtcctggaagggcgactccaaggtttaccatgtctgggaaaaacagaacggcaagaaagtttgggtggatgatgctttccgcgtttatccctcggtagcggattctctggcagaccggatgcaaatgttgcagaacagctcgcgttatgccaaggcggggctgatggatcccggcgtgaagggcaatatggagaaggaagcccatgcgttgaagaaaggcggctacgctactgcagaaaattacgcggaaagcatgatcgaactgttccatggccgcaccatgcgccatgcgctggctgaagcccgcaagcggcatccggagtttgacgcggcgggccaggcaaagccggccgtcgcctcgcaggcgccgcattccagcgccgcgcaggcctccccgccgccggtcaaagccgtttcggcatctgtcgcgcatgataagccggcccagcctgtcgccgcgcatgctgctcagcagcaagcgcagcaaccgaaacaatcgcagccatccgccgcggcggcttccgcgcccagcgcggagcgggtgcagaccctgttgccggaggcgcagcagcatctggtgcaggaagccaaaaacgccgtgcaggcgctgcaacagcgcgacgcccgcctgcagaagctggacgccgcgcaactggacaatctgagcggccaactggcggtcgacgccgcgcgccaaggcatggccaagatcaacggtgcggtggtcaacgccgccgatccgggcaagatcagcctggtggggcaggatgccggcaacaagctgcaacaggtcagcgcggaattcggcgcggcgccggccgcgccctcgccaaaccagccggcatcgacggtcgctgcccagccccagtccggcgccagtccggcgcagcctacgccagccaagcctgtggagcaggccgcggcggccaagccgcagatcgagcaggcgaagcccgccgcgccgcaggcggctcatgtttcgcatccgccagcacagggtgcccatggcccagccaaagcgacggcgcctgccgggccggcgcaatcggctcacgctcagcatatgccggcacaggcagcccatgctcaagccaaagcggcggcgcatgccggccaggacaagtcgcagcatccgcagccggttgccggcaacgaccgcggctcgcgcatggtcaacgccgcgctggagcatttcggcgacggcacttttgaatatggccgcgccgacatggcgggccagttggccaacaagaagaaacccaacggcaatcgcatcgatggcagccggctggaggcggacacggatcacgatggcaagaaaggcgtggattgctcatcgctggtatggcgcacgctgcagctgggcaataccaaggtgaccgatgatttcaagagcgcggcgaacttcaccactcacaccttgttcaacggcggacacggcggccagcatccccacgccaatataaccgactacgccaagcgcaacttcaatgtgatcgacaacaagaaagacctgcagccgggcgacatcctgatgttcaagatggcgggcggcggccagcacgtggcggtctacaagggcaaaaacgagaagggcgagcagatgttctacggctcgcaaacctccaccggcccggcggaagtcaatctgagcagcaatccttactggagcaagcaggccttcctgggcgcgctgcggcccaaggatgacttctacaagcctgacgccgcgccgcaggcggcccagcacgcgggcctgtccgacggcaagcaaagcctgctggagcagacgcggcagcacgtgggttcgctgcagcagcgcgacggccgcttgaaagacctggcgtcgcaccaggtggacaacctgagcgccgccctggcggtggaagggtggaaaaagggcatcgagaaggtgggcgcggtgatggtgaacgccgtcgaccccggcaagatcagcatgctttacaagagcgcggccaacaaggtcgagcacgccgcggtggagctgagggatgcgatcaagcagtcggcgcagcactcgctgtcgctgctggcggcggcgcctgagcatggccagccagcggccaaggcgcaggcgcaccagccgccggcgcgcgccaagcagccggcgatggggatgtga

SEQ ID NO: 4275 - DNA, 597 bp, Chromobacterium substugae
ttgaaccatgcaggtttgaatatgcaagcgtatggcctggcaggccagcaagcgcttcccaagtacgaaggctctctcaagccggtcaacaatgccaatgattttgactccattcctgcacctattccacatagccgattgaatcatcggcaaaccaaccccttgccggaaaaccggacgttgctgcagaagctgctgaccgaaaacgacgcgctgtcgccggaaaagcagaaattcgccacgcaaaccgcgcaggcggtggaggcgctgcagcggcgcgagcccaagttggcggcgctgcagcccgggcagatagacaatctgagcgcgtcgctggcgcacagcggctggaaaaacggcatggccaaggccgatggcgcggtgctgaacgccgccgatccgggcacggccacgctgatcggccgcgacggcggccagaaaatccagcatgccagcgtggaggtggacagcgcgatccggcagccggcggcgacggcgctggcagcgctggcggcgacgccggacaaggcagcgcccgcgccggcccaggcggtgcggaccgcctcccgttcggctgggggcatgagcctgggctga

SEQ ID NO: 4276 - DNA, 867 bp, Chromobacterium substugae
atgggcagatccagggccggcgactatgcgcggcgtttcacgcgggttttcgatcatatcgatcaacatttgcaacagccgctcaatatcgagcggctgagccaggtcgcgcatttttcccgctttcattttcagcgccagtttgccgcttattgcggcgccagcgtggcgcgctacatccagctgcagcgcctgcggcgggcatcgtatcaactggtgttccagcccttgttgcggatcaccgacatcgcgctggatgccggctttgaaaatccggagtcgttttcccgggctttcaagcacgctttcggccagacgcccagcgcctttcgccgcgcgccggattgggcgcattggcaaacccggtttcctgttcccgtcagagagaggatggaggatatggacgtgaagatcatggtcgtggatacggtgcgggtggccgcgctggagcatcgcggcgcgccggagcgggtaaacgacagcgccagccgcttcattgagtggcgcaaggagagcggcctgtcgccgttgaccagcagccagacttacggcatcgcttacgacaacccggataccaccgcggcggcggatttccgcttcgacatttgcggcagcgtggcggggccggtgccggccaaccgccagggggtggtggccaaggagattcccggcggccgctgcgcggtgctgcgccatgtcggctcgcatcagcggctgggcgaaagcgtgtactgcctgtaccggcagtggctgccgtccagcggcgagagcctgcgcgacttcccggtgtatttcctgtacctcaacctggtcggcgcaacaccggaacatttgctgcagacggacatttatttgcccttgagctga

SEQ ID NO: 4277 - DNA, 1704 bp, Chromobacterium substugae
atgcaagccttgagaatcgtcctgttgtcctcggccttcaacggccttacccagcgcgcctggttggagctgcgcgaatcgggccacgagcccagcgtggtgctgttcaacgatgcggacgatgtctgccggcagatagaggcggcggcgccgcagctggtgatctgcccgtttctgaaagaccgggtgccggcgcggctgtggcgcgacgcgccttttccggtggtgatcattcatccgggcatcgtcggcgaccgcggcgcgtcggcgctggactgggcgatcagcctgcagcagaagcgctggggcgtgaccgcgttgcaggcggtggaggaaatggacgccggcccggtgtggtccagccgcgagttcgatctgcccgcggggctgcgcaagtccgaactttacaacggcctggtcagcgacgccgccatctattgcctacgcgacgtggtggagaagttcgtcggcggctaccagccgcaagcggtcgactatgccgatccggcggtgcgcggccggctgcagccgaatatgaagcaggcggatcgggcattcgactggcgcgagccggcggaggcgatcaagcgccgcatcgacgccggcgacggccagcccggagtgctggcggatctggccggcggccgctactacctgtacgacgcccacctggatcataggcgcggcagcccgggccagattctggcggtgcatgacgacgcggtgctggtggcaaccggcgacgccagcctgtggctgggcgcgctgcggcgcgcgcccgaggccggcgaagaaactttcaaattgccggcgcgccatctgctggcggacctgctggatgaggtgccaaggctggaatggtctatcgccacccatccgcattgcgaagaatcctatcagcctatccgctaccgccgggtcggcaaggtgggcgagctgaccttcgagttctacaacggcgcgctgagcaccgagcaatgccggcgcctgcagcgggcgctgcaatgggccaagcggcaggattgcgaagtgctgctgctgcgcagcgggcgcggcagcttttgcaacggcatccatctgaacgtgatccaggcggcgcaggacccgggcgccgaggcctggcgcaatatccaggcgatagacgatgtctgcctggagatattgaccgcgccgcaactggtggtggcgggcgtggccggcaacgccggcgccggcggcgcgatgctggcgttggccgccgacgtggtgctggcgcgccagggcgtggtgttcaatccgcattaccagaccatggggctgtacggctccgagtactggacctacacgctgtcgcgcgcggtgggggccgaaacggcggtcaagctgtgcaacgactgcctgccgctgggcgcccgccaggcctggcggctgggcatggtgcaggacattgggccgcgcgacgagcaggagttcggccgctggctgctgcaagcggcgaagcaggctttgttgacgccggcttggcaggcctggcgcgagcgcaaagagacgctggatctggcgcagctggagcgatgccggcaggcggagctgggcgaaatgcggctggacatgttgcgcaaccgccgccagttcatcgagaaatgcggcaacttcgtccacaagcgccgggcctgcggcacgccgcagcgcttggtcgcgccatgggcgcggcagggaggctag

SEQ ID NO: 4278 - DNA, 1653 bp, Chromobacterium substugae
atgggctggcaaacgcatgaagtgagcaatcagttcgacgaactgacggactacaagctgctggacagcgacccggccttgggcgaggcgctgagtcgggccggcgccgagtgggccgtgccctggctgcggggctacggcgagacgctgggccgcgccgaaacctttgaactggccgaggaggccaatcttttcccgccgcggctgcgggcgttcgaccggcgcggccgacgcgtcgaccaggtggatttccacccggcctggcaccggctgctgcagatgtaccgcggccaggggctggtgtcgctgcctttcgccgaggagcggggcgggcgctgggcggccacgctggccggcagctatctgcacggccaggtggaggcgggcacgctgtgcccggccaccatgacgcaggcggccattccgctgctgcgcagggagccggcgttgtgggaggtgctgcgggacaagctgttcagccatgtccatgacggccgcgacctgccgctggcgcagaaggcctgcgcctggatcggaatggggatgacggaaaagcagggcggttcggacgtgcgcgccaacaccacccgggccgagccgctcggtcatggcggccgcggcggcgaataccggctgcgcggccataaatggtttttctccgcgccgaccagcgatgcccacctggtggtggcgcagctggcggacagcgggccgtcgtgcttttatgtgccgcgctggctgccggacggcagccgcaatgcggtggcgatccagcgcctgaaggacaaggtgggcaaccgcagcaacgccagcagcgaagtggaactccaggacgcctggggcgttctgctgggcgagcccggacgcggcattcccaccatcatcgaaatggccacctatacccgtctcaattgcgtgatcggcagcgcggcgctgttgcggcaggccgcgacgcaggcgttggcgtacacccgccggcggatggccttcggcaaggtgttggcggagcaggcggcgatgcgcgcggtattggccgacctggcgctggaaagcgaggcggcgctggcgctggcgatgcggttggcgcaggctttcgagcgtgacggcgagccggccgagcgggcctggaagcgcatcgtcacgccggccgccaagttttgggtgtgcaagcgcgcggtggagtggagcggcgaggcgatggagatcttcggcggcaacggctatgtcgatgccgggccgatggcgcgcttgttccgcgaggcgccggtcaactccatctgggaaggttcaggcaatgtgatgtgcctggatgtggcgcgcgcggtgcggcgcgagccggaagcctgggagcggctgctggcggatctggcggcgatggccgcgggcgaggccgggctgacggatgcgatcggggatttgcgcgcgcaggcgcaggcggggccggagcaactggaggcgcggggccgccgttttgcccagctgctggccctaaccgcgcaggcttgcctgctgcgcgcgcagtcgccggctttcatcgccgacgctttcatcgccagccgcctgcgcgacgcggcatggggccgggtggctggcgcgctggatgccggcgggatggatgtggaatccatcctgcggcgcagcctgccggtttga

SEQ ID NO: 4279 - DNA, 1032 bp, Chromobacterium substugae
atgcataactccgccccgaatttcagcgtgatcaccggcgacttcatccatggcgcgctggcgcaggccaaaaccgaggtgatcgacatcatccgccaggcctatttgctgcaccaccagcgcaagacggtcaatccggacagctatttcctccgcttcgccgacaggcccgaggcgcgcatcatcgcgctgccggcggcgatccgcgacgccgattcggcgctggaagtctccggcatcaagtggatagccagctatccgggcaatgtcgacgctaatctgcagcgggcttcggcggtggtgctgctcaacgactaccgcaccggctatccgttcgcctgcctggaagcgtcccagatcagctcggcgcgcaccgccgcgtcggcggtgctggccgcgcagcagttatggccccacggccggcgcgccggctcgctggccatcatcggcggcggcgtgatcgccggcagcatcctgtccttcttcgatgccgccggctggcacttcgacgacgtgcgcgcctacgacatcaacgatgcgcatctggcggcgttcacccgcaatatgggcgcgagcctgcgctacccgatccgcgccgccagccgggacgaggccttgcaagccgacatcgtggtgctcgccaccaccgccggcacgccgtggattcccgccggccacgccttcgcgccgtcgcagctgatcctcaacgtctcgctgcgcgacctggcgccggaaaccatcgtcggcgccaacaatgtgctggacgacgtcgagcactgcatgaaagccaacacctcgccacacctggcggagcagcgctacggccatcgcggcttcatcgacggcacgctggcgcaagtgatgcagggcgaaatccgcctggatcccgccaaaccgaccatcttctcgcccttcggcctgggcgtgctggacctgtgcctggcgatgttcttgtaccggaaaagcgaaaccgagggcgccagccatccggtgccgggcttcttcgccgacacccagcgctggaacggctga

SEQ ID NO: 4280 - DNA, 990 bp, Chromobacterium substugae
atgcgatacgactccatcgaacaagccgtctccgacgatattttcctgaggctcgagcaattttccccatcgggcgacgtgcacttgaagatagaaggcttcaatccgggcggatcgatcaagatcaagaccgcgatggcgctgatccgcgacgccgaggagcgcggccagctcgcggcccgcaagaagataatagagtccagttccggcaatctgggcctggcgctaagccagatcgccgcggcgcgcggctatgacttcgtctgcgtcgtcgacaagaacaccagcgcccagaacatcggcatgatgcgcgcgctgggcaccaccgtggtggtgatcgagcagcgcgacgagcacaacggctatctgggcaaccggctcgcctacatccgccaggccatcgcgcgcgaccccgagcggatctggctgaaccagtaccagaatccggccaacccggcggtccatgccgacatgaccgcgcgcgccatcctgaacgagttcggcagcgtcgactacctgttcgtcggcgccggcaccaccggcaccctgatgggctgcgccgcgttcttccgcggccattcgccgcaaacccggctgatcgccgtcgactcggtaggctcggtgactttcggcacgccggggcaggcgcgctatctgcctgggctgggctccagcgtgcagccccacttcttcgacgccgccgcggtggaccggctgatccagattccggaagccgaaaccatcgccgcctgccgcgatgtcgcgctgcgctacggctatctgggcggcgcgtccaccggcacggtgctggccgcggtgcggcgcctgcacgccgaactgccggccgacgccgtggtggtggccatctcgcccgacctgggcaacggctacctggacacggtctacgacgacgactggtgcgatcaacgcttcggcccggcatggcgccaggcctcccaaccgctcaacgagaatctgacctatgcataa

SEQ ID NO: 4281 - DNA, 432 bp, Chromobacterium substugae
atgaatccgaggccaatcgagaccgccgcagccaggcccaagcttgcgctgctgccgccggaccggctgaagccgaccgaggagttcctgccggaacgcttgggggaggtggccgcgcgggtgctggccgatggcggatggaagacgccgatcctggtcgagcgccgcacgctggtggtgatggacggccatcatcgccgcgaattcgcgctgcgccacggcttgatgctggtgccctgcctgttgctggactacgccgacgtcgcgctggaggcccgccgcgacgacctgctggtcacgccggaagaggtgatcgcgcgtggcctggaaggccggccgtacccgcccaaatccacccggcacacgccggtgccggcgctggattgcagctgctggttcgcgctggacgagctgctgccgccgcgggcctga

SEQ ID NO: 4282 - DNA, 618 bp, Chromobacterium substugae
atgggcaaccgcatttctcccgattacgccaccccccactctccccagccgcttaccggcgcgccggcggtgttgtggctgaccggcatttccggcgccggcaaaaccaccatcgccagccatctcaagcagttgtgcctggcatccggccatgcggcggcgatgctggacggcgacgagctgcgcggccggctgaacgccgatctgggtttctctgagagcgaccgggccgagaacgtgcggcgcatcgccgaagtcgcggcgctgatggcggacgccggcctgctggtgatcgtgtcctgcatttcgccgctggcgtctttccgcctggcggcgcgcgacatcgtcggcgcgcagcgcttcgtcgaggtttacatcgacacgccgatcgatgtcgccgaagcccgcgaccccaagggcctgtaccggctggcccgcgccggcaagatcaccggcttcaccggcctgcacgcggcttacgagccgccgcgggagccggcgatccggatcgataccacggtcaccggcgtggaagcggcggcggagcgtctgctcggccattaccaggcgatggcgcgcgcggcggccacccgcgccgaggctggcgtttgtggctga

SEQ ID NO: 4283 - DNA, 1284 bp, Chromobacterium substugae
atggccttagctgcgctgcgcgcctggtgggcggatctgtcaggcccgttcgcgtaccgaaccttcaccgtcgtctggctgaccagcctggctgccaatgtcggctatacggtgcagggcgtgggcgcgtcctgggcgatggcgtcgatggcgccgacgccgacgatggtggcgctggtccagaccgcggccagcgtgccgatcgccctgttcgcattgctgtccggcgtggcggccgacgcctgggaccgccgcgcggtgatgctggcgtcgcaggcgctggtgttcgccgtcgccgcggccttgaccggcttcagcgccgccggctatctggcgccggcgatgattctggcctgcaccttcctcaatggctgcggcgcggccttgtttcagccgacctggcagtcgtcggtggccgaacaggtgccgcgcagccagctgtccgccgcgatcgccctggacagcttttccttgaatttcgcgcgcgccgccgggccggcgttcggcggactgatcgtggccaggttcacccctggcgcggcgttcttgatcagcgcactggccggcgcggtgatgatcgcggcgctgttgtcgtggaaacggccgccgccgcgccggcacccgcgcgagaagctgttggcggcgctggccggcggcgtcgcttattgctggcgcgcgcggcggatgcgcgacgcgctgttccgcagcgcgctgttcggttttctcggcagcccggtttgggcgttgctgccgctgttcgccaagcagcagttcggcggcgccgccggcacctacggcatgctgctggcggcattcggcgtcggcgccaccgccggcgcgctgggcggagccgcgctgcgggcgcgccacgccaaggaaacggtggtgcgcggcggcgctttcgcctttggcctgggcattatcgccgccgccgtgagcccggcgctgccgggcacgctgctgggcctgtccgtcgccggcgccagctgggtggcgtcggtgtccactttcaatctttcgattcaaaccggcgcgcccgaccggctggcgggccgggcattgtccctgttccattcctgcatcatcggcggcatgtcgctgggcagcttcgcctggggctgcgtggcggagccgctcggcgtgggggccgcgctgctgatgtcgggcctgttgatgtcggcgtcgtgcctgctgggctggctgctgccgctggcggaggcggacgagccggacgcggtcctggcggtgagcggtgccggcggaatggacggccactgcaaatga

SEQ ID NO: 4284 - DNA, 1452 bp, Chromobacterium substugae
atgaacaagagcgaagcgatgaagacgattgcgattatcggcgccggtttttgcggcgcgactctggcggcgcggctgttgcggcagccgccggccacgccgctgcgggtggtgctgatcaatcggtccgggccgatggcgcgcggcgtggcgtatggcagccgcaccgcgacccaggtgctgaacgtgccggtgggcaggatggacgcgctgtcggagcggggcgacgggttttaccgttatgtccgccagcggatcgccgacgccgcgcccggcagcttcgtcgcgcgcagcctgtacggcgattacctggagcagctgttgcgggacgccgagcgcgacgcgccggcgggagcgagcttgcgcaccgtggttggcggcgtggcggcgttgcggccgcgcgccgatggcgagggtgcgcgcttgacgctggatgacggcagcgcgctggacgccgaccgggtggtgctctgcgtcggcaactacgcgccgctggatccgcccatcgcggcggcgcagcgcaggttttacgccagccgccgctacatccgcgacccctgggcgccgggcgcgctggcgcgtgtcgcgccggagcagccggtgctggtgataggcagcggcctcaccatgctggacatcctgctggagctgcgcgagcgcggccatcgcgcgcccatccacgcgatatcgcgccgcggcctggcgccgcaggcgcaccgggcgctggacaacccgccgcattacgacgagtcgctgttgcacgcgatgctgagcgagccgaccgcgcgcaactacctgagcctggtgcgcggcgcggcggcgcgccatgcgcgcggcggcggcgactggcgcgacatcgtcggcggcttgcgcgcccgcaccccggagctatggcaggccttgccgctgccggaacggcgccgcttcctgcagcggctgcggccgttctgggaggtgcatcggcaccgctgcgcgccgcaactcggggaaaggctgcgcgccgaactggcgagcggctcgctgcgcctgctcgccggccgggccatcgcctaccgcgagaccggcgacggcgtggaggcgacgctgcagccgcgcggcggcggcgaggcgctgcgcctgcaagtgggggcggtgatcaactgcaccggcccgcgcggcgatgtccgccggctggacgagccgctgctggacagcctgcaagccgacggcctgctggtgccggacgcgctcggcctggggttcgagctggacgagcgctacgcgctgcgcgacagcgccggcgtcgcttcccgctggctgcactacgtcggccctttccttaagggccgttactgggaggcgaccgcggtgccggaattgcgcgttcatgtcgcgcggctggccgaggccttgagcctggactgcggcgatgaaacgcggctgcggcagccggcgcaaccggcaagcgcgtga

SEQ ID NO: 4285 - DNA, 1419 bp, Chromobacterium substugae
  modified_base (1388)..(1388): a, c, t, g, unknown or other
atgctggcgcgggaggaagccccgccggcggacgcggcctggacgccgttgcgcgccggcgccgacggcgtgccgcgcgcctgcgacatgaccgcggacgactggctgctggcttacgacgtcgatgcccagctggccgacggcggcgcgccggcagccgccggcctggaaagcgcgctgcgggagatctggcagtcggtgctcggcgtcgagggactatcggcgaccgacaatttcttcgccgccggcggagactccatcgcctcggtgcaactggcggcgcaggcgcgcgccaagggcatagccttgtcggcgcaagacctgctccgccaccagaccatcgcggcgctggcggcgagcgccagccaggcctcgcccgaacggcagcccagccaggggcggttggcgctgcggcccgcgcagctggcggcgctggatggcggcgcggtgagccgccggttgctgcaagtgccggaagagatggacgagcgttttctgcaggcctggctgcgggcgctgcatgccggccacgatgcgctgcggctgcggtttgcgcgccagggcggcgaatggcgcgcggaattccgcgccgatgccgacgcgctggcgcgcgaggcgcgggatggccgcgcggcgtcgtcgatgccgccgcagccgcaggccgatgccggtcccgtgttgatggcggcgctggaaaaggggcgcgatggcgcgcggctatggctcagcgcccggcaggcggcggtggatgccgcatcgtggcgcacgattctggccgacctgcgcgcggccttcgacgaatggcggcggcgcggcgccatttccgcgcgcggcgcagccgggtttggccgctaccaagagtggtgtgagaagcgggaaggcgagccgcggcaagcagcttggctggcggcgggcggcgaatgggtcttagcgccggttgccgagctggatgcggcgcgcagcgccgccatgctggagagcggtttgcgcaagcatcgggcgcggccggaggagctgttgctggcggccgcgctgttggcggcttgccgctggtcgggcgagagggcgcttactctgcggctggcgcaagatggccgcgcggccgacgccgagctggcggccacggtcggccagttcgatgtcgaacgcggtttgacgctggcgctggcggccggcgagcttgcgccgggggcggcgatcctggcggccaaggaaggctgccgcgcgcagacccaagagctgggcgacgctggccgaaccgcgcgcctggcattccgttacgacggcgatttcgacgcgccggcagcggcgcgcgccggcatcgcgcggctggcgctgccgaacgacgatgacgacgccggcgggccgccggtgcggctgcgcggcgnccggcaaggcctgaaaatcgcaaggtattga

SEQ ID NO: 4286 - DNA, 82 bp, Chromobacterium substugae
ggggggttaccccagcggtcaacgggtccggactgtaaatccggcggcttagccttcgaaggttcgaatccttctcccccca

SEQ ID NO: 4287 - DNA, 71 bp, Chromobacterium substugae
gcgggtgtagctcaatggtagagcagaagccttccaagcttacgacgagggttcgattcccttcacccgct

SEQ ID NO: 4288 - DNA, 72 bp, Chromobacterium substugae
gcccatgtagctcaggggtagagcactcccttggtaagggagaggtcggcagttcaattctgcccatgggca

SEQ ID NO: 4289 - DNA, 1191 bp, Chromobacterium substugae
atggctaaggaaaagtttgcgcggactaagccgcacgtaaacgtcggcaccatcggtcacgttgaccatggtaaaaccactctgaccgcagcgatcaccaccattctgtcgaagaagttcggtggcgaagctaaagactactcccagatcgatagcgcgccggaagaaaaggctcgtggtattaccatcaataccgcgcacgttgaatacgaaaccgaatcccgccactacgctcacgtagactgcccgggccacgccgactatgtgaagaacatgatcaccggcgcagcccagatggacggcgcgattctggtttgctcggccgctgacggtccgatgccgcaaacccgcgaacacatcctgctgtcccgtcaggttggcgtaccgtacatcatcgtttacctgaacaaggctgacctggttgacgacgccgagctgctggaactggttgaaatggaagtgcgcgatctgctgtcttcctacgacttcccgggcgacgacaccccgatcgtaaccggctccgctcgtctggcgctggaaggcgaccagtccgaaatgggcgagccgtcgatcttccgtctggccgacgcgctggactcctacatcccgactccggagcgcgcggttgacaagccgttcctgctgccgatcgaagacgtgttctcgatctccggccgcggcaccgtggtgaccggtcgtgttgagcgcggcatcgtgaaagtcggcgaagagctggaaatcgttggcctgaaagaaaccgccaagaccacctgcaccggcgtggaaatgttccgcaagctgctggaccaaggtcaggctggcgacaacgtgggcgtgctgctgcgcggcaccaagcgtgaagaagttgagcgtggccaagtactggtgaagccgggctcgatcaagccgcacaccgagttcagcggttcggtatacgtgctgagcaaggaagagggcggccgtcacaccccgttcttcgctaactaccgtccgcagttctacttccgcaccaccgacgtgactggcgcagttacgctggccgaaggcgtggaaatggtaatgccgggcgacaacgtggaaatcactgttaagctgatcgctccgatcgcgatggaagagggtctgcgtttcgcgatccgcgaaggtggccgtaccgtcggcgccggcgtggtctccaagatcatcaactaa

SEQ ID NO: 4290 - DNA, 73 bp, Chromobacterium substugae
aggccagtagctcaattggtagagtatcggtctccaaaaccgagggttgggggttcgagaccctcctggcctg

SEQ ID NO: 4291 - DNA, 357 bp, Chromobacterium substugae
atggaaatgcaagataagatcaagttggcactggctggtcttgtggtggcggccggcgttgtcggcttttacctgataccggaaggtcaggacctgctgcgcgcgctggctttcatcgtctccatcctggtggctgccggggtggtgtgggcgtcggcgcccggcaaggggctggtggtctacgccaacgagtccatcgtcgaggctcgcaaggtggtgtggccgacccgcaaggaggcgactcaggtgacgctgatggtgttcgtattcgtcgcggtcctggcgctgttcatgtggctggtggactccagcctgtcctggctgttttacgatgtgattctcggtcgaggtagataa

SEQ ID NO: 4292 - DNA, 483 bp, Chromobacterium substugae
gtgcaaaaggcgctgcgtgaacgtatcgaacgttccgacatcgcagatcaatttggtcagatcctggtgccggtagaggaagtcgtcgacatcaagaatggccgccgctcgatcaccgagcgcaaattcttccctggctacgtgctggtggaaatggaaatgaccgacgatacctggcacttggtgaagagcactcccaaggtgaccggtttcgtcgggggaaccggcaaccgcccggcgccgatttccaagcgcgaagtcgaggccatcatgcagcagatgcaagagggcgtggaaaagccgaagccgaaggtgctgttcgaagttggcgagaaggttcgcgtcatcgacggcccgttcaacgacttcaatggctcggtcgacgaagtcaactacgagcgcaacaagctgcgcgtgtcggtgcagatcttcggtcgcgacaccccggttgagctggaattcagccaggtagagaagctgtaa

SEQ ID NO: 4293 - DNA, 327 bp, Chromobacterium substugae
atggaattctgcaaggcgttcaacgcccagactcaaggcgttgagccgggtctgccgattccggttgtgatcactgcctacgcggacaagtccttcaccttcatcatgaagaccccgccggccaccatcctgctgaagaaggccgctggcatcaagtccggctccgccaaggcgcacgtggacaaggttggcaaggtaacccgcgctcagctggaagaaatcgccaagaccaagcagccggacctgaccgccggtgacctggacgctgctgttcgcaccatcgccggctccgcccgttcgatgggtctggaagtggagggcgtgtaa

SEQ ID NO: 4294 - DNA, 696 bp, Chromobacterium substugae
atggctaagatctccaagcgtctgcaagctctgaaggctaccgttgatcgcaacaagctgtacgctgttgaagaagcgattgccctggtgaaaaccgccgccaccgccaagttcgacgagtccatcgacgtctccgtgaacctgggcgtggatccgcgcaagtccgaccaagttgtccgtggctccgtggttctgccgcgcggcaccggcaagtcggtacgcgttgccgtattcgctcaaggcgccaacgccgaagccgccaaggctgccggcgctgaagtggtcggtttcgaagacctggccgagcaagttaaagccggcaacctggacttcgacgttgtcatcgcttccccggatgcgatgcgcgttgtcggtcagctgggtcagatcctgggcccgcgcggcctgatgccgaacccgaaggttggcactgttaccccgaacgtagccgaagccgtgaagaacgccaaggctggtcaggttcagtaccgcaccgataaggctggtatcatccacgccaccatcggccgcgcttccttcgaagctgaagccctgcgtgaaaacctttccgctctggttgatgccctggtgaaagccaagccggcagcttccaagggtgtgtatctgaagaagatcgccgtatccagcaccatgggtgtcggcgctcgcgtagataccgctaccgtcaacgcctaa

SEQ ID NO: 4295 - DNA, 72 bp, Chromobacterium substugae
gctcatgtagctcaggggtagagcactcccttggtaagggagaggtcggcggttcaattccgcccatgagca

SEQ ID NO: 4296 - DNA, 387 bp, Chromobacterium substugae
atgaccaagcttcgcgcccaggcgcgagctaacggcgtgttcctgcgcgttctgaagaacacgctggtgcgtcgtgccgtggaaggcactccgttcgccgatctggctgaccaaatggttggcccgttggtgtacgcgatttccgccgacccggttgctgctgccaaggtgctgcatcaatttgccaaggccgacgacaaaatcatcgtcaaggcaggttcctacgaaggcaaggtactgtccgctgctcaggttgctgagctggcgtccatcccgagccgcgaagaactgctgtccaagcttctctacgttatgcaggctccggtcgctggcttcgcccgcgcgctggccgccctgtccgacaagaagcaagccgaagccgcttaa

SEQ ID NO: 4297 - DNA, 372 bp, Chromobacterium substugae
atggcaatcaccaaagaagacatcctcgaggccgttgctggtctgaccgtgatggaactgaacgacctggttaaggcgttcgaagagaagttcggcgtttccgccgctgctgtagctgttgctggcccggccggcgctggcgctgccgccgctgaagaaaagaccgagttcgacgttgttctgaccgccgctggcgacaacaaggttggcgtgatcaaggttgttcgcgcgatcaccggcctgggtctgaaggaagccaaagacctggtagacggcgctccgaagaacgtgaaggaaggcgtgtccaaggctgaagccgacgacgttgccaagcaactgatcgaagctggtgctaaggctgaagtcaaataa

SEQ ID NO: 4298 - DNA, 4176 bp, Chromobacterium substugae
atgagttattcgtttactgagaagaaacgtattcgtaagagctttgcgaaacgtgccagtgttctcgacgtcccattcctgttggcgacccagattgattcctacaccgaatttctccagctgggcaagccgctggatgagcgcaaggatgtgggtcttcaggctgcgttcaagtcgattttcccgatcgtcagccataacggctatgccaagctggacttcgcccactatatcctgggcgaaccgccgttcgacgtgcaggagtgccagctgcgcggcatcactttcgccgccccgctgcgcgcccgcattcgcctgacgattttcgacaaggaatcgtccaagccggtggtgaaggaagtgcgcgagaatgaggtgtacatgggcgagattccgctcatgaccaccaacgggtctttcatcatcaatggcaccgagcgtgtcatcgtttcccagttgcaccgttccccgggcgtgttcttcgagcacgaccgcggcaagacccattcctcgggcaaactgctgttctcggcgcgcgtgattccctaccgcggctcctggctggacttcgagttcgatccgaaggacctgctgtacttccgtatcgaccgtcgccgcaagatgccggttaccattctgctgaaggcgctgggttacagcaacgaagaaatcctgtccgagttctacagctttgacaccttctacctgacccgcaacggcgtattcatgcgcgtggtgccggatcgtctgaagggcgaagtggccaagttcgacatcgtggccgccgacggcaagctgatcgtcgccaaggacaagcgcatcaccgccaagcacatccgcgacatccagaccgctgagctggatcgcattgaagtgccggccgacgcgctgctgggcaagatgctggcgcacaacgtggtgaaccagaacaccggcgaagtgatctcccgcgccaacgaggaagtgaccgaggaagtgctggccaagctggcgctggcggacatcgaccaggtcgacgtgctgttcaccaacgatctggaccagggcgcgtacatctcgcaaaccctgcgttccgacgacatccaggaccagctgcaagcccgcgtggcgatctaccgcatgatgcgcccgggcgagccgccgaccgaagacgcggtggaagcgctgttccagcgcctgttcttcagcgaagaaacctacgatctgtcgcgcgtgggccgcatgaagttcagctcgcgcacttaccagtacaaattcgacgacaagaccccggaatggttcaagtcgctgatcggcgacaagttcgcgtcgcgccgcgacgtgatggaaggcacgctgtccactgaggacatcgtgtccgtgatcgccattctgaccgagctgcgcaatggccgcggcgaagtggacgacatcgatcacctgggcaaccgtcgcgtgcgttcggtgggcgaactggccgagaaccagttccgcgccggtctggtgcgtgtcgagcgcgcggtcaaggaacgcctgaaccaggccgagtccgacaacctgatgccgcacgacctgatcaacgccaagccggtttccgccgcgatcaaggaattctttggttcctcgcagctgtcccagttcatggatcagaccaacccgctgtcggaaatcacccacaagcgccgcgtatcggctcttggcccgggcggtctgacccgcgagcgcgccggcttcgaagtgcgcgacgtgcacccgacccactacggccgcgtgtgcccgatcgaaacgcctgaaggtccgaacatcggcctgatcaactcgctgtccgtgtttgcgcgcaccaacgagttcggtttcctggaaaccccgtaccgcaaggtggtggacagcaaggtcaccaacgagatcgactacctgtccgcgatcgaagaaggccgctacgtgatcgcccaggccaacgccgagctgagcgaagacggcgcgctgatcgacgagctggtgacctgccgcgagaagggcgaaaccattctggcgacgccggaccgcgtgcagtacatggacgtggccaccggccaggtggtgtccgtggccgcttcgctgattccgttcctggaacacgatgacgccaaccgcgcattgatgggcgccaacatgcaacgtcaggccgtaccgtgcctgcgtccggaaaaagccttcgtcggcaccggcatcgagcgttcggtggctgtcgactccggcaccaccgtggtggctcgccgcggcggcgtggtcgattacgtcgacgccggccgcgtggtggttcgcgtcaacgatgaagaagcgaccgctggcgaagtgggcgtggacatctacaacctgaccaagttcacccgttccaaccagaacaccaacatcaaccagcgtccgatcgtgaaagtgggcgaccacatcgcgcgcggcgacgtggtggccgacggcgcctccaccgacctgggcgagctggcgctgggtcagaacatgaccatcgcgttcatgccgtggaacggctacaactacgaagactcgattctgatctcggaaaagctggtcgcagaagaccgctacacctcgatccacatcgaagagctgtccgtggttgcccgcgacaccaagctggggccggaagaaatcacccgcgacatcccgaacctgtccgaacgcatggcaggccgtctggatgaatccggcatcgtctacatcggcgcagaagtcgaagccggcgacgtgctggtgggcaaggtgacgcctaagggcgaaacccagctgacgccggaagagaagctgctgcgcgcgatcttcggcgagaaggcctccgacgtgaaggacacaagcttgcgcgtgccgaccggcaccgtgggcaccgtgatcgacgtgcaggtgttcacccgcgaaggcatcgagcgcgacaagcgcgcccagtccatcatcgattcggaactgaagcgctatcgccttgacctgaacgaccagctgcgtattttcgacaacgacgccttcagccgtatcgaacgcctgatcgtcggcaaggtcgccaacggcggtccgaagcgtctggccaagggcaccgtgatcgaccaggaatacctggccggcctgccgaccaagcacgattggttcgacatccgcatgagcgatgaagacatcgccaagcagctggaactgatcaaggaaagcctggcgcagaagcgtgaagaattcgacctcaagttcgaagacaagaagcgcaagctgacccagggcgacgagctgccgccgggcgtgcagaagatggtcaaggtttatctggccgtgaagcgccgcctgcaggcgggcgacaagatggccggccgtcacggtaacaagggtgtggtttcccgcatcctgccgatcgaagacatgccgtacatgggcgacggccgtccggtcgacatcgtgctgaacccgctgggcgtaccgtcgcgtatgaacatcggccagatcctggaagttcacctgggttgggcagccaagggcatcggcgaacgcgtcgaccgcatgatcaaggaacagcagaccgctgccgagatccgcggctacctggaacgcctgtacaacgaaaccggccgcagcgaggacctggcgtccctgagcgacgacgaagtgctgcaactggcgcaaaacctgcgcaagggcatgacttttgctacaccggtattcgacggcgcgaaggaagccgagatcaagcacatgctggatctggcctacccggacggcgacgagctgaccgacaagatgggcttcaacgagtccaagacccagatgaccctgcacgacggccgctccggcgaagccttcgaccgcaaggtgaccgtgggcgtcatgcactacctgaagctgcatcacctggtcgacgacaagatgcacgcccgttccaccggcccgtactcgctggtgacccagcagccgctgggcggtaaggcgcagttcggcggccagcgtttcggtgagatggaggtgtgggcgctggaagcttacggcgccgcctacacgctgcaggaaatgctgaccgtgaagtcggacgatgtgaccggccgtaccaaggtctacgaaaacatcgtcaagggcgagcacaagatcgatgccggcatgccggaatccttcaacgtgctggtgaaggaaatccgttcgctcggcctggatatcgacctggaacgttattga

SEQ ID NO: 4299 - DNA, 4197 bp, Chromobacterium substugae
atgaaagctctgctcgacctctttaagcaagttacgcaagaagaagagtttgatgcgattaagatcggcatcgcctcgcctgacaagatccgttcctggtcttatggtgaagtaaagaaacccgaaaccatcaactaccgcaccttcaagccggaacgcgacggcctgttctgcgcccgcatcttcgggccggtgaaggactacgagtgcctgtgcggcaagtacaagcgcctgaagcaccgcggcgtgatctgcgagaagtgcggcgtcgaagtgaccctgtccaaagtgcgccgcgagcgcatgggccacatcgaactggccagcccgaccgcgcacatctggttcctgaagtcgctgccgtcgcgtctgggcatggtgctcgacatgacgctgcgcgacatcgaacgcgtgctgtacttcgaagcgttcgtggtgaccgatccgggcatgaccccgatgcagtaccgccagctgttgaccgaagaggacttcctggacaaggaagaccagtacggtgaagagttcgtcgccatgatgggcgccgaggcggtgaaggaactgctgaagaaactggatctggacagcgagatcgagaccctgcgtcgcgagctcgaagccaccaattccgacaccaagatcaagaagatcgccaagcgcctgaaagtgctggaggccttccagcgttccggcatgaagccggaatggatgatcctggacgtgctgccggtgctgccgccggaattgcgtccgctggtgccgctggacggcggccgcttcgcgacctccgacctgaacaacctgtaccgccgcgtcatcaaccggaacaaccgtctgaagcgcctgctggaactgcgcgcgccggacatcatcgtgcgcaacgagaagcgcatgctgcaggaatcggttgactcgctgctggacaacggccgtcgcggcaaggcgatgaccggcgccaacaagcgtccgctgaagtcgctggccgacatgatcaagggtaagggcggccgtttccgtcagaacctgctgggtaagcgtgtcgactactccggccgttccgtgatcaccgtgggcccgaccctgcgcctgcatcagtgcggcctgccgaagaagatggcgctggaactgttcaagccgttcatcttccacaagctggaagtgatgggcctggcgtccaccatcaaggcggccaagaagctggtcgagcaggaagtgccggaagtctgggacatccttgaagacgtgatccgcgagcacccggtgctgctgaaccgcgcgccgaccctgcaccgtctgggcatccaggcgttcgagccggtgctgatcgaaggcaaggccatccagctgcacccgctggtctgcgcggcgttcaacgccgacttcgacggcgaccagatggccgttcacgtgccgctgtcgctcgaagcgcagatggaagcccgcaccctgatgctggccaccaacaacgtgctgtccccggccaacggcgagcctatcatcgtgccgtcgcaggatatcgtgttgggtctgtattacatgacccgcgacaaggtgaacggcaagggcgaaggcatggtgttcgccgacaccaaggaggtgcatcgcgcttacgaaacccgccaagtcgagctggctacccgcatcaccgtccgcctgaaggaatgggaaaaggacgagcagggcgagttccagccggtgatcaagcgttacgacaccaccgtcggccgcgcgatcctgtcggacatcctgcctaagggcctgccgttcgagcacatcaacaaggcgctgaagaagaaagaaatctcgaaactgatcaacgtttcgttccgtcgttgcggcatccgcgacacggtgatcttcgccgaccagctgatgtacaccggtttcgcctactccacccgcggcggcatctccatctgcgtggacgacatgcagattccgaagaaaaagaccgaactgcttggcgaagccaacaaggaagtcaaggagatcgaagagcagtatcgccagggtctggtgacccagggcgaacgctacaacaaggtggtggatatctggggccgcaccggcgacaagatcgccaaggcgatgatggacgagctgtccaagcagcgcgtgctggatcgcgacggcaaggaagtcgaccaagagtccttcaactcgatttacatgatggctgactcgggcgcgcggggttccgcagcccagatcaagcagctggccggcatgcggggcctgatggcgaaaccggacggttccattatcgaaaccccgattaccgccaacttccgcgaaggcttgacggtactgcagtacttcatctccacccacggcgcccgtaagggtctggcggatacggcgttgaagaccgcgaactccggttacctgacccgtcgtctggtcgacgtgacccaggatctggtggtgatcgaggacgattgcggcaccaccaacggcttcaccatgaaggccgtgctgcaaggcggcgacgtgatcgaagcgctgcgcgaccgcatcctcggccgcgtgaccgcggtagacgtggtggatccgtccaccggcgaaaccgtgatcgaagccggcacgctgctggacgagcagatggtcgactcgatcgacagcctgggcatcgacgaagtgaaggtgcgtaccgccatcacttgcgacacccgctacggtctgtgcgcgaagtgctacggccgcgacctggcgcgcggcaagcgcgtcaacgccggcgaagcggtaggcgtgatcgccgcccagtcgatcggcgaaccgggcacccagctgaccatgcgtaccttccacatcggtggcgcggcgtcgcgaaatgcggccgccagccaagtggaaggcaagtccaacggtaccgtgcgcttctccagccagatgcgttacgtggcgaacaccaagggcgagctgatcgtcatcacccgctccggcgaagtggtgatccacgacgacatgggccgcgagcgcgagcgtcacaaggtgccgtacggcgcgaccctgatggtgaccgatggtctgcagatcaaggcaggcacggttctggccacctgggacccgcacacccgtccgatcatcaccgagtacgctggccgcgtgaagttcgagaacgtggaagagggcaacaccgtagccaagcagaccgacgaagtgaccggcctgtccacgctggtggtgatcgacccgaaacgccgcgccggcgcccagtcgaagatgctgcgtccgctggtgaagctgctcgacgacaacggcaacgaagtgaagctggccggttcggacgcttcggtttcgattaccttccaggtgggcgcgatcattaccgttcgcgacggccaggacgtgggcaagggcgaagtgctggcccgcatcccgcaggaatcgtcgaagacccgcgacattaccggtggtctgccgcgtgtggccgagctgttcgaagcccgttcgccgaaggatgccggcatgctggccgaggtgaccggtaccgtttccttcggtaaggacaccaagggcaagcagcgcctgatcatcaccgatctggaaggcagcggctacgaaaacctgatcccgaaggacaagcacgtgctggtccacgacggccaggtggtgaaccgcggcgaatccatcgtcgatggtccggtcgatccgcacgacatcctgcgtctgcagggcatcgaggcgctggcccgctacatcgtccaggaagttcaggaagtgtaccgtctgcagggcgtgaagattaacgacaagcacatcgaggtgatcattcgccagatgctgcgtcgcgtcgtgatctccgacagcggcgacaccgagttcatccagggcgaacaggtggaacgcgccgaagtgctggaaatgaacgacaagatggtcgcggagggcaaggagccggcgcagtacgaaaacgtgctgctgggcatcaccaaggcgtccttgtcgaccgactcgttcatctccgcggcttccttccaggaaaccacccgcgtgctgaccgaagcggccatcatgggcaagaaggacgatctgcgcggcctgaaggaaaacgtgatcgtcggccgtctgattccggccggtaccggtctcgcgtaccatcgcacccgccgtcgccagcaactgggcctcgacgccgccgaatcgcagctgttcgactcgggcatgctcaacacggcgctggaaaacgacgaataa

SEQ ID NO: 4300 - DNA, 276 bp, Chromobacterium substugae
gtgtgcacccgtgtctacaccaccactccgaagaagccgaactcggcgctgcgtaaagtgtgcaaggtacgtctgaccaacggtttcgaagtgatttcctacatcggtggcgaaggccacaacctgcaggaacactcggtagtgctgatccgcggcggtcgtgtaaaagacttgccgggtgtgcgttaccacaccgtgcgcggttccctggataccgcaggcgtgaaagaccgtaagcaagcccgttccaagtacggcgccaagcgtcccaagtaa

SEQ ID NO: 4301 - DNA, 471 bp, Chromobacterium substugae
atgccaagacgcagagaagtccccaagcgtgaaattctgccggatccgaagttcggttcgcaggatctctccaaattcatgaacgttgtgatgatcgacggcaagaagtctgtagccgaacgcatcatctacggcgctctggaacagatcgaaaagaaatccggcaaaaacgccctggaagtgttcaacgcagcactgtccaacgccaagccggtagtggaagtaaaaagccgccgcgtaggtggtgcaaactatcaagttcctgttgaagtacgtccgtcgcgtcgtatggccctggccatgcgttggctgcgcgacgctgcgcgcaagcgcggtgagaagtccatggacctgcgcctggctggtgaattgctcgatgcggccgaaggccgtggcggcgcgatgaagaagcgtgacgaagtgcaccgcatggcagaagccaacaaggccttctcgcacttccgtttctaa

SEQ ID NO: 4302 - DNA, 150 bp, Chromobacterium substugae
atgcacttcaccgatcttgtggttcacaccggtgtaaaacagaatacgctcggtagtagtagtcttaccggcgtcaatgtgagcggagataccgatattacggtagcgctcaaggggggttttccgtgccacgatctacaccttgaataa

SEQ ID NO: 4303 - DNA, 1974 bp, Chromobacterium substugae
gtgcatgatggcgccgccaccatggactggatggagcaagagcaggaacgtggcatcaccatcacttccgccgctaccaccacctattggaagggtatggccatgcagtatccggcccaccacttcaatatcatcgacactccgggacacgtggacttcaccatcgaggtggagcgttccatgcgcgtgctggacggtgccgtgatggtttactgcgctgtgggcggcgttcagccccagtcggaaaccgtatggcgccaggccaacaagtacaaggttccgcgtatcgcgttcgtgaacaagatggaccgtcaaggcgccaacttcttccgcgcggttgagcaggtgaaaacccgcctgcgcggcaacccggtgcctatcgtcgtgcctatcggcgcggaagatagcttcaccggcgtggtcgacctgctgaagatgaaggccatcatctgggatgaagcttcccagggcatgaagttcgagtacggcgatatcccggccgacctggtttccgttgccgaagaatggcgcgagaagatggttgaagccgccgccgaagtcagcgaagaaatgatggacaagtacttgggcggcgaaacgctgaccgaggaagaaatcgttgctggcctgcgcgaacgtaccctgaagtgcgaaatccagccgatgctgtgcggctccgcgttcaagaacaagggtgttcagcgcatgctggacgccgtgatcgaactgctgccgagcccgctggatgttccgccggttccgggtgagaacgaagacggcaccccgaccacccgcgaagcttccgacgacgcttccttctccgctctggcgttcaagctgatgaacgacccgtacgtgggccagctgaccttcttccgcgtctactccggcgtggtgaagtccggcgacaccgtgctgaactcggtcaaaggcaagaaagagcgtatcggccgtatcgtgcagatgcacgccaacgaccgtaaggagatcgaagaagtgcacgccggcgacatcgccgctgccatcggtctgaaggaagttaccaccggtgaaaccctgtgcgcgatcgacgctccgttgatcctcgagcgcatggaattcccggaaccggtgatccacgttgccgttgagccgaaaaccaaggccgaccaggagaagatgggcgttgccctgaatcgcctggccaaggaagacccgtcgttccgcgtgcgtaccgacgaagaatccggccagaccatcatttccggcatgggtgaactgcacctggaaattctggttgaccgcatgaagcgcgaattcggcgttgaagccaacgtcggcgcgccgcaagtggcttaccgcgaaaccatcaccaagacggttaccgacgttgacggcaagcacgtcaagcagtccggcggtaagggtcagtatggtcacgccgtgatcacgctggaaccgtccggcgaaggccagggctacaagtttgtcgacgagatcaagggtggcgtgattccgcgcgaattcatcccgtccgtggacaagggtattcaaaacaccctgtccaacggtattctcgccggcttcccggtggtggacgtgactgtgcgtctgaccttcggttcctaccacgacgtcgactcctcgcagatcgcgttcgaactggcaggctcgctggctttcaaggaagccatgcgccgcgccggtccgtgcatcctcgagccgatgatggctgtggaagtggagactccggaagagtacatgggtgacgtcatgggtgacttgaaccgccgtcgcggcatggttcaaggcatggacgacgacggtctgggcggcaagatcatcaaggctgaagtaccgctggccgagatgttcggttactccaccgacctgcgttcggctacccaaggccgtgccacctactcgatggagttcaagcactactcccaggctccgaagcacgtcgctgacgctgtaatggccgccaagaagtaa

SEQ ID NO: 4304 - DNA, 1176 bp, Chromobacterium substugae
  modified_base (613)..(613): a, c, t, g, unknown or other
atggcaaaagaaaagtttgcgcggaccaagccgcacgtaaacgtcggcaccatcggtcacgttgaccatggtaaaaccactctgaccgcagcgatcaccaccattctgtcgaagaagttcggtggcgaagctaaagactactcccagatcgatagcgcgccggaagaaaaggctcgtggtattaccatcaataccgcgcacgttgaatacgaaaccgaatcccgccactacgctcacgtagactgcccgggccacgccgactatgtgaagaacatgatcaccggcgcagcccagatggacggcgcgattctggtttgctcggccgctgacggtccgatgccgcaaacccgcgaacacatcctgctgtcccgtcaggttggcgtaccgtacatcatcgtttacctgaacaaggctgacctggttgacgacgccgagctgctggaactggttgaaatggaagtgcgcgatctgctgtctgaagtcgtaggaagacagcagatcgcgcacttccatttcaaccagttccagcagctcggcgtcgtcaaccaggtcagccttgttcaggtaaacgatgatgtacggtacgccaacctgacgggacagcaggatgtgntcgcccaacgcgacgccaaccacacgacgggccggcgttggatccacaacgtcggccagcacctcagcctgttcgtggcgggggtgaaggacaaggtggcgctgaagctgatcgcggcgaaggggaaggtgcaagtgcaggcgcagagcgacgcgatggagctgacggcggatcaagacctctccatcacctcggtgaaacagaaaatccacctcaacggcaaacaggaaatcctgctgaccagcggcggcgcttacgtgcggatcaaggacggcaagatcgagctgcatgcgccgggcaccgtcagcttcaagggtggtagccatgattggagtggggggacgagtcttggccagacctataacgccatgccgcaagccaagtttgatgatcgtttccagctagtagatcagcatacgggccagcctctggttaatcataagtatgagatacatcgtgaatttgggggagtagagcgaggatatactgatagtgaaggatttacccacatgataaaaaatcctgatgcagcagagagtattgaaattaaaatatttaagtaa

SEQ ID NO: 4305 - DNA, 366 bp, Chromobacterium substugae
atgtccaatgtctcgccatttgtcccgcccgccgctcccaggcccgccccgctccccgccaccgcggcggcgctggtggagctgcgccaagtcatcgccaagctgcaaagcccgcatgaccctacctgccccaccacgctgcgcttgtcgatggagcggctggcccagctggaccgcgacatcgaacaagccctcagcgccagcagccacacgctggcccgcgtcagcgaaggcatgcagtcgctgttgaacctgctgctgctggccgacgccaccccgttgccctcgcgccagctgttcagcctgatctccccgctgcaccgccagttgctgcaggcccgttaccagttggagggcagggtgtag

SEQ ID NO: 4306 - DNA, 387 bp, Chromobacterium substugae
atgacccatcacaccgaactggcgccccatacttccgcccaagcccgcgcggcaaaccgccggccgcagccggccaaacccaccgccgcgctggcagggctgaagcaagccctggcccagctgcaagccatgctggccgacccggacctggccagcctgaaccaaccgctggcgcggctaaacgaactatgcggcgacattgaaggcgcggtggtggcagccatctgccacctggccgacggccagcagagccagcacgcggtgcgggacctgctgacttgcctgggcgacgacctgcgcctgccttccagccggctgcgggaattgctgctgccgctggatgcgcgcatggacaaggcgctgacgctgcttgcccaggtgcgctaa

SEQ ID NO: 4307 - DNA, 321 bp, Chromobacterium substugae
ttgtctcagcccagcctgctggccatgcataggctgcatgatgcctttgccgccttgcaggaccagctagcccgcaagccgcaggcctgcgcccgcgtgccggcggcgcagttggcgcatctgtgccgcgacattgaggacgcggtggtagaaaccatctgccacctggcccatagccagctgggcctgcaggcgctgttggacctgcttgcctgcctgggcgacgatgtgcgcctgccttccagccgcctgctgcaattattgcagccgctggacaagcgggtggaggcgtcgcttagccggctgaccggcgtgctgtaa

SEQ ID NO: 4308 - DNA, 927 bp, Chromobacterium substugae
atgagccgcctgtcccaatcccaaaaagtggcgcaactgctgcgcagccaccctggtcaacgtttcaccgcccgccagattgccagcaccatcgtgcatcaatacccagaagactatgcagacaagcgcagcaacccgcgttttgccaacgacaaggcatttctctcccaagtggtagcggagattggcgcgcagaaagatgccatcatcggcgcagatagccggatacgctggcaagacaaacctcggccacgggtgtactggtatgaaaccacggatgcggtggtggaaacggtaattgaagaagacgaagatgacagcccggcagccgagcaggccgatctaagcgagtaccaactgtaccccttgctgatgcagtatctgcaaaccgaactgtctttgtatggcctgcgtgtcgacgaaaaacgctcacgtaaccagcgcggcagcggcggcaaccattggctgcacccagacctggtagccatgcaaccagtggcaaaagactggcacgagctggtacgcagctgcgtactgcatggcggtggccagagcgtgcggctgtgggcttttgaagtaaagaaagaactaacccggggtaatgtgcgcaagtccttcttccaggccgtcagtaattccagctgggctaacgaaggctacttggtttgcaccggcatcgtcggcaaagacacggaagacgaattgcgcatgctgtccgccctgcacggtataggcgtgatcgtactggacagcagcaaccccagcgagagcgagatcgtcgtccccgcccgagcccgtcaggatgtggactggcaatcggtccaccggctggtggaagaaaacgaagacatgcgcgaatttgtagaactggtttccacttactaccaaaccggccgcctgcggccacaagactggaataagtgttaa

SEQ ID NO: 4309 - DNA, 1620 bp, Chromobacterium substugae
atgaccgaacaaaaccaaaaacaattgggcaacaccctttggagcatcgccgaccaactacgcggggcgatggatgcggacgacttccgcgactacatgctgtccttcctcttcctgcgctatctctccgacaactacgagacggcggcgaagaaagagttagggcgggactatccgaaagatgacgaatatgggtgtcaggtgccgctggcgcgctggtacgacgccaatgagagtgatattcctgcgtttgaaaagcagatgcgccgcaaggtgcactacgtcatccggcctgaacacctatggaatagtattgccaatctggcacgcacgcagagcaagtatttgttgagcaggttgcaggatggttttaaatatatcgagacagaatcgtttgagagcactttccagggcttgttctcagagattgacctctcctctcccaagctcggcaaaacttacgaagatcgcaacgccaagctttgcaccatcatccagaagattgccgaagggttggcggaattctcaaccgacattgacgcattaggcgatgcctatgaatacctgatcggccaatttgccgccgggtcgggcaagaaagcgggcgagttctacaccccgcagcagatttccgacatcctctccgccatcgtcacactggacagccaggagccgaaaaccggcaccaagaagcggctagaaagcgtgatggactttgcctgcggctccggctcactgttgctcaacgtgcgcaagaaggtagccaaggcgggcggcaccatcggcaagatcttcggccaggaaaaaaacatcaccacctacaacctggcacgcatgaacatgctgttgcacggggtgaaggacacggagttcgagatcttccacggtgacaccctgctcaacgagtgggacatgatgcgcgagcagaacccggccaagaggcctagctttgacgccatcgtcgccaatccacccttcagctaccgctgggaaccgaccgacgcgctggccgacgatgtgaggttcaagagccatggcctagcgcccaagtccgcggccgacttcgccttcctgctgcatggcttccactacctcaaagacgaaggcgtgatggccatcattctgccgcacggcgtgctgttccgcggcggcgcggaagaacgcatccgcaccaagctgctcaaggacggccacatcgacaccatcatcggcctgcctgccaatctgttctactccaccggcattccggtctgcatcctggtgctgaaaaagtgcaagaagccggacgacgtgttgttcatcaacgccgccgagcactttgtgaaaggcaagcgccagaaccagctgagcgatgagcacatcgcaaaaattatcgacacctatcagcaacggccagaaaagcctatcgagcgctacgcccgcagggttgagatggcggagattgagaagaatgacttcaacctgaatatctcccgctacatcagcacggcagtggctgaagaagaaatcaaattagatgagttgaatcagacactgggcgatatcgagcaagagattgctaaggccaaggccaaacacaataccttcctcaaagaattggggctgccattattgccttaa

SEQ ID NO: 4310 - DNA, 1011 bp, Chromobacterium substugae
atgaccgatctcattctctacaccaccgaagacggccgcagccagatcaagctgcgagcgcaggagcaaaccgtctggctgacacagctggagatggcggagctgtttgacgccagcaagcagaacatctccctgcacttaaaaaacatcttcgaagacagggagttggacgcagcggcaactgtcaaggaatccttgacagttcaaatcgagggcagccgcaaggtacagcgccccgtcacgctctacaacctcgatgccattctcgccgtcggctatcgcgtgcgctcaccgcgcggggtgcagttccgccgctgggcttccaccgtcctgaaagagtacctgaccaagggctttgtgatggacgatgagcggttgaagaatccggatggccgcccggattatttcgacgagatgctggcgcgcattcgggatatccgggcctccgagaagcgcttttaccagaaggtacgcgatctgtttgcgctctccagcgactacgacaaaacggacaaggccacgcaggttttctttgccactgtgcagaacctattgatctatgccgtgacgcagaagaccgccgctgaactcattaccgcccgcgccaatgtggctgatccgaatttcggcctactcgcctggaagggtaacaaggtacgcaaggcagacattgtggtggccaagaactacctgaccgaggacgagatcgacaccctgaaccggctggtggtcatcttcctggaaaccgccgagctgcgggccaagagcaagcaagaaacgcgcatggccttctggaaacagaacgtggatcagatcatcaccttcaacggattcccgctgctcacccacgccggcaccatcagccatgagcagatggaagcacgcacaggtgagctatatctccagtttgaccagaaccgcaaacggcaggaagcgattgctgccgaccagcaggacgagatcgatctaaaggcactggagaacaccttgaaaaggcgggcaaagccatga

SEQ ID NO: 4311 - DNA, 1188 bp, Chromobacterium substugae
atgagcggcaaacctacgatcaacagctatgccaatctgcagacgctcgcgaaaaagctgcggtctgacctcaccgggattgatctcatcctgctctatgcctacaaccgtaccggcaagacgcggctatcgatggaattcaaggatgacggtaagcgtaagacgaaaaagaatccggacggaatcgccgacacgctttatttcaatgcctataccgaagacttgttcacctgggacaacgacctcgacggtgataaggtccgacagctccagctcaatgccaactccacttttttcaatggcctgaaagacctggcgctggacgcaacgattgcaggctaccttgaccgctacgcagacttcgatttcgacattgactacgagacatggaaggtctcttttcgcaaaggggaggacgaaaatattaagatctcccgtggcgagcagaacatcttcatctggtgcctattcatggccatttgcgagcggatgctcgacggacacgtctcctatcagtcgaacaaatacctctatatcgacgaccccatctcctcgctggacgacaacaacgccatcgccgtggcctgtgacctcgccaagctcctgcgccgagccgcgagccgaaaagacgagagcggcgcgctcgcgcccatcaaagtggtgttctcgtcccatcacgcgctgttcttcaacgtaatgtgcaacgagcttggcaggacgaaagaaggggagacgaaagtcagccacaggcgttatttcctgcatcgcccgaatggcgatgggaaatataccttgcgagccacagaggacacgccgttctttcatcacgttgcatcactcgccgagcttcagctggccgcggcccctggcaccggcaagctctatactttccatttcaacgccctgcgcagcatcatggaaaaaaccgcgtccttctttggccatgcggatatttccttctgcctcaaggcgctgaacaccgaagatgtggcactctacaaccgcgccctgaacctgctcagtcacggcaaatacgccatccacgaaccgaccgaaatgggcgaggacaacaaagacctcttccggcgtatttttagagatttcactactcagttccagtttgacctgccagagattttggcgacaacgcccgctgtggctgcacctgtacccgagcctgcaccatga

SEQ ID NO: 4312 - DNA, 1329 bp, Chromobacterium substugae
atgagcagtaagaacaaaaccaccgcgatgacgggagagaaaaagcccacgctggtgccgaagctgcggtttcctgaatttcaaagcgctggcgattggacgacagtaaagctcggagcaattgcgacgatctgtacggaaaaagttggcaagaacatttgcgtgccgatgagcatcacatcgggcgtaggacttgtgagccaagaagaaaaatttgggcgcgtaattgcgggcgactcatacagaaattacctgctcttgaagccatacgattttgcgtacaacaagagcgccaccaaagaatatcccgaaggttttctcaccttgtactcgggcactgagctggcagcggttccgaacagcatattcacttgtttccgaatcaacggggagtcaccagatgcgctgtttttaaactatcaattctcagacaacattcacgggcgttggctgcgcaaatttattcaggtaggcgctagggcccatggctcgttgagcatcaacgacagcgatctgatggctctacctgttcccatcccgacaggcacgacacccctcgccgaacaacaaaaaatcgccgagtgcctgagttcgctggatgagctgatcaccgcgcaagcgcggaaagtggacgcgctcaatacccataaaaaagggctgatgcagcagctttttccccgcgaaggtgagacactgcctagctttcggtttccggagtttcaaaaggaagggaattggaaagttttgccacttgcagttttgacagacaagattatggtaggaattgcaagtgcggctactcatgcatatcgtgaaacaggcgtgcctatgttgaggaatctaaatattaaggagagtggaattgatgactccagccttctatatatcgaccccacttacgaagcgactcacaagaacaaacgattgagagcgggcgatgtcatcaccgtaagaactggctacccgggtttgtctgcggtagttaccaaaccctttgaaaatgcgcagtgctttacatccctaataactcgtccaaaagctgatattttagattcaaattatctatgtctatatataaattcccccattgggaaaaaatttatgttaggagcagaagcgggaggggcacaaaagaacgtcaatgccggtgcattagaaacactagaggtttatctcccgcaacttgaagagcagcgaaaaatagccactagtttcagcagcctcgatgctctgatcgccgccgaaacccaaaagctcgaggccctcaagacccacaaaaagggcctgatgcagcagctatttccatcctcggaggaggtcgaggcatga

SEQ ID NO: 4313 - DNA, 3054 bp, Chromobacterium substugae
atgaacacgcatgaacgtcagatcgagcatgatttcatcgccaagctcaatgagctcaaatacaccatacgctcagacatcaatgatcgtgctgcgcttgagaacaatttccgcgaaaaattcgaagcgttgaatcgcgtccgcctcacggacgccgagttcaagcggctgcatgacgagatagtcacctcggacgtattcaccgccgccaagaccctgcgcagcatcaatgccttcacccgcgacgacggcacaccactgaactacatgctggtgaacatcaaggactggtgcaaaaaccacttcgaggtcatccatcagctgcgcatcaacaccgacaacagccaccagcgttacgatgtcatcctgctcatcaacggtgtgccctgcgtgcagatcgagctgaaaaccctgggcgtcaatccgcgccgtgccatggagcagatcgtcgaatacaaaaacgatcccggcaacggctacagcaagacgctgctctgcttcatgcagctgttcatcgtcagcaaccgcgaccgcagctactacttcgccaacaacaactcccgccacttcgccttcaatgccgacgagcgctttttgcccatctatgagtttgcagatgaagacaaccgcaaaatcactcaactcgacgagtttgccgagcactttctgaaaaagtgcgacctcggccgcaccatcagccgctacatggtgttgctcgccggcgagcagaagctcatggtcatgcggccctaccaggtctatgccgtacagcacatcatcaagtgcatcgacgaagacaacggtaacggctttatctggcacaccacgggcagtggcaaaacactcacctccttcaaggcatcaaccttgctgaaggaaaacgagcacatccacaagtgtgtgttcgttgtggaccgcaaagacctcgaccgccagacgcgggaggaattcaaccgcttccaggagggttgcgtcgaagaaaacaccaacaccgccgccttggtgcgccgcttgctgtcggaggactacgccgacaaggtcattgtcaccaccatccaaaagttgggcctggcactggacgaaaacagcaagcgcaacaagcagcgcagcaagagcggccaagccacctacaaggaacagctcgaagcgctgcaagataagcgcatcgtcttcatctttgatgaatgtcaccgttcgcagtttggcgacaaccacaaggccatcaaagcatttttcccgaaggcgcagatgttcggtttcaccggcacgccgatatttggtggagaagatggcaacgccactcgcataaaaatcgacggagaggtggcctcatatcagaccaccgaagagctcttccacaagcagctccacgcctataccatcactcacgccatcgaggacggcaacgtcctgcgcttccacgtcgattacttcaagcctgaaggtaaaaaaccgcccaaacccggcgaagccatcgccaagaaagccgtcatcgaggccattctcgccaaacacgatgccgccacggctgggcgccgtttcaatgccatcctcgccaccgcgtccatcaatgacgccatcgagtatcacgccctgttcaagaccatgcaggcggagaaacaggccgctgatcccgattttaagccgctaaacatcgcctgcgtcttctcaccgcccgccgagggcaactccgatgtgaagcagatccaggaagacctgccacaggagcaggcagacaacgaagaagaccccgagggcaagaaagccgcgctcaagaccatcctggccgactacaacacccgctatggcaccaaccaccgcttaagtgagttcgacctctactaccaggatgtgcaaaagcgcatcaaagaccagcagtggccaaacagcgattacccggccacgcagaagatcgacatcaccatcgtggtggacatgctgctcaccggtttcgactccaagttcctgaacacactctacgtggacaagaacctcaagcaccacggcttgatccaggccttctcgcgcaccaaccgcgtgctgaccagcattcagacagatgacaagaaaccgaatggcaccaagccattcggcaacattctcgatttccgtcaacagaaagatgctgtggatgccgccattgccctcttctccggcgagaaatccgaggagaaggcacgggaaatctggctggtggacaaggccccgctggttatccagcggctagagaccgcagtacagaaactggacgatttcatgaaatcccagggcttggcctgcaccccttccgaggtggccaacctgaaaggcgacgccgctcgtgccgccttcgttacccacttcaaagaagtgcagcggctcaaaacccagctcgatcaatacaccgacctcagcgaagacaacaaagccaccatcgagcaggtgctgcctaatgacaacctgcgcggcttcaagggccagtacctggaaaccgccaagcggcttaaagatcagcagaacaaagccagcggcaaggacgactccaccgaagacccgctggaccaactcgacttcgagttcgtcctcttcgcttctgccgttatcgactacgactacatcatgggcctgctcgccaactactcagccaaggagccgggcaaggccaagatgagccgcgaggaactcatcggcgttatcagcgccgacgccaagttcatcaacgagcgcgacgacatcgccgcatacatcgccacactccaggccggcgagggtctctccttggccgccatcgaagagggctatacccgcttcaaggccgagaagaacgccacgcaactcgccgccattgccgccaaacacggtctggacactgccgccttacaaaactttgtcgacagcatcctcgaccgcatgatcttcgacggcgaacagctcagcgacctgatggccccgctagatctcggctggaaagcccgcacccaggcagagcttgccttaatggaagatttgcaccccctactcacccaacgcgccgctggccgcgatatttcaggactcagtgcgtatgagcagtaa

SEQ ID NO: 4314 - DNA, 2391 bp, Chromobacterium substugae
atgagcgaacaagaatacggcgcggacagtatcaaggtgcttaaaggcctggatgcggtgcgcaagcgccccggcatgtacattggcgacacccaggacggcaccggcttgcaccacatggtgtttgaagtgctggacaacgccattgacgaggcgttggccggccatgccgacaccatcaaggtcaccatcaacccggacaactccgtctccgtagaagacaacggccgcggcattcccaccgacatccacccggaagaaggccgctccgccgccgaggtcatcatgaccatcctgcacgccggcggcaaattcgacagcaacagctacaagatttccggcggcctgcacggcgtgggcgtatcggtggtgaacgcgctgtccgactggctgaagctgaagatctggcgcgacggcaaggtgcatgaaatggaattccgccgcggcgacgcggtggccccgctcaccgtcaccggccataccagccaccgcggcaccgaagtcaccttcttcgccagcgtggaaaccttcggccacatcgaattccacttcgacatcctggccaagcgcatccgcgagctgtcgttcctgaaccagggcgtcggcatccagctgatcgacaagcgcagcggcaaggaagaaaacttcgccttctccggcggcgtggccggcttcgtcgaatacatgaaccgcaacaagaacgtgctgcacccgaaaaccttttacggcatcggcgaaaaagacggcatgacggtggaagtggcgatgcaatggaacgactcttaccaagagaacgtccagtgcttcaccaacaacatcccgcagcgcgacggcggcacccacatgaccgcgctgcgccaggtgatgacccgcacgctgaaccagttcatcgaagagagcgaagtggccaaaaaggccaaggtggacaccaccggcgacgacatgcgcgaaggcctgacctgcgtgctgtccgtcaagctgcccgaccccaagttctccagccagaccaaggacaagctggtttccagcgaaatcggcccggtggtcaacgaagtgatcagcgaagcgctgaagacctatctgctggaaaacccgaacgacgccaagatcatctgcggcaagatcgtggaagccgcccgcgcccgcgaagccgcgcgcaaggcccgcgaaatcacccgccgcaaaggcatcatggacggcctgggcctgcccggcaaactggccgactgccaggaaaaagacccgtcgctgtgcgaactgtacctggtggagggtgactccgccggcggctccgccaagcaaggccgcgaccgcaaattccaggccatcctgccgctgaagggcaagatcctgaacgtggaacgcgcccgcttcgacaagatgctgcaaagccaggaagtggccacgctgatcaccgccatgggctgcggcatcggcaaggacgaatacaacccggacaagctgcgctaccaccgcatcatcatcatgaccgacgccgacgtggacggcgcgcacatccgcaccctgctgctcaccttcttctaccgccagatggcggaactggtggagcgcggccacatctacatcgcccagccgccgctgtacaaggctaagcacggcaagcaggaacgctacctgaaggacgactacgagctgaaccagtacctgctacaactggcgctggaaaaagccgagctgatcccggccgaaggcgaagccccgctggccggcgacaccctggccgaaatcgcccgccagttcctgctgacccgcgcggtaatagagcgcgaaagccgcgtgatcgacccgctggtgctggaagccatgctgaagagcggcccgctgtcgctgcaaagccaggctgaagccgccgcctgcgtcgccgcgctgcaagcgctgctgccggccgaaaccatcgacctgcagctgctgcgcgacgaaaagaacgacggccacctggtgaagatcatccgcaagctgcacggcaacgtgctggtgacggtgctggaccaaaacttcctggacagcggcgactacgccgagctgaagaaaaccggcgacctgctgaacaacctgctgcgcgatggcgcccaggtgaagcgcggcgaaaccgtgcgcccggtggcggaatttggcgaagcgctggactggctgctggccgaagtgaaaaagggcatgaacatccagcgctacaaaggcctgggcgagatgaacccggaacagctgtgggaaaccaccatggacccgaccgtgcgccgcctgctgaaggtgcgcatcgaagatgtgatgggcgcggacgacgtgttcaccaccctgatgggcgacgaggtggagccgagacgtcagttcattgaaggaaacgccttgatcgcacgcaacatagatgtttaa

SEQ ID NO: 4315 - DNA, 1110 bp, Chromobacterium substugae
atgctgatcctgcaagccgaacgcgatgccctgctcaagcccctgctggcagtgaccggcattgtcgagcgtcgccacaccctgcccatcctgtccaacgtcctgatcgagaaaaagggcggccaggtgggctttctggctaccgacctggaaatccagatcaccaccgccagcgccgacgaactgccgggcgaagacttccgcctgaccacgtccgccaagaaactgcaggacatcctgcgcgccatccccggcaacgccaccgtcacgctggaacagctggacggcggccgcctcaccctgaaggccggcaagagccgcttcaacctgcagacgctgccggcggaagacttcccgctgctgtcggtgggcaacgccagcgactccagcttcacgctgagccagcgcgagctgaagcgcctgatctcccaggtgcaatacgcgatggcggtgcaggacatccgctactacctgaacggcctgttgatgcagaccgacggcaaccaggtgcgcctggtggccaccgacggccaccgcctggccttcgccagcgccgacgtcgccgccaccctgcccaaggccgaggtgatcctgccgcgcaagaccatcatcgagctgtacaagctgctgcaggacagcgacgacgaaatcaagatcgaagtgctggccaaccaggtgcgcttcagcttcggcgccaccgtgatcatcagcaaggttgtcgacggcaagttccccgactacaaccgcgtgatcccgctggacaacgaaaagattttcctgatcgaacgcctggaattcctgcacgccttgcagcgcgccgccattctggccaacgagaaattccgcggcgtgcgcctggtgctggcgccgggcaagatgtccatcctgtgcaccaacagcgaacaggaagaagcggaagaagagctggaaatcgccttccagggcggcacgctggaaatcggcttcaacatcaattatctgctggatgtgctgaccaacctgccgacagacaccctgcagctggcgtttggcgactccaaccgcagcgcgctgttcaccattccggacgtcagcaacttcaagtacatcgtgatgccgatgcgcatctga

SEQ ID NO: 4316 - DNA, 1401 bp, Chromobacterium substugae
atgaccgaactggatcaattctggcctgcttgcctcgctcgcctggaggccgaactgtcttcgcaacagttcaacacctggatcaaacccctcaccgccgaagccggcgacgagggcgttgcgctgctcgcgcccaaccgcttcatcatgcagttcatcaaggaccgcttcctgggccgcatcgaggaactggcggtggaactgatcggcgaatgcccggtggagctgcgcctgggcgcgccgtcggccaagccgctgcagccggcggccagcagcctgcccaaggccaaggagcccgccaaggccgcggccagcgcgccggcggcgccgtcccccgccaagcaggcggcggtgaaggccatcggcggcagccatgaaagcacgcgcctgaacccttccttcaccttcgacacgctggtgacaggcaagggcaaccagctggcgcgcgcggcggcgatgcagatcgcggaaaacccgggcgaccaggcctacaacccgctgttcgtctacggcggcgtcggcctgggtaaaacccacttgatccaggcgatcggcaaccacgtgttccagaagaacccgcaggccaagatccgctacatccacgccgaacgctatgtggccgacatcatgcgcgcctaccagcacaaggcgtttgacgaattcaagcgctactaccactcgctggacctgttgctgattgacgacatccagttcttcgccggcaaaaaccgcacccaggaagaattcttctatgccttcaatgcgctgatcgagggcggcaagcaggtgatcatgacctgcgacagctaccccaagcagattgaagggatggaagagcggctgatttcgcgcttctcctggggcctgacggtggaaatccagccgccggagctggaaatgcgcgtggccattctgatgaagaaggccgaggccgacagcatcaagctggagcacaacgtcgccttcttcatcgcccagaacgtgcgctccaacgtgcgcgagctggaaggcgcgctgaagcgcgtggtggcctacgcccgcttcaccaaccaaaacatcacgctggagctggtgaaggaagcgctgaaggacattctggccgccggcaaccgccaggtgacggtggacgccatccagaagacggtggccgagtactacaagatcaagctgtccgacatgcacagcaagaagcgcagccgcgacatcgcccggccgcgccaggtggcgatggcgctggccaaggagctgacccagctgtcgctgcccaatatcggcgacgcgttcggcggccgcgaccacaccacggtgctgcacgcctgcaaaaccatcaatgaaatgcgcgccaacgacgccgacatcgcccacgactacgacacgctgctggccatgctgcgcaactga

SEQ ID NO: 4317 - DNA, 225 bp, Chromobacterium substugae
ttgatccagttcggtcattacatacacgcaagtgaaagcgaaaaacccgctgccggcgcaaggcttgcaacagcgggagaggccgcctgcgacctttatagagcaaggcggcgcaggcggcgggtgttcggcatggaagcggccggcaggctgcggtggtttggacgcggcgggttgtgggccctgggtgcgttcatttgttgtgcagccggacggcaacgataa

SEQ ID NO: 4318 - DNA, 135 bp, Chromobacterium substugae
atgaaacgtacttaccagccttccaatacccgtcgcaaacgcactcacggcttcctggtccgcatgaagacccgcggtggccgcgccgtcatcgccgctcgccgctccaagggccgcaagaagctggccgtataa

SEQ ID NO: 4319 - DNA, 366 bp, Chromobacterium substugae
ttgtcggcttaccgctttcgccgtgcgcaccggctgttaaaaacggatgatttttcatccgtttttagtttgcggcaacaacgcagcaatgcgttcttccaggtgtatgtccgccccaacgggcttgaccatccccgcgtagggctggtggtcggcaaaaaggtggccaagcgggcggtgcgccgcaattacatcaagcgctgcgtgcgcgagtggttccgcctgcatcggcaagagctgggcggcgtggactacgtggtgcgggccaagctggcattcacccgagagcaacgcggcgaagctgtcacagctttgtcggctctgtttgctaaactggcacgatgtcacgcatcctcatcctcctga

SEQ ID NO: 4320 - DNA, 210 bp, Chromobacterium substugae
atgtcacgcatcctcatcctcctgatccgcttttaccagctggctatcagcccgtggctgccgccgcgctgccgctatcagcccacctgttccagctatgcgatcgaggcggtgaggaaacatggcgcactcaagggcggctggctcgccgccagacgcatcggacgttgccacccctggggcggcagcggctatgacccggttccctga

SEQ ID NO: 4321 - DNA, 1593 bp, Chromobacterium substugae
gtgggcattctgtttggctggaatgaatatttcatgcccaagcacagccagcagcaggcggcacagacccaggccgccgcgggcgcgagcaatgcgcagcagccggccgacgtcaacaagctgacccgcggccagcgcatccacgtcaagaccgatctggtcgaggctgaaatcgacaccgtcggcggcgatctgcgctcgctgcagctgctgaagcacgccgccgcagaagaacacggcaagccgttccagctgttcgaggacgacgccaagcgcacctacgtggcgcaaaccggcctggtggcagccagcaacccggcgctgcccacccacaaaaccgttttcaccgccgcccagtccagctaccagctgaccggcgacaagctggaagtgaagctgactgcgccggacgccaacggcgtcaaggtgagcaaggtctacaccttcagcaagggcagctacgagatcggcgtccgctacgacatcgtcaacggcggctccgccccggtcgcgcccaccgcctactaccgcctgctgcgcgacagccaggcgccggaaggcgaaggccgcatggcccacacctacaccggcccggccgtgtacacctccgagcacaagttccagaaggtgagcttcgacgacctggccaagggcaagggcgactacgccaagaccaccaccgacggctgggtggcgatggtgcagcactacttcatgtccgcctggatcctgaagccgctggacgccgcctcggtgtgcaaggacgacaagtcctgccgcttcgagctgaagcagagcaacggcctgaactccgccgccgcgctggttgactacgccaccatcgccccgggcaagagcctgagcgtgagcgtgccgctgtacgccggtccggaagagtacagcatcatctccaagctggccgacggcatggaatacgccaaggacttcggcatcttctacatcttctcctcgccgctgttctggctgctggtgaagctgcacgcgctggtgaacaactggggctgggcgatcatcctgctgacgctgaccatcaaggcggtgttctacccgctgaccgcggcgtcctaccgttcgatggccaagatgaaggcgctggcgccgcgtctggagcggatgaaggaacaatacggcgacgaccgcatgaagttccagcaggcggtgatggagatgtacaagaccgagaaggtcaacccgctgggcggctgcctgccgatgctgatccagattccggtgttcatcggcctctattgggcgctgctggcctcggtagagctgcgcggcgcgccgtgggtgctgtggtacaccgacctggcccgcccggacccgtacttcgtgctgccggtgctgatgaccgccaccatgttcctgcagaccttcctgaacccgccgccggccgacccgatgcaggcgaagatgatgaagatcatgccgctggccttctcggcgctgttcttcttcttcccggccggcctggtgctgtactacgtggtcaacaacgtgctgtcgatgagccagcagtggtacatcaaccgcaacatcaacaagcagaacaaggccgcgctgcaatcgtaa

SEQ ID NO: 4322 - DNA, 333 bp, Chromobacterium substugae
atggcttggccgcgatttatctgcctgctgctggctggcggtggaagctgcctgcatcgctccggccctctcccccagagagagcgggcgcccgctcatgcgttctggcgcagacatcgcgacgcattcactgcttccattatcccgcaattccagcgcttcgaagcggctttcgctgcgaatggatcctggcaagccgaagtccggcctcttgattatgagcgagagggggccggcggcccggccagcaaaaaacccggcctggggccgggttcggtcagcagtccagactcagcgcttacgattgcagcgcggccttgttctgcttgttga

SEQ ID NO: 4323 - DNA, 1422 bp, Chromobacterium substugae
atgcaggcagcttccaccgccagccagcagcaggcagataaatcgcggccaagccatcaaggaatgtcgatgaacctcagttacacccccgccaccatctgcgcggtcgccaccgctccgggccgcggcggcgtcggcgtgatccgcgtctccggcaaggacctgctgccgttcgcgcaggccatttccggcggcaagtcgcccaagccgcgctatgccacctacaccgactttttcgatgcccacggccaggccatcgacaacggcctgctgctgtacttcccggggccgaacagcttcaccggcgaagacgtgctggagctgcagggccacggcgggccggtggtgatgaagatgctgctggcgcgctgcgtggagctgggcgcgcgcctggccgaaccgggtgaattcaccaagcgggccttcctgaacgacaagctcgatctggcgcaggcggaaagcgtggccgacctgatcgacgccagcagcgaaaccgccgccaggagcgcgctcaaatcgctgaagggcgcgttttccaaagagatccacgtgctggtggacgaactgatcaccctgcgcatgctggtggaagccacgctggacttcccggaagaggaaatcgactttctcaagcaggccgacgcgctgggcaagctcatgcggttgcgcgaccggctggtgcaggtgcaggccaccgccaagcagggcgccatcctgcgcgagggcatgcacgtggtgctggtgggccagcccaatgtcggcaagtccagcctgatgaacgcgctggccggcgacgacatcgccatcgtcaccgatatcgccggcaccacccgcgacaccgtgcgcgaggaaatcgtcatcgacggcgtgccggtgcacatcatcgacaccgccggcctgcgcgacaccgacgacgtggtggagaagataggcatcgagcgcacctggcaggcggtggagcgcgccgatctggccctgctgctggtggacagccgcgaaggcctgaccgccgaggtgcaggccatcctggagcggctgccgccggcgctgcccagggtgcaggtcttcaacaaggtggacctgtctggcgaagcggcgggcctgtcggtggaaaacggccacccgctggtgcggctgtcggcccgcacccaccagggcgtggacgtgctgaaggccaagctgctggagatgataggctacagcggcgccgacgagggcgtgttcctggcgcgccagcgccacctggatgcgatcgcccgcgccgccgagcacctggagctggctcacgccgattgggaacaggtggagatcttcgccgaggaattgcggatggcgcagaacgcgctgtccgagatcaccggcgaattcagcgccgacgacctgctgggcgtgatcttctcccgcttctgcatcggcaagtaa

SEQ ID NO: 4324 - DNA, 495 bp, Chromobacterium substugae
atgttgcgcagatggctgggggtgttattcggcattttgatggcaagcggcgcggcgctggcggcggaagacccggtgatactgaccgtttccggccagatcgggaaatggacgaataataaaagccggacatacgaattccgcgaaagcgacttgcaggctttgtcgcagcacgccatcaccacccgcaccagctggacgccggaggcggttttttccgggccgctgatgcgggatatcctgcgccgcgtcgaagccaggggcgggcaggtgaaattcgtcgccttgaacgattacgcctatacggtgagccgcgacgaactggaaaaatacaatgtgattctggcccgttcgttcaatcacaagccgatggcgatcaaggagcgcgggccgctgtggctgatgtatccgctgccggacatgccggcggaggaaaggggaccgctgctggatgcgaaattgatctggcaggtgtatcggatcacggtttattga

SEQ ID NO: 4325 - DNA, 1755 bp, Chromobacterium substugae
atgaatatggcagatggcgaaagcagtgcgagcaagcagccgtcctggctgctctggggtttgtccccgatattctggctggttgtcctgctggtctccatcagcatgtatatcgcggtggaccgttacgccgcgatcaagaaattcgatggccgcagcgaggacctgtattggtcggtggcgcagctgcagatcgcgctggagcgctcgcgcgccgagctggtgcggctgaaggccggcgaaatcagcccggagcaggcagacatccggctggagatcgccaaaagccgctatcaggactatgtcacgccgtcgaccctgcacggcatgctgaacgcggtgccgggcttccgcgaaaccgccgacatgctgggcaatttcttccgcgacggcaatatcggccatctgagccgggattcggcgcagcggcatatcgaccagatcgacgacattcggccgcggctggccgagttcgcggtgcagtcgcggatgtcggaagtgtcgttccgcgatgagcgcaacaaggatctggaacgcaagcggctggtgttttcgttgtggttcgcgttgtggggcggcatcgtcatcgtcatctgggtgctgctgtcgagctaccgccgggcgcgccgcgacgtggcttcgcgccaggcgctgctggagaaggaaagggcggcgcacaaggccacggtgtcggccgagctggaccgcaccacctttctcgccaccatcagccacgaaatccgctcgccgctgcagaccatgcaagtgtgcgtcgagctgatggagctggatgtgcagcccggcaatcgcatccacgccaacctgatgcggctgaaggccagcatgagccatctgctgagccaggtgcgcgacatcatggacatttccgccatcaacaatatgcagctcaggctgcatcccgaggacgtcagcctggcaggcatcctgaccgaggtggtggacgcctaccgggtgcagctggaaggcaaggggctgcggctgcatttcgcgatggccaatctgccggagaccgccaccctggacggcaaccggctgcggcaggtcgtcggcaacctgctggccaacgccatccgctataccgatcacggcgaggtgtcggtgacggcccgggtggacggggtgcgcggattccatcatctggaaatccgggtgcgcgataccggggtgggcatccccgccgactaccagtcgcggattttccagcccttcttccagggcaagcagcgccggccgggcagcagcggcctggggctggccatcgtcaaggagctggtcagcctgctggggggcgagatcgagctgaacagcgaggagggccgcggctcggagttcatcgtcaggctgccggtgcgcatccagccggaagagggtggccatgagcgttcggtgctgctggtggacgacgaccagaacatccgcgagcctttcgccgactgcctgagcctggacggctacgcggtggtgatggccagttcggtggccgaggcctgccagcaggtgcagcagcggccgttcgacgccatcctgctggacatgcagctgggcaacgaaagcggctacagcgtgctggagttcatccggaaaagccgcaacaaccagcaggccagcatcatcgccatgaccgcctacccggaagaatacgccgacccccgctccgcctgtttcgccgagcggctggaaaagcctttcgacttcaaccgcttgcgcgcggtgctgaagcggcagatgtcctag

SEQ ID NO: 4326 - DNA, 1140 bp, Chromobacterium substugae
atgcgactcgatcccgacatctgctaccgcgcgctggccagccgcgacgcccgcttcgacggccgcttcttcatcggcgtgcgcaccaccggcatctactgccggccgatctgcccggcgcgcaccgccaagcgcgagaacgtggacttttatcccacggcggcggcggcgcaggaagccggcctgcggccctgcctgcgttgccggccggaagccgcgcccgactccggcgcctggcgcggcgtgtccaacagcggccacagccataccgtggcgcgcgcgctggcctggatcgagcgcggcatgctggacgaggccagcctggccgaactgtgcgacaagctgggcgtgggcgagcggcaactgcgccggctgttcgccgaacacgtcggcgcgccgccgctggcggtggcgcaaacgcggcgggtgctgctggccaagcagctgatccacgaaacgcggatgccgctgaccgacatcgccttcgccgccggcttcggcagcgtacgccgcttcaacgaggtattccaggcgctgtaccggcggccccccggcgcgttgcgccgcgacgccggcgccgcgccggccgcgcccggcgagatcaccctgctgctgcgctaccggccgccctaccactggccggccatgctgctgcacctggccgcccacgccattcccggcgtggaaaccgtgcaggacgacggctatgcgcggaccatcgcgtggaacggcgcccgcggcgaactggcggtgcgtcccggcgcgggccacgcgctgagcgtcaccatccgcttcccgcaactggcggcgctgccggccatcctggcgcgggtgcgggcgatgttcgatctggcggccgaccccgccatgattgagcggcacctatcccaggatccgcgattggcgggcctgatcgccgcgcggcccggcctgcggctgcccggccgctgggacgcgccggacgccgccgcggattcggcgcaagccgagccggatgcctacccggccgttcgccaacgcttgctggaggatttaggcctgagcgccgccgagcgggaacggctgcacaggcgcgccgaagcctggcagccatggcgcgcctatgcgattcagcatttgtggacggaaagacacgcctag

SEQ ID NO: 4327 - DNA, 837 bp, Chromobacterium substugae
atggccgcagacattcagcagtttcatcatttccgccaattgaaccgccagggccgcctgttgctgcccaatgcctgggattgcgccagcgcccggctgttcgccgccgccggcttgccggccatcgccaccaccagcggcggcatcgcttacgcccgcggttgccacgatgcccagcacctaggccgcgaggcgatgctgcgcgagatcgccgccatcgcgcagagcgtcgatctgccgctcagcgccgacatcgaggccggctacggcctggcgccggaggacgtcgcgctgacagtgcagggcgcgcttgccgccggcgcggtgggggtgaatctggaggacaacggccatggcctgctggcgcagcccttgttcgacatcgccgcgcaatcggcgcgcctcgccgccgcgcgccgggcggcggagcaggccggcctgcccttgtggatcaatgcccgcgtcgatgtctggctgctgggcctgggcggagatgaggaggcgcgcctggctcagaccgtggcgcgcggcaatgcctacctggcggccggcgcggacatggtgtttgtgccggggctggccgacgcggcgttggcggcgcgcttggcggcggccttgaacgggccgctcaatctgatggcgctgcccggggtggcgggggccgaggcctggtttgccgccggggcgagccgggtcagcctgggcgtggggccgatgctggccagcatggggctggtgcgcgagatggcgcgcgaggccgcccagggcgtctggccgagcatggctgcgcacttttacggcttcgccgaggcggaagccttgttcgccgccggctga

SEQ ID NO: 4328 - DNA, 774 bp, Chromobacterium substugae
atgagctggctgcgccgccgcgccgcgctgatcctggccagcctggcgctggccggcctgctgctggcgctgccgcgcagcgccgcgctgttccgcctcgccttcccggaactggagcggccgctatacctgcaggacgacttcgccgcgctgaccttgtcccatcttggcatcgtcgcgctgtccagcgcgctcgcgctgctgctgggcggcggcgccgggctgtggaccagccgccccgccgggcgtgaattccgcccgctgctggaatcgctgttgtccctcgcccaatcgctgccgccggtggcggtgctggcggcgacggtgcccttgctgggcttcggcgcgctgccggcgctggcggcgctgacgctgtacagcctgctgccgatcgcccacgccaccctggccggcctggcctcggtgccgccggacatgcgcgaagtcgccgccggcatcggcatgagccggcggcagatcctgctgcgggtcgagctgccgctggccgcgccggtgatcctggccggcgtacgcaccgcggtggtgatcaatgtcggcaccgcggcgctggcctccaccgtcggcgccaaaaccctgggcctgcccatcatcgtcggcctgtccggcttcaacaccgcctacgtgatccagggcgcgctgccggtggcgctgctggcgatagtcgtcgaccagctgttccaatggctggacgatgccgtcgcgccgcagcgtcagccggcggcgaacaaggcttccgcctcggcgaagccgtaa

SEQ ID NO: 4329 - DNA, 933 bp, Chromobacterium substugae
atgattgaaatcgctggcgtcaacaaaagcttcaatggctcgcgcgtggtggccgacctcgacctgacagtggccgagggcgaactggcggtgctggtgggcacctccggctccggcaagtccaccacgctgaaaatgctcaatcggctgatcgaacccgacagcggcagcatccgcgtcgccggccgcgacatccgcagccagccgccggaaatcctgcgccgccacatcggctacgccatccagtcggtaggcttgttcccgcactggacggtggcgcagaacgtcgccgcggtgccgcagctgctcaaatggccgccggcgcgcatccgcgcccgggtggaagaactgctggacgcgctgcggctgccggcgcgggagttcggcccgcgctatccgcaccagctgtccggcggccagcagcagcgcgtcggcgtggcgcgcgcgctggccgccgaccccgacgtgctgctgatggacgagccgttcggcgcgctggacccggtgacgcgcgccaatctgcagcaggagctggcgcgcatccagcggctgttcggcaaaaccgtgatcctggtcacccacgacatcgacgaggcgctgctgctgggccagcgcatcgtggtgatggaccagggccgcatcgtccagcagggcggcgcgcgcgacatcctgctgcgcccggccaccgactttgtccgccaattcttcaacccggccgatgtcggcgtgcgcctgctgggcctggtgcgggtgggagagcggatgcggccgggcgagcgcgccgacggcgcggccatccgcgccgacagcactctgcgcgaggcgctgtcggccttcgtcgcccagggcgccgcggcgctgccggtggaggatggccagggcgccaggataggcgcgctgcgtttcgacgacctgctgggcccgcgcgcatga

SEQ ID NO: 4330 - DNA, 1146 bp, Chromobacterium substugae
atgcggctgcgcaaccgggttggcctgctgctggccctgctgctggcggcgggtttctgctgcccgctgctcagctatgcccccaaccggctgctgagcggccagggcctgtacctggccagcctgcccggcgccgaggccgccctgttgctggcggccgcgttgccgctggcgctggcgccctggctgcgccgctcggctggcagccagctgttgctggcgctgtgcgcctgcctgctgggcaatggcctgctgtgggtggccggccgcgaggcgctgcgcctcgccgccggcgaagacgcgctggcccgcgtcgccttcggcgccggcttctggctgctgcaactggccgccggcctgcagctggccgaagcgctgcgcggcctgtcgccatcaccggcgcggcgcgcgctgatggtctgcgccgcctgcctgccggcgctggccatgctgctgggcggcgcgctggaccaactggcgctgctgcgcgaataccgcaactaccaggacagcttccacctggcgctgctgcgccacctgcaactggtgtgcttctcggtgctgccggcggcgctgctgggcggcgcgctgggcctggccgcgtttcgccgcccgcgggtggaagcctggctgttcccggcgctgaacgcgctgcagacggtgccgtccatcgccctgttcgcgctgttgatcgcgccgctggcctggctgggccggctgtggcctcagtccggcatcgccggggtcggcctggccccggcgctgaccgcgctgacgctgtactcgctgctgccgatggcgcacggcaccctggccgcgctgcgccaggtgccgacggcggcccgcgacagcgcgcgcggcatcggcatgtcgccatggcagctgctggcgcgggtggagctgccgctggcgctgccggtgtttctcagcggcctgcgcgtcaccaccgtgcaggcggtggggctggcggcggtggcggcgctgatcggcgccggcggcttcggcgccatcctgttccagggcctgtccgccagcgcgccggaccagacgctgctgggcgtgctgcccatcgcgctgctggctgccgcgtgcgacgccgcgttcaagatcgtcatctcccggatggaccacgctgcccatgattga

SEQ ID NO: 4331 - DNA, 930 bp, Chromobacterium substugae
atgccgcgccccgttttccgccttgccccgctggccgcgcttgccgccggcctgctgctgtccgccgccgccgccggcgccgccgacgccatccgcgtcggctccaagatagacaccgagggcgcgctgctgggcaacctcatccagcaggtgctcgaggctcacggcgtcaaaaccgccaatcggctgtcgctgggcaataccaaggtagtgcgcgccgccatcgccgccggcgaaatcgacatctaccccgaatacaccggtaacggcgcctttttcttcgccgacgagaaaaacccggcctggaaatccgccgccgccggctaccagcgcgtcaagcagctggactacgacaagaaccgcatcgtctggctggcgccggcgcctgccaacaacacctggaccatcgcggtgcgccgcgacctggccgccgccaaccatctggcctcgctggcagacctccagcgctggctggccaagggcggccgcttcaagctggcggcctcggccgaattcatcgagcggcccgacgcgctgccggccttccaacaggcctacggcttcaagctgcgtcaggaccagctgctgacgctggccggcggcgacacctccgccaccatcaaagccgccgccgagcaaacctccggcgtcaacgccgcgatggcctacggcaccgacggccctctggccgcgcttggcctgacgacgctgagcgaccccaagggcgtgcagccggtatacgcgccggcggccatcatccgcgccgacgcgctggcgcgccagccgcagatcgccgtctggctcaagccggtgttccagtcgctggatgaggccacgctgcagaagctcaacgccagcatcgcccttgagggccgcgacgcgcgcaaggtggcggccgactacctgaagcgcaaaggcttcatccgatga

SEQ ID NO: 4332 - DNA, 243 bp, Chromobacterium substugae
gtgctgcgctgcgcgggcggcgcgctctacaccggcgtcagcaccgacgtggcgcgccgctaccgccagcaccaggccggcaagggcgcgcgctacacccgcctcaacccgcccagcgccatcgcgctggtgatcgaatacccggaccgttccaccgcgctgaaggccgaatacgcgttcaagcagctctccgccgccgccaagcgcgacttcctggcgcgccacggcgacgccgcgggctaa

SEQ ID NO: 4333 - DNA, 1581 bp, Chromobacterium substugae
atggacttatcgtggctgtccgaccccgccgcctggctgggcctcttgacgctgatcattctcgagatcgtgctcggcatcgacaacctgattttcgtggccatcctggccgaaaaactgcccccggaacaacgcgaccgcgcccgcatcaccggcctgtcgctggcgctgctgatgcgcctcgtcctgctggccagcatttcctggctggtcaccctcaccaccccgctgttctcgatctggggccagggcttcgccggccgcgacctgatcatgctgggcggcggcgtgttcctgctgttcaaggcaaccaccgagctgcatgagcggctggaaggcgtggacgaagtgaaggccagcggccagcgcgcctacgccgccttcgccaccgtcgtcgcccagatcctggtgctggacgcggtgttctcgatcgactcggtggtgaccgccatcggcatgtccgaacacctgccggtgatgatgctggccgtgatcatcgccatgatcctgatgatcgccgccagcaagccgctgaccgccttcgtcaacgcccacccgaccgtggtgatgctgtgcctgggcttcctcttgatgataggcttcagcctggtggccgacggcttcggcttccacattcccaagggctatctgtacgccgccatcggcttctcggtattgatcgaatcgttcaaccaggtggcgcaggccaaccgcgtccgctacctcaaccgcaaccagagcttccgcgagcgcaccgccaacgcggtgctcagcctgatgggcacccgcctgtcggaagccaagcccgaggccaagcccgaagtcggcccgcagccggtggaggaaaccgccttcggccacaacgaacgcgcgatgatacacagcgtgctgacgctggccgagcggccgatccgcgtgatcgccaccccgcgcgccgacatccaccggctggacctcagccagcctgaagccgcccgccgcaaggcgctgcgcgacagcccctactcgcggctggtggtgatacgcgacggcagcatagacgagccactgggcatcgtcgcgcgcaaggacctgctggcgcagctcctggatggcggccagctcgacatcgacgccgcgctgcgccagccgctggtgctgccggaaaccgtcaccgtgctgaaggcgctggagagcttccgccagcacgccgccgacatggccttcgtggtcaacgagttcggcagcctggaaggcatagtcacccagaaagacctcatggaggcgatcgccggcgaattcccggaagagcacgaacgccacgagctgccggccatcgtggccaatgccgacggcagctacgacgtggagggcagcctggaattgatgacgctggagcaatacctgacgctaggcgacttcgaggacgaagacttccacaccgtggccggcctgttgatggactgcctggagcgcatcccgcgcgaaggcgacgaggtgacggtgggcgaatggaagctgcgcgtcaccgcgcagaaaggcaaccgcaccgagcgggtgctgatcagcccgatcgccgacggcttcgatgccgccatctga

SEQ ID NO: 4334 - DNA, 1146 bp, Chromobacterium substugae
atggaactggcaacttcttcctttgcacgcacgccgctgtggaagcggctctcgctgtgggacggcgcctacgcgctgctgatcctgctggccgccggttacagcttccggctgtatcaccaggacatggacgtctacgagcagggcatcctggccggatcggcgctgggcctgatcgcgctgggctggttctggcaatcctggcgctggttcttcccgctggccggcggcgccgccttgctcggcatcgccgactaccagcacgatctggcccgcggccagaccgcgttctggctgaagttcgcgctggccagccagtcggccatcatgtggatgtgcacgctgttcttcctggccaccgccgtctactggctgggggtggcgcggcgctccgacctgctgctgcgcatggggcgcggcctgacttgggcggcggcggcgatgggcttggccggcctgttcgtgcgctggtacgagagctatctgatcgcgccggacgtcggccacatcccggtgtccaacctgtacgaagtgatggtgctgttctgtctgatcaccgcgctgatgcacctctactacgaggcgcgcttcgccgcgcgccaggccggcgcgctggtgctgccggtgatctgcgccaccgtcggcttcatcctgtggtacagcctggaccgccaggcccacgagatccagccgctgataccggcgctgcagtcgtggtggatgaagatacacgtgccggccaacttcgtcggctatggctccttcgcgctggcggcgatgctgggcgtgggcgagctgctggtgctgaagggctggctgaaggacaggctgcccagcgccgaggtgctggacgagatgatgtacaaggccatttccgtcggcttcctgttcttcaccatcgccaccatcctgggcgcgatgtgggcggcggacgcctggggcggctactggagctgggacccgaaggaaacctgggcgctgatcgtctggctcaactacgccgcctggctgcacatccgcctggtgaagggctggcgcggcgcgccgctggcctggtggtcggtcggcggcctgctggtcaccaccttcgccttcctcggcgtcaatatgttcctgtccggcctgcactcgtacggcggcctgtaa
